United States Patent 9,782,462 (MODIFIED POLYNUCLEOTIDES FOR THE PRODUCTION OF PROTEINS ASSOCIATED WITH HUMAN DISEASE) - sequence listing, part 104

SEQ ID NO: 203006 - DNA, 1377 bp, Artificial Sequence
  Description of Artificial Sequence: Synthetic coding sequence
atggccaaggccaccagcggcgccgccggcctgcggctgctgctgttgctcctactcccattactgggcaaggtcgccttgggattatatttttcacgggacgcctactgggaaaagctctacgttgatcaggctgcgggaacaccattactgtatgtgcacgccttaagagatgcccccgaggaggtgcctagtttccggctgggtcagcacttgtatgggacctatcgaaccaggcttcatgaaaataattggatctgtatccaggaggacacagggctcttgtacctgaatcgcagcttggaccattcttcctgggagaagctgagcgtgcggaaccggggcttccctctcctcaccgtttatttgaaagttttcttgtcccctacgagcctgcgcgagggtgagtgccagtggcctggttgcgcccgcgtttactttagttttttcaataccagcttccccgcatgctcctccctgaaaccccgggaactgtgtttccctgaaacacgcccctccttcagaatcagggagaacaggccacctggcacttttcatcaattccgcttgttacctgtacagttcttgtgtccaaacatctccgtggcctaccggctgttggagggtgaggggcttcccttccggtgcgctcctgacagtctggaggtctcgaccagatgggctctggaccgcgagcagagagagaaatatgaacttgtcgccgtctgtactgttcacgctggagcgagagaggaggtcgttatggttcctttccctgtgaccgtatatgacgaggacgatagcgctcctacctttcctgcaggcgtggacaccgctagtgccgtcgtcgaatttaagcgcaaagaagatacagtggtggccacgctgcgggttttcgacgccgatgtcgtgccagcatccggcgagctggtgcgacggtacacttcaactctactgccaggtgacacctgggcgcagcagaccttccgcgttgagcactggcccaatgagacctccgtgcaggccaatggatcctttgtgcgggcaaccgtgcatgactatcgactggtcctgaataggaacctttcgatttcagagaatagaaccatgcagttagccgtgctggtaaacgactcggacttccaaggtcctggcgccggcgttcttctgctgcattttaacgtgtcggtgctgccagtttccctgcacctgccttccacgtatagcttgtctgtgagccgccgggcacgccgcttcgcacagattggaaaagtctgtgtggagaactgcctggctgacctcacaggagacgctgtgagtggtagagacgaggctcgttcatctggcctgggtagtcaaaaacaccccggctcgtag

SEQ ID NO: 203007 - DNA, 786 bp, Artificial Sequence
  Description of Artificial Sequence: Synthetic coding sequence
atggacgaggccctggagacccagctgaagaccagccggggccggttcagcgctacagagagtctgccaacattggagttactgagtcaggttgatatggattgtcgtgtacacatgcggcctatcgggctcacttgggttctacagctgacccttgcctggattcttctggaggcttgcggtgggtctcggcctctgcaggcacggtcacagcaacaccatggccttgctgccgaccttggtaagggtaaattgcacctggcgggcccctgttgccccagtgaaatggacaccaccgaaacttcaggcccaggcaaccaccccgagagatgcggagtaccaagtcctgaatgcgagtctttccttgaacacctacagcgggcgctacggagtagatttcgtcttaggctgttgggagttcgtcaggctcagcccctttgcgaagagttgtgtcaggcgtggttcgccaactgtgaagacgacattacatgcggacccacgtggctgcctctgtccgagaagcgtgggtgtgagcccagctgtttaacttacggtcaaacattcgcagatggaaccgacctttgccgaagcgctctggggcatgctctacctgtggctgccccaggggctagacattgtttcaacattagtatctctgcagtcccacgcccccggccaggacggcgtggccgtgaggctccatctcgacgatcacgctctccccggaccagcattcttgatgccgcaggcagcggctctgggtccggtagcggtagtggcccttag

SEQ ID NO: 203008 - DNA, 675 bp, Artificial Sequence
  Description of Artificial Sequence: Synthetic coding sequence
atgggctggcagctgatctgggccaaggccagctgcacctggcaggatttggtggttcctcagcggtggacccaacagcggcatagggcgctcgaaacaatccagaatgcagtggagtgcagggccctgaacgccaatccgtcttggaataccagtaacgtgcccttcgccgtggcctccgcctgcggctattgggggtatgccaggcatagccgttctgctaggtccagtgccagacccggatcaccaacagccaaaatgattagtccggccgccaggctgggctcgcatagtcagaagaagggcgccgtgagcccggccgcacttcctatggaccgtctcgagtgttctggtgctatttccgcccggtgtaatcttcgacttcggggttcttcggactctccagcagcgaccagtaggattgccggcatatctggggcttgccatcatgcccagctgatatttgtgtttctcgtggagagcgctttccatcatgtgggccaggccgggtttgagctgctcactagcggcgatcctccaactagcgcaagtcagagtgtgggcattacaggggtttcacaccgccctcggccaccacccagttcatttctgccctgtctcgaccctagagaccgcatcggtacaccccaggtccctgctccaaccctaccgtag

SEQ ID NO: 203009 - DNA, 690 bp, Artificial Sequence
  Description of Artificial Sequence: Synthetic coding sequence
atggactgccgggtgcacatgcggcccatcggcctgacctgggtgctgcagctcaccctggcttggatactgctggaagcctgtggcggcagccggcctcttcaagccaggagtcagcagcatcacggtctcgctgccgatctaggaaagggcaagctgcatctcgcaggaccttgctgcccttcagaaatggacactaccgagacctccggccctgggaaccatcccgaaaggtgtggagtaccaagccccgaatgtgaatccttcctggagcacctgcaaagagcgctgagatcaagattccgactgcgtcttcttggtgtgaggcaggcacaaccactctgcgaagaactgtgccaggcctggttcgccaactgtgaagatgatatcacatgtggccccacttggcttccgcttagtgaaaaaagaggctgcgaaccaagttgcttgacttatgggcagacatttgccgatggcacggatctgtgccggagtgccctgggccacgccctccccgtggccgcccctggcgctaggcattgtttcaatatttccatctcagccgtccctagacctcggccaggcaggagaggccgagaagctccctctcgccgaagccgatcccccaggacatcgattcttgacgccgctgggtcaggttccggctcaggtagtggttcagggccatag

SEQ ID NO: 203010 - DNA, 618 bp, Artificial Sequence
  Description of Artificial Sequence: Synthetic coding sequence
atggacgaggccctggagacccagctgaagaccagccggggccggttcagtgccactgaatcattgcctactctcgagctgctgtcccaggttgacatggattgccgggtgcacatgcgccctatcggcctgacctgggtgttgcagttaaccctagcgtggatactccttgaggcctgtggtggttcccgacctttgcaggcaagaagtcaacagcaccacggcctagcagctgacttagggaagggtaaactgcaccttgcaggtccctgttgtccaagcgaaatggataccacagagacatctggcccaggcaatcatcctgagcgttgcggcgttccaagccctgaatgtgagtcattcttggagcacttgcaacgcgccctgcggtccagatttagattgaggctacttggagtgaggcaggcccagcctttgtgcgaggagctgtgccaagcctggtttgccaattgtgaagacgacatcacttgcgggccaacgtggctaccgctgtctgaaaaaagaggctgtgagccctcatgtctaacttatggccaggccggcgtgcagtggcgggacctgagttctatgcagcctcccccaccaggatttaaatag

SEQ ID NO: 203011 - DNA, 720 bp, Artificial Sequence
  Description of Artificial Sequence: Synthetic coding sequence
atggcccggcagctgctgagccaggtggacatggactgccgggtgcacatgagacccatcggcctcacctgggtgctgcaactgaccctggcgtggattctcttggaagcatgtggcggtagtcgcccacttcaggctagaagccaacaacatcatggcctcgcagctgacctgggcaagggaaaactgcatttggccgggccgtgttgcccatctgagatggacacaactgagacatctgggcccggcaaccaccccgagagatgtggcgtgccctcgccagaatgcgagagttttctggagcacctgcagcgcgctctgcggagtagattccggctcagacttttgggtgtccgccaggcgcagccgctctgtgaggagttgtgccaggcctggtttgcaaactgcgaagacgatatcacttgcggccccacttggctgcccctttccgagaaaagaggctgcgaaccaagctgtctgacatatggccaaacgttcgcagatggcaccgacctgtgtaggtcggctctaggtcatgccttgcctgtggctgctccaggcgccagacattgcttcaacatcagcatatccgccgttccacggcctcggccaggcaggagaggtcgggaagcccccagtagacgcagtcgctctcctagaacgtccatcctggacgctgcaggctccgggtcggggtccggttccgggtctggtccttag

SEQ ID NO: 203012 - DNA, 996 bp, Artificial Sequence
  Description of Artificial Sequence: Synthetic coding sequence
atggcccggggcggccggggccggcggctgggcctggccctgggcttgctccttgccttagtgttggcacctcgcgtcttaagagctaagcctacggttaggaaggaacgggtggtcagacccgatagcgagttgggcgagaggccgccagaagacaatcagagcttccagtacgaccatgaggcttttctgggcaaggaggatagcaagaccttcgatcaactaactccggacgagtctaaagaacgtctgggaaaaatcgtcgatcgcattgacaatgacggagacggttttgtgaccaccgaggaactcaaaacctggattaagagagtgcaaaaacgctatatttttgacaacgtggcgaaagtgtggaaagactacgatcgggataaggacgataaaatttcatgggaggaatataagcaggctacgtacggctattatctcgggaatccagcagagttccacgatagctctgaccaccatacattcaaaaagatgctgcctcgggacgaacgtagattcaaagcagccgatcttaatggagacctgactgccacccgcgaggagttcaccgcatttctgcaccctgaggagttcgaacatatgaaggagatcgtagtacttgagaccctcgaagacatagataaaaatggggacggcttcgtagaccaggacgagtatattgccgacatgttcagccacgaggaaaacgggccagaaccggattgggtgctgtccgagcgggagcagtttaacgagtttagggatctcaacaaggatggaaagttggacaaggatgagatccgtcattggatactgccgcaagactatgaccatgcacaagccgaggccaggcatttagtatacgagtcggataaaaacaaagatgagaagctcaccaaagaagagatactggagaattggaacatgttcgtgggctctcaagccacgaactatggggaagaccttacgaagaatcacgacgaactctag

SEQ ID NO: 203013 - DNA, 87 bp, Artificial Sequence
  Description of Artificial Sequence: Synthetic coding sequence
gagatcctggagaactggaacatgttcgtgggcagccaggccaccaattacggagaggatctcacgaaaaaccacgacgaactctag

SEQ ID NO: 203014 - DNA, 954 bp, Artificial Sequence
  Description of Artificial Sequence: Synthetic coding sequence
atgcggctgggcccccggaccgccgccctgggcctgctgctgctgtgtgccgcagccgccggggccggcaaggccgaagaactccattatccacttggggagcggagatcagactatgaccgggaggcgcttctgggcgtccaagaggacgttgacgaatatgtgaagctcgggcatgaggagcagcagaagcgcctgcaggccatcatcaaaaaaatcgacttggatagcgacggattcctgactgaatccgaattgagtagttggattcagatgtcctttaagcattacgctatgcaagaggctaaacagcagtttgttgagtacgacaaaaatagcgacgacactgtcacctgggatgagtacaacatccagatgtacgacagagtcatcgactttgacgagaatacagccctagatgatgctgaagaagagtccttccgaaagctacatctgaaggataaaaagagattcgaaaaggccaaccaggatagtggccccggactgagcctggaagagttcatagcgtttgagcatcctgaagaagtggattatatgaccgaatttgttattcaagaagcacttgaagaacacgataagaacggggacggattcgtgagtcttgaagagttcctcggagattacagatgggaccccaccgccaatgaggacccagagtggatcctggtcgagaaggacaggtttgtgaacgactacgataaggataacgatggacgactggacccacaggaactgctgccatgggtcgtgcccaataatcagggaattgctcaggaggaagcccttcaccttatcgatgaaatggatcttaatggtgacaagaagcttagcgaagaagaaattctggaaaatccagacctgttcctcacatctgaggccactgactatgggcggcagctgcacgacgactatttttatcacgacgagttgtag

SEQ ID NO: 203015 - DNA, 2331 bp, Artificial Sequence
  Description of Artificial Sequence: Synthetic coding sequence
atggccgcccccggcgacccccaggacgagctgctgcccctggccggccctggcagccagtggctccgccaccgtggcgagggtgagaatgaggccgtgactcctaaaggggccacacctgcgccccaggccggtgaacccagcccggggctgggagctcgcgcgcgcgaagctgcttcacgggaggccggaagcggacccgcccgacagagccccgtggcaatggaaaccgcttctactggggtggctggcgtctcgtctgcaatggaccacacatttagcacaactagcaaagatggcgagggctcctgttatacctccctgattagtgatatctgctaccctcctcaggaagattccacttatttcacaggaattttgcagaaggagaacggccatgtaacaatcagtgagtcccccgaggagctaggcacaccagggccatctttgccagatgttcctggcattgaatcccgcggcttgttcagctctgattccggtatagagatgactccagctgagtccaccgaggtgaacaagatactggctgaccctcttgaccagatgaaagccgaggcttacaagtacatagatattacacggcctgaagaggtgaagcaccaggagcagcatcaccccgaactcgaggataaggacctcgatttcaaaaacaaagataccgacattagtattaaaccagagggagtacgagaacccgataagccagcgcctgtcgagggcaagattatcaaggaccatctgttagaagagtccaccttcgctccctacatcgacgatctgtcagaggagcagcgaagagccccccagatcacaacgcccgtaaaaattacattaacagagatagaaccttctgtggagaccaccactcaggaaaaaacacccgagaaacaggatatttgcctcaagccaagccccgacaccgtccccaccgtcacagtctccgaacctgaagatgattctccaggcagcatcaccccaccttccagcggcacggagccatccgccgccgaaagccagggcaaaggcagtatctcagaagacgaacttattacagccataaaggaggccaagggactgtcttacgagaccgcagaaaatccccgaccggtcggccagctggcagaccgcccagaggtgaaggcgaggtccgggccccccacaattccatcccccctggaccacgaggcaagctccgccgagtctggcgacagtgaaatcgaacttgtttctgaagatcccatggctgcagaggacgccctgccttctggttacgtatctttcggacacgtggggggccccccaccctcgccagctagtccctcaatacagtattccatccttagagaagagcgggaagctgagctggacagtgagctgattattgaaagctgcgatgccagttccgcctcggaagagagtcctaagcgggagcaggactcacccccgatgaagccttcagccctcgacgccatccgggaggagacgggcgtacgggccgaagaacgggctccatctcgccgtggactggctgagccaggaagctttttggactatccttccactgaaccccagcccggtcccgaactcccacctggcgacggagccctggaacccgaaacccccatgttgccacgcaagcctgaggaggattcatcgtccaaccagtcccctgctgccactaaaggcccaggaccccttggcccaggcgcccctcctccattactctttctgaacaagcagaaggccatagacctgctgtattggagagatatcaaacagacggggatcgtcttcggttccttcctactactcctgttctctctgacccagttttctgtggtctccgtcgttgcatacctagccctcgcggctctttccgcaacaatctcctttagaatctataagagcgtgctacaggccgtgcagaagaccgatgaaggccatcccttcaaagcttacctggaactcgaaataacactgtcacaggaacagatccagaagtacactgattgccttcagttttatgttaatagcacacttaaggaactgaggaggctctttcttgtacaagacttggtggacagtctcaagtttgctgtcctgatgtggttattaacttacgtgggcgccctttttaatggtttgacactcctgctgatggcagtggtgtccatgtttaccctgcccgtcgtgtatgtgaaacaccaggcacagatcgaccagtacctgggtttggtgagaacacacatcaatgcggtggtcgcaaaaatccaggcaaaaatccctggggccaagcggcacgcagagtag

SEQ ID NO: 203016 - DNA, 627 bp, Artificial Sequence
  Description of Artificial Sequence: Synthetic coding sequence
atgcaggccaccgccgacagcaccaagatggactgcgtgtggagcaattggaaatcacaagcgattgatctgctctattggcgcgacatcaaacagacaggcatcgtgtttggctcttttctgctcctcctgtttagtttaacccaattctctgtggtctccgtcgtcgcttacctcgccctcgcagccctgtcggccaccatcagcttccgcatttacaagtctgttttgcaggcggtgcagaagaccgacgagggacatcccttcaaagcgtacctggaattggagatcaccctttcccaggaacagattcagaagtataccgattgcctccagttctatgtaaattctactctcaaagagttaaggcggctgttcctcgttcaagatctcgtggattccctgaagtttgccgtgctgatgtggttactcacatacgtgggagctctgtttaacggactgaccttgctactcatggccgtggtttccatgtttaccttgccagtcgtgtatgtgaaacaccaggcccagatcgatcagtatctcggtctggttcgcacccatattaatgcggtagttgccaagattcaggccaaaattcccggggctaagagacacgccgagtag

SEQ ID NO: 203017 - DNA, 1071 bp, Artificial Sequence
  Description of Artificial Sequence: Synthetic coding sequence
atggccgccgaggacgccctgcccagcggctacgtgagcttcggccatgtaggggggccgcccccttctccggcatcccccagtatccagtacagtattctgcgcgaagagcgtgaagcagagctcgattccgagctcattatcgagagttgcgatgcgagcagtgcaagcgaggaatcaccgaagcgggaacaggactcacctccaatgaagccctccgctctggatgccattcgcgaagagaccggagtgcgcgcagaagaaagagctccatcccggagaggtctcgccgagccaggctcgtttctggattatccatccacagagccccagcccggacctgagctgccccccggcgacggcgctttggaacccgaaactcctatgctcccccgaaagcctgaagaggactcaagcagcaaccagtctcctgccgccacaaaaggacccggacccctagggccaggggcccccccaccactgttgttcctcaacaaacagaaggccattgatttactgtactggcgcgacatcaaacaaactggcattgtattcggatcatttctactgctgctgttttcactgacccagttctcagtggtgtccgtggtcgcctaccttgctttagcggccctcagcgccaccatttcgttcaggatctacaagtccgtcttacaggctgtgcaaaagaccgacgagggccacccttttaaagcttacttggaactggagatcaccctctcccaggagcagattcagaagtacaccgattgcctacagttctacgttaactctactctgaaggaattacgtaggcttttcctcgtccaggaccttgtggattccttaaagtttgcagtgctgatgtggctcttgacttatgtgggtgccctgttcaacggattgacactcctcctgatggccgtggtctccatgttcaccctgcccgtcgtgtatgtgaaacaccaagcgcagattgaccaatacctgggcctagtgaggacacacattaacgccgtggtggccaagatccaggctaaaatccccggcgcaaaacgtcatgcagagtag

SEQ ID NO: 203018 - DNA, 2109 bp, Artificial Sequence
  Description of Artificial Sequence: Synthetic coding sequence
atggagaccgccagcaccggcgtggccggcgtgagcagcgccatggaccatacgtttagcacaacctcgaaagacggagagggctcttgctatacaagtttgatcagcgacatctgctaccctcctcaggaggacagcacttactttacaggtatcctccagaaggaaaacgggcacgtaacaatttcggaatctccggaagaattgggaacacctggcccatcactccccgatgtacccggaatcgagagtcggggcttattttcctctgactccggtatagagatgactccagccgagagtactgaagttaacaagatccttgccgatcctctggatcagatgaaggctgaggcttacaagtatatcgacattactcgtcctgaagaagtgaaacatcaggagcagcatcacccagaacttgaggacaaagaccttgactttaagaacaaggatacagatattagcattaagcccgagggtgtgcgggaacctgacaagccagctcccgttgaaggcaagattattaaggatcatctgttggaggagtccacctttgcaccatatatagatgacctttccgaggaacagcgtcgcgcaccccagatcaccaccccagtaaagattaccctgactgaaattgagccgtcggtcgagactactacccaggaaaagacaccggagaagcaagacatttgcctcaagccttcaccagataccgtacctacggtgaccgtgtctgagcccgaagatgatagtcctggctccattacgccaccgagctctgggacagaacctagcgccgccgaatcccaggggaagggatctattagcgaggacgaattaataaccgccattaaggaagccaagggcctctcgtatgagacagctgagaaccctcgacccgtcggtcagctagccgatcggcctgaagtcaaggcgaggtccggcccccctaccatcccctcgccattggaccatgaagcttccagcgctgaaagtggagatagtgagatcgagttggtctcagaggaccccatggccgcggaggatgcactgccatccgggtacgtatctttcggacatgtcggcgggcctcccccgtctcccgcatccccatccatacagtatagcattttgcgcgaggaacgcgaagctgaactcgattctgagctgatcattgaatcatgtgacgcttccagcgcttctgaggagtcgcccaaaagagagcaggactcaccccccatgaaaccaagcgctctcgacgcgatccgggaggagactggcgttagggcagaggaacgggcaccgtcaagaaggggcctagccgagcctgggagctttctggactacccatcaactgaaccacaaccagggccggaacttccaccaggagacggggccctcgagccagaaacacccatgttaccaagaaagccagaggaggactccagcagtaatcagtctcctgctgccacaaaaggccccgggccactcggccccggtgctccacccccgctgctgtttttaaacaaacagaaggcaatcgacctactgtactggcgcgatattaagcagactggcattgttttcgggtcattcttgctccttttgtttagtctcacgcagttcagcgtggtgtccgttgtggcctacttggcactcgccgcactgagcgctactatcagctttagaatctataaatccgtcctgcaagctgtccagaagacagacgaaggccatccctttaaggcgtacttggaacttgaaattactctcagtcaggagcagatacagaagtataccgactgcctgcaattttatgtgaactcaaccctgaaagagctccgcaggctcttcttggtccaggaccttgtcgatagcttgaagttcgccgtcttgatgtggctgcttacatacgtaggagcgctctttaatggcctcactctcctgcttatggcagtggtgtctatgtttacgttgccggtagtgtacgtcaagcaccaagcacaaatcgatcagtatttgggcctcgtgaggacccacatcaatgcagtcgtcgctaagatccaggcaaaaatccctggagccaaaagacatgcagagtag

SEQ ID NO: 203019 - DNA, 1638 bp, Artificial Sequence
  Description of Artificial Sequence: Synthetic coding sequence
atgggccaggtgctgcccgtgttcgcccactgcaaggaggccccctccactgcatccagtacacctgacagtactgaggggggaaatgatgacagcgacttccgggaactgcatactgcccgcgaattttctgaggaagatgaggaggagaccacatcccaggactgggggacccctagggagttaactttctcttacattgcatttgacggagtggtggggtccggcggacgccgggactctaccgcacgccggcctaggccacaaggccgatcagtttccgagccaagagatcaacacccccagccaagtctcggggattctttggagtcaattccctctctctcccagtccccagagccaggcaggagaggggatcctgacaccgctcctccatctgaacggccattagaagatcttcggctccgacttgatcaccttggctgggtcgcgcgaggcacgggaagtggtgaagacagctccacctcgagcagcacacccctcgaagatgaggagccccaagagccaaaccgcttggaaacgggcgaagccggtgaggaactggaccttagacttagactggctcagccatcatcgcctgaggtgctcacacctcagttgtccccaggcagtgggactccccaagctggcaccccctctccgagtcgctcaagggacagcaatagtggaccagaggagcctctcttggaagaagaggagaagcagtggggccctctggagcgggagcccgtacgaggccaatgtctcgactctactgatcagttggagttcaccgtggaaccaaggttgctgggcaccgcaatggaatggctgaaaacctctttactgcttgccgtttacaaaactgtcccaattttggaactgtcgccgcctctgtggacagctatcgggtgggttcagcgtgggccaacccctccgactccagtgctgcgggtactcctgaaatgggcaaagtctcctcgatcaagcggcgttcccagcttatcattgggcgccgatatgggatcgaaggtcgcagacctgctatattggaaagacacccgcactagcggcgtggtgtttactggcctcatggtttccttgctgtgcctactgcatttttccatcgtgagtgttgctgctcatttggccttgctgctgttgtgcggaacaatatctctacgcgtgtaccgaaaggtgctgcaggccgtgcacaggggagacggtgcgaacccatttcaggcttatcttgacgtcgaccttacacttacgagagaacagacagaacggcttagccatcaaattacaagtcgtgttgtgagcgcagccacccagctgcgtcactttttcttagtggaagatctcgtcgattccctgaagcttgcgcttctcttttacattctcaccttcgtcggtgccatatttaatgggcttaccctcctgatcttaggcgtgattgggctcttcaccatcccattactgtaccgccagcaccaggcgcagattgatcagtatgtgggtctggtcaccaaccagcttagccacatcaaggctaagatacgggccaagatccctgggaccggggccctggcaagtgctgccgctgctgtgtctgggtccaaagctaaagcagaatag

SEQ ID NO: 203020 - DNA, 1419 bp, Artificial Sequence
  Description of Artificial Sequence: Synthetic coding sequence
atgggccaggtgctgcccgtgttcgcccactgcaaggaggccccctcgaccgcctcaagcactcctgatagcacagagggaggtaatgatgattcggacttcagggagctacacacagctcgggagttcagcgaggaagacgaggaggagaccacatctcaggattggggcacgcctagggagctgaccttttcgtatatcgcatttgatggcgtggtcggtagcggcgggaggcgggacagtaccgccaggcgccctcgccctcagggaaggtcagtaagtgagccaagagaccaacatccccagccctctctgggtgattctctggaatccattccaagcctgtcacagagtcctgaaccaggtaggagaggcgatcccgataccgccccacctagcgagcggccactggaggatctgagactaaggcttgaccacctcggctgggttgcccggggcacagggagtggcgaggacagctccacctcaagcagcactcctctggaggacgaggagccccaggaaccgaatcgccttgagacaggggaggcaggagaagagctcgacctgagactacgtctggcccagccgtccagtcccgaggtcttgactcctcagctgtcccccgggtccggcactccacaggcaggtacgcctagcccatcacgttcccgggactccaactcagggccggaagagccattgttggaagaggaagagaaacagtgggggcctttggaacgcgagccagtgcgaggccaatgcctggacagcacagatcagctcgagtttaccgtggagccgaggctgctcgtcgccgacttactgtattggaaggatactcgaaccagcggcgtggtgttcacgggcctgatggtatccttgctttgcctgctgcacttttccatcgtttctgtggccgcacacctcgctctgctactgctatgcggcacgatttccctgcgggtgtatcgcaaggtcctccaggccgtacacagaggggatggggccaacccgtttcaagcgtacctcgatgttgatctgacgctcacaagagagcaaacagagagactgtcgcatcaaatcacttcccgagtggtgagcgcggcaacccaacttcggcacttctttctcgtggaggacctggtagacagtttgaagttagctctgctgttttacattctgaccttcgtcggcgccatatttaacggactcaccctgctgatcctgggcgtgatcggcttgttcacgattcctctgctatacaggcagcaccaggcccaaattgaccagtatgtcggcctggtgactaaccagctttcgcatattaaagcaaaaattcgtgctaagatcccaggcacaggggccctggcttccgccgccgcagccgtgagcgggagcaaggcaaaggccgaatag

SEQ ID NO: 203021 - DNA, 618 bp, Artificial Sequence
  Description of Artificial Sequence: Synthetic coding sequence
atgggcagcaaggtggccgacctgctgtactggaaggacacccggactagtggagtagtgttcaccgggttgatggtgtcactgttgtgcttactacacttttccatcgtctccgtggccgctcatttagctctgctgctgctttgcggcacgatctccctccgggtgtacaggaaggtcctgcaggctgtgcacaggggcgatggtgccaacccgtttcaggcttacctagatgtagatctgactttgacacgggaacaaaccgaacggctgagccatcagatcacaagcagggtggtctccgccgcaacccagctgcggcatttcttcctggtcgaggaccttgtggatagcctgaagctggcattgctattttacatactcaccttcgtcggggccatcttcaacgggctcacccttctgatcctgggggtcattggcctgttcactatcccgcttttatacagacaacatcaggcccaaatcgaccagtatgtcggactggtcactaaccagctgtctcatataaaggccaagatacgggctaagatccccggaaccggcgctttggccagcgcagccgccgccgttagtgggagtaaggccaaggcagagtag

SEQ ID NO: 203022 - DNA, 3042 bp, Artificial Sequence
  Description of Artificial Sequence: Synthetic coding sequence
atggccgagcccagcgccgccacccagagccacagcatcagcagcagttcatttggcgccgaaccgagtgcacccggaggcggcggatcgccaggagcctgtcccgcactgggaactaaatcctgcagtagctcatgcgcagaaggtctatccagcctgtgcagtgatgagccctcttccgagattatgaccagttcatttctgagcagctccgagattcacaatacaggcttgactatcctccacggggagaagtcccatgttttgggcagtcagccaattctggccaaagaagggaaagatcacctggacctcctcgatatgaaaaagatggagaaaccacagggtactagcaataacgttagtgacagctcagtgtcccttgctgctggagtgcactgcgatagaccttcaattccagcctcatttcccgagcaccccgcctttctcagcaaaaaaattggccaggtggaggagcagattgacaaggagacaaagaatcctaatggagtctcctctagggaagccaaaaccgccctggatgccgacgatcggttcactctcctgacggcacaaaagccacctaccgaatacagcaaggtcgaaggaatatacacctactcactcagcccctctaaggtgtcgggcgatgacgtgatcgagaaagactccccagagtcaccctttgaagtcatcatcgacaaagctgcatttgataaagaattcaaagatagctataaggagtcaactgatgactttggctcgtggtcagtccacacagataaggagtcatctgaggatataagtgagacgaacgacaagctgttcccccttagaaacaaggaagctggaagatacccaatgtccgccctgcttagtaggcagttctcacacacgaacgcagcactggaagaagtctcacgctgtgtcaatgatatgcacaattttacaaacgagatactgacctgggacctggtgccacaggtgaaacaacagacagacaaaagtagtgactgcataactaaaaccaccggactggatatgtcagaatacaattctgagattcctgtcgtcaacctcaagacatccacccaccagaagaccccggtttgcagcatcgacggctctacccccatcacaaagtctactggagattgggccgaggcttctctacagcaggagaatgcaataactggcaagcctgtcccggattcactcaactcaacgaaggagttctcaattaaaggcgtacaaggaaatatgcagaaacaggacgacaccctagccgagctgccaggctcgcccccggagaagtgcgattccctgggctccggcgttgcaacagtgaaagtagttcttcccgacgaccatctgaaagacgaaatggattggcaatcgtccgctctcggagaaatcacggaagcggactcttccggcgagagtgatgatacggtaatcgaagacatcaccgcagacactagctttgagaacaataaaatccaagccgaaaaaccagtctccattcctagcgctgtggtaaagaccggggagagggaaattaaggaaataccctcatgtgaaagggaagaaaaaacatccaagaactttgaagaactggtaagcgacagtgagctccaccaggaccaaccagacatcctgggtaggagtcccgcgagtgaagctgcctgttcaaaggttccggataccaatgttagccttgaagatgtgtctgaagtggcccctgagaaaccaattacgacagagaacccaaagctcccatccacagtgtctcctaacgtattcaatgaaacggaattctccctgaacgtgaccactagcgcttacctggaatctctgcacggtaagaatgttaagcacatcgacgacagctcacctgaggatttgattgccgcatttaccgagacccgggataagggtattgttgactccgagcgtaatgcgtttaaggcaattagtgagaagatgacagactttaagaccacccctccagtggaagtgctccatgagaatgaatctggcggcagcgaaatcaaagatattggaagcaaatacagcgagcagtccaaggagactaatgggtctgagcccttgggtgtatttcccactcagggaactccagtggccagtctcgaccttgaacaggagcagcttactataaaggctttgaaagagctgggcgagcggcaggtggagaaaagtacttccgctcaaagagatgcggagttacccagtgaggaggtacttaaacagacattcacttttgcccctgagtcgtggcctcaaagaagctacgatattttggaaaggaatgtgaagaacgggtcggatctgggaatctctcagaagccaataactatccgtgaaacaaccagagtcgatgcggtgtcctctctcagcaaaaccgaactcgtcaaaaaacacgtacttgcacggttgctgaccgattttagcgttcacgatctcatattttggcgggatgtcaaaaaaaccgggttcgtctttggtactacactcattatgctgctgtctctcgctgcgttctcagtcatatccgtggtgtcatacttgattttggccctgctgagcgtgacaatctcattcagaatttataaaagcgttatccaggccgtgcagaagtcagaggagggccatccgtttaaagcatacctcgacgttgatatcacactaagctcagaggctttccacaattatatgaacgccgccatggtgcacatcaaccgggcactcaagctgataattaggctctttctggtagaagatctggtcgacagtttaaaattagcagtcttcatgtggctaatgacatatgtgggtgctgtgtttaatgggattactttactgatattggctgaactcctgatcttctccgtcccaatcgtgtacgagaagtataagacacagatcgaccactatgtcggcattgcccgggaccagaccaagtctatcgtggaaaaaatacaggcaaaactgcccggtatcgccaagaaaaaggctgagtag

SEQ ID NO: 203023 - DNA, 726 bp, Artificial Sequence
  Description of Artificial Sequence: Synthetic coding sequence
atggccgagcccagcgccgccacccagagccacagcatcagcagctctagctttggagcagagccatcggctccaggcggcgggggtagtcctggagcatgcccagcactgggaaccaaaagctgcagctcctcctgcgcagtacatgacctaattttttggcgggacgttaagaaaacaggattcgttttcggaacaacactgatcatgctgctcagcctggccgcttttagcgtcatcagcgttgtttcctacctaatcttggcgctgctgagcgtgactatatcttttcgcatatacaagagtgtaattcaggctgtgcaaaaaagcgaggagggacatccattcaaggcctatctagatgtggatatcactctcagctctgaagcattccataactacatgaacgccgccatggttcatatcaatcgcgccctgaaattgatcatccggctcttcctcgttgaggatctcgtcgactcactgaagctagcagttttcatgtggctcatgacttacgtaggagcagtttttaacggcatcaccctcttgatcctcgccgagttgctgatctttagcgttcctattgtctacgagaaatacaaggacccttccaaaaccccctggaaccggcaaaagaagggccgaatatctacgtggaagccagagatgcagcagttattgaagcatcatttgatcgtcatcacaagccttctagtcctgtag

SEQ ID NO: 203024 - DNA, 645 bp, Artificial Sequence
  Description of Artificial Sequence: Synthetic coding sequence
atggccgagcccagcgccgccacccagagccacagcatcagcagctcttcctttggggctgagcctagcgctccaggaggcggaggcagcccaggcgcttgtccagctctcggtaccaaatcctgttcctccagttgcgctgttcatgacttaatattctggagggacgtcaaaaaaacaggcttcgtgtttggaactacactcataatgctcctgtcgcttgccgcatttagcgtcataagcgtcgtgtcttatctgatcctggctctgttatccgtaacaatttctttccgtatctataagtctgtcatccaagcggttcaaaaaagcgaggaaggtcacccttttaaaccaagactgatcaccatgcttgcctctcccgagattcgaccctctcaattgctgaagcgctccaaacagaactccctcgagtctcccaagaagcgccagaataagtacatggagacccgcaacgccactgtaactaagactccttttaactcttacaatgtggtgacctgcacaatgaaggagaacacccagtgccagctcgagcctgcattccaggccttcttcttgatttggtgcttcctcccatcctttccttttaatccacagtatcaggcacaaaagctcatggactag

SEQ ID NO: 203025 - DNA, 768 bp, Artificial Sequence
  Description of Artificial Sequence: Synthetic coding sequence
atggccgagcccagcgccgccacccagagccacagcatcagcagcagctcattcggagctgaacctagcgcacccggaggcggaggaagccctggcgcctgtccagcactgggaaccaaatcttgctccagctcctgcgcagatagtttcgtcagcagctcctctagccagccagtgagtctgttcagtacaagccaggttcatgatttaatcttttggagagatgtgaaaaaaacaggattcgtgttcggaacaactttaataatgctcctgagcttggctgctttctccgtgatatcagtggtgtcctacctaattttagccctcttgtccgttacaataagctttcgaatctataaatcagtgatacaggccgttcagaaaagtgaggaaggccatccgtttaaggcgtacctggacgtggacatcaccttaagtagcgaagcatttcacaactatatgaatgctgcaatggtgcatattaaccgggcactgaaactcataatcagattattcctggtggaggacctcgtggattctcttaagttagccgtgtttatgtggctgatgacatatgtgggagctgtgtttaacgggataacactgctgattctggccgagctgctcatttttagtgttccgatcgtgtacgaaaagtataagacccagatcgaccactacgtgggtattgcccgggaccagacaaagagtattgtggaaaaaattcaagccaaactccccggtatagccaagaagaaggccgagtag

SEQ ID NO: 203026 - DNA, 3099 bp, Artificial Sequence
  Description of Artificial Sequence: Synthetic coding sequence
atggccgagcccagcgccgccacccagagccacagcatcagcagctcaagtttcggagcagagccttcggcgccgggtgggggaggctcccccggtgcatgtcctgcactcggcaccaaatcctgctcaagctcgtgtgcagactctttcgtttctagttcatcttcgcagcccgttagcctgtttagcactagccaggaggggctgtcttcgctctgctctgacgagccgagctcagagattatgacatcatctttcttatcttcgtccgaaatccacaacactggcctgaccatcctccacggggaaaaaagtcacgttctcgggtcccagccgattttggctaaggaaggaaaggaccacctggacctgcttgacatgaaaaagatggaaaagcctcagggcacttctaacaacgtaagtgactcatcagtgagtcttgccgcgggagttcattgtgatagaccgagtataccggcttcctttcctgaacaccctgcttttctatccaaaaagatcgggcaggtggaagagcaaatcgacaaggagaccaagaatccaaacggagtatccagtcgggaggctaagacggctctggacgcagacgaccggtttacactgcttactgctcagaaacctccaactgagtattcaaaggtggagggtatttacacatattccctgtccccctctaaagtgtcaggggacgacgtcattgaaaaggactccccggaaagccctttcgaagtcattatcgacaaggccgcgttcgacaaagaattcaaggattcatacaaagagagtactgacgatttcggctcatggtccgttcacacagataaggagtcgtccgaggatatcagcgagacaaatgataagttattcccccttaggaacaaagaagcagggagatacccgatgtcagctctgttatcccgccagttttcccatacaaacgccgcactggaagaggtgtcacggtgcgttaacgacatgcacaattttaccaacgaaatcctaacgtgggatctggtgcctcaagtgaagcagcagaccgacaaatcgtccgattgtattactaagactactggtctagacatgagcgaatataactcggaaatacccgtagtgaacctgaagacttccacccatcagaagacccctgtttgctccatcgacggcagtaccccgattaccaaatcgacaggagactgggctgaggcatcactccagcaggagaacgctattactggaaagcctgttccagactctctgaactcaactaaggagtttagtattaaaggggtacaaggcaacatgcaaaaacaagatgatacgttagcagagcttccgggcagtccccccgaaaagtgtgactctctcggctccggagttgccaccgtgaaggtcgttctgcccgatgaccatctcaaagacgagatggattggcagagtagcgctttaggcgagatcacagaagctgattcttctggtgagtcggatgacacagtgatcgaggacattacagcagatacaagtttcgaaaacaacaagatccaggcggaaaaacccgtgagtatccctagcgcggtcgtaaagactggcgagagggaaattaaagaaatcccatcttgcgagagagaggagaaaacctccaagaatttcgaagaactggtgagcgactccgagctccatcaggaccagccggatattcttggcaggtctcctgcctccgaggcggcctgctccaaagtaccagataccaatgtttcactcgaggatgtctccgaagttgcccccgagaaacccattacaactgaaaatccaaagctgccttccaccgtgagcccgaacgtctttaatgagaccgagttctcattaaacgttacgaccagcgcctatctggaatcattgcatggtaagaatgtgaaacatattgacgacagttcccctgaagacctgattgctgcgtttactgagaccagggacaagggcatagtggacagcgagaggaacgcatttaaagccatttcagaaaaaatgactgatttcaaaaccacccctcctgtggaggtgctgcacgaaaacgaaagtgggggatcagagataaaggatatcggtagcaagtacagcgagcagtccaaggagactaacggcagcgagccactcggcgtcttcccaactcagggcacccccgtcgcctctctagacttagagcaggaacaactcaccatcaaagccctcaaggagctgggagaacgccaggtagaaaaatccacctccgctcaacgggatgcagaactcccgagcgaagaggttttgaaacagacttttacctttgctcccgaaagttggcctcagcggtcctatgacattctggagcgcaatgtgaagaacgggtctgatctgggcatttctcagaagccaattactattagggagacaacaagagtggacgccgtaagctcactgagcaagaccgagcttgtgaagaaacatgtcctggcccgactcctgactgatttttccgtgcatgatttaattttttggcgtgacgttaagaaaacaggattcgtattcggcacgacattgattatgctgctctcccttgctgcctttagcgttatatcagtggtctcttatctcatcctggcgctgctttccgtcactatttcatttcgaatatacaagtctgttattcaagccgttcagaaatcagaggaggggcacccattcaaggcttacctggatgtagacattactttgtcttctgaggccttccataactacatgaacgcagctatggtacacattaatcgcgcactgaagctcatcataagactgttcctagtggaggacctggttgactcactaaagcttgcggtgtttatgtggctgatgacctatgttggagctgtattcaacgggatcacgttgctcatcctcgctgagttgctcatcttttcagtacctatcgtctacgaaaaatataaaacacagatcgaccactacgtcggtatcgcccgagaccagactaaatccattgttgagaaaatccaggctaagctgccgggcatcgccaaaaagaaagccgaatag

SEQ ID NO: 203027 - DNA, 372 bp, Artificial Sequence
  Description of Artificial Sequence: Synthetic coding sequence
atggccgagcccagcgccgccacccagagccacagcatcagcagcagttcctttggagcagaacctagcgcacccggtggaggcggctctcctggtgcatgcccagccctaggtacaaagtcatgttcttctagttgcgcagtccacgacctcatcttttggagggacgttaagaagactgggttcgtgtttgggactacactaataatgttgctgagcctcgcggcttttagcgttatcagcgttgtaagctatctcatcttagcactgctgagtgtcacgatttcatttcggatatataagagcgtgatccaagccgtgcagaaatccgaagagggtcacccatttaattggctgtccagttgcggatag

SEQ ID NO: 203028 - DNA, 711 bp, Artificial Sequence
  Description of Artificial Sequence: Synthetic coding sequence
atggccgagcccagcgccgccacccagagccacagcatcagcagctcatctttcggcgccgagccttcagcgccaggcggaggtggttccccaggcgcttgcccagcgttaggaacaaaatcatgctctagcagctgcgccgtgcacgacctgatcttctggcgcgacgtgaagaaaacaggcttcgtttttggtaccactctaatcatgctgctctctctggccgctttcagtgttatctccgtggtgagttatctgattctggccctgctcagcgtgaccatctctttccggatctataaatctgtgattcaggccgtgcaaaagtcagaggagggtcacccttttaaggcatatctggatgtggatattaccctatcctcagaggcctttcacaactacatgaacgccgccatggtgcatattaatcgagccctgaaattgattattcgccttttcctcgtcgaggaccttgtagattccttgaaattggcggtgttcatgtggctaatgacatatgtcggggccgtgttcaacgggatcactctgttaatactggccgagctattaatcttttcagtgcccattgtctacgagaaatataagacacagatcgaccattacgtggggatagcacgggaccagaccaaatcaatcgtggagaagatccaggccaagttgccagggatcgccaagaagaaagccgagtag

SEQ ID NO: 203029 - DNA, 1122 bp, Artificial Sequence
  Description of Artificial Sequence: Synthetic coding sequence
atggaggacctggaccagagccccctggtgagcagcagcgacagccctcctaggccccagccggctttcaaataccagtttgtccgcgagcccgaggacgaggaggaagaagaggaagaggaggaggaggacgaagacgaggatctggaagaactggaggtgcttgagcggaagcccgccgccgggctgtccgcagcccccgtgcctacagctccagctgcaggcgctcctttgatggattttggaaatgatttcgtgccaccggcgccaagaggacccttgcccgccgctccccctgtggctcccgaacgtcagcccagctgggaccccagtccagtctcctccactgtgccggccccttctccgctaagtgcagctgccgttagcccgtcaaaacttcccgaggatgatgagccccccgctaggcctcctccacctccccctgcatcagtgagtcctcaggccgagcctgtgtggacaccccctgccccagctccagccgctcccccaagcacccccgcagcccccaaaaggcgaggcagctctggttcagttgtggtagatcttctttactggcgggacatcaagaagaccggagttgtgttcggggcctccctatttcttctgctcagcctgaccgtattctccatcgtcagcgttacagcttatattgccctagcgctgctaagcgtgaccatttccttccgaatctataagggcgtgatccaggccatacagaagtctgatgaaggacacccgtttagggcttacctcgagtctgaggtggcgataagcgaggagctcgtgcagaaatatagcaatagcgccctcggtcacgttaactgtacaattaaagaactgaggcgtcttttcctggtggacgacctggtggatagtctcaaatttgccgtgttaatgtgggtgttcacatacgtgggagccctgttcaacggtctgacactcctcatattggcactcatctccctgttcagcgtgcctgtgatttacgagcggcaccaggcacagatagaccactacctggggctcgccaataaaaatgtgaaagatgctatggccaaaatacaggccaagatacccggactgaagagaaaagccgagtag

SEQ ID NO: 203030 - DNA, 3579 bp, Artificial Sequence
  Description of Artificial Sequence: Synthetic coding sequence
atggaggacctggaccagagccccctggtgagcagcagcgacagcccacctaggccccagccagccttcaaataccagttcgtgagggagcctgaagatgaggaggaagaagaggaggaagaagaggaggacgaggatgaggacctggaagagctggaagtgctagagagaaaacccgccgcggggctgtcagctgctccagtccctacggccccggcagctggcgctccactaatggactttggcaatgacttcgtgccccctgccccccgcggtccactccctgctgctcccccggtggcgccggaaagacagccatcctgggatcctagtccagtatcttcaactgtgcctgctcccagtccactttcggctgccgccgtttccccgtcaaaacttcccgaagacgatgaaccgcccgctcggccacctcccccaccacccgcctcagtctccccccaggcagaacccgtgtggacaccgcccgctcctgctccagccgccccaccaagtacccccgccgctcccaagcgaagggggagttctggctctgttgatgagacgctgttcgccctgccagccgcctcagaacccgtcattcgatcaagcgcagaaaacatggatctgaaggagcagccagggaataccatatcagccggccaggaggacttccccagcgtcctgcttgaaacagccgcgtccctccccagcctaagccccctctcggcagcgtcttttaaggagcacgaatatctaggcaacctgtccaccgtgctgcccactgagggtacactccaagagaatgtgtctgaagcgtcaaaggaggtgagcgagaaggctaagaccttgctgatcgaccgcgatctgaccgagttttccgagcttgagtatagtgagatggggagctcttttagcgtgagcccaaaggctgagtcagcagttattgtcgctaatcctcgtgaggagattatcgtgaagaataaggatgaggaggagaagttggtgagcaacaatatcctccataatcaacaggagctgcctactgccctgaccaagctcgtgaaagaagacgaggtcgttagttctgaaaaagcaaaggattctttcaatgagaagcgcgtcgccgtggaggccccaatgagagaggagtacgccgactttaaacccttcgagcgcgtctgggaggtaaaggatagtaaggaagacagtgacatgcttgccgctggcggaaaaatcgaatccaacctagagagtaaagtcgacaagaagtgttttgccgattcactcgaacaaacaaaccatgaaaaagacagcgagagctcaaatgatgacacctcatttccgtctactcctgagggcattaaggacaggagtggagcttacatcacctgtgcacctttcaatccagctgccaccgaatcaatagccaccaatattttccccctgcttggcgacccaacatccgagaataaaacagatgaaaagaagatagaggagaagaaggcacaaattgtcacagagaaaaacacttctacaaaaacctccaatccttttctggtcgccgctcaagactctgaaaccgactatgtgacaaccgataacctgaccaaagtcactgaagaggtcgtggctaacatgcctgaaggcctaaccccggacctcgtccaggaagcctgcgaaagcgagcttaacgaggtcaccggcaccaaaatcgcgtatgagacaaagatggatctagtgcagacctcagaagtgatgcaggagtctctctatccagccgctcaactctgcccatcttttgaagagagtgaggcaacaccgtcgcctgtcctgcccgacatagtgatggaggccccattaaacagtgcggtcccctccgccggagcctccgtcatccaaccctccagctctcctctggaggcaagcagcgttaattatgaatccatcaagcacgaacccgagaaccctcccccctacgaagaagcaatgtcagtctccctcaagaaagtgtccggaatcaaagaagaaatcaaagagccggaaaacatcaatgcggctctccaagagaccgaggctccatatatcagcattgcatgtgacttaatcaaggagactaagttgagtgcagagcccgcaccagactttagcgactactccgagatggctaaagtggagcaacccgtgccggaccactctgaactggtggaggattcttcacccgattctgagcccgtggatttgttttccgatgattccatccctgatgtgccacagaagcaggacgagaccgtgatgctggtcaaggagtcattgactgaaacaagctttgagtcgatgattgagtatgaaaacaaagagaaattgagcgccctccctcccgagggggggaagccatatctcgaaagctttaaattgagccttgacaataccaaagataccctgctgcccgacgaagtcagcacgctctctaagaaggaaaaaattcctctgcagatggaggagttgtcgacggctgtctactctaatgacgatctgttcatatccaaagaagcacagatccgggagacagaaacgttcagtgatagctcaccaatcgaaatcatcgatgagtttcccacacttattagttccaaaaccgactctttttcgaagttagctcgtgagtacactgatttggaggtgagccacaaatctgaaatagcaaatgcccctgatggcgctgggagtctcccctgtacagagctgccgcatgatctctcactgaaaaacattcagcctaaagtggaggagaagataagttttagtgacgacttcagtaagaatggatcagccacatctaaagttttgctactcccaccagacgtctcagccctcgccactcaggcagagatcgaatcaattgtgaaacccaaagttctagtgaaagaagctgagaagaagctgccgtccgatacagaaaaagaggatcgatccccctcagcgattttctcggccgagctctctaagacaagcgtggtggacctcctgtattggagggacatcaaaaaaaccggagtggtgtttggagccagccttttcctcttgctgagcctgacagtgttttctatcgtcagtgtgactgcctacatagccctcgctctcctttcagtgaccatcagctttagaatttataagggggttatacaggccatccagaaatcagacgagggccatccttttagagcttatctcgaatccgaggtggcaatcagtgaagagctggttcagaagtactccaattccgccctaggccacgtgaactgcacaatcaaagagctgcgccgcctgttcttagtggacgacctagtggactcactgaagttcgctgtgctcatgtgggtttttacctatgtaggagcgctgtttaatggactcacactcttgattctcgccttaattagcctttttagcgtgcccgtcatttacgagcgccaccaggcacagattgatcattacttgggcctcgccaacaaaaatgtcaaagacgcgatggcaaagatccaggcaaagatccccggccttaaacgtaaggccgaatag

SEQ ID NO: 203031 - DNA, 2883 bp, Artificial Sequence
  Description of Artificial Sequence: Synthetic coding sequence
atggaggacctggaccagagccccctggtgagcagcagcgacagccccccaaggcctcagcctgcgtttaaataccaatttgtgcgggaacccgaggacgaggaggaggaggaggaggaggaggaagaggatgaggacgaagacctggaggaattggaggtactggaacgcaaacagttctccgagctcgaatattccgaaatgggcagcagcttttcagtgagtcccaaggctgagagtgcagtgattgtagcaaatccgagagaagagattatcgtgaaaaacaaagacgaggaagagaagttagtttcaaacaatatccttcacaatcagcaggagctgcctacggccttaacaaaactggtgaaagaggatgaagtcgtcagcagcgaaaaggcaaaggatagttttaatgaaaagagggtggccgtcgaagctccaatgcgcgaagaatatgcagattttaagccctttgagagagtgtgggaagttaaagactctaaggaagattccgacatgcttgctgcaggaggaaagattgagagcaatttggaatctaaggtggataagaaatgtttcgcagattcgttagagcaaactaaccacgagaaggattccgaatcgagtaatgacgacacaagttttccatcaacccccgaagggattaaggataggagcggggcctacatcacatgcgctcctttcaatccggccgctaccgagagtatagcaaccaacatattccccctgctcggggatcccacatcagaaaacaagacagacgaaaagaagatagaggagaagaaggcccaaatcgtgaccgagaagaatacgtcaacaaaaacttcaaacccttttcttgtagcggctcaggactctgaaactgactacgtgaccaccgacaacctgaccaaagttaccgaagaggtagtggccaatatgccggaaggccttacccctgatctcgtccaggaggcctgtgaaagtgaactgaacgaggtgaccgggacaaagatcgcctatgaaactaagatggatcttgtgcagacgagcgaagtgatgcaagagagcctttaccccgccgctcagctgtgccctagctttgaggagtctgaagcaacaccctcacctgtcctgcctgatatcgtgatggaagcccctcttaatagcgcagttcccagcgctggagcctccgtcatacagcctagttccagccctctggaggctagtagtgtgaattatgaaagcatcaagcacgagccggaaaacccgccaccatatgaggaggccatgtccgtttccctcaagaaggtgtcaggaatcaaggaagaaattaaagagccagaaaacatcaatgcagcacttcaggagaccgaggccccctatatcagcatcgcatgtgatctcattaaagagaccaaactaagtgcagaacccgcccctgacttttctgattatagtgaaatggctaaggttgagcagcctgtgcctgatcacagcgagctggttgaggattcaagcccagactctgagccagtcgatctgtttagcgacgactccataccagacgtgcctcaaaagcaggacgagacagtgatgttggtaaaggagagcctgaccgagacctcttttgagtcaatgatagagtatgagaataaggaaaagctatcagccctgccaccagaaggagggaagccatatctcgagtcattcaagctgtctctggataataccaaggatacgctcctgcccgacgaggtgtccactctgagcaaaaaggagaaaatccccctacaaatggaggaactatctacagcagtgtactcaaacgacgatctattcatttcaaaggaagcacaaatccgggagacagagactttctccgactcttcgccgatcgagattattgacgaatttcccactctcattagtagcaagaccgacagcttttctaagctggccagagagtatactgacctcgaggttagccacaaatcagaaattgccaacgcgcccgatggggcaggaagcctcccatgcactgagttgcctcacgacctttccctgaagaacattcaacccaaggttgaggagaaaatatctttcagcgatgacttcagtaagaatggttccgcaacctctaaggttctgctcctgccaccagacgtgtcagctctggctacacaagccgagatcgagagcattgtaaaacccaaggtactggtaaaggaagcagagaagaagctgccgagcgacacagaaaaagaagatcgaagtccaagtgccatttttagtgccgaactgtccaagaccagtgtggttgatcttttatactggagagacatcaaaaagacaggcgtggtgtttggggcctctctgtttttgttgctgagcctgactgtcttttctatagtgtcagtcacagcttatatcgccctggccttgttgtcagtaaccatttcatttcggatctacaaaggagttatacaggcaatccagaagtctgatgaaggccatcccttccgggcctacctagagagtgaagtggctattagtgaagaacttgtccagaagtactccaatagtgccctcggtcatgtgaactgcactatcaaagagctcagacggttgttcttggtcgacgacctcgtggatagccttaagttcgcagtcttgatgtgggtgtttacatacgtgggtgccctgttcaatggactgacccttctcatcttggctctgatttcattatttagcgtgcccgttatttacgaacgccaccaagcacagattgatcattacttgggactggcgaacaagaatgtgaaggacgcaatggcaaaaattcaagccaaaatacccggcttaaaacgaaaggcggagtag

SEQ ID NO: 203032 - DNA, 2961 bp, Artificial Sequence
  Description of Artificial Sequence: Synthetic coding sequence
atggacctgaaggagcagcccggcaacaccatcagcgccggccaggaggactttccttcagtgctgctggagactgccgcaagtctcccttcactctctcccctttctgcagcatcatttaaagaacatgagtacctgggaaatttatcaacagtcctgccaacggagggaacgttgcaggaaaacgtgagcgaggcctccaaggaggtatctgagaaagctaaaactctactcattgatcgtgacctcacagagtttagcgagctggaatatagcgagatggggtcttcctttagcgtgagccccaaggccgagtcagcggtcatcgtggccaacccgagggaagagattatagtgaagaataaagacgaggaggaaaaactggtgagcaataacatcttacacaatcaacaggagcttcctactgccttgaccaagctggtgaaggaagacgaagtggttagtagtgaaaaggccaaggatagcttcaatgaaaagagggtggccgtcgaggccccaatgagagaggaatatgccgatttcaagcccttcgagagggtgtgggaggtgaaggacagcaaagaggattcggacatgcttgccgcgggcgggaaaattgaaagtaatttggagtctaaagtggacaaaaagtgttttgctgacagcctggaacagacaaatcacgagaaagattctgaaagcagtaatgacgacacatcttttccatcgaccccagaggggattaaggaccgcagcggggcctacattacctgcgctccattcaatcctgccgcgactgaatcgatcgctactaacatcttcccactactcggtgaccctacgtccgagaacaagactgacgaaaagaaaatcgaggagaagaaggcccaaattgtgacagaaaagaacactagtacgaaaacgtcaaatccattcttggtagccgcccaagactccgaaaccgactatgtgaccaccgacaacctgaccaaagtgacggaagaagtggttgccaatatgcccgaaggtctgacgcctgacttggtgcaggaagcatgtgagtcagagcttaacgaggttaccgggaccaagatagcttacgaaactaaaatggacctggtgcaaacgagcgaagtcatgcaggaatccttgtaccccgcagcccaactctgcccatctttcgaagagtctgaggcaactccttcaccagttctcccggacatcgtgatggaggccccccttaattccgccgtgccctcggccggtgccagcgtcatacagccaagcagcagccctctcgaggcgagctctgtcaactatgagagcatcaaacacgagcctgagaatcctccgccatatgaagaagcgatgagcgtaagtctgaagaaagtcagcggaataaaagaggaaattaaggagcccgaaaatatcaatgcagcactccaggagacagaagctccgtatattagcatcgcttgtgacctgatcaaagaaacgaagttaagtgccgagcccgcacccgacttcagcgattactcagagatggccaaagtcgaacaaccggtgcccgaccattcagagctggtggaggacagttccccagatagtgagcctgtcgatctgtttagtgatgattcaataccagatgtaccccaaaagcaagacgagacagtaatgcttgtgaaggagtctttgacagagacatcttttgagtccatgatagagtatgagaataaagaaaaactctctgcgctgccccccgaaggaggaaaaccatacttagagtcctttaaactgtccttagacaataccaaggatacacttctgccggatgaagtcagtaccctgagtaaaaaggagaaaatcccgctccagatggaggaactctccacggccgtgtactccaatgatgacctgttcatatccaaggaggctcaaattcgggagaccgagacattctcagattcgagtccaattgaaatcatcgatgaattccccacactcatctctagcaaaaccgactcatttagcaaactggctcgtgaatacacggacctcgaggtctcccacaaaagcgagatagccaatgcccctgacggagctggatccttgccgtgcactgagctgccccacgatcttagccttaagaacattcagccaaaagttgaagaaaagatctcctttagcgacgatttcagtaagaatgggtcggcaacgtccaaggtgctgctgctgcctccagatgtgtccgccctggccacccaagctgagattgagtcaatcgtgaagcccaaagtgttggtgaaggaggctgagaaaaagttgccatccgacaccgaaaaagaggacagatcgccaagtgcaattttctccgcagaactgagtaagacaagcgtggtagacttgctctattggcgcgacattaaaaagacgggagtggtgttcggcgcaagtttgtttctgctgttgagccttaccgttttctcaattgtgtcagtcacggcgtatatcgctctggccctgctctccgtcactatttcttttcgcatctacaaaggggtgatccaagccatccagaagtccgacgagggacacccttttcgcgcgtatttagaaagtgaagtggctatctccgaagagctcgtgcagaagtacagcaactccgctcttgggcacgtaaattgcaccatcaaggaactgcggcggctttttctcgtggatgacctggtggactcgctgaaattcgccgtgttaatgtgggtctttacctacgtgggggcactctttaatggtctgacactgctaatcctggcactgattagtctcttttccgtgccggtcatctatgaaagacatcaagcccagatagatcactacctcggcctcgccaacaagaacgtgaaggatgcaatggctaagatacaggctaagattcccgggctcaagcggaaggcggaatag

SEQ ID NO: 203033 - DNA, 1179 bp, Artificial Sequence
  Description of Artificial Sequence: Synthetic coding sequence
atggaggacctggaccagagccccctggtgagcagcagcgacagcccgcccagaccacaaccagcctttaagtatcagttcgtgagggagcctgaagacgaggaggaggaggaggaggaagaggaggaagatgaggacgaagacctggaggaactggaagtactggaaagaaagccggccgccggattgtccgccgcgccagtgccaaccgccccagcggctggagcccccctgatggatttcggaaacgactttgtgcctccagcacctcgcggccctctgcccgctgccccgcccgtggcccctgagagacagccctcttgggacccttcacctgtttccagcaccgtgcccgctccatctccactgtcggcagcagccgtcagcccaagtaaattaccagaggacgatgaaccccctgcccgcccccccccaccacctccagcaagtgtttcaccgcaggcggagcccgtctggacaccgccggcccccgcccctgccgctcccccctctacaccggccgcgcccaagcggcggggatcgagcggctcagtggacgagactctgtttgcattacccgctgcatccgaacctgtgatcagatcttcagcagtggttgatcttctgtactggcgagacattaaaaaaacaggggtcgtttttggcgcgtccctgtttctgctgctgagcctgactgtcttctcaattgtgagtgtaacagcttacatagccttagcgctcctgtcagtcaccatctcgtttagaatctataagggtgtgatccaggctatacagaagtccgatgaaggtcacccttttcgtgcatacttagagtcagaagtggccatcagcgaagagctggtgcagaaatactccaattcagctctgggccacgttaattgcaccataaaggagctgaggagactgtttctggtggacgacctcgtggactctctaaagtttgcagtcctgatgtgggtgtttacctacgtgggagcacttttcaatgggctcaccctactaatattggcccttatttctctgttctccgtgccagtgatttatgagagacaccaagcgcagattgatcactatctcgggctggctaataaaaatgtgaaagatgcaatggccaaaattcaggcgaaaatccccggcttaaaacggaaagctgaatag

SEQ ID NO: 203034 - DNA, 600 bp, Artificial Sequence
  Description of Artificial Sequence: Synthetic coding sequence
atggacggccagaagaagaactggaaggacaaggtggtggacctgttgtactggcgagacattaaaaagaccggtgtcgtgtttggtgcgagtctcttcttattgttatcgctcacagttttttctatcgtctctgttacagcatatatcgcgctcgccctgctgtctgtcactatatccttcaggatatataaaggagttatacaggcaattcagaagagcgacgaaggacacccctttcgcgcatacttggagtctgaggtggctattagtgaggaactcgttcaaaaatactcgaattcggcattaggacacgtgaattgtaccattaaagaattgcggagactgttcctggttgacgacttagtcgacagtttaaagttcgctgtactgatgtgggtctttacgtacgttggtgcactgtttaacgggttaaccctgctgatccttgccctgattagtctgttttctgttcccgtgatttatgagagacatcaggcccagatcgatcattacctgggcctcgccaacaagaatgtgaaggatgccatggcgaagatacaggccaagatcccggggctcaaaagaaaagctgaatag

SEQ ID NO: 203035 - DNA, 2961 bp, Artificial Sequence
  Description of Artificial Sequence: Synthetic coding sequence
atggacctgaaggagcagcccggcaacaccatcagcgccggccaggaagattttccatctgtgctgctcgagaccgctgcatccttaccctcgctcagccccctaagtgcagcaagcttcaaggagcatgagtatttaggcaatctatccacagtcctgcccacggaagggactcttcaagaaaatgtctcagaagcctccaaagaagttagcgagaaagccaagaccttattaatcgatcgggatcttaccgagttctccgaactggaatatagcgagatggggtctagctttagcgtgagcccgaaagcagaatctgcggtgatcgtggccaacccccgcgaagagattatagttaagaataaggacgaggaggaaaagctcgtgtcgaacaatattctgcataaccagcaggaattgcccactgcactgaccaaattagtaaaggaggacgaggtcgtttcctctgagaaggctaaggatagcttcaatgagaagcgggtggccgtagaggcccctatgcgggaggagtacgcagactttaagccattcgaacgagtgtgggaggtaaaggacagtaaggaggattccgacatgctggccgcaggcggaaagattgagagcaacctcgaatctaaggttgacaaaaaatgttttgcggacagccttgaacagactaaccatgaaaaagattcagaatcctccaacgacgatacctcttttccgagcacgccagaagggattaaagaccggtccggtgcctatattacatgcgctcccttcaaccccgcggccacggagtccattgccacgaatattttccccctgctcggcgatccaacatccgagaataagacggacgaaaaaaaaattgaggaaaagaaggcccagatagttacagaaaaaaatacgagcaccaaaactagtaacccttttttggttgcagcgcaggacagcgagactgattatgtgactaccgacaatctgaccaaagttaccgaagaggtcgtggctaacatgccagagggcctgacgccagatctggtgcaggaggcgtgcgagagcgagctgaatgaagtgaccggtaccaagatcgcctatgaaacaaaaatggacctcgtgcagacaagcgaggtgatgcaggagagcctctaccctgccgctcagctatgtccaagttttgaggaatccgaagcgaccccttctcctgtcctgccagacatcgtgatggaagcaccactgaacagcgcagtaccctctgccggagcatccgtcattcagcccagttcttcgcccctggaggcttctagcgtgaactacgagagcataaagcacgagccagagaatccaccaccctatgaggaggcaatgtctgtctccctcaaaaaagtgtcgggaatcaaagaggaaataaaagagcctgagaacatcaacgcggcactgcaggaaacagaggcgccctacatttctattgcctgtgacctgatcaaagagactaagcttagcgccgagccggcccccgacttttccgattactctgaaatggcaaaggtggagcagcccgtgccggatcactcggaactggtggaggacagttcacctgattcagaaccagtcgatcttttctccgacgatagcatccccgacgtgccccagaagcaggatgagacagttatgctggtaaaagaatctctgactgagacctctttcgagagcatgattgagtatgaaaacaaggaaaagctcagcgccttaccccctgaaggtggaaagccatacctcgagtccttcaaactttccttggacaacactaaggacacacttttacccgacgaggtatcaaccttgagcaagaaagagaaaatcccgctgcagatggaggagcttagtaccgccgtctactctaacgatgacctgttcatatccaaagaagcccagatccgagagacagagacctttagcgattcctcacccatcgagatcatagatgagtttccaactctgatcagcagtaagaccgactcttttagtaaacttgcaagagagtacactgacctagaagttagtcacaaatcagagatagctaacgcccccgacggggccggtagtcttccctgcacggaacttcctcatgatttgagtctgaagaacattcagcctaaagtagaggagaagatatcttttagtgatgactttagcaaaaacgggtctgctacttccaaggtgctgctgctcccaccggatgtctcagcccttgcaacccaggctgagatcgagtccattgtgaaacctaaagtgctggtgaaagaggccgagaaaaaactgccgagtgacactgaaaaggaggacagatccccctcagcgatcttcagtgccgagctctctaaaacttccgtcgttgacctgctttactggagggacatcaaaaagactggtgttgtattcggtgcaagcctgtttctactccttagtttgactgtttttagtatagtctctgtgaccgcctatattgccttagctctgttatccgtcacaatcagcttccgcatttataagggtgttatccaagccattcagaagagcgatgagggccatccctttcgcgcgtacctcgaaagcgaggtggcgatctctgaagagctcgtgcagaagtattcgaactcggctcttggacatgtgaactgcacaattaaggaactccgacggctattcctggtggatgatctggtggattccttgaagttcgcagtgttaatgtgggtttttacctacgtgggcgcactgtttaatggactcactctcctcatcctcgcattgatctctttgtttagcgttcccgttatttacgagcggcaccaggctcagatcgaccactacctgggcctggctaataaaaatgtgaaggacgcaatggccaagatccaggccaaaattccaggtctcaagaggaaggcggaatag

SEQ ID NO: 203036 - DNA, 1038 bp, Artificial Sequence
  Description of Artificial Sequence: Synthetic coding sequence
atggagcccgaggacgaggaggaggaggaggaggaggaggaggaggacgaggatgaggatctagaggagctggaggtcctcgaacgaaagccagctgccggcctgtcggcagcgccagtgcccacggcccccgctgcgggggccccattgatggacttcggtaatgactttgtcccacccgccccccgcggccccctgcccgccgccccaccagtcgctcctgaaaggcaaccgtcatgggaccctagtccagtttcctctacagtcccagccccgagccccctgtctgccgccgcagtcagtccatctaagctgcctgaggacgacgaaccacctgcgcgcccaccaccccccccaccggccagtgtttccccacaagcagaacctgtgtggactcctcctgcacctgctcccgctgctccgcccagcacaccggccgcccctaagcgtcggggttcatcgggttctgtggttgtggacctgctctattggcgcgacatcaagaaaaccggcgtggtctttggtgcatccctgttcctgctcctgtctctaaccgtatttagcatagtgtccgtcaccgcctacatcgcactagcactgctcagtgtcacaatatccttcaggatttataagggggtcatccaggccatccagaagagcgacgaaggtcatccattccgagcctacctggaatctgaagttgctatttccgaggaactggtccagaaatatagcaactcagccttaggtcatgtgaattgcactattaaggagctccggagattgtttctggtcgatgacctagtggacagcctgaaatttgcagtgctcatgtgggtctttacctacgtcggagctctgtttaacggattaacacttctaatcctggcgctcatatcccttttttcagtgcctgtaatttacgagaggcaccaggctcaaatagatcactatctggggctggccaataagaacgttaaggatgctatggcaaaaatacaagctaagatccctggcctgaagagaaaagcggagtag

SEQ ID NO: 203037 - DNA, 2961 bp, Artificial Sequence
  Description of Artificial Sequence: Synthetic coding sequence
atggacctgaaggagcagcccggcaacaccatcagcgccggccaggaggatttcccaagcgttctgctggagactgccgcctctctaccctctctgtctcctctcagtgccgcctcctttaaggagcacgaatatttaggaaatctctcgacagtgttacccactgagggcaccttacaggagaacgtgagcgaagctagcaaagaagtgagcgagaaggctaaaactttattgatcgaccgggaccttaccgaattctctgagttggaatacagcgagatgggcagcagtttctcagtgtcccccaaggcagagtctgccgtaattgtcgccaatccaagagaagaaatcatcgtaaagaataaagatgaagaggagaagctcgtctcgaacaatatcctccataatcagcaggagctccccaccgcgctgactaaactagtgaaagaggacgaggtagtctcttccgagaaggccaaggactctttcaatgaaaaacgggttgcagtcgaggcccccatgcgggaggaatacgcagactttaaaccattcgagagagtgtgggaagtcaaggactctaaggaggacagcgatatgttggcagctggcggtaagatcgaatcaaaccttgaaagcaaagtcgacaagaagtgcttcgctgattcactcgaacagacgaaccacgaaaaagattcggagtcttcgaatgacgatacctcatttccttccactccagagggtataaaggaccgcagcggggcatatatcacctgtgcccctttcaatcctgctgccaccgaatcaatagccacaaatattttccccttgctgggcgatcctacctcggaaaataagactgatgagaaaaaaatcgaggagaaaaaggcgcagatcgttaccgaaaaaaatacatccacaaagacaagtaacccatttctcgttgccgcccaggatagcgagactgactacgtaactacggacaacctgaccaaggtcacagaagaggtcgttgcaaatatgccagagggactcacccccgacctcgtccaggaggcttgtgagtctgaactgaacgaagtgactggaacaaagatcgcatacgaaaccaagatggacctcgtccagaccagcgaagtgatgcaggaatccctctatcctgccgcgcagttgtgccctagcttcgaagaaagtgaagcaacacccagccctgttctcccggacatcgtgatggaggcccctctgaattcagctgtgccgagtgcaggggcctccgttatacaaccttcctcaagtcctctagaagcgagctccgtcaattatgaatccataaaacatgagccggaaaaccctcccccatatgaggaagcaatgagtgtgtcattgaaaaaggtgtcaggcatcaaggaggagataaaagagcccgaaaacatcaacgccgccctgcaagagactgaggctccctatatttcgatcgcttgcgacctcattaaggaaaccaagttatctgcggagccagccccggatttttctgactattcagagatggcgaaagtggaacaacctgtcccagatcacagtgagttagtggaagattcaagtcctgatagcgagcccgttgatttattcagtgatgactccatccccgatgtgcctcagaagcaagatgagaccgttatgttagtaaaggaatcgctgactgaaacgtcattcgaaagcatgatcgagtatgagaataaggagaagctcagcgcactgcctcccgagggcggaaagccctaccttgaatcatttaagttgtcgttggacaatactaaggatactttactgcccgacgaagtcagtactttaagcaaaaaggagaagatccccctgcaaatggaagagctgtccaccgccgtctactcaaatgacgatctcttcatctctaaagaagcccaaatccgggaaacagagaccttttctgacagcagccccatcgaaattattgatgagtttcctactctcatttcctcaaagaccgactccttcagcaagctggcgcgggaatatacagacctcgaggttagccataaatccgagatcgcgaacgcccctgacggtgctggaagcctcccatgtaccgaactcccacatgacttgtctttgaaaaacattcaacccaaagtggaagaaaagatatctttctccgatgatttttcaaaaaatggatctgctacctcaaaggtccttttactgccgccagacgtaagtgctctcgctactcaggccgaaatcgagtctattgttaaaccaaaggtgctcgtcaaagaggctgagaaaaaactgccaagcgacaccgagaaggaagatcgttctccaagtgcaattttcagcgctgagctgtctaagaccagcgttgtggatctgctctattggagagatattaagaagactggcgtcgtatttggcgcctccctctttctgctgcttagccttactgtgttctctatcgtgtccgtgacagcttatatagcccttgcccttctgtctgtgacaatttcctttagaatctacaagggcgtgatccaggcaattcaaaagtcggacgagggccacccgtttagagcttatttggagtcggaggtcgccatctcagaggaactggtacagaaatacagcaattcagctctgggacacgtgaactgcacgattaaagaattgaggaggctgtttctggtcgatgacctggtggacagccttaagttcgccgtactgatgtgggtgtttacgtatgtgggggcactcttcaacggattgacgctgcttattctagccctgatctctctgtttagcgtccctgtcatctatgagcggcaccaagcccagatcgatcactacctcggtttagctaacaagaacgttaaagatgctatggctaagatccaggccaagatacccgggctgaagaggaaagccgaatag

SEQ ID NO: 203038 - DNA, 2961 bp, Artificial Sequence
  Description of Artificial Sequence: Synthetic coding sequence
atggacctgaaggagcagcccggcaacaccatcagcgccggccaggaagattttcccagtgtactactggagacagccgcctcactgcctagtctctcaccactgagcgccgcctcgttcaaggagcacgaataccttggtaatctcagcaccgtattaccaacagaaggtacactgcaagagaatgtgtctgaggcatcaaaggaggtgtccgagaaagcaaagacgctgctgatcgatcgggatttaacggaattttccgaactggagtatagcgaaatggggtcgagtttcagcgtgtctcccaaagccgagagcgccgtcatagtggcgaaccctcgggaagagatcattgtgaagaataaggatgaggaagagaagctggtgtctaacaatatcctgcacaatcagcaagagctgccaacagccctgaccaaactggtcaaggaagatgaggtcgtgtcctcagagaaggctaaagattctttcaacgagaaaagagtggctgtggaggctcccatgcgggaggagtacgctgacttcaagccctttgaacgcgtatgggaggtgaaagactctaaggaggactccgatatgctagctgcaggaggtaaaatcgagagtaatctagagagtaaagttgataagaagtgcttcgccgatagcctggagcagactaatcacgagaaggacagcgaaagctctaatgatgatacaagctttccatccactcctgagggtatcaaggatcgaagcggggcctacatcacatgtgcccccttcaaccctgctgcaactgaatccatcgctactaatattttccccctcctgggagacccaacctctgagaacaagaccgacgaaaagaagatcgaagaaaaaaaggcccagatagtcactgagaaaaatacatccactaagacttcgaatccatttttagtggccgcccaagactcagaaaccgactacgtaaccaccgacaatctcaccaaagttactgaggaggtggtggcaaacatgcctgaaggcctcacccctgacctggtccaggaggcttgtgaatccgagctgaacgaggtgacagggacgaagattgcatacgagaccaagatggaccttgtgcagacatcagaagtgatgcaggagtcactttaccccgcagctcaactttgcccatccttcgaggagtccgaagcaacaccatctcccgttcttcctgatattgtgatggaagccccactgaattctgcagtacccagcgccggcgcatctgtcattcagccgtcttcaagcccgctggaagccagcagtgtgaactatgaatctataaagcacgagcccgagaacccacccccctacgaagaagcaatgagtgtctcccttaagaaggtgagcgggattaaggaggaaattaaagaacctgaaaacatcaatgccgctctccaagaaactgaagcgccatacatctctatagcttgcgatctgattaaagagaccaagctcagtgctgagccagcacccgatttctctgactacagcgaaatggctaaagtggaacagcctgtgcccgaccactccgagcttgtggaggactcaagcccggattctgaacccgtcgacctgttcagtgatgactccatcccagacgtcccgcaaaagcaagatgagacagttatgcttgtcaaagaatccctgacggagactagctttgaaagtatgattgaatatgagaacaaggagaagttatcagcactccctcccgaggggggtaagccctacctggagagtttcaagctgagcctggataatacaaaggacacccttttgcctgacgaagtctcaaccctcagcaaaaaggagaaaatacccctacagatggaagaattatcgaccgctgtgtacagcaacgatgatctgttcatcagcaaggaggctcagattagagaaactgaaactttctccgattcgtctcccatagagattatcgacgagttccctacactgatttctagcaagaccgattctttcagtaagttggctagggaatacaccgatctggaggtcagccacaagtctgaaatcgcgaatgcccctgatggcgccggctctctcccctgtactgagctcccacacgatctcagcctcaaaaatatccagccgaaggtcgaagaaaagatctctttcagcgatgacttctcaaagaatgggtcagcaacaagcaaggtgctcctcctgccccccgatgtgagcgcccttgccacccaggccgaaattgagtccatcgtgaagccgaaagtgcttgtgaaggaggcggagaagaaattgccatcagataccgagaaagaagatagatctccatccgctatcttcagtgccgagttgtccaaaacctccgtggtggatctcttgtactggcgggatattaagaagactggggtggtcttcggcgcgagccttttcctgctattgagcctcaccgtgtttagtatcgtttcggtgacagcttatatcgcgcttgccctgttgtcagttactatctccttccggatatataaaggcgtcatccaggccatccagaagtccgacgagggacaccctttccgtgcatatctcgagtctgaagtggccatttctgaggagctagtccagaaatattccaacagcgcactcgggcacgtcaattgcaccatcaaggagctcaggagattgtttctggtggatgatttagtcgactctctcaaatttgccgtgctgatgtgggtgttcacatatgtcggggcacttttcaacggcctgacgctcttgattctggctctgatctccctgttctctgttcccgtaatctacgaacgtcatcaagcacagattgaccactacttagggctggctaacaaaaacgtgaaagacgccatggcaaaaattcaggcgaagattcccggcctcaaacgaaaggcggaatag

SEQ ID NO: 203039 - DNA, 276 bp, Artificial Sequence
  Description of Artificial Sequence: Synthetic coding sequence
atggacctgaaggagcagcccggcaacaccatcagcgccggccaggaggactttccatcggtcctgttggagaccgccgctagtttgccttcgctgagcccattgtctgcagcctccttcaaagagcatgagtatttggggaatctgtctactgtcctgccaaccgagggcactctccaagagaacgtctccgaggcatccaaagaagttagtgagaaggctaagacactgctaatcgatagggacttaactgagtttagcgaactagagtattag

SEQ ID NO: 203040 - DNA, 1191 bp, Artificial Sequence
  Description of Artificial Sequence: Synthetic coding sequence
atggagttcctgaagacctgcgtgctgcggcggaacgcctgcaccgccgtgtgcttctggaggagcaaggtggtccagaagcccagcgtgaggagaatctcgaccacctccccaagatcaaccgtgatgccagcgtgggtaatcgataaatatgggaagaacgaggtgctgaggtttactcagaatatgatgatgccaatcatccattatcccaacgaagtcattgtgaaggttcacgcggccagtgttaatcccattgacgtgaacatgcgtagtggttatggtgccaccgcactgaatatgaaacgagacccgctccacgtgaagattaagggcgaggagttccccctcaccctggggagggatgtgagcggggtggtgatggaatgcggccttgacgtgaaatacttcaaacctggcgacgaggtgtgggcagccgttccaccatggaaacagggaactctaagcgagttcgtcgtcgtgtcagggaacgaggtatcacataagccaaagtcccttacacacactcaggcggccagcctgccatacgtcgccctgaccgcctggagcgctataaacaaagttgggggactgaacgataaaaattgcacaggaaagcgcgtgctcatccttggtgcatcaggaggcgttgggaccttcgcaatccaggtgatgaaggcttgggacgcccacgtgacggcagtctgcagtcaggacgcctccgaactagttagaaagctgggagccgacgatgttatcgactacaagtccggctccgtggaggaacagcttaaaagcctgaagccgtttgacttcatactggacaacgtgggagggtctaccgaaacctgggcacctgatttcctaaaaaaatggagtggagcaacttacgtgactctggtgactccattcctgcttaacatggatagactcggcattgctgacggaatgctccaaacgggcgtcacagttggatccaaggcactgaagcatttttggaaaggagtgcactacagatgggcgttttttatggccagcggtccctgtctcgatgatattgccgaattagtggacgccggtaaaatcagaccggtgatcgagcagacattccccttctccaaagtgccggaggcatttcttaaagtagagagaggccacgcgcgggggaagacagtgattaatgtcgtgtag

SEQ ID NO: 203041 - DNA, 681 bp, Artificial Sequence
  Description of Artificial Sequence: Synthetic coding sequence
atggagttcctgaagacctgcgtgctgcggcggaacgcctgcaccgcagtatgtttttggcggtccaaggtggtgcagaagcctagcgtgaggagaattagcaccaccagccctaggtccaccgtaatgcctgcatgggtcatcgataaatacgggaagaacgaagtcctccgcttcacgcagaatatgatgatgcctattattcactatcctaatgaagtgatcgtcaaggttcatgcagccagcgtaaatcccatcgatgtgaatatgaggagcggttacggggcaaccgcgctaaacatgaaaagagatccgttgcacgtgaaaattaaaggcgaggagttccctctaacactgggtcgagatgtcagtggcgttgtaatggagtgcggattggacgtcaagtactttaaacctggggatgaggtctgggccgccgtgcctccctggaaacagggaacattgtctgaatttgttgtggtctctggcaatgaagtttctcacaaacccaagtccttgacacacacacaggctgcgtccctgccgtacgttgctctcacagcctggagtgccatcaataaggtggggggattgaatgacaagaattgtaccggcaagcgcatctccggaaaggagagcatcattgccggccacttcagttggcccgttgcccacgtctag

SEQ ID NO: 203042 - DNA, 1422 bp, Artificial Sequence
  Description of Artificial Sequence: Synthetic coding sequence
atgaagcgggccagcgccggcggcagccggctgctggcctgggtgctgtggttacaggcctggcaggtggccgccccgtgtccaggagcctgcgtctgttacaacgagcccaaagtgaccacatcatgccctcagcagggattgcaggctgttcccgtggggattcccgcggcatcacagaggatcttcttgcatggaaatcgtatctcccacgtaccagcggcaagtttcagagcatgccggaacctgactatattgtggttgcatagtaatgtacttgcacgtattgacgctgctgctttcactgggttggccctgttggaacaactcgacctgagcgataacgcccagctgcggagcgtggatccagcaacctttcatggattaggtcggttgcatactctccaccttgatcggtgcggcttacaagagttaggccctggcctattccgcggtctggcagcactccagtacctgtatctgcaggacaacgctctgcaagcgttgcccgacgacacattccgggatctcggaaatctcactcacttgttcctgcacggtaatcgtatctccagcgtgcctgagcgggccttcagaggattgcattcacttgaccgcctgctgttacaccagaacagggtggctcacgtgcaccctcacgcatttcgggatttgggaaggctgatgaccctatacttattcgccaataacctgtccgcactacccacggaggctctagcacctctgcgcgccctgcagtatttgcgtctgaatgacaatccctgggtgtgcgactgtcgagcccgccctttgtgggcctggctccagaagttccggggcagttccagcgaggtgccgtgcagcctcccccagagactagctgggcgcgatttgaaacggctagctgctaacgacctgcagggctgtgctgttgctaccgggccataccaccccatttggacaggacgggccacggatgaggaaccactcgggttgcctaagtgctgccaacccgatgctgctgataaagcatcggtcctcgaaccaggccggccggcatccgcaggaaatgcactcaaaggaagggttccccctggtgactctccacccggaaatggttcgggcccccggcacataaatgatagtccattcggcacattgccgggctcggctgagccgccccttactgctgtgcgacccgagggatccgagcctcccggattccccactagcgggccacgaaggcgacccggctgctccaggaaaaatcgaactcgctcccactgtagacttggccaggcaggtagtggcggtggcggaactggggactccgaggggagtggagcacttcccagtctgacctgcagtctaacacctcttgggcttgctttagtgctctggactgtactgggaccgtgctag

SEQ ID NO: 203043 - DNA, 1041 bp, Artificial Sequence
  Description of Artificial Sequence: Synthetic coding sequence
atgcacctgcccggctgcgcccccgccatggccgacggcagcttctctcttgccggccacctactgcgttcccctgggggctctacttcgaggctccacagtatcgaagccatcctgggttttactaaggacgacggaattctggggactttcccagcggaaagaggtgcacgcggagccaaggagcgggacagacgactaggagcgaggccagcatgcccaaaggcacccgaggaaggctcagaaccatctccacctcccgcccccgcccccgctcccgaatatgaggcgcctcggccttattgcccaaaggaacctggggaggcgaggcctagccccggcctgccagtgggaccagccaccggcgaggctaagctctctgaggaggaacagcccaaaaaaaaacatagacgcaatcggactaccttcacaacttaccaattacacgagctagagcgggccttcgaaaagtctcattacccagatgtgtactctcgggaggagcttgctgggaaggttaacttgccagaggtccgcgtccaggtgtggttccagaaccggcgggctaagtggcgacggcaggagaagctcgaagtgagtagcatgaagctccaggactcccccctcctgagtttcagccggagccccccatccgccacactatccccactcggcgcgggccctggcagtgggggtggccctgctggcggggccctgcctctggaaagctggctgggcccccccctgccgggggggggagcaaccgcgctccagagcttaccaggttttggtccccctgctcagagtctgcccgcctcttacaccccacctccgcctcctcccccctttctgaattcacctccactgggccccgggttacagccactggccccaccccctccatcctacccatgtggccccggctttggggataaattcccactggacgaagcggatcctagaaacagttccatcgcagcgctccggcttaaggcgaaagagcatatacaagccattggcaagccttggcaggctctatag

SEQ ID NO: 203044 - DNA, 225 bp, Artificial Sequence
  Description of Artificial Sequence: Synthetic coding sequence
atgcacctgcccggctgcgcccccgccatggccgacggcagcttctctctcgcaggccacctgctgcgaagcccaggtggtagcacctcaagactacatagcattgaggccatcctcggatttaccaaggacgatggtatacttgggacttttcccgctgagaggggggctcgaggcgccaaggagcgggacagaaggttaggggcaaggcctgcttgcccatag

SEQ ID NO: 203045 - DNA, 588 bp, Artificial Sequence
  Description of Artificial Sequence: Synthetic coding sequence
atgagcctgatcagctggctgcggtggaacgaggcccccagccggctgagtacacgatcccccgctgaaatggtattggagactctgatgatggagttgaccggtcagatgcgcgaagctgagagacagcagagggaacggagtaacgccgtccggaaggtctgcaccggcgtagattattcctggttagcttcaaccccccgtagcacgtatgacttgtctcctattgagcgcctccaactagaggatgtttgtgtgaagatccaccctagctattgtgggcccgccattctgcggtttaggcaacttctggccgaacaggaacctgaggtgcaggaagtgtcccagctttttagatctgtgctgcaagaggtactggagaggatgaaacaggaggaagaagcacacaagcttacccggcagtggagcctacggcccaggggctctctcgcaaccttcaagacccgggcacggatttcaccattcgcctctgatattagaacaatatcggaagacgtcgagagggacacaccaccccctctgagatcatggtcaatgcccgagttccgggcgccaaaggcggattag

SEQ ID NO: 203046 - DNA, 762 bp, Artificial Sequence
  Description of Artificial Sequence: Synthetic coding sequence
atggccgagaccagcgccctgcccaccggcttcggcgagctggaggttctggcagtgggcatggttctgttagtggaggcactgagcgggctgagtttgaacacactcactatcttttctttctgtaaaacccccgagttacgcacaccctgtcatctgttggtgctgagtcttgccttggcagattctgggatcagccttaatgcactggtcgccgcaacttccagccttctgaggcgttggccctacgggtcagacggctgccaggctcacggctttcagggctttgtaaccgctttggcctctatttgctcctcagccgctatcgcatggggccgctaccatcattactgtacgagatcccagctcgcatggaactctgcagtaagcctggtgctgttcgtgtggctcagctcagcattttgggccgccttgcccctattggggtggggccactacgactacgagcctctcggaacctgctgtacactagattactcaaaaggtgataggaactttaccagctttctgtttacaatgagcttcttcaatttcgccatgcccctgtttattaccattaccagctactctctgatggagcagaaactggggaaatctggacacctgcaggtccccgccctcattgctaaaatggtgcctaccatcaatgccattaactacgctctgggaaatgaaatggtctgcaggggtatatggcaatgcttgtctccacagaagcgtgagaaggaccgcactaagtag

SEQ ID NO: 203047 - DNA, 888 bp, Artificial Sequence
  Description of Artificial Sequence: Synthetic coding sequence
atggccgagaccagcgccctgcccaccggcttcggcgagctggaggtcctggccgtgggaatggtgctcctggtcgaggctctctccgggttatccttgaacactctaacaatcttttctttctgtaagacgcctgagctgcggaccccttgtcaccttctggtccttagcctagctttagccgactccgggattagcctgaatgcactggttgcagcaactagctcgcttcttcgggtatcccaccggcgatggccctacgggtctgacgggtgtcaggctcacggctttcagggattcgtgaccgctctggcctctatctgcagctcagcagcaatcgcctggggacgctatcatcattactgcacaaggagccagcttgcctggaatagtgcagttagtctagttctgtttgtctggttgtcttccgcattttgggctgccctgcccctgttagggtggggtcattacgactacgagccactcgggacatgctgcaccttggattactcgaaaggggatcgtaatttcacctcattccttttcacaatgagcttttttaacttcgcaatgcctctatttatcaccattaccagctacagcctgatggaacagaagcttgggaaaagtggacatctccaggtcaacactaccttgcccgcaagaacacttctgctggggtggggtccttacgctatcttatatctgtacgctgtgattgcagatgtgaccagcatcagcccgaagcttcagatggtccctgccttaattgctaagatggtgcccacaatcaatgccatcaactatgctctcggaaacgagatggtgtgcagaggaatatggcaatgccttagccctcagaagcgcgagaaggacagaactaagtag

SEQ ID NO: 203048 - DNA, 363 bp, Artificial Sequence
  Description of Artificial Sequence: Synthetic coding sequence
atggccgagaccagcgccctgcccaccggcttcggcgagctggaggtcctggctgtgggcatggtcctgctggtcgaggatcccggcgctgcggattctctgccccccacgggggccgagcttgggtcttgcggccagtgggatcagcccgaatgcccacgttgcagtcatatccagccttctccatgtctgcctcaagccctcgcccttaggctgggccgcctccctggaagcagactcccaggtctctgcgacagcgtgggacaacaccttcaacagtgttcccacaggatgggtgctctgagcccactgctacaccccccgaagtgttgtcatcgaagtcatcactttgaatggcgatag

SEQ ID NO: 203049 - DNA, 1056 bp, Artificial Sequence
  Description of Artificial Sequence: Synthetic coding sequence
atggcccccgtgctgcccctggtgctgcccctgcagccccggatccgcctagcccagggactatggcttttgagctggctgctcgcgctggccggcggggttatactgctgtgctcaggccacctgctagtgcagctgaggcaccttggcactttcctggcacctagctgccaattccctgtactgccgcaggccgcattggctgccggtgccgttgccctggggaccggacttgtgggcgtgggagcctcaagagccagcctgaacgctgcattgtatcctccctggaggggcgtactgggacctctgcttgtggccggtaccgctgggggcggcgggctccttgtggtgggactgggtctggctcttgccctcccaggttctctggatgaagctcttgaggaaggcctggttacagccctcgcacactataaagataccgaggtgcctggccattgtcaggctaaaaggctggtggatgagctgcagctgcgatatcactgttgtggccggcatggatataaagactggtttggggtgcagtgggtgtccagccggtatttggatcccggggatagagatgtggccgatcggattcaaagtaatgtcgagggcctgtacctgactgacggggtcccattttcatgctgtaacccccatagtcctagaccctgcctccagaacaggctttctgattcctacgcccacccgttgtttgatcctcggcagcccaatcagaacctttgggcccagggatgtcatgaggtgctcctggaacatttgcaggatttggccggtaccctggggagcatgctggctgtcacctttctgttgcaggccctggtcctattaggtctaaggtatctgcaaaccgctttggaaggattaggcggcgtcatcgatgctggtggggaaacccagggttacttgttcccttcaggactgaaagatatgctgaagacagcatggctacaaggtggcgttgcctgtaggccggctcccgaagaggctcccccgggggaagcaccaccaaaggaagatctttcagaggcctag

SEQ ID NO: 203050 - DNA, 1602 bp, Artificial Sequence
  Description of Artificial Sequence: Synthetic coding sequence
atgagcatccaggtggagcaccccgccggcggctacaagaagctgttcgagaccgtggaagaactaagctctcccctcactgctcatgtgaccggacggattccactctggctgacaggctccctgctcagatgtgggcctggactattcgaggtgggatcagagcccttctatcatctctttgacggacaagccctcctccacaaatttgatttcaaggaagggcatgttacttaccaccgcaggtttattagaacagacgcttacgtgcgagctatgaccgaaaagagaatcgtcattaccgagtttgggacatgcgcatttccagacccttgcaaaaacatattcagtcggttcttttcttatttccgaggagtcgaagtaacagacaacgccctggtcaatgtgtacccagttggcgaggattactatgcatgcacggagacaaatttcattacgaagattaatcccgaaaccctagaaactatcaaacaggtcgacctctgtaattacgtctctgtgaacggcgctactgcccaccctcatatcgagaatgacggcacagtctacaatatcggaaactgtttcggaaagaatttcagtatcgcttataatatcgttaaaatcccgccactacaagctgacaaagaagaccccattagcaagagcgaaatagtagtccaatttccatgtagcgataggttcaagccctcctatgtgcattcattcggtctcacgccgaattacatcgtgtttgtagagacacctgtaaagataaatctatttaaattccttagcagttggagtctgtggggcgctaactatatggattgctttgaatccaacgagaccatgggcgtttggctgcacatcgcagacaaaaaacgtaagaaatacctgaataacaagtataggacgtccccctttaacttattccaccatattaacacatatgaggataacggatttctcatcgtggacttgtgttgttggaaaggttttgagttcgtttacaattacctctacttagctaatttacgcgagaattgggaagaagtcaagaagaatgccagaaaagctcctcaaccggaggtgaggcggtacgtccttcccctgaacattgataaggccgatacaggcaagaacctcgtgacactacccaatacgacggcaaccgccatcctctgcagcgatgagaccatttggcttgagcccgaggttctgttctccggtccccgtcaggcgttcgagttcccacaaattaattatcaaaagtactgcggcaaaccctacacatatgcttatggcctgggactgaaccacttcgtgccggacagactctgtaaactgaacgtcaaaaccaaggaaacctgggtctggcaggagccagactcatatccttccgaaccaatcttcgtgtctcaccctgatgccctcgaggaggatgatggggttgtgttatccgtagtggtcagccctggcgccggccagaaaccagcatatctgctgatcctgaatgcgaaagacctgtccgaggtcgctcgggcagaagttgagattaacattcctgtcactttccatggactgttcaaaaagagttag

SEQ ID NO: 203051 - DNA, 954 bp, Artificial Sequence
  Description of Artificial Sequence: Synthetic coding sequence
atgagcgagggcgtgggcaccttccggatggtgcccgaggaggagcaggagcttcgcgcgcagctcgagcaactgacaacgaaggaccatggtcctgtgtttggcccctgttcacaactgcccagacacactctccaaaaggccaaagacgagctgaatgaacgagaggaaactcgtgaggaggccgtgcgggagctgcaggagatggtgcaggcacaggctgccagcggcgaagaactggctgtagctgtcgccgagcgcgtccaggaaaaggactccgggtttttcttgaggtttattagagccagaaaattcaatgtaggccgcgcctacgaacttctacgtgggtatgtgaacttcagactgcagtatccggagctcttcgattcactgtctccggaggccgtgcgatgcactattgaagccgggtatccgggtgtacttagtagcagagataaatacggtagagtagtgatgctgttcaacatcgaaaactggcagagccaggaaatcacattcgacgaaatcctgcaggcctactgtttcattttggagaagttgttagagaacgaggagacgcagattaacggcttctgtatcattgagaactttaagggatttaccatgcagcaggctgcttcgctgcgcacgtctgatctgaggaaaatggtggacatgctccaggatagcttccccgcccgtttcaaagcgatacatttcatccaccagccatggtacttcaccacaacctacaacgtggtaaagcctttcctgaagagcaagctcctggaaagggtgtttgtccacggagatgacctgagcggtttctatcaggagatcgacgagaacatcttgccctccgacttcggcggtactttaccaaaatatgatggcaaagccgtcgctgagcagctgtttgggcctcaggctcaggccgagaataccgccttctag

SEQ ID NO: 203052 - DNA, 807 bp, Artificial Sequence
  Description of Artificial Sequence: Synthetic coding sequence
atggccgagctggacatcggccagcactgccaggtggagcactgccggcagcgtgatttccttcccttcgtatgtgatgattgcagcgggatcttctgtctcgaacaccgcagtcgtgagagtcatgggtgtccagaagtgacggttatcaacgaacgcctgaaaactgaccagcacacctcttatccttgttctttcaaagattgtgccgagagagagctagtagccgtgatttgcccttactgcgaaaaaaacttctgtctgaggcaccgccaccaatctgatcatgaatgcgaaaaattggagattccaaagccccgcatggcagcaacccagaagctggtgaaggatattattgactctaaaacaggggaaacagcttcaaaaaggtggaagggagccaagaattctgaaacggcagctaaggtggccctgatgaaacttaagatgcatgcagatggggacaagtctcttcctcagacagaacgtatttatttccaagtattccttcccaagggttcaaaggagaaatccaaacccatgtttttctgtcaccggtggtccatcggcaaggcaatcgatttcgcggcaagccttgccagactgaagaacgacaacaacaagttcaccgctaagaagttgcggctctgtcacattacctccggtgaggcactgccattggatcacacattagaaacttggatcgccaaggaagattgtcccttatataatggaggaaatataatactcgagtacctcaacgatgaagagcagttttgcaaaaacgtggaaagttacctggagtag

SEQ ID NO: 203053 - DNA, 2751 bp, Artificial Sequence
  Description of Artificial Sequence: Synthetic coding sequence
atgcagcggcccgtggtgaagctgtacgccaccgacggccggcgggtcccgagcctccaagccgtaatcctgtcctcaggcgcggtcgtggcagccggaagagaacctttcaagccagggaactacgatatccaaaaatacctgctgcctgccaggttgccagggatcagtcaaagggtatacccaaaaggaaatgcaaaaagcgagtctcggaagagcagtaactggaaggtattcatcatcactagtgacctgcccgacgcagggacaagcagccagatctacatcatcctgtatggtcagcatcgatccagcgcgccaatttacctgtatgggactgatggcgccaggtttcaggtcgggcacgaagacatttttacaatcactgtgggcgatattggtgccctgttcaagatacgtattgggcacactaactccgggtcaagtccaagctggcattgtaaagagatccagttgcataacatgaatagtggtaagcagttctacgtgccagtacagagatggttagcaagagaccaagaggatggcgagatctgcagagaattcccactcctgagcaaaggccaacccgtcttacctgtgaccatttatgaagtaaatgtcgctaccggggagctctggaacgccggcaccgtggccaatgtgtatatatccattcacggagagaagggcgataccggttcaagacaactgttcagatctaagagcagcttcaactttcttcgtggccagaccgatacattcttcttggaagcggtacatttgggtgatctctgcaaaatcgtcatcggccatgacgggttgggccctggtaacggttggtttctcgatgatgtggtgatcaaagaccccacaaccaattacgaatacgcctttttctgtcaccgatggctggaccagggggaggatgactgcaaaattgtacgagaactgtatgccagagataactcaatcttctcagcccgtcagaagctggaactgaagcggaaagagacctggaccgccgaatcatggaaattcacaaagggaaacacgttacagttttataacaagcttactggcggattcgtgagactgcatcctgatggaacagtggacgctattggtgaaaaaaccgataaatatggcgtctttgacgtgatatttaataaaagaaatatttgtatctttcagtcacatgagatgagacacctgtcgctggctcttgacaacggaattgttactggaatggtgtctggagaagcaacaaccgaactacgcgtactttaccagccgaaccgctgtgctttactggaatctgccctcgtgccggggcacacagttgtcttcgacagacacggcaaaatagccgacgctagctccgccgggtatgcaaacctttccaaggaatttgttatcttcgttaagggggtctttttaaattcagccgtggtcttactggccacaagcctatgccaggctttgtgcctccaacccgatggatcttgcacaggagtcggctcccagagcgagaaatcatattggaaggtacacaagattagcagcggaatatgtatgttcgaaagcgtgaagaatgcccaaatgtacctaaggattaaggatggtagatgcgacggaaccggaaccggggatgtggattgtcacttcaagataaagaagaatctcaagaacgctagtattagcctggagagcacaaagtccccgggattgtttgtagggctgcagagcgacgggcaggcgaaaccgatgatatatacgaaggacgagaacgtttgcttttacccccaggttattcagtttggccgggagaatccaatgggaatgagcgcgacaccctcccaagaagaagagaaaatacatgagagcaaaaaacaaaagaagatccctccggagagtgaggcccggtctcctctgccttcctctactgcaaaggagatccggcatttccagagcagcgaaactttactgtccgaagatgagtggaaggtgttggtgcttactggaaatacaggaactcaagctaacgtgacactgtgggtatacggcgacaagggagtaacgggacctatctcactacggaaagactcctctgagcaactcttcctgcctggccacgaggacgaatttcaggtggaaatcaggaatactggaaatatatacaaaattcggatcggacatgacggtacctctgaacagcccgagtggaatctgcagagagttactatgcaacacatgaaatctaaaaagatcctggattttgccgcgaatgtctggttgtcccgcatccaggccgatggcgacgtcgtctgcgagctcccggtggtaaaaggtggccaggctatcttcccactggtcaggtatcaggtggatgtctatactggacagctaaaacacgcggagaccgagtccgaagtgtttctgtgcctgttcggagagagaggcgattcagggctgcggcaactgtacaaatccaacatgcaggtgaaattccagagaggccagatcgacaaatttcaggtggccgctgtgagccttggcaaactccaaaaggtactgctgagatgcgaggctagtgataagagccagtattggtattgcgagcaggtgatagttcgggagcctggtactacatcggagtctatcttcacatgtcagagatggctgcccttcatgagccaaggcattatccatagcgagattgaactgtacctgcaaggcgaggattattag

SEQ ID NO: 203054 - DNA, 7203 bp, Artificial Sequence
  Description of Artificial Sequence: Synthetic coding sequence
atgaacagcaccccccggaacgcccaggcccccagccaccgggagtgcttcctcccaagtgtcgcacgcactccttccgtaactaaggtgacaccagccaaaaagataacgttcctgaagcggggagatcctcggtttgccggggtccgtttggctgtgcaccagagggctttcaaaaccttttccgcactgatggacgagttaagtcaacgggtcccactgagctttggggtcagatccgttaccactcctagaggcctgcatagtttgtcggctttagagcagctggaggatggaggatgctacctgtgctcagataaaaagccacccaaaacgccctcgggacccggccgcccccaggaacgaaaccctacagctcagcagctcagagatgtggaagggcaacgggaggctcccggcaccagctcctcaaggaaatccctcaagacccctagacgtattctccttattaagaacatggatccccgtcttcagcagactgtagtgctcagccatagaaatacccgtaacctggccgcttttctgggcaaggccagcgacctcctccggttcccagtcaaacagctgtacacgacctccggaaagaaggtggatagcctgcaggccttgcttcactctccaagcgttctggtgtgcgcagggcacgaagcgtttagaactcccgccatgaaaaacgccagaaggtctgaagctgagaccttgagcggcttaacctcaagaaacaagaacggctcatggggcccaaagactaaaccatcagtgatccactccagatctccaccaggcagcactcctcggctgccagagcgcccaggaccctccaatccaccagtggggcctgctcccgggaggcatccacaggacacgccagcccagtccggcccgttagtggctggagacgatatgaaaaaaaaagtgagaatgaacgaggacggttccctcagcgtcgagatgaaagtcaggtttcatctggtgggcgaggacaccctcttgtggtcgcggcgaatgggacgtgctagcgctctcacagctgcaagtggagaggatcctgtgctgggggaggtggatcccctgtgttgcgtgtgggagggatacccgtggggattctccgagccaggtgtgtggggcccccgaccatgtcgcgtggggtgtcgggaagtattcggtcggggagggcagcctggccccaaatacgaaatatggactaatccgctgcacgcttcccagggggaacgggtcgccgcaagaaaacggtggggactagcccaacatgtgaggtgctctggcctttggggccacgggaccgctggccgcgagcgttgctcccaggactccgcatcaccagcctcctcaacaggcttgcctgagggatccgaacccgaaagcagttgttgtccaagaacccctgaggatggagtggactctgcatcaccaagcgcacagattggtgctgagcgtaaagctggcggaagcctgggtgaagaccctggactctgcatagacggcgcgggtctgggcggacctgagcaaggcggccggctgaccccccgcgcacgatcagaggagggcgccagtagcgactcttcagcgtccaccggctcacacgagggatcgtcagagtggggcggccggccccaggggtgcccaggcaaagctcgagctgaaacttcacagcaagaggcgagcgagggaggtgatccggcctcccctgctctcagcttatccagcctgcggtctgatgatttgcaggccgaaacacaaggacaaggcacagagcaggctacgggggcagccgtaaccagggaaccgctggtgctgggactttcttgttcttgggatagtgagggcgcgagttctacccccagcacctgcacatcctctcagcagggacagaggaggcacaggagccgcgctagcgccatgagctcacccagcagtccagggctgggtagagtggccccacggggtcacccacggcatagccactacaggaaggacactcatagccctctagacagttcagtgactaagcaggtgccgcgccctccagagcggcggcgcgcctgccaagacggctccgtccctcgatacagcggttcctcctcttcaacccgcacccaggcttctggaaacctgagaccacccagtagcggctccttgccatctcaagatctgctcggtacatcttccgcgaccgttacaccagctgtccatagcgatttcgtcagcggcgtgtcaccccataacgcgccctccgccgggtgggccggcgatgccggaagtcgaacgtgctcgccagccccaatcccgccacacacaagcgattcttgtagcaaatctggtgccgcgagcctgggggaggaggccagggataccccccagccttcttcacccctggttcttcaagttggccgccctgaacagggagctgtgggtccccatcgatctcattgctgttcacagccgggcacccagccggcccaggaggcccaacggggtcccagtccagaagccagctggctgtgcggccgatattgcccaactccgcctagaggtcgcccttgcccgcaaaggaggtccagcagctgcggttccactggatctagccatcaatccactgcccgaggccctggcggatcaccacaagaaggcactcgtcagcccgggccaacaccatcccctgggccaaatagtggagcttctaggaggtcaagcgcgagccagggggcgggctcccgcggcctctctgaagaaaagacactgcgctctgggggagggccacaaggccaggaggaggccagcggagtcagcccctcgtcgctgccccgatcgtcacctgaggcggtggtacgtgaatggctggacaacattcctgaggaacctatccttatgacctacgaattggccgatgagactacaggcgctgccggagggggactgcgcggccctgaagtcgaccccggtgacgaccacagtctggaaggtcttggagagccagcccaggcgggtcaacagtccctcgagggcgatcctggtcaggacccagagccggagggcgcactgctaggcagcagcgacacagggcctcaatcaggcgagggagttccgcagggcgccgcccccgaaggagtttctgaggcacccgccgaagctggagctgacagggaggcccccgccgggtgccgcgtgtccctccgggcactgccaggtcgggtctccgcgtccactcagataatgagagccttgatgggctctaagcaggggagaccttcaagtgtgccagaggtttcccgacctatggcaagacgactttcgtgcagcgcgggcgctctgattacttgtctcgcgtccctgcagctgtttgaagaggatctgggtagtcctgcaagcaaggtgagatttaaagactcaccccgttaccaggagttattaagtatctccaaagatctttggcccgggtgtgacgtgggcgaagatcagcttgattcgggtctctgggagttaacatggtcacaagctctgccagatctgggcagccacgctatgacggagaatttcactccaacttcttcttcgggggtggacatctcaagcggatccggggggtcgggagaatcatcagtcccctgcgctatggatggcacgttggtaacacagggcactgagttacccctgaaaacatctaaccagcgcccagattcgagaacttacgagtcacccggcgatctcgagaatcagcagcagtgttgctttccgaccttcctgaatgcgagggcttgtgcatgcgcaacaaacgaagatgaggcagaaagagattctgaagaacagcgggcctccagcaacctcgagcagctcgcggaaaataccgtgcaggaggaagtgcagttagaagagacaaaagaaggaaccgagggtgagggcctgcaggaagaggcggtccagctggaggagactaagactgaggagggtctgcaagaggaaggcgtgcagctcgaagagaccaaagagaccgagggcgagggccagcaagaggaggaagctcaactggaagaaatcgaggaaacaggaggggaagggctacaggaagagggggtccagctggaggaggtgaaagaaggacctgagggcggattgcaaggagaagctctagaagaaggcctcaaggaagaggggctgcctgaagagggtagtgttcacgggcaggaactctccgaggcttctagcccagatggaaaagggtcccaggaggatgaccctgtgcaggaggaggaagccggacgagcttccgcttcagcagagccttgtcctgctgagggcactgaggagcccaccgagccgccttctcacttgtctgagactgaccctagcgcctctgagagacagtcagggtcccaactggagcccggcttagaaaagccaccaggagctacaatgatgggccaagaacatacccaggcgcaaccaactcagggggccgccgaacggagcagcagcgtggcctgttcggcagccctggactgcgacccaatctgggtttctgttcttttgaagaaaacggagaaagctttcctggctcacctggcctcagcagtggccgagcttcgggcccggtggggcctccaggataatgacctgctggaccagatggcggctgaactgcaacaagacgttgcacagcggctgcaagacagcacaaaacgtgagctccagaagttgcaaggccgcgcaggcaggatggtgctggagccgccccgcgaagccctgaccggcgaattgctgctgcagacgcagcagcgccgtcaccggctgcggggcctgcgaaatctgtcagctttctccgagcggactctagggctgggccctttgagcttcacgctggaagacgaacccgccctctcaactgcgcttggatcgcagctcggcgaagaggccgagggagaggaattttgtccatgtgaggcatgcgtccggaagaaggtgtcccctatgtcaccaaaagcaaccatgggcgccacccgaggccctatcaaagaagccttcgacctgcagcaaattctgcagcgcaagagaggcgagcacactgatggggaggctgctgaggttgcccccggtaaaacacacaccgatccaacatccacaagaacagtgcagggtgcggaaggcggactgggaccaggtctgagccagggcccaggcgtggatgaaggcgaagatggggaagggagtcaacgattgaacagggataaagaccccaagctcggagaagccgaaggagacgccatggcgcaggagcgggaggggaagacacacaattcagaaacgtccgcaggaagcgagcttggcgaggcagaacaggagggggagggaatcagtgaacggggcgagactggcggccagggcagtggccacgaggataatctccagggcgaggcggctgcagggggcgatcaggatcctggtcagtctgatggggcagagggtatcgaggcccctgaggctgaaggtgaagctcagccagaaagcgaaggggttgaagctcccgaagcggagggtgacgctcaggaagccgagggcgaagcgcagcccgagagcgaggacgtagaggcccccgaagctgagggggaggctcagccagaaagtgaggatgtggagacaccggaggccgagtgggaggtccagcccgaaagcgaaggagcagaggcgcccgaggctgagaaggaagcacagcccgagactgagtctgtggaagccctggagacggagggggaagacgaacccgagtcagaaggggctgaggcgcaggaagcggaggaggccgcgcaagaggccgagggccagacccagccagaaagcgaagtgattgagtcgcaagaggccgaggaagaggctcagcctgagtcagaggatgtggaggctctggaggtggaggttgagacacaggaggctgaaggcgaagcccagcctgaatctgaagatgtggaggccccagaagcggaaggtgagatgcaggaggcggaggaggaggcacagccagagtccgacggcgtggaagcgcaacccaagtcagaaggtgaagaggcacaggaagtggagggtgagactcagaagacagaaggcgacgcccagcccgagtctgacggggtggaagctcccgaggccgaagaagaggcccaggaagccgagggggaggtgcaagaggccgaaggcgaagcacaccctgagtcggaagacgtggatgcgcaggaagccgagggagaagcacaacccgaaagtgagggtgtagaagcccccgaggctgagggggaagcacagaaggcagaggggatcgaggcgcccgagaccgagggggaagcgcaacccgagagcgaaggtatcgaggccccggaggcagagggtgaggcccagcccgaatctgagggcgtagaggcccaggatgcagaaggcgaagcccagcctgagtccgaaggaatcgaggcccaagaagctgaggaggaagcgcagcccgagcttgaaggtgtcgaggcaccagaggccgagggggaggcacaacccgagagtgaggggatcgaagcccctgaggccgaaggggaggcccagccggagctggagggagtggaagcaccagaggccgaagaggaagcccagccagagcccgaaggggtagagacccccgaggctgaaggggaggcacaaccagaatcagagggtgaaacgcagggagagaaaaaaggatcaccacaggtgtccctgggtgatgggcagtccgaagaagcatccgagagcagttctcctgtgcctgaagaccggcccacacccccaccaagtccaggcggcgacacaccccaccagagacctgggtctcaaacaggtccctcttccagccgtgccagctcctggggcaactgttggcaaaaggactctgaaaacgaccatgtgctgggcgacacacgcagcccggacgcaaaatcaacaggcactccacacgctgagagaaaagctacaaggatgtaccctgagtcgagcactagcgaacaggaagaggcacccttgggttcccgcacacccgagcagggcgctagcgaaggatacgacttgcaggaagaccaggccctcggtagcctggctccaacggaagcagtcggaagggccgacgggtttggtcaggacgacctggatttttag

SEQ ID NO: 203055 - DNA, 5019 bp, Artificial Sequence
  Description of Artificial Sequence: Synthetic coding sequence
atgaaggtggaccggaccaagctgaagaagacccccaccgaggcccccgcggattgtagggcccttattgataagctcaaggtgtgtaatgacgaacaacttctactggaactccaacagattaagacatggaatattgggaaatgcgaactgtatcactgggtagatttactggacagattcgatggaatactggctgatgcaggtcagacagttgaaaacatgagctggatgctggtctgcgacaggcccgagagggagcaactcaagatgctgttgctagcagttctgaatttcaccgccctgctcatagagtactctttttcgagacacctgtatagctctatcgagcacttgacaaccctcctggcctcatctgacatgcaagtggtacttgcagttctgaatctgctgtacgtattttctaagcggtcgaactatataacaagattgggctcagataaacgaacccccctgctgactcggctgcagcacctggccgaaagctggggcggcaaggagaatggcttcggcttggcagaatgctgccgggacttgcacatgatgaagtatcctcccagtgcaaccacactccattttgagttctacgccgaccccggagcagaggtaaagatcgagaagaggaccacaagcaacacactccactacatacacatcgaacagctcgacaagattagtgaatctccctccgaaattatggagagccttacaaagatgtactcaatccccaaggacaagcagatgctgctcttcacgcacatcagacttgcccatggtttctctaaccacaggaaacgactgcaggctgtgcaggcgcgccttcatgccatttcgatcctagtttactccaacgctctgcaggaaagtgccaactctatactgtacaatgggctgattgaagagcttgtggacgtgctgcaaatcacagataagcaattaatggagatcaaggcggcaagcctgcggactcttacttctatcgttcacctcgagaggactcccaagctctcatctatcattgattgcacgggcaccgcttcctatcatgggtttctccctgtattggtcaggaattgcatacaggctatgattgatccttctatggatccctatccacatcagtttgcaactgccctgttctcttttctatatcatctggcatcatacgatgccggcggtgaggcactggtgtcttgtgggatgatggaggccctgctgaaggtgattaagtttctgggagacgagcaggatcaaatcacattcgtgacccgagccgtgagagttgtggacctgattacaaacctggatatggccgcatttcagtctcatagcggcctctcaatatttatctatagactggagcacgaagtggatctgtgtcgcaaagagtgtccgttcgtgatcaagcccaaaattcagcgaccgaacacgacccaggaaggagaagaaatggaaacagacatggatggggtccagtgcatcccccagcgcgccgcgttgctcaaatcaatgctcaattttttgaaaaaggcaatacaagatcctgcttttagcgacgggatacgtcacgtcatggacggatccctcccaacatcgctgaaacacatcattagtaacgctgagtactacggcccatcactgtttctgctggctacggaggtcgtgacagtgttcgttttccaagaaccatctctgctgagcagtctccaggacaatggcctcacggatgtgatgttgcatgccctgctgattaaagatgtcccagcaacgagagaagtgctggggagcctgcctaacgtattctccgccctgtgcctcaacgctcggggcctccagagctttgtccagtgccagccttttgagcgtctctttaaagtgctgttgagccctgactacctcccggccatgaggcggagacgcagcagtgaccctctgggcgacacagcctctaacctaggaagtgccgtggatgagttaatgaggcaccagccaaccttgaagacagatgccaccacagccatcataaagttattagaggaaatttgtaacctgggacgcgaccctaaatacatttgccaaaagccttccattcagaaagcagacggtaccgccaccgcccctccgcctcgctccaaccatgccgctgaagaagccagcagcgaagatgaagaagaggaagaagtgcaggccatgcagtcatttaattctacacagcagaatgagaccgaacccaatcagcaagttgtgggtaccgaagaacgtatcccaatcccactgatggactacatcctgaacgtcatgaagtttgtcgagtccattttgagcaataacacaaccgacgatcattgtcaggagttcgtcaatcagaagggtttgctccctctagtgacaatcttgggcctgccgaatctgcctatagatttcccaacaagcgccgcttgccaagccgttgccggggtatgcaagagcattctgactctctctcatgaacccaaggtgctgcaggaaggcctgctacaactggattcgatcctctcctccctggaaccactacaccgtccgattgaaagtcccggaggaagcgtgttgctacgggagcttgcctgcgccgggaacgtggctgatgctaccctgagtgcccaagccactcccctgctgcatgctctgaccgccgcccacgcgtacatcatgatgttcgtgcacacatgtcgcgtgggtcagagcgaaattaggtctatttctgtcaaccagtgggggtctcagttaggcctgtctgttctgagtaaactgtcacagctgtattgttctttggtgtgggaaagcacagttctcctgtcactgtgtacgcctaacagccttcccagcggctgcgagttcgggcaggccgatatgcagaaactagtccctaaagacgagaaggccggcacgactcagggcgggaaacggtctgacggtgagcaggacggagccgccggaagcatggatgcgtctacacaaggtctgttagaaggcattggtctggacggcgacaccctagctccaatggagaccgatgaacctaccgcctccgactccaaaggtaaatctaaaatcactccagccatggccgcaagaatcaagcaaattaagccattgctgtccgctagttcacggcttggcagagccctggccgagttgttcggactgttagttaaactctgtgttggatctccagtacgccaaagaaggtctcaccatgctgcctctaccacaaccgcccctaccccagccgctaggagcactgccagtgcgttaacgaaattgcttaccaaggggctttcatggcagccaccaccatacacccctacaccaagatttcgactaaccttttttatatgtagcgtgggcttcacttccccaatgttgtttgacgagaggaagtatccttaccatcttatgctccagaagtttttgtgttccggcgggcataacgcacttttcgaaacttttaactgggctctgtcaatgggcggcaaagtgccagtgtccgagggcttggaacacagtgacttgcccgacggcaccggtgagttcttggacgcatggctgatgctggttgaaaaaatggttaacccgacaactgtgctagaatccccacacagtttgcctgcaaagcttcctgggggcgtgcagaacttccctcaattttctgccctccggtttctggtggtcacccagaaagctgccttcacttgtatcaaaaacctctggaaccgtaaacccctcaaagtctatggaggcagaatggcggaatccatgttggcaatcctgtgtcacatcctgagaggagaacccgtcattcgtgaaaggctttctaaggaaaaggaaggaagtagaggcgaagaggacacaggacaggaagaaggagggtcacgtagggagccccaagtgaaccagcaacagctgcagcagctgatggacatggggttcacaagggaacatgctatggaggccctgctcaacactagtaccatggagcaggccacagaatatttgctgactcacccacccccgatcatggggggcgtggtgagagatcttagtatgagtgaggaggatcagatgatgagggctatagctatgtctctgggacaggacattcccatggaccagagagccgagagtcccgaagaagtagcgtgtcggaaagaggaggaagagcggaaggctagagagaaacaagaagaagaagaggccaagtgtctggagaagttccaagatgctgatcctctggagcaggacgaactgcacacttttacagatacgatgctccccggttgctttcacctgctggacgagttgcctgacaccgtgtaccgcgtgtgtgacctcattatgactgccatcaagcgtaatggggcagattacagggacatgatacttaagcaggttgtgaatcaagtgtgggaggccgcggacgtcttgattaaggccgctttacccttaaccacctcggacacaaaaaccgtctcagaatggataagtcagatggctacactacctcaagcctccaacttagccacacgcatcctgctgttgacgcttctctttgaggaacttaagctgccgtgcgcttgggtagtggaaagtagcgggatcttgaatgtcctgattaagctgcttgaggttgtccagccctgcttgcaggccgccaaggagcagaaggaggttcaaaccccaaagtggattacaccagtgttgctgcttatcgatttttacgagaagaccgcgatctcctccaagcgaagggctcagatgacgaagtacttgcaaagcaacagcaataactggcggtggttcgatgaccggagcggccgctggtgcagctacagcgctagcaataattccacaattgacagcgcttggaaatccggggaaacaagtgtgagatttaccgccgggaggaggagatatactgtacagtttacaacaatggtgcaggggaccagcgctgaatag

SEQ ID NO: 203056 - DNA, 666 bp, Artificial Sequence
  Description of Artificial Sequence: Synthetic coding sequence
atgagcagccggcccggccgggaggacgtgggcgccgccggcgccagacgaccccgcgaaccgccagaacaagagctgcagcgacgaagggaacagaaaaggcgcaggcatgacgcgcagcagcttcagcagctgaagcacctcgaatctttctacgaaaagcccccacctgggctaatcaaggaggatgaaacaaaaccagaggattgtataccagacgtgccaggaaatgaacatgctcgggaattcctcgcacacgcaccaacaaaaggcctttggatgcctctgggtaaggaagtcaaggtgatgcaatgctggcggtgtaagagatatggccatcgaaccggcgataaagagtgtccattttttattaagggcaaccagaagctcgagcagttccgcgtggcccacgaagatccaatgtacgatatcatccgggacaacaagcgccatgaaaaggacgtgcgcatccagcagctgaaacagctcctggaggattctacaagcgatgaggatcgctcctccagttctagcagcgaaggaaaagaaaagcacaagaaaaagaagaaaaaagagaaacataagaagcgaaaaaaggaaaagaaaaagaagaagaagcggaaacacaagagctccaagtcaaacgaaggctccgactccgagtag

SEQ ID NO: 203057 - DNA, 2262 bp, Artificial Sequence
  Description of Artificial Sequence: Synthetic coding sequence
atgcgggagcccgaggagctgatgcccgacagcggcgccgtgttcactttcggcaaatccaagtttgccgaaaacaatcctgggaagttctggtttaagaacgatgtcccagtgcacttgagctgtggcgacgaacatagtgccgtcgtaacaggcaacaataagctgtacatgtttggtagcaataactggggtcagctgggccttggatctaagagcgcaattagcaaaccaacctgtgtgaaggcccttaaacccgaaaaggtcaaacttgctgcgtgcggccgtaatcacacattagtgtctacagagggggggaacgtctacgcaacaggaggaaacaatgagggccaactgggactgggcgacaccgaggaacgaaacaccttccacgtaatctccttttttaccagcgagcacaagatcaaacaactgagtgcgggctccaatacatcagcagcacttaccgaggacggcaggctctttatgtggggggataactccgaaggtcagattgggctgaaaaatgtgagcaatgtctgtgtgcctcagcaggtcacaattggcaagccggtgtcctggatttcttgtggctactatcattccgctttcgtgacgaccgatggagagctttacgtgttcggggagcccgagaatggcaaacttggactgcccaaccagctgctaggcaatcatcggacgccacagctggtttcagaaattcctgagaaagtcatccaggttgcttgcggcggcgaacacaccgtcgtgcttacagagaatgcagtgtacactttcggtttaggacagtttggacaactgggattagggacgttcctctttgaaacatccgaacctaaggtaattgagaacatccgtgaccagaccatatcgtatatatcctgtggtgaaaaccataccgcgttgattacggacataggcctaatgtacacattcggagatggcagacacggaaagctgggactgggactggaaaacttcaccaatcatttcatccccacactttgcagcaacttcttgcgtttcattgtcaaactcgaacggtctcccgacagcttctccatgcgccgaaccctgccacccatcgaaggaacgttgggactgagcgcatgtttccttccaaatagtgtgtttccccggtgctcagaaagaaacctgcaagagtcagtgctctctgagcaagatctgatgcagccagaagagcccgattaccttctggacgagatgaccaaagaagccgaaatcgacaattctagcaccgtcgaaagcctcggcgagaccacggatattctcaatatgacccacatcatgagcttaaacagtaatgaaaaaagcctgaagctgagtcccgtccaaaaacagaaaaagcaacagacaatcggcgagctgacccaggacactgccctgaccgaaaatgacgacagcgatgaatacgaggagatgtctgaaatgaaagagggaaaagcgtgcaaacagcacgtgagtcagggaatttttatgactcaacctgcaaccaccatagaagccttttcagatgaagaggtggaaataccagaagaaaaggaaggagctgaggattcgaaggggaacggtatagaggaacaggaggtcgaagccaacgaggaaaacgtcaaagtgcacggcgggcgcaaggagaaaactgaaattctgtcagacgaccttaccgacaaggcggaggaccatgagtttagtaagacagaagaactcaaactagaggatgtagatgaagaaataaacgccgaaaatgttgaatccaagaaaaaaacagtgggcgacgacgagtctgtcccaacagggtatcattctaaaaccgaaggagcagaacgaactaatgacgattcctccgcagagaccatcgaaaagaaggagaaggccaacttagaagagcgggcaatctgcgaatacaatgaaaacccaaaagggtacatgctcgatgatgctgattcatcatccctggagatcctggagaattcggaaactacacccagcaaagatatgaagaagacaaagaagatcttcctgttcaagcgtgttcccagtattaatcaaaaaattgtgaagaataacaacgaacccctccccgagattaaaagtatcggggaccaaataattcttaaaagcgacaacaaagatgcggaccagaatcacatgagtcagaatcaccagaatattccccctaccaatacagagcgcagaagcaagtcttgtaccatcctgtag

SEQ ID NO: 203058 - DNA, 2448 bp, Artificial Sequence
  Description of Artificial Sequence: Synthetic coding sequence
atgcgggagcccgaggagctgatgcccgacagcggcgccgtgttcacgttcgggaaatccaagtttgcagaaaataaccccggtaaattttggttcaaaaatgatgtgcccgtccacttgtcctgtggggatgaacactcagcagtggtgacagggaacaacaaattgtacatgttcgggtctaataattggggtcaactagggttgggtagtaagagcgctatcagtaagccaacatgcgtcaaggcattaaaacccgagaaagttaagctggctgcctgtggccggaatcacacattggtgtctacagaggggggcaatgtctatgccaccggcggcaacaatgaggggcagctgggtctgggtgatactgaggagcgcaacaccttccatgtgatcagtttcttcaccagtgaacacaaaatcaaacagctgagcgccggcagcaacacgtccgcggcactaaccgaggacggtaggctgtttatgtggggggataacagcgaaggccagatcggccttaagaacgtctcaaacgtgtgtgtacctcagcaagtgacgattgggaagccagtgagctggataagttgcggctattaccattcagcattcgtgaccaccgatggggaactttatgtcttcggggagcccgagaacgggaaattgggtttgcccaatcagctcctaggcaaccatcgcaccccacagctggtgtctgaaattcccgagaaagtcatccaggtggcctgcgggggcgaacataccgtggtcctcacagagaatgccgtgtacaccttcggtctgggccaatttgggcagctgggactgggcacatttctgttcgaaactagtgagcctaaagtcatcgagaacatccgtgaccagaccatcagttatattagctgcggggagaaccataccgcactgatcactgatattggtctgatgtacacttttggggatggtaggcacggaaagctcgggctgggccttgagaactttactaatcacttcattccaaccttgtgtagcaactttctgagattcattgtgaaacttgtagcatgtggggggtgtcatatggttgttttcgcggctcctcatcggggagtcgctaaagagatcgaatttgacgaaatcaacgacacatgcctgtctgtcgccacatttttgccttacagcagcttaacttcaggaaacgtcctccaacgcaccctcagcgcgcggatgcggagacgggagcgggaaaggtctccggattcgtttagtatgcgacgcacactaccccccattgaggggacactcgggctgtccgcatgctttctccctaattcagtgttccctaggtgctcagaaagaaatctgcaggaaagcgttctttctgaacaagatctcatgcagccagaggaacctgactacctgctcgatgaaatgacaaaggaagccgagatcgacaattcttctacagtcgagtccctgggggaaactactgacatcctgaacatgactcatattatgagcctaaactctaacgagaagagcctgaaactcagcccagtccagaagcagaaaaagcagcagacaataggtgaactgactcaagacacagcccttacggagaatgatgatagcgacgagtatgaagaaatgtccgaaatgaaggaggggaaagcctgcaaacagcacgtgagtcagggcattttcatgacacagcctgccactactatcgaggcgttttcagacgaggaggtagaaatccctgaggaaaaggaaggagctgaagattccaaaggtaacgggatagaggagcaggaagtggaggctaatgaggaaaacgtgaaagtgcacggggggaggaaagaaaagacggaaatcctgtctgacgacctaactgacaaggcagaagatcacgagttctccaaaaccgaagagctaaaactggaggacgtagacgaggagattaacgccgaaaatgtagaatccaaaaaaaagaccgtgggggatgatgagtccgtgccgaccggctaccactctaagactgagggggctgaacgaaccaatgacgactctagcgcagagaccatcgagaaaaaggagaaagccaatctggaggagagggctatatgcgaatacaacgagaatcccaagggttatatgctcgatgatgcagatagtagcagcctggagattttggaaaacagtgaaaccaccccttctaaggacatgaaaaaaactaaaaaaattttcctgtttaaacgggtcccatctatcaaccagaagatcgtgaagaataataacgaaccgctccctgagatcaaatctataggggatcagattattctcaaaagcgataacaaggatgcggaccagaaccatatgtctcagaatcaccagaatatcccccccaccaatactgagagacgaagtaaaagctgcacaattctgtag

SEQ ID NO: 203059 - DNA, 1443 bp, Artificial Sequence
  Description of Artificial Sequence: Synthetic coding sequence
atgcgggagcccgaggagctgatgcccgacagcggcgccgtgttcacgtttggcaagtctaaattcgcagaaaacaaccccggaaaattttggttcaagaatgacgtgccagtgcacctctcttgcggagacgagcattcggccgtcgtgactgggaacaataaactctacatgtttggttccaacaactggggccaactggggctcggctcgaagtctgcaatcagcaagcctacttgtgtgaaagctttgaaacccgagaaagttaagctcgccgcgtgcggacggaaccacaccctggtctccacggaaggtggaaatgtatacgcgaccggcggcaacaacgagggtcaactcgggctgggtgatactgaagaacggaatactttccacgttatctcattcttcaccagcgagcacaagattaaacaactgagcgctggttccaatacctctgcagctctgacagaagacggacggctgttcatgtggggtgataactcggaagggcaaattggcctaaagaatgtctcaaatgtctgcgtgccccagcaggtgacaatcggtaagccagtgagctggatttcatgtgggtactaccacagtgcatttgtgaccacggacggagagctgtacgtgtttggagagccagagaatggaaagcttggcctaccaaaccagttactggggaaccacaggacccctcaattagtttccgagattcctgagaaggtcatccaggttgcttgcggcggggaacataccgtcgtcctgacggagaacgccgtctacactttcgggctaggacagtttggccaacttggtttgggaacctttctcttcgaaacatcagaacccaaggtgatcgaaaacataagggaccagactatttcttatataagctgcggcgagaaccataccgcgctgataacagacattgggctgatgtacacgttcggggacggaaggcacggcaaactgggcctagggctggagaactttaccaaccactttatccccacactgtgctcaaattttttaaggttcatagttaaattagtcgcctgtggagggtgccacatggtggtgttcgccgctccccaccgcggagtcgccaaggagatagagttcgacgagatcaacgatacatgccttagcgttgcaacctttctaccatactcgtcactcactagcggaaatgttttgcagcgcactctctcggcccggatgcgccggagggagcgagagcggagcccagattccttctcaatgcgaagaaccctgcctccgatcgaggggacattgggactgtctgcatgcttcctgcccaatagtgtgtttccaaggtgtagtgaaagaaatctccaggaaagtgtgctcagcgaacaggatctgatgcagcctgaagaacctgatactcatcatgaaccagaatttcagtag

SEQ ID NO: 203060 - DNA, 3063 bp, Artificial Sequence
  Description of Artificial Sequence: Synthetic coding sequence
atgcgggagcccgaggagctgatgcccgacagcggcgccgtgttcacattcgggaaatctaagttcgcagaaaataatccaggaaagttctggtttaagaatgatgtccctgtgcacctgagctgcggtgatgagcacagcgctgtggtgacgggaaacaacaagctttacatgtttggatctaataattgggggcaactgggattagggtctaagtccgcaatcagcaagcccacttgcgtgaaggccttgaagcctgagaaagtgaagcttgcagcatgtggaagaaaccacacactggtcagcacagagggaggtaacgtctatgccaccgggggaaacaacgagggccagttggggctgggcgacacagaagagagaaatactttccacgtgatcagtttcttcacatccgaacacaagatcaagcagctaagcgcaggatctaacacttctgcagccctgaccgaggacggccggttatttatgtggggtgacaactccgagggtcagattggactgaagaatgttagtaatgtttgcgtgccacagcaagtgactataggaaaacccgtcagctggatttcctgcgggtactatcacagtgccttcgtcacaaccgatggagagctgtatgtgttcggggagccagagaatggaaagctcggcctgcctaaccagcttctggggaatcacaggacacctcagttggtgagcgaaatcccagagaaggtgatacaggtggcttgtgggggcgaacacactgtcgtcctaaccgaaaatgcggtgtacacctttggactgggccagtttggccaacttggcctggggacatttcttttcgagacctctgagcctaaagttattgagaatataagggatcaaacaatctcatacattagctgtggggagaaccacactgcattaatcacagacatcggcctcatgtacactttcggagatggccgccacggaaaattgggtttaggacttgagaatttcactaatcatttcatccctaccctttgtagcaacttcctgcgattcatcgtcaaattggtcgcctgcggtgggtgccacatggtcgtctttgccgcccctcacaggggggtggccaaagagatcgaattcgatgaaatcaacgacacttgcctgtcagttgccacattcctgccatacagttctctgacaagtggaaacgtgctgcagcggacactgtctgctaggatgcgaagaagggaacgagagcggtctccagactctttcagcatgcggcggactctgccacctatagaaggtacgctgggcctttcagcctgtttcttacctaactcggtgttccccaggtgtagtgagcgtaacctgcaggagtccgtactttcagagcaggatctcatgcaaccagaggaacccgactaccttcttgacgagatgaccaaggaggctgagatcgataattcttccactgtggagtctctgggagagactacagacatcctgaatatgacccacatcatgtcacttaattctaatgaaaagagtctgaaactaagtcccgtccaaaagcagaagaaacaacagactatcggagaacttacccaagacacagcattgactgagaatgatgactcagacgaatatgaggagatgtcggaaatgaaggagggtaaggcttgcaaacagcacgtctctcagggcatattcatgacccagcccgctaccacaatagaggccttcagcgacgaggaggtcggcaacgataccggtcaggtgggtccgcaagccgatactgatggtgagggcctccagaaggaggtctatcggcacgagaacaataatggcgtcgatcaactcgatgcgaaggaaatcgagaaagaatccgacggcggccactctcagaaagagtccgaagctgaagaaatcgactcagaaaaggagactaaacttgctgagatcgctggtatgaaagatctgagagaacgggaaaaaagcacaaagaaaatgtcaccattttttgggaatttaccagaccgaggcatgaacactgaatctgaggaaaacaaagatttcgtgaagaaaagagagtcttgtaaacaggacgtgatcttcgactccgaacgcgagagcgtggagaaacccgacagttacatggaaggagccagcgagtctcagcaagggatcgcagacggcttccagcagcccgaagccattgaatttagtagtggggaaaaggaggacgatgaggtcgaaaccgaccagaacatacggtacggtaggaaacttatagagcagggaaacgagaaagagactaagcctattatcagcaagagcatggcgaaatacgacttcaagtgcgatagactctctgagatccctgaggagaaagaaggcgctgaagacagcaaaggcaatggaatagaggagcaagaagtggaggcaaatgaagaaaatgtgaaagttcatggagggaggaaagaaaaaaccgagatcctgtccgacgacctgacagataaagcggaggatcacgagtttagcaaaacggaagaactcaaactcgaagatgttgatgaggaaattaacgcggagaatgtggagagcaagaaaaaaacggtgggggacgacgaatcagttcctaccgggtatcattccaagaccgagggtgctgagagaaccaacgatgatagcagtgcagagaccatcgagaaaaaagagaaggccaacctcgaagagcgtgccatctgtgaatacaacgaaaacccaaagggttacatgttggatgatgccgattcatctagcctcgagattttagagaacagtgagacaaccccatcaaaggacatgaaaaaaacgaagaagatctttctgttcaaaagagtgccgagcattaatcaaaaaattgttaagaacaataacgagccactgccagagataaagagcatcggggatcagataatcctgaaatccgacaataaagacgcagatcagaaccacatgagccagaaccaccagaatattcctcccaccaatacagagaggcggagcaaatcatgcaccatcctttag

SEQ ID NO: 203061 - DNA, 1941 bp, Artificial Sequence
  Description of Artificial Sequence: Synthetic coding sequence
atgcgggagcccgaggagctgatgcccgacagcggcgccgtgttcacattcggaaagagcaagttcgctgagaacaaccctggaaagttctggtttaaaaatgacgtcccagtgcacctgagctgcggggacgagcactcagctgtcgtaactggcaacaataaattgtacatgtttggttccaacaattgggggcagttgggcctgggctctaaatcagccatctcaaaacccacctgcgttaaagcccttaagcctgagaaagtcaaactcgctgcctgtgggaggaaccatactctcgttagcacagagggagggaacgtctacgcaacaggggggaataatgagggacagttaggcttgggggacaccgaggaacggaatacttttcatgtgatctccttctttactagcgagcacaagattaaacaactgtctgcaggctctaatacctctgctgcactgacagaggacggacgcctatttatgtggggcgacaacagtgagggacagatcggtctgaagaacgtgtcaaatgtgtgtgtaccacaacaagtaactatcgggaagcccgtgagttggatatcatgcggttattaccactccgccttcgtgaccactgatggagagctgtatgtcttcggggaaccagagaatgggaaattgggactccccaaccaactgttaggcaaccacaggacaccacagctcgtttcagaaattcctgagaaggtaatccaagttgcctgtggtggggagcacacagttgtgctgacggagaacgcggtgtacacctttgggctggggcagtttggtcagttgggccttgggacatttctcttcgagacctccgaacctaaggtaatagagaacattagggaccagacaatttcttatatatcatgcggggaaaaccacacagccctgataactgacatcggccttatgtacacattcggtgacggcagacatggaaaactcgggcttgggctcgaaaattttacgaaccacttcatcccaaccctatgctcaaattttttaagattcattgtgaagctggtcgcctgtggaggctgccatatggtggtgtttgctgctccccacaggggtgtggcaaaggagatagaattcgacgaaatcaatgatacatgcctgagtgttgccaccttcctgccgtattcaagtctcacgtcaggaaatgtgctgcagcggactctttcggctaggatgcgacgacgcgaacgcgaacgctcacccgactctttttccatgcgaagaacactgcctcccatcgaaggcacactgggtttgagcgcttgtttcttacctaacagcgtattcccccgctgctcagaaagaaatctgcaggaatcagtgctgtccgaacaagacctcatgcagccagaggagccagattatttattggatgaaatgaccaaagaagctgagatagataatagctcaaccgttgagtccctgggtgaaacaacggatatcttgaacatgacccacatcatgtctctgaattctaacgagaagagcctgaagctgtcgccggttcagaaacaaaagaaacagcagactattggtgaattaacgcaggatactgccctcaccgagaacgacgattcggatgaatatgaggagatgtcggagatgaaagaaggcaaggcttgtaagcagcacgtgagccagggcattttcatgacccagcccgctaccactattgaggccttcagcgatgaggaagttgagatcccagaggaaaaggaaggtgcagaagatagcaaggggaatgggatcgaggagcaggaggtagaggctaacgaagagaacgtgaaagtgcacggggggcggaaggaaaaaaccgaaattctttctgacgatctcaccgataaggccgaatatagtgcctcccactctcaaattgtgagtgtctag

SEQ ID NO: 203062 - DNA, 3459 bp, Artificial Sequence
  Description of Artificial Sequence: Synthetic coding sequence
atgcgggagcccgaggagctgatgcccgacagcggcgccgtgttcacgttcggtaagagtaagttcgccgagaataatcccggaaaattttggtttaaaaacgacgtgccagtccacctgagctgcggtgacgaacatagtgccgtcgtgacaggcaacaacaaattgtatatgttcggatctaacaactgggggcagctcggactggggagcaaaagcgcaatttctaagccaacttgcgtcaaggccctgaaacccgaaaaggtgaaattggcggcctgtggccggaaccacaccctggtttctaccgagggcggaaatgtgtatgccactggtggcaacaacgagggacagttaggactgggtgacaccgaagagaggaatacattccatgtcatttcttttttcacaagtgaacataagattaaacagctgtcggccgggagcaacacgagcgccgccctgactgaggacggacgtctttttatgtggggcgataactctgaggggcaaatagggttgaaaaacgtgtctaatgtttgcgtgcctcagcaggtgacaatcggaaaacctgtatcttggatctcttgcggctattaccactcagctttcgtgaccacggacggagaactgtacgtgtttggtgagccagaaaacggtaagctaggcctcccaaatcagctgttgggcaaccaccgaacgccccagttggtgagtgaaatacctgaaaaggtcatccaggttgcttgcgggggcgagcacacagtcgtgctaaccgagaatgcagtgtatacattcggcctcggtcagtttggccagctcggtctggggactttcctgtttgagacgtcagagcccaaagtgatcgagaatattcgggaccaaacaatctcgtatatcagctgcggggaaaaccacaccgccctgatcaccgacataggccttatgtacacattcggcgacggtcgtcacggcaagctaggactgggattagaaaattttactaaccactttatacctacactgtgtagcaactttcttagattcatcgtaaaactggtggcatgcggaggatgtcatatggtcgtgtttgctgccccccatcgcggggtcgctaaggagattgagttcgatgagattaacgatacctgcctgagcgtggccacgtttttaccttactctagtctaacatcaggcaacgtgctccagcggacattgagtgcaaggatgcgccggagagagcgggagagatcacccgactccttcagtatgagacgcactctaccaccgatcgaggggactctgggtttatcagcttgcttcctgccaaacagtgtcttccctcgttgctcagaaagaaacttgcaggaaagcgttctctctgagcaagatcttatgcagccagaagaaccggactatctgctcgacgaaatgaccaaggaagctgagatagataactctagcacagttgaatcgctgggggagacgaccgatatattgaacatgacacacattatgtccctcaatagtaacgaaaagagcttaaaactgtctcctgtgcaaaaacaaaagaaacaacagaccattggcgagctaactcaggatacagctctgaccgaaaatgacgacagtgacgagtacgaggagatgtccgaaatgaaagagggcaaagcgtgcaagcagcatgttagccaggggatcttcatgactcaaccagctaccaccatcgaggccttttctgacgaggaggtcgagattcctgaggaaaaagaaggagctgaagacagcaaaggaaatggcatcgaagagcaggaggtcgaagcaaatgaagagaatgtgaaggtgcatgggggacggaaggagaagacggaaatcttgtcagacgacttaaccgataaggccgaagtcagcgagggcaaagccaagtctgtaggggaagctgaagacggaccagagggccgtggcgacggcacatgtgaagaaggaagctccggagcagagcattggcaagatgaagagagagagaagggagaaaaggataaaggacggggggagatggaaagaccaggggagggcgaaaaagagctggcagaaaaggaagagtggaaaaagcgcgatggggaagagcaagaacaaaaagagagagagcagggccaccagaaagagaggaaccaggaaatggaggaaggcggggaggaagagcacggtgagggggaagaagaagagggggatcgtgaagaagaggaggagaaagagggagaaggcaaggaggagggagaaggggaagaagtcgaaggcgagagggaaaaagaggagggtgagagaaaaaaggaggagcgagctgggaaggaagagaagggcgaggaggagggcgatcaaggcgagggagaagaggaagagaccgaagggcggggagaggaaaaggaggagggcggcgaggtcgaaggtggcgaggtggaagagggcaaaggagaacgtgaggaagaggaagaagagggagagggcgaagaggaggaaggcgagggagaagaggaggaaggcgaaggcgaggaggaggagggggaaggtaagggcgaggaagagggcgaagagggcgagggagaagaggagggagaggagggggagggagagggcgaagaagaggagggggaaggcgaaggcgaggaagaaggggagggtgaaggcgaagaggaagaaggcgagggcgagggggaggaagagggtgagggagaaggtgaggaggaggaaggagagggcaaaggtgaggaggagggggaggagggagagggcgagggggaggaagaagagggtgagggtgaaggagaagatggagagggggagggcgaagaggaggagggagaatgggaaggggaggaggaagaaggagagggggaaggggaggaggaaggagaaggcgaaggtgaggagggagagggagaaggagaagaggaagagggggagggagaaggggaggaagaagagggtgaggaagaaggcgaggaagaaggtgagggtgaggaagaaggggagggcgagggagaggaggaggaagagggcgaagtggaaggcgaagtagaaggggaagaaggtgaaggcgagggcgaggaggaagaaggagaagaagaaggagaagagcgggaaaaagagggcgaaggggaagagaacaggaggaaccgggaagaagaggaggaggaagagggaaaatatcaggagactggggaagaagaaaacgagcgacaggatggggaagagtataaaaaagtcagcaagattaagggcagcgtgaaatacggcaagcacaagacctatcagaaaaagtctgttacaaatacccaggggaacggcaaagagcagcgatcgaagatgccagtacagtcaaaacgactcctcaaaaacggccctagcggcagcaaaaaattttggaataacgtcctgccccattacttggaattgaagtag

SEQ ID NO: 203063 - DNA, 2121 bp, Artificial Sequence
  Description of Artificial Sequence: Synthetic coding sequence
atgaacgagagcaagcccggcgacagccagaacctggcctgcgtgttttgccgaaaacatgatgactgtcctaataaatatggcgaaaaaaaaaccaaagaaaagtggaaccttaccgttcattactactgcctgcttatgagcagcggcatctggcagcgcgggaaggaagaagagggggtctacggatttttgattgaagatatccggaaggaggtgaatagggcgtccaagttgaagtgttgtgtttgcaagaagaacggcgcgtccattggttgcgtagctccccgatgtaagcggtcttaccacttcccctgcggactgcagcgcgagtgtatcttccagtttaccggaaattttgcttccttttgctgggaccatcgcccagtacagatcataacctctaataattatcgcgaaagtctcccttgcacaatttgtctggaattcatcgaaccgattccgtcatacaatatcctgcggagtccttgctgcaaaaacgcctggttccatcgagattgccttcaagtacaagctattaatgccggtgtgttcttcttccggtgcactatctgtaacaacagtgatattttccaaaaagagatgttgaggatgggcattcacataccagaaaaggatgcctcttgggaactggaggaaaacgcctatcaggaactgctgcaacactatgaacggtgtgacgtgagacggtgccgatgtaaggaaggaagagattataacgcaccagatagtaagtgggagattaagagatgccaatgctgcggttcgtctgggactcatctggcatgtagttcattaagaagctgggagcagaactgggagtgcctggagtgtcgcgggattatttacaattctggcgagtttcagaaggccaaaaaacacgtgctgccgaacagcaataacgtgggtattacagattgcttactggaagagtcttcaccaaaactgccgaggcagtctcctggttcgcagagcaaagatttgctacgccagggtagtaaattccgacgaaacgtcagtaccctgctgatcgagctcggattccagatcaagaagaagaccaagcgcttatacattaataaagcaaatatctggaacagcgccctggacgcgttccggaaccgaaactttaatccttcctatgcaattgaggtggcttatgtgattgaaaatgataactttggttcagaacaccccggatccaaacaagaatttctgtcactgttaatgcagcatctcgagaatagtagtctgtttgaagggtctctgtcaaagaacctgagccttaactcccaggctcttaaggagaatctgtattatgaggccgggaagatgctcgctatttctttggtccatgggggacctagcccagggtttttctcaaagactctgttcaactgtctggtgtatggacccgaaaatacccaaccaattctggacgatgtttcagacttcgacgtggcacagattatcatccgaatcaacaccgctaccacggtagcagacttaaagtcaataattaatgagtgctataactatcttgagctgatagggtgtctgcgtctcatcaccaccctgtctgacaagtatatgctggtgaaggatatactggggtatcacgtaatccagcgcgtgcacacaccttttgaatcctttaaacaaggtcttaagactctgggtgtgctagagaagattcaggcataccccgaagctttctgctcaatcctgtgccataagcccgaatctctgagcgcgaagatcctttctgaattgtttacggtgcatacgctccctgacgtgaaggctctgggattctggaacagctatctccaggcagtcgaagacggcaagtccaccactaccatggaggacatccttatcttcgcaacgggctgttccagcattccacccgctgggtttaagccaactccttctatagagtgtttgcacgtcgactttccggtagggaacaaatgtaacaattgcctcgccattccgattacgaacacatataaggaattccaggaaaacatggacttcaccatccgcaatacactgcgcctcgagaaggaggagagttcccattacattgggcattag

SEQ ID NO: 203064 - DNA, 1938 bp, Artificial Sequence
  Description of Artificial Sequence: Synthetic coding sequence
atgctgctgatggcccccgaccggtgccggtacgtgtggaagcactgtcagcccatggaaatgcgtatcaagtggatcttcctgtgttgtatcaggcccttgtacgattttacaagccagtatgttatggagactgacagcttatttcttcattaccttcaggaggcctcagctaggcttgacatacaccaagcgatggcttccgagcactccactctggcagcaggctggatttgctttgacagggtcttggagacagtcgaaaaggtgcacggattagccaccctaataggtgccggcggagaagagtttggagtcctggagtattggatgcgattgcgatttccaatcaagccttcacttcaggcttgcaataagagaaagaaggctcaggtgtacctttctacagacgtgctgggcggaagaaaagctcaggaggaggagtttaggagcgagtcttgggagccgcagaacgagctctggattgagattacaaaatgctgcggccttcgttcgaggtggctaggtacccaaccctcaccatatgcagtgtacaggttttttaccttcagcgaccatgacaccgcaattatccccgcctcaaacaacccgtacttccgggaccaggccaggtttcccgtcctcgtgacctccgatctcgaccattatctgcggcgcgaagctcttagcatacacgtcttcgatgacgaagacttggagcccggcagttatctgggtagagcccgcgttcccctcttgcccctggccaagaacgagtccattaagggcgattttaacctgacagatccagcggagaagccgaacggatcaattcaagtgcaactggactggaagttcccttacatacctcccgaatcttttcttaagccggaggcacagaccaaaggtaaggacaccaaggatagctccaaaatttccagcgaggaagagaaggcaagtttcccaagccaagatcagatggctagtcccgaggtgcctatcgaagcagggcaataccgcagcaaacggaaaccaccacatggcggggaaaggaaagagaaggagcatcaggttgtatcctatagccggaggaagcatgggaaacgcataggcgtgcaaggtaaaaacagaatggaatacctctctctaaacatactaaatgggaataccccagagcaggtgaattacacagaatggaaattttccgagaccaattctttcatcggagacgggttcaaaaaccagcatgaggaagaggagatgaccctctctcatagcgcactaaaacagaaggaacctctgcacccagttaacgacaaggagtctagtgagcagggcagtgaagtgagcgaagcccagacgacagattccgacgatgtgattgttcctccgatgtcccagaagtaccccaaagccgattctgagaagatgtgcatcgaaatcgtgtcactcgctttctatcccgaagccgaagtgatgtctgatgaaaatatcaaacaggtctacgtcgaatataagttttacgacctacctctgtccgaaacagagacgcctgtgtcgctccgcaagcccagagcaggcgaagaaatccacttccacttttcaaaagtcatagacctagatccccaggagcagcagggacgacgtcggtttttgttcgatatgctcaatggccaagatcccgatcagggccacttgaaatttaccgtggtttcagacccacttgatgaagagaagaaagagtgtgaagaggtcggctatgcatatttgcagctgtggcaaattctggaatctggcagggacattctggagcaggagctggatatcgtgtcccctgaggacctggctacccctattgggcgactgaaagtctctctgcaggccgcagcggtgcttcatgcaatttataaagagatgaccgaagacttgttttcctag

SEQ ID NO: 203065 - DNA, 1839 bp, Artificial Sequence
  Description of Artificial Sequence: Synthetic coding sequence
atgctgaagctggacaacaaggacgtgatcagccaccccctgggctatccttccgaatcacttctctccatagcttccatgttggattccagtgactcatcgagccagccacactggtctaacgaactgattgcagaacaactccagcaacaggtctctcaattacaagaccagttagatgccgaactggaggataaacgcaaagttctcctggagctaagtagggagaaagcccaaaatgaagatctgaaacttgaggtcactaatatactccagaagcataagcaggaggtggagcttttgcaaaacgccgctacaatctcccaaccccctgacaggcaatctgagccagcgactcacccagcagtattacaggagaatacccaaatcgagcccagcgagcccaaaaaccaggaggagaagaagcttagccaggtccttaatgagctacaggtatcgcatgctgagactacactagaactggaaaaaaccagagacatgctgatcctacagaggaagatcaatgtgtgctatcaggaagagctcgaagccatgatgacaaaggcagacaacgataaccgggatcataaagaaaaattggagcggctcaccaggttgctagatctcaagaataaccgtatcaaacagctcgagggcatcctgcggtcacacgacctgccaacgagtggtgatttcaatctgactgatcccgctgaaaaacctaacggcagcatccaggttcagctcgattggaagttcccgtacattcctcccgagtctttcttgaagcctgaggctcagaccaagggaaaggatacaaaagacagctcaaagattagcagcgaggaggagaaggcttccttcccaagtcaggaccaaatggcatccccggaagttcccatcgaggccggtcagtaccgctctaaacgcaagccgcctcacggaggagagcgaaaggagaaagagcatcaggtggtgagttattcaagacggaaacacgggaaacgcattggggtgcaggggaaaaataggatggagtatctcagtttaaatattttgaacgggaatacacctgagcaggtcaactacaccgagtggaaattcagcgagaccaatagctttataggcgatggcttcaagaaccagcacgaggaggaggagatgacactgtcgcactccgctctgaagcaaaaggaaccgctccatcctgttaatgataaagaatcgtcagagcaaggaagtgaggtatcggaggctcagactaccgacagcgacgatgtaatcgtgccccccatgtcacagaagtaccccaaggccgactcagagaaaatgtgtattgagatcgtgtcactggctttctatccagaagcagaagtgatgtcggacgagaatatcaaacaggtgtatgtcgagtacaaattttacgatctcccactttctgagactgagactcccgtcagcctccggaagcctagagcaggcgaagagatccatttccatttctcaaaggtgatcgacttagaccctcaggagcagcagggcagaaggcggttcctgttcgacatgcttaatggccaggatccagatcagggccaccttaagttcaccgtcgtcagcgatcccctggacgaagaaaagaaagagtgtgaagaggtcggatatgcctatctgcagttatggcaaatcttagaatccggtagggacattctggaacaggagctggatattgtttcaccagaggatctagctacgcctatcggtagacttaaagtgtctctgcaggccgctgctgtcctccatgccatttataaggaaatgacagaagacttgttttcctag

SEQ ID NO: 203066 - DNA, 3861 bp, Artificial Sequence
  Description of Artificial Sequence: Synthetic coding sequence
atgagccacctggtggaccccaccagcggcgacctgcccgtgcgggatattgatgccattccactggtgttgccagcttcaaaagggaagaacatgaaaacccagccacctctctcaaggatgaatcgggaagaattagaggacagcttctttagactgagggaagaccatatgctggtcaaagaactgtcttggaagcagcaggatgagataaaaaggctgcgtacaacattgctgagactgacagcagcgggtagagatctgagagtcgctgaggaggcagcaccgctgagcgagacagctcgccgtgggcaaaaagccgggtggaggcagcgcctttctatgcaccaaagacctcagatgcatcgcctccaaggccacttccactgcgttggcccagcatcaccccgacgcgcacagccccgtgtccaggtaggacatcggcagctgcatactgccggagcccctgttccagagaaaccgaaaagggggccaagagaccggctgtcatacacagctcctccgtcctttaaggaacacgcaactaacgagaatcgaggagaggtggcctcaaagccgtccgaattggtctcaggctcaaattctataatctccttcagtagcgtgatcagcatggcaaaacccatcggtttgtgtatgccaaacagtgcccacattatggcttccaacactatgcaggttgaggagcctcccaagtccccagagaaaatgtggcccaaagatgaaaatttcgagcagcggtcaagcttggagtgcgctcaaaaagcagcagaactcagggccagcattaaggaaaaggtcgagctcataaggctgaaaaaactgcttcacgagcggaacgcctccctggtgatgacgaaggctcagctcactgaagtccaggaagcctatgagaccctcttgcagaaaaaccaaggtattctatcagctgctcatgaagccctgctcaagcaggtcaacgagttaagggccgaactgaaggaagagagtaaaaaggccgtgagtcttaagagccagttggaggacgtatccattctacaaatgaccttaaaagagtttcaggagagagtggaggatctggagaaggaaagaaagctcttaaatgataactacgataaactattagagtcaatgctcgattcttccgactccagtagccagccacattggagtaatgagttgatcgctgagcaattgcagcaacaggttagccagctgcaggaccagctggacgccgagcttgaggacaaacgtaaagtactcctggagctgagtcgcgagaaagcccaaaatgaggatctgaagctcgaggtgaccaacatactgcagaagcacaaacaggaagtggagcttctgcagaatgccgccaccatatctcagcccccagacaggcagtcagaacccgctacacatccagctgtcctgcaagaaaacacacaaatcgagccatccgagcccaagaaccaagaagaaaagaagctgagccaggtcctcaatgaactccaggtgagtcacgctgagaccacactggaactggaaaaaactagagatatgttaatattgcaacggaagatcaatgtctgttatcaagaggagctcgaggccatgatgactaaggcagacaacgacaatagggatcataaagagaaactggaacgactcacaaggctgctagatttaaaaaataatcgaatcaagcaattagaggggattctcagatcccatgaccttcctacatcggaacagctgaaagatgttgcgtacggcactagacccctatccctttgcctggagacgctcccggcacatggagacgaggacaaagtcgatatctcccttctccaccagggagaaaacctcttcgagctccacattcaccaggcatttttaacctcagcagcccttgcccaggccggggacacacaacccaccactttttgcacatactcattctacgacttcgagactcactgtaccccactgtctgtgggacctcagccactgtacgactttactagccagtacgtgatggaaaccgacagtttgttcctgcactatcttcaggaagcatctgcgcgcttagacatccaccaagccatggcttcagaacattccacactcgcggctggttggatatgtttcgatagagtgctggagacggtcgagaaggtgcacggactggctacactcattggggccgggggtgaggagttcggggtgctggaatattggatgagacttaggtttcccatcaagcccagcctacaggcgtgtaataaaagaaaaaaggcacaggtttacctctctacagatgtgctgggcggcaggaaagcgcaggaggaggaattccggagcgagtcctgggagccacagaacgaactctggatcgaaatcaccaagtgttgcgggcttaggagcagatggctgggaacacagccatccccttatgcagtgtatagatttttcacattcagtgaccacgatactgcgatcatccctgccagtaataatccctacttcagggatcaagcacgcttccccgtattggtgacttccgatctggaccactatctgagaagggaggctttgtcaatccacgtgtttgacgatgaggatctggagcctggttcctacctagggcgggcacgcgttcctctcctgccacttgccaaaaacgagagcatcaagggagattttaatctgactgatccagctgagaagcccaatgggagcatccaagtacagttagattggaagttcccttatattccacctgagtcttttttgaaaccggaggctcaaaccaagggtaaagacactaaagatagttctaaaattagttccgaggaagaaaaggccagtttcccctcacaggaccagatggctagccccgaggttcctatcgaggcaggacagtatagatccaagcgaaaaccgcctcacggaggagaaaggaaggagaaagagcatcaagtcgtttcttattcccgtcgcaagcacggtaagcggatcggcgttcagggcaaaaaccgtatggagtatctgagcctgaacatcctgaacggcaacacacctgagcaggtgaattataccgagtggaagttcagcgaaacgaacagtttcatcggcgacggcttcaagaaccagcacgaagaggaggagatgaccctgtctcacagtgccctgaagcaaaaagagcccttacacccggtcaatgataaagaatcctccgagcaaggatccgaggtcagcgaggcccaaactaccgatagtgatgatgtgatcgtcccccctatgagccaaaagtacccaaaagcggattctgagaagatgtgcattgagatcgtttcactcgccttttaccccgaagctgaggttatgtcagacgaaaacatcaaacaagtatacgtagagtacaaattctatgacctgcctctgtcggagacagagacacctgtgagtttgcggaagccaagggcaggcgaggaaatccattttcatttttcaaaggtgattgatctcgacccccaagaacaacaaggaaggcgtcggttcctattcgacatgcttaacggccaggatcccgaccaaggtcatctgaagtttactgtggtgtccgacccattggatgaggagaagaaagagtgtgaagaggtgggctatgcctatctccagctgtggcaaatcctggagagcggcagagatattctggagcaggagcttgacatcgtaagtcctgaagatctggctacccctatcgggaggttaaaagtgtctctccaggctgcagccgtacttcacgcaatatacaaggagatgaccgaagatcttttttcctag

SEQ ID NO: 203067 - DNA, 1617 bp, Artificial Sequence
  Description of Artificial Sequence: Synthetic coding sequence
atgaacctggagctgctggagagcttcggccagaactaccccgaggaggcagacggtaccctggactgcatttccatggccctgacctgtaccttcaaccgctggggcactctactcgccgttggatgcaacgacgggcggattgttatatgggacttcttgactcgggggatcgcaaagattatttccgcgcatatccatccggtttgtagcttgtgctggtcccgcgatggtcataaacttgtctccgccagtacagataacatcgtctcacagtgggacgtcctgagtggcgattgcgaccagaggtttcgattcccctccccgatcttgaaggtgcagtaccatccaagagaccagaataaggtgttggtctgtccaatgaaatccgctccagtgatgttgactttgagcgattcaaagcacgtggttttgcctgtggacgatgatagtgacctcaacgttgtggcgagcttcgatagacgaggggagtatatctatacgggcaatgccaaaggcaaaattctggtgctcaagacagactctcaggacctggttgccagtttcagagttactacagggacgtcaaataccacagccatcaagagcatcgaattcgctcggaagggcagctgctttctgataaataccgccgacaggatcataagggtgtacgacgggagggagattctgacatgtggaagagacggggaaccagagcctatgcagaagctccaggatttagtcaacaggacgccgtggaaaaaatgctgtttctcgggtgacggggagtacatcgtggccggctccgcgcggcagcacgcactttacatctgggaaaagagtattggcaacctcgtgaaaattctgcacgggacacggggggagctgctcctggacgttgcatggcaccctgtgaggccaatcattgccagcatcagcagcggggtggtgtccatctgggctcagaatcaagttgagaattggtcggcctttgctcctgacttcaaagagctggacgaaaacgtggaatatgaggaaagagagtccgaatttgacatcgaagatgaagacaagagtgagcccgaacagacaggcgccgacgccgctgaggacgaagaagtcgacgttacttctgtggaccccatagctgccttttgcagctcggacgaggaactggaggactctaaagccctgctgtacctgcctatcgctcccgaagtggaggatcccgaagaaaatccttacggtcctccacccgacgctgttcagacatcactaatggacgagggggcgtcttcggaaaagaagcggcaatcttcagcagatgggtcccagccccctaagaagaaaccaaaaacaacaaatatagaactgcagggtgtgcctaatgatgaggtacatcctctactcggcgtgaagggtgatggaaaatctaagaaaaaacaggccggcagacccaagggatccaaagggaaagaaaaggacagtcctttcaaaccaaagctctacaagggtgacaggggcttacccctcgaaggctctgcaaagggcaaggtgcaggcagaattgtcgcagccattaaccgcggggggtgccatctccgaacttttgtag

SEQ ID NO: 203068 - DNA, 1503 bp, Artificial Sequence
  Description of Artificial Sequence: Synthetic coding sequence
atgaacctggagctgctggagagcttcggccagaactaccccgaggaggcggacgggaccctggactgcatttctatggccttgacatgtacatttaatcggtggggaacgcttctggccgtgggttgtaacgacggcaggattgtgatctgggactttctcacgcgcggcatcgccaaaataatctcagcccacatacaccctgtgtgctctctgtgttggagcagagacggtcacaagctggtatcagccagcacggacaacatagttagccaatgggacgtgctatctggcgactgcgaccagcgctttagattcccctctccgatccttaaggttcagtatcatccacgcgaccagaataaggtgcttgtgtgtcccatgaagagcgcacctgtaatgctgacactgtcggattccaaacacgttgtgctgcctgtggacgacgattccgacctaaacgtggtcgccagctttgacagacggggcgagtacatctacaccggaaacgcaaaaggaaagatcctggtgctaaagacagatagtcaagacctggtagcgagtttcagggtgacgaccggaaccagcaataccaccgccattaagtcaatagaattcgcccggaaggggtcctgtttcctaattaatactgctgatagaataatccgtgtttacgacggccgagagatactcacctgcgggcgagatggggagccagaacctatgcaaaagctgcaggatctcgtgaaccgaacaccctggaagaagtgttgtttttccggagatggcgaatatatcgtggccggcagcgcgaggcagcacgcactgtatatctgggaaaaatccattggaaatttagttaagatcctacacggaacccgaggagagttactcctggatgtcgcctggcatcccgtcaggccgatcattgccagtatctcgagtggtgtcgtttcaatctgggctcaaaatcaggtagagaactggagcgcattcgctccagactttaaagagttggatgaaaacgtggaatacgaagagagggaaagcgaatttgacatcgaagatgaggataaaagtgagcccgagcagactggggccgacgcagccgaggatgaggaggtggacgtgacgtcggtcgaccctatagccgcattttgtagctctgacgaggagttggaggattctaaagccctgctgtatttgcctatagcccccgaggtggaagatcccgaagaaaatccctatgggcctccgcccgacgcggttcaaacatctctgatggatgagggtgccagctccgaaaagaaaaggcagagcagtgccgatgggtctcagccacccaagaaaaagcctaaaacgacaaacattgagctgcaaggcgtgccaaacgacgaggtgcacccgctcctgggagtcaaaggggacggaaagagcaagaagaagcaggctgggaggcccaagggatccaaagctggaggtgcaatatctgaattgctctag

SEQ ID NO: 203069 - DNA, 5379 bp, Artificial Sequence
  Description of Artificial Sequence: Synthetic coding sequence
atgagctgcgtgcactacaagttcagcagcaagctgaactacgacactgtgacctttgacgggctacatatctctttatgtgacctgaaaaaacagatcatggggcgcgagaagttaaaggctgcagactgtgacctccaaatcacaaacgcccagaccaaagaagaatatactgatgacaatgctctgattcctaagaactccagcgttattgtgcgacgcatcccaattgggggagttaaaagtacctccaaaacttacgtgattagccggaccgagccagccatggcgactactaaggccatcgacgactctagcgcttctatctccctcgcccagttgacgaagacagcgaacctcgccgaggcgaacgcctccgaagaggataagataaaggcaatgatgtcacagagcggccatgaatatgacccaatcaactacatgaaaaagccacttggtcctccccccccttcatatacgtgtttcagatgtggcaagcctggacactacatcaagaactgtcccactaatggcgacaagaatttcgaatctggtccccggatcaaaaagtcaacgggcatcccacggagttttatgatggaggtgaaggaccccaacatgaagggcgctatgttgactaatacgggaaagtacgctattcctacaatagatgctgaagcctacgcgattggcaagaaagaaaagccaccatttctccccgaggagccgagtagtagttcagaggaggacgaccccattccagacgaactgttatgtctcatctgcaaggatataatgaccgacgcagtggtgattccttgttgcggtaacagctactgcgacgaatgcatcagaacggccctgcttgagagcgacgaacacacttgccccacctgccaccaaaacgatgtctctcccgatgcgctaatcgcaaacaaattcctccgtcaggcagttaataacttcaagaacgagacaggatataccaagcggctccgtaaacagctgccgccacctcctcctccaatccctccgcctcgtcccttgatccaaagaaacctccaacctctgatgaggtccccgatttctcgccagcaggatcctcttatgatacctgtcacttcttcttcgactcaccccgcaccgtccatttcttcccttacttcaaatcagagcagcctggcccccccagtctccgggaacccatcttccgcccctgcccctgtgcccgacatcacggcaaccgtcagtatcagcgtacactcagagaaaagcgacgggccgtttcgagattccgacaataagatcctgcccgctgccgcgctggcatctgaacacagcaagggcacatctagtatcgccattactgccctgatggaagaaaagggatatcaggttcccgtccttggcacaccgagcctcctggggcagagtctgctgcacggccagttaatacccacaactgggcccgtgagaattaatactgcgcggcccggaggaggacgacccggatgggaacattcaaacaaactgggatatcttgtgtccccacctcagcagatcaggaggggggagcggagttgttataggagcattaatcgcgggcgccaccactccgagcgatcgcagcgtactcaaggcccctccctccctgctacccctgtctttgtacctgtcccaccgccacccctgtatcctcctccaccccatacccttccactcccgccaggtgtccctccccctcaattctctcctcagtttccaccaggacagccgccgccagccggatacagcgttccaccaccaggctttcctccggcaccggccaacctgtccacaccatgggtctcctccggcgttcaaacagcccacagtaatactattcctaccacgcaggctcctcccctcagccgcgaggaattttatcgggaacagcgccggttaaaggaagaggaaaagaaaaaatcaaagctggacgagttcacaaacgacttcgccaaggaactcatggaatacaagaaaatccagaaggagcggcgtcggtccttctcccgcagtaaatccccatactctggatctagttatagtcgctcatcttacacttattcaaaaagccggagcgggagtacacgcagtcgttcctattcccgctcattttcaagaagccattcaaggagttacagccggtctcctccctaccctaggcgtggcaggggcaagagtagaaactatcgctcacgcagcaggtcccatggataccaccgaagccgtagccggagcccaccgtaccggagataccattcaaggtcacgctctccccaggcgtttcgcggacaatctcccaacaaaagaaatgtccctcagggagagacagaaagagagtacttcaacaggtacagggaggtcccgccaccgtatgacatgaaggcatattatgggcgatccgtggacttcagggatccgttcgagaaggaaaggtatagggaatgggagagaaagtacagagagtggtacgaaaagtactataagggctacgcagccggcgctcagccacgaccgtcggctaaccgggagaatttctcaccagagagatttttgcctctcaacatcaggaactcaccttttacgcgcggacgccgcgaagattacgtgggcggccaatcccaccgctcacgcaatatcgggagtaattatccagagaaactgagcgcaagggacggccataatcaaaaggataatactaaatcaaaggagaaggaaagcgagaacgctccgggggacggcaaaggcaataaacacaagaagcacagaaaacgcagaaagggcgaggaatcagagggctttctgaaccccgagctgctcgagacttcacgcaagagtcgcgagccaactggcgtcgaggaaaacaaaactgattcattatttgtgctgcccagtcgcgatgacgctacaccagtacgcgacgagccgatggatgccgagtccattactttcaagtcagtttctgagaaggacaaacgggaacgtgacaaaccaaaggccaaaggagacaagaccaagaggaaaaacgacggatctgcagtgagcaaaaaagagaacattgtaaaacctgccaaggggcctcaggagaaggtggatggggagcgggagcgcagtccgcggtctgaacccccgattaagaaggcgaaagaggagacacctaagaccgacaacacaaaatcgagttcaagctcacagaaggatgagaaaatcacaggcaccccgcgaaaggcccattcaaagtctgcaaaggagcatcaggaaactaaacccgtcaaggaagagaaggtcaaaaaggattacagcaaggacgtgaagagcgagaagcttacaaccaaagaggaaaaggcaaaaaagcctaacgaaaaaaacaagcccctcgataataagggagagaaacggaaacggaagacagaggaaaagggagtcgacaaggatttcgaaagcagttctatgaagatcagcaaacttgaggtgactgagatcgtgaagccttcacccaagcgcaaaatggagccagatactgaaaagatggatcgaacccctgaaaaagataaaatcagcttgagcgctccggcgaagaagattaagcttaacagagaaactggcaaaaagattggatccacagagaatatttccaatacaaaagagcctagcgaaaagctcgaaagcaccagctcaaaagtgaaacaggaaaaagtgaaaggaaaagtgcgcagaaaggttacaggaacagaggggagcagtagtactctggtggattatacatccacctcttctaccggcggcagccctgtgagaaagagtgaagagaagacagatactaagcggaccgtgatcaagactatggaggaatataacaacgataataccgctccggctgaagacgtgatcatcatgattcaggtgccacaatcaaagtgggataaggatgatttcgaatctgaagaggaggacgtgaagagtactcagcctatctcctctgtaggcaagcccgcgtccgtgatcaaaaatgtcagcaccaagccgtctaatatcgtgaagtaccccgagaaagaatctgaaccatccgagaagatccagaaattcactaaggacgtgagtcacgaaattattcaacacgaggtgaaatcctccaaaaacagtgcctcatctgagaaagggaagacaaaagatcgagattactccgttctcgagaaagagaaccctgaaaagagaaagaattcaacccagccagaaaaggaatcgaaccttgaccgcttgaatgagcagggaaattttaagtctctgtcacagtcttcgaaagaggctcggacgtcagacaagcacgacagcacgcgagcgagttctaataaggatttcacccctaatcgggataaaaagaccgattatgacacccgggaatactcctcaagcaagagacgagatgaaaagaacgaacttactaggaggaaggatagtccatccagaaataaggactccgccagtggtcagaagaataagccaagggaggagagggatctgcccaaaaagggaactggggattccaaaaagtccaattcaagtccatccagagaccggaaaccacatgatcataaagccacatatgatacaaagagacccaacgaggagaccaaatctgtggacaaaaacccgtgcaaagatcgcgaaaagcacgtgttggaagcaagaaataacaaggagagcagcgggaataagttactgtatatactcaatcctcccgaaacccaggtcgagaaggaacagattaccggacaaattgataaatctacagttaaaccaaaaccgcagctgagtcactcatccagactctcaagcgatctgacgcgagagactgacgaagctgccttcgagcccgattataacgaaagtgacagcgaatcaaatgtgtctgtgaaggaggaggagagctctggaaatatttcaaaggacttgaaagacaagatcgtcgaaaaagcaaaggagtcattagacactgccgcagtggttcaggtgggcatcagcagaaatcagagccatagttcaccatccgtatccccaagcaggtcccattctccttctggttcccagacaagatctcattcctcatcagcttccagcgccgaatcacaagattccaaaaagaaaaaaaagaaaaaggaaaaaaaaaagcataagaagcataagaaacataagaagcataaaaagcatgccgggacagaagtcgaattggaaaagtcgcaaaaacataagcacaagaagaagaaaagcaagaagaacaaagataaagagaaggagaaagaaaaagacgatcaaaaggtgaagagcgtgacagtttag

SEQ ID NO: 203070 - DNA, 5277 bp, Artificial Sequence
  Description of Artificial Sequence: Synthetic coding sequence
atgagctgcgtgcactacaagttcagcagcaagctgaactacgacactgtgacttttgatgggctgcatatctccctgtgcgatcttaaaaagcagatcatgggtcgagaaaagctcaaagccgcggactgtgatctgcagattacaaacgcgcagaccaaggaagagtataccgatgataatgctcttatacccaaaaattcgagcgtgattgtccgcaggattcctatcggtggcgttaagtcaacaagcaagacctacgtgatttctagaacagagccagcaatggccaccaccaaagcaatcgacgactcttccgcgagcatttcgctagctcagctcactaagaccgctaacctggcagaagccaacgcctctgaagaagataagataaaggccatgatgtctcagagcggacacgagtacgatcctattaactatatgaaaaaacccttgggtcctccacctccgtcctatacctgtttccggtgtgggaagcctggacattacatcaagaattgtcctaccaacggcgataaaaattttgagagtggaccacgcataaaaaagtccacaggaatcccccggagcttcatgatggaggtgaaggatccaaatatgaagggagccatgctgactaataccgggaagtatgctatacccactattgatgccgaagcctatgcaattggaaaaaaagagaagccacctttcctgccagaggagcccagctccagtagcgaggaagacgacccaataccagacgagctcttgtgtttgatatgcaaggacatcatgactgacgctgtggtcatcccttgctgtggaaacagctattgcgacgagtgtatccgcacagccctgctggaaagtgacgagcacacctgtccaacatgtcaccagaatgatgtatcccccgatgcccttattgcaaataagtttctccgccaggctgtgaacaattttaagaatgaaactggctacactaagagattacgtaagcaactccccccccccccgcctccaattcccccacctagaccacttattcagcggaatctgcaacctctcatgcggtcgccaatcagccgccaacaggatcctctcatgatcccagtaacaagttcatcaactcacccagctcctagcatcagtagtctcaccagcaatcagtcttcgcttgcacccccagtttctggtaatccctcctccgctcccgcgcctgtacctgacatcacggcaaccgtttcgatctctgtgcacagcgagaaatctgatgggccctttagggactctgacaacaagatcctcccggccgctgcactggcaagcgagcatagcaaaggcacaagctcaatcgcaattacagccctgatggaagaaaaggggtaccaggtgcccgtgctcggtaccccgagcctcctcggccagagcttactacacggtcagctgatccctacaactggcccagtcaggataaacacagctagacctggtggcggtaggcccggatgggaacatagcaataaactcggatatctcgtgtcgcctccccagcagattcggcggggagagcggagttgctaccgcagcattaacaggggcaggcatcacagcgagcgttctcagaggacacagggaccgtccctgcctgccaccccagtttttgtacctgtaccaccgccgccactctatccgcctcctccccacacactccctttacccccaggagttcctcccccacagtttagcccacaatttcctccggggcagccaccaccggctgggtacagcgtgcctcctcccggctttccccctgcgcccgctaacctgtccactccctgggtgtcaagcggtgtgcagactgcgcactcgaacaccattcccactacacaagccccacctctttccagagaagagttttatagggaacaacgccggcttaaggaggagagcaagagtccgtattccgggtcaagctacagccggtccagctatacgtactccaagagccgctctgggtcaaccagatcacggtcctattccaggagcttctctagatcgcattccagatcttatagtcggtcacccccctacccaagaagggggcggggtaaaagccgcaactaccggagtcgctcacgctcgcatggctaccatcggtctagaagccgtagccccccctaccggagatatcattccaggtcccggagtccacaggctttccgtggccaatctcccaacaagaggaatgttcctcagggcgaaactgagcgtgagtatttcaatcgctatagagaagtgcccccaccttacgatatgaaagcatattatggcaggtcggtggactttcgtgacccatttgagaaggaaagataccgggagtgggagcgaaaatacagagagtggtacgagaagtactacaagggatatgcagcaggcgcgcagcctcgcccttccgcgaaccgtgaaaactttagccctgaacgcttcctaccacttaatatacggaatagtccttttactaggggaaggcgcgaggattatgtgggcgggcagtcacatcgctctcggaacattgggtctaattaccccgaaaaactgtccgcacgtgacggccacaatcagaaagataatactaaatcaaaggagaaggaaagtgagaacgcaccgggcgatggaaagggcaataagcacaagaagcaccgaaaacggcgcaagggcgaagagtcagaggggttccttaatccagagttactggagaccagcaggaagtcaagagaacccactggagtggaagagaacaagaccgactctctgttcgttctccctagccgggatgatgcgacccccgtacgcgacgagcctatggacgccgagagcataacgtttaagtcggttagtgagaaagacaagagggaacgagataaacctaaggccaagggggacaagacgaaaaggaagaacgacggcagtgcagtgtctaagaaagaaaacatcgtcaagcccgcaaaagggccacaggagaaggttgatggggagagagagcgcagtccacgatccgagccacccatcaaaaaagccaaagaagaaacgcccaagacagacaatacaaagtcatcttcttcgtcacagaaggacgagaagataaccgggacacctcgcaaggcacattctaaatccgccaaggagcaccaggagacgaagccagtcaaggaggaaaaggtgaaaaaggattactcaaaggacgtgaaaagcgaaaagctaacaacgaaagaggagaaggccaaaaaacctaacgaaaaaaacaagcccctggataataaaggcgaaaaaagaaagagaaaaaccgaagagaagggggttgacaaggattttgaatctagtagtatgaaaattagcaagctggaggttaccgaaattgtgaagccatcgccaaagcgtaagatggagccggatacagagaaaatggaccgaacacccgaaaaagacaaaatcagtttgtctgctcctgcgaaaaaaattaaacttaatcgtgagactggtaaaaaaattgggtccactgaaaatattagcaatacgaaggaaccttctgagaagctggaatctacatcaagtaaagtgaagcaggaaaaggtgaagggtaaggtgcgaagaaaggtcactgggactgaggggtcgagcagtacgctggtggactacacatctactagtagcaccggcggcagtccagtcagaaaaagcgaggagaagacggacaccaaacggactgttataaagaccatggaggagtacaataacgacaatactgcaccagccgaggatgttattattatgatccaagtgcctcagtctaagtgggacaaagacgattttgagagcgaagaagaggatgtaaaaagtacgcagcctatctcatcagtgggaaaaccagcatcggtgattaaaaatgtttctacaaagccatcaaatatcgtgaagtaccctgagaaagagtcagaaccctctgagaagatccagaagttcaccaaggatgtcagccacgagataattcaacatgaagtcaaatcttctaagaattcggcatcaagcgagaagggcaaaacgaaagacagggattattcagtgcttgaaaaggaaaatcctgagaagagaaagaattccacccagcctgaaaaggagtctaacctggatagattaaacgagcaaggaaactttaagtccctctcccaaagctcaaaagaggcccgaacttcagataagcatgattcaacacgggcttctagcaataaggactttacaccgaatcgggataagaagactgactacgatactagggagtatagctcttctaagcgtcgggacgaaaagaatgagctcacgcgtaggaaagacagcccttctcggaacaaagattctgcttcaggccagaagaacaaaccgcgcgaggaaagagatttaccaaaaaaaggtacgggagattcaaagaagagcaacagctcacccagccgggataggaagccccacgaccacaaggccacctacgacacaaagaggccaaacgaagagaccaaaagcgtggacaagaacccctgcaaagatcgagaaaagcacgtgctcgaagcccggaacaataaggagtcgtccggaaataaacttctgtacatcttgaatcctcccgagactcaggtggaaaaagaacaaataaccggccaaattgacaaaagtaccgtcaagccaaagccacagctaagccattccagcagactgagctccgacctaacacgtgagacagatgaagccgccttcgagcccgattataacgagtccgactctgaatcaaacgtgtccgtgaaagaagaggaatccagtggaaatatctcaaaggacctcaaagacaaaatcgtagaaaaggctaaagaatcattggatactgctgccgtggttcaggtagggatcagcaggaatcagagtcacagcagtccctctgtctctccatcacggtcccacagccctagtggttctcagacccggtcccactctagtagtgctagtagcgccgagtcccaggatagcaagaagaaaaagaagaaaaaggagaaaaagaagcacaagaagcacaaaaaacacaaaaagcataaaaagcatgccggtacagaggtggagcttgagaagtcacagaagcacaagcacaagaaaaagaaatccaagaagaacaaggacaaggagaaggaaaaagaaaaggacgatcaaaaggtgaaatcagtgacggtgtag

SEQ ID NO: 203071 - DNA, 2859 bp, Artificial Sequence
  Description of Artificial Sequence: Synthetic coding sequence
atgagctgcgtgcactacaagttcagcagcaagctgaactacgacacggtgacattcgatggactgcatatcagcctctgtgatctgaagaagcagataatgggccgcgaaaagcttaaagccgctgactgcgacctacaaattacaaacgcccaaacaaaggaggagtacacagacgataacgcattaattcctaagaattcctccgtcattgtcagacgcattcccataggaggcgtgaaatcaacctctaagacttacgtgatcagtagaacagagccagcgatggccacaacgaaggccattgacgattcctctgccagcatctcactagcccagctgactaaaactgccaacctcgcggaggcaaatgcaagtgaggaggacaaaattaaggcaatgatgtcacagagtggacacgagtacgatccaattaattatatgaagaagcccttaggccccccacccccctcatacacttgcttccggtgcgggaaacctgggcattacattaaaaattgccccactaacggagataagaattttgaaagcgggcctagaatcaagaagtcgaccggcattcctagaagttttatgatggaggtcaaagatccgaatatgaaaggggctatgctgaccaacaccggaaaatatgccattcccacaatcgacgccgaggcctacgcaataggcaaaaaagagaaaccgccatttctgccagaagagccttccagcagttcggaggaagatgaccctatccccgacgaactgctctgtctgatctgcaaggatatcatgacggatgcagtagttataccctgctgcgggaatagctattgtgatgagtgtatcagaaccgccttactggaatccgatgagcacacctgtccaacatgccaccaaaatgatgtgtcccctgatgccttaatagcgaacaaatttcttcgacaggctgtcaataattttaagaatgagacagggtacaccaaacgcctgcgtaaacagctcccaccccctccgcctccgatacccccaccccgccccctgattcagagaaacctgcagccattaatgcggagtccaatctcccgccagcaggaccctctcatgattccggtgacttcaagcagcacccacccagcaccatctatatcctctcttacgtccaatcagtcctccctcgcacctccagtgagtgggaatccatccagcgcacccgccccagtgcctgacatcactgccacagtctcaatctccgtgcacagtgagaagagcgacggccccttccgcaccagcagcaccgggggatcgcccgtgcgtaaatcagaagaaaagaccgatacaaaacggacagtcattaagacaatggaagagtataacaacgacaacaccgctccggctgaggacgtcatcattatgattcaggtgccccaatcaaaatgggataaagatgacttcgagtcagaggaagaggatgttaagagtactcaaccaatcagcagtgtcgggaaacccgcctccgttattaagaacgtgagcactaagccatccaacattgtgaagtatcctgagaaggagtccgagccctctgagaaaatccagaagttcaccaaagacgtgagccacgagatcattcagcatgaggtgaagtcgtcaaagaattccgctagttcagaaaaaggtaagacgaaggatagggactattccgtgcttgaaaaggagaatcccgagaagagaaagaactctacacagcctgaaaaagagtctaacctagacaggctcaacgagcaaggcaacttcaagtctctctcacagagctctaaggaggctcggactagtgataagcatgattctacccgtgccagctctaataaggactttacgccgaaccgcgataaaaagacagactatgacacacgagaatactctagcagcaagagacgggacgagaaaaacgaactgacccgaagaaaggattcccctagccgtaataaagacagtgcgagtggacagaaaaacaagcccagggaagaacgtgacctgcccaagaagggcactggggatagtaaaaagtctaactcgtctccatcgcgagatcgaaaacctcacgaccataaggccacttatgacactaagcgccccaatgaggaaaccaaatctgtcgataaaaatccgtgtaaggaccgggagaagcatgtcctggaggccaggaataacaaggagagctctgggaataagttattgtatattctcaaccctccagaaactcaagtggaaaaggagcagatcacaggccagatcgacaaatcaacagtgaagcccaagcctcagcttagccatagttctcgcctgtcctctgacctcactcgggaaactgacgaagccgcctttgaacccgactacaatgaatctgattccgaatccaatgtttcagtaaaagaagaggagtcgagtggaaacatttcaaaggatctgaaggacaagattgttgagaaggctaaagaatctctcgatacagcggcagtcgtgcaggtgggaatttcgagaaaccagagccattcctcaccaagcgtctcaccaagtcgctcacattccccgagcgggtcgcagaccagatcccactcctcctccgccagctcagccgagtcccaggactctaaaaaaaaaaaaaaaaaaaaagaaaagaagaagcacaaaaagcacaaaaagcataaaaaacacaagaaacacgcagggactgaggtggagctggaaaagtcccaaaagcacaagcataaaaaaaagaagtctaagaaaaataaggacaaagagaaagagaaagagaaggacgatcagaaagtgaaatcggttacagtctag

SEQ ID NO: 203072 - DNA, 357 bp, Artificial Sequence
  Description of Artificial Sequence: Synthetic coding sequence
atgagctgcgtgcactacaagttcagcagcaagctgaactacgacacggtcacattcgatgggctccacattagcttatgtgacttgaaaaagcaaatcatgggccgggaaaaattaaaggccgccgattgcgacctccaaatcactaatgcccagaccaaggaggagtacacagacgataatgcgctgatcccaaagaattcctccgtgattgtgagacgaatcccaattggcggtgtgaaatccacctccaaaacctacgtcatttcaaggaccgagcctgcgatggccaccaccaaggctgtgtgtaaaaacaccatcagtcacttcttctatacactcttgctcccgctgtag

SEQ ID NO: 203073 - DNA, 1410 bp, Artificial Sequence
  Description of Artificial Sequence: Synthetic coding sequence
atggccgccgaggccggcgtggtgggcgccggcgccagccccgacggagactggcgggatcaagcctgtggactgctgttgcatgttcacctgagttcccgattgggccgcgcagcgcccgtccggactggccggcacttgcgaactgtcttcgaggacacagtggaggagcgggtcatcaatgaagaatataagatttggaagaaaaataccccattcttatatgaccttgtgatgacccatgcactgcagtggccctccttgaccgtacaatggctgcctgaggttactaagccggagggaaaggactacgctcttcactggcttgtccttggcacacacacaagtgatgagcagaatcacctggtcgtggcacgcgtgcacatcccaaatgacgatgcacaatttgatgcctcccactgcgacagcgataagggggaatttggcgggttcggatccgtaaccgggaaaatcgaatgtgagatcaaaatcaatcatgagggggaagtgaatcgcgcaaggtacatgcctcaaaacccccatatcatcgctactaaaactccatccagcgatgttctggtctttgactacaccaaacacccagccaagcctgacccttcaggggagtgcaatcccgacctgcgactgagaggccaccagaaggagggttacgggctatcttggaattccaacctttccggacatcttctaagtgcttcggacgaccacaccgtttgtctgtgggacattaacgctggaccaaaggaaggcaaaatcgtggacgccaaagccatcttcacgggccattctgccgttgttgaggatgtggcttggcacttgctgcatgagtccctcttcggatcagtggctgatgatcagaaattgatgatatgggacactcggagtaacaccacttcaaaaccatcacatctggtagacgctcacaccgcggaggtaaattgcctatcctttaatccttacagtgaatttatcttagcgaccggcagtgcggataagacggtggccctctgggacctgcgaaacttgaaacttaagctgcacactttcgagtcccacaaggacgaaattttccaggtacactggagtccgcacaatgaaaccattctagccagttccggcaccgataggcggttgaatgtttgggacctgtcaaagattggggaagaacaatctgctgaggatgctgaagacgggcctcccgagctcctgttcattcacggaggacacacggccaaaatttccgatttttcttggaaccccaatgagccttgggtgatttgcagtgtcagcgaggataacattatgcaaatctggcagatggccgaaaatatctacaacgacgaggagtctgatgtcactacaagcgaacttgagggccagggtagctag

SEQ ID NO: 203074 - DNA, 1278 bp, Artificial Sequence
  Description of Artificial Sequence: Synthetic coding sequence
atggccagcaaggagatgttcgaggacaccgtggaggagcgggtgattaacgaggagtacaagatctggaagaaaaacactccctttctctatgacctggtgatgacccatgctctgcaatggccctcattgacagttcaatggctccccgaagtcaccaagcctgaagggaaagattacgcgctccattggttagtgctgggaacacacacctccgacgagcagaatcatttggtggtggcccgtgtgcatattcctaatgatgatgcccagttcgatgccagtcattgtgattccgacaagggtgagtttggtgggtttgggtccgtaacagggaagattgagtgcgagatcaagattaaccacgaaggggaggtgaaccgcgctagatatatgccccagaacccacacattatagccacaaaaacccccagtagtgatgttttggtgtttgactatacaaaacacccagccaagccggatcccagtggtgagtgtaacccggacttacgtctgcggggccatcagaaagagggatatggcctttcctggaattccaatctttcagggcacctcctgagtgcatcagacgaccacaccgtttgtctgtgggacattaatgcgggacctaaagagggaaaaattgtggatgccaaggctatcttcaccgggcactcagccgtcgttgaagatgtggcctggcatttactacacgagtccctctttgggagcgtggcagatgatcagaagcttatgatctgggatactcggagcaacactacctctaagcctagtcacctagtcgatgcccacacagcagaagtgaactgtctatcattcaatccttatagcgaatttatccttgcaacaggaagcgccgataagactgttgctctctgggacctacgcaatctgaaactgaagctccatacatttgaatcgcacaaggatgaaatattccaggtccattggtctccccacaatgaaaccatcctagcatcttctggcacggatcggaggttaaacgtgtgggacttgtctaagatcggcgaagaacaatcagcagaggatgcagaggatggacctcctgagttacttttcatacacggaggacacactgccaagatttctgacttctcctggaatcccaatgagccttgggtgatatgttcggtttctgaggataatataatgcaaatttggcagatggctgaaaacatctacaacgatgaggagtccgatgtgacaacatcagaactggagggccagggatcctag

SEQ ID NO: 203075 - DNA, 1251 bp, Artificial Sequence
  Description of Artificial Sequence: Synthetic coding sequence
atggccagcaaggagatgttcgaggacaccgtggaggagcgggtgatcaacgaagagtataagatttggaaaaagaacacacccttcctctacgaccttgttatgacccatgccctccagtggccctccctgaccgtccagtggctacccgaagtcacaaaacccgaggggaaggactacgcgctccactggctggtgctgggtacacatacctccgacgagcagaaccacctcgtcgtggcgcgggtgcacatccccaatgacgatgcacagtttgacgcctcccactgtgattccgacaaaggcgggaagatcgagtgcgaaattaagattaaccacgagggcgaggtcaaccgggcgcgctatatgcctcaaaatccccatatcattgccacaaaaactccttcctcagacgtactggtcttcgactatactaaacacccggctaaaccggacccgtctggagaatgtaaccctgatctccgcctgcggggacatcagaaggagggatatggtctgagttggaacagcaatttgagcgggcatttgctgtctgccagcgatgaccacactgtatgcctctgggatatcaatgccggccccaaagaaggtaagatcgtcgacgcaaaggctattttcactgggcactcggccgtggtcgaggacgtggcatggcaccttttgcatgaatccttatttgggtcggtcgccgacgatcagaagctcatgatctgggacactcggtccaacaccacatcgaagcccagccacttggtcgacgcgcacaccgccgaggtcaattgcttaagtttcaatccgtacagtgaattcattctggccacagggtccgcagacaaaaccgtggctctatgggatcttcgcaaccttaagctaaaactccacacctttgaatcacataaggatgagatttttcaagtccactggtctcctcacaacgagacaatcttagcaagcagcgggacagaccggcgcctgaatgtatgggatctctcaaaaatcggtgaggagcagtcagctgaagacgccgaggacgggccacccgaactcctgtttatacatggagggcatacagccaaaatatccgacttctcatggaaccccaatgagccatgggttatctgctctgtgagcgaagacaatatcatgcaaatttggcagatggccgagaatatttataatgacgaggaaagcgatgtgaccacgagcgagttggagggccagggctcttag

SEQ ID NO: 203076 - DNA, 561 bp, Artificial Sequence
  Description of Artificial Sequence: Synthetic coding sequence
atggccagccccagcaaggccgtgatcgtgcccggcaacggcggcggagatgtgactacccatggatggtacggatgggtcaaaaaggaactggagaagatccctggattccagtgcttagcaaagaacatgcccgacccgatcacagcccgcgagtccatatggctgccctttatggagacagagctgcactgtgacgaaaaaactattatcatcggccattcatccggggcaattgccgccatgcgctacgccgagacacaccgcgtctatgcaatagttctggtctctgcctacactagcgaccttggtgatgaaaatgaacgggcatcagggtactttacacgcccctggcaatgggaaaagatcaaagccaattgcccatatatcgtgcaattcgggtcaaccgatgacccattcctgccatggaaggaacaacaggaagtggcggaccggctagaaactaagctgcacaaatttaccgattgtgggcatttccagaatactgagtttcacgagttgattaccgtcgttaagtctctgttgaaggtgcctgcctag

SEQ ID NO: 203077 - DNA, 519 bp, Artificial Sequence
  Description of Artificial Sequence: Synthetic coding sequence
atggccagccccagcaaggccgtgatcgtgcccggcaacggcggcggggacgttacaacccatgggtggtacggatgggtcaaaaaagagctggagaagatccccgggtttcagtgcctggctaaaaacatgcccgaccctataacagcacgcgagagcatctggttgccatttatggaaacagagttgcattgtgacgaaaagaccattataatcggacatagcagtggagctatagctgccatgagatatgcagagacacatagagtgtatgcgattgtgcttgtgagcgcttatacctccgatctgggcgatgaaaatgaacgagcctcaggatacttcaccagaccctggcagtgggaaaagatcaaggctaactgcccatacattgtgcaatttgggtctaccgacgaccccttcctgccgtggaaggaacagcaagaggttgcagactggaagcctaactgcacgaattcgctgactgtggcaacattccgcacccagtccttcatgaactag

SEQ ID NO: 203078 - DNA, 741 bp, Artificial Sequence
  Description of Artificial Sequence: Synthetic coding sequence
atggccgccgccgccatccccgccctgctgctgtgcctgcccctgctgtttttactgttcggctggagccgcgcccgtagagacgacccccactcactttgctatgatatcaccgtcatacctaaatttagacctgggccacgctggtgcgccgtgcaggggcaagtggacgaaaagactttccttcactatgactgcggaaataaaacagtgacgccggtctcgcccctggggaagaagctgaacgtcaccatggcttggaaagcacagaaccctgtgctccgagaggtcgtggacattctgacagagcagctacttgatatccaactcgagaactatactccaaaagaaccacttaccttacaggccagaatgagttgtgagcagaaagcagaagggcactcttctggatcctggcagttctccatcgacggccaaacattccttctgttcgattcagagaagcggatgtggaccaccgtgcaccccggagctcgtaaaatgaaggaaaagtgggaaaatgataaggacgtcgcgatgtctttccactacatttctatgggagactgtataggctggctggaggattttttgatgggcatggactcaacccttgaaccctccgcaggcgccccactcgctatgtctagtggcaccactcagctgagggctaccgcaaccactctcatcctttgctgcctgttaattattttgccatgcttcattcttccaggcatttag

SEQ ID NO: 203079 - DNA, 741 bp, Artificial Sequence
  Description of Artificial Sequence: Synthetic coding sequence
atggccgccgccgccatccccgccctgctgctgtgcctgcccctgctgttccttctgtttggttggagcagggcaagaagggacgatccccacagtctctgctacgacatcacagttatccctaaattcagacctggaccccgctggtgcgcagtccaggggcaagtagacgagaaaacattcctccattatgattgtggaaacaagactgttaccccagtttcccccctcggcaaaaaactgaacgtgacaatggcctggaaagctcagaacccagttcttcgagaggttgtagatattctgaccgagcagttgttagatattcagcttgagaactacacacctaaagagcccttaacattgcaagcaaggatgtcttgcgagcagaaggcagagggccattcttctggtagctggcaattttccatcgacggacagacatttctgctgtttgattccgagaagaggatgtggacaacggtgcacccaggcgctcgaaagatgaaggagaagtgggaaaatgataaggacgtcgcaatgtctttccattatatttccatgggcgattgtattggatggctggaggactttttgatgggtatggacagcactctggagccaagcgctggtgccccactggctatgagctccgggaccacccagctgagagccactgcaaccaccctcattctttgctgtctgctaatcatcctgccttgctttatactgcccggaatctag

SEQ ID NO: 203080 - DNA, 4923 bp, Artificial Sequence
  Description of Artificial Sequence: Synthetic coding sequence
atgcagagcttccgggagcggtgcggcttccacggcaagcagcagaactaccagcaaacctctcaggagacttcacggctcgaaaattacagacaaccttcccaggcgggactgtcatgcgacagacagcgtctgttggcaaaggattattacaatccacagccttatcccagctatgaaggaggcgctggcacgccctcaggcacggccgccgctgtggctgctgataagtatcatagagggagtaaagcgctacccacccagcagggactacaaggaagaccagcctttcccggctacggcgtgcaagactcaagcccctacccaggtcgttatgccggagaggagtccctccaggcttggggagcaccccaacctcctcctccgcaacctcagccgcttcccgccggtgtcgcaaaatacgatgagaaccttatgaagaaaacagctgtgccacccagccgccaatatgctgagcaaggagctcaggtcccgttcaggacccactccctgcatgttcagcagccccccccgccacaacaacctctggcctatcccaaactacaaaggcaaaagctgcaaaatgacattgcatcgcccctaccttttccacaaggaactcattttccacagcattcacagagcttcccaacttccagcacatattccagttctgtgcagggcggaggccagggagctcattcgtataaatcctgtacagcgccaaccgcacaaccccatgatcgacccctcacagctagcagctccctggcgcccggacagcgagttcaaaatctgcacgcctatcagtcaggcagactgagctacgatcagcagcagcaacagcaacagcagcagcagcaacagcagcaggctcttcagtcccgccaccatgcgcaggaaacactgcactatcaaaatctggccaaatatcagcactatgggcagcagggacagggctattgccaacccgacgcggccgtacgcactcctgaacagtattaccagaccttctcccccagcagttcacacagtcctgcacgctctgtcggaaggagccccagctactcctccacgccatcacctttgatgccgaatctggagaatttcccatatagccaacaacccttgtcaaccggtgcctttcccgctggaatcactgaccacagtcattttatgcctttgcttaacccttcaccgaccgacgccacatcttcagttgacacccaagccggcaattgcaagcccctccaaaaagacaagctcccagaaaacctgttgagcgatctatctttacagagcttgactgccctgactagccaagtagagaatatttctaacaccgtgcagcaactgctgcttagcaaggctgccgtacctcagaagaagggcgtgaagaatctcgtttctcggactcccgaacagcataaatcacagcattgctcccccgagggatctggctatagtgccgagcccgccggtacacctttgagcgagcctccttcttcgaccccccagtctacccatgccgagccccaagaagccgattacttgtcaggctcggaagacccgttagagaggagcttcctgtactgcaaccaagctagaggttcaccagcccgcgtgaattctaattcaaaagccaagcccgaaagcgtgtctacatgctcagtgacgtcgccagacgacatgtcaaccaaatcagacgatagtttccaaagcctgcatggtagcctgcctctcgacagtttctctaagttcgtggcaggggagcgtgactgtccccgcctgctgctttctgcacttgctcaggaggatctcgcttcagagatcttaggactgcaggaagccataggcgaaaaggcagacaaggcatgggccgaggcaccatccttggtgaaggactccagcaaacctccgttctcactagagaatcacagcgcctgtctggattcagtggcgaagtcagcgtggccccgccctggagaaccggaagctctgccagattctctacagcttgacaaaggaggtaatgccaaggatttttctcctgggctattcgaggacccatccgtggcctttgcgacaccagatcccaagaagacaacagggcccttgagtttcggaacaaaaccaacactcggtgtgcctgcccccgatccaaccaccgccgcattcgactgctttcccgacacaacggccgcatcaagcgctgactccgcaaaccctttcgcatggcccgaggagaatctgggggacgcctgcccacggtgggggttgcatcctggtgaacttacaaagggtctggaacagggtgggaaagccagcgacggcattagcaagggggacacacatgaagcaagtgcctgtctggggtttcaggaagaggacccacctggcgaaaaagttgcgtctcttcctggcgacttcaagcaggaagaagtcggaggcgtgaaagaggaggccggaggccttcttcagtgtccagaagtcgctaaggcagatcggtggttagaagattccagacattgctgcagcactgctgatttcggcgaccttcctctcttaccccctacgtctagaaaggaagacctcgaggcagaggaagagtattcgtctctttgcgagttgctcggcagcccagagcagcggccaggaatgcaggaccccctgtcaccaaaggccccactgatctgcacaaaagaggaggtggaggaggttctggacagcaaggccggatgggggagtccatgtcaccttagtggtgagagcgtaatcttgctggggccaactgttggcaccgaatctaaggtgcagtcttggtttgagagctctctttcccatatgaaaccaggagaggagggcccagacggcgagagggccccaggagactcgacaacaagcgatgcttccctggcacagaagcccaataaacccgccgttcccgaggccccaatcgctaaaaaagaacctgtgccacgaggcaaatctttaaggagtcgaagggttcacagagggcttcccgaggctgaggacagcccctgccgggcaccagtcctgcccaaagatctcctgctgccggaatcatgtacgggtccgccacagggccaaatggagggggcaggtgcaccggggcgaggtgcttctgaaggactccccagaatgtgcacccgttccctgacggccctttccgagccccggacacccggtcctccaggcctgaccaccacaccggctccccctgacaaattggggggaaaacagcgggctgccttcaagtctgggaagagggtcggcaagccctcccctaaggcggccagttctccttcgaaccctgctgcattgccagtggccagcgattcctcgcccatgggctcaaagaccaaggagaccgactccccctcaacccctggcaaggatcaaaggtcaatgatcttgcgaagtaggaccaaaacacaggaaatctttcacagcaagcgccggagacctagcgagggccgtctgccgaactgccgggccactaaaaaactcctagacaacagccatctgcccgcaactttcaaggtctcctctagtccgcagaaggagggccgcgtgtcacagagagcaagagtgcccaaaccaggcgccgggtcaaaactgtcagaccgacccctccacgctctgaaacgcaagtctgcctttatggcccccgttccaactaagaagcgtaacttagtgttaaggagcagatcctcttcttcatccaatgcatctggcaatggtggagacgggaaggaggagagaccggaggggagtcccaccctattcaaaaggatgtcttcccccaagaaggcaaaaccaacaaaaggcaatggagaacctgctaccaaactgcctcctccagagactccagatgcttgcttaaagctggcttctagagccgcttttcagggcgcgatgaaaacaaaagtcttaccccctcggaaaggacggggcctgaaactagaggcaattgtccagaaaattactagccctagtctcaaaaagtttgcttgtaaagccccaggcgcttcgcctggcaaccctctgtctccctcgctgagcgataaagatcgtggtttgaagggagccggcgggtcccccgtcggagtggaagaaggtctcgtgaatgtgggtaccggccagaaacttcccaccagcggggctgatcctctgtgcaggaatccgaccaaccggtcattgaagggtaagctgatgaatagtaagaagctgagcagtaccgattgtttcaaaaccgaggctttcacatcacccgaggccctacagcctggtggcaccgcgcttgcccctaagaaacgctctcgaaagggccgagccggcgcccacggactgtctaagggacccttagaaaagcggccatacctaggtcccgccctcttgttgacacctagagatagagccagcggaacccagggtgcatctgaagataattccggtggtggcgggaaaaagcctaaaatggaagagctcggcctcgctagccaaccgccagaggggaggccatgccagccgcagactagggctcagaagcagcccggtcatactaattacagtagctacagcaagagaaaaagactgacaagagggcgagcgaagaacaccacatcatctccgtgcaagggtagagctaaacgccgaagacagcagcaagtgttgcccctggatcccgccgagcctgagataagactgaaatacatctcttcctgcaaaaggttacgctctgactcacggacacccgcctttagtcctttcgaaccatcactcggcgcccagaatcctagatcagggcagaatgccccacccgctcctgcagacgcccgtcccctttgcacaacccgtgatcgccgggcatatagtgcgagggagcaaggacagcgatag

SEQ ID NO: 203081 - DNA, 5589 bp, Artificial Sequence
  Description of Artificial Sequence: Synthetic coding sequence
atgcagagcttccgggagcggtgcggcttccacggcaagcagcagaactaccaacagactagtcaggaaactagtcgtctggagaactacaggcagcctagccaagccgggctctcatgcgatcgccagcggcttctggctaaagactactataacccacagccatacccttcatacgaaggcggagcaggaactccatccggaacagctgcagcagtggcagccgataaataccaccgcggtagtaaagcgctgccaacacagcagggactgcagggacgccccgctttccctgggtatggcgttcaggattctagcccttaccctgggagatatgccggggaggagagtttacaggcttggggcgccccccagcccccccctccacagccccagcctctgccagcgggggtcgctaaatacgatgagaaccttatgaaaaagaccgcagtacccccttcccgccaatacgctgaacagggggcgcaggtgccgttccggactcattcccttcacgtccaacagccacctcctccccaacagcctcttgcctatcccaagctccagaggcagaaactgcagaatgacatcgctagtcctctcccattccctcagggctggtgggctggtcacagctataaatcatgtactgctcctaccgcccagcctcatgataggcctctgaccgcaagctcctcgctagctcctggccagcgcgtccagaacctgcacgcatatcagagcggccggctctcttacgaccagcagcagcaacaacaacaacagcagcagcaacaacagcaggctctgcagagtagacaccatgcccaagagacactgcactatcaaaacctggccaagtaccagcattatggccagcagggacaggggtattgccagcctgatgcagccgtccgcacccctgaacagtactaccaaacgttctctccatccagttcccactcaccagctaggtcagtggggcgttctcccagttacagcagtacaccgtctcctctgatgcctaacctggagaacttcccctatagccaacagcccctgtccaccggcgcttttcccgcgggaattaccgaccatagccactttatgcccctcctgaacccgtcacccaccgatgcaactagttcagtggattctcttactgccttaaccagccaggtggaaaacattagcaacactgtgcagcagctgctcctgagcaaagctgcagttccacagaagaaaggtgtaaagaacctcgtctcccggactcccgagcagcataagagccagcattgttcaccagaaggttctggttatagtgcggagcctgccggcacgcccctaagcgagccaccgtcctccaccccacagtcgacacacgccgaacctcaggaagcagattacttgtcaggatctgaggacccactggagaggtccttcctgtattgcaatcaggccagagggagtccagctcgggtgaattctaatagcaaagctaaaccggagagtgtgtccacctgctcagttacatctcccgatgacatgagcactaaatctgacgattcatttcagagcttacacgggagcctgccactggactccttttccaagtttgttgccggagagagagactgcccccgactgctgctttccgcattggcgcaggaggacttggcatccgaaatccttggactccaagaggccatcggagagaaggccgacaaggcctgggctgaagctccttctctggtgaaggattcttctaagcctcctttctcactggaaaatcattctgcttgccttgacagtgtcgccaagagtgcttggcccaggcctggtgagccggaagctcttcctgactccctgcaattggacaaaggaggaaatgccaaggatttcagccccggcctgttcgaggacccttctgtagcgtttgctacccccgatccgaagaagaccacaggccctctctccttcggtactaaaccaacccttggggttcctgcgcctgaccctactaccgccgcattcgattgtttccctgatactaccgccgcaagctcagccgactcagcaaaccccttcgcttggcctgaggagaatctgggcgatgcatgccctaggtggggcctacatccaggagaactgaccaagggtctggaacagggaggaaaagcttctgacggcatctcgaagggcgatacccatgaagcctcagcctgtcttggttttcaggaagaagacccccccggcgagaaagtggcctccctgcctggggactttaaacaagaggaggtgggcggagtcaaagaggaagctggaggtcttctccaatgtcctgaagttgctaaggctgaccgatggctagaagatagcaggcactgctgctctacggctgacttcggtgatctacccctgttgccccctacatctcggaaggaggacctggaggcggaggaagaatactcttccctgtgtgaactcctaggcagtcctgaacagcggcccggaatgcaagatcccttgtctccgaaagcccctctgatatgcaccaaggaggaagtcgaggaggtgctggatagtaaagctggttggggctctccttgtcatttaagcggggagtccgttattctgctgggccctactgtgggaaccgagtccaaggtacagagctggtttgagagttccctgtcgcatatgaagcccggagaggagggacccgacggtgaaagggcacctggcgatagcaccacatccgacgcatcactcgcccagaaaccaaataagcctgcagtgccagaagccccaattgcaaaaaaggaaccagtgcctagaggcaagtcccttagatctagaagggtccacagaggcctgcccgaagcggaggattccccttgtcgagccccagtattacccaaggacctgcttctgccggagagttgcactggtccaccccagggccagatggaaggcgcgggcgctccaggtaggggtgctagtgagggactgccgagaatgtgcactcgctctctgacggcgctatcggagccccgaacccccggcccaccaggcctaaccaccactcccgcaccgccagacaaactgggcggtaagcagcgcgccgccttcaaatcaggtaaacgggtagggaaaccttccccaaaagcagcgtcgagtccaagtaacccagctgcgctacctgtagcttccgactcttcacctatgggcagtaagacaaaggaaacagatagtccttcgacaccaggtaaagaccagaggtctatgattctgcgctcacgcacaaaaacccaggaaatattccattctaaaagaaggaggccttcagagggaaggttgcctaactgcagggctacgaagaagttgctggacaactcccacctgcccgccactttcaaagtctccagcagcccccagaaggaaggtcgtgtgtcccagagggccagagtgccaaaacccggggctggcagtaaactcagcgaccggcctctgcacgctctgaagcgaaagagcgctttcatggcgcccgttcccacaaagaagcgaaacttggtcctgcggtccagatctagcagcagctcaaacgccagtggcaatgggggggacggtaaggaagagcggccagaggggtcccctacactattcaagcgaatgagcagccctaagaaagcgaaaccaacgaaaggcaatggagagcccgcaacaaagctcccccctcctgagacccctgacgcatgtttgaaattagcttccagagcagccttccagggagctatgaaaactaaggtcctccctcctcggaaggggaggggcctcaagcttgaggccattgtgcaaaagataacatccccaagtcttaagaaattcgcttgtaaagcacccggcgcctcacctgggaaccccctgtctccatcactgtccgataaagataggggcctcaaaggcgctgggggatcaccagtgggggttgaggaagggctggttaacgtgggaaccggtcagaagttacctacatcgggagccgatcctctgtgcagaaaccctactaataggtcattgaaaggcaaactcatgaataaccgggctagtggtacacagggggccagcgaggacaatagcgggggaggcggaaaaaaacctaagatggaagagttgggcctcgccagccagccaccagagggcaggccttgccagccacaaacaagggcacaaaaacagccaggacacacaaattactcaagctactccaagaggaagcgcttgaccagggggcgggcaaaaaatacgacttctagcccctgcaagggccgggcgaagagaagaagacagcagcaagtgctgcctctggacccagcggaaccggagatccgtctcaaatacattagctcatgtaagagacttaggtcggattcccgtacgccagctttttcacccttcgtgagggtggaaaaaagggatgcattcaccactatatgcacagtcgtaaactcacccggtgacgcacctaaaccgcatcgaaagccttcaagcagtgcatccagtagttcttcttcgtcttcgttctctctggatgccgccggagccagcctggccactctgccaggcggctccattctccagcctagaccctctttgcctttgtcctctaccatgcaccttggtcccgttgtctctaaggccctcagtaccagctgtctcgtctgttgcctctgtcaaaatcccgccaattttaaagatctcggtgatctctgcggcccttattatccggaacactgtttgcccaagaagaagcctaaactcaaagagaaggtaaggcccgagggcacctgcgaggaggccagccttccactggaaagaactctcaaagggccagagtgcgccgccgccgccacagccggcaaacccccgaggcctgacgggcccgcagacccagctaagcaaggacccctgcgaacttcggcccgcgggctgagccggcgacttcagtcttgttactgctgcgatgggcgggaggacggtggcgaagaagccgccccagccgacaagggacattgggtccacgaagcttgcgccgtgtggactggaggcgtgtatctggtggctggcaagctctttgggctgcaggaggcaatgaaggtcgccgtcgatatgcatggcggtacggtagccttggcccccggcgacttctctctgcctggactcagattcgcctccttattccaaggcccaagctggtgcgattgtccagtactcgccacctccacaccaagctcctggagcagatgcgtaccagctgcgaaaaagccaggcccccctctgggtgctgccacaaaagatgctagcacacccaccacaactcgcgttcctgctatgcaggtgagagctcggccaggaactggaggacactggagtccatcaaagcagagccgcgggacactccccggccacagctcccccaacccagggccaatctccctgttttcctttcctccactgctgccacagcaatttttttatccttctgtttgcttggacctctgctgggccatgcctggcacctggaaatag

SEQ ID NO: 203082 - DNA, 5721 bp, Artificial Sequence
  Description of Artificial Sequence: Synthetic coding sequence
atgcagagcttccgggagcggtgcggcttccacggcaagcagcagaactatcagcagacctcccaagaaacgagcagactggagaactaccgtcagccaagccaggccggattgtcttgcgatcgccagagactgctggcgaaggattattataatcctcagccctatccatcttatgaagggggcgcggggactccaagtgggacagccgcagccgtggccgctgacaagtatcataggggttcgaaggcgctcccgacccaacagggacttcagggcagacccgcttttcctggatatggagtgcaagattcttccccttatccagggcgctacgctggcgaggagtcacttcaggcctggggagccccacaacctccaccccctcagcctcagccattgcctgcgggggtggcaaaatatgacgaaaatctcatgaagaagaccgcggtgccacccagtaggcaatacgccgaacagggcgcccaggttcctttccggacacactcccttcacgtacagcaacctccgcccccgcaacaacccctcgcctacccaaagctgcaacggcagaagctgcagaacgatattgcaagccctttgccctttccacagggcacacatttcccacagcactcccagtcgttccccacgtcttcaacatactcttcaagtgtgcagggtggaggtcaaggggcacactcgtataaaagctgcacggccccgactgcccaacctcacgatcggcctctgacggcctctagtagcctggctccagggcagcgcgtccaaaacctacacgcctatcagagtggccgcctgagctatgatcagcagcagcagcagcagcagcagcagcaacaacaacagcaggcccttcaatcccgacaccacgcccaggagaccctgcattatcagaatcttgccaagtatcagcattatggacagcagggacaggggtattgccagcccgacgctgcagtgagaacgccagaacagtactaccagactttcagtccatcaagcagccacagcccggcaaggagcgtgggacgaagtccaagctacagttccacaccaagcccattgatgccaaatctggagaactttccctattctcaacagcctctatccaccggcgccttccctgccgggataacggaccactctcactttatgcccctgctcaatccttccccaactgacgctactagcagcgtcgacactcaggcggggaattgcaaaccattgcagaaggataaactgcccgaaaacctgctgagcgatctgagcctgcagagccttactgccttgacttcccaagtggaaaatatttcaaacaccgtgcaacaactcctcctgagtaaagcggcagtgccacagaaaaagggcgtcaagaatttggtcagtcgcacgcctgagcagcacaagtctcagcactgcagcccagagggaagtggctactcagccgagcctgcgggcacaccacttagtgaaccgccttcctctaccccacagtctacccacgctgaaccacaggaggcggactacctgagtggttccgaggatccccttgagcggtccttcttgtactgtaaccaagccagagggagccctgctcgtgtgaactcgaactccaaggccaaacctgaatccgtgagtacatgcagtgtgacgtctcccgacgatatgtcaacaaagtcagatgactctttccagtccctgcatggtagcctgcctctagacagtttcagcaaattcgtggctggagagcgcgattgtccaaggttgcttctctcagccttggcgcaggaagatctggccagtgagatccttggactacaagaagcaatcggggaaaaagctgataaggcctgggctgaagccccgtctctcgtaaaagactcctctaaacctcctttctcactggagaaccactcagcgtgtctggatagtgtcgctaagtctgcctggccacgtcccggagagccagaggccctcccagatagtttacagctggataagggcggcaacgccaaagatttttctcctgggttgttcgaggacccatcggtcgcctttgccactcccgaccctaaaaaaactacaggccccttgtcttttgggaccaagcccactctcggtgtacccgccccagatccgaccaccgctgccttcgactgttttccggacaccacggcagcttcatccgcagacagcgcaaatccatttgcgtggcctgaggaaaatctgggtgacgcgtgtccaagatggggtctacatcccggagagctcaccaaggggttggaacaggggggcaaggcatcagacggcatttctaagggagacacccatgaggcttctgcttgcctcgggtttcaagaagaggatccgccaggagagaaggtggccagccttccaggggatttcaaacaggaagaggtcgggggggttaaagaggaagctggcggactgctccaatgccctgaagtcgctaaagccgacagatggttagaggacagcagacactgctgctctactgcagattttggagacctgcctttactccctccaacctctcggaaagaagacctcgaagcagaagaggagtactcaagtttgtgcgaactgctgggctccccagagcagaggccaggaatgcaggatcccttaagccccaaggcgccactcatatgcaccaaggaggaagtggaagaggtgctcgactccaaggcaggttgggggagtccttgtcacttgagtggcgagtccgtgattctcctgggtccaacagttgggacggagagcaaggttcagtcttggtttgaatcatcgctgtcacatatgaagcccggtgaggaggggcctgacggagaaagagcccctggcgattctaccacgagcgacgcgagcttggcgcagaaacccaataaacccgcggttccggaggccccaattgctaagaaagaaccagtaccaaggggaaagtctctgaggagcaggcgcgtgcatagaggcctgccggaggctgaggacagtccatgccgggctccggttcttcccaaagacctgcttctcccagagtcttgtacgggtcctccccagggccagatggagggagccggcgcacccggacggggcgcctccgagggcctaccccggatgtgtacccgatccctgaccgcgctgagcgagccccgtacgcccggtccccctggtctaaccaccacgccggccccaccagataagctgggcggtaaacagagggcggcattcaagtccggaaaaagagttggaaagccctcccctaaggcggcctccagtccatccaatcctgctgctctccctgtggcatctgacagttcacctatgggcagcaagaccaaagagaccgactccccctcgacccccggaaaggaccaacggagcatgattcttcggtcacgaaccaagacacaggaaatcttccattcaaagagaaggcgcccctcagaggggaggcttcctaactgcagagcaactaagaaactcttggacaactctcatcttcccgccacttttaaagtttcctcttcgccccagaaagaaggacgggtgtctcagagggcacgggtgccgaagcccggggccggttccaaacttagcgataggcccctacatgccctaaaacgaaaatccgcatttatggcccccgttcctaccaaaaagagaaatctggtgctgaggtccaggagctccagtagctccaacgcctcagggaacggtggggatgggaaagaggaaaggcccgagggctctcccaccctgttcaagcgcatgtcttcccctaagaaggcgaaacctactaaaggcaacggcgaacctgccaccaaactcccgccgccggagacccctgacgcctgcttgaaactggcctctcgggcagcctttcaaggtgcaatgaagaccaaagtcctgccgcctaggaagggacggggccttaagctggaggcgattgttcagaagatcacctccccaagcctgaagaaattcgcttgcaaggcccccggggcaagcccggggaaccctcttagcccctccctgagtgacaaagatcgaggtcttaaaggtgccggaggatcccctgtaggggtggaagaaggcctggtgaatgtgggaacgggacagaagttgcctactagtggtgccgatccattgtgcaggaatcccacgaaccgctctctcaagggaaaactcatgaattccaagaagctctccagcacggactgtttcaagacagaagccttcacttcacctgaagcgttacaacctggggggaccgccctcgctcctaaaaagagatccagaaaaggtcgagccggggctcacggtcttagtaagggtccattggaaaaacgtccatacctcggccccgccctacttttaactcctcgggatagggcaagtggaactcagggcgcaagcgaagataatagcggtgggggagggaaaaaaccaaaaatggaggaactaggactggcttcccaaccgcctgaggggaggccctgtcaaccgcaaacgcgggcccagaaacagcccggacataccaactatagcagttacagcaagcggaagcgcctcaccaggggacgagctaagaacactacttccagcccttgcaagggtcgggctaaacggcgacgacagcagcaggtgcttccgctggaccctgctgagcctgagataagactcaaatacatttcaagctgcaagcggctgcgatctgactccaggacccccgcgtttagcccattcgtgcgcgtcgagaagcgtgatgctttcaccactatttgcacggttgtgaactccccaggcgacgcaccaaaaccccaccgaaagccctcatctagcgcatcgtcatcgtcctcaagtagcagcttctccctggatgcagccggcgcctcgctcgccaccctaccaggtggatccatcctgcaaccgcggccctcactgcctctgagctctacaatgcacctcggtcccgtggtgagtaaagccctcagcacctcatgtcttgtttgctgtctgtgtcaaaaccccgccaatttcaaagaccttggtgacctgtgcggtccttattatccggagcattgtctgcccaaaaagaaacccaaactgaaggaaaaggtcagaccggaggggacttgcgaagaagcatccctgcctctagagcgaacactgaaggggcccgagtgcgctgccgcagcaacagccggaaaacctccacgccccgacggcccagccgatcccgcgaaacagggacccttacgcacatctgcacgcggtctttctcggcggcttcagtcctgttactgttgcgatggcagggaagatggaggcgaggaagcggccccggccgacaaagggaggaagcatgagtgtagtaaggaagctcccgctgaacctggcggagaagcccaggaacactgggtacacgaagcctgtgcagtgtggaccggtggagtttacctggttgccgggaaactgtttggactgcaagaggcgatgaaggtcgctgtggatatgatgtgttctagttgtcaagaagccggagctacaatcgggtgctgccacaaaggttgtctgcatacctaccattatccctgcgccagcgacgctgggtgtatttttatcgaggagaacttctccttaaaatgccccaagcacaaacggttgccctag

SEQ ID NO: 203083 - DNA, 2901 bp, Artificial Sequence
  Description of Artificial Sequence: Synthetic coding sequence
atgcagagcttccgggagcggtgcggcttccacggcaagcagcagaactaccagcagaccagccaggaaaccagtagactcgaaaactatagacaacctagccaagcaggactcagttgcgaccgccagagattgctcgctaaggattattataacccgcagccgtaccccagctatgaggggggcgccggaacgccaagtggcaccgcagctgcagtagccgcagataaataccacagaggcagtaaggcattacctacccaacaggggctccagggccgccctgcatttcctgggtacggagtccaggatagctccccctatccagggagatacgcaggggaagaaagcctccaggcatggggggcacctcagccccctcctccccagccccagcccttgccagccggcgtagcgaagtacgatgaaaaccttatgaaaaagacggcagttcccccatctcggcagtacgccgagcagggcgctcaagtgccattccggacgcattctctccacgtgcagcagcccccccccccgcaacaaccactggcatatcccaaactccaaagacagaagctccaaaatgacatcgcaagcccactgcccttccctcaggggactcacttcccccaacactcccagagctttcctactagctccacttattccagttctgtccagggtgggggacagggcgcccacagttataagtcgtgcactgctcctactgctcagcctcacgaccgccctctgactgccagttcctctttggcacccggtcagcgtgtacagaacttacacgcctaccagagcggcaggttgtcctatgatcagcagcagcagcagcagcagcagcagcagcagcaacagcaggctctacaaagccgtcaccatgcccaggagaccctgcactaccagaacctggctaagtaccaacattacggccaacagggacagggatactgtcaaccggatgcagccgtgaggaccccggagcagtattatcagaccttcagcccatcatcctcacattcccctgctaggtctgtgggccggtcaccatcatattcttctacaccttccccattgatgcccaatttagagaactttccctactcccagcagccactctctaccggggctttcccggccggaatcacagatcattcacattttatgccactcctaaatccatccccgactgacgcaacatctagtgtcgatacccaggccggaaattgcaaaccccttcagaaagacaagcttccagaaaatctgcttagtgatctgtctcttcagagccttaccgcactgacaagccaggttgagaatatatcaaacaccgtccaacagcttctcctctcaaaggcagccgtccctcagaagaaaggggtgaaaaatctggtgtctagaacacccgagcagcataagtctcagcactgtagtcctgaagggagtggctactcagcagaacctgcagggacaccgctaagcgaaccgccttcaagcacccctcaaagtacacacgccgagccccaagaggccgactacttaagcggctctgaggatccattggagaggtctttcctgtactgcaatcaagctagggggtcccctgcacgtgtcaattctaattcgaaggccaaacctgaaagcgtgtcgacatgttccgtcacttcccccgacgatatgtctaccaagtctgacgactcttttcaaagcctacatggctcccttccccttgattcttttagcaaattcgtcgctggggagcgtgattgcccacggcttttgctgtcagctctcgctcaagaagatcttgccagcgagatcctgggactacaggaggctataggggagaaggccgataaggcctgggcagaagcaccatcccttgtcaaagactcttccaagccgccctttagcctcgagaaccactctgcttgtctagacagcgttgctaagtctgcctggcctcggccaggcgagcccgaggctctgccggactccctccaactggacaaaggggggaatgccaaggatttcagccctggtctgtttgaggatccctccgttgccttcgcaacacccgaccccaagaagactaccggccccttgagcttcggtacaaagcctaccctgggcgtccccgccccagatccaaccaccgccgcttttgactgctttccagacacgaccgccgctagttctgccgactccgccaatccgttcgcttggcctgaggaaaatcttggtgacgcttgccctcggtggggcctgcatcccggggaactgacgaagggcctagaacaggggggtaaagctagtgacggaattagcaagggggacactcacgaggccagtgcatgtctcggattccaggaggaggatccgcccggggaaaaggtggcctctctcccaggggactttaaacaggaggaagtaggtggtgtgaaagaagaggctggcggactgcttcagtgtcccgaggtggctaaggcggacaggtggctggaagacagtcgccactgctgctctactgccgatttcggcgatctcccactgctaccccctacttctcggaaggaagacctggaggccgaagaagaatattctagtctttgtgagcttcttggctctcctgagcagcgccccggaatgcaggaccccctctcaccaaaggcccccctcatctgcacaaaagaggaggtcgaggaggtgctggactcaaaagcaggatgggggtctccttgtcacctctccggcgagtctgtgatcctcctcggtcccacagtgggtacagaatctaaggttcaatcgtggtttgaagccagtctatacagcgtttatatttgcatccacatccatatctataatatttatgaggattgcaagtgttag

SEQ ID NO: 203084 - DNA, 2829 bp, Artificial Sequence
  Description of Artificial Sequence: Synthetic coding sequence
atgcagagcttccgggagcggtgcggcttccacggcaagcagcagaactaccaacagacctcacaggagacatctcgattggagaattaccggcagcccagtcaggccggcctgagctgcgaccgacagcgccttttggccaaagattattacaatccccagccatacccctcttacgagggtggtgccggcactccctccgggaccgctgcggccgtggccgccgacaagtaccatagaggctctaaggccctccccactcagcagggtctccaaggccgacccgcattccctggttacggcgtgcaagatagctcgccttaccctggccgctacgccggagaagagagtttgcaggcgtggggtgccccgcaaccacctccccctcaacctcaaccactccccgcgggcgtggccaaatacgacgagaatctgatgaaaaagactgccgtgcctccctcacggcagtatgcagaacaaggcgcacaggtaccgttccgaactcattcgttgcacgtccaacagcctccacctccacagcagcctctagcttaccccaaactccagaggcaaaagcttcaaaacgacatcgcctctcccctcccctttcctcagggcacccactttccacaacattcgcaaagcttcccaacaagctccacctatagctcgtcagtccagggcgggggccagggagcccactcctataaatcctgtaccgcgccaaccgcccagccccatgacaggccgttgaccgcatctagttccttagcaccaggtcagagggtccagaatctgcatgcctatcagagtggcaggttgtcatacgaccaacagcagcagcaacagcaacagcaacagcagcagcagcaggcccttcagagcaggcaccacgctcaggagactctgcattaccagaatctcgctaagtatcaacactacgggcagcaaggccagggttactgccagccggacgctgccgtgaggacacccgaacagtactaccaaactttctccccatcttcatcccactcacccgccagatccgtgggcagaagcccctcatacagttcgaccccttcccccttgatgccaaacctggagaatttcccctactctcagcaaccattaagcacgggggcattccctgccggtatcaccgaccactcacatttcatgccactcctcaatcccagccctactgacgctactagttctgtcgacacccaggccggtaactgtaagcccctccaaaaggataagctacccgaaaacctgttatccgacctaagcctacagtcactgacagcactaacttctcaggtggaaaatatttccaacacagtccagcagctgctgttgagcaaagcggccgtccctcagaaaaagggagtgaagaacctggtttcaaggaccccggaacagcacaagtcccagcactgttcccctgagggcagtggttactccgccgaaccagctggcaccccgctcagcgaacctccaagcagcaccccacagtctactcacgcagaaccgcaagaagcagactacctgtctggtagtgaggatcccttggaaagatctttcctgtattgcaatcaggctcgtgggtcccctgctcgagtgaacagtaactccaaggccaaacccgagtctgtttcaacatgctccgtgacttcgccagacgacatgtcaaccaagagtgatgatagttttcagtcacttcatggctctttgccattagactcattttccaaatttgtggcaggggaaagagactgcccccgtctgctgctttccgctctagcccaggaagacttggcttctgaaatcctgggattgcaggaagccatcggggagaaagctgataaggcatgggcggaggctccaagtctcgtcaaagacagctcaaaacctcctttctctctggagaaccacagcgcctgcttggactctgtcgcgaagtccgcttggcctcgcccaggagaacccgaagcactacccgatagcctgcaactcgacaaaggcggcaatgccaaagatttctctcctggcctgtttgaagaccctagcgtggccttcgcaacgcccgatcctaagaagacaactggtccgctttcttttgggaccaagccgacactcggtgtgccagcccccgatcccacaactgccgccttcgattgcttccccgacacaacagccgcctcctcagccgatagtgcaaatccattcgcttggcctgaggagaacctgggcgacgcatgtccacgctggggcctgcatcctggcgagttaacaaaaggccttgagcaagggggtaaggcaagtgacgggatcagtaaaggcgacactcatgaagctagcgcttgtctggggttccaagaagaggatccaccgggcgagaaggtcgccagtcttccaggggatttcaaacaggaagaggttggaggcgtcaaggaagaagccggaggactgctccagtgtcccgaagtggccaaggctgatcggtggctcgaagacagtcgtcactgctgttctacagcagattttggcgatttaccccttttgcccccgaccagccgcaaggaggatctagaagccgaggaagaatacagcagtctgtgcgagttacttggtagccccgagcagcgcccagggatgcaagatccccttagccccaaggcccccctcatatgtacaaaagaggaagttgaagaggttctggacagcaaagcaggatgggggagcccttgtcacctctccggggagtcagttatactgcttggtcccacagtgggtactgaaagcaaggtgcagagttggttttag

SEQ ID NO: 203085 - DNA, 5982 bp, Artificial Sequence
  Description of Artificial Sequence: Synthetic coding sequence
atgcagagcttccgggagcggtgcggcttccacggcaagcagcagaactatcagcagacctctcaagagacttcaaggcttgagaattatcgacagccctcccaggctgggctgagctgtgaccgccagcggttgctcgccaaggattattacaatcctcaaccctatccctcgtatgaagggggcgctggtacaccctctggaactgccgcggccgtggcagcagacaaataccaccggggttcaaaagccctgcccacccagcaggggttgcagggccgccctgcattccccggatacggcgtgcaggattcctcaccatatcccggacggtacgcaggcgaggagagtcttcaagcttggggagcaccccagccgccacctcctcagccgcagcccctcccagccggcgtggctaaatacgacgaaaatctcatgaagaagaccgctgttccgccctcacggcagtatgcggaacaaggcgcccaggtgccattcagaactcactccctccacgttcagcagcctcctcctcctcagcaacctctggcatatccgaagctacagaggcaaaagctgcagaacgacatcgccagcccactaccattccctcagggcacccattttcctcagcattcacaaagttttcccacgtccagcacgtatagttcctccgtccagggaggtggccagggggcacacagttacaaaagttgtaccgcaccaaccgcacagccccacgatcggcctctgactgcaagctccagtcttgctcctgggcaaagagtccagaacctacacgcttaccagagcggcagactgtcatacgatcagcagcaacagcagcaacagcagcagcagcagcagcagcaagccctgcaaagcaggcatcatgcccaggaaacccttcattatcaaaacctcgccaagtaccagcattacggccagcaaggacagggctactgtcagcctgatgccgccgtgcgcactcccgagcagtattaccagactttctccccctccagctcacacagtcctgctagatctgttggaagatccccttcttattctagcactcctagccccttgatgccgaacttagagaatttcccctatagccagcagccactcagcaccggggcgttcccagccgggatcaccgatcactcccattttatgcccttgctgaacccaagcccaactgatgcaacaagttctgtggatacgcaggctggcaattgtaaacctctccagaaagataaattgccagagaacctgctcagtgacctcagcctgcaaagcctcaccgctttgacatctcaggttgagaacatctccaacacagtgcagcagctgctgctgagtaaggccgccgtgcctcaaaagaagggggtgaagaacctcgtgtcccgaacccccgagcagcacaagagccaacattgcagtccagaaggctccggctatagcgcagagcctgcgggcacgcctttgtcagagccaccctcttcgacacctcagtcaacgcacgccgaaccccaggaggcagattatctgtccggctctgaagacccattggaacgatcattcttgtattgcaatcaggctaggggctcccccgcccgggtgaattcgaacagtaaggccaaacccgaatctgtctccacatgtagcgtgacttcaccggacgacatgtctactaaatctgatgacagcttccaatccctccatggctcgctgcctctcgactctttctcaaagtttgtggccggggaaagagactgtcctcgtctcctgctatccgctctggcacaggaagacctggcctctgaaatcctcggattgcaggaagccattggtgagaaagctgataaggcctgggcggaagctccctcactagtgaaggattcttcaaagccccctttttctctggaaaaccattccgcctgtctggactccgttgctaaatctgcctggcccaggcccggcgagcctgaggctcttccagacagcctccagttggacaaagggggcaacgctaaggacttctcacccgggctcttcgaagacccttccgtggccttcgcgactcccgatccgaagaagacaactggccctcttagtttcggaactaagccaactttaggcgttcctgcaccagatccaaccactgctgctttcgattgttttccagacactaccgctgctagttccgccgattcagccaatccttttgcctggcctgaggagaatttaggcgacgcatgccctcgatggggtctgcaccctggtgaactgactaagggactggagcagggtgggaaggcgtctgacggtatctctaaaggagacactcacgaggccagcgcatgcctcggttttcaagaagaggaccctcccggtgagaaagttgcctctctaccaggtgactttaaacaggaagaagtcgggggggttaaagaggaggctggcggtctgctgcagtgcccagaagtcgccaaagccgatcgctggcttgaggattctcgtcattgctgttccaccgcggatttcggcgacctacctttgttgccacctacgagtaggaaggaagacctcgaagcagaggaggaatatagtagcctctgcgagctgcttggatctcccgaacagcggcccggtatgcaggatcccctgagccctaaagcccccctgatctgcactaaggaggaggttgaggaagtactcgatagcaaggctggctggggaagcccatgccatctctcgggtgagagtgtcatactgcttggaccaacagtcggaacggaaagcaaagtgcagtcctggtttgaaagcagcttgagccatatgaaacccggcgaggagggacccgacggcgaaagagcacctggggatagcactacttccgatgcaagcttggctcagaaaccaaataaacccgccgtccccgaggctcccatcgctaaaaaagagccggtccctaggggcaaatccctgcgtagtcgccgcgtccatagggggttacccgaggccgaggactccccctgccgcgcacctgtactcccaaaagacctcttactgccggagtcttgtacagggcccccccaaggccagatggagggggcaggcgctcctggccggggggcaagtgagggactgcctaggatgtgcacgaggtccttgacagccctgtcagaaccccggacgccaggaccacctggccttacaaccactcccgcccccccggacaagctgggggggaagcagcgagcagcttttaaatcaggcaagcgcgttggcaagccatccccaaaagccgcctcaagcccgtcgaacccagctgccttaccagtggcctcagattccagccctatggggtctaagaccaaggaaaccgactctccctccaccccaggtaaggatcagcgctctatgatcctgcggagtcgcaccaaaacgcaggagatttttcatagcaaacggaggaggccaagcgaggggaggctgcccaactgtcgggccacaaaaaaactactggataacagtcacctccccgccaccttcaaggtctcttcctctccacaaaaagagggaagagtctctcagcgcgctcgtgtacctaaaccgggcgcagggagtaaactctccgacagacctctccacgccctaaaaagaaaatcagcattcatggcgcccgtgcccactaagaaaaggaacctggtgctgcggagccgcagctcgtccagcagtaacgcatccgggaatggcggggacggcaaagaagaaagacctgaaggctcaccaaccctgttcaagcggatgtcctcaccaaagaaagctaagccaacaaagggaaatggtgagcctgctaccaagctgcctccccctgagaccccggacgcatgcctgaaattggccagcagggctgctttccagggcgctatgaaaacaaaagtcttaccacctcgtaagggccgaggcttaaaactcgaggctatcgtgcagaaaattaccagcccatctttgaagaaatttgcctgtaaggcgccgggcgccagtcccggtaaccccctcagtccgtcactctctgacaaagataggggcctcaagggagcagggggctcgcccgtgggtgttgaagagggccttgttaatgtcggcaccggccagaagctgccaacctcaggggcagatcctctgtgtcgtaatcctaccaataggagcctgaaaggcaaacttatgaactcgaaaaaattgtcaagtacggactgttttaaaaccgaagcgtttaccagtcctgaggctttgcagccagggggcactgccctagctccaaagaagcgtagccgcaaagggagagctggagcccatgggctatccaagggccctctcgagaaaaggccatatctcggcccagctctcctcctaaccccccgggaccgtgctagcggtacgcagggggcgtcagaagacaattcgggcggcggtggtaagaagcctaagatggaagaactgggactggcaagccagcccccggagggccggccctgtcaaccacagacgagagcccagaaacagcctggtcacaccaactacagctcctatagtaagagaaagaggctcacccggggacgggcaaagaacaccacatcctccccctgcaagggcagagccaagaggcggaggcaacagcaagttttgcccttagaccctgccgagcctgaaatcagactcaaatatatctcctcctgtaaacgccttcgaagcgactccaggacccccgctttctctcctttcgtaagggtcgaaaagagagatgccttcacaaccatctgcacagtggttaatagtcctggggatgctccaaagcctcaccgaaagcctagcagttctgctagctctagttccagcagcagcagcttttccctagatgctgccggagcttcactggcaacactccctggcgggagcattctgcagcctaggccttccctgccactgagctcaacgatgcatctgggccctgtggtctctaaggccctgtcgacgagctgtctcgtgtgttgcctgtgtcagaaccctgctaacttcaaagatctcggtgacctttgtgggccatattaccctgagcactgtctgccaaagaaaaagcctaagctgaaagagaaagtacgccctgagggaacgtgcgaagaggcctcgctgccattggagcgcactctgaaggggcctgagtgtgccgccgctgccaccgccgggaagccccctcgacccgatggaccagcagaccccgctaaacagggcccccttcggacctccgctaggggactatcgcgtcgcctgcaatcatgctactgctgcgatggaagggaagatggaggcgaagaagccgcccctgcagataaaggaagaaagcatgagtgtagtaaagaagcgcccgccgaaccggggggagaagcccaggagcattgggtacatgaggcctgtgccgtatggaccggaggtgtatatctcgttgccggcaaactctttggacttcaggaggccatgaaggttgcagtggacatgcatggtggcaccgtcgccctggctcctggggatttttcgctcccagggctgcggttcgctagcctcttccagggcccctcttggtgcgattgcccagtgctggccacttctactcccagctcatggtcaagatgcgtaccagccgccaaaaaacccggtccccccctgggagccgctacaaaagacgcgtcaactccaaccacaacacgggttccggctatgcaggttcgcgcccggcctgggaccggaggccactggtctccgtccaaacagagtcgcggaacattgccaggacactcttcccccaatcccggtcctatatccctgtttagcttccccccccttttgccccaacaattcttttacccgagtgtgtgtcttgacctttgttgggctatgccaggaacgtggaagtag

SEQ ID NO: 203086 - DNA, 2943 bp, Artificial Sequence
  Description of Artificial Sequence: Synthetic coding sequence
atgaagagcctgaaggccaagttccggaagagcgacaccaacgagtggaataagaacgacgacaggcttctgcaggccgtcgaaaatggtgatgcggaaaaagtcgcctccttgctgggcaaaaagggagcgagtgccacaaaacatgattcagagggcaaaacagccttccatttagctgctgctaagggtcatgttgaatgcttgagagtgatgattacacatggtgtcgatgtgacagcgcaggacactacgggacactctgccttgcatttggcagctaagaatagtcaccacgagtgcatcaggaaactcctgcagtccaagtgccccgcagaaagcgtggactctagcggcaaaacggcactccactacgcggccgctcaagggtgcctccaagccgtgcaaatcttatgcgaacacaaaagtccaattaacctaaaggacctagatggcaatataccactgcttctggctgtgcagaatggccactctgagatatgtcactttttattggatcacggcgccgacgtcaactccagaaacaagagcggtaggactgccctcatgctggcctgtgagatcggctcatctaacgccgttgaagccttgatcaaaaagggagccgacttgaacctagttgactccctgggatacaacgctttgcattactcgaagcttagtgagaatgccggaattcagagcctgctacttagcaaaatcagtcaggacgcagatctgaaaacccctactaaaccaaaacagcacgatcaggtgtctaagatcagctccgagcgcagcggcacaccaaagaaacggaaagcacccccccctcccatctcacctactcagctgtccgacgtgtccagtcccagatctattaccagtacaccactaagtggcaaggagagtgttttcttcgccgagcctcccttcaaagctgaaatttcttctatcagggaaaataaggaccgcctaagcgacagtactacaggcgccgattctctcctcgacatatcatcagaggcagatcagcaggacctgctgagcctgctccaggccaaggtggcctcactgacgctccacaataaggaacttcaggacaagctgcaggcaaaatcccccaaggaggccgaagctgatttatcttttgacagttatcattccacacaaactgatctggggccatcactcggcaaacctggcgagacatcacccccagactcgaagtcatctcccagtgtactcatccattctctgggcaaatctacgaccgataatgatgtgcgtattcagcagctccaagagattctgcaggatctgcagaaacggttagagagtagtgaggccgaaaggaagcagctgcaagtggagctgcagtcccggagagcggaactggtctgcctaaacaatacagagatttctgaaaactcatcagacctctcccagaagctaaaagagacccagtccaagtatgaagaggccatgaaggaggtactgagcgtacagaagcagatgaaactcgggctggtgtcgcccgaatcaatggacaattatagccactttcatgagctaagggtgaccgaggaagagatcaatgtactcaagcaagatctacagaacgctctcgaggaatctgaaaggaacaaagaaaaggtgcgagagctggaggaaaagcttgtcgagcgtgaaaagggcacggtgatcaaaccccccgtggaggaatatgaagaaatgaaatctagctactgcagcgtcatcgagaatatgaataaggagaaggcattcctcttcgaaaaataccaggaagctcaagaggagattatgaagctcaaggacacactcaagagccagatgacccaggaggcgtctgatgaggcagaagatatgaaagaggcgatgaacagaatgatcgatgaattgaataagcaggtgtccgaattatctcagctgtataaggaggcccaggcggagctagaggattaccgaaagaggaaaagtctggaagatgttaccgccgagtatattcacaaggctgagcacgagaagctcatgcaactcaccaacgtgagcagggccaaagccgaagacgccctcagcgagatgaagtcccaatatagcaaggttctcaatgaactaacgcaattgaaacaacttgtggatgctcagaaagaaaattccgtctcgatcacagagcatttgcaagtcatcacaaccctgcgcaccgcggctaaagaaatggaagagaaaatttcaaatctcaaggaacatctggcctcaaaggaagtggaggtagcaaagctggaaaagcagctgctggaggagaaagctgctatgacagacgcaatggtgccccgaagcagctatgaaaaactccagagctctctggagtccgaggttagcgtgctggcaagtaagcttaaggagtccgtcaaggagaaggagaaagtacattcagaggtcgtgcagattagatcagaagtcagccaagtgaagagagagaaagaaaacatccagacactcctaaaatctaaagaacaggaggtgaacgagctgctgcagaagtttcagcaggctcaggaggagctagctgagatgaagcgctacgcggagtcctcttctaagctcgaggaagacaaggacaaaaagataaatgaaatgagcaaggaggtgaccaaattgaaagaagcactcaattctctctctcagctgtcatacagcaccagttcttcgaaacgtcagtcccagcagctggaggctcttcaacagcaggtcaagcagcttcagaaccagttggccgaatgcaaaaaacagcaccaagaagttatcagcgtgtacaggatgcatttgctgtacgcagtccagggacagatggatgaggatgtccagaaagtgctgaaacagatcctcacgatgtgcaaaaatcagagtcagaaaaagtag

SEQ ID NO: 203087 - DNA, 2922 bp, Artificial Sequence
  Description of Artificial Sequence: Synthetic coding sequence
atggtgaagggcaagaccaacgagtggaacaagaacgacgaccggctgctgcaggctgtggagaatggcgatgccgagaaggtggcctccctgctcggtaagaaaggggcaagtgccacgaaacatgatagcgagggaaaaaccgccttccatctggcagccgcaaaaggccatgtggagtgcttgcgggtcatgattacacacggtgttgatgtgacagctcaggacaccactggacacagtgcactgcacttggctgcaaagaacagtcaccacgagtgcatccgcaaactcctacagagtaaatgtccagctgagtctgtcgactcttcgggaaagacggccctccactacgcggctgcccagggatgtctgcaggccgttcaaatcctgtgtgaacacaagagcccaatcaatctcaaagacctggatgggaacattcccttattgctcgctgtgcagaacgggcactccgagatttgtcactttctgctggatcatggtgccgacgtgaatagtcggaacaagtcaggcaggaccgcgctgatgttggcatgcgagatcgggagctccaatgcagttgaggcactcattaaaaagggcgctgacttaaacttagtagatagcctgggatacaacgctctgcactattctaagctttctgaaaatgctggcatacagtccctgctgctgagcaaaatctcacaggatgcagaccttaaaacccccaccaaacctaaacagcacgaccaggtatcgaagatatcctccgagcgttcaggtacccctaaaaagaggaaggcacctccgccaccaatcagccctacacagctctccgatgtttctagccccaggtctatcacatccactcctctctccggtaaagagtccgtcttctttgccgagcccccgttcaaagccgagatcagctctattagggagaataaggaccgcctgagcgactcaaccacaggtgcagatagcctcctggatatcagcagcgaagcagatcagcaagatctactgtcactgctgcaggctaaggttgcttccctcaccttgcacaacaaagaactgcaggacaagcttcaagcaaagtccccaaaagaggccgaagccgatctctccttcgacagctaccactctacacaaacggacctcggtccttccctggggaagccaggcgaaacttccccccctgatagcaaatcgtctcccagtgtgctgatacactctctggggaaatccaccaccgataatgacgtgcggattcagcagctgcaggaaatattacaggatctccagaagcgactagaaagcagcgaagccgagcgtaagcagctgcaagtcgagctgcagagcagaagagcagagcttgtctgtctgaacaacaccgaaattagtgagaactcatcagacctgagccaaaaactgaaagagacacaaagcaagtatgaggaggctatgaaggaggtgctctctgtccagaagcagatgaaactcgggcttgtatcgcctgagagcatggacaattactctcatttccatgaactccgggtaaccgaagaggaaatcaacgtgctcaaacaggatctccagaacgccttagaagagtcggaaagaaacaaggaaaaagtccgagagttggaggagaagctggtggaaagggagaagggcacagtgattaaaccccccgtcgaagaatacgaggaaatgaaatcctcttactgttctgtaatcgaaaacatgaataaagaaaaagcctttctgttcgagaaataccaagaagcccaagaggagatcatgaagctcaaggacactcttaagagccagatgactcaagaagctagcgatgaagctgaggatatgaaagaagctatgaacagaatgatcgacgaactgaataaacaggtgtccgagctgtcccagctctataaggaggcccaggcagaactggaggactataggaagaggaagtcactagaagatgtgacggctgagtatatccataaagccgaacacgagaaacttatgcaactgaccaatgtcagccgagctaaagcagaagacgccctgtctgaaatgaagagccaatactcaaaggttttgaacgaattgacccagctcaagcagctcgtcgacgcccagaaggagaattctgtgtctattaccgagcacttgcaggtgatcacaacactacgaaccgctgcaaaagaaatggaggagaaaatcagcaacctgaaagagcacttagcgtccaaagaggtggaagtggccaaactggaaaaacagctgctagaggagaaggcagctatgaccgacgccatggtacccagatcaagctatgaaaagctgcaatccagtttggaatctgaggtatccgtcttagcgtccaaactgaaagagagcgtgaaagagaaagaaaaagttcatagtgaggtggtccagatacgcagtgaagtctcccaggtgaagcgggaaaaggagaatatccagactctcctcaaaagcaaggagcaggaagtgaatgaactgctccagaagtttcaacaggcccaggaggaactggccgagatgaagagatatgccgaaagctcaagtaaacttgaggaagacaaggataagaagatcaatgaaatgagcaaggaggttacaaagcttaaggaagctctcaactcgctctcccaactgagctatagcacaagtagtagtaagcgacagtctcaacagttagaggcactgcagcagcaagtgaagcaactgcagaatcagctggccgagtgtaaaaagcagcaccaggaggtgatcagcgtttataggatgcatttgctctatgcggtgcagggccagatggacgaggatgtccagaaagtgcttaagcagattctgactatgtgcaagaatcagtcccagaagaagtag

SEQ ID NO: 203088 - DNA, 2943 bp, Artificial Sequence
  Description of Artificial Sequence: Synthetic coding sequence
atgaagagcctgaaggccaagttccggaagagcgacaccaacgagtggaacaagaatgacgatagactgctgcaggctgtagagaacggcgacgcagagaaagtggcctccctgctaggaaagaagggcgcatcagccaccaagcacgattctgaaggcaagactgcctttcatctggcggcagcgaaaggacatgtggagtgcctgagagtcatgatcacgcacggagtggacgtgaccgcacaggataccacaggtcattcagctctccacttggcagctaaaaattcccaccacgagtgtattcgaaaattactgcagtctaagtgcccagctgaatctgtggactcctccggtaagacggccctacactacgccgctgcccaggggtgcctgcaggcagtacagattctgtgtgaacacaagagccctattaacctcaaagacttggatggcaacatcccactgctgttggcggtgcagaacgggcatagtgaaatttgccattttcttcttgaccacggagctgatgtcaattcaagaaataagtccggaagaactgcactcatgctagcttgtgaaataggcagttctaacgcagtggaagccctgataaagaaaggggcagatctgaatttagtcgattcactaggatataatgctcttcactactccaagttgagtgagaacgcaggtattcagagccttctcctaagcaaaatctcacaggatgccgacctgaaaactccaacaaagcccaaacagcacgatcaagtgtctaaaattagttctgagagaagcggaacccccaagaaaaggaaagcccccccaccccccatcagtcccacacagctttcagatgtttcctctccccggtctataaccagtactcccctatcaggcaaagagtccgtgttctttgcagagcctccattcaaagcagagatctcgagtattcgcgaaaataaagaccgtctgtcagatagcacaactggcgccgatagccttctggacatatcctccgaagcagatcagcaggatctcctttccctgctgcaagctaaagttgcctctctcactctccataacaaggagctgcaggataaattacaggcaaagtctccaaaggaagccgaggccgacctgagtttcgactcttaccatagtacccaaaccgatcttgggccgtctctagggaagcccggtgagacgagtccaccagattctaagagcagcccctcagtacttattcactcgcttggtaagagcacgactgataacgatgtccgaattcagcaactgcaggagattttgcaagatcttcagaaacggctggaaagtagcgaagccgagcgtaaacagctacaagttgagctgcagtcccgcagagccgaattggtgtgtttgaacaacacagaaattagcgagaatagttctgatttatcccagaaactaaaggaaacacaaagtaaatatgaggaggctatgaaggaggtactatcggtgcagaaacagatgaaacttggcctggtgtcccctgagtctatggataattacagtcattttcacgagctgcgtgtcactgaagaggagatcaacgtgctaaagcaggatcttcagaatgccctcgaggaatccgaaaggaacaaagaaaaagtgagggagctcgaggaaaaactggtggagagggaaaagggtactgtgatcaaaccgccagtggaggagtacgaagagatgaaaagctcgtattgctcagtgattgaaaatatgaataaagaaaaagcatttctgttcgagaaatatcaagaggcccaagaagagatcatgaagctgaaagacactttgaagtctcagatgactcaagaagctagcgatgaagcggaggacatgaaagaggccatgaaccgtatgattgacgaacttaataagcaagtgtcagaactgagtcagctgtataaagaggctcaggcggaattggaagactatcggaagcggaagtcattggaggatgtgaccgccgagtacattcacaaggcagagcacgaaaaactgatgcagctaacaaacgttagccgagccaaggctgaggatgccttatcagagatgaagtcccagtattccaaagtgctcaacgagttaacccagctgaaacaattagttgatgctcagaaagagaactccgtgagcatcacggaacatctacaggtaattacaacccttcggaccgcggctaaggaaatggaagagaaaatttccaatttgaaggaacatctcgcaagtaaagaagtggaggtggcgaaattagagaagcagcttttagaggagaaagctgccatgactgatgccatggtacctcgaagcagttacgagaagctccagagctccttagagagcgaggtttccgtgctggcctccaaactgaaggagtctgtcaaggagaaggagaaggtacacagtgaggtggtgcagatcaggagcgaggtcagtcaagtgaagcgagagaaggaaaacatccagaccctgctgaagtccaaagagcaggaagtaaacgaactgctgcagaaattccagcaggcacaggaggagttagccgagatgaaaagatatgcggagtccagctctaagcttgaggaggacaaagacaaaaaaataaacgagatgtctaaggaagtaacaaagctgaaagaggcattaaatagtcttagccagttgtcctactccacaagcagctctaaacgtcaatcccagcaactggaggcactgcaacagcaggtgaaacagctgcaaaaccagctcgccgagtgcaagaagcagcaccaagaggtaatctcagtgtatagaatgcatttactctacgcggtccaaggacagatggacgaggatgtgcagaaagtccttaagcagattttgaccatgtgtaaaaatcagagccagaagaaatag

SEQ ID NO: 203089 - DNA, 2943 bp, Artificial Sequence
  Description of Artificial Sequence: Synthetic coding sequence
atgaagagcctgaaggccaagttccggaagagcgacaccaacgagtggaataaaaatgacgaccgtctgttgcaggccgtggaaaacggcgacgccgaaaaagtggctagcctcctggggaaaaagggcgccagcgctaccaagcacgatagcgagggaaaaaccgccttccacctcgctgcagctaagggacacgtggaatgtctacgagtgatgatcacccacggagtggacgtgactgctcaagacacgacaggacacagtgcacttcatctggctgccaaaaactcgcatcacgagtgcatacggaagctcttgcagtctaagtgccctgccgagagcgtcgattcaagtggaaaaactgcattgcactatgcggctgcacaaggttgcctacaggcagtgcaaatcctttgtgagcataagtcccctatcaacctgaaggatttggatggaaacatacctctccttctggctgttcaaaacgggcatagcgaaatctgccattttttgctggaccatggagcggacgtgaactctcgaaacaaaagtggacgcaccgccctgatgctggcttgtgaaatcggcagctccaatgcagtggaagccctgattaagaagggtgcggatctaaatctcgtggattcactaggatacaatgcactccactattctaagctgagcgagaacgcaggtattcagagcctgctgctctcaaaaatcagtcaggatgctgacttaaagaccccaaccaaaccaaagcagcatgaccaagtatcgaagatctcatcggaacgctccggaacacccaagaaacgcaaagctcctccaccccctatttcccctacacagcttagcgatgtgtcatctccacggagtattacaagcaccccactgtccggtaaagagtcagtcttctttgccgagccacccttcaaggccgagatcagtagtattagagagaacaaagaccgtctttcagactctactacaggcgcagattcactgctggacatctccagcgaggcggaccaacaggatcttctgagtctgctccaagcaaaggtcgctagccttaccttacataataaggagctgcaggacaaactgcaagcaaaaagtcctaaagaagcggaggctgatcttagcttcgactcatatcactcgactcagaccgacctcgggccctccctcggcaaaccgggagaaacctcgcctcccgatagcaaatctagcccttcagtactcatccactccctgggcaaatccacaacggacaacgacgtgaggatccagcagctgcaggagatactgcaggacctgcagaagcgcctagagtcatcagaagcagagcggaaacagcttcaggtggagctgcagtcacgccgtgccgaattggtgtgcctcaacaataccgagataagtgaaaactcttctgacctgagccagaagctgaaagagacgcagtcaaagtatgaggaggcaatgaaagaggtgctgtccgttcagaaacagatgaagctcgggttagtcagtcccgagtctatggataattacagccacttccacgaactccgtgtaaccgaggaggagatcaatgttctcaaacaggatctgcagaatgctctggaagagtctgaacggaataaggagaaagtgagggagttggaggagaagctggtggaacgagaaaaggggacggtcatcaagcctcccgtggaggaatatgaggaaatgaaatcatcctactgttccgtgatagaaaacatgaataaagaaaaagcattcctgttcgagaagtaccaggaggctcaggaggagataatgaagttgaaagatacattgaagtcacagatgacacaggaggcctcagatgaagcagaggatatgaaggaggccatgaatagaatgatcgacgagctgaacaagcaggttagcgaactgtcccagctttataaagaagcccaggcagaattggaggattaccgcaaaaggaagagcctggaagacgtcaccgccgagtatattcacaaagctgagcacgagaaactgatgcagctcacaaatgtgagcagagccaaagcagaggatgcactttctgaaatgaagagccaatactctaaagttctgaacgaattgactcagttaaaacagctagtggatgctcaaaaggagaatagcgtctcaattaccgagcatcttcaggtaattaccacactgagaacagcagccaaagagatggaagagaagataagtaacctcaaggaacatcttgcatctaaggaagtcgaggtcgctaaactggagaaacagttgctagaagagaaggccgccatgacagatgccatggttcctaggagttcatacgaaaagctgcaatctagcttggagagcgaggtcagtgtcctggcctcgaaactgaaggaatcagtcaaggaaaaagagaaagttcacagcgaagtggtgcagattagaagtgaagtctcccaggtaaagcgggagaaggaaaacattcagacattgctgaagtcaaaagagcaggaagttaacgaactcttgcagaaatttcagcaagctcaggaagaattagctgaaatgaaacggtatgctgaaagcagctctaagctcgaggaggacaaagataaaaaaatcaatgaaatgtccaaagaggtgaccaagttaaaagaagcactgaatagcctgtcacagctttcctacagcaccagcagttccaaacgacaatcccagcagttggaagcgctgcagcagcaggtgaaacagctccaaaatcagttagcagaatgtaagaagcagcatcaggaggtcatttccgtttatcgcatgcatcttctgtatgccgttcagggacagatggacgaagacgtacagaaggtgctaaagcagatcttaaccatgtgtaagaatcagagtcagaaaaagtag

SEQ ID NO: 203090 - DNA, 345 bp, Artificial Sequence
  Description of Artificial Sequence: Synthetic coding sequence
atgaagagcctgaaggccaagttccggaagagcgacaccaacgagtggaacaaaaacgatgaccgtttactccaagccgttgaaaatggagatgctgagaaggtggcatcgttgctcggaaagaagggtgccagcgcaacaaagcacgattccgaaggcaagacagcattccatttggctgcagcaaagggccacgtcgagtgtttgcgcgtcatgatcactcacggtgttgatgtcactgcccaagacacaacagggcactcagcactccatctggccgcaaagaattctcatcacgaatgcatacgcaagctgttgcagagcaaatgtcctgcagagtcctag

SEQ ID NO: 203091 - DNA, 2919 bp, Artificial Sequence
  Description of Artificial Sequence: Synthetic coding sequence
atggaggccaagaccaacgagtggaacaagaacgacgaccggctgcttcaggccgtcgaaaacggggacgcagagaaggtggcttcgctcctcgggaagaaaggtgccagcgctactaaacacgatagcgagggaaagaccgcttttcatctggccgccgctaaggggcatgttgagtgcctcagggtgatgattacacacggagttgatgtcaccgcgcaggataccacaggtcattccgccttgcatttggctgccaagaattcgcaccacgagtgcatccgaaaattgcttcagagcaagtgccccgccgagtctgttgacagctcgggcaaaaccgcattgcattatgcagccgctcagggttgtctgcaggcagtgcagatcctctgcgaacacaaatctccgatcaacttaaaagatctggacggcaacataccgctgctgctggccgtgcagaacggccattcagagatctgtcatttcctcttggaccatggcgctgacgttaacagtcggaataaatctggtaggacagcattgatgctggcctgcgagatcgggtctagcaacgccgtggaagccttgattaagaaaggggcagacctgaacctcgttgatagtttaggatataatgccctgcactattctaagctgagtgagaatgcgggcatccagagcctgctcctcagcaagatctcacaggacgccgacctgaagacgccaaccaaacccaaacaacacgatcaagtgtcaaagatctcttctgagagaagcggcactccgaagaagagaaaagcgcctccacctcctatctcacctacccagttgtccgacgttagttctcctagatctattacatccaccccattgtccggaaaggagtccgtgttcttcgccgaacctccctttaaagccgaaatatcatctatcagggaaaacaaggatagactctccgacagcaccaccggtgctgactccctgctcgatatttcgagcgaggccgatcagcaggacctcctgtctctcctccaggcaaaggttgccagcctgactctccacaacaaagaactccaggataagctgcaggcgaagagccctaaggaagctgaggccgacctgtcgttcgactcatatcattccacacagacagaccttggcccttctctggggaagccgggggagacatcgccccctgacagcaagagtagtccatcagttttaatccattctctgggaaaaagtacaaccgataacgatgtgagaatccagcagctgcaagaaatccttcaggatttacagaagcggctggagagcagcgaggcagagcgcaaacagttgcaggtggagctgcaatcaaggcgagctgagcttgtgtgtctcaacaatacagagatctctgaaaacagcagtgacttaagccagaaactgaaagaaactcagtctaagtatgaggaagccatgaaagaggtgttgtcagtccagaagcaaatgaagcttggccttgtatccccggagtcaatggacaactactctcatttccacgagctgagagtcacagaggaagagattaacgttttaaagcaggacttgcagaacgcccttgaagaatctgaaagaaacaaggaaaaggtgcgggagttggaggagaaactggttgaacgtgaaaagggtactgtaatcaagcctccagtggaggagtacgaggagatgaaatcttcctactgcagtgtgattgagaatatgaataaagaaaaggcctttctgttcgaaaaataccaagaggcccaagaggagatcatgaagctgaaagatactcttaagtcacaaatgacacaggaagctagcgatgaggctgaagacatgaaagaggctatgaatagaatgatagacgagctcaataagcaggttagcgaattgtctcagctgtacaaggaggcccaggccgaactcgaggattataggaaaaggaagtcactggaggatgtgaccgccgagtacatccacaaagctgagcacgagaaactgatgcagttaacaaacgtctcccgggccaaagccgaagacgcactctcagagatgaagtcacagtattctaaggttctcaacgagttaacacaactcaagcagctggtcgatgctcaaaaggagaactcagtgtccatcacagaacatcttcaggttatcaccacattgcggacagccgcaaaagaaatggaagagaagataagcaatctaaaggaacatctggcgagcaaagaagtagaagttgccaaacttgaaaagcagttgctggaggaaaaagccgctatgactgacgcgatggtgccccgctcttcctacgagaaacttcagtcaagtctcgaaagcgaggtatcagtgctcgcgagtaagttgaaagagtctgtgaaggaaaaagaaaaggttcacagcgaagtggttcagatcagatccgaggtatcgcaggtcaaacgcgaaaaggagaacattcagactctgctaaagtctaaagaacaggaggtgaacgaactgcttcagaagtttcaacaggcacaggaggaacttgcggagatgaagcggtatgctgaatctagttccaaattggaagaggacaaggataaaaagatcaacgagatgagtaaagaagtgacgaaactgaaggaggcccttaattcgctgagccagctgtcatacagcactagcagcagcaagcgacagtcccagcaactggaagcactacagcaacaggtgaaacaattgcagaaccaacttgctgaatgcaaaaaacagcaccaggaggtcatctctgtatatcgaatgcacctgttgtatgctgtccagggccagatggacgaagatgttcagaaggttctgaaacaaatcctcacgatgtgcaaaaaccaatctcagaaaaagtag

SEQ ID NO: 203092 - DNA, 378 bp, Artificial Sequence
  Description of Artificial Sequence: Synthetic coding sequence
atgaagagcctgaaggccaagttccggaagagcgacaccaacgagtggaacaaaaatgacgacagacttcttcaggccgtggagaatggagacgctgagaaggtggcatccctgttaggaaaaaagggcgcttccgcaactaaacatgactccgagggtaagaccgcttttcatctggccgctgccaagggacacgttgaatgcctgcgcgttatgatcacacacggagtggacgtcaccgcccaggacacaaccggacatagcgccttacatctggcggctaaaaacagtcaccacgaatgtattcggaagctgctgcaaagcaagtgcccggctgaaagcgtggactcaagcggcaaaacagctctgcactactag

SEQ ID NO: 203093 - DNA, 324 bp, Artificial Sequence
  Description of Artificial Sequence: Synthetic coding sequence
atgaagagcctgaaggccaagttccggaagagcgacaccaacgagtggaacaagaatgacgacaggctcctccaagccgtcgagaatggagatgcagaaaaggtcgcgagtctgctaggcaagaagggggcaagcgcaacaaaacacgattccgaagggaagacagctttccatcttgccgccgctaagggtcatgtagaatgtctcagagtaatgatcactcatggagtggacgtgactgcacaagacaccacaggccattcagccctgcatctggccgcgaagaacagccaccacgagtgcatcagaaaactgctacagtag

SEQ ID NO: 203094 - DNA, 453 bp, Artificial Sequence
  Description of Artificial Sequence: Synthetic coding sequence
atgaagagcctgaaggccaagttccggaagagcgacaccaacgagtggaacaagaatgatgatcggctgctccaagccgtggaaaacggggacgcggagaaggtggccagcctgcttggtaagaagggggcctccgctactaaacacgattctgagggcaagaccgccttccacctcgccgcggctaaggggcacgtggaatgcctccgtgtgatgattacacatggagtggacgtgacagcacaggatacaaccggacatagtgcattgcacttggctgctaagaactcccatcatgagtgcattcgaaagttacttcagagcaaatgccccgccgagtcggtggacagcagcggaaagacggcactgcactacgccgccgcacagggatgcctgcaggccgttcaaatcctgtgtgagcacaagagtccaatcaatttgaaggacctctag

SEQ ID NO: 203095 - DNA, 381 bp, Artificial Sequence
  Description of Artificial Sequence: Synthetic coding sequence
atgaagagcctgaaggccaagttccggaagagcgacaccaacgagtggaacaaaaacgatgacaggctccttcaggctgtggagaacggcgatgccgaaaaagtagcaagtcttctgggaaagaaaggtgcctcggccaccaaacacgactcagagggaaaaacagccttccacctggccgccgccaagggtcatgtggaatgcttgcgcgttatgatcactcatggggtcgacgtaacggcccaggatacaacagggcattccgctctccatcttgccgctaagaacagccaccacgagtgcatcaggaagctcctgcagtctaagtgcccggcagagtctgtggatagttcaggtaagaccgcactccattacgcatag

SEQ ID NO: 203096 - DNA, 315 bp, Artificial Sequence
  Description of Artificial Sequence: Synthetic coding sequence
atgaagagcctgaaggccaagttccggaagagcgacaccaacgagtggaataaaaacgatgatagactcctgcaagccgttgagaatggcgacgctgaaaaggtggcctcactgctggggaaaaagggtgcatcagcgacaaaacacgattccgaaggcaaaaccgctttccatcttgccgctgccaagggacacgtggaatgtctccgggtgatgattactcatggagtagatgttaccgcacaagacacaacaggccattccgccctccacctggccgcaaagaactctcatcacgagtgcattcgaaagtag

SEQ ID NO: 203097 - DNA, 420 bp, Artificial Sequence
  Description of Artificial Sequence: Synthetic coding sequence
atgaagagcctgaaggccaagttccggaagagcgacaccaacgagtggaacaaaaatgacgacaggctgttgcaggctgtggaaaatggagatgcggaaaaagtggccagtctactgggaaagaagggtgcatctgctacaaagcacgattccgaggggaagacggcattccatcttgctgccgctaagggacatgttgagtgcttgcgcgtgatgattacacatggggtggacgtgaccgctcaggatacaaccggtcacagcgcacttcaccttgccgctaaaaactcacatcacgaatgcatccgcaagttactgcagagtaagtgtccagcagaaagcgtcgacagtagcggcaagactgcattacactatgctgcagcccaggggtgcctgcaagctgttcagatcctgtgttag

SEQ ID NO: 203098 - DNA, 381 bp, Artificial Sequence
  Description of Artificial Sequence: Synthetic coding sequence
atgaagagcctgaaggccaagttccggaagagcgacaccaacgagtggaacaaaaatgacgatcgcctgttacaggccgtggagaacggagacgccgaaaaagtggcaagtttactcggaaagaaaggcgcaagcgctaccaagcacgatagcgaggggaagaccgctttccacctagcagccgcaaaaggccacgtggagtgtttgcgcgtaatgattacccacggggtcgacgtgaccgcgcaggacaccaccggtcatagcgctctgcatctggccgccaaaaattcacatcatgagtgcattcgaaagctgcttcagtctaagtgcccagcagaatccgtcgactcatccggtaagactgcgctccattatgcctag

SEQ ID NO: 203099 - DNA, 2952 bp, Artificial Sequence
  Description of Artificial Sequence: Synthetic coding sequence
atgcagcccacctacctgccctggctgagcgccaaggagaagaagactaatgaatggaataaaaatgacgatagattactgcaagccgtggaaaatggcgatgccgagaaggtcgcctcactcctcggcaagaaaggagctagcgccactaagcatgactctgaaggtaaaactgcatttcacttggcggccgctaagggtcatgtggagtgcttacgagtcatgatcacacacggagtggacgtcactgcccaggacaccactggacatagcgccttgcacctggctgccaagaactcccaccatgagtgcattcggaaactgcttcaatccaagtgccctgcagaaagcgtggattcctcgggaaagacagccctgcattacgctgcggcacagggatgcttgcaggccgtgcaaatactgtgcgagcataaatccccaattaatctgaaagatctggacggtaatattcccttgctgcttgcagtccaaaacggtcacagtgagatttgtcattttctgctggaccacggcgccgatgtgaacagccgcaacaaatccggcaggacggctctcatgttggcttgtgagatcgggtcttccaatgcagttgaagcccttatcaaaaaaggagccgatcttaatctggttgattctctcggctataatgcactccattactcgaagttgagcgagaacgctggaattcagtccctcctgctcagcaaaatcagtcaagacgctgatctaaagactcctaccaagccaaagcaacacgaccaggtgagcaaaatttccagtgagcggagtggcactccgaagaaacgcaaggcccctcccccaccaatttcgcctactcagcttagcgatgttagtagtccaagatcaatcacaagcacccctctgtccggcaaggagtctgtgttcttcgctgagccccccttcaaggccgaaattagctctatcagggagaataaagacaggctgtctgattcaaccacgggggccgactcactgctggatatctcatctgaagccgatcagcaggacctgcttagcctgctgcaggctaaggtggcgagtctcacgttgcataacaaagagttgcaagacaagctgcaggctaaatctccaaaagaggccgaggctgaccttagtttcgacagttaccacagtacacagactgacctgggccctagtctggggaagcctggagagacttctccaccagattcaaagagtagtccctccgttctgatccacagtctgggcaaatctactactgataatgatgtgaggatacagcagttgcaggaaatcttacaggatctccagaaaagattggaatccagcgaagcagagaggaaacaattgcaggttgaactacaatctaggagagccgagcttgtgtgtctgaataacacagagatcagtgaaaattcttcggatttgagtcagaaactcaaggagacacaatctaaatacgaggaggctatgaaagaggtgctcagcgtgcaaaagcagatgaagttggggctggtgtcccccgagtccatggacaactactcacactttcatgagctgagagtgacagaagaagagataaatgtgttaaagcaagacttgcagaacgccctggaggagagcgaaagaaataaggagaaggtgcgggaactggaagagaagttagtggaacgagagaagggtaccgtgatcaagccgcccgtagaggagtacgaagaaatgaaaagctcttactgctctgtgatagaaaatatgaacaaggagaaagcttttctgttcgaaaaataccaggaagcccaagaggagatcatgaagttaaaagataccctgaaatctcaaatgacacaggaggcatctgacgaagctgaggacatgaaggaagctatgaacaggatgattgacgaactcaataagcaggtatctgagctgtctcagctatataaggaagcccaggccgaattggaggattatcgaaagagaaagtctttggaagacgtcactgcggagtacatccacaaagctgagcacgagaaactcatgcagctgactaacgtcagtagagcaaaggctgaggacgctctgtcggagatgaaatctcaatactcaaaagtgctgaatgagctcacacagctgaagcaattggttgacgcacaaaaagaaaattctgtatcgatcactgagcatctccaggtgataaccacccttcggacagctgccaaggaaatggaagagaaaattagcaatcttaaggagcacctggcgagcaaagaggtagaagtggccaaattggagaaacagctcctggaggaaaaagcagccatgactgacgcgatggtaccacgctcctcctacgagaagctgcagtccagccttgagagcgaagtttcggtcctcgcctccaagcttaaggaatccgtaaaggaaaaagaaaaggtccactccgaggtggtgcaaattcgcagtgaagtcagtcaggtgaaacgagagaaggaaaatatccaaactttgctaaagtctaaggagcaggaagttaatgagctgctacagaagttccagcaagcccaggaagagttggccgagatgaagcgctacgcagagtcgtccagtaagctggaggaagacaaagataagaagattaatgaaatgagtaaggaggttactaagttgaaggaggctctaaattctctgtcccagttaagctatagtacgagttccagcaagagacagagccagcagcttgaggccctccagcaacaggtcaaacagctgcagaaccagctcgctgaatgtaaaaaacagcaccaggaggttattagcgtgtatagaatgcatctactctatgccgtgcaggggcagatggatgaggatgttcaaaaagttttgaagcagattttgaccatgtgtaagaatcagtcacagaagaaatag

SEQ ID NO: 203100 - DNA, 2856 bp, Artificial Sequence
  Description of Artificial Sequence: Synthetic coding sequence
atgaagagcctgaaggccaagttccggaagagcgacaccaacgagtggaataagaatgacgaccgtctgctccaggctgtggaaaacggcgacgcagaaaaggtcgcttccttgctcggtaaaaaaggcgcttccgccactaaacacgacagtgaaggcaaaactgcttttcatctggctgcagccaagggacatgtggagtgtttacgggtgatgattactcatggggtagacgtgaccgcgcaagataccactggccattctgcactccacctggcggctaaaaattctcaccacgagtgtatccgaaaactgcttcaatctaagtgtccagcggaatcggtagatagctccggcaaaaccgctttacactatgccgcagcacagggctgtctgcaggcagttcagatcctgtgtgaacacaagtctcccattaaccttaaggacctggatggaaacatcccccttctgctcgctgtgcagaatggtcatagcgagatttgtcacttccttctcgatcatggtgctgacgtcaactctagaaacaaaagtggccgaacagccctgatgctggcctgtgaaatcggttctagtaatgctgtggaggcactgatcaagaaaggcgccgatttaaatctggttgactctctgggatataatgcactgcactattcaaagctgtccgagaatgcaggaatacagtcacttctcctcagcaaaatctcacaagacgccgatctcaagaccccaactaaaccaaaacagcttagcgatgtttccagtccccgctccattacgtccacgcctctcagcgggaaggagtcagttttcttcgcagagcccccgttcaaagcagaaatcagctcgattcgcgagaataaggaccggttgtcagattcgactaccggtgcagatagtctcctggacatttcctctgaggctgatcagcaggatttgctgagcctgctgcaggccaaggtcgcatcgttgaccctacacaacaaagagctgcaggataaactccaggccaagtctcccaaagaggccgaggccgaccttagctttgactcataccacagtacccagacagatctaggaccctccctggggaagcctggcgaaacatccccacccgactccaagtcctctcccagtgtcctcatacactccctcggcaaaagcactaccgacaatgatgtccgaatacagcagctgcaggaaattctccaggacctccagaagaggctcgagtccagtgaagccgagcggaagcagctacaagtagagctccagagccggagagcagagcttgtgtgtttgaacaacacggagatttcggagaattcttccgacctgtcccagaagctcaaggaaactcaaagcaaatatgaagaggccatgaaggaagtgctctctgtgcaaaagcaaatgaagctcgggctggtctcaccagagtctatggacaactattcccactttcacgaattacgggtgactgaggaggaaataaacgtgctcaagcaggacctgcagaatgccctggaggagagtgagaggaataaagaaaaggtgcgggagctagaagaaaaacttgtcgagcgagagaagggtacagttataaagccacccgtggaagagtacgaagaaatgaaatccagttactgttccgtgatcgagaatatgaataaagaaaaggcctttctattcgaaaagtaccaggaagctcaggaggaaattatgaagctgaaagacacactgaaatcacagatgacccaagaggcctctgacgaggctgaggatatgaaggaggccatgaaccgcatgattgatgagctgaacaagcaggtcagtgagctgagccagctttacaaagaggcacaggccgaactggaagattacaggaaacgtaagagcctggaggatgtcacagctgaatacattcacaaggcagagcacgaaaagttgatgcagcttacaaacgtctctcgagctaaagcagaggatgctctatctgaaatgaaaagtcaatacagcaaagtgctgaatgaactcacccaacttaagcagctcgtggatgcccagaaggaaaactccgtctcaataacggagcatctgcaggtaatcacaacactcaggaccgctgccaaagagatggaggagaagattagcaaccttaaggagcatttggcatctaaagaagtagaggtagctaagctggaaaaacagttattagaagagaaggccgccatgacggatgcgatggtgccccgctctagttacgaaaagctgcaatcgagtctggaatctgaggtttcagtgctggcaagcaaactaaaggaatcagttaaggaaaaagaaaaagtccacagcgaggttgttcagattagatcagaggtgtctcaggtaaaacgtgagaaggagaacatccagaccctattaaagagtaaagagcaggaagtgaatgagctgctgcagaaattccagcaggcccaggaggaactcgccgagatgaaaaggtacgcagagagcagtagcaaattagaagaggataaggacaaaaaaattaatgagatgagcaaggaggtcaccaagttgaaggaggcacttaactcactgagtcagctgagttacagtaccagttcttccaagcgtcagagccagcagctggaagcgctgcaacagcaggtgaaacagctccagaaccaactggctgagtgtaagaaacaacaccaggaagtcatttctgtatatcgcatgcacctcctgtatgcagttcagggccaaatggacgaagacgtgcagaaagtgttgaagcagatcctgacaatgtgtaagaaccagtctcagaagaaatag

SEQ ID NO: 203101 - DNA, 1593 bp, Artificial Sequence
  Description of Artificial Sequence: Synthetic coding sequence
atggacgacctgcagagccagaacctgagcatggacatgaccgacagtcccccagccctggctaataatcggctggagaatggaatggcccaactgattactaccgaggcctggaatattaacagcacggacctggtgaagaaggccctggtgacggtgcctgctccaagcatcctgaaccccccagctgagagtcagtcaggaatggccctgaaggtggctgctaccgtcctgcagccactctgtctaggtgagtctcccgtcgtgatgcccatccacatgcaggtggagggttcctccgcccccgagctaaacccaaacggaaatgcaacttatgtgatgactacccagggccccgtccaacttcccgtcgtgctggagcagcacgtctttcagcatctcaactcccccctggttcttccccaagaagctccctgttcttcttccactatccataataatctgtttcagggcgcagaagaccctgaagcccagccccaactcctggacctcaggatccccagccaaccacaagaacctactttgccatttgaggctgtgttgcagaaccttttccccagtcagggaaccctcgggcctccaccgtgtcagccacccccgggatacgcgccagtacctccacaaccgttcagcagtccactttctccattggtgcctcccgccacactattagtaccataccctgttattgtgccgctgccggtccccgtccccatcccaatccccatccctatgccacagagctctgagagcaagttctcatcatcatttccgaagcccccaagttccttcggcctccatccctttaaaggcacacagactcccctggaaaaagacgagctgaaacctttcgacatactgcagcctaaggagtatttccagctgtctaggcacacagtgatcaaaatgggttcggagaatgaagcactggatcttagcatgaagagtgtgccctggctgaaggctggggaggtctctccgcccattttccaggaggacgcagcactagatctttctgtcgccgcccacagaaaaagcgagcctccaccagaaactctgtatgattccggagcgagcgtcgactcgtccggtcatacggtcatggagaaactgccctcaggaatggagataagcttcgctccagccacatcccacgaggcaccagctatgatggatagccatatttcatcctccgatgcggccactgaaatgctgtcacagcccaaccacccatcaggagaggtgaaggcggagaataatatcgagatggttggagagtctcaggccgccaaagtgatcgtgtccgtagaggatgctgtgccgactatattttgcggcaagattaaaggtctctctggagtgagcactaagaacttttcattcaaacgcgaagacagtgtgctgcagggctacgacattaattcccagggagaggagtcaatgggcaatgcagagcctctgcggaagcccatcaaaaatcgctcaatcaagctgaagaaggtgaactcgcaagaaatccatatgctgcctattaagaaacagaggcttgccacgttcttcccgcggaagtag

SEQ ID NO: 203102 - DNA, 1593 bp, Artificial Sequence
  Description of Artificial Sequence: Synthetic coding sequence
atggacgacctgcagagccagaacctgagcatggacatgaccgactcaccacccgcgttggctaataacaggttagagaatggcatggcacaactcatcacgaccgaagcctggaatataaatagtacagacctggtgaagaaggctctggtgacggtccccgcaccttccattctgaatccccctgccgagagtcagagcggcatggccctgaaggttgcagctacggtgctacagcccttgtgcttaggagagtctcctgtggtgatgcctatccacatgcaggtggagggtagctccgcccccgaattgaatcccaacggcaacgctacgtacgttatgactacacaaggaccggtccagctaccagtcgtcctggagcaacacgtgttccagcacctgaacagccccttagtgctgccgcaggaggccccctgcagcagttcaacaatccacaacaatctctttcagggtgctgaggatcctgaagcccagcctcaactgctggatttacgcatcccctcccagcctcaagaacccacactgcctttcgaggcagtcctgcaaaacctctttccttcacagggtaccctgggtccaccgccatgtcaaccccctcctggttacgcgcctgtgcctccccaaccatttagtagcccactgtcacccttagtccctccggctactctcttagttccctaccctgtcatcgttccactgcctgtgcctgtccccatccctattccaatcccgatgccacagtctagcgaaagtaagttcagctccagcttcccaaaaccgccttcctctttcgggctccacccctttaagggcacccagacgccactagagaaagatgagctgaagccctttgatattcttcagccaaaggagtacttccaactgagccggcacacagtgatcaagatgggaagcgagaatgaagcactagatctgtcaatgaagtccgtcccttggctaaaggcaggggaagtgagcccacctattttccaggaagacgccgcgctagacctgagtgttgccgcccaccggaagagtgaaccaccacccgagactctctacgatagtggcgcttccgttgattcctcgggccatacagtaatggaaaaactcccgtctggcatggaaatctcattcgcaccagccacctcacacgaagccccagctatgatggacagtcacatttcttcctctgacgcagctacagagatgctatcccagccaaatcacccatctggggaggtgaaagccgagaataacattgagatggtgggcgagtcccaggctgccaaagtgatagtttccgtggaggatgcggtaccaactatattctgcggtaaaataaagggcttgtccggcgtgagcaccaagaatttctcctttaagcgagaagatagcgtcctgcagggatatgacatcaactcccaaggcgaagagagcatggggaacgcagaaccactgcgaaagcccatcaagaatagaagtatcaaactcaaaaaggttaactctcaggaaatacacatgctccccattaaaaagcagaggctcgccaccttcttcccccggaagtag

SEQ ID NO: 203103 - DNA, 1443 bp, Artificial Sequence
  Description of Artificial Sequence: Synthetic coding sequence
atggacgacctgcagagccagaacctgagcatggacatgaccgactctccacccgcactggctaacaatagattggaaaacgggatggcccaactgattacaactgaagcttggaacattaatagtacagacctggtggagggaagcagcgcacccgaactgaacccaaacggtaatgctacatacgtgatgactacacagggcccagttcaactgccagtggttctggagcagcacgtttttcagcacttgaattcgcctctggtgttgcctcaggaggctccatgttcatctagtacgatccataataatctgttccagggcgccgaagatcctgaagcacaaccccagctactggatcttcggatcccatctcaaccacaggagcctacactgcctttcgaagcagtactccagaatctgttcccttcccaaggaaccctggggccccccccttgccagccaccaccagggtatgcacccgttcctccacaaccttttagtagtcctctgagtcctcttgtgcctccagcgaccctgttggtgccgtatcccgtgattgtgccgctgcccgtgcctgtacccattccgatccctattccaatgccacagtccagtgaaagcaaattttccagcagtttcccgaaaccacccagtagttttggactccatccatttaagggcacccagactcccctggagaaggatgagcttaaacctttcgatattctgcagcctaaggagtacttccaactaagccggcacacagtcataaaaatggggtcagaaaatgaggccctggatctgagtatgaagtccgttccatggcttaaagctggagaagtgtcacccccaatattccaggaggacgcggcgcttgatttatccgtcgctgcacatcgaaaatctgaacctcctccagaaaccctgtacgatagtggagcctctgtcgattcctctgggcacactgtgatggagaagctgccctccggaatggaaattagctttgcccccgctacgtcacacgaggctcctgcaatgatggattcccacatatcttcctcggatgcagccaccgagatgctttctcagcccaaccatccttccggggaggtgaaagcagagaacaacattgagatggtgggcgaatctcaagcggcaaaggtgatcgtgagcgtcgaggacgctgtgcctacaattttttgcggaaaaatcaagggtctcagtggcgtgtctaccaaaaacttttctttcaagcgagaggacagtgttctgcagggatacgacattaactctcagggggaggagtctatgggaaatgcggaaccattaaggaaaccaataaagaatcgtagcatcaagttgaaaaaagtgaattcacaggaaattcatatgctgccgattaagaaacagagacttgccacttttttcccacgcaagtag

SEQ ID NO: 203104 - DNA, 1593 bp, Artificial Sequence
  Description of Artificial Sequence: Synthetic coding sequence
atggacgacctgcagagccagaacctgagcatggacatgaccgacagcccgccagcccttgcaaacaataggcttgaaaacggaatggcccaactgataactacagaagcgtggaacattaactccactgacctggtgaagaaggcgctggtgactgtccccgcacccagcattctcaatccaccagccgaatcacagtccggtatggcactgaaagtggccgcaacagttttacagcctctgtgcttgggcgaatctccagtagtcatgccaatccacatgcaagtggagggatctagcgcccctgaactcaatcctaatgggaatgctacttacgtaatgacgactcaaggcccagtccagctgcccgttgtactcgaacagcacgtgttccaacacttgaactcacctctggtgctgcctcaggaggccccatgcagcagcagcactatccataataatctgtttcagggggccgaggacccggaggcccagcctcaattgttagacttgcgaatcccgtctcagccacaggagcctacattaccgtttgaagccgttctgcagaaccttttccccagtcagggtacattagggccccctccttgccagccgccaccaggctacgctccagtcccaccacaaccatttagcagccccctgtctcccctggtgccccccgcaactctgttagtcccctatcctgttatcgtccccctgcccgtgcctgtgcccatccctattcccattccaatgccacagagctcagaatccaaattttccagctcgttcccaaaaccaccttccagctttggactccatccattcaagggcacccaaactccgctcgagaaagatgagctgaagccattcgatatcctgcagccgaaggagtattttcaattgtcccgccacacagtgatcaagatggggtctgagaacgaagcattggacctctccatgaagagcgttccttggctgaaggccggagaggtgagcccacctattttccaggaagacgccgccctggatctgtctgtagcagcccacagaaagagcgagcccccccccgagactctgtacgatagcggagcctccgtggattcctctggccatactgtgatggagaaacttcccagcggcatggaaattagcttcgctcctgcaaccagccacgaggctcccgctatgatggattcccacatatccagttcagacgctgctaccgaaatgctctctcagcctaatcaccctagcggggaggtgaaggctgagaataacatagaaatggtgggagagagtcaggccgccaaggtcattgtttctgtggaggacgctgtccctacaatcttctgcggaaaaatcaagggcctgtccggcgtgagcacaaaaaacttttccttcaaaagagaggattctgtactgcaggggtacgatattaattcccagggggaagagtccatgggtaacgctgaacctctaaggaagcccatcaagaaccgcagtatcaagcttaagaaggttaactcacaggaaattcacatgttgccaatcaaaaaacagaggctagctaccttctttcctcggaaatag

SEQ ID NO: 203105 - DNA, 1593 bp, Artificial Sequence
  Description of Artificial Sequence: Synthetic coding sequence
atggacgacctgcagagccagaacctgagcatggacatgaccgacagcccaccagcgctggcaaacaatagactcgagaacggaatggcacagctcatcactacggaagcttggaacatcaatagtacggatctggtgaagaaggcactggtgacagtacccgccccctctattctcaacccccctgctgaatctcagagcgggatggctctcaaagttgctgctacagtgctccaacctctctgcctgggagagagtccagttgttatgccaatccacatgcaggtggaagggtcatccgcgccagagcttaatcccaacggcaacgctacctatgtcatgactactcaaggtcccgttcagctgcctgttgtgttggagcagcacgtcttccaacaccttaactctccgctcgtgttaccccaggaggcaccgtgctccagctcaacgatccataacaatctcttccagggtgcagaggaccccgaagcccagccccagttgctggacctacgaattcccagccaacctcaggagcctacactccctttcgaggctgtgctccaaaaccttttcccctcgcagggcaccctggggcctccgccgtgtcaaccccctcctggatacgccccagtcccgccccagcccttcagcagccccctgagcccgctcgtgccacccgctacgcttctggtcccttaccctgtgattgtgcccttaccagtcccagtcccaattcctattcctattccgatgccccagagtagcgaaagtaagttctcgtcttctttccctaaacctccatccagtttcggattgcacccattcaagggtacccagactccactggaaaaggatgagctaaagccatttgatattcttcaacctaaagagtatttccagctgtctcggcatacagtgataaagatgggcagcgagaacgaagctcttgatttgtccatgaagtctgttccctggctcaaggcaggcgaggtttctccaccaatcttccaggaagacgccgccctggacctatccgtggccgcccacaggaagtctgaaccgccccctgagactctgtacgatagtggcgcgtcagtggattcaagcggacacacagtcatggaaaagctgcccagcggtatggagatatcatttgctccagcaaccagccacgaggccccagctatgatggactcacacatcagctccagcgacgcagctaccgaaatgctgtcgcagcctaatcaccctagcggcgaggtgaaagctgagaacaatatcgaaatggtcggcgaatcacaggcagccaaggttattgttagcgtggaagacgctgtgccgactattttttgtggaaaaatcaaggggctgagcggagtaagtaccaagaattttagctttaaaagagaagacagcgtattacagggatacgatataaatagtcagggagaggagtccatgggtaatgccgagcccctgagaaagcctataaaaaacagatcgattaagctgaaaaaggtgaacagccaggaaatacacatgctgccaatcaagaaacagcgcctggcaacattctttccccgcaagtag

SEQ ID NO: 203106 - DNA, 885 bp, Artificial Sequence
  Description of Artificial Sequence: Synthetic coding sequence
atgcagccccggcggcagcggctgcccgccccctggagcggccccagaggcccaagaccaaccgcaccgctgctcgcactccttctgctcctggccccagtcgccgcaccagcagggagtggagatccagatgaccctggacaaccccaggacgccggcgtccctagaagactgctgcagcaagccgcccgcgcagctctgcacttcttcaacttccgcagcgggtctccaagtgctctgagagtactcgctgaggttcaggaaggcagggcctggataaaccctaaagaaggctgcaaggtccacgtagtgttctctacagagcggtacaaccccgagtcactcctgcaggaaggcgaaggtaggctgggtaaatgctccgctagagttttctttaaaaatcaaaaaccacggcctacaattaacgttacctgcactagattgattgaaaagaagaaacgccaacaggaagattatttgctatataagcagatgaagcagctgaagaatcctctggaaatagtaagtatcccagataatcatggccatatcgaccccagcttgcggctcatttgggatctcgctttccttggctcttcctacgtcatgtgggaaatgacaacccaggtctcccattactatctcgcccaacttacgagcgtgcgacagtggaagacaaacgatgacacaatcgatttcgactataccgtcctcttgcacgagctatcgacacaggaaatcatcccttgcaggatacatctcgtttggtaccctgggaagcctcttaaagtcaagtaccattgccaggagttacagactcccgaggaggcgtcaggaaccgaggagggttctgccgtggtcccgaccgaactaagcaacttttag

SEQ ID NO: 203107 - DNA, 687 bp, Artificial Sequence
  Description of Artificial Sequence: Synthetic coding sequence
atgcagccccggcggcagcggctgcccgccccctggagcggcccccgcggaccaagacctaccgcgcccctgctcgccttgctcctgctgctcgctccagttgctgccccagccggatcaggggatccagacgaccccggacagcctcaggatgctggcgtacctaggcgcttgttacaacaggctgctcgcgctgctctgcacttcttcaatttcagaagcggttccccaagcgccctccgagttctggcagaagtgcaggaggggagagcatggatcaatcccaaggaagggtgtaaggtccatgtggtttttagtaccgaaagatataaccccgaaagcctgctacaggagggcgaaggcaggctcggaaaatgttctgccagagtcttttttaaaaatcagaagccacgaccaacaattaacgtaacctgcacaagacttattgagaagaagaagcggcagcaggaggattacctcctgtataagcagatgaagcagttgaagaatccgctggaaatcgtgagcatccccgataaccacggccacatcgatcctagcttgcgccttatttgggatctggcctttctcggctcgtcttacgtaatgtgggagatgaccacccaggtctctcactattatctggcccagctaacatcagtgagacagtgggtgcgaaagacatag

SEQ ID NO: 203108 - DNA, 1008 bp, Artificial Sequence
  Description of Artificial Sequence: Synthetic coding sequence
atggtgcggcgggaccggctgcggcggatgcgggagtggtgggtgcaggttggactgcttgcggtaccacttctcgccgcatacctgcacatccctccaccccagctgtctcctgctttgcactcctggaaatcctccggaaaatttttcacctataaggggctgaggattttctaccaggattctgtcggcgtcgttgggtctccagaaattgtcgtcctgctgcacgggttcccaaccagttcgtatgattggtataaaatctgggagggcctaactctccggtttcacagagtgattgccctcgactttctgggctttgggttttccgacaagcctcgaccacaccattatagtatattcgagcaggccagtattgttgaggcacttctgcgccatttgggacttcagaacagacggataaatctactgtcccacgattacggagacatagtggcgcaggaactactgtatcggtacaagcagaatagatcaggccgcttgaccattaaaagcctgtgtctgtcaaacggaggcatctttcccgagacccacagacctctcttgttgcaaaagctgctgaaagatggcggagtcctctcaccaatattaactcgactgatgaatttttttgtattcagtagaggtctgacacctgtttttgggccctacacgaggccatctgaaagcgaattatgggacatgtgggccgggatcaggaataatgacggcaatcttgtaatcgactctctgcttcagtacataaatcaacgaaaaaaattccgcagaagatgggtcggggccctcgctagcgtaactatccccatccactttatctacggacccctggatccagtaaatccgtacccagagtttctggagctgtataggaaaactttgccccggtctacagtgagcattctggatgaccatatctcacattacccacaactggaggaccctatgggcttcttgaatgcctacatgggcttcattaacagtttctag

SEQ ID NO: 203109 - DNA, 492 bp, Artificial Sequence
  Description of Artificial Sequence: Synthetic coding sequence
atgcggcggctgctgatccccctggccctgtggctgggcgccgtgggggtgggcgtcgccgagctgacggaggcgcagagacggggtctccaggtagcacttgaggagtttcataagcatccacccgttcagtgggcattccaggagactagcgtggaaagcgcagtcgataccccatttccagcgggcattttcgtccgcctcgagttcaagctgcagcaaacttcatgtcgcaagagagactggaaaaaacccgagtgtaaggtgcgtccgaacggacgcaagagaaaatgcctggcatgcattaagctggggtcagaggacaaggtgctcgggcgcctggtccattgcccaattgaaacccaagttttgcgggaggccgaggagcaccaggaaacacagtgccttagggtgcaacgcgccggagaagatcctcactctttctacttccctgggcaattcgccttcagtaaggcactgccaaggagctag

SEQ ID NO: 203110 - DNA, 492 bp, Artificial Sequence
  Description of Artificial Sequence: Synthetic coding sequence
atgcggcggctgctgatccccctggccctgtggctgggcgccgtgggtgtgggcgtggccgagctaacagaggcccagagacggggcctgcaggtggccctagaagaatttcacaaacacccacccgttcaatgggcctttcaggagacatcagtcgagtctgccgtcgatacaccatttccagccggcatctttgttcgacttgagttcaagctgcagcagacctcgtgccggaagcgtgactggaagaaaccggaatgtaaagttcgtcccaatggccggaagaggaagtgcctggcctgtattaagctgggaagtgaagataaagtgctgggcaggttagtgcactgcccaattgagactcaagtcctccgcgaggccgaagagcatcaagagacacagtgtttgcgcgtccagcgggctggagaggatccccactcgttctacttccctggacagttcgccttttcaaaggcactcccccggagctag

SEQ ID NO: 203111 - DNA, 495 bp, Artificial Sequence
  Description of Artificial Sequence: Synthetic coding sequence
atggccagcccccaccaggagcccaagcccggcgacctgatcgagatcttccgcctgggatatgagcattgggcactctacataggggacggctatgtgatccatctcgcccctccttccgaatatccaggggctggtagcagttccgtcttcagtgtgctcagcaattcagccgaagtcaagagagagcgtcttgaagatgtggtcggaggctgttgctatcgcgtgaacaattcactcgaccatgagtatcagccacgtcctgttgaagtcatcatcagctcggcaaaggagatggttggtcagaaaatgaaatactcaattgtgtccagaaattgcgagcattttgtcacacaactcaggtatgggaagtctaggtgcaagcaggttgagaaagccaaggtggaggttggtgtcgcgactgcgctagggattctagtcgtggcaggatgtagctttgctattaggaggtatcagaagaaggctacagcctag

SEQ ID NO: 203112 - DNA, 495 bp, Artificial Sequence
  Description of Artificial Sequence: Synthetic coding sequence
atgggcctgcccgagcccaagcccaagcccggcgacctgatcgagatttttcgccttggttatgagcattgggccctgtatattggtgatggctacgtgatacacctggcgccaccttctgagtaccctggtgcaggtagtagcagcgttttctccgtgctgtctaattctgcggaggttaagagagagcggctcgaggacgtggtgggcggctgctgttatcgtgtcaacaactccttagatcatgaataccagcctagaccagtggaagtgatcatttcttccgctaaggagatggtgggtcagaagatgaagtacagtatcgtctctcgcaattgtgagcatttcgttacacagctgcggtacgggaaatcacgctgtaaacaggttgaaaaggccaaagtcgaggtcggcgttgccaccgcactgggtattctggtagtagctggttgctcctttgccattcgcagataccagaagaaggcaaccgcctag

SEQ ID NO: 203113 - DNA, 1389 bp, Artificial Sequence
  Description of Artificial Sequence: Synthetic coding sequence
atggccagcaacagcagcagctgccccacccccggcggcggccaccttaacggatatcctgtgcccccttacgcctttttttttccaccaatgcttgggggcctgtcccctcccggcgcactgacaacccttcagcaccaactgcccgtctctggttacagcactccgtcaccggcaactatagagacacagtcaagctcaagtgaagaaattgtcccaagcccacccagtccaccccccctgcctcgcatttataaaccttgttttgtgtgccaggataaaagctccggataccattacggcgtttccgcctgtgagggatgcaagggttttttccgtcgctctattcagaagaatatggtgtacacatgccatcgggacaaaaattgtatcataaataaggtcactaggaaccgatgtcaatattgccgcctacagaaatgttttgaagttgggatgtccaaagagagtgtgcgtaacgatcggaacaaaaaaaaaaaagaggtccctaagcccgaatgtagtgagtcttatacgctaacaccggaagtgggggaacttatcgagaaggttaggaaggcccaccaagagactttccccgccctgtgccagctcggcaagtataccaccaataattcatccgaacagcgggtgtctctggacattgatttgtgggataaattctcggagctatctactaaatgcattatcaaaacagttgaattcgcaaaacaattacctggctttaccacgctaacaatcgctgaccagattacactgttgaaggcagcctgcctggatattctgatcctgcgcatttgcaccaggtatacacccgagcaggataccatgacattttctgatggccttactttaaacaggactcagatgcataacgccggcttcgggcccctgaccgacttagtgtttgccttcgctaatcagctgcttcctctggagatggacgacgccgagacgggactgctgagtgctatttgcctgatttgtggggataggcaggatctagagcagccagaccgggtcgacatgttacaggaacccctgttggaagccctaaaggtgtacgtccggaagaggcgccccagccgcccgcatatgttccccaaaatgctgatgaagattactgatttgcggtccatctcagccaaaggagcagagcgcgttattactctaaaaatggagatccccggtagtatgcctccgttaattcaggagatgctggaaaatagtgaaggtttagatacgctgagcggccagcctggagggggcggtcgagatggcggtgggctagcacccccccctgggagttgctccccgagtctctccccaagcagtaaccggtcctcacccgccacccactcaccctag

SEQ ID NO: 203114 - DNA, 1902 bp, Artificial Sequence
  Description of Artificial Sequence: Synthetic coding sequence
atgtacgagagcgtggaggtgggcggccccacccccaaccccttcttggtggttgacttctataaccagaaccgtgcctgtctgttgccggagaagggactgcctgccccaggcccgtactccactccactccggactcctctttggaatggtagcaaccacagtatagagacgcaaagcagcagcagcgaggaaattgtgccttcgccaccgagtccaccacccttgccaagaatttacaagccttgttttgtatgccaagacaagtcctccggatatcattacggtgtctccgcgtgcgaggggtgcaagggatttttccggagatctatccagaaaaacatggtgtacacatgccaccgtgataaaaattgtataatcaataaggtgacaagaaatcgctgtcagtactgcaggctgcagaagtgctttgaagtgggaatgtccaaggagagtgtgagaaatgatcgtaataagaagaagaaggaagtgccgaagcctgaatgctccgagtcatatacactcactcccgaggtgggcgagttaatcgaatgcgcaaagaggaccaggaagccttctcttccctctgccagttgggctaacacactcagaactacggctcagaataatgtatccttatggactctgacaagtggcaccagttccgtgaatagtcctaaatgcatcatcaagactgtggagtttgctaaacagctccccggttttactactctaacaattgcggatcagataaccctgcttaaagccgcatgcctagacatcctgatcttgcggatttgtactcgatacactccggagcaagacaccatgacattttcagatggacttactctgaataggacccagatgcacaacgctggatttggtccattgacggacctagtctttgctttcgccaaccagctcctgcctctggagatggatgacgcggaaacagggctcctatctgccatctgtcttatctgcggcgaccgtcaagacctggagcagcctgatagggtggatatgctgcaggaacctctgttagaagcattgaaagtgtatgtgcgcaaaagaagaccttctagacctcacatgttccccaaaatgctgatgaagatcacagacttgagatccatttcagccaaaggcgccgagagggtgatcacactgaagatggaaattcccgggagcatgccacctctaatacaggagatgttagaaaattcggagggactcgacaccttgtctgggcagcctggtggcggaggccgtgatggaggtgggctgccccgccaggctgcagtagccccagcatccgctccagcccctacagaggcagcgcgccctccaactcctcgagacaggcctcgtcatatggacaccgccctggccctcaggcctggcttttcactgcccttttataggccttgtgaccccgcacctgccctcccaccacctgctctgcccgggagcacgggtgacctgccctggggcaccggtcgagaggaggcagccactccatggacggaagcctgggcactgtcaggactgccggccccgaccgcttgggcggatgtacgaggaaggggacaggagctcagcgaagcgcccggtccaggttcacaggacggcagctgggggccaagggtgcaccaggacacaccgctgccaagtagcccacacctgcaccaccagcaaacccccggcctggggagtccaattttgcggacacacaaaccgctcctgccatcctggggaactagtacttcccctttgccccgcctcgtgaccgaaggggtcggccagggcagaggcgtccctccggtgcataccttgccttatcagccccaagtgctgatcttagccggttttgtttttatcctgatcttcctgttctag

SEQ ID NO: 203115 - DNA, 1374 bp, Artificial Sequence
  Description of Artificial Sequence: Synthetic coding sequence
atgtacgagagcgtggaggtgggcggccccacccccaaccccttcctagtcgtcgacttctataatcaaaaccgagcctgcttgctccccgaaaaagggcttcccgcccccggaccttattcaactccgcttcgcacacccctttggaatggatcaaatcattcaattgagacccagagtagttcctccgaagagatcgtgccatcccccccctctccaccacccctgccaaggatctataagccctgcttcgtgtgccaggataagtcctcgggctatcactacggcgtatccgcttgtgagggatgcaaagggttttttagacgttcaatccagaagaacatggtctacacatgccacagagacaagaactgcatcatcaacaaggtaacgaggaaccgctgtcagtactgcagattgcaaaaatgcttcgaggtgggtatgtccaaagaatccgtgagaaacgacaggaataaaaagaaaaaagaggtaccaaagcccgagtgttctgaaagttacactctcacgcccgaagttggagagcttattgagaaggttcgcaaggctcaccaggaaacatttcctgccctatgtcagctgggcaaatatactaccaacaattcatcggagcagcgcgtctcactggacatcgatctgtgggacaaattcagcgagttgtcgacaaagtgtattattaaaactgtggaatttgccaaacagctaccagggttcaccacacttaccattgcagatcaaataacactgctcaaagccgcgtgcttggatatcctgatactgagaatctgcaccaggtacacaccagaacaggacacaatgacattttcagatggcctgacccttaatcgcacacaaatgcacaacgctggattcgggccactaaccgatctggtgttcgctttcgccaaccaactgctgcccttagagatggatgatgccgagacggggctcctcagcgctatctgcctgatctgtggtgatcggcaagatctggagcagcctgaccgtgttgatatgctccaggagcctcttctggaggccctaaaggtctacgttcgcaagaggcgcccttcccggccccatatgtttcctaagatgctcatgaaaattacagatcttaggagcatcagcgcaaaaggggcggagagggttatcaccctgaagatggagattcccggtagcatgcccccgctcatccaggagatgctggagaattccgaggggctcgacaccctctccggtcagccaggcggcggcgggagagacgggggtggcctggcccctccacccggcagctgtagcccttctctttctccatcatctaatagatcttcccccgccactcattccccgtag

SEQ ID NO: 203116 - DNA, 1437 bp, Artificial Sequence
  Description of Artificial Sequence: Synthetic coding sequence
atgatgagccagaccatgacccaggccggcgtgagcttccggcactcagttagagcagcccaatgtcacacaagagtcccaaatacctggccaagggcgacaagaccttatgcatcgtgccggcggagcccccgcttacgggggaggtggccgggcagtgccggtcagggcgctgggggcagggccccccgggctggttggcgggcgggcgacgttaccggcagtgcaatcgagacgcagagctcttcttccgaggaaattgttccttctccaccgtccccgccaccgctgccaagaatatataagccgtgcttcgtatgtcaggacaagtccagtggttaccactatggagtctctgcctgcgagggctgtaaggggttttttcgtcgcagcatacagaagaacatggtgtacacctgccaccgggacaagaattgtattattaataaagtgactagaaacaggtgtcagtactgtagacttcaaaaatgttttgaggttggaatgtcaaaggaatccgtgcggaatgatcggaataagaagaaaaaggaagttcctaaaccagagtgtagcgagtcttataccctgacacctgaagttggcgagctcattgaaaaggtgagaaaggcacaccaggaaactttccctgcattgtgccagttgggcaagtatactaccaataacagctctgagcagcgtgtttctttggatatcgatctgtgggacaagttctccgagttatcgacaaagtgcattatcaagactgtagaattcgccaagcagctgcctgggttcaccacccttactatcgccgaccagattacgctcctcaaggccgcatgtcttgacatactgatcttgcgcatttgtaccaggtacactcccgagcaggacacaatgaccttttctgacggtcttactctgaatcgcacccagatgcacaacgccggctttggtccactgactgacctggtgttcgcattcgcaaaccaacttctgccacttgaaatggacgatgcagagaccggtctgctctctgccatttgcctgatctgtggcgatcgacaggacctggaacaacctgatcgcgttgacatgttgcaggagccattgctcgaagcactgaaggtctacgtgcgcaagaggaggcccagccgcccccacatgttcccaaagatgctaatgaaaattacagatctgaggtctatttccgctaaaggcgcagagcgcgtgattactttgaagatggagatccccgggtctatgccccctctcatacaggagatgttagagaatagtgaaggccttgacacattatcaggtcaaccgggtgggggtggccgagacgggggcggactggcacctccgccagggagttgttccccctctctctccccctctagtaaccgcagcagccctgccacccactcaccttag

SEQ ID NO: 203117 - DNA, 1389 bp, Artificial Sequence
  Description of Artificial Sequence: Synthetic coding sequence
atggccagcaacagcagcagctgccccacccccggcggcggccacctgaatggatacccagtgcccccttatgcctttttctttcccccgatgctgggagggctgtcaccgcccggggccctgaccactctacagcaccagctgccggtgtcaggctactccacaccttccccagccaccattgagacccagtccagctcctccgaagaaattgtgccaagcccccccagccctccaccattgccacgcatctacaaaccatgctttgtgtgccaggataagtcctcgggatatcactacggtgtaagcgcatgtgaaggttgcaaggggttttttcgccgttctatccaaaagaacatggtgtatacgtgtcacagagataagaactgtatcataaacaaagtgacgaggaaccggtgtcagtactgcaggctgcagaaatgctttgaagtcggaatgagtaaggagtctgtacggaacgacagaaataagaagaagaaagaggtaccaaagccagagtgtagcgagtcttacactcttacacccgaggtcggcgagctgatcgaaaaggtgcgaaaggctcaccaggaaacattccccgcgctgtgtcagctgggaaagtatactactaacaatagctctgaacagcgcgtgagcctcgatatcgacttatgggacaaattcagcgagctgtccactaaatgtatcattaaaactgtggagtttgctaagcaactgcccgggttcacaactctcacaattgccgaccagatcaccttactcaaagccgcatgcctcgatatccttatcctgaggatttgcacccgatataccccggagcaggacaccatgacgttctccgatgggctgactttaaatcgcacacagatgcataatgcgggttttggacccctgacagacctggtgtttgcctttgccaaccagttattacccttagagatggacgatgcagagacagggcttctgtctgcgatatgcctgatctgcggtgatcggcaggatttagaacagcctgatcgagtcgacatgttgcaggagcctctcctggaggcccttaaggtatacgttcgcaaaagacggcccagtcgcccccacatgtttcccaagatgctgatgaagataaccgacttacggtctatttcagcaaaaggcgcggaacgggttattacattgaagatggagatcccaggatctatgccgcctttaatccaggagatgctggagaattctgaaggacttgacaccctttcaggacaaccaggaggagggggacgggatggcggaggactggctcctcccccgggaagctgctcgccgagtctcagcccgtccagtaaccggtcttccccagccactcacagtccctag

SEQ ID NO: 203118 - DNA, 1041 bp, Artificial Sequence
  Description of Artificial Sequence: Synthetic coding sequence
atgggccaggagatcctgcccgcccggagccccaccctgcggctgggatcgccaaccccccatttaccccaggagctactgcgggcatcccctaaagggccccccggcaggttgcaactgggaggcttggcggtgcggaatgaccgaaacaagaaaaaaaaagaggtgcctaaacccgaatgttctgagagctatacgcttacgccagaagtgggggaacttatcgagaaagttcgcaaggcccaccaagaaaccttccccgctctgtgtcagctgggaaaatataccacgaataactcatctgagcagcgagtaagccttgacattgatctgtgggacaagttttcagagctaagtaccaagtgtatcatcaaaaccgtagaatttgccaaacagctgccaggtttcaccacgctcactatcgcggatcagataacactgctgaaagctgcctgtctggacattttgatcctgcgtatttgcaccagatatacacctgagcaggatactatgacattctccgacggattgaccctcaatagaacccaaatgcacaatgcaggattcggccctctgacagatctggtttttgctttcgccaatcagctcctccctctggaaatggatgatgcagagaccggcctcctgagcgctatatgtctcatttgcggggatagacaggacctagagcagccagacagggtggacatgctacaagaacctctccttgaagctcttaaagtctatgtaaggaaacggaggccgagtcgcccccatatgttccccaaaatgttaatgaagattaccgatcttcggtcaatctccgcaaagggcgccgagcgcgtaatcaccctcaagatggagatccctggatccatgccgcccttaattcaggagatgctcgagaatagtgagggcctggatactctgagcggccagcccggtggaggggggagggacggaggagggctcgcccccccccccgggtcttgtagcccttcattgtccccctcatccaatagatcctcacccgccacgtag

SEQ ID NO: 203119 - DNA, 1098 bp, Artificial Sequence
  Description of Artificial Sequence: Synthetic coding sequence
atggccagcaacagcagcagctgccccacccccggcggcggccaccttaatgggtacccagtgcctccctacgcctttttctttccaccaatgcttggtggcctcagcccccctggcgccttaaccactctccagcatcaactgccagtgtctggttattcaaccccgtccccagccacagtgaggaatgatagaaacaagaaaaaaaaggaggtccccaaacctgagtgctctgagtcctacaccctcacccctgaggtcggggaactcatcgaaaaagttcgaaaggctcaccaggaaacctttcccgcgctgtgtcagctgggcaaatatactaccaataattcatctgagcagcgagtgagcctggacatcgacctctgggacaaattttccgagctctctacaaagtgcattatcaaaacggtggagttcgctaagcagttgccgggtttcactactttaacaatcgcagatcagatcaccttgttaaaggcagcttgtctcgatattttgatcctgaggatctgtacccgatacacacccgagcaagacaccatgaccttctccgatggtctgaccctcaaccgcacccagatgcataacgctggcttcggccctctgactgatctggtgtttgcctttgcaaatcagctgctccctttagagatggatgacgccgagactgggcttctgagtgccatttgcctaatatgcggagatcggcaggacctggaacagcccgaccgcgtggatatgctgcaggaacccctactagaagcactcaaggtgtacgtgcgaaagcgaaggccaagtcgaccacatatgttccctaaaatgttaatgaagatcactgacttacggagtattagcgcaaaaggagctgagcgcgtgatcactctcaagatggagattccagggagtatgccccctctcatccaagagatgctagagaacagtgaagggctcgacacgctatctgggcaacccggcggaggtggccgagacggaggtggcctcgccccaccccctggctcctgtagccctagtttgagtccaagttcgaacagaagcagccccgccacgcattcaccttag

SEQ ID NO: 203120 - DNA, 1149 bp, Artificial Sequence
  Description of Artificial Sequence: Synthetic coding sequence
atggtgcccagcagccccagcccccccccccccccccgggtgtacaaaccatgttttgtgtgcaacgataaatctagtgggtatcactacggggtgtcaagttgcgaggggtgtaaaggtttctttcgcaggagcatacaaaaaaacatggtctatacatgccaccgagataaaaactgtatcattaataaagttaccagaaaccgctgccagtactgccgactgcagaagtgttttgaggtgggcatgtccaaagaggccgtgagaaacgatcgcaacaaaaaaaaaaaagaggttaaggaggaggggtcccccgatagctacgaactgagccctcagttagaagaactcatcacaaaggtgtccaaagcccatcaggagactttcccttccctctgtcagcttggaaagtacacaacgaacagttcagcagaccaccgagtacagctggacctggggttgtgggacaagttttccgagttggctacaaaatgcatcataaagattgtcgagttcgccaaacggctccctggttttacaggcttatctatcgcagaccagataacactgctgaaggccgcttgtttggacatactgatgctacggatctgcacccgctataccccggagcaggacaccatgacattttcagacgggttaacattaaatcggacacaaatgcacaacgccggctttggccccctgactgatctcgtctttgcattcgctggacagttgctgccacttgagatggatgacacggagactgggctgctgtcagcgatatgtcttatctgcggcgaccgcatggatttggaggaacctgaaaaggttgacaagcttcaagagcctcttttggaagcactccgcctctacgctaggagaagacggccatcacaaccctacatgttcccaaggatgctgatgaagataacggatttgcggggcatatctaccaagggagctgagcgggccattactctgaaaatggaaatccctggcccgatgcctcctctgatccgggagatgctcgagaacccagaaatgttcgaggatgatagctcacagccggggccccaccccaatgccagctctgaggatgaggtgcctgggggacaagggaagggtgggttgaaatcaccggcctag

SEQ ID NO: 203121 - DNA, 1332 bp, Artificial Sequence
  Description of Artificial Sequence: Synthetic coding sequence
atgtacgactgcatggagaccttcgcccccggcccccggcggctgtacggcgccgcaggccccggcgctggcctgttgaggagggcaacgggtggttcatgctttgcagggctggagtcatttgcatggccccagccggcgtccctgcagtctgtggagacccaaagcactagcagtgaggagatggtgccgagttcaccttctcccccccccccacctagggtgtacaagccatgttttgtttgtaatgacaaatcctctggatatcattatggtgtgagcagctgtgaaggctgcaagggcttttttcgccggtcgattcagaagaatatggtgtacacatgtcatcgggacaagaactgcatcatcaataaggttactagaaataggtgccagtactgccgactgcaaaagtgttttgaggtaggaatgtctaaggaagccgtgagaaacgatagaaacaaaaaaaaaaaagaagtcaaagaagagggcagtcctgatagctacgagctgtctccacaacttgaggagctgataacaaaagttagtaaagcccaccaggaaacctttccgtctctgtgtcagctggggaagtacactacaaacagctcagctgatcatcgagtccaactcgacctaggtctttgggataaattctccgaattggccacaaagtgtattattaagattgtcgagtttgctaaacgcctccctgggtttaccgggttgagtatcgccgaccagattacactactgaaagccgcgtgccttgacattttgatgctgcgtatctgcacccgttacaccccagaacaggacacaatgacattctccgatggtctcacccttaataggacccagatgcacaacgcaggctttggccctctcacagacctagttttcgcttttgccgggcagctactgcctcttgaaatggacgacacagaaacaggcctcctatccgccatttgcctcatctgtggagatcgcatggacctggaggagcctgaaaaggtggataaactgcaggagcctcttctcgaggcattaaggctctatgcaagaagacggagaccttcccagccctacatgtttcccaggatgctgatgaagattactgacttgcggggcatttcgaccaaaggtgctgagagagcgatcacgctaaaaatggaaatccccgggcctatgccccctctcattcgagaaatgctcgagaatcctgaaatgttcgaagacgactcctcacaacctggcccgcatccaaatgctagcagtgaggatgaagtccccggaggacaggggaaaggagggctgaagagccctgcctag

SEQ ID NO: 203122 - DNA, 1365 bp, Artificial Sequence
  Description of Artificial Sequence: Synthetic coding sequence
atggccaccaacaaggagcggctgttcgccgccggcgccctgggccctggatctgggtatccaggagccggcttcccattcgctttccctggagccctaaggggaagtcctccatttgagatgctgtctcctagtttccgtggcctgggacaaccagatctgcccaaagagatggcgtctctgagcgtcgagacacagagcactagttctgaggagatggtgccctcaagcccctctcctcctccaccaccacgggtgtacaaaccatgtttcgtttgtaatgataagagtagtggataccattatggggtgtctagttgcgaaggctgcaagggttttttccgacggagcattcaaaaaaatatggtgtatacttgccaccgcgataaaaattgcattataaacaaggtcactaggaatagatgtcagtactgtagactgcaaaaatgttttgaagtggggatgagcaaggaggcagtgcgtaacgatagaaataaaaagaagaaggaggtcaaagaggagggctcgcccgatagctacgaactgagcccacagctggaggagctgattacaaaagtgtcaaaagcccaccaggagactttcccatccctgtgtcagctgggcaagtacaccacaaatagcagtgcggatcatcgtgtgcaacttgaccttgggctgtgggacaagttcagtgagctggccacgaagtgcatcattaagatcgtagagtttgccaagcggctgcccggttttacagggctgtctattgccgaccagattaccctgctgaaggcagcctgccttgacatcctgatgctgaggatatgtacccgctacacgcccgaacaggatactatgaccttctccgacgggttgacactcaatcgtactcaaatgcacaatgctgggttcggtccacttaccgatctcgtttttgcatttgccggtcagctgttacccctggaaatggacgacacagagactggtcttttatccgcgatctgccttatctgtggcgatcggatggacctggaggagcctgaaaaagtggacaaacttcaagaaccattattagaagccctgcggttatatgcgagaaggcgacgtcctagccagccctatatgttccctcgaatgctcatgaagatcacagatctcaggggaatttctacaaaaggtgcagaaagggcaatcacactaaagatggagatccctgggcctatgcctccgctgattagagagatgctggaaaaccccgaaatgttcgaggatgactcgtcacagcctggccctcatcctaatgcctcttccgaagacgaggtgcccggaggacaggggaaaggaggcttaaagagcccagcttag

SEQ ID NO: 203123 - DNA, 1365 bp, Artificial Sequence
  Description of Artificial Sequence: Synthetic coding sequence
atggccaccaacaaggagcggctgttcgccgccggcgccctgggcccaggatccgggtatccgggcgccgggttcccctttgcattccctggggctctcagggggagccctccttttgaaatgctgtctccctcgttccgtggtctggggcagcccgatctacctaaggagatggcatcactgtccgtggaaactcagtcaactagtagcgaggaaatggtgccctccagcccttctcctcccccccctccacgggtttataagccgtgttttgtctgtaacgacaaaagttctggatatcattacggcgtgtcgtcctgtgagggctgtaaaggattctttcgccgctcaattcaaaaaaatatggtctacacctgtcacagagacaaaaactgtatcataaacaaggtgacacgaaatcgctgtcagtactgtaggctccaaaaatgtttcgaggtgggcatgtccaaggaagccgtgagaaatgaccgcaacaagaagaaaaaagaagtaaaagaggaagggagcccagactcctatgaactgtccccccaattagaagaacttattactaaggtaagtaaagcccatcaggagaccttcccttccttatgccagttggggaagtacacaactaactcctccgcagaccaccgcgttcagctcgacctgggattgtgggataagttcagtgaactggcaaccaaatgtattatcaagattgttgaatttgccaagcgcttgcccggtttcacggggctgtccatagcggaccaaattactttgttgaaagctgcctgcttggatatcctgatgctacgcatttgcacgcggtacacccccgaacaggacaccatgacatttagcgatgggctaaccttgaatcggacccaaatgcacaacgccggcttcggcccccttacagacctggttttcgctttcgccggtcagttactgcctcttgagatggatgatacggaaaccggccttctttctgcaatctgccttatctgcggtgatcgcatggacctcgaggagccggaaaaagtggacaagctgcaggagccgctgctcgaggcactgagactgtacgcgcggagacgaaggcctagccagccctacatgttcccccgtatgcttatgaaaataactgatcttagaggaatttccacgaagggggccgaaagagccattacactgaagatggagatccccggccctatgcccccgttaatacgggagatgcttgagaatcctgaaatgttcgaggatgattcaagccagccaggcccgcaccccaatgcttcttccgaggacgaagtacctgggggtcaggggaaagggggtctgaaaagccctgcctag

SEQ ID NO: 203124 - DNA, 306 bp, Artificial Sequence
  Description of Artificial Sequence: Synthetic coding sequence
caccaccaggacgagttcgccaagcggctgcccggcttcaccggcttatccatcgccgaccagatcactctgctaaaggcggcgtgcctggacattctgatgttgcgtatctgtactcggtacacccccgaacaggatacaatgaccttctcagatggactgaccctgaatcggactcagatgcataatgccggctttggtccactcaccgacctggtgttcgccttcgcaggacagttgcttcctcttgaaatggacgacacagaaaccggtctgctatcagccatctgcctgatctgcgggtag

SEQ ID NO: 203125 - DNA, 1299 bp, Artificial Sequence
  Description of Artificial Sequence: Synthetic coding sequence
atgctggccctgcccctgcccccctgctggagcggcgccccccccggcgaagagggcgagtccgcagctggaccatggtgttttcagcaccctgtaagtctccaagccggttcacggtgcacaaccgtgtggaaacggctgccaagagtgcgcgatgggtgtaccggtaggcctggtcccggacccgcctgttgtgctgaacctccagctgccccagtgtcccctgacctgaatttgttgccaggccgcaacccacccgcatgtaatggtttctttaggaggtctatccaaaaaaatatggtgtatacctgtcaccgggataagaactgtatcattaacaaggttaccaggaacaggtgtcagtactgtaggctccagaagtgttttgaggtcgggatgtccaaggaagccgtgcgaaatgacagaaataagaagaagaaagaagtgaaagaggagggtagtcccgacagctacgagctaagcccacagttagaagaactaattacaaaggtgagtaaggcacaccaggagacgttcccttcactttgccaactcggaaaatatactaccaacagcagcgccgatcatcgtgtgcaattagatctggggttgtgggataagtttagtgaactggccaccaaatgcatcattaagatcgtggaattcgcaaaaagacttccaggtttcaccggattgtccatagccgaccagatcaccctcttaaaagctgcctgcctcgatattttgatgctacgtatctgtacacggtatacacctgaacaggatactatgacattttcagatggcctgacgttgaatcgcacccagatgcataacgcagggttcggacctctgaccgacctggtgtttgcctttgccgggcaactgctgccgctggagatggatgacactgaaaccggcctcctgagtgctatttgcttgatctgtggggatcgaatggacctggaagaaccagaaaaggttgataaacttcaggagccgttgctagaagcacttcgactgtatgccagaaggcggagaccgtcgcagccttatatgttcccccggatgctcatgaaaattactgatctgcgagggatctcaactaagggcgccgagagagccatcactctgaaaatggaaatacctggaccaatgcctccactcattcgagaaatgttggaaaaccctgagatgttcgaggacgactctagccaacctggccctcacccaaatgcatcttccgaggatgaggttcccggtggacagggtaaggggggactcaaaagcccagcctag

SEQ ID NO: 203126 - DNA, 1389 bp, Artificial Sequence
  Description of Artificial Sequence: Synthetic coding sequence
atggacaccaagcacttcctgcccctggacttcagcacccaggtgaacagctccctgacatctcctacggggaggggatccatggccgccccaagtctgcacccgtccctgggtcccggtatcggtagcccaggtcaactgcactcacctattagcactcttagcagccctatcaatggcatggggccacccttttccgtgatatccagcccaatggggccacactcaatgtctgtccctaccactcccaccctgggatttagtaccggctccccccaattgagttcccccatgaatccagtgtcatcgtcagaggatatcaaaccaccccttgggctgaatggtgttcttaaagtgccggcacacccctccgggaatatggcaagtttcacaaagcacatctgcgccatttgtggcgaccggtcatccggaaaacattacggggtctatagctgcgaggggtgcaaaggcttctttaaaaggaccgtacgcaaggacttaacctacacctgcagggacaacaaggactgtctgatcgacaagcggcaacgtaataggtgtcagtactgcagatatcagaaatgtctcgctatgggcatgaagagggaggccgtacaagaagagaggcagcgcggtaaggaccgtaacgaaaacgaagtggaatcaacaagctcagccaatgaggacatgcccgtggagaggattctcgaagcagagctcgccgtggaacctaagacagaaacttacgtcgaagccaacatggggctgaatcctagttctcccaacgatcctgtgaccaatatatgccaagcggcagataagcagctgtttacacttgtggaatgggcaaaacggattccacatttcagcgagctgcccctggacgaccaggttattctcctgcgggccggttggaatgagcttctgattgcttcattttctcatcggtcgatcgcagtcaaagacgggatcctgcttgccacagggcttcatgttcacaggaatagtgcgcatagcgcaggggtcggggccatcttcgacagagtgctaaccgaactagtatcaaaaatgcgggatatgcagatggacaagactgagctgggatgcctgcgcgcaattgtcttatttaacccagactcaaagggtctgagcaaccctgcagaggttgaggctctgagagagaaggtctacgcctccctggaggcctattgcaagcacaagtaccccgaacagcctggccgtttcgctaagttacttctaaggcttccagcattacggagcataggcctaaaatgtttagaacatcttttcttttttaaactcatcggagacactccaatagatacctttctgatggagatgctagaggccccacatcagatgacctag

SEQ ID NO: 203127 - DNA, 1098 bp, Artificial Sequence
  Description of Artificial Sequence: Synthetic coding sequence
atgaaccccgtgagcagcagcgaggacatcaagccccccctgggcctgaatggtgtcctcaaggtgccagcacatcctagcggaaacatggccagctttactaaacatatctgcgcaatatgtggcgacaggtcgtccggaaaacattatggagtgtacagctgcgagggatgtaaagggtttttcaagcggaccgtgcggaaagacctgacatacacatgcagagacaacaaggattgcctgatcgataagcgccagcggaatagatgccagtattgtcgctaccaaaagtgtctggccatggggatgaaacgcgaggctgtccaagaggaacgacaacgaggcaaggacagaaatgagaacgaagtggaaagtacctcatctgcgaacgaggacatgcccgtggagcggattctggaggcagaattggctgtagaacctaagaccgagacctatgttgaggctaatatgggccttaatccttcatcccccaacgatcccgtaaccaatatatgtcaggccgctgataagcagttattcaccctggtggaatgggcaaaacgcatccctcatttttccgagctgcctctagatgaccaggtcatcttactccgggcaggttggaacgagctcctgattgcatctttttcacacagatccattgctgtaaaagacggcatcttgctggccactggacttcatgtgcatagaaattccgctcacagcgcgggagtaggagctatcttcgacagggtcttgacagagctggtgtccaagatgcgggatatgcagatggataagaccgagctcggctgtctccgggccattgtcttgtttaatcccgatagcaaaggactcagcaaccctgccgaggtggaggccctccgcgagaaagtgtacgcaagccttgaagcttattgcaaacacaaatatccggagcagcctggcagatttgccaaattactgcttcgactacccgcactaaggagcatcgggctcaaatgcttagagcacttgttcttctttaagcttatcggggatacaccgatcgataccttcctcatggagatgctggaagccccccatcagatgacttag

SEQ ID NO: 203128 - DNA, 1602 bp, Artificial Sequence
  Description of Artificial Sequence: Synthetic coding sequence
atgagctgggccgcccggccccccttcctgccccagcggcacgccgccgggcagtgcggacccgtgggagtgagaaaagagatgcactgcggggtggcatccaggtggagaaggagacgaccttggctcgatcccgctgccgcagctgccgctgcagtagccggcggagaacagcagactcctgaaccagaaccaggtgaggcgggtcgcgacggaatgggtgactctgggcgagacagccgcagccccgactcctctagtccaaatcctctaccccagggtgttcctccgccgagtcccccagggccccctctgcccccctctactgccccctcactggggggctcgggcgcccccccaccaccacccatgcctcccccccccctgggaagtccattccctgtaattagctcctccatgggcagtccaggactgcccccgcccgctccccccggcttcagcggcccagtgtcctctccgcagattaatagcacggtctctctgccaggaggtggatctgggccacctgaggatgtgaaaccacccgtgttgggggtgcgcggtctccactgtcccccaccaccaggtggcccaggggctggaaaacgactgtgtgcgatatgtggtgacaggagctccggcaaacactacggagtgtattcatgcgaggggtgtaaggggttcttcaagcgcactatcagaaaggacctaacgtattcatgcagagacaataaggactgtaccgttgacaaacgccagagaaaccgatgtcagtattgccggtaccaaaaatgcctggcaaccgggatgaagcgtgaggcagttcaggaggaacgacaaaggggcaaggacaaggatggcgatggagagggggcaggtggggctccagaggaaatgccagtcgatagaattctggaggccgaattagccgtggagcagaagagcgaccaaggtgtggagggccctggcggaacaggaggatccggctcctcgcccaatgacccagtcacaaatatctgtcaagctgctgataagcagctgttcactctggtggagtgggccaaacgtatcccccacttttcctcactacctctagatgatcaagtgattttactgagagccggctggaacgaactcctcattgcctccttcagccacagaagtatcgacgttcgggatggaattttactcgcgactggtctgcacgtccaccgcaacagcgcccattctgcaggggtgggcgcaatcttcgacagagtccttaccgagctggtcagtaaaatgcgggacatgagaatggataaaactgagctgggatgcctccgggccattatcctgttcaatccagacgccaagggcctcagcaatccatccgaggtggaggttctgcgggagaaggtgtatgccagtctcgaaacatactgcaaacagaaataccccgagcagcaaggccggtttgcgaaactcctgctccgcctgccagccctcaggagcatcgggctgaaatgcctggaacacttatttttctttaagctgatcggcgacactcctatcgacacgtttctcatggagatgcttgaggccccccaccagctggcatag

SEQ ID NO: 203129 - DNA, 1614 bp, Artificial Sequence
  Description of Artificial Sequence: Synthetic coding sequence
atgagctgggccgcccggccccccttcctgccccagcggcacgccgctggccaatgcggcccagtgggtgtacgaaaggagatgcactgcggtgtggcatcccgctggaggaggcgccgcccgtggctggaccctgccgctgccgcagccgcggcagtcgcagggggtgagcaacagacgcccgaacctgagccaggcgaggctggcagagacggaatgggcgacagtggaagagacagcaggagtccagactccagctctcccaacccgttgccccagggagttcctcctccatcgcccccaggaccacctcttccaccctccacggccccttccctgggtgggtccggagcacctcctcctccacccatgccccctccccctctggggtccccctttccagtgatttccagctcaatgggttctcccgggctccctccaccagctccgcctgggtttagcgggccagttagttcgccccagataaacagcaccgtgtcgttgcccggaggaggttctgggcctcccgaggatgtcaagccgcccgtgctgggagtcaggggcctgcactgccctcccccgcccggcggacccggtgcaggaaagcggctctgtgccatttgtggggaccgatctagcgggaaacactacggagtgtattcctgcgagggatgtaaaggctttttcaagcgtaccatccggaaggaccttacctattcatgccgagacaacaaggattgcactgtcgacaagcgccagcgcaataggtgtcagtattgccgctaccagaagtgtcttgcaaccgggatgaaacgcgaggcagttcaagaggaaagacagaggggcaaggataaggacggcgacggagaaggcgcaggaggagcccccgaggaaatgcccgtggataggatcctagaagccgagctggcagttgaacagaagtctgaccagggggttgagggaccaggcggcactggcgggtccgggagtagtcccaacgaccctgttaccaacatctgccaggccgcggataaacaactattcaccctggtggagtgggcgaagcgtattccccacttctcctctctcccactcgatgatcaggtgatactcctgcgcgctggttggaacgaactgctaattgcaagtttttcccatcgctcaatcgacgtgcgcgacggcatcttgttggccactgggctccatgttcatcgtaattccgcacattctgccggcgtcggggcaatttttgatcgatccctttctcgcgtattgaccgagctggtaagcaagatgcgggacatgaggatggacaaaactgagctgggatgcctgcgggccataatcctttttaaccctgacgccaaaggcctcagtaaccctagtgaggtggaagtcttgcgcgagaaggtgtacgcctctcttgagacatactgcaaacagaaatatccagaacaacagggacgctttgcgaagttgctccttcgtctccctgccctgcgctctatcggactcaaatgtttggagcatcttttcttttttaaactcataggagatacacctatcgatacatttctgatggaaatgcttgaagcaccccaccagctcgcttag

SEQ ID NO: 203130 - DNA, 1614 bp, Artificial Sequence
  Description of Artificial Sequence: Synthetic coding sequence
atgagctgggccgcccggccccccttcctgccccagcggcacgccgccgggcaatgcggcccagtgggggtcagaaaggaaatgcattgcggggtggcctcacgatggcgcaggcggcgcccctggttggaccctgctgccgcagccgcggccgccgtggccgggggcgagcagcagacccccgaacccgaaccgggcgaagccggccgggacggtatgggggatagcggccgcgatagccggtctcccgactccagctcccctaatccactgcctcagggcgtcccacccccatcgccccccggccctcccctgccgcctagtacagcaccaagcctgggcgggagtggcgcgcctccccctccccccatgccacctccccctctgggttctccctttcccgtaattagttcctcaatgggtagtcccgggctcccccctcccgctccaccaggattctccggtccggtctcctccccccagataaattccactgtgagtttacctgggggcggaagcggtcctccagaggacgtcaagccccccgttttgggggtgcgcggtctacattgccctccgcccccaggcggccccggagctggcaaacgcctttgcgccatatgcggtgatcgcagcagcggcaagcactacggtgtgtacagttgcgaggggtgtaaggggttcttcaagaggacaattaggaaagatctgacgtactcttgcagagataacaaagactgtaccgtggacaaacgccagcggaacaggtgtcagtactgcagatatcagaaatgtctggctaccggcatgaaacgcgaggctgtccaggaggagcggcaacgggggaaggacaaagacggggatggtgagggcgctggcggagcaccagaagaaatgcccgttgataggatcctggaagccgagttggccgtagagcagaaaagtgatcagggggtggaaggcccgggagggactggcggaagcggcagcagccccaacgaccccgtcaccaacatttgccaggcggcagacaagcagctctttacccttgtagagtgggccaaacgaatcccacacttcagcagtctgcctctggacgatcaggtgatcctgttgagggctggctggaatgaactgctgatagcgtccttttcccacaggtccatcgatgtacgcgatgggatcctgctggcaaccgggctccatgtccatagaaacagtgcacactcagccggggtgggcgctattttcgatcgttcactgagtcgcgttctcacagaactcgtgtctaaaatgcgggatatgcgtatggacaaaactgagctcggctgcctaagggccatcattctgtttaatccggatgccaaggggttgagcaatccatcagaggtagaggttctgcgggaaaaggtgtacgcatcattagagacctactgcaagcaaaagtatcccgagcaacagggacgctttgcaaagcttctgttgcgcctgcctgccttaagaagcatcggtcttaagtgcctcgagcacctcttttttttcaagctaataggtgacacccctatagatacatttctaatggaaatgcttgaagctccacatcagctagcttag

SEQ ID NO: 203131 - DNA, 1602 bp, Artificial Sequence
  Description of Artificial Sequence: Synthetic coding sequence
atgagctgggccgcccggccccccttcctgccccagcggcacgccgcaggccaatgcggacccgtgggggtgaggaaagaaatgcattgtggcgtcgccagtagatggcgcaggagaagaccatggctggatcccgcagccgcggcagcagctgccgtggccggcggtgagcagcagacccctgagccagaaccgggtgaggccgggcgggacggcatgggcgattccggccgagatagcaggtctccagattctagtagccctaatcccctgccgcaaggcgtacctcctccatctcctcctggaccccccctccctccttcaacagccccatctttggggggatctggcgccccccccccgcctccaatgcctccccccccgttgggttccccatttcccgtcatcagttcgtccatgggatctcccggcctcccgccacctgctccccccggcttctctggacccgtcagctctccccagattaattcaacagtgtccctgcctggcgggggatcaggtcccccagaggacgtcaaaccccccgttctgggagtcagaggactgcactgtccacccccacccggtggtcccggtgccggtaaaagactctgcgccatatgcggagatcgctccagcgggaagcactatggggtgtacagctgcgaaggctgcaaggggtttttcaagcgcaccatcaggaaggatctgacttactcatgcagggataataaggattgcaccgtggataaaagacaacggaacagatgtcagtattgccggtatcagaaatgtttggccaccggcatgaaacgtgaggcggttcaggaggagcggcagcggggcaaagacaaagacggggatggtgagggcgctggaggagcacctgaagagatgcccgtggatagaatcttggaagctgaactggcggtcgagcaaaaaagcgatcagggggtggagggccccggagggactgggggctctgggtcttcccctaatgatccggttaccaacatctgccaagccgccgacaagcaactgttcaccttagttgagtgggccaagcgaatcccccatttctccagcctgcccctggacgaccaggtgatcttgttgcgagccggatggaacgaattactcatcgccagtttctcacataggtctattgacgtgcgtgacgggatcctgctggccacaggactgcacgtgcacagaaatagcgcccattctgctggagtgggcgcaatattcgatagggtgcttaccgaactcgttagtaagatgcgggacatgcgaatggataagacggaattggggtgtctcagggccataatcctcttcaacccagatgctaagggcttgtcgaatccttccgaggtggaggtcctgagggaaaaggtatatgccagcttagaaacctactgtaaacaaaagtaccccgaacagcagggccgcttcgcgaaacttttactacgactgccagcccttcgctccatcggcctcaaatgtctcgagcacctcttcttttttaagcttatcggagatacacctattgatacctttcttatggagatgcttgaggcaccccaccagctggcgtag

SEQ ID NO: 203132 - DNA, 861 bp, Artificial Sequence
  Description of Artificial Sequence: Synthetic coding sequence
atgccccagggcagcgtgggccggtggggctgcgagaagaagtgcattgtgggctccagaccaggtggtgggggcgatgggccggggtggatcccccagcgaaggcggcgaaggagatggcaggcggagaataataagccccgcagccggagccagggaaggctcgatgggactggatgggccactgccggtgggatcaacagtacagtgtccctgccagggggggggagtggacccccagaagatgttaagcctcccgtcctgggcgttaggggcctccattgtccccctcccccaggtggaccaggggccgggaaacgcttatgcgcaatctgcggcgatcgatcctcaggtaagcactatggcgtgtacagttgcgagggttgcaagggatttttcaagcgaacgatcagaaaagatttgacctattcgtgtcgggacaataaagactgcacagttgataaacgccagaggaaccggtgccagtactgtcgttatcagaagtgcctcgccaccggcatgaagagagaagctgtgcaggaggagagacagcggggaaaagacaaagatggagatggtgagggagctggaggggccccagaggagatgcctgtagacaggattttggaggccgagttagccgtggagcagaagtccgatcagggcgtggaagggccaggtggcactggaggaagcggctcgtcagtgtcagtgggcgtgaatcctttgtcgttcgtgatgggcgtggggggcggatctctcggcctgttttatattccgtctcccagctttccgttgattacttttctcacacttctgggtacaggtggagccgctaaacaaggcctttctaacatctag

SEQ ID NO: 203133 - DNA, 1602 bp, Artificial Sequence
  Description of Artificial Sequence: Synthetic coding sequence
atgagctgggccgcccggccccccttcctgccccagcggcacgccgcggggcagtgtgggccagttggcgttcggaaagaaatgcactgtggggtcgccagccgctggcgacggcggagaccctggctggaccccgcagctgctgctgcagcagccgtggccggaggcgagcagcagacgcccgagcctgagcccggagaggcagggagggacggaatgggagactccgggcgggatagccggagccctgactctagcagcccgaacccattaccacagggggtacccccccccagtcctcccgggcctccactgcccccatccactgctcccagcctgggaggctccggagctccacctccacctcccatgcccccacccccactcggatcaccatttcctgttatttcctcgtcaatgggcagtccgggcctgccaccacccgccccgccgggcttctccggaccagtgtccagtccccagatcaacagcacagtgtctttgccaggcggtgggtcagggccgccagaagatgtcaagccccctgtgttaggcgtgagggggcttcactgccctcctccaccaggcggccctggcgcgggaaagaggctgtgcgcaatttgcggtgatcgttcatcaggaaagcattatggcgtatactcgtgtgagggctgtaaagggtttttcaaaaggacaattaggaaggacctgacttatagctgcagagataacaaggactgtacagtggataagagacaaaggaatagatgccagtattgccggtatcagaagtgcctcgccactggcatgaaacgcgaagcggtacaggaagagcgccagcgtggaaaggataaggacggagacggggaaggagcaggcggggcacctgaagagatgcctgtggatagaatcctggaggctgaactggccgtggaacaaaagtccgatcagggagtagagggacctggcgggaccgggggttctggttcgagtcccaatgaccctgtgacgaacatttgccaggctgccgataagcagctgttcacattggtggagtgggctaaacggattccgcattttagcagtctacccctcgacgatcaggtgatcctcctaagggcagggtggaacgagctactcatcgcttccttctctcatcgcagcatagatgttcgtgacggcattttacttgccactggactgcacgttcacaggaactccgcccactcagctggagtgggcgccatattcgatagagtactgaccgaattggtctcgaaaatgagagacatgcggatggacaagacagaactgggctgtttgcgggcaattatactctttaacccagatgccaaaggtctatctaacccttctgaggtcgaggttctgcgggagaaggtgtatgcctctcttgagacgtattgtaaacaaaagtacccagaacagcaagggcgcttcgctaagcttctgctgcgcttgccggcactgagatctatcggactgaaatgcctggagcatctgttctttttcaaactgataggggacactccaatagacaccttcttaatggaaatgctcgaggctccacatcagctagcttag

SEQ ID NO: 203134 - DNA, 291 bp, Artificial Sequence
  Description of Artificial Sequence: Synthetic coding sequence
tgaagccccaacgaccccgtgaccaacatctgccaggccgccgacaaacagctgttcaccctggtcgaatgggccaaacgtatcccccatttctcatctctgccgctagacgatcaggtcattctgctgagagccggtctgcacgttcacagaaacagcgcacattcagccggggtgggggccatcttcgatcgcgtgctcactgaactggtgagcaagatgcgcgatatgagaatggacaagaccgagcttgggtgccttcgcgctattatattgtttaaccccgactag

SEQ ID NO: 203135 - DNA, 1602 bp, Artificial Sequence
  Description of Artificial Sequence: Synthetic coding sequence
atgagctgggccgcccggccccccttcctgccccagcggcacgccgcaggccagtgcgggcctgtaggtgtgcgcaaagaaatgcattgtggagtggcgtcgagatggcgccggcggcgtccctggttagatccggccgctgcagcagcagccgcggtcgcaggcggtgagcagcagactcccgaacctgagccaggcgaggccggaagagatgggatgggcgattccggcagagactcacggtcccctgactctagcagtcccaacccattaccacagggagtgccacccccttcccctcccggtcctccactgcctccgtctactgctccttcactgggaggttcaggggcccctccccccccaccgatgccccctccgcccctaggcagtcctttcccagtcatttcatcatctatgggttctcccggcctgcctccccctgcaccccccgggttctccgggccagtcagttcccctcagatcaactcaactgtgtccttgcctggcggcggatcaggccctcctgaggacgtaaaacctcctgtgttgggtgtccggggactccattgtcctccaccacctggcggccctggcgcaggcaagaggctttgcgccatttgtggagatcgctcatcagggaagcactatggggtgtactcctgcgaaggctgcaagggttttttcaagcggactattcgcaaggacctgacatacagctgcagagataataaggattgcactgtggataaaagacaaagaaaccgctgccagtattgtcgttaccaaaagtgcctggcgacagggatgaaacgggaagcagttcaggaggagcggcaacgcgggaaagataaagatggtgatggggagggcgctgggggggctcccgaggagatgccagtggatcgcatccttgaggccgagcttgccgtcgagcagaaatccgaccaaggtgtggaaggaccgggaggaaccggaggtagtgggtccagtccaaatgatccggtcacaaatatctgccaagcagccgataaacagctgtttacgctcgtagagtgggccaagaggatccctcacttcagctcccttccactcgatgatcaggtgattctattaagagcgggatggaacgagctgttgatcgcttccttctcccatagatcaatagacgtcagggacggaatcctccttgcgacaggcctgcacgtccaccgcaactcagctcattccgcgggcgtgggagctatctttgatagggtattaacggaattagtcagcaagatgcgcgatatgcgcatggataaaacagagttgggctgcctgagagcaatcatcctgtttaacccagacgcaaagggcttgtccaaccccagcgaagtggaagtgctccgggagaaggtgtatgcatccctggaaacctactgcaagcaaaagtaccccgagcagcagggtagattcgctaaattactcttgcgcctgccagcactcagatcaatagggctgaagtgccttgagcatctattctttttcaagttaatcggggacacacctatcgatacctttctgatggaaatgctggaggcgccgcaccagctcgcatag

SEQ ID NO: 203136 - DNA, 291 bp, Artificial Sequence
  Description of Artificial Sequence: Synthetic coding sequence
tgaagccccaacgaccccgtgaccaacatctgccaggccgccgacaagcaactgtttacactggtggagtgggctaaacgcatcccccatttctccagtctgcccctggacgaccaggttattcttctcagggctggactgcacgttcatcgtaactctgcccactccgctggggttggcgccatcttcgacagggtcttgaccgagctggtcagcaagatgcgtgatatgagaatggacaaaacagagttagggtgccttcgcgctataattctatttaatcctgattag

SEQ ID NO: 203137 - DNA, 1614 bp, Artificial Sequence
  Description of Artificial Sequence: Synthetic coding sequence
atgagctgggccgcccggccccccttcctgccccagcggcacgccgctgggcagtgtggacctgtaggcgtgagaaaagagatgcattgtggggttgcttcccgttggcggcgcagaaggccctggctggaccctgctgctgctgctgcggctgcagtcgccggaggagaacagcagaccccggagccggagcccggggaggctggccgggacggcatgggcgattcgggtcgcgactccagaagccctgacagctctagcccaaacccactgccacagggcgttccccctccatcacctcctgggccacctctgcccccttccactgctccatcattgggggggagcggcgctccacctccaccccctatgcccccacctcccctcgggtcaccctttccagtcatttcttcatcaatgggctctcccgggctgcctccacctgctcctcctggcttttcaggaccggtgtcttcacctcaaatcaactccacagtgtctctgccagggggggggagcgggccccctgaggatgtaaagccacctgtgctgggagttcgagggctgcactgccctcccccgcccggaggacctggtgccggcaagaggctgtgcgcaatttgcggtgaccggtcatcgggcaaacactatggtgtttattcgtgcgagggctgcaagggattcttcaaacgcacgatacggaaggatcttacatattcctgcagagataacaaggattgtaccgttgacaaaaggcagcggaacagatgtcagtattgcagataccagaagtgcctggccaccggcatgaaaagggaggccgtccaggaggagcgccagcggggaaaagacaaagatggcgatggtgaaggggcaggaggcgctccagaggagatgccagtcgacagaatcctggaagcggaactggctgtggagcagaaaagcgatcagggtgtggaaggacccggtggaacgggcgggagcggctcctcccctaatgaccctgtgacaaatatatgccaagctgcagataaacagctgtttacactcgtagaatgggcgaagcggatcccgcacttttcttcgctacctcttgatgatcaggtgatactgttgagggctggttggaacgagctgctgatcgcctctttttctcaccgctctattgatgttcgagacggcatcctgctggctaccgggcttcatgtgcacaggaactcagcccattccgccggcgtcggagcaatctttgacagatctctgtcacgcgttctgacagaacttgtgagtaagatgagagacatgcgaatggataaaacagagctggggtgcctaagggccattatcctttttaatcccgacgccaaaggtctttcaaaccccagcgaggttgaggttttgagggagaaggtctacgcgtctctggaaacctattgtaagcaaaagtatccagagcagcaggggcgatttgccaaattgctactccgtctgcctgccttgaggtcaattgggctgaaatgccttgaacacttgtttttcttcaagctaattggggatactcccatcgacaccttcctcatggagatgttggaagcgccacaccagctcgcatag

SEQ ID NO: 203138 - DNA, 1602 bp, Artificial Sequence
  Description of Artificial Sequence: Synthetic coding sequence
atgagctgggccgcccggccccccttcctgccccagcggcacgccgccggacaatgtggcccagtaggagtcaggaaagagatgcactgtggagtggctagccgttggaggcgccggcgcccgtggctcgatcctgcagcagctgccgccgctgctgtggctggaggcgagcagcagacaccggagccagaacccggggaggctggaagggacggcatgggggactccggtagggacagtaggtccccagactcatcttcccctaaccccctgccacagggcgtccccccgccgtctccaccggggccccccctcccccctagcacagcgccctcgctgggcggatctggcgcccccccccctccccccatgccacccccacccctcggatctccgttcccagtcatttctagctctatggggtctccaggactcccaccccctgcacccccaggcttctccggaccagtctccagcccccagattaacagtactgtttcccttcctggcggcggcagtgggccaccagaggatgtaaaacctccagtcttaggcgtgcggggactgcattgccccccaccccccggggggcccggggcgggaaagcgactctgcgctatttgcggggataggtctagcggcaaacactatggagtctactcgtgtgaggggtgtaaaggtttctttaaacgaaccattcggaaggacttaacttactcctgtcgagataataaagactgcaccgtggataaacgacagcgtaacaggtgccagtattgtcgataccagaaatgtcttgccaccggtatgaagcgagaggccgtgcaagaagaacgacagaggggcaaagacaaggatggcgatggagagggtgccggtggcgcacccgaagaaatgccagtagaccggatcctggaagctgagctcgccgtagagcagaaatcggatcaaggcgtggagggaccaggtggcaccggtggcagtggttcatcacccaatgaccctgttaccaatatctgccaggccgctgacaagcagctcttcactctggtggaatgggccaagaggattccgcatttctcaagtctgcctctggatgaccaggtaattctattgagagctggctggaacgaactgctcatagcctccttttctcaccgaagtattgatgtgcgagatgggatcctcctggcgaccggtttacacgtgcacaggaatagcgcccatagtgctggcgtgggggccatatttgatcgggtgctgaccgaactcgtgtctaagatgagggacatgcgtatggacaaaaccgagcttgggtgtctgcgggccataatcctattcaatccggatgccaaggggctgtctaaccccagcgaggtcgaagtactgcgagagaaggtgtatgcaagcctggaaacctactgcaaacagaagtatcccgagcagcagggtcggtttgcaaagcttctcttaaggctgcccgccctgaggagcattggactcaagtgcttggaacacctatttttcttcaagttgattggcgatactccgatagacacttttctgatggaaatgttagaggctccacatcagttggcctag

SEQ ID NO: 203139 - DNA, 1602 bp, Artificial Sequence
  Description of Artificial Sequence: Synthetic coding sequence
atgagctgggccgcccggccccccttcctgccccagcggcacgccgccggccagtgcggtcctgtgggggtgcgtaaggagatgcattgcggggtcgccagtcggtggcgtcggagaagaccctggctggatcccgcagccgcagccgctgcagcggttgcgggaggagaacagcaaaccccagaacccgaacccggagaagccggtcgtgacggaatgggggattctggcagagacagccgaagccccgatagctcgagtcctaatcccctgccgcagggtgttccacccccctctcctcctggccctcccttaccaccatccaccgctccatctctgggggggtccggcgcccccccgcctcctcctatgccccccccacccctcggctcaccattcccagtaatttcaagcagcatgggcagcccagggctgccaccgccagctccacccggcttctccgggccagtgtccagccctcagattaacagcaccgtgagcctccctggcggcggctcagggccgcctgaagatgtgaagccaccggtcttgggagtacggggcctgcattgccctcctccgccgggcggcccgggcgcagggaaaagactgtgcgctatttgcggggaccgtagctcaggaaagcactacggcgtttatagctgcgagggatgcaagggttttttcaagagaactattaggaaagatttgacctactcctgtcgagacaataaggattgtaccgttgacaagcggcagcgtaaccgttgtcaatactgtcgctaccagaagtgcctggccactggcatgaagcgagaggcggtacaggaagagcgtcagaggggcaaggacaaggatggcgatggcgagggagctgggggcgcacctgaggagatgcctgtagatcgaatacttgaagccgaattggccgttgagcagaagtccgatcagggtgtggaaggacctggcggcaccggtggaagtggttcatctcctaacgaccccgtgacgaacatttgtcaggccgccgacaagcaactcttcaccctcgtggaatgggctaagcgcattccacacttttcctcccttcctctggacgatcaggtgattcttttgcgtgctgggtggaacgaactgctcatcgcttcctttagccaccgctcgattgatgtgagggacggaattctcctggccacgggcctccatgtacaccgcaactctgctcattcggcaggcgtcggagcaatattcgaccgggtcctgactgaactggtgtccaagatgcgggacatgaggatggacaaaaccgaattaggttgccttagagccattatattattcaatcctgatgctaagggcctgtcaaacccatctgaagtggaagtgctgagagagaaagtatatgcctccctagagacctactgcaaacagaaataccccgaacagcagggaaggttcgctaaactgctgttgagactgccagccctccggtccatcgggctcaagtgtttagagcacctgttcttctttaagcttattggagacacccctattgacacgttcctgatggagatgctagaagccccacaccagttagcctag

SEQ ID NO: 203140 - DNA, 291 bp, Artificial Sequence
  Description of Artificial Sequence: Synthetic coding sequence
tgaagccccaacgaccccgtgaccaacatctgccaggccgccgacaaacagctgttcactttggtcgagtgggccaaacgcatcccacactttagctcactgccactggatgaccaggtgatactattacgggccggacttcatgtccaccgtaatagcgcccacagcgctggcgtaggcgcgatctttgatcgcgttctgacggagctggtttctaaaatgcgagacatgcggatggacaagactgaattaggatgtttaagagccatcatccttttcaatcctgactag

SEQ ID NO: 203141 - DNA, 291 bp, Artificial Sequence
  Description of Artificial Sequence: Synthetic coding sequence
tgaagccccaacgaccccgtgaccaacatctgccaggccgccgacaagcagttgtttacgctggttgaatgggctaagcggatcccgcacttcagctcccttcctctggatgaccaggtgatcttactacgcgctgggctgcacgtccaccggaactccgcccactccgctggtgttggcgctattttcgacagagtccttaccgagctggtgagtaaaatgagagacatgaggatggacaagaccgagctcgggtgcttgagggctattatccttttcaatcccgattag

SEQ ID NO: 203142 - DNA, 1614 bp, Artificial Sequence
  Description of Artificial Sequence: Synthetic coding sequence
atgagctgggccgcccggccccccttcctgccccagcggcacgccgccggacagtgtggccctgtaggcgtgcgtaaggagatgcactgtggggtcgcctcacgctggcgccggcgccggccttggctagatcccgctgcagccgctgctgctgctgtagcaggcggagaacagcagactccggaaccagaacccggagaagcgggacgcgatgggatgggagattctggacgagattccagatcgccagactcaagttcaccaaaccctttgccacaaggcgtgccacctccaagcccccccggccccccgctgccgccgagtactgcaccttctctgggaggttccggagctccaccaccaccacccatgcccccaccacccctcggatctccatttcctgtcattagctcttcaatgggcagtcccggtctgccaccaccggctccacctggcttctcaggccccgttagcagccctcagattaatagcactgtctcactacccggcggtggatctggaccacctgaggacgtcaagcctcccgtgttaggtgtcagggggctgcactgtcccccaccacctggagggcctggtgcaggaaagaggctctgtgccatctgtggcgataggtcatccgggaagcactatggagtatatagctgcgagggctgcaaggggttctttaagagaaccatccgtaaggatctcacctattcttgcagagacaataaagattgcactgtcgacaagcggcagcgaaatcggtgtcagtattgcaggtatcagaagtgcctggccacaggtatgaagcgcgaagccgtacaggaagaacgtcaacgcgggaaagataaggacggcgacggggaaggagcaggcggggcaccagaagagatgcccgtagataggatacttgaggctgagctggcagtggaacaaaagagcgaccagggcgtggagggaccaggtggaactggcggctccggaagttctcccaatgatccagtcaccaatatttgtcaggccgcagacaagcagctgttcaccctcgtagagtgggctaagaggatcccccacttttctagtctccccttggacgatcaggtcatcctactgagagctgggtggaacgaacttcttatcgcctcttttagtcaccggagtatagacgtgcgggatggcattcttcttgccacgggcctacacgtgcacaggaattcagcccatagcgcaggcgtcggagctatttttgacagatcattgtcacgagtgttgacagaattggtctctaaaatgagggacatgcggatggacaagacagagctgggctgccttcgggccatcatcctgttcaaccccgacgccaagggcttgtcaaaccctagcgaggtggaagttcttagagaaaaggtttatgcatctctcgaaacctactgtaaacaaaagtaccccgagcagcaggggagattcgccaagttgcttttgcgactccctgcgttacgctctatcggattgaagtgcctggagcacttgtttttttttaaactaatcggcgacaccccaattgacactttccttatggaaatgctggaggctccccaccaactggcttag

SEQ ID NO: 203143 - DNA, 291 bp, Artificial Sequence
  Description of Artificial Sequence: Synthetic coding sequence
tgaagccccaacgaccccgtgaccaacatctgccaggccgccgacaagcagctcttcacactggtggagtgggccaagagaataccacatttttccagtctgcccctggacgatcaagttattctactaagggctgggctgcacgtgcataggaactccgcccactctgcaggcgtaggcgctattttcgaccgcgtgttaactgagcttgtctctaagatgcgcgatatgcggatggataagaccgagctgggttgtttgagagcgataatcctgtttaatccggactag

SEQ ID NO: 203144 - DNA, 1614 bp, Artificial Sequence
  Description of Artificial Sequence: Synthetic coding sequence
atgagctgggccgcccggccccccttcctgccccagcggcacgccgccggccagtgcggacccgttggcgtcaggaaggaaatgcattgtggcgttgctagcagatggagaagacgcagaccttggctggacccagccgccgctgccgctgctgccgtcgccggcggcgaacagcaaactccagagcccgagccgggagaagccggtagggacgggatgggagatagtggacgcgatagccggagcccagattcttcaagtccgaatcctctgccccagggcgttcctcctcctagcccccctgggccccccctgccccccagtactgccccctccctcggcggcagcggcgcccctcccccccctcctatgcccccaccgcccctcgggtcaccattcccagtcatctctagttcaatgggtagcccaggcttgcctcctccagctccacctgggttcagtggtccagtgtctagcccacaaatcaacagtaccgtgagccttcccggcggaggaagcggaccaccagaggatgtaaaaccccccgtgctgggcgttcgtggcctgcattgtccacctccgccaggtggccctggagccggtaagcgcctatgtgcgatttgcggcgataggagctctggtaaacactacggggtttatagctgcgagggctgcaaggggttctttaagcggaccatcagaaaggacctgacctacagctgcagggacaacaaagattgtactgtcgataagcgtcaacgaaataggtgtcagtattgtagatatcaaaaatgcctagcgaccgggatgaagcgggaagccgtgcaggaagagcgacagcgtgggaaagataaggatggagacggggaaggagcagggggcgcccccgaggagatgccagttgaccgaatcttagaagctgagttggcggtggagcagaagagcgaccagggagttgagggcccgggcggaactggtggctccgggagcagtccaaacgaccccgtgactaatatttgccaagccgctgacaaacagctgttcactctggttgaatgggctaagagaatccctcacttttccagtctgccgctggatgaccaggtgattttactgcgggccgggtggaatgagctattgattgcgtccttctcccacagatcaattgacgttcgagatggcattctcctggcaacaggcctacatgtacatcgcaactctgcccattccgccggcgtaggtgctatctttgatagatccttgtctagagtgctcacagagctcgtgagcaaaatgagagacatgaggatggataaaactgaactcggttgtctgagagctattatattatttaatcccgacgctaaggggctctcaaacccgagtgaagtggaggtgctgcgtgagaaggtttatgcctcgctggagacgtattgcaaacagaaatacccagagcagcagggtcgcttcgctaagctgctcttgcgcctgcccgcacttaggtccatcggccttaaatgcctggagcatttgtttttcttcaaactcattggagacacccccatcgacacattcctgatggaaatgctggaggcgccacatcagcttgcctag

SEQ ID NO: 203145 - DNA, 1614 bp, Artificial Sequence
  Description of Artificial Sequence: Synthetic coding sequence
atgagctgggccgcccggccccccttcctgccccagcggcacgccgcaggacagtgtgggcctgtcggtgtgagaaaggaaatgcattgcggagtcgcatccagatggagacggcggcggccctggctggatccagccgccgccgcggccgcggccgtcgccggaggggagcaacaaactccagagccagagcccggcgaggcagggagagatggaatgggtgatagtgggcgtgactctcgatcaccagatagctccagcccaaatccacttcctcaaggggttcccccacccagtcctcccggcccacctttgcctccctcaacggccccctctctcggcggcagcggggcaccacctccccccccgatgcctccgccgccacttggcagccctttcccggttatctcctctagtatgggatcgcctggtctgcctcctcctgccccgcccggtttttctgggcctgttagttcaccgcagatcaactctactgtgtccctgccaggaggcggatccgggccaccggaagacgtcaaacctcccgttttgggcgtccgcgggcttcactgtccgcccccgcccggggggcctggtgcaggtaagcgcctctgtgcaatatgcggtgatcggagttcagggaagcactacggggtgtactcttgcgaggggtgtaagggattcttcaaacgcacaatccgcaaggacctcacatactcatgcagagataacaaggactgtacagtggataagcggcagcgaaacagatgtcagtattgtaggtaccagaaatgcttggctaccggcatgaagcgcgaggccgtacaagaggaacggcaacggggcaaggacaaagacggggacggtgagggggcgggcggggcccctgaggagatgcccgttgacagaattcttgaagctgagctggccgtggaacagaaatcagatcaaggcgtcgaggggcccggtgggaccgggggtagcggctcaagcccaaacgatcccgttaccaatatctgccaggcggcagataaacagctttttacacttgtggagtgggcaaaacgaattccacactttagttccctgcccctagatgatcaggtgatactcctgcgcgcaggatggaatgagctactaatagcgagcttcagtcacagaagcatcgacgtaagggatggaatcctgttggcgaccggtctgcatgtacatcggaattcagctcacagcgcaggtgtcggagctattttcgatagatccctgagcagagtattgactgagttagtgtccaaaatgagggacatgcgcatggacaaaacggaactcggatgcctgcgtgctatcatccttttcaatccggatgctaagggcctgagtaacccctccgaggtggaggttcttcgggagaaggtgtatgccagcttggaaacttattgcaagcagaagtaccctgagcaacaggggcggtttgccaagctactgttacgattgccagcacttcggtcaatcggcttgaaatgtttggaacacctctttttcttcaaacttataggtgatacaccaattgatacctttctaatggaaatgttagaggccccccatcaactggcatag

SEQ ID NO: 203146 - DNA, 1044 bp, Artificial Sequence
  Description of Artificial Sequence: Synthetic coding sequence
atgcgggagtgcggcggcggccccggcgccggcaagcggctgtgcgcaatttgtggcgaccggagttctggaaagcactatggcgtgtactcttgcgaaggttgtaagggcttctttaagaggaccattcggaaagatctcacgtacagctgccgagacaacaaggattgcactgtcgacaaacgccagagaaaccgctgccagtactgccgctaccagaagtgtctggctactgggatgaagagggaggctgtgcaggaggaaaggcaacgcgggaaagataaggacggcgacggcgagggcgctgggggcgcacctgaggagatgcctgtcgacagaatactcgaagctgaactcgcggtcgagcagaagagcgaccagggtgtagagggcccgggtggaaccggcggtagcggatcctctcctaacgaccctgttaccaatatttgtcaggcagctgacaaacagttattcacattggtggaatgggccaagaggatcccacatttcagcagtctacccctggatgaccaggtcatactgctgagggccggctggaacgagttactgattgcctccttcagccatcgatcgattgatgtaagagacggaattcttctagccaccgggcttcacgtgcaccggaacagtgcccacagcgcaggcgttggcgcgattttcgataggtccctcagtcgggtgttgacagagctggtgtcaaagatgcgtgacatgcgaatggataaaactgagctgggctgcctacgtgccattatcctgtttaaccctgacgctaaaggactttccaatccctcagaagttgaggtacttcgcgagaaagtttatgcctcccttgaaacttactgcaagcaaaagtaccctgaacaacaaggaagattcgccaagctgttattgagattgccggctcttcgatcaattggcttaaagtgcctcgagcacttattcttttttaaacttatcggcgacacgcccatcgacacatttctaatggagatgttggaagctccacaccagctggcctag

SEQ ID NO: 203147 - DNA, 1179 bp, Artificial Sequence
  Description of Artificial Sequence: Synthetic coding sequence
atgggcagccccggcctgcccccccccgccccccccggcttcagcggtcctgtcagttcccctcagataaacagcaccgtgagccttcctggcgggggatctggcccacctgaagacgtgaagccacctgtgcttggcgtccggggcctccactgccctcctccacctggtgggcctggagcagggaagcgactgtgcgcaatctgtggagatcggagttctgggaagcactacggtgtatattcctgtgaggggtgcaagggatttttcaaaaggacaataagaaaagatctaacgtactcgtgtcgcgacaataaagactgtacggtggacaagaggcagaggaacaggtgtcagtattgtcgataccagaaatgtctagcgacaggtatgaagagagaggccgttcaggaagagagacagcgcgggaaagacaaggacggagatggggagggagcaggtggggctcccgaggagatgcctgtcgatagaatccttgaagcagaactcgccgttgaacagaagtcagaccagggggtggaagggccagggggtacgggtgcacctagccctaacgatcctgttaccaatatctgtcaggctgctgataaacagcttttcactcttgttgaatgggctaaacgaatccctcactttagttccttgcccctggacgatcaggtgatcctccttagagcggggtggaatgaattgctgatcgcatcttttagccatcgctctatagatgtgagagatgggattttattggcaaccggactgcatgtgcaccgcaactccgcccacagcgccggcgtcggggccatctttgatagagtactcaccgaacttgtgtccaagatgagagacatgcggatggacaaaaccgagttgggctgcctcagggccattattctcttcaacccagacgcaaaaggactctccaaccccagtgaagtcgaggtgctgcgagaaaaggtctatgcatcactcgagacatactgcaagcagaaatatcccgagcagcagggccggttcgcaaagctgctgctgaggcttcccgcactgagatctattgggctgaagtgtctggagcatctatttttttttaagctgattggagacacccccatcgatactttcctcatggagatgctggaagccccacaccagctggcctag

SEQ ID NO: 203148 - DNA, 1170 bp, Artificial Sequence
  Description of Artificial Sequence: Synthetic coding sequence
atgggcagccccggcctgcccccccccgccccccccggcttcagcgggcccgtgtccagcccccagattaatagtactgtgagtctgccagggggtggtagcgggccccccgaagacgtcaaaccacccgtgctgggtgtgcgtggcctgcattgtccccctccccccggggggcccggtgccggcaaaaggctttgtgccatttgcggggatagaagtagcggcaagcactacggggtttactcctgcgaagggtgtaaaggtttcttcaagcggacaatcagaaaggacctgacatatagttgccgggacaataaggattgcaccgtggacaagaggcagaggaatcgttgccagtactgccggtatcagaagtgtctcgccactggaatgaaaagagaggcagtgcaggaggagcggcagaggggaaaagacaaagacggcgacggcgagggcgccgggggtgcccccgaagaaatgcccgtggatcggatcttggaagcagagctggctgtggaacagaagtccgaccagggaggttctcagcacatcagcaaaagtcccaatgacccagtgactaacatctgtcaggctgctgataagcagcttttcacattagtcgagtgggcaaaacgcatcccccattttagtagtctccccttagacgaccaggtgatcctgctgagagctggatggaatgagcttctcattgcttctttctctcaccgctcaatagacgtacgcgacggcatactgttggccaccggcctgcatgtgcatcgcaactcagcacattcagccggtgtgggggccatcttcgaccgagtcctgactgagctcgtttcaaaaatgagagacatgaggatggataagaccgagttgggctgcttgcgcgctattattctgttcaaccccgatgcaaaagggctcagcaacccatccgaggtagaagttctaagagaaaaagtgtacgcatctttagagacttattgtaagcaaaagtatccggagcagcagggtcgcttcgcaaagctgcttctccgcttgcctgccctgagatccattggccttaaatgcctcgaacacctttttttcttcaaactgatcggtgacactcctattgatacatttctcatggagatgctggaggccccccatcagctcgcctag

SEQ ID NO: 203149 - DNA, 1044 bp, Artificial Sequence
  Description of Artificial Sequence: Synthetic coding sequence
atgcgggagtgcggcggcggccccggcgccggcaagcggctgtgcgctatttgtggcgaccggtcgagcggaaagcactacggggtctactcctgtgaggggtgtaaggggttcttcaaacggacgatacgcaaagatttgacctactcatgccgagacaataaggattgtacagtggataagcgccagcgcaataggtgccagtactgcaggtatcaaaagtgtctggcaactgggatgaagcgagaagcagtgcaagaggaaagacagcggggcaaagacaaggacggtgatggagagggcgctggaggcgcccctgaagaaatgcccgtggaccgcatcctggaagctgagctggcagtggagcagaaatcagatcagggggtggagggacctggaggcactggggggagcggaagtagtcctaatgaccccgtgaccaacatttgtcaggcagcagataagcagctgtttaccctggttgagtgggctaaaaggatcccccacttttcatcactaccattagatgaccaggttattcttctgcgggcaggctggaacgaattactgatagcttctttctcgcacaggtccattgacgtgcgagatgggattctcttagctacaggcctccatgtccatcgaaacagcgctcattcggctggcgttggggccatctttgataggtcgctgagcagggtattgaccgaactggtatcaaagatgcgagatatgaggatggataaaaccgagcttggatgtttgagagctattattttgtttaaccctgatgcaaaagggctttcaaatccaagtgaggtagaagtactcagggagaaggtatatgcctccctggagacctactgcaagcaaaagtatcccgaacagcaaggcagatttgccaaactcctacttcgactgccggccttgaggtccattggtctaaaatgcttggaacacctgtttttcttcaagctcataggcgacacaccgatcgacaccttcctcatggagatgctggaagctcctcatcagctggcttag

SEQ ID NO: 203150 - DNA, 1179 bp, Artificial Sequence
  Description of Artificial Sequence: Synthetic coding sequence
atgggcagccccggcctgcccccccccgccccccccggcttcagcgggcccgtcagtagcccccagatcaactccacagtctcgctgccgggcggggggagtgggccccctgaggacgttaaaccccctgtcttgggggtcagggggctgcattgccctcctcccccgggcggccccggggcaggtaagcgcctctgtgctatctgtggcgataggtcttctggaaagcattatggcgtttacagctgtgaaggatgtaaaggctttttcaaaaggacaattaggaaggatctgacctattcatgccgggataacaaggattgtactgtggacaaaaggcaaaggaatcgatgtcagtattgtcggtatcagaaatgcctggcgaccggcatgaaacgcgaggctgttcaagaagagcggcagcgggggaaggacaaagacggtgacggagaaggagccgggggtgcacctgaagagatgcccgtcgacagaatcctggaagctgagttagcagtggaacaaaagagcgatcaaggagtggaggggcccgggggcacaggagcaccttcccccaatgaccccgtcactaacatatgtcaggccgccgataaacagctctttacacttgtggaatgggctaagcgtatcccccatttttcaagcttgccccttgatgaccaggtcatccttcttcgagctggatggaacgagttacttatagcatccttctcacatagatccatcgacgtacgcgatggtatccttctggccaccggactgcatgtacacaggaatagcgcccatagtgctggcgtgggggctattttcgaccgcgttttaactgagctggtgagcaaaatgcgggatatgaggatggacaaaaccgaattaggatgcctgagagccatcattcttttcaatccagatgccaaggggctgtccaatccgagcgaggtggaagttctgagggagaaggtttatgcttccttagagacctattgtaagcagaaatacccagaacagcagggcaggttcgccaagctgctattaaggcttccagctctgcggtcaatcggactaaaatgcttggagcaccttttcttcttcaagttaattggggacactccgatagacactttcttgatggaaatgcttgaggctcctcaccagcttgcgtag

SEQ ID NO: 203151 - DNA, 1170 bp, Artificial Sequence
  Description of Artificial Sequence: Synthetic coding sequence
atgggcagccccggcctgcccccccccgccccccccggcttcagcggcccagtgtctagcccacagatcaattctacagtgtcactgccgggcggcggctccgggccacctgaagatgttaagccacccgtgttaggagtgcgaggcctccactgcccgcctccgccagggggaccaggggctgggaagcggctgtgtgccatctgtggtgatagatcaagcggaaagcattatggcgtgtactcatgtgagggatgtaaggggttttttaaaagaacaatccgaaaggatttaacgtattcatgccgcgataataaggattgtaccgtggataagcggcagcgcaatcggtgtcagtactgccggtaccagaaatgtcttgcaaccgggatgaaacgggaagccgtacaggaggagcgccagcgaggaaaagataaggacggcgatggcgaaggtgctgggggggcccctgaggagatgccagtcgaccggatattggaagcagagctggctgtggagcagaagagcgatcagggcggaagccagcatatatctaagagtcccaacgaccctgtcacaaacatttgtcaagccgctgataaacagctgttcaccctggtggaatgggctaaaagaatcccgcacttttcgtctctgccactcgatgatcaagttattttgctgcgggcaggctggaatgagctgctaatcgcttcattctcacaccgaagcatcgacgttcgagatggcatcctgttagccaccggtctgcatgtgcataggaactccgcccactccgcgggagttggagccatattcgaccgcgtgttgaccgagctcgtgtctaagatgagggatatgcgaatggataagactgaactgggatgcctcagagccattattctgtttaacccggacgctaagggtctgtccaatccttcagaagtggaagtgctgagagaaaaggtgtacgcaagtctggaaacttattgtaagcagaagtacccagagcagcagggaaggttcgccaagcttctgttgagattgcccgctcttcggtccatcggcctgaagtgtctagagcatctgttctttttcaagctgataggtgacactcctatcgatacgtttttgatggaaatgctggaggccccgcaccagctcgcctag

SEQ ID NO: 203152 - DNA, 861 bp, Artificial Sequence
  Description of Artificial Sequence: Synthetic coding sequence
atgccccagggcagcgtgggccggtggggctgcgagaagaagtgcattgtgggctcccggcccggcggcggaggagacgggcctggttggattcctcaaagacgtaggcgtcgtcggtggcaggctgaaaataacaagccacgaagcagatcccaaggaagactcgatgggacgggatgggccacagctggaggaatcaattccacggtgagtctcccaggtggcgggagtggacctcccgaagatgtgaagccacccgttctgggagtgcgagggctgcactgcccccctccccccggtgggcccggggccggaaagaggctctgtgccatttgtggcgacaggtcatcggggaagcattacggggtgtactcctgtgagggctgtaaaggattcttcaagcggactatcaggaaggaccttacctacagttgccgcgacaataaggactgcacagttgataaaagacaacggaaccggtgtcaatattgccggtatcagaagtgccttgcaaccggcatgaagcgagaagccgtgcaggaggaaaggcagagggggaaagacaaagacggcgatggcgaaggggcaggtggcgcccctgaagagatgccagtcgatcgcattctagaggccgagctggccgtcgaacagaagtcagatcagggggtcgaaggaccggggggcacaggcgggagcggcagcagcgtctccgtcggagttaatccactttccttcgtcatgggcgtcggtggtggatctcttgggcttttttacatcccttcacccagcttccccctgattacctttcttactcttctgggaactgggggcgcagcgaagcaggggctgtctaatatctag

SEQ ID NO: 203153 - DNA, 1170 bp, Artificial Sequence
  Description of Artificial Sequence: Synthetic coding sequence
atgggcagccccggcctgcccccccccgccccccccggcttcagcggacccgtgtcctccccccagatcaatagtactgtttctctgcccggcggagggagtgggccaccagaggacgtgaaacccccagtactgggcgttcgcggcctccactgtccaccgcccccaggggggcccggtgctggcaagcgcttatgtgcaatctgtggggatcggtctagtggaaaacattatggcgtgtactcttgcgagggctgcaaggggttctttaaaagaaccatacgaaaagatctgacttacagctgtagagataacaaggactgtacggtcgacaagagacagcgcaatcgctgccaatactgtaggtatcagaaatgtctcgccactggaatgaagcgggaagctgtgcaggaagaaaggcaaagggggaaagacaaggatggcgacggcgagggtgccggcggcgcccccgaagagatgcccgtagacagaatcttagaggccgagctggctgttgagcagaagtccgatcaaggggggtcgcagcatatttcaaagtccccaaatgaccctgtgactaacatttgtcaggctgctgataaacagctgttcaccctagtggaatgggccaagcgcatacctcatttcagctccctccctttggacgaccaggtgatcttgctgagagcgggctggaacgagctacttatcgcctcctttagtcacaggtctatcgacgtgcgggacggaattctcttggcaacaggcttacacgtgcaccggaacagcgcgcactccgccggggtgggtgcaattttcgaccgagtcttaaccgaactggtgtccaaaatgcgtgatatgaggatggataagaccgagctaggctgtttacgggcaatcatactgttcaatccggacgctaaaggcctctctaatccctcagaagtggaagtcctaagggagaaagtgtatgctagcctggagacgtattgtaaacagaaataccccgagcagcagggccggtttgcaaaactgttactgcgcctgccggccctgcggagtatcggactgaagtgtctggagcacctgttcttttttaagctgattggcgatactcccatcgacaccttcttgatggagatgctggaagctccccatcaactggcctag

SEQ ID NO: 203154 - DNA, 861 bp, Artificial Sequence
  Description of Artificial Sequence: Synthetic coding sequence
atgccccagggcagcgtgggccggtggggctgcgagaagaagtgcatagtcgggagccggcctggcgggggcggggacgggccgggttggatccctcaacgcagacgcaggcgccgttggcaagctgagaacaataaacctcggagcagatctcagggccgcctcgacggaactggatgggccaccgctggcggaatcaattccaccgtctctttgcccggagggggttcaggccctcccgaggacgtaaaaccacctgtgctcggagtccgaggactgcactgccccccccctcccggaggcccaggcgcggggaagcggttgtgcgctatctgtggggaccgaagctctggcaagcactatggtgtgtactcttgcgagggatgcaaaggcttcttcaagagaactattcggaaagacctcacttactcgtgccgcgataacaaagattgtactgtggacaagagacagcggaaccgttgtcaatattgcaggtaccaaaagtgcttagccactgggatgaagcgcgaggccgttcaggaagaacgtcagagaggcaaagacaaagacggtgacggagaaggggctggcggagctcctgaggaaatgcccgtagaccggatcctagaggcagagttggccgtggaacagaaatccgaccagggcgtggaaggaccaggggggacggggggtagcgggtcatccgtgagtgtgggcgtgaaccccctgtcctttgtgatgggggtgggcggggggtccctgggcctcttttatattccatctcctagttttcctttgatcacttttcttactctactggggaccggtggtgctgcgaagcaaggattgtctaacatttag

SEQ ID NO: 203155 - DNA, 1179 bp, Artificial Sequence
  Description of Artificial Sequence: Synthetic coding sequence
atgggcagccccggcctgcccccccccgccccccccggcttcagcgggccagtgtcttcgcctcagatcaacagcacagtctccctgcctgggggggggtctgggccccccgaggacgtgaagccacccgtgttgggggtccgcgggctgcactgtcccccacctcctggagggccaggtgccggaaagcggctgtgcgctatttgcggtgacagatcatccggcaaacactacggcgtctatagctgtgagggatgcaagggcttttttaaaagaactattaggaaagatctgacctattcttgtcgagataataaggactgtacagtcgacaagaggcagagaaatagatgtcagtattgcaggtatcagaagtgtttagctacaggaatgaagcgggaagcggtccaggaagaaaggcaacggggtaaagacaaagacggcgatggggagggagccgggggggccccagaggagatgccagtggaccgaatcttagaagccgaactggctgtggagcagaaaagcgaccaaggtgtggagggaccaggagggacgggggccccatcaccaaatgacccagttactaatatttgtcaggccgcggacaagcagctgtttacactcgtcgaatgggcaaaaaggatcccccatttctccagtctgcctcttgacgatcaggtcatcctgctcagggctggctggaatgaactcctgattgccagcttcagccatcggtccattgatgttagggacggaatccttctcgctactggccttcatgtgcaccgaaatagtgcacactcggcaggagtcggcgctatcttcgatagagtgctaactgagttggtcagcaagatgagagatatgaggatggacaaaaccgagctcggatgcctaagagcaatcatactgtttaatcccgatgcaaagggcttatctaatccctctgaggtcgaagtgctcagagagaaggtgtatgcaagcctggagacctattgcaagcaaaagtatcctgagcaacagggcaggttcgcaaaactgctgcttaggttacctgccctccgtagcatcgggctcaaatgtctcgaacaccttttttttttcaagctcattggcgatacccccattgacaccttcctgatggaaatgctcgaagcaccccatcaactcgcatag

SEQ ID NO: 203156 - DNA, 1044 bp, Artificial Sequence
  Description of Artificial Sequence: Synthetic coding sequence
atgcgggagtgcggcggcggccccggcgccggcaagcggctgtgcgctatatgcggcgaccgaagttccggtaagcactacggcgtatactcctgcgaagggtgcaaggggttcttcaagaggacaatccggaaagatctgacatattcatgccgggataacaaagactgcaccgttgacaaacggcagcgcaaccgatgtcagtactgtcgttatcaaaaatgtctggcaacgggcatgaagcgggaagccgtccaggaagagaggcagcgaggcaaggataaggacggcgatggagaaggagccgggggggcccctgaggagatgcccgtggatcgaattttagaagccgaactggctgtggagcagaagtctgaccagggcgtcgaaggtccaggcggtacgggaggatcaggaagctcccccaatgacccagtgacaaatatttgccaggccgccgacaagcagctgttcacactggttgagtgggcaaagcggatcccccactttagctctctacctttagatgatcaggttatccttctgcgtgcaggttggaatgaactgttaattgcctctttttcacaccgctccatagatgtgcgcgacgggatccttcttgcaacaggcttgcacgtacataggaatagcgcccacagcgcaggagtgggagccatttttgatagaagtctgagtcgggttttgaccgaacttgtgagcaagatgcgcgatatgcgtatggataaaacagagctgggatgcctgagggctattattctctttaaccccgatgccaagggtctcagtaacccctccgaagttgaggtgctgcgggagaaggtctatgcttctctcgaaacatattgtaagcagaaatatccagagcagcagggaagatttgcgaagctgctgctcagactaccagctttaagaagcatagggctcaagtgtctggagcatcttttcttcttcaagctcataggagacacacccattgacacctttctcatggagatgctcgaggcacctcatcagcttgcatag

SEQ ID NO: 203157 - DNA, 1179 bp, Artificial Sequence
  Description of Artificial Sequence: Synthetic coding sequence
atgggcagccccggcctgcccccccccgccccccccggcttcagcggacccgtttcttcccctcagatcaactccaccgtctccctcccgggcggcggatccgggccgcccgaagacgtgaagccccctgtgctcggagtccgaggtttgcactgtccaccaccccccggtggacccggcgcaggaaaacgcctgtgcgcaatttgtggagaccgctccagcggcaagcattatggagtatattcctgcgaaggatgtaagggattctttaagaggacaatcaggaaagacctcacgtactcttgtcgggataacaaagactgcaccgtcgataagaggcagagaaatcggtgtcagtactgccgctatcagaagtgcctggcgaccgggatgaaaagggaagccgtgcaggaggagaggcagagagggaaagataaagacggcgatggggaaggggccggtggagcgccagaggagatgcctgtggatcggatcctcgaagcagaactggccgtggaacagaaaagtgaccagggggtcgagggcccaggcggaacaggtgctccaagtccaaatgatcctgttactaatatttgccaagctgctgataagcagctcttcacattagtcgaatgggccaaaaggattccgcactttagcagcctccccctcgacgaccaggtaatcctgttgagagccggctggaacgaattgctcattgcctccttcagccacaggtcgatagatgtcagagacggaatcctccttgcaaccggtttacacgtgcaccgcaatagcgcacactcagcaggggtgggcgccatcttcgatcgagttttgaccgagttagtcagtaaaatgagggacatgcgcatggacaagacagagctgggctgtctgcgtgccatcatcttgtttaatccagatgctaaggggctttccaaccccagtgaagtcgaggtgctccgtgaaaaggtgtacgctagcctggaaacttactgtaagcagaaatatcccgagcagcagggacgcttcgctaagctgctacttagactccccgccctccgaagtatcggactcaagtgcctcgagcatttgtttttctttaaactgataggcgacaccccaatcgacacctttctgatggagatgctcgaagccccccaccagctcgcttag

SEQ ID NO: 203158 - DNA, 1179 bp, Artificial Sequence
  Description of Artificial Sequence: Synthetic coding sequence
atgggcagccccggcctgcccccccccgccccccccggcttcagcgggcctgtgtccagtccacagatcaatagcaccgtgagcctaccaggcggtgggtccggccctcctgaagacgtgaaaccgccagtgctgggcgtgaggggcctgcactgtcctccaccacccggtggtcctggagccggaaaaaggctgtgcgcaatctgcggggaccggtctagtggcaagcattatggcgtgtattcgtgcgaggggtgcaaaggatttttcaaacgcaccatcaggaaagaccttacctactcctgtcgagacaacaaggattgcactgtggataagagacaacgtaaccgttgtcagtattgcaggtaccaaaagtgtctggcaacagggatgaagcgcgaggcagttcaggaagaaaggcagagagggaaagacaaggacggagatggagagggtgccggcggggcacctgaggagatgccggtggatcgtattctggaagccgagcttgccgtcgagcaaaagtccgatcagggtgtggagggacctggcggcaccggagcaccatcgcccaacgaccccgtgaccaatatctgccaggcagccgataaacagctgttcaccctggtggaatgggccaagcgaattcctcatttctccagtttgccactggatgatcaggtcattctgctgcgggccgggtggaatgaacttttgattgcctccttctctcaccgctctattgatgtccgggatggcattttactggctacaggtttgcatgttcatcgcaactcagcccactctgccggtgtgggcgcaatttttgaccgcgtgctgacagagttggtctctaagatgagagatatgagaatggacaagaccgagctgggatgcctgcgggccatcattctgtttaatcccgacgctaagggcctgtccaaccctagcgaagtggaggtgctccgggagaaggtgtacgcatcgttggagacatactgcaagcagaaatatcccgaacagcaggggcggttcgcgaagctgctgctgcgccttccagccctccggagtattgggctgaagtgtctggaacatttatttttcttcaaactcataggagatacaccaatcgatacttttctcatggaaatgctggaagccccccaccagttggcttag

SEQ ID NO: 203159 - DNA, 861 bp, Artificial Sequence
  Description of Artificial Sequence: Synthetic coding sequence
atgccccagggcagcgtgggccggtggggctgcgagaagaagtgcatcgttggctctcgtccgggggggggcggggatgggcccgggtggatcccacagcggcgtagacgtcggaggtggcaagccgagaacaataaacccagaagcagatctcaggggcggctggatggcactggctgggctacagccggaggtattaacagcactgtttccctaccagggggtggatccggaccacccgaggacgtaaagcctcctgttcttggcgtgcggggactgcactgtcccccaccgcccggtgggcccggtgccggtaagcgtctgtgtgctatctgtggtgatagatctagtggcaaacactatggtgtgtactcctgtgaaggttgcaagggattcttcaagcgaactattagaaaagacctgacctattcatgccgggacaacaaggattgtacagtagacaagaggcagagaaatcgatgccagtattgtcgctaccaaaaatgcctcgctacgggcatgaagagggaagctgtacaggaggaacggcagcgggggaaagataaggatggggacggcgagggagcagggggcgccccagaggaaatgcccgtcgaccggatcctggaagccgagctggctgtcgaacagaagtctgaccagggggtggagggccccggaggcaccgggggcagcggtagctctgtgtccgtgggcgtgaacccactttcttttgtcatgggggtggggggcggcagcctggggcttttttatattccaagtccctcattccctcttattacctttctgactctgctgggaactgggggagctgctaagcagggtctgtccaacatctag

SEQ ID NO: 203160 - DNA, 1170 bp, Artificial Sequence
  Description of Artificial Sequence: Synthetic coding sequence
atgggcagccccggcctgcccccccccgccccccccggcttcagcggtccggtgagcagtccccaaatcaacagcacggtcagtctgccgggtggaggaagtggacctcctgaagacgtgaaacctcctgttctgggcgtccgcggcctccactgcccccctcccccagggggacccggcgccggcaaaaggctgtgtgctatctgcggggacagatctagtggaaagcactatggcgtgtatagctgcgagggctgtaaagggttctttaagagaacaattaggaaggatctcacctacagctgccgggacaataaggattgtacggtggacaagcggcagcgcaacaggtgtcagtactgccgctatcagaagtgccttgccacagggatgaaaagagaagctgtccaggaagagcggcagcgcggaaaagacaaagacggagatggcgagggggccggcggggctccagaagagatgccagtagatcgtatcctagaggcagaactggccgtggagcaaaagagcgaccagggtggatcccagcatattagcaaatcacctaatgaccctgtaaccaacatatgtcaagccgctgacaagcagctctttaccttagtggagtgggctaagcggataccccatttctcttccttacctctcgacgaccaagtcatcttgttacgagctgggtggaacgagttgctgatcgcatcctttagccatcggtccatcgatgtgcgtgacggcattcttctggcaaccggattgcatgtccaccgcaactccgcacacagtgccggggtcggggctattttcgaccgagtactgaccgagctggtcagtaagatgcgggacatgagaatggataaaacagagctcggctgtttaagagcaatcattttgtttaatccggatgcaaagggattgagcaatcccagcgaggtggaagtgctgagagagaaggtgtatgctagtcttgagacctattgcaagcagaaatatccagagcagcagggacgctttgctaaactgctgctacgcctccctgcacttcggtcaatcggcctgaagtgcttggagcacctctttttctttaagcttatcggggacacccctatcgacaccttcctcatggagatgctcgaggccccccaccaactggcatag

SEQ ID NO: 203161 - DNA, 1044 bp, Artificial Sequence
  Description of Artificial Sequence: Synthetic coding sequence
atgcgggagtgcggcggcggccccggcgccggcaagcggctgtgcgccatttgtggagaccggagctcaggaaagcactacggcgtatactcttgtgagggctgcaagggattctttaagcgcaccatccgtaaagatttgacatattcttgtcgagacaataaggactgcacagtggacaagcggcagcgtaatagatgccagtactgccgttaccagaaatgcctcgccacgggaatgaaaagagaggcggtgcaggaggagcggcaacggggcaaagataaggacggcgatggagaaggagccgggggcgcacccgaggaaatgccagtggacagaatcctggaagccgaactcgctgtggagcaaaagtccgaccaaggcgtggaaggtccgggagggacaggaggttccggatcatcacccaacgacccggtcactaatatttgccaggctgctgacaagcagctgtttaccctggttgagtgggccaaacgaatcccacactttagttccttaccgctggacgaccaggtgattctgctccgagccggctggaacgaactactcattgcgtctttcagccatcggagcattgacgtacgagacgggatcctcttggccacaggcctgcacgtacaccgcaattcggcacattccgctggggtaggtgcaatcttcgaccgctcactctctcgggtcctcacggagctggtgtctaagatgagagatatgcggatggataaaaccgagctgggatgcctgcgggccattatcctgttcaaccctgacgctaagggcctgtcaaatccttccgaggtagaggtgctccgcgagaaggtctacgccagtctggaaacctattgtaagcagaaatacccagagcagcagggcaggttcgccaagctgttgctgaggctgcctgcactgcggtcaataggactgaagtgtctggagcatctctttttctttaaactcatcggcgacacgcctatcgacacgttccttatggaaatgcttgaggccccccatcaactggcttag

SEQ ID NO: 203162 - DNA, 1170 bp, Artificial Sequence
  Description of Artificial Sequence: Synthetic coding sequence
atgggcagccccggcctgcccccccccgccccccccggcttcagcggtcctgtctccagcccacaaatcaactctacggtttccctccccggagggggatctggacctcctgaggatgttaagccacccgttctgggcgtacgcggattacactgtccccctccacctgggggccccggcgctgggaagcgactgtgtgctatctgtggtgatcgctcttccggcaagcactacggagtgtatagctgtgagggttgcaaaggattttttaagcggaccatcagaaaagatctgacctacagctgccgagataataaggactgtacagtggacaaaagacagcggaacaggtgtcaatactgtcgttaccagaagtgcctggccaccggtatgaagagagaggctgtgcaagaagaacgacagcgcggtaaggacaaggatggcgatggcgagggggcggggggggcacctgaggagatgcctgtggataggatattggaggcggagctggccgtggagcaaaaatcagatcagggagggtcgcaacacattagtaagtcccccaatgaccccgtcacaaacatctgtcaggcggccgacaagcagctgtttacactggtggaatgggcgaaaagaatcccccacttctcctctctgccgctcgacgaccaggtgatactcttaagagccgggtggaatgagctgctcatcgccagtttctcccaccgaagcattgatgtcagagatggtatcctacttgctacaggtttgcacgtgcatcgaaacagcgcacatagcgcaggcgttggcgcaatctttgaccgagtccttaccgagcttgtgagcaagatgagggacatgcgcatggacaagaccgagctcggctgtctccgtgccatcattctttttaatccagatgccaagggactgtcaaacccttccgaggtggaggtcttgcgggagaaggtgtatgccagccttgagacctactgtaaacagaaatacccagaacagcagggcagattcgccaagctgctgctgcggcttcccgcactacggtcaatcggactgaaatgcctggagcacctcttctttttcaaactgatcggagacactccaatcgacacgttcctgatggaaatgttagaggccccacatcagctggcctag

SEQ ID NO: 203163 - DNA, 1044 bp, Artificial Sequence
  Description of Artificial Sequence: Synthetic coding sequence
atgcgggagtgcggcggcggccccggcgccggcaagcggctgtgcgccatatgcggcgaccggtcatccggcaaacactacggcgtgtatagctgcgagggctgtaagggtttctttaagaggacaatccggaaggatctgacttactcttgcagagataataaggattgtacagttgataagcggcaaaggaaccgatgtcaatattgtcgctaccagaaatgtctagccaccgggatgaaacgtgaagccgtgcaggaggaacggcagaggggcaaagataaggacggcgatggcgaaggcgctggcggtgcgccagaagaaatgcccgtggatcgaattctggaagccgaactcgccgttgagcagaaatcagaccagggagtcgaaggccccgggggaaccgggggaagtggttccagtcccaatgaccctgtgacaaatatttgtcaggccgctgacaagcagctctttaccttggtggaatgggccaagcggattccacacttctccagtctacctctcgatgaccaggtcatcttgctgagagctggctggaatgagctgctgattgctagcttttcgcacaggtcgattgatgtaagagacggcatcctgctggccacagggttacacgtgcaccgaaactccgctcactcagcaggtgtgggtgcgatctttgatcggagcctgtctcgcgtgctcaccgagctggtaagcaagatgcgtgatatgcgtatggacaagaccgaactcggttgcctgcgggcgatcatcctcttcaaccccgacgccaaaggcctgtctaatccatccgaggtcgaagtgctacgggaaaaagtctatgcatctctcgaaacctactgcaagcaaaagtaccctgaacagcagggcagatttgccaaactcttattgcggttgcccgctctgcggtctatcggactaaaatgtctggagcacctgttcttctttaagcttatcggtgataccccaatcgacacattcttgatggaaatgctcgaggccccgcatcagctggcctag

SEQ ID NO: 203164 - DNA, 861 bp, Artificial Sequence
  Description of Artificial Sequence: Synthetic coding sequence
atgccccagggcagcgtgggccggtggggctgcgagaagaagtgcattgtgggatctaggcccggaggcgggggggatggaccaggatggataccccagcggagaagacgacgtcgatggcaggctgaaaataataagcctcgtagccggtcccagggaaggcttgacgggaccgggtgggcgactgcaggcggaattaattcaacagtgagcctcccaggcggtggcagcgggccaccagaggacgtaaagccgcctgtgttaggagtgagaggtctgcactgcccacccccaccaggagggccaggggccggaaagagactctgcgccatatgcggagacagaagctctggaaaacattacggagtatattcctgtgaagggtgcaaaggcttcttcaagcggacaatacggaaagacctgacttattcttgtcgagacaataaggactgtaccgtggataagcgccagcgcaatagatgtcaatactgccgatatcagaaatgcctggctaccgggatgaaaagagaagcagtccaggaggagcggcagagaggtaaagataaggacggtgacggtgagggagccggcggagcccccgaggagatgccggtcgataggatccttgaagcggaacttgcagtggaacaaaaaagcgatcaaggagtggagggaccgggtggtactggggggagcgggtctagcgtaagcgtgggggtgaatcccctgtctttcgtgatgggtgtcggaggggggagcctggggctcttttacattccctccccaagcttccctctgattacatttctgactttgttggggacgggcggcgccgccaaacaggggcttagtaacatctag

SEQ ID NO: 203165 - DNA, 1392 bp, Artificial Sequence
  Description of Artificial Sequence: Synthetic coding sequence
atgtacggcaactacagccacttcatgaagttccccgccggctacggaggttcgcctgggcatacgggaagcaccagcatgagcccgtccgcagccctgtcaacaggcaagcccatggactcccacccttcttacaccgatacccccgtgtcagccccccgtacgctgagtgcagttggcacacccctaaacgcattaggatctccatacagggtcataacttcagccatggggcctccaagtggcgcgcttgctgcacctcctggcatcaacttggtcgcacccccttccagtcagctgaatgttgttaacagtgtcagttccagcgaggacattaagcccctgcccgggctgcccggcattggtaacatgaattaccccagcacatctccaggctcactagtcaaacacatctgcgctatctgcggagatcggagcagcggcaagcactacggagtatacagctgcgaggggtgcaagggattcttcaaacggactattcgcaaggatctcatctatacatgccgcgataacaaagattgtcttatcgataagcgacagcggaacagatgtcaatactgcaggtaccagaagtgtcttgttatgggaatgaaacgcgaggctgtgcaagaggagagacagcggagtagggagcgagctgaaagcgaggcggagtgcgcgacgtccggacatgaagatatgcccgtggaacggattctcgaggccgagttggccgtcgaacctaagactgaatcctacggtgacatgaacatggaaaattctaccaacgatcccgtaaccaacatctgtcatgccgcggataagcagctcttcacccttgtggagtgggcaaagcgtataccccacttttccgacttaactctcgaggaccaggtgattctcctcagggcaggttggaatgagcttctcatcgcctccttttcacatcgcagcgtctccgttcaggatggcatactgttagctacagggctgcatgtccatcgctcgagtgcccactccgccggggtgggctcaatatttgacagagtgctgacagagcttgtgagcaaaatgaaggacatgcagatggataagtcagaactgggctgccttcgcgccattgtgctgttcaatcctgatgctaagggactgtctaatcccagcgaggtcgaaacactgcgcgagaaagtctacgctaccctggaagcctatactaagcagaagtatccagagcagcccggaaggttcgctaaactgctgctgcggttgcctgcccttagaagtataggcctaaagtgcttagagcacctctttttttttaagctcattggagacacacccatcgatacattcttgatggagatgctggaaacgccactgcagatcacttag

SEQ ID NO: 203166 - DNA, 2619 bp, Artificial Sequence
  Description of Artificial Sequence: Synthetic coding sequence
atggccaccgcctgcaagcggagcggcgagccccagagcgacgacattgaagcaagccgcatgaagcgggccgccgctaaacacctgatcgagcgttattaccaccagctcactgaggggtgcgggaatgaagcctgtactaacgaattctgcgcatcgtgtcccactttcctgcgaatggacaacaatgcggcagcgatcaaggctctggagctgtataagatcaacgccaaactgtgtgatccacatccgagcaaaaagggcgcaagcagcgcctacttagagaacagcaagggagcacccaacaattcatgcagcgaaatcaagatgaataagaagggagcacgcattgactttaaggatgtgacatacctcactgaagagaaggtatatgagatcctagaactttgcagggagagagaagattatagtccactgatacgggtgatcggcagagtgttttcttccgccgaggcactggtgcagtcatttcgtaaggtgaagcagcatacaaaggaagaactaaagagtctgcaggctaaggacgaagacaaagatgaagatgagaaggaaaaagccgcttgttccgcggcggctatggaggaagattccgaagccagctcttcccggattggcgacagctcccagggagacaacaatctgcaaaaattaggtcccgacgacgttagtgtcgatatcgacgcaatcaggagagtctatacccggctcctgtcaaatgagaaaatcgaaactgctttcctcaacgccctggtctatctgtctcctaacgtggagtgcgatctcacgtaccacaacgtgtattctcgggaccctaattacctgaacctgtttatcattgtgatggagaatagaaatttgcattctcctgaatacctggaaatggcactgcccctcttctgcaaggcaatgtccaaactgccactggcagcacaggggaagctgattagattgtggagcaagtacaatgcagatcaaattcgacgcatgatggagacctttcagcaactgatcacatataaagtgatctccaacgaattcaactcacgcaacctcgtgaatgacgatgacgcaatcgtggctgcgtccaagtgtctgaaaatggtctactacgccaatgttgttgggggagaggtggacaccaaccataatgaagaggacgacgaagagccaattccggaatccagcgagcttactctgcaagaactgctcggcgaagagcggagaaacaaaaaaggacctcgagttgatccactggaaacagagctaggggtgaagaccttggattgccgaaaacctctgataccttttgaagaatttattaatgagcctttaaacgaggtgctggaaatggacaaggattacacattcttcaaggtggagacagaaaataagtttagcttcatgacttgcccattcatacttaatgccgtaacaaagaatctgggcctttactacgacaacagaattcggatgtatagtgagcggcgtatcaccgtgctatacagcttggtgcagggtcagcagcttaacccctacctacggctcaaggtcaggagggaccatattatcgatgatgcccttgtcagactggagatgatcgccatggagaatcccgctgacttgaaaaaacagctttatgtcgaattcgagggcgagcagggggtggacgaggggggcgtttccaaagagttcttccagcttgtggtggaagaaattttcaatcctgatatcggcatgtttacttacgacgaaagtactaagctgttctggtttaatcctagtagcttcgagacagagggtcaatttaccctcataggaattgtcctgggactagcgatttataacaattgtatactcgatgtccatttcccaatggttgtctatcgcaagctgatggggaagaagggaacattccgcgaccttggagactctcatccagtcctttaccaatctttgaaggatctcctggaatacgaggggaatgtcgaggacgatatgatgatcacattccagatctctcagactgacttattcgggaatcccatgatgtacgacctcaaggagaacggggacaaaatccctattacaaacgagaacaggaaggagttcgtaaacctgtattccgactacatactgaacaagtcagtcgaaaagcagtttaaggcctttaggagagggttccacatggtcacaaacgaatcaccgctgaaatacctgtttcggcctgaggagatcgaactattgatatgcggcagcaggaaccttgattttcaggcgcttgaagagacaaccgaatacgatggggggtacactcgagacagtgttctgatccgggaattttgggagattgtgcactccttcacagatgagcagaagagactgttcctacaattcactactggaacagaccgagccccagtgggtgggttgggaaagctaaagatgatcatagcaaaaaatggacctgatacggaacgccttccaacatcacatacatgtttcaatgtcctgttgcttcccgaatactccagcaaggaaaaacttaaggagcgactgttgaaggccattacttacgcaaaaggattcggtatgttgtag

SEQ ID NO: 203167 - DNA, 75 bp, Artificial Sequence
  Description of Artificial Sequence: Synthetic coding sequence
atgacccgggaccagaacggcacctgggagatggagagcaacgagaactttgagggctacatgaaggctctgtag

SEQ ID NO: 203168 - DNA, 312 bp, Artificial Sequence
  Description of Artificial Sequence: Synthetic coding sequence
atgacccgggaccagaacggcacctgggagatggagagcaacgagaactttgaaggctacatgaaagcactggatatcgatttcgccacaagaaagatcgcagtgaggcttacacagaccaaagtaatagaccaggatggggacaacttcaagaccaaaaccactagtacattccgcaactatgacgtggatttcacggtgggcgtagagtttgatgagtacacaaaaagccttgacaatcgacacgtgaaagcactggtgacatgggagggagacgtcttagtctgcgtgcagaagggggaaaaggagtag

SEQ ID NO: 203169 - DNA, 1494 bp, Artificial Sequence
  Description of Artificial Sequence: Synthetic coding sequence
atgggcctgcccgccctgctggccagcgccctgtgcaccttcgtgttgcccctgctcctgtttctggcggctattaaactttgggacctctattgcgtgagcggtcgagatagatcatgtgccctgcccctgcctcctgggactatgggtttcccgttctttggggagactttgcaaatggtgctgcagaggaggaagttcttgcaaatgaagagacgcaaatacggctttatctacaaaactcacttgtttgggcgcccaacagttagagtgatgggggcggataatgttcgaagaatccttcttggggagcatcgcctggtgagcgtgcactggcccgccagcgtgcggacaattctgggcagtgggtgcctatccaatcttcacgacagcagtcataagcagcgaaaaaaagtgatcatgcgggctttcagtagggaagctctggaatgctatgtgccagtgatcaccgaggaggtcggtagcagcttagagcagtggctgagctgtggcgaacgaggactgctggtgtatccagaggtgaagaggcttatgtttcgcattgccatgcggatccttctgggatgtgagccacaacttgctggagacggagactcagaacagcaactggtggaggcattcgaggagatgactagaaatttattttctctgccgatcgatgttcctttctcggggttgtaccgcggcatgaaagcacggaacctcatacatgcccgcattgagcagaatatccgggctaaaatctgtgggttgcgagcctccgaagctggccagggctgcaaagatgctctgcagctgctcattgagcactcctgggagcgaggcgaaagacttgatatgcaggcattgaagcagtcctctacagagcttctgttcggcggccacgaaacaaccgcctcggccgcgactagcctaattacttatttgggtctctacccacatgtgttgcaaaaggttcgggaggagctgaagagtaaaggcctcctgtgcaagagtaaccaggataataaactagatatggagattctggaacagttaaaatacatcggttgtgtaattaaggagacactgcgactgaacccccctgtcccaggtggctttcgagtggcccttaaaaccttcgaactcaacggttatcagatcccaaaggggtggaacgtgatctattccatctgcgatacgcacgacgttgccgaaatattcactaacaaggaagagtttaatccagacaggtttatgcttccacaccctgaagacgcttctcggttttcatttatccccttcggtggcggactgaggagttgtgtgggaaaggaattcgccaaaattttactgaaaatattcacagtggaactagctcgacattgtgactggcaactcttaaacgggccacctaccatgaagacgagtccaaccgtgtatcctgtggacaacctccccgctcgctttacacactttcacggtgagatttag

SEQ ID NO: 203170 - DNA, 600 bp, Artificial Sequence
  Description of Artificial Sequence: Synthetic coding sequence
atgaactacagcaagatccccgcccaggtggacctgcggcggcagaccgaacgagactgccgtgtgtcttctttccgagtgaaagaaaacttcgacaaggcaagatttagcggcacctggtatgctatggccaaaaaggacccagaaggactgttccttcaggataatatcgtggccgaattttctgtcgatgagacgggacagatgagcgctaccgcgaagggtcgagtcagactccttaataactgggacgtgtgcgcagacatggtggggacctttactgataccgaagatccagcaaagtttaaaatgaaatattggggcgtggcatctttcttgcagaaagggaacgacgaccactggatcgtcgatactgattacgatacctacgcagtccagtacagctgtaggctactcaacctggatgggacttgcgccgatagctattccttcgtcttttcccgggatcccaatggcttaccacccgaggctcagaaaatcgtgcgccaacgccaggaggaactgtgtctggccaggcagtatcgcctgatcgttcacaatggatactgcgatgggaggagcgagcggaacctgctgtag

SEQ ID NO: 203171 - DNA, 606 bp, Artificial Sequence
  Description of Artificial Sequence: Synthetic coding sequence
atgaagtgggtgtgggccctgctgctgctggccgccctgggcagcgggcgggctgagagggactgccgcgtgtcgagtttccgcgtgaaggagaatttcgataaagctagattctctgggacttggtacgctatggccaagaaggaccctgagggcctgttcctgcaggataacattgtggctgagttttctgtagacgagactggtcagatgtctgctaccgccaagggaagagtgcgcttactgaacaattgggacgtctgtgccgacatggtggggacctttactgataccgaggatcctgctaagtttaaaatgaagtactggggagttgcttcgtttctgcagaagggtaatgacgatcattggatcgtggacactgattacgacacatacgccgtgcagtacagttgtaggctcctgaatttggacggcacttgtgccgattcctattcgtttgtcttcagtagggaccccaacggtttgccaccagaggctcagaaaattgtgcgacagcgtcaggaagagctctgtctggctaggcagtacagattgatcgtccataatggatactgcgacggccggagtgagagaaacctgctgtag

SEQ ID NO: 203172 - DNA, 606 bp, Artificial Sequence
  Description of Artificial Sequence: Synthetic coding sequence
atgaagtgggtgtgggccctgctgctgctggccgccctgggcagcggccgcgcggaacgggactgcagggtatcatcatttcgcgtgaaagaaaatttcgataaagcccgcttttcaggtacgtggtatgcaatggccaagaaggacccagaagggcttttcctccaggataatattgtcgccgaattctccgttgacgagactggacaaatgagcgcaaccgcgaaaggaagggtccgtctgctgaacaattgggatgtttgcgcagatatggttggcactttcactgatactgaagaccccgccaaattcaaaatgaagtactggggagtggcttcttttttgcagaaaggcaacgacgaccattggatagttgacactgactacgacacgtacgctgtacaatacagctgtaggctgctcaatttggacggaacttgcgcagattcttactcttttgtcttttccagagatcccaatggactgcctcccgaggcacaaaaaatcgtgcgccagcggcaagaagaattgtgcctggcacggcaatatcgactgatcgtccataacgggtactgtgatggtcggtcagagcgcaacctgctttag

SEQ ID NO: 203173 - DNA, 600 bp, Artificial Sequence
  Description of Artificial Sequence: Synthetic coding sequence
atgaactacagcaagatccccgcccaggtggacctgcggcggcaggccgagagggattgcagagtatcttcgttcagggttaaagagaatttcgacaaggcaagatttagcggcacctggtatgctatggctaagaaagatccagagggactgttcttgcaagataatatagtcgctgagttttccgtggacgagacgggccagatgtccgccactgcaaaaggtagggtgcggcttctgaataattgggacgtctgtgcagatatggtgggaacatttactgatacggaggaccctgccaagttcaaaatgaaatattggggtgtggcatctttcttgcagaaaggtaatgatgaccattggatcgtggataccgattatgacacttatgctgttcagtactcatgtcgcctattgaacctggacgggacctgtgcagatagctatagcttcgttttttcacgggatccgaatggactgcccccagaggctcagaagatcgttcggcagcggcaggaagaactgtgcttggctagacaataccgccttatcgtccataatggttattgtgatggtaggagcgagcggaacctgctgtag

SEQ ID NO: 203174 - DNA, 408 bp, Artificial Sequence
  Description of Artificial Sequence: Synthetic coding sequence
atgccccccaacctgaccggctactaccggttcgtgagccagaagaacatggaagattacctgcaggcacttaacatctcccttgccgtgaggaagatagctctgcttctgaagcctgataaggagatcgaacatcaaggtaatcacatgacagtgcggaccctcagcacctttaggaactacactgtccagtttgatgtaggagtggagttcgaggaagatttgcgatcagtagacgggcgcaaatgccaaactatagtgacatgggaagaagagcatctggtgtgtgtgcagaaaggggaagtgcctaatagaggatggcggcattggcttgaaggagaaatgctttatttggaactcactgcaagagatgcagtgtgtgagcaggtgttcaggaaagttcggtag

SEQ ID NO: 203175 - DNA, 1026 bp, Artificial Sequence
  Description of Artificial Sequence: Synthetic coding sequence
atgaacatcgtggtggagttcttcgtggtgaccttcaaggtgctgtgggcctttgtgctcgcagctgcccgctggctcgtgcgccccaaggagaagagcgtcgcagggcaggtgtgcctgataacgggcgctggtagcggcctggggcggctgttcgccctggaatttgcccgcagacgagccctgctcgtgctctgggatataaatacacagagcaacgaggagacagctggaatggtgaggcacatttatcgagatctggaagccgccgatgcagcagccctgcaggctggcaatggcgaagaagagattctgcctcattgtaacctgcaagtctttacctacacatgcgatgtcggaaagcgggaaaacgtttacttgactgccgagcgcgtcagaaaggaagtgggagaagtgtcagtcctcgtaaacaacgcaggggtcgtgtccggtcaccacctgctggagtgtccagatgagttgatcgaacgtactatgatggtgaattgccacgcacatttctggacgacaaaagccttcctgccgaccatgttggaaataaatcacggtcatatcgttaccgtggctagtagtctcggactcttctctaccgcaggagttgaagactattgtgcttcgaagttcggggtagttggctttcacgagagcctgtctcatgagcttaaagctgcagaaaaagatggaatcaaaacaactcttgtgtgtccttacctcgttgataccggtatgttcaggggatgccggattcggaaagagattgaacctttcttacctccactgaagccggactactgtgtgaagcaagcaatgaaggccatcttaaccgatcaaccaatgatttgtaccccccgactaatgtacattgttacctttatgaaaagcatcctcccctttgaagcggtagtctgcatgtacaggttcctaggggccgacaagtgcatgtatcctttcatcgcccagcggaagcaggccacaaataacaacgaggcaaaaaatgggatatag

SEQ ID NO: 203176 - DNA, 957 bp, Artificial Sequence
  Description of Artificial Sequence: Synthetic coding sequence
atggtggagctgatgttccccctgctgctgctgctgctgcccttcttgctgtacatggcagccccacagatccgcaagatgctgagctcaggggtctgcacgtctacagtccagctgcctggtaaggtcgtggtggtaactggcgccaatactggcataggcaaggaaaccgccaaagaacttgcccagaggggtgcgcgcgtttatctggcttgtagggacgtggagaagggcgaattggtggctaaggagatccagacgacaacgggcaaccagcaggtactcgtgcgtaaactcgacctaagcgatacaaagtctattcgcgccttcgccaagggttttctggctgaagagaagcatctgcacgtgctgatcaacaacgccggggttatgatgtgtccatacagcaagaccgccgatgggtttgaaatgcacattggggtgaaccacctggggcattttttgctgacccacttactgcttgaaaaacttaaggagtccgctcctagccggatagtcaacgtttcatctctagcacaccatcttggtagaatccacttccacaacctccaaggtgagaaattctataatgcaggcctggcctattgccattctaagctggctaacattctcttcacacaggagctggctaggaggttaaagggttccggggtgacgacttattctgtgcacccgggtaccgttcaatctgaactggtccggcatagcagttttatgcgttggatgtggtggctcttttcgttttttataaaaacaccgcagcagggagcgcaaacatccctgcactgcgcactgacagaagggctcgagattttaagcgggaatcacttcagtgactgtcatgtggcttgggtgtctgcacaggcccgcaacgagacaattgctagaaggctgtgggatgtctcatgtgacctcttggggctgcccattgactag

SEQ ID NO: 203177 - DNA, 918 bp, Artificial Sequence
  Description of Artificial Sequence: Synthetic coding sequence
atggtggagctgatgttccccctgctgctgctgctgctgcccttcctcctgtatatggcagcgccacagataaggaaaatgctatccagtggagtgtgcaccagcaccgtgcagctacctgggaaggtcgtcgtggtcacgggcgcaaatacaggcgcccgcgtatacttggcatgcagagatgttgagaagggcgagttagtcgcaaaggaaattcagaccacgaccggtaaccagcaagtcctggtcaggaagcttgatctgtctgacactaagtccatccgcgcattcgcaaagggatttctagcggaagaaaaacatttacatgtgctcatcaataatgctggggtcatgatgtgtccttattccaagacagccgacggcttcgagatgcacataggcgtcaaccacttaggccattttttgttgactcacctactcctcgaaaagcttaaggagtctgctccatccagaatcgtgaacgtctccagcctggcccatcatttaggccgtattcattttcataaccttcaaggagagaaattctataacgccgggctggcctactgtcactccaagctggcaaatatcctgttcactcaggagcttgcccgaaggctgaaagggtctggggtaacaacatactccgtgcaccctgggacagtgcagtcggagctggtccggcactcctctttcatgaggtggatgtggtggttgtttagcttctttattaagactccacagcagggtgcacaaaccagcctacactgcgctctgactgagggactagagattctcagtggtaatcattttagcgattgccatgtggcctgggtctccgcccaggcccgtaatgagaccatcgcgagacgactgtgggacgtgagttgtgacttgctggggctgcctatcgattag

SEQ ID NO: 203178 - DNA, 951 bp, Artificial Sequence
  Description of Artificial Sequence: Synthetic coding sequence
atgctggtgaccctgggcctgctgaccagcttcttcagcttcctgtacatggtggcccccagcatacggaaattcttcgccgggggggtctgccggactaacgttcaacttcctgggaaggtcgtggtgattaccggcgcaaacaccggaatcggaaaagagacagcacgggagttagctagccgcggcgccagagtatatatagcgtgcagagatgtgttgaaaggggaaagcgccgcctctgaaatccgggtggacaccaaaaatagccaggtactagtcagaaagctagacctgtccgataccaagagtatccgggcattcgccgagggattcctggctgaggaaaagcagttgcatattttgattaacaacgctggggtgatgatgtgtccttacagcaagaccgctgatggtttcgagacacacttaggagtaaaccatcttgggcactttctactgacgtatctgctcttggagcgcctgaaagtctcggcaccggcaagagtggttaatgtgagcagtgttgctcaccacatcgggaaaatacccttccatgatcttcaatcggagaaaaggtacagcagggggtttgcatattgtcactcaaagctagccaatgtactttttactcgggaactggctaaacggcttcagggaactggcgtcaccacgtatgccgtacatcctggcgtggtccggtcggaacttgtacggcactcatctcttctctgtctattgtggcgcttgttttcgcccttcgtcaagacagcccgcgagggcgcacagacttctcttcattgcgccctcgcagaaggcctggagcctctgagcggcaagtatttcagtgactgtaagagaacatgggtttctcccagggccagaaacaataaaactgcagagcggctgtggaacgtatcttgcgaactacttggaatacggtgggaatag

SEQ ID NO: 203179 - DNA, 951 bp, Artificial Sequence
  Description of Artificial Sequence: Synthetic coding sequence
atgctggtgaccctgggcctgctgaccagcttcttcagcttcctgtacatggttgctccctccatacgaaagttttttgcgggaggtgtgtgccgcactaatgtgcaactaccaggcaaggtggtggtgatcacaggcgccaatactggcatcgggaaagaaactgctagagaactggctagccggggggctcgtgtctacattgcctgtcgtgatgtcctcaagggggagagcgcagcctctgagatacgggttgacaccaaaaacagccaggttctggtgcggaaactcgatctgtcagacacaaagagcattcgcgctttcgcggagggctttcttgctgaagagaagcagctccacatcctcattaataacgcaggtgttatgatgtgtccttactctaagacggcagacggttttgagacacacctgggcgtgaatcaccttgggcatttccttctgacttacctcctgctggagcggttaaaggtcagcgctcccgctcgggtggtcaacgtctcatctgtcgcccatcatatcgggaaaattcccttccacgatctccagagtgagaaacgttacagtcgcggcttcgcctactgtcattctaagcttgccaacgtactgttcacccgagagttggcaaagagactacagggtacaggtgtgaccacgtacgcagtccatcctggtgtggtgcggagtgagctggtgagacactcatctctactgtgcctgctgtggagactgttctctccttttgttaagaccgctcgagagggcgcccagacgtccctgcactgtgctctcgcggaggggctggagcctctatccggaaagtatttttctgactgcaagcggacctgggtgagtcctcgcgcccggaataacaagacagcggagcgattatggaacgtgagttgtgagctgttaggcatccgatgggagtag

SEQ ID NO: 203180 - DNA, 951 bp, Artificial Sequence
  Description of Artificial Sequence: Synthetic coding sequence
atgctggtgaccctgggcctgctgaccagcttcttcagcttcctgtatatggtcgctccctccattcgcaagttcttcgccggcggcgtctgccggacaaatgtccagctgccaggcaaggtggtggtcatcacaggagccaatactggcatcggcaaggagacagcgagggaattggcctcacgcggcgctcgggtctacatcgcatgccgtgatgtgctcaaaggtgaatccgcagcatccgaaatcagagtggacacgaaaaacagccaagtactggtacggaagttggacctgtccgataccaagtccattcgggccttcgcagaggggttccttgctgaggagaagcagctccacatactgattaataatgccggcgtcatgatgtgtccatattcaaaaacggccgatggtttcgagacccatctcggtgtgaatcacctgggccacttcctactgacctatctgctcctcgagaggttaaaggtgtccgcaccagctcgcgttgtcaacgtcagcagtgtggcccatcacattgggaagatcccattccacgacttgcagtctgaaaaacgatattcaagagggtttgcctactgccacagtaagctggcgaacgttttgtttaccagagaactggctaagaggctgcagggaactggagtcacgacatacgccgtccaccccggtgtggtgcgctctgagctggtgcggcattcttccctcctttgcctgctgtggcggctgttttccccttttgtgaagacagcccgagaaggggcccagacctctctgcattgtgcactggccgaagggctggaaccactcagcggcaagtactttagcgattgcaagaggacatgggtgagcccacgtgcacgcaacaacaagaccgcagaaaggttgtggaacgtgtcttgcgagttgctcgggatcaggtgggagtag

SEQ ID NO: 203181 - DNA, 957 bp, Artificial Sequence
  Description of Artificial Sequence: Synthetic coding sequence
atgtggctgcccctgctgctgggcgccctgctgtgggccgtgctgtggctgttacgagacaggcagagcctccctgcgagtaacgcctttgtctttatcacgggatgcgattctgggtttggtagattactggcactgcaactagaccaaagggggttccgagtcctagcttcatgtcttacaccaagcggtgctgaggatctgcaaagagtggcgagctcgcgactccataccacgctgttggatatcaccgacccacaaagcgtgcaacaggcagctaaatgggtggagatgcacgtcaaggaagcagggcttttcggcctggtaaataatgcaggggtcgccgggattataggtcccactccctggctcacccgggatgactttcaacgggttttgaatgtaaacaccatgggtcctattggcgtcaccttggccctgctccctctgttgcagcaagcccgggggagggtaatcaatatcaccagcgttttgggccggctggcagcaaacggcggcgggtactgtgtatccaaatttgggctagaggccttcagcgactctctgcggcgggatgttgcccatttcggcattagagtcagcatcgtggagcccggcttctttcgaacccccgttacaaatttggagtccctcgagaaaaccctgcaggcttgctgggctaggctgccccctgcaacacaagcccactatggcggcgcatttctgaccaaataccttaagatgcaacaaagaattatgaatctgatctgtgaccccgacttgaccaaagtttcaagatgcttagagcacgccttgactgctagacatccacggactagatatagtcctgggtgggatgcaaagctgctgtggctgccagcttcctacttaccggcctcattggtggatgccgtgcttacgtgggtgctgcctaagcccgcacaggccgtgtactag

SEQ ID NO: 203182 - DNA, 957 bp, Artificial Sequence
  Description of Artificial Sequence: Synthetic coding sequence
atgtggctgcccctgctgctgggcgccctgctgtgggccgtgctgtggttacttagagataggcagagcttacccgcctcaaacgcatttgtgtttatcaccggctgtgattcaggcttcggcagattgctcgcactgcagttggatcaacgcggcttccgagttttagctagctgtttaacaccctctggggctgaggacctgcaaagggtggcatcttctaggctgcacacaacactactggatattacagaccctcagtcagtacagcaggcagctaagtgggtggagatgcacgtgaaagaggctggtctctttggactagtgaataatgccggagtggctggcatcattggccccactccatggctgaccagggacgacttccagagagtgctcaatgtaaacacgatggggcccattggagtgaccctggctttgctgcccctgctccagcaggcacgcggcagggttatcaatatcaccagcgttcttgggagattggcagcaaacggcggtgggtattgcgtgtcaaagttcggtctcgaagcgtttagcgactctctccgcagagacgtggcgcacttcgggatcagggtttctatagtcgaaccgggcttctttcgaacccctgttaccaaccttgagagtctggaaaagacactgcaggcgtgttgggctaggctgccacccgctacacaggcccattacggtggcgccttcttaacaaagtatctgaagatgcagcagagaattatgaacctcatttgtgatccagatctgacaaaggtctcacggtgtttggagcacgccctgacggcccgacatcccaggaccaggtattctccgggatgggatgctaagttactgtggctgcctgcatcttacttgcccgcgagcctggttgacgcagttctgacctgggtgctaccaaagcccgcccaggccgtctactag

SEQ ID NO: 203183 - DNA, 936 bp, Artificial Sequence
  Description of Artificial Sequence: Synthetic coding sequence
atggccgccgccccccggaccgtgctgatcagcggctgcagcagcggtattggattggaactggcggtgcagctggcccatgaccccaagaagcgctatcaggtagttgcaaccatgcgtgatctaggcaagaaagagacactagaagcggctgccggagaggcacttggccagacacttaccgtagcccagctggacgtgtgctctgacgagtcagtggcacagtgcctgtcctgcattcaaggggaagtagacgtcctggtaaataatgccggcatgggattagtaggccccctggagggactgtctttggcagcaatgcaaaacgttttcgacacaaatttttttggcgcagtgagactggtaaaggctgtgctccccggtatgaagaggaggcgtcagggccacatcgttgtaatctcaagcgtgatgggactgcagggtgtcatctttaatgacgtgtatgctgccagtaaattcgctttggaaggattttttgaaagcttggcgattcagctattgcagtttaacattttcatcagcctggtcgaacccggaccagtggtgaccgaattcgagggcaaactgttggcccaggtgtctatggccgagttccctggcaccgatcctgaaaccctgcattacttccgcgatctatacctgcccgcttcccggaagctgttttgtagtgttgggcagaatccacaggacgtggtgcaagcaattgtgaatgtcatttcgagtacccggccccccttaagaagacagaccaatattcgttatagccccctgacaaccttgaagacagtcgacagttcaggctccctttatgtgcgcaccacccaccggctcctctttaggtgccctaggcttctcaatctgggattgcagtgcttgagttgcggatgtcttcctacacgtgtgaggcccagatag

SEQ ID NO: 203184 - DNA, 675 bp, Artificial Sequence
  Description of Artificial Sequence: Synthetic coding sequence
atgagccggaagatcgagggcttcctgctgctgctgctgttcggctatgaagcaacccttggtctttcaagcacagaggatgaaggggaagatccatggtaccagaaagcgtgcaaatgtgattgtcaaggcggtcctaatgctctgtggagcgcgggggcgaccagcttggattgcatccctgagtgcccttatcacaaaccgttgggctttgaaagcggtgaagtgacgcccgatcagattacttgttccaatccagaacaatatgtaggttggtattcctcttggactgccaacaaagcacgccttaatagccaggggtttggctgcgcttggctttctaaatttcaggatagtagtcagtggctccagatcgatctcaaagaaattaaagtgattagtggtatattgactcagggaagatgcgatatcgacgagtggatgaccaagtactcagtgcagtaccgaaccgatgagcgtctgaattggatatactataaagaccaaacaggcaacaatcgcgtcttttatggcaatagcgacagaacttctaccgtgcagaacctgctgcgtccgccaattatatcacgctttatcagactaatacccctggggtggcacgtcagaattgccattcgcatggagttgttggaatgtgtcagtaaatgcgcttag

SEQ ID NO: 203185 - DNA, 4077 bp, Artificial Sequence
  Description of Artificial Sequence: Synthetic coding sequence
atgatcgagcccagcgaggacagcttcgagaccatgatggagcacaagaacccatcctccaagcagatggagtccagtgaaggaagttctaacactacagaggcaaccagcggcagcggggttagaggcgaagccggccccgcgtccggccccgcccaggaaaaaaaggaaccacctagcggtcccctccaggaaatggaagaacttcctacggacttactgcaagacatggaggagccatcaagtgggccccggaaggagattgaggaccctcctaacgacctgcttcaggacctcgaagagtcctgcaatggctctcatcaagcgaggggggacccactttccggcgcctcagaccgtatgaaagaagcatcagttaatccgagcggagcaagagaggagcaggaggcacacaccgacctgaaggagtccgggcgcgaggagacaccccaagagcagaaccagacagagcactctactgcagaacttatggcaatggtcagatcaattatttccttgtattttcgaatgcaggatctcaaagaacagcagcgcgtggctgaagaaattctgatcaagggcattaacgctggccagttgcctgcgccaaaacatttttctggggatcgaagggaatttcacgagttcatcgtgctgtgtcagctgacacttcagtcttatcctcggatgttttacaacgaccgtctccgggtagggtatgttattaaccatctgtccggcttagcccttgagtgggctaaagccctcctgcaagagaattccccgctgatcggcgatttccccgctttcttagaggctatgtctgaagtttttgagtacaggcaagctctgcgggtcgccgaggaagcaatgttcacgatccgacaggggggccggtccgccacggagtatatcgatgaattccaaagcttggtgcctatcttaggttggcctgacgaggtgctgcaggcccatttgtgccagggattgaacgaggaaattcggcattatctgttccgagttccacagcccgactcccttgatagtctgattgtgctgattctgcagatcgaagaaaaactggccgagaggcgggccatgctacggctacctcccgaagctcgaccgcgaaacctaacatggattgactcccctgcgcctgaacgctggatggtgagctcatggctccctagtgaggtgcatcctgatataaatcgggcgcacctctttctgcttcttatggtaagagttaacccgtatcacagcgttgccgtgcaggccctggtggattctggagctgatggcaatttcatggatgaaaaattcgcgcaggagcactatgtagagctctatgaaaagccgtatccgcagcccgtccagagcgtggacggatcattgattgggaatgaacccgtatggctatacaccgaaccacttgtctgcatccatcagaaccatcaggagtccatcgagtttgatatcgtgcctagcccaaacttcagtgtcgtgctgggcataagatggttgagagtgcacgctccagaggtcgattggatcaagggtcgctgtacgtttcacagcccatattgcctgaagaactgcttccgcccacccccaccttgtatcgctctggagcgccacggtatgtctctactgcccgggttgccacacccttactctgacctcgcagacgttttcaaccccaaggaggccgatgacgagacatccgatcagccctccagcgatggctccgacgatctctccgagtccgaaccctcggagctgcagcaggctggagactccgaccattctgagaccttctacgagtgcccaagtactgccccttgggagccggtcggcgcccggatgcaggagcgcgccagactgcaagaggaatactgggatctgcaagacatgctgacgaataggcaagattatattcagatgatccccgagctgtttgaccagctgcacggagccgagtggtttaccaagctggaactccgtgggacaatcgttgaagaatccgtgaatggccacaggacggaggatgtgtggaaggcagcctttggactagaactcgaagaaatgaagagttaccagcccttcgccctgtctccggatcctattatacctcagaatgttattcattttatactgaaagatatgttaggattcttcgttctaagctacggacaggaggtccttatttacagcatgagtcaggaggagcacctccatcacgtgagacaagtactggtcaggttccggcatcataatgtctattgttctctggacaaaagtcagttccaccggcagaccgtggagtttcttggctttgttgttacacccaagggcgttaagctgaataagaatgtaatgactataattacaggataccctacccctgggtctaaactgtccctgagaaattttattgagttcgttttcccttaccgacatttcgtggagcgctttagcattatagcagagccacttgtgaggcaactgctgtccagttaccagttctactggggcgtggaagaacaggaggcttttgaatgcctaaagcgggcgtttcgcaaagcccctcttctgcatcaccccaaaccacaaaatccattctacttggaaacaggcgtgacaggcacagccctgcacgcaagtctcatccagatcgatgaccagactggaaaaagagcttgttgtgctttttactctcggaatatctctcctattgaagttgagtatagccaagccgagatgaaaatcttacctatccgggctgcttttatggtgtggtgcaggtatctcgagaatacagaggaacccataatgattctgttgaatacggaggaccttgcaagcttaaataacgatcggctgaccgttctgctacctggccattgggtattcttcttcagccatttcaatttcgatgtgatggagctgccagagcaggatggtggtagggccctgccacccgttcggaatttgcggtggaggagagcgttccagaggaacacagctgctaggcagacacttttgttagcatcacggggattcccccgggatccttccaccgaatccggagaggaggagaatgaggagcaagatgagctaaatgagcagatcctgagacaggaactgttagccatgatccctatcgatcagatcctcaatagcttcttggctcacttctcaatggcgcagatccgggcagtgatcttgcacttctttcgcggactgctgtattggaaaaatacactggcactcgcagccatcttggtactgctgcgcgtccggcagtgtctgtctttacgtcccgcccctgcaatgcgtgtggctcggccacaaccccaaagatctctccggctgattctggactcttctcttattgccggatcatccattactaccgccatcacccagctgctgacacagatgccggccctggttggcgcaaacaccatccccgcacaggaacttgctgagctattcctggggccgggacgctggcagaggaatgccctgcattcccaagcccaccggggcttgcagttcacacccgggttttggcttactctgtgcgagtttttcggagtccgggtaacccctcaggaaggacaccttccagcgttgcgtcaaaatagatatctcgaactgcacgtggtcggggatgaagatgttgtgctccgggaggcgttgcaggacgatctccagaggtatagacagtgcgggcttcatgacggactgcaggatacatcgcaggacaagcaggataacgatgtacaggaagcacctccttcccatacagcagcgacccatcccccgcggcctagacacctgatggatccccaagtcttggaattcctgggaagtcggttgctgcatattcacagcgcggacgggcagctgcacctgcttagcagggagcaagccgcccgggcactctcccagttccttaccctcatataccgacgcgcgttacctatcccagcctgggaaagtcagcctagggaacaggcgagattggaggagttgccagatgaagacgaagatgccaatctagattag

SEQ ID NO: 203186 - DNA, 9393 bp, Artificial Sequence
  Description of Artificial Sequence: Synthetic coding sequence
atgttcagcgtgcggatcgtgaccgccgactactacatggccagcccattacagggtctggatacctgtcagagccccctcacccaggcccccgtgaaaaaggtgcccgtggtgagagtattcggggccacccctgccgggcagaagacatgtttacacctgcacggtatcttcccttatctgtacgtcccatacgatggatatggtcagcagccggaatcttacctctcgcaaatggccttcagcatcgacagggccttgaatgttgctctcgggaacccatcatctaccgctcagcacgtgtttaaagtgtcactagtgagcggcatgcccttctatggttaccacgagaaggaacgccattttatgaagatatatctgtataatcccaccatggtgaagcgcatatgtgaactgctacagagtggggctatcatgaataagttctatcagcctcatgaggctcacatcccctatctgctgcaactttttatcgactataacctttatgggatgaacctgatcaacctcgccgccgtaaaattccggaaggccaggcgcaagagtaatactctgcatgctacaggatcttgtaagaatcatctgtctggtaatagtctggctgatacattgtttcgctgggagcaagacgaaataccctccagcctcatcctggaaggggtggagccgcaatcaacgtgcgaactggaagtggatgccgtagcggctgacatcttgaaccgcctggatatcgaggcccagattggaggcaaccctggactgcaggcaatttgggaggacgagaagcaacgtaggagaaacaggaatgagacctcccaaatgagtcagccagagagtcaggaccaccggttcgtgcctgctactgagagtgagaagaaatttcagaagcgactccaggagattttaaagcagaatgatttctctgtgaccctgagcggatccgtcgactattctgacggttcacaggagtttagtgccgaactcaccctacatagcgaagttctgtctccagagatgttacagtgcacaccagccaatatggtggaggtccacaaggacaaagaatcatcaaagggccatacacggcataaggtggaggaggccctgatcaacgaagaggccatcctcaatttgatggaaaatagccagactttccagccgctcacgcagcggttatcagaatccccagtgtttatggactcaagccctgacgaagctctggtgcacctacttgccggcctggagtcagatgggtatcgcggggagcggaatagaatgccatcaccatgtcgtagttttggcaataacaagtatccacagaattccgacgacgaggagaacgagccacagatcgagaaggaggagatggaactctcccttgtgatgagtcagcgatgggactctaatatcgaggaacattgcgcgaaaaaaagatccctgtgccgcaacacacatcggtcctcgaccgaggatgatgattcaagctcgggcgaagagatggagtggtccgataactccttactcctggctagcctgtcaatcccgcaacttgatggcactgccgacgagaattccgataatcctctgaataacgaaaacagtaggacccacagttctgtgatagccacaagcaaactcagcgtgaaacctagcatctttcacaaggatgctgctactctcgagccctccagttcagccaagattacattccagtgcaagcacacgagcgctttaagtagtcacgttctcaataaagaagatttgatcgaagacctcagtcagactaacaagaacacagagaagggcctggacaattcggtcacctcgttcaccaatgaatccacctattctatgaaatatcctggctccctctcctctaccgtgcattccgagaattctcataaggagaattcaaaaaaagagatacttcctgtctcatcttgcgagtcttcgatcttcgactatgaggaagatataccctcagtcacccggcaggttccgagtagaaagtacaccaacattcggaagattgagaaggactctcctttcatccacatgcacagacaccctaacgagaataccctgggaaagaactcctttaatttctctgatctgaaccacagtaaaaataaagtgagctctgagggaaacgaaaaggggaattcgactgcactgagcagtctgtttccaagcagctttacagagaactgtgagctgctgagctgctccggtgagaacaggaccatggttcacagccttaactcgactgccgacgagagcggtttgaacaagttgaaaatccggtacgaagagtttcaagaacacaagaccgagaaaccgtccttatcgcagcaggccgctcactacatgttctttccttccgtggttctctcaaattgcttgacaagaccccagaaactgtccccagtgacttacaagctgcaacccggtaacaaacctagccgcctgaagctgaataagcgcaagctagctggccaccaggagactagtacgaagagctcagaaaccggcagcacaaaggacaatttcattcagaacaatccttgtaattctaatcccgaaaaggataacgccctggcctccgacttgacgaagacaacgcgtggagccttcgaaaacaagacccccaccgatggctttattgattgtcatttcggcgacggcactctagagactgagcagtcttttgggctttacggtaacaagtatacacttcgggccaagcggaaagttaattacgagaccgaggatagcgagtcgagctttgtcacacacaattcaaagatctcactgccccaccctatggaaattggtgagtccctcgacgggaccctcaaatcaaggaaacgcagaaagatgtcgaaaaaacttcccccggtgataatcaagtacatcattattaacagattccgcgggcgtaagaatatgctggtaaaattgggcaagatagatagcaaggaaaaacaggtcattctcactgaagagaaaatggaactatacaagaagctcgccccgctgaaagacttctggcccaaggtgcccgactcacctgccacgaaataccctatttaccccttaacccctaaaaaatcacacagacggaaaagcaaacataagtctgcgaaaaaaaaaacagggaaacagcagagaacaaataatgagaatattaaaagaaccttaagctttaggaagaaacggagtcatgcaatactctcacctccttcgcccagctacaatgcagagaccgaggactgtgatctgaattacagcgatgtgatgtccaagctcggcttcctttccgaaagaagtacttcccctattaatagtagcccacctcgctgttggagccccactgacccacgcgccgaagaaattatggccgctgccgaaaaggaagccatgctcttcaaggggcccaatgtgtacaaaaaaactgtgaatagccggattgggaagacctccagggctagagcacaaatcaaaaagtcaaaggctaaactggccaacccttccattgtgacaaagaaacgaaataaacggaatcaaactaacaagctagtcgacgatggcaagaagaaaccgcgggctaagcagaaaacaaacgagaagggcactagcaggaagcatactactcttaaagatgaaaaaattaagagtcagagtggagctgaagtcaagttcgtcctgaagcatcagaacgtgtctgaatttgcctctagcagcggcggcagccaattgctttttaagcagaaagatatgcctctaatgggctccgccgtggatcacccgctgagtgcctctcttccaacaggcattaacgctcagcagaaattaagtggatgttttagctctttcctggagtcgaagaaaagcgtggatctacagaccttccccagttcacgggacgacctacatccgtctgtggtgtgcaactccattggccctggagtctctaagatcaatgtacagaggcctcataatcagtctgccatgttcaccctgaaggaaagcaccttaatccagaagaacatttttgacctcagcaatcacttaagccaggtcgcccaaaatacacagatctccagcggaatgtcctcaaaaatagaagataatgccaacaatattcagcggaactacctgtcctcaatcggaaagctgagtgagtaccggaatagtcttgagtctaagctcgaccaagcgtatacccccaactttttgcactgcaaagacagtcagcagcaaatcgtttgcatagctgaacagagtaaacacagcgagacctgttctccggggaacactgcctctgaggagagtcagatgccaaacaattgcttcgtcaccagcctgagatccccaatcaagcagattgcttgggagcagaagcaaagagggttcattctcgacatgtctaatttcaaacctgagcgagttaagcccaggtcactgtcagaagctataagtcagaccaaagccctctcacagtgtaaaaataggaacgtgagcacccccagcgcgttcggcgaaggacaaagtggtttggctgtgctgaaggagttgctccaaaaaagacagcagaaggcgcagaacgccaacacaacacaggaccccctaagtaacaaacatcagcccaataaaaatattagtggttctctggagcataacaaggcgaacaagaggacgagatcggttacctcgcctaggaaaccacgaacaccacgttccacgaagcagaaagagaaaatccccaagctgctgaaggtggactctctcaatcttcaaaattcttcccagctggacaacagtgtctccgacgactcacccatttttttttcggatcctgggttcgaatcctgttattcactcgaggattcgctgtcaccagaacataactacaactttgacataaatacaataggtcagacaggtttttgtagcttctacagcggatctcagtttgttcctgctgaccagaatctgccccagaaatttctctctgacgccgtacaggatctgttccctggacaggcgattgagaaaaatgagttcttgtcgcatgataaccagaaatgcgacgaggacaagcatcacacaaccgacagtgcctcttggataaggagtggcactctgtccccagaaatcttcgaaaagagcaccatcgattccaacgaaaaccgtagacataatcagtggaaaaattcttttcatccactgactacgcggagcaacagcataatggacagtttttgtgtgcagcaggctgaagactgtctaagcgagaagtctagactgaaccgttcatccgtctctaaggaagtgttcctgtcactgccccagcccaacaactctgattggatccagggtcacactcggaaggagatggggcagagccttgacagtgcgaacacttctttcactgctatcctttcctctcccgacggcgagctcgtggatgtcgcatgcgaggatttggagctatacgtgtccaggaacaatgacatgctgacccccacgcccgatagctctcctcgcagtacttcgagtcccagccaatccaaaaatgggagttttaccccccgcaccgccaatatcctgaaacctctgatgtcccctccctcccgagaggagattatggcaactctacttgaccacgatttatccgagaccatctaccaggaacccttctgcagtaatccctccgatgtgcccgaaaagccaagagaaattggagggcgccttcttatggtggagactaggcttgctaacgacctcgctgagtttgaaggagacttctctttggagggcctccggctgtggaagacagccttcagtgccatgacacaaaacccacgacctgggtcgccactgaggtctggacagggcgttgtcaataaaggctcctcaaactcccctaagatggtcgaagacaagaaaattgttattatgccttgcaagtgtgcaccctcaagacagctggtacaggtgtggctgcaggctaaagaagagtatgagcggagcaagaagctgcctaagaccaagcctactggagtcgtcaagagtgcagaaaacttcagtagttccgtcaaccccgatgataaacccgtagtgccacccaagatggacgtgtccccgtgcatcctgcctactacagcacataccaaggaggatgttgacaattcccagattgccttgcaagcccccactacagggtgctcacagacagcctcagaaagccaaatgttgccccccgtggctagcgcgtctgacccggagaaagacgaggatgatgatgataactactatatttcctacagctcccccgacagcccagtgattcccccttggcaacagccaataagccctgactcgaaggcattgaatggcgatgaccggccctctagtcctgtggaagagctcccctccctggcattcgagaatttcctgaaaccgattaaagatgggatccagaagtcaccttgcagcgagccacaggagcctctggtgatctcccctattaatacccgggcccgcaccggcaagtgtgagtccttatgcttccacagtacccccatcattcagagaaaacttctcgaacgcctacctgaagcccctggtctgagcccgctgtctaccgaacccaagacgcagaagcttagcaataaaaagggcagcaacaccgacacactgcgaagggtgctgctgacccaagcaaagaaccaattcgccgctgtgaatactccccagaaggagacttctcagatcgatgggccaagcctgaacaatacatatggctttaaggtgtccatacagaacctgcaagaggccaaagccctgcacgagatccagaacctcactttgatttccgtggaacttcacgctcggacgcgccgggacctggagccggaccctgagtttgatccgatatgtgctctgttttattgcatttcatctgacacccctctcccagatacagaaaagaccgaacttacgggagtgatcgtcattgacaaggataaaacagtgttttctcaggacatccggtatcagacccctttgctaattaggtcaggcattacggggctcgaggtgacgtacgcagctgatgagaaggccctgttccacgagattgccaatattataaagaggtacgaccccgacatcctgttagggtatgagatccagatgcattcctggggatacctcttgcagagggcggctgctctgagcatcgacctgtgccggatgatatcacgtgtaccagacgacaagattgagaatagattcgccgctgagagagatgaatacgggtcatatacgatgtcagagataaacatcgtcggtcgcattacactgaatctgtggcgcatcatgcgtaacgaggtggccctcacgaattatacgttcgagaatgtgtcttttcatgtactccatcagcgtttccctctgtttacttttcgcgtcctctcagattggttcgacaataaaacggacctgtaccggtggaaaatggtagatcattacgtttcgagggtgaggggaaacttgcaaatgctcgaacagttggatctgataggaaagactagcgaaatggcccgcttgtttgggatccagtttctccatgtcctgactaggggcagccagtatcgagtggaatccatgatgttaagaatcgctaagcccatgaactacatccctgttacacctagcgtgcagcagcgctctcagatgcgagctcctcagtgtgtccctttaattatggagcccgagtccaggttttactcaaactcagtcttagtgcttgacttccagtctttatatccttcaatagtaatcgcttataactattgctttagtacgtgtcttggccacgtcgagaatctgggcaagtatgacgaatttaaattcgggtgcacctcactccgggtgccccccgacctgttgtatcaggttaggcatgacattacagtgtctcccaacggggttgcatttgtgaaaccttctgtcaggaagggcgttcttccaagaatgctggaggagatcttgaagacacgctttatggtaaaacaaagcatgaaggcttacaagcaagacagggccttatcgcgaatgctggatgctaggcagcttggtctcaaacttatcgcaaacgtgacttttgggtatacctccgccaacttctcaggccggatgccatgcatcgaagtaggtgacagcattgtgcacaaggcgagggaaactctggagcgcgccattaagctagtcaatgacactaagaaatggggcgctagggtggtttatggagacactgattcaatgtttgtgctgctgaaaggggccaccaaagaacagtctttcaagatcggccaggaaatcgctgaagcggtgacagccaccaaccccaagccagtaaagctcaaatttgagaaagtctatctgccctgtgtgctccagactaaaaagagatatgtcggatatatgtatgaaacgttggatcagaaggacccggttttcgacgctaaggggatcgaaactgtcagacgcgacagttgccctgctgtgtccaaaatccttgagagatccctcaaacttctcttcgagaccagggatatcagcctgatcaagcagtacgtccagcggcagtgcatgaaactcctcgagggaaaggcttctatacaggacttcattttcgctaaagagtataggggatcgttctcttacaaacccggtgcttgcgttccagccctcgagttgactaggaaaatgctgacctatgaccggcgatccgagccacaagtgggcgaaagggtgccttacgtcatcatctacggcaccccaggcgtgccactgatccagctcgtccgacgccctgtggaggtacttcaggaccctacactccgattaaacgctacttactacataacgaaacagatcctgccacccctggccaggatattttcattgatcggcatcgatgttttctcttggtaccacgaactcccacgcatccacaaagccactagtagttcaagatccgagcctgaaggcaggaaaggaacaatttcccagtacttcactacgttacattgtcccgtgtgtgacgatcttacccaacatggcatttgcagcaagtgcagatctcaaccccagcacgtggcggtaatacttaatcaggaaatccgagaactggagagacagcaagagcagctggtgaagatatgcaaaaactgtactgggtgctttgatcgccacatcccgtgcgtgagtctgaattgtccggtgttgttcaaactttcccgggtgaatcgggaactaagcaaggcaccctacctgcggcaactgcttgaccagttctag

SEQ ID NO: 203187 - DNA, 9393 bp, Artificial Sequence
  Description of Artificial Sequence: Synthetic coding sequence
atgttcagcgtgcggatcgtgaccgccgactactacatggccagccctctacagggacttgacacgtgccaaagccccctgactcaggcgccagtgaaaaaagtaccagtggtgagagtgtttggcgctactccggcaggtcagaaaacctgcctgcatctccatggcatcttcccctacttgtatgtcccatacgacggatatggccagcagccagagtcctacctgagtcagatggctttttccatcgacagggcccttaacgttgctctcggaaaccccagctcaaccgcccaacatgtgttcaaagttagcttggtgagtggcatgccattctacggctatcacgaaaaagagcgccattttatgaaaatctacctctacaacccaacgatggtgaagaggatctgtgagctcctgcagagcggggcaattatgaataagttttatcaaccacacgaagcccacataccttatctgctgcagttgtttatcgactacaatttgtatggcatgaacctcatcaacctagccgccgtgaagttccggaaagcacgtaggaagtcaaatacactgcatgccaccggctcttgtaagaatcatcttagtggcaactctctggccgacactttattccgatgggaacaggatgagatacctagttcattaattctggaaggagttgaaccccaatcaacctgcgaacttgaggtggacgcagtcgctgcagatatactcaatcgcttggacatagaggcccagattggcggtaaccccgggttgcaagcaatttgggaggatgaaaaacagcgccgacgaaatcggaacgagacctcccagatgagtcagcccgaaagccaagaccatcggtttgtaccagcaaccgagagtgagaaaaaattccaaaagcggcttcaggagatcctgaagcaaaacgacttcagtgtgaccctgtcaggttcagttgactattcagacggctctcaggagttttctgcagagctgacactgcattccgaagttctgagccccgaaatgttacaatgcacccctgccaatatggtcgaggtgcacaaggacaaggaaagcagcaaaggccatactcgccacaaggtggaggaggccctgatcaacgaagaggccattctcaacctcatggagaacagccaaacattccagcccctgacccagcggttgtccgagagtcctgtcttcatggatagttcacccgatgaagccctcgttcacttgctggctgggctcgaatctgatggctacagaggggaaagaaataggatgcctagtccttgtagatcattcggcaacaacaaatatccgcagaattctgatgatgaggaaaacgaacctcagatagagaaggaggaaatggagctgtcactggtgatgtcccagcgttgggatagcaatatagaagagcactgcgccaaaaagcgcagcctgtgccgaaacacgcacaggagttccaccgaggacgacgattcttcctccggcgaagaaatggagtggtccgataacagcttgcttctcgcttcccttagcattcctcagcttgatgggactgcggatgaaaactctgataatccactaaacaatgaaaactcgcggacccacagtagtgtcatcgccactagtaagttatccgttaaaccctccatttttcataaagatgcagcaaccttggaaccttctagcagcgcaaaaatcaccttccagtgtaagcatacatccgccctaagtagccacgtcctcaataaggaagacctgattgaagacttgtcgcaaaccaataagaacacagaaaaggggctcgataattcggtcaccagttttaccaacgagtctacgtattctatgaaataccctggcagcctgtctagcacagtccattctgagaactcccacaaagaaaacagtaagaaggagatccttccagtcagtagttgcgagtctagtatttttgactatgaagaagacattccctccgtgacccgccaggtaccatctaggaaatacactaatattcggaagatcgagaaagattccccgtttattcatatgcaccgtcacccgaacgagaatacattgggcaaaaacagtttcaatttctctgatctgaatcactctaagaacaaggtttcaagcgaaggaaacgaaaaaggcaattctactgccctcagctcactgttcccctcttcctttaccgagaactgtgagctgctttcgtgttctggtgagaataggactatggtacactctctgaacagcaccgctgacgagagcgggctcaacaagcttaaaatccgctacgaagaattccaagagcacaagactgaaaaaccatctctcagccagcaagccgctcactacatgttctttccctcagtagtcctctctaactgtctgactaggccgcagaagctctctcccgtgacatataagctgcagccaggtaataaaccgtcccgactgaagttgaacaagcggaagttggcaggacaccaagaaacatctactaaatcatccgagacaggttcaacaaaagacaactttatccagaacaatccatgtaattctaatcctgagaaggataacgcgctcgcttccgatctgactaaaaccacgaggggagccttcgaaaacaaaacccctacggacgggttcatcgattgccattttggcgacgggactttggagactgaacagagttttgggctatacggtaacaaatataccctgagggcgaagaggaaggtcaattacgagactgaggactctgaatcgtccttcgtaacgcataacagcaagatatcccttcctcaccctatggagattggagagagcttagatggaaccctcaagagtaggaaacggagaaaaatgtcaaaaaaattgcctcctgtgattattaaatatatcatcatcaaccgatttcgagggcgcaaaaatatgctggttaagttggggaaaattgacagtaaagagaagcaggttatcctgacagaggagaaaatggagctttacaagaaattagccccattaaaggatttctggcccaaggtccctgattcacccgccactaagtatccaatctacccattaacaccgaaaaagagccatagacggaaaagtaagcataagtcagctaaaaaaaagacgggaaaacaacagagaaccaataatgaaaatataaaaagaaccctgagcttccggaagaagcgctcccacgccatactgagccctccttccccatcttataatgctgaaactgaagattgcgacctaaattattccgatgtcatgagtaaactgggtttcctgtcagaaaggtccacaagtccaattaactcatcgccaccacgttgctggagccccactgatccccgagccgaagagattatggccgcagccgagaaggaggcaatgctattcaaggggcccaatgtgtacaaaaagaccgttaattcacggatcggaaagacctcaagagcaagggcccagatcaagaagtccaaggcaaagcttgccaatccatctattgtgactaaaaagcgaaataagcgtaaccaaacaaataagttagttgatgacgggaagaagaaaccaagggcaaagcagaagacaaacgagaaagggacatctcggaagcacacgacattgaaagacgagaaaattaagtcccagtccggggctgaagtgaagtttgtgctaaagcaccaaaacgtatcagagtttgccagctcctctggaggatcacagctcttattcaagcagaaagacatgccactgatgggtagtgcggtcgaccatcccctgagtgcctcgctgcccacagggattaatgctcagcaaaagctgagtggatgcttttcctcatttctcgagtcaaagaaatctgtcgacctgcagacattcccgagcagtcgggacgatctccacccctctgtggtgtgcaatagtataggacctggtgtatcgaagatcaacgtgcagcgacctcataatcagagtgccatgttcaccttgaaggaaagcacattaatccagaagaacattttcgaccttagcaaccatttgagtcaagtggctcaaaatacccagatctcatcaggcatgagctctaagatcgaggacaacgcaaataacatccagaggaattacctgtcctcgattggaaaactttcagagtaccgcaatagcctggagtccaagctggatcaggcttatactcccaactttttgcactgtaaagacagccagcagcagatagtttgtattgcggagcagagcaaacacagtgagacctgttcaccaggtaataccgcatcagaggaatcccaaatgccaaataactgcttcgtgacatctttaagaagcccaattaagcagattgcctgggaacagaagcagcggggcttcatcctggatatgtctaactttaagcccgagcgtgtgaagcctcgcagcttaagcgaggcaatttctcaaaccaaagcactatcccagtgcaagaaccggaatgtctctacccccagcgcgttcggcgaaggacaaagcgggcttgccgtgctcaaggaactccttcaaaagcgccagcagaaggctcagaacgccaatacaacacaagaccctttgtccaacaagcatcagcctaacaaaaacatcagcggctcactggagcataataaagccaacaagaggacgcgctctgtcactagcccccggaaacctaggacacctaggagtaccaagcaaaaagagaagatcccaaaactgctgaaggttgactccttgaacctccagaattcctcccagctggacaattccgtgtcggacgacagtccaatattcttctctgaccccggatttgagtcatgctatagcttggaagactctctctctccggaacacaactataacttcgacattaacacaattggccaaactggtttttgctctttctattcaggctcccaatttgtgccggcagaccaaaacctcccgcagaagttcttgtcagatgccgtccaggacctgtttccaggtcaggctatagagaagaatgagtttctttcacatgacaaccaaaagtgtgacgaggacaagcatcacaccacagacagtgcaagctggatacggtcaggaaccctttcaccagaaatttttgagaagagtaccattgactctaatgaaaatcgaagacataaccagtggaaaaattccttccacccactgaccacccgctctaattccatcatggatagcttttgtgtacagcaggcggaggattgtttaagcgaaaaatcacgactgaatcggtcatctgtttccaaagaggtgttcttgagccttccccagcccaacaatagcgattggattcagggccatacgaggaaggagatgggacaatcccttgactcagcaaacacctcgtttacggccatcctgagtagtcctgacggcgagttggtggacgtggcctgcgaggatttggagctgtacgtgtccagaaataatgacatgctgacaccaacacccgactcttccccccgctccacctccagcccttcccagtcaaaaaacggatcttttacccccaggaccgccaacatactaaagcctctgatgagccctcctagcagggaggagatcatggcgacactgctcgaccatgatctgagcgaaactatctatcaagagccattctgctcaaacccttctgacgtgcccgagaaaccccgagagatcggtggccgattgctgatggtggagacccgtctcgccaatgacctggctgagttcgagggagacttctctcttgagggcttgagattatggaaaaccgcgttctccgccatgacacagaatccaagacctggatccccattacgctccgggcagggcgttgtgaataagggatcaagcaactcacccaagatggtggaagacaagaaaatcgtgattatgccatgcaagtgcgccccctccagacagctggtgcaggtgtggctacaggcaaaagaagagtatgaacggagcaagaagctgccaaagactaaacctaccggtgtggtaaaatcagccgaaaacttctcctcctctgtgaaccctgatgataagcctgtggtgccccctaagatggatgtgtctccctgtattctgcctactaccgctcacactaaggaggacgtcgacaattcccagatcgccctgcaggctcccaccacaggttgctcccaaaccgcaagcgagagccagatgctgcctcccgtcgcctctgcctcagatcccgaaaaggacgaggatgatgatgataactactacatctcttactctagccctgattccccagtgattcctccttggcagcaacctatcagtcctgatagtaaggcactaaacggtgacgataggccaagctcaccagttgaggagttaccaagtctggccttcgagaacttcctcaagcccattaaagatgggatccagaaatctccttgtagcgaacctcaggaacctcttgtgatatctccaattaatactcgggctaggacaggaaagtgtgaaagcttatgcttccatagcactccgattattcaaaggaagttactggagagactccccgaggctcctggcctgtcacctctaagtactgagccaaaaactcagaaactatccaacaaaaaagggtcaaacactgacaccctgcggagggtcctccttactcaagctaaaaaccagttcgccgccgtgaacactccacagaaagaaacctctcagatcgatgggccttctctgaataacacctatgggttcaaagtgtcaattcagaacctgcaggaagcaaaggcactccatgaaattcagaatctgaccctgatcagcgtggagctgcatgcacggacgcggagagacctcgaacctgatccagaattcgatcctatttgcgctctgttctattgcattagttctgacactccactcccagacactgaaaagacagagctgaccggcgtgatagtcattgataaggataagaccgtgttttctcaggacattcggtatcagacccctctgctgataagatcgggaattacaggtctggaagttacatatgcggccgacgagaaagctcttttccatgagattgctaacataattaagaggtacgacccagacattcttctggggtacgagattcaaatgcattcgtggggctacctactgcagagggcggccgctttaagcatcgatctgtgcagaatgatctcacgagttcccgacgataagattgaaaatagatttgctgcagaaagagacgagtacgggtcctacacgatgtctgagattaacatcgtggggaggatcacactcaatctgtggcggatcatgcggaatgaagtcgcccttacaaactacacattcgaaaacgtgtcctttcacgtactgcaccagaggttccccctgttcacttttcgggttctgagtgattggttcgacaataagacggatctatacagatggaaaatggtagaccactacgtgtctagggtgcggggaaatcttcagatgctggaacagctagatctaattggcaaaacctccgagatggccagactttttggcatacagtttttacacgtactgactcgcggaagccagtatagggttgaaagtatgatgctgcgcatcgcaaagccgatgaactacatcccagttacgcctagcgttcagcagcgtagccaaatgagagctccgcaatgcgtgcctcttattatggaacccgaaagcagattttattcaaacagcgtgcttgttctggactttcagtctctctaccctagcatcgttatcgcttacaattattgtttcagcacttgcctaggtcacgtggagaaccttgggaagtacgatgaattcaagttcggctgtaccagcttgagggttccacctgatcttctttatcaggtgaggcatgacataactgtcagtccgaacggcgtcgcattcgtcaagcctagcgtccggaagggtgtgcttccaagaatgcttgaagagatattgaagactcggttcatggttaagcagtctatgaaagcctacaagcaagacagagcactgtccagaatgttggatgcccgccagctcggacttaagctgattgcaaacgtgacatttggatacacgtcagctaattttagtgggcgaatgccctgtatcgaggtgggcgatagtatcgtgcacaaagctcgcgagacactggaaagagccataaaactcgttaacgacacgaaaaaatggggagcccgagtggtctatggcgacactgattccatgttcgtgcttttaaaaggcgccacgaaggagcagtcttttaagatcgggcaggagatcgctgaggctgtgaccgccactaaccctaagccggtgaagttaaaatttgagaaagtgtatctaccctgtgtgctccagacaaagaaacgttatgtaggctatatgtacgagaccctagaccagaaggaccctgtttttgacgccaaaggcattgagaccgtcagacgcgattcatgccccgccgtcagcaaaattctggaaagaagtcttaaactcttattcgagaccagggacatctcgctgattaagcagtacgtgcagcgccaatgcatgaagttactggaggggaaggcctcaatacaagatttcatattcgccaaagagtaccgcgggtccttttcatataagcccggcgcatgcgtcccagcactcgaactgacaaggaagatgctaacctatgaccggaggagtgagccacaggtgggcgaacgagtgccatacgtaattatctacggtacaccaggagtacccttgatccagctcgtccggagaccggtagaggtgttgcaggaccccaccttgaggctgaatgcaacctattacattactaagcagatcctcccaccactcgccaggatctttagtctgattggcatagatgtcttttcatggtaccatgagctgcctcggattcataaagccactagcagcagtcggtccgagcctgagggtcggaagggaactatctctcagtactttactactctccattgtcctgtgtgtgacgatctgacgcagcacgggatttgcagtaaatgtcgctcacagccgcagcacgttgctgtgattcttaaccaggagattcgcgaactggagcgccagcaggagcagttagtgaagatctgcaaaaattgtaccggctgctttgatcgacatataccatgtgtgtcactgaactgtccagtactctttaagctaagccgagtgaaccgagaactgagtaaagccccatatttacgacagctgctcgatcaattttag

SEQ ID NO: 203188 - DNA, 9393 bp, Artificial Sequence
  Description of Artificial Sequence: Synthetic coding sequence
atgttcagcgtgcggatcgtgaccgccgactactacatggccagccccctgcaggggcttgatacctgtcagagccctttgacccaggccccagtgaaaaaggttccggttgtgcgagtcttcggcgccacccccgctggccagaagacctgtttgcaccttcacggtatcttcccctatctttatgtgccttatgatgggtacggtcagcagccggaatcgtacctcagccagatggccttttccatcgaccgtgcactgaacgtcgctttggggaatccctcatcgacagcccaacacgtgtttaaggtctctctcgtctctggaatgcccttttatggctatcatgaaaaagagagacacttcatgaaaatttacctctataaccccactatggttaagagaatatgtgagttgctccaatctggtgcaatcatgaataagttttaccagccccacgaggctcacataccttatcttctgcaattgttcatcgactacaatctgtacgggatgaacttgatcaacttagccgctgttaaatttcggaaagccagaaggaaaagtaacactcttcatgccactgggagctgcaagaaccacctgtcaggcaattccctggcagacaccctcttccgctgggaacaagatgagatcccctcttcccttattctggagggggtggagccccagtctacatgcgaactggaagttgatgcagtagcagcagatatcctcaaccgactcgacattgaagcccagattggcgggaatcctggactccaagcgatttgggaggatgagaaacagcgcaggagaaaccggaatgaaacctcgcaaatgagtcagcccgaaagccaggaccacagattcgtgccggcaaccgaaagcgaaaaaaagttccagaaaagattgcaggagatcctcaagcagaacgatttcagcgtgaccctctccgggagtgtggattattctgacgggagccaggagttcagcgcagagctgacccttcacagcgaagttttgtcgcccgagatgctccagtgtacaccagcaaatatggtagaggtacataaagataaagagtcgtcgaaagggcacacacgccataaggtcgaagaggctctgataaatgaggaggcaatcctcaatctgatggaaaacagtcagaccttccaaccgctgacacagagactctctgaaagtcctgtgtttatggatagctccccagatgaggcgcttgtgcaccttttggcaggcctggagtctgacggttaccgaggagaaagaaacaggatgccatccccttgccgcagtttcggtaacaacaagtacccacagaactccgacgatgaagagaacgaaccacagattgaaaaggaggaaatggagctctctctggtgatgagtcagcggtgggattccaacatagaggagcactgcgccaagaagcgctctctttgcaggaacacccatcgctcctccactgaggacgatgattctagctccggagaagaaatggaatggagtgataattctttgttgcttgcctccctatctatcccacagttggatggaactgccgatgagaacagcgataacccgcttaacaacgaaaattccagaacacacagtagtgtgatcgccacctccaaactatccgtgaagcccagtatcttccacaaagacgcagccactctcgagcccagttccagtgcaaaaatcacattccagtgcaaacatacaagtgcattgtcaagtcacgtgttgaacaaggaagatctcattgaggacctttcgcagacaaataaaaatacagaaaagggcctggataactctgtgacgtcctttaccaatgaatctacttactctatgaaatatcccggtagtctgtcttcaacggtccacagcgaaaatagtcataaagagaattccaagaaagaaattctgcctgtatcttcctgcgaaagttccatcttcgactatgaggaagatatccctagtgtgactagacaggtgccctcgcggaaatacaccaacattcggaagatcgaaaaggactcaccctttatacatatgcatcggcatcctaatgagaacacactcggaaagaattcatttaacttcagcgacctgaaccatagcaagaacaaagtgagtagcgagggcaatgagaaagggaacagcactgccttatcgagcttgttcccatcaagtttcaccgaaaattgcgaacttctgagctgctctggggagaatcgcaccatggttcacagcctcaactcaacagccgacgaatcaggcctcaataaactgaagatcagatacgaagaattccaagagcacaagacagagaaaccaagcctctcacagcaagccgcgcattatatgtttttcccatccgtcgtgctgagtaattgtctcacccggccccagaagctgtccccggtgacctacaagctacaacctgggaataaaccttctaggctcaagctgaataagcggaaactcgctgggcatcaagaaacaagtacaaagtcaagtgaaaccggcagcactaaagataacttcatccagaacaatccttgtaacagtaaccccgaaaaggataatgctttggcctctgaccttaccaaaacaaccagaggcgcttttgagaacaaaactcccacagacggattcatcgattgccactttggggacggtacactcgagaccgagcagagcttcggactctacggtaataagtacactttaagagcgaaaagaaaggtgaactacgagacagaggacagcgagtcttctttcgtcacacataatagtaaaatctctctgccgcaccccatggaaattggtgagagcctggatggtactctcaagtcccggaagcgtcgcaaaatgtcaaagaagcttccacctgtgattatcaagtacattataatcaaccgcttcagagggcgcaaaaacatgctggttaaactgggcaaaatcgactccaaagaaaagcaggtgatcctcaccgaggagaagatggagctgtataagaagctggctccactcaaggacttctggcctaaggtgcctgacagcccggctaccaagtatcccatctacccacttacgcctaagaagagtcatagaaggaagtctaagcataagagcgctaaaaaaaagacaggaaaacagcagagaaccaacaatgaaaacatcaaaagaacactgtcctttcggaagaagaggtcccatgctattctgtcacctccctctccctcatacaatgcagagacggaggattgcgatttaaattatagcgacgtcatgtccaagctgggatttcttagcgagcggtctacaagcccaatcaactccagccctccccgctgctggtcacctacggaccccagggcagaggaaatcatggccgccgccgagaaggaagccatgttgttcaaaggcccaaacgtgtacaagaagactgtgaatagccgaatcggaaagacctcacgggctagagcacagatcaagaagtctaaagccaagttggcaaaccctagcattgtcactaagaaacgcaataagaggaatcaaacaaataagctggtggacgacggaaagaaaaagccaagggcgaagcagaagacaaatgaaaagggaaccagcaggaaacatacaacattgaaggacgagaagattaagtcacagtcgggagctgaagtgaagttcgttctaaaacaccagaacgttagcgaattcgcgtcatcctctggaggcagtcagctgcttttcaaacagaaagacatgcccctgatgggctccgcagtggaccaccctctgagcgccagtttacctaccggcattaacgcccagcagaaactgtctggttgcttctccagctttctggagtccaagaagtctgtggatctgcaaacatttcctagctcacgcgatgatctgcacccttctgttgtgtgcaattcgataggccccggagtgtcaaaaataaatgtgcagcggccacataaccaaagcgcaatgtttacactgaaagaatcgactttgatccagaaaaacatcttcgacctcagcaaccatctcagccaggtggcacaaaatacccagataagctcagggatgagttctaagattgaggacaacgccaataatatccagcgtaactacctgagcagcataggaaagctgagtgagtatcggaattccctcgagagcaagcttgaccaggcatacacccccaatttccttcattgtaaggattctcagcagcagatcgtgtgtattgccgagcagtccaagcactccgagacctgtagtcctgggaacaccgcttctgaagaatcccaaatgccgaacaattgtttcgtcacctccctcagatcaccaattaaacagattgcctgggagcaaaaacaacggggcttcatcctcgatatgtcaaatttcaagcctgaaagagttaaaccgcgcagcctctctgaagcgatcagtcaaaccaaagcactttcacaatgcaagaatcgtaatgtatctaccccatcggccttcggggaggggcagtcggggctggcggtactgaaggagcttttgcagaagaggcagcaaaaagcccagaacgcgaatacaacgcaggatccactttccaacaagcatcagccgaataaaaacatttcgggctccctcgaacacaacaaggcgaacaaacgtactaggtcagtaaccagtccacgcaagccgcgtaccccccgatcaaccaagcagaaagagaaaatcccaaagctcttaaaggtggactcccttaacctccagaactcaagtcagcttgataacagtgtgtcagacgattccccaatttttttcagcgacccaggcttcgaaagctgttattcccttgaggactccctaagccccgagcacaattataactttgacatcaacacgatcggacagacaggattctgcagtttctattcgggaagccagttcgtacccgcggaccagaatcttccacagaaattcctgtctgacgcggtgcaggacctgttccctggtcaggcaatcgaaaaaaacgagttcctgtcacacgacaatcagaagtgcgacgaagataagcaccacactactgactccgcgagttggatccggtcagggactctctctcccgaaattttcgaaaaaagcaccatagactctaacgagaatcgcaggcacaatcagtggaagaacagctttcatcccctgacgacacgctccaacagcataatggattctttttgtgttcagcaagccgaggattgcctaagcgagaaatcgaggctgaaccgctcatcggtctctaaagaggtattcctaagtctgcctcagcctaacaacagcgactggattcaagggcacacaaggaaggagatgggacagtccctagactcagctaatacgagcttcacggccattctcagctctccagacggcgaactggtggatgtggcgtgtgaggacctggaactttatgtgtccagaaataatgatatgctgacccccactccggattcctctccacggtctacctcaagtccatcccagtcaaaaaacggtagcttcacgccacgcaccgccaatattttaaaacccctgatgtccccccctagcagagaggagattatggctacactcctggatcacgatctgagcgaaacaatctatcaggagccgttctgctccaaccctagtgatgtccctgagaagcccagggaaattggtgggcgattgttgatggttgagaccagactcgcaaatgatctggctgagttcgaaggagatttcagccttgaaggcttgagattgtggaagacagccttcagtgcaatgacacagaacccccggccgggatctccgctcagatcaggacagggcgtggtgaataagggaagcagtaattctccgaaaatggttgaggacaagaagatcgtcatcatgccctgtaaatgcgccccatctcggcaattggtgcaggtgtggcttcaggctaaagaggagtatgaaagaagtaaaaagctgccaaagacaaagccaaccggggtagtgaagtcagctgagaactttagctcttcagtgaatcccgatgacaagccggtggttccacccaagatggacgtatccccatgcatcctgcctacaactgcacacacaaaagaggacgtggacaatagtcagattgctctgcaagcaccgactactggttgttcccagacggcatccgagtcgcagatgctgccacccgtggcctccgcctctgaccctgaaaaagatgaggacgacgatgataattattacataagctattcatcaccagacagcccagtaattcccccctggcagcagccgatcagccccgactctaaggccctaaacggggatgaccgaccctcttccccagtcgaagagctaccttccttggcctttgagaattttctgaaaccaatcaaggacggaattcagaagtctccgtgttctgaaccccaggaaccactggttatttccccgatcaacactcgggcccgaactggtaagtgcgaatcactctgttttcacagtactcccatcattcaacggaaattgcttgagcgcctgccagaggcacccggcctgtctcccctgtcaaccgagcccaagacccaaaagttgtccaacaaaaagggttcaaacactgacacactgcgtagagtgctcctgactcaagcgaagaaccaatttgcagcggtgaatacaccgcagaaagagaccagccagattgacggaccaagtctcaataacacatatgggttcaaagtcagcatacaaaacctgcaagaggcgaaggctttgcatgaaattcagaacctgaccttaatctccgttgagctgcacgcacggacccggagggacctggaacccgacccagagttcgatcctatctgcgcactattttattgcatttcatcagacacacccctgcccgatacagaaaaaaccgagctgaccggagtgatagtaattgacaaagataagactgtgttttcacaggatatccgctatcagacaccattactcatccgtagcggcattactggcctcgaggttacttacgcagcagatgagaaagcactattccatgagattgccaatatcatcaagcgctatgaccctgatatcctactggggtacgagatccagatgcacagctgggggtatctgctacagagggctgctgcgctgtcaattgatttatgcagaatgatttctcgcgtaccagacgacaaaattgaaaacagatttgccgcggagagagacgaatatgggagctatacaatgtcagagataaacattgtcgggcggataacacttaatctctggaggatcatgcgaaacgaagtggccctcacaaattacacgttcgaaaacgtgagctttcacgtactgcaccaaaggtttcccttatttaccttccgcgtgctctcagattggtttgacaataagaccgacctctacagatggaagatggtggaccactacgtcagcagggtgcgcgggaatcttcagatgctggaacagctggatctgatcggaaagaccagcgaaatggcaagactgtttgggatccagtttttacacgtgctgacaagaggcagccaataccgggtggaatcaatgatgcttcgaatcgcaaagccaatgaactatattcctgtgaccccttctgtgcaacagcgttcccagatgagggccccccagtgcgtgcccctgatcatggagcctgagagcaggttctactctaatagtgtgctcgttctcgatttccagtctctttatccatctattgtgatcgcctataactattgctttagtacctgcctggggcacgtcgaaaacctgggtaagtacgatgagtttaagtttgggtgtaccagcttacgcgtgccaccggatctcctgtatcaggtgaggcatgatatcacagtcagccccaacggtgttgcttttgtaaagcccagcgtgcgcaagggtgtcctcccgcgcatgctcgaggagatactgaagactcgttttatggtaaagcagtccatgaaggcttacaagcaggaccgggcgctgagccgaatgctcgatgcccggcagctgggactcaaattgattgccaacgtaacgttcggatacactagcgccaacttctcaggaagaatgccctgtattgaggtcggagattcaatcgtgcacaaagctagagaaactctggagcgcgccatcaaactggttaatgacacaaagaagtggggcgcgcgagtcgtgtatggcgacaccgattccatgttcgtgttgctcaagggcgctacaaaggaacagtcatttaagattggccaggagattgctgaagccgtaacagctactaatcccaaaccagtgaaactcaagtttgagaaagtgtacctcccatgtgtgctgcagaccaagaagaggtacgtggggtacatgtatgagacactcgaccagaaggacccagtgtttgatgccaaaggcatcgagaccgtccggagagattcctgtcccgcagtgtccaagattctcgagcgtagcctcaagctgttatttgagacaagagacatcagcctcatcaagcagtacgttcagagacagtgcatgaagctcctggagggcaaagcgagtatccaggattttatcttcgccaaggagtatagaggctccttctcttacaaacccggcgcgtgcgtgccagcacttgagctgacaaggaaaatgctgacctacgaccgtcgctcagagccgcaggtgggagaacgggtgccctacgtgataatctacggaaccccaggtgtcccacttattcagctggtgagaagaccagtcgaagttctccaggatccaaccctgcggctcaacgcaacgtactatataaccaagcagattctgccacccttagccagaattttctctcttatcggcatcgatgtgttcagttggtaccacgaactgccccgaatccacaaggctacttccagctcccgaagcgagcctgaaggaaggaaggggacgataagccagtatttcacaaccctccattgtcccgtctgtgatgatctgacccagcacggcatctgctccaaatgcaggtctcagcctcagcatgtggctgttattctgaatcaggagattcgagaattagaacggcagcaagaacagctcgttaaaatctgcaaaaactgtacagggtgttttgatagacatataccatgcgtgtccctgaattgcccagtgctgtttaagctatctagagttaaccgcgagctctcaaaggctccttatctgcggcagctgctggatcaattctag

SEQ ID NO: 203189 - DNA, 9159 bp, Artificial Sequence
  Description of Artificial Sequence: Synthetic coding sequence
atggccttcagcatcgaccgggccctgaacgtggccctgggcaacccatcttcgactgcccagcatgtctttaaggtgtccttagtatccggcatgccgttttacggctatcatgaaaaagagcggcacttcatgaagatctatctttataacccaacaatggtaaaacgcatatgtgaactacttcagagcggagccatcatgaacaaattctatcaacctcacgaggctcacataccgtatttgttgcagctgttcattgactacaatctgtacgggatgaacctgatcaatctcgcagccgttaaatttcggaaagcacggagaaaaagtaataccctgcacgccactggcagctgtaaaaatcacctgtctggaaactcgttggcagacaccctgttccggtgggagcaagacgaaatcccttcatcactgattctcgaaggcgtagagccccagtcgacttgcgaattagaagtcgacgctgtcgcggccgatatcctgaaccgcctagacattgaggcccagataggaggaaaccccggtctgcaagccatctgggaagatgaaaagcaaaggagacggaaccgaaacgagacatcccaaatgtctcagcctgaatcacaagaccatagatttgttccggcaacagagtcagagaaaaagttccagaaacggttgcaggaaattctgaagcagaacgactttagtgtgacactgtccggatctgtggattacagcgacggcagccaggagttttcagccgaactcaccctccatagcgaggttctgagtcccgagatgcttcagtgtacacctgccaatatggtggaggttcataaggacaaggagtccagtaaaggacacactagacataaggttgaagaagcccttatcaacgaggaggcgattctgaacctcatggagaacagtcagacattccagcccctgacacaaagactctcagaatccccagtcttcatggacagcagtcccgacgaagccctcgtccacctgctggccggactcgaatcggacggatacaggggcgagcgtaacaggatgccgtcgccctgtaggagctttggcaacaataagtacccccaaaacagtgatgacgaggagaatgagccgcagatcgaaaaagaagagatggaactgagcctggtgatgtcccaacgatgggacagtaatattgaggagcattgcgctaagaaacggtcactttgtaggaacactcaccgcagcagtacagaggatgacgattcctcatcaggtgaggaaatggagtggtccgataactcactgctgcttgcatctctcagcattccgcagctcgacggtaccgctgacgagaactcagacaacccactgaacaacgagaatagtaggacgcatagcagcgtcatcgctacttccaaactgtctgtgaaacctagtattttccataaggatgccgctacccttgagccctcaagctccgccaagatcacttttcagtgtaagcatacctcagcactgagttctcacgtcctgaacaaggaagacctgatagaggaccttagccagacaaataagaatactgaaaagggactggataactcggtcacgtcttttacaaacgaaagcacctattcaatgaaatatcctggttccctttcatctactgtgcactcagagaattcacacaaagaaaacagtaaaaaggaaatactccctgtttcttcttgtgaatcatctatttttgactacgaggaagacattccctccgtgacaagacaggtgccctcccgcaagtatactaacattcggaagatagaaaaagactcccctttcattcatatgcaccggcacccaaatgaaaatacactaggcaaaaattcctttaattttagtgatctcaatcactctaaaaataaagtatccagcgagggcaatgaaaaaggcaactctactgcgctgagcagcctgttccctagctcttttaccgaaaactgtgaactcctttcttgttccggggagaacaggaccatggttcactcccttaacagcactgcagatgaatccgggctcaataagctaaagatccggtacgaggagttccaggagcataagacagagaaacctagtttgagccagcaggctgctcactatatgttcttcccctcagtcgttttgtctaactgtttaacgcgcccacaaaagctctctccggtaacgtacaagctgcagccagggaataaaccttctcggttgaagcttaataagcggaaattggccgggcatcaggagacatctacgaaaagctctgaaaccggatccacaaaagacaacttcatccaaaacaacccctgcaacagtaaccccgaaaaagataacgccctagcatctgatctgaccaaaactacccgtggagcctttgagaataagacacccaccgatggcttcatcgattgccacttcggcgacgggaccctggaaacagaacagtcatttggtttgtacggcaataaatataccttacgtgccaaacgcaaggtcaactatgagacagaagatagcgagagctctttcgtgactcataactccaagattagcctacctcacccaatggagattggagaatctctcgatggcacacttaaaagcagaaagagacgaaagatgtctaagaaactcccgccggtgataatcaagtatataatcataaacaggtttcgtgggagaaagaatatgctcgttaagttgggcaaaatcgactccaaagaaaagcaggtgatcctgacggaggaaaaaatggagttgtacaagaagctggccccactcaaagatttttggcccaaggtgccagacagcccggctacaaaataccctatttatcccctgacccccaagaagagccaccgacggaaatccaagcacaaatccgccaaaaagaaaactggcaaacagcagcgcactaataacgagaacattaagcgtacgctgtcattcaggaagaagcgcagccacgcaatactatcccccccttcacccagttataatgccgagaccgaggattgcgatctcaactattcggatgttatgtcaaagctgggatttctgagtgagcgatccactagtccgatcaatagctcaccacctcggtgttggtctccaaccgacccccgagcagaggaaatcatggctgcggccgaaaaagaagccatgttgtttaaggggccaaacgtgtataagaaaaccgtgaatagcaggataggcaaaaccagtagggccagagctcagataaagaagtcaaaggcgaaactggctaaccccagcattgtaacaaagaaaagaaacaaacggaaccagaccaacaaactggttgatgatggaaaaaaaaagccaagagcgaagcaaaagactaacgagaagggaacttctcgtaagcataccacgctgaaggacgagaagattaaaagccagtcaggggctgaagtcaaatttgtgctgaagcatcagaacgtgtctgagttcgcctcgtctagcggcggatcacagcttttgttcaagcaaaaggatatgcctctgatgggctctgcagtggaccaccctctatcggcttcccttccaaccggtatcaatgcccagcagaagctgtcaggttgctttagcagctttctcgagtctaagaagagtgtggacctccagaccttcccctcctctcgcgatgatctgcacccgtctgtagtatgtaatagcatagggccaggggtgtcaaagatcaacgtccaaaggcctcacaatcagtcagcaatgtttactctgaaagagagtaccctcattcagaagaacattttcgatctcagcaaccacctttctcaggtggcccagaatacacagatctcctcaggcatgagtagtaaaatcgaggataatgccaacaacatccagaggaactacctaagctccatcgggaagctgagcgagtatcggaacagtctggagagcaagctggaccaagcctatacacctaacttcctgcattgcaaggactctcagcaacagatcgtctgcattgcggaacagtcaaagcactcggagacctgtagtccaggaaatacagcttcagaggagtctcaaatgcccaataattgctttgtgacctcactgagaagtcctatcaagcagatcgcctgggaacagaagcagcgagggttcatcctggatatgagcaattttaaacctgaacgtgtaaagccccgatctttatctgaggccattagccagacaaaggccctcagtcaatgtaagaatcggaatgtttccacgccgtcagcgttcggcgaagggcagagcggcctggcagtactcaaggagctgctgcagaagagacagcagaaagcacaaaacgcgaatactacacaggaccctctctcaaataagcaccagcctaataagaatatatcaggaagcctagaacacaacaaggccaacaaacggacaaggagtgtgacgtcccctaggaaaccccgtacaccccgaagcactaagcaaaaggagaaaatcccaaagctgcttaaggtggattccttgaatttgcagaactctagtcagctcgataactctgtctccgatgattcccctatcttttttagtgatccgggcttcgagagttgttactctttggaggactctctgtctcccgagcataactataactttgacattaacacgattggacagaccggattctgttctttttattccggctcccagtttgtccctgccgatcagaatctacctcagaagttcctgtccgatgcagtgcaggatctttttcctggacaggccatcgaaaagaacgaatttttgtctcacgataaccaaaagtgcgatgaggataagcatcacactacggatagcgcttcctggatcaggtctggcaccctatcgcctgagatctttgaaaaatctactatagactctaacgaaaatcgaagacacaaccaatggaaaaacagtttccatccgttgactactcggtctaatagtattatggattctttttgcgttcaacaagccgaggactgtctcagcgagaaatcgaggctcaacaggtcttccgtgagcaaggaagttttcctctcactgccccagcctaacaacagcgattggatccagggccatacgaggaaggaaatgggtcaatcactggattccgcaaacaccagcttcaccgccattctctcaagtccagatggcgagcttgttgatgttgcctgtgaagatctcgagctctacgtgtccaggaacaacgatatgctgactcctacaccagattcctcaccacggtcgaccagctccccaagccaatctaagaacggctccttcactcctaggactgcaaatattctgaagccactcatgtcacccccttcaagggaagagattatggccacactcctagaccacgatctctctgaaacaatttaccaggaacccttctgttctaacccgagcgatgttcccgagaagccccgcgagattggcggccgacttttgatggtggagacccgcctcgctaacgacctggccgagttcgagggagacttcagtctggaaggtttaaggctttggaagacggcatttagtgcgatgacacagaacccccgcccagggtcaccactgcgcagcgggcagggcgtggtgaacaagggctccagcaattcacccaagatggtggaagacaagaagatcgtgatcatgccctgtaagtgtgcccccagtcgccagctcgtacaagtgtggctgcaagccaaggaggagtatgagcgctccaagaagctccctaagaccaaaccaaccggcgtggtcaagtcagcagagaacttcagtagctcagtgaaccccgacgataaaccagtggtaccgcccaagatggatgtatccccgtgtattctgcccactacggcgcacacaaaggaagacgttgataattcccaaattgcactgcaggcccccactacaggctgcagccagacagcatctgaaagccagatgcttccgcctgtggcctccgcatccgatcctgagaaagatgaagatgacgacgacaattactacatatcttactcatctcctgactcaccagtgatccccccgtggcagcagcccatcagccccgattcaaaggccctaaacggcgatgatcggccgtccagccccgtagaagagctcccatctttagcattcgagaatttcctcaagcccattaaggacggtatccagaagagcccatgttctgagccacaggagccactcgttatctcaccaataaacacccgcgctcgcaccggtaagtgtgaatcactctgtttccactcaaccccaatcattcagaggaagctgctggaacgtctccccgaagctcccgggctgagcccccttagcaccgagcctaagacccaaaagctatctaataagaagggctcaaacaccgacactctcagacgcgtgctgctgacccaggctaaaaatcagtttgctgctgttaacacaccccagaaggaaacttcccaaatcgatggaccctctttaaacaatacttacggatttaaggtatcaatacagaacttacaggaagctaaggcactgcatgagatccagaatctgaccctaatctccgtagaattacatgctcggacaaggcgagacttagagccggatcctgaatttgacccaatttgcgcattattctattgcatttcttcagacacccccctcccagatacagagaagacagaactgacaggtgtgattgtcatcgataaggacaagaccgtcttcagccaggatattcgctaccagactcctcttctcatcagaagtgggattaccggccttgaagttacctatgctgctgacgaaaaagccctcttccatgagatagcgaatattataaagcgctacgatcccgacattctcttaggatatgagatacaaatgcactcttggggatacttgctccagcgagccgcagcattgagtattgacctctgtagaatgatttcccgagtcccagatgataagatcgagaatcggttcgcagccgaaagagacgagtacgggagctatacgatgagtgaaataaacatcgtcggacgcatcactctgaacctatggcgtattatgcgcaacgaggtggccctcactaactatacctttgagaacgtcagctttcatgtcctccaccagcgttttccgttatttaccttccgggtactgagtgactggtttgataacaaaaccgacctctaccgctggaagatggtcgatcactacgttagtagagtgagaggcaaccttcaaatgctcgaacaacttgacctgatcggtaagactagtgagatggccagactgtttggcatccagttcctgcatgtgctaacccggggcagccagtaccgcgtagaatcgatgatgctccgtatcgcaaaacccatgaattacatccccgtcacacccagcgtccagcagcggagccagatgcgtgctcctcaatgtgtacccctaatcatggagccagagtcgcgcttctactccaacagtgtcctcgtccttgatttccagtccttgtacccttccatcgtaatcgcctacaattattgcttcagcacctgcctgggccacgtagagaacctcggcaagtacgatgagtttaagttcggctgcacttctctaagagtgccgccagacctgctttatcaggttagacatgatattacagtctctcccaatggcgtggcctttgtaaaaccttcagtccgaaagggagtcctaccgaggatgctggaggagattctgaagactcgattcatggtcaagcagtccatgaaggcttacaagcaggacagagccctcagtagaatgttagacgctaggcagttggggctgaaactaatcgctaacgtgacctttggctacacctccgctaatttttccggacgcatgccgtgcatagaagtgggcgacagcatagtgcacaaagctcgcgagacactggaacgggctataaagctcgtgaatgacaccaagaaatggggagcccgtgttgtgtatggagacaccgacagtatgttcgttttacttaagggagccacaaaggaacagagcttcaaaatcggccaggaaattgccgaggccgtcaccgcaacaaacccaaagcctgtgaaactaaagtttgagaaggtgtacctgccttgtgtgttgcagacgaagaagaggtacgtggggtacatgtacgaaaccctggatcagaaggacccagttttcgacgccaagggcattgagacagtgaggagggacagctgtccggccgtttcaaagatcttagaaagatcactgaagctgctttttgagacccgagacatatcacttattaagcagtacgttcagagacagtgcatgaaactgctggaggggaaggcgtccatacaggatttcatcttcgccaaagagtaccgggggtccttttcttacaaaccaggcgcctgtgttcctgccttggaactgacgcggaagatgctgacatacgatagaaggagtgaaccccaagtaggcgagcgggtgccctatgttataatatacgggacacctggagtccccctgatccagctggtgcgacgcccagtcgaggtgctccaagaccctacactgcggctgaacgctacgtactatatcacgaaacagattctgcccccactcgcccgaatttttagtctaatcggcattgatgtgttttcatggtatcacgagctgccgcgtattcacaaagcaacctcatcgtcacgctcagaacctgagggtcgaaaaggaacaattagccagtattttaccactctccattgtcctgtgtgcgacgacctcacgcagcatggaatctgttctaagtgtaggtcccagccccagcatgtggccgtcatacttaatcaggagatccgggaactcgaacggcagcaggaacagctcgttaagatatgtaaaaactgcacgggatgctttgacagacatattccctgtgtctctctcaactgtccagtgctgttcaagctatcccgggtgaatagagagctgagtaaagcaccttatcttcggcaactgttggaccagttctag

SEQ ID NO: 203190 - DNA, 2289 bp, Artificial Sequence
  Description of Artificial Sequence: Synthetic coding sequence
atggtggagacccggctggccaacgacctggccgagttcgagggcgatttcagtttagaagggctgcgcctttggaagaccgccttttcagccatgacccaaaacccccgtcccggctcccctctaaggtccgggcagggagtcgtcaacaaagggtcaagcaattcacccaagatggttgaggataaaaaaatcgttatcatgccttgtaaatgcgcccctagtagacagctggtacaggtttggctccaggcgaaggaggagtatgaacgctctaagaagcttccgaagacaaaacctaccggtgtggtgaagtcagcagaaaactttagcagtagcgtgaacccggatgataagccagtggttccccccaagatggacgtctcgccatgcattctccctacaactgcccacacaaaagaagatgtggacaatagccagatcgcccttcaagctcccaccacaggctgctcccagaccgctagtgaatcccagatgttgcctcccgttgcctccgcatctgaccctgagaaagatgaagacgatgacgataactactatatcagttactctagccccgatagtcctgtcattcccccatggcagcaaccaattagtcccgattctaaagcccttaatggcgacgatagaccatcatctccggtggaggaattgccatccctcgccttcgagaatttcctcaaacctattaaggacggcatacaaaaaagcccctgctcggagcctcaggagccactggtcatctctcccatcaacacacgcgcccggacgggcaaatgcgaaagcctctgctttcattccacgccaataattcaacgtaaactcctggaaagattgcccgaagcccctggcctttctcctctaagtactgaacccaagacacagaaactgagtaacaagaaagggtccaatacagatacattgagaagggtgctgctgacacaagccaagaatcaattcgccgctgttaatacgccgcagaaagagacgtcccaaatcgatggtccatcactcaataacacctacgggttcaaagtctctatccaaaacctgcaggaggccaaggctctgcatgagatccagaatctgacattgatttccgtagagctccacgctcgcacccggcgcgacctcgaacccgaccctgaattcgatccaatatgcgcccttttctactgcattagcagcgacacccccctgcctgatactgaaaaaacggagctaactggtgtgattgtaatcgacaaagataaaacggtatttagtcaagatatacgctatcagacaccgcttctgattagatcaggaataacaggcctggaggtgacttacgctgcagacgagaaggcactgttccacgagattgcaaacatcattaaaagatatgacccagatatcctgctcggatatgaaatccagatgcattcctgggggtatctccttcagcgggccgccgcactgagtattgatctgtgtcgcatgatttctagagtaccagatgataaaatcgagaacagattcgccgccgagcgagatgaatacggctcatataccatgtcagaaatcaacatcgtcggcaggatcacattgaacctgtggagaattatgcgtaacgaagtcgcactgaccaattacacctttgagaacgtgagctttcacgtcctccatcagcgcttccccctcttcactttccgggtgctgagcgactggtttgacaataaaactgacctgtaccgctggaaaatggttgaccattacgtctccagagttaggggtaacctacaaatgctggaacagctggacctcatcgggaagacctctgagatggcgaggctattcggtatccagttccttcacgtgttgactagagggagccagtatcgagtagaatccatgatgctgaggatagccaaacccatgaactacatcccggtaactcccagtgttcagcagaggagccagatgagggcaccccagtgcgtgccgcttattatggaacctgagagccgtttttactctaattcagtcctcgttctagattttcagagtctttacccgagtatcgttatcgcctacaactattgcttcagcacttgtttaggtcacgttgagaacctgggcaagtacgacgaatttaaattcgggtgtacttccctgcgcgttcctcccgatctgctctatcaggtcaggcatgacataactgtatctcctaacggtgtggccttcgtgaaaatcgccaacaagtgtagacctgaaggtatggcatag

SEQ ID NO: 203191 - DNA, 3666 bp, Artificial Sequence
  Description of Artificial Sequence: Synthetic coding sequence
atgctgcggagcaccggcttcttccgggccatcgactgcccctactggagtggtgcccctggcggcccttgccgacgcccgtactgccacttcaggcaccggggtgctcgaggctcaggcgcccccggtgatggcggggaagctcctcccgccgccgggttgggctatgacccatataaccccgaactgccgaaaccgccggcccagagagagaatggaactctaggactgggcgaggagcctaggcctgacgtcctggaactcgagctagtcaaccaggccatagaggcagttcggagtgaggtcgaacttgagcagaggagatacagggagctcctggaaactacaagagaacataggtctgctgaggcccccgcactcgcgcccagaggaccgaacgccagcccgaccgtgggccccgacgaggacgcgtttcctttggcatttgactattccccaggttcccatggcttactgtcacctgatgcaggttaccaacctaccccactggctgcaccggctgaacctggttccaaatactccctggcgtctctcgatcgcgggcaaggcagaggcggcggtggtggcggcgccctggagtacgtgcctaaggccgtcagccaacctcggcgccattctaggccagttccaagcggaaagtatgtcgtcgacaactctcgacctcccaccgacctcgaatatgatccactgtccaactactcggcgcgccatctgagccgcgcgtctagcagggatgaacgcgccgctaaacgtcctcgcggctctcgagggtccgagccctacacgccagcaccaaaaaaactctgcgacccttttggctcctgtgacgctagatttagcgactcggaggacgaggcagcgaccgtgcctggaaacgagcctacaaccgcttctacccctaaggctcgggcagaccctgagattaaggcaacgggccaaccgccttctaaggagggactggaagcagagggtggaggtctgcgggagacgaaggagacagctgtgcagtgcgatgtcggtgatctgcaacctcctcccgctaaaccagcaagtcccgctcaggtgcagagctcccaagatgggggctgtccaaaggagggaaagcccaagaagaagaagaccggagctccccccgccccatcatgcaaagatggagcccaagggaaagacaagaccaaggataaggggagagggcgtccagtggaaaaaccaagagctgacaaaaagggaccacaggccagcagccccaggcggaaggctgagcgtcctgagggaactaaaaagaagccttcctccgctacacctgtagcaacttctggaaagggccggccggatcggcccgctagacggccgagtcccacctctggggatagcagacccgccgcggggaggggccctcctcggccgctccagctgcccgatcgtaagagcactaaagcccctagtgggaaactggtggagaggaaggcccgctccctggacgagggagcaagtcaggacgcccctaagctcaagaagcgggccctaagccatgccgatttgttcggagacgagtctgaagatgaggccgcagggccaggagtcccgtcagtatggccttctgccctccctagcttgtcgtctgacagcgattccgatagtgatagtagcctcggcttccccgaggcgcaagggccacctaagagactcaaggcaagcccacccccgagtcccgcaccatcctcatcgtcctcttcatccagttctaccagctccgccggcgctgacgtggattattctgccctggagaaggaagtcgactttgactcagatccaatggaggaatgcctccggatattcaatgaaagcacctccgtcaaaacggaagatagaggtcgattagcccgacaaccccccaaggaggaaaaatcagaggagaaaggactttcaggtcttacaactctctttccagggcagaaaaggcgcatctctcacctgagtaagcaggggcaggaggtggagcctcctcgtcgcggccctgcggtgccccctgcacgacctcccaccgcccaagaggtttgttatcttagggcccagcaagcacagcgggcttccgccagccttctccaggctcccgcaagactggctgaaaagagcccttctgtccatatatcggcaccaggagagaaacggcgcatcgcccacataccaaaccccagattagctgctgcacccaccggggccaagcgtactctggcagcttctggaagccagagctccaacggaccagaaccaggaggccagcagctcaaaacacgcactttgtctggaatggctagcaaaaccaccaccactatcatccctaagcgaattgcacatagcccaagccttcagagtctgaaaaaaccaattatcccgaaagagtttggaggcaaagttcctacagtgattaggcaacgctatctaaatctttttattgaagagtgccttaagttttgcacctctaaccaggaagcaatagagaaggctttaaacgaggaaaaagtggcatacgaccgcagcccctccaaaaatatttaccttaatgtggcggtgaacacattaaagaagctgagagggcttgcgccatcagcagtgccgggtttgagtaaaacttctggtcgccgcgtagtgtcccatgaagtggtgctcggtggccgcttagcggccaaaaccagcttcagtcttagcaggccatcaagtccacgcgtggaggatcttaagggagcggccctgtatagcagactgcgcgagtatctgctgactcaggatcaattgaaggagaacggctaccccttccctcatcccgaacgcccaggtggagcaatcatctttacggcagaggagaagcgcccaaaggattcatcttgtaggacatgttgtcggtgcggaactgagtacttggtgagcagtagtggaagatgcataagggatgaagaatgttactatcactggggacggcttaggaggaatagggtggccggagggtgggaaactcaatatatgtgttgctccgccgcagctggaagcgtgggttgccaagtcgccaagcagcacgtgcaagacggaagaaaggagagacttgaaggcttcgtcaagaccttcgaaaaggaattaagcggcgatactcacccaggaatttatgctctagactgtgaaatgagttacacaacctacggactcgagctaacacgggtgacagttgtcgacaccgatgtccacgtggtgtacgataccttcgtgaaaccagataacgagattgtagactacaatacacgcttctccggtgttaccgaagctgacctggccgatactagcgttaccttgcgggatgtgcaggcagtgctactgagtatgttcagcgccgatacaattctgatcgggcactctctggagtcagacctgttagccctcaaggtgatccattccacggtggtagacacaagcgtgttgtttcctcatagactggggctgccttataaaagatctctgagaaatttgatggccgactacctcagacagataatccaagataacgtggacgggcacagcagctccgaagacgctggagcctgtatgcatttggtgatctggaaagtgcgcgaggatgcaaaaacaaagcgatag

SEQ ID NO: 203192 - DNA, 1014 bp, Artificial Sequence
  Description of Artificial Sequence: Synthetic coding sequence
atgctgcccagcagcacccggctgggctacgacccctacaaccccgaactgcctaagccacccgctcagcgagaaaatggcacacttggactgggggaggaaccaaggcccgacgtgctggaactggaacttgtgaaccaggcaatcgaggctgtacgatcagaagtcgagcttgagcaaagacggtatcgagaattacttgagactactcgcgaacaccggagtgccgaggcgccagctctggccccccggggcccaaatgctagtcctactgtcggccctgatgaagatgcctttcctctggcattcgactattcccccgggagccatggactcctgagtccagacgcgggttatcagcctacgcctctcgcagctcctgccgagcctggatcgaaatactcgttggctagcctcgatcgcggacagggccgaggaggcggcggaggcggcgccctggaatatgtaccaaaagcagtctcccagccacgtagacatagccgccccgttcctagcgggaaatacgttgtcgataactctaggcctcctacagatttagagtacgacccactttctaattacagcgccagacacctatctagggcatccagtcgagatgagcgtgcagccaagcgtccccgaggttcgcgcggtagtgagccttacactcctgctcccaagaaactctgcgacccgttcggcagctgcgatgcacggtttagcgactccgaggatgaggccgccaccgtccctggcaacgaacccactaccgcatccacgcctaaagcaagagctgatcctgaaatcaaagcaacaggtcaacctccatctaaagaggggctcgaagccgaaggagggggtctgcgggagaccaaggagaccgctgttcaatgtgacgtaggagacctgcagccaccacccgccaaaccggccagtcctgcacaggttcagtcttcacaggatggtggatgccccaaggaaggtaagcctaagaagaaaaagaccggggcctag

SEQ ID NO: 203193 - DNA, 1482 bp, Artificial Sequence
  Description of Artificial Sequence: Synthetic coding sequence
atgggcagccacagcccctgcgcccacaccccctgcgccccccccgctcccaccggagcaaagcgtacgctcgctgcatccggctcccagtccagcaatggccccgaacccgggggtcagcaactgaagaccagaacactgagcgggatggcttctaaaacaacaacaactatcatccctaagcgcatcgctcattcaccatctttgcagagcctgaaaaagcccatcattcctaaagagttcggcggcaaagtgcccactgttatccgacagcggtacctgaatctcttcattgaagaatgcctgaagttctgcacctccaaccaagaggcaatcgagaaagcactcaacgaggagaaagtggcctatgaccggtccccaagtaagaatatatacctaaacgtggcagtaaatactctgaaaaagctaagggggttagcaccgtccgcagttcccggcctgtctaagacctctggccggcgcgtggtttcccacgaagttgtgctgggcggacgtctggccgcaaaaacaagctttagcctgtcacgaccctctagtccgcgggtcgaggacctgaagggggcagcactctatagtaggctgagggaatatctgctgacgcaggatcagctgaaagaaaacggctatcctttcccccaccctgagaggcctgggggcgccatcatcttcacagctgaggagaagaggcccaaggattcttcatgtcgtacttgctgccgctgtggaacagaatacttggtttcgtcctctggcagatgtattcgcgatgaggaatgttattaccattggggcaggctgagaaggaaccgcgtggccgggggctgggaaacacagtacatgtgctgtagcgccgccgctggctcagttggctgccaggttgccaaacagcacgtacaagatggacgcaaggagcgcctcgaagggttcgttaaaacattcgaaaaggagctgtccggcgacacacacccaggaatctacgctctggattgcgagatgagttatactacctatggtctcgagctaacacgggtgactgtagttgacactgacgtccacgtggtgtatgacactttcgtgaagcccgacaacgagatcgttgattacaacaccaggttttctggagtcacagaagctgatttggcagatacgagtgtcactctgcgggatgtgcaggcagtgctactctctatgttctctgctgatacaatcctgatagggcattcactcgaaagtgacctactggctctgaaggtgattcattccaccgtcgtggacaccagcgtcctatttcctcaccgcctgggtctgccttacaagaggagcctgcgaaacttaatggcagactaccttcggcagatcatccaggataatgtggacggacatagcagcagcgaggatgctggagcttgcatgcacctcgtgatctggaaggtccgcgaagatgctaagaccaagaggtag

SEQ ID NO: 203194 - DNA, 714 bp, Artificial Sequence
  Description of Artificial Sequence: Synthetic coding sequence
atgctgggcggcagcctgggcagccggctgctgcggggcgtgggcggctcccatgggcgttttggcgcccgcggagtgagggaaggaggcgccgctatggcggcaggtgagagtatggcccagcgaatggtctgggtagatcttgagatgacggggcttgatattgaaaaggatcagattatagaaatggcctgtctcattacagatagcgacctgaatatactcgcagagggccccaacctgattatcaagcaacctgacgagctcctagattcaatgtcggactggtgtaaggaacatcatggaaaatcaggcctgacgaaggctgtgaaggagtctactatcaccctgcagcaggcagaatatgagtttttgagcttcgtccgacagcagacaccccctggcctgtgtccgctggcaggaaactcggttcacgaagataagaagttcttagacaagtatatgccacagtttatgaagcatcttcactatcgaatcattgatgtgtctaccgtgaaggagctgtgcagaaggtggtatcctgaggaatacgagttcgcgcccaagaaggcagcctcacacagggccctagacgacatatcggaatcaatcaaggaactgcagttttacaggaataacatcttcaagaagaagatcgatgagaagaaacggaagatcatcgaaaacggagagaatgagaagaccgttagttag

SEQ ID NO: 203195 - DNA, 753 bp, Artificial Sequence
  Description of Artificial Sequence: Synthetic coding sequence
atgggcaaggccaaggtgcccgccagcaagcgggcccccagcagccctgtggccaagcccggtcccgttaaaaccctcactcggaaaaaaaacaagaagaaaaagcgcttttggaaatcaaaggctagggaagtaagcaagaaacccgcctcaggccccggggccgttgtgaggcctcctaaggcccccgaggactttagccagaattggaaggccctacaagaagtgccccggtggaccggcggcaggcagtaccttgctccaaggcccgtggaacagtctacgattcggaaggagcctcgcaagggccagatggtaattctgtttcagaatgagggcaccagctcaattcgcagtggcaagctcaggagacaacctcagccgcacccccctcgagaagagctcgaagtagtccagaaagaagtagctgaaatgttgaaggggcgaatcctggtgggacatgcattgcacaacgatcttaaagtactgttcttagaccacccaaagaagaaaattcgggatacccagaagtacaaaccattcaaatctcaggtgaaatctgggcgcccaagtttgaggctgctgagcgagaagattttgggactacaggtacaacaagcagaacattgctctatacaagatgcccaggcagcaatgagactctacgtgatggtcaagaaggagtgggaatctatggccagggaccgcaggcccctgctgaccgctcctgatcactgcagtgacgacgcttag

SEQ ID NO: 203196 - DNA, 1269 bp, Artificial Sequence
  Description of Artificial Sequence: Synthetic coding sequence
atgggcaaggccaaggtgcccgccagcaagcgggcccccagcagccccgtagcaaagcctgggcctgtgaaaaccctgacgaggaagaaaaataaaaaaaaaaaaagattttggaaatcaaaagcgagggaggtctccaaaaagcccgctagtggacccggtgcagttgtccgcccccccaaggcacctgaggacttctcccagaattggaaagcgctgcaggaatggctgctaaagcagaagagccaggcaccagaaaagcctctggtaatttcgcagatgggtagtaagaaaaaaccaaaaatcatccagcagaataaaaaagagacctctcctcaggtaaagggtgaagaaatgccagcgggcaaggatcaggaggccagccgcggtagtgtgccatctggcagtaagatggaccgaagggccccagttcctcgcacaaaagcctccggaactgagcataataaaaaaggaacgaaagaaaggacaaacggtgatatagttcctgaacggggggacatcgagcacaaaaagagaaaagcaaaggaggcggcacccgccccccctacagaggaggatatctggttcgacgatgtggatcccgctgatatcgaagccgctatcgggccagaggcagccaaaatagcaaggaagcagctgggacagagcgagggaagcgttagcctgtcgctggtaaaggagcaggcattcgggggcttaacccgggcactggccctcgattgtgaaatggtcggcgtcggcccaaagggcgaggagagtatggctgcccgcgtgtcaatagtcaatcagtacggcaagtgtgtttacgataagtacgtgaagcccacagaaccggtcaccgattatcgcactgctgtttcaggaataagacccgaaaatctcaagcagggggaggagttagaggtggttcagaaagaggtagctgagatgctcaaaggtcgcatcctggtggggcacgccctacacaatgacctgaaggtgctgttcctggaccatcccaagaagaagatcagagatactcagaagtacaaacctttcaagagtcaggtgaaaagtggaagaccctccctgcgattactctcagagaagatcttagggctgcaggtgcagcaggccgagcactgctcaattcaggatgcacaagccgccatgcgactttacgttatggtcaaaaaggagtgggaatccatggcccgagatagacgtccactcctgactgccccagaccattgttcagacgacgcttag

SEQ ID NO: 203197 - DNA, 570 bp, Artificial Sequence
  Description of Artificial Sequence: Synthetic coding sequence
atgggcagcaagaagaagcccaagatcatccagcagaacaagaaggagacaagcccacaggtcaagggagaagagatgcctgctggaaaggaccaagaagccagtcggggctcagttccttctggatcaaaaatggacagaagggcccccgtgcccaggaccaaggcctcaggtactgagcacaataaaaaaggcacaaaagaacggactaacggggacatcgtgcccgagcgtggcgatatcgagcataagaagagaaaggctaaggaggccgcgccggctccacccactgaagaggacatctggtttgacgacgtggacccagctgacattgaagccgccattggaccggaggccgctaagatcgctagaaaacaactggggcagtctgaagggtcagtgagcctgtccctggtcaaagagcaggctttcggcggcctaacgcgggcgctggccttggactgcgagatggtgggggtgggccctaagggcgaagagagcatggctgcccgagtgtcgattgtgaatcagtatggcaagtgcgtgtatgacaagtacgtcaagccctag

SEQ ID NO: 203198 - DNA, 1125 bp, Artificial Sequence
  Description of Artificial Sequence: Synthetic coding sequence
cccgtggccaagcccggccccgtgaagaccctgacccggaagaagaataagaaaaaaaagaggttttggaaatcgaaggcccgagaggtgtccaaaaagccagcctcagggccgggagctgtcgtgcgaccaccgaaggcgccagaggacttctctcagaattggaaggcactgcaagagtggcttctgaaacagaaatcacaggcgccagaaaaacccttagtgatcagccagatgggctccaaaaagaaacctaaaattatccagcagaataaaaaagaaacatctccacaggtgaaaggcgaagagatgcctgctggtaaagatcaggaggcgagtagaggttccgtcccaagcggctcgaaaatggacagacgagctccagtgcctagaactaaagccagtggcaccgaacacaacaagaaagggaccaaggagagaactaatggggatatagtgcccgagcgtggggacatagagcataagaagaggaaggctaaagaggccgcacccgcccccccaaccgaggaggacatctggttcgacgatgtggatccggccgacattgaagcggcaatcggacctgaggctgccaagatagcccgaaaacagctgggacagagcgaaggatctgtgtccctctctctcgtcaaagaacaggcatttggcgggctcactagagcactagcactcgattgcgaaatggttggagtgggacccaaaggtgaagagtctatggccgcacgggtttccattgtcaatcaatatggcaaatgtgtgtacgataagtatgtgaagccaactgagcccgtaaccgactaccgcacggccgtatcgggaattcgccctgagaatctgaagcagggcgaagaactggaagtagtgcaaaaggaggtggcagagatgttgaagggccgcatcctggtggggcatgccctgcataatgacctgaaatccgggcggcctagcctgaggttgttatcagaaaaaatcctcggcttgcaagtgcagcaagattctgggtgcccaggatccaatgaggcggtaaggcatggggaagaaggcgttggtgagcacgggcctagacaggcacctcctgccgactgttctcgaccactgcagtag

SEQ ID NO: 203199 - DNA, 702 bp, Artificial Sequence
  Description of Artificial Sequence: Synthetic coding sequence
atgggcaaggccaaggtgcccgccagcaagcgggcccccagcagccccgtagcgaaacctggccctgtcaagacattgactcggaaaaaaaataaaaaaaaaaagcgattctggaagtctaaggctagagaagtttctaaaaagcctgcctccggtcctggagccgttgtgagaccccctaaagcacccgaagattttagtcagaattggaaggcacttcaagaggttccacggtggacaggcggcagacaatatctggccccccgcccagtcgagcagtctacgattaggaaggagccacgcaaaggccagatggtgatcttattccagaacgagggaacaagctcaattcgcagcgggaagctgcgccgccagccccaaccccacccgccacgtgaggaactcgaagtggttcagaaggaagtcgccgagatgttaaagggacgcatactggtgggccacgccctgcacaatgacctcaaagttctcttcctcgaccatcccaaaaagaagattagggatacacaaaagtacaaaccattcaagagccaggttaagtcaggaaggccatctctgcgcctgctgagtgagaaaatcctcggactacaggtccagcaggctgagcactgctcgattcaggacgcccaggcagcgatgcggctgtacgtgatggtgaagaaggagtgggagtctatggcttag

SEQ ID NO: 203200 - DNA, 996 bp, Artificial Sequence
  Description of Artificial Sequence: Synthetic coding sequence
atgagccgggcccggggcgccctgtgccgggcctgcctggccctggctgctgcgctggctgcactgctactcctgcccctccctttgcctcgggcccctgcccccgccaggaccccagctccagctccacgcgctcccccttcgcgccctgcagcccctagcttgcgaccagatgacgtgttcattgcggtcaagactacccgaaaaaatcatggcccacgtctcaggctgcttttgcgcacttggatatcacgggctagacagcagaccttcatctttacagacggtgacgatcctgagctggagctgcaaggcggtgatcgggttattaacaccaactgctccgcagtcaggacacggcaggctctgtgctgtaagatgtccgtcgaatacgacaagttcattgaatccggccggaaatggttttgccacgtcgatgatgacaattatgttaacgcaaggtcccttctacacctcctctcatcctttagcccaagtcaggatgtgtaccttggccgcccaagcctggaccaccccattgaggcgacagagagagtgcagggaggacggactgttactaccgtaaaattctggtttgccaccggtggggctgggttctgcctcagtcgcggcttggcgctgaagatgagtccgtgggcatccctgggaagttttatgtccaccgcagagcaggtgaggctgccggatgactgtactgtgggctatatagttgaagggttgcttggtgcgcgtttgttgcatagccccctattccatagccacctggagaacctgcagcgacttcctccggataccctgctccagcaggtgacgctaagtcatggcggacctgagaacccgcataatgtggtcaatgtggcgggcggtttctcactccaccaggatccgactcgcttcaagtcgatccattgcctgttgtaccctgacaccgattggtgcccccgtcagaaacaaggcgcaccgacttctcgatag

SEQ ID NO: 203201 - DNA, 873 bp, Artificial Sequence
  Description of Artificial Sequence: Synthetic coding sequence
atgagccgggccccccccagccggcccgccgcccccagcctgcggcctgatgacgtgttcattgcagtcaagaccacaaggaagaaccacggtccaaggctgcgcttgctgctccggacttggattagccgggcaagacagcaaacatttatattcaccgacggggacgatccagagctggaattgcagggaggtgacagggtgattaacactaattgttctgcagtgcggactagacaggcactgtgttgcaaaatgagcgtcgagtacgacaaattcattgagagtggcagaaaatggttctgccacgtcgacgatgataactatgtaaacgcaagaagcctactgcatctgctcagttcattctcaccatctcaggatgtgtacctgggtcgcccgtcccttgatcatccaattgaggctacagagagggttcaaggtggcagaaccgtgacgacggtaaagttctggtttgccacgggaggggcgggtttctgtctatcaaggggcctagcactgaagatgtccccctgggcctctctgggtagcttcatgtccaccgcggaacaagtgcgcctgccagacgactgcacagttggctatatcgtcgagggcctgctcggcgcacgcctgctgcatagccctctattccacagtcatctggagaacctccaaagactcccaccagatacacttctgcagcaggtcaccctgagccatggcgggcctgagaacccccacaacgttgtgaacgtagccgggggcttctccctccaccaggatccgacaagattcaagtccattcactgcctgctgtaccccgacacagactggtgccctaggcaaaaacagggagcccccacctcacggtag

SEQ ID NO: 203202 - DNA, 1626 bp, Artificial Sequence
  Description of Artificial Sequence: Synthetic coding sequence
atgggcagccaggaggtgctgggccacgccgcccggctggccagcagcgggcttttgctccaggtccttttccgcctcatcacttttgtcttaaatgcattcatcctgcggtttctgtccaaggaaatcgtcggcgtggtcaatgtgcgccttaccctgctatatagcaccactttgttcctagctagagaagcctttagacgggcttgtctgtcaggcggaacgcagcgcgattggtcacagaccctcaatctgctgtggctgacggtgcccctgggagtgttctggtcactttttctggggtggatctggctgcagctcctggaggtacccgacccaaatgtagtgccacattatgccacaggcgtcgtgctgtttgggctgagcgcggtcgtggagctgctcggggaacctttctgggtcttggcgcaggcacatatgttcgtcaagctgaaggtcattgccgagtcgctctccgtcattctaaaatcagtgttaactgctttccttgtgctttggctgccccattgggggctgtacatcttttctcttgctcagttgttctataccacagtgttggtgctttgttatgtaatctacttcactaaactattggggagtcctgagagtacaaagctgcagaccctacccgtcagcagaatcaccgatttattgcccaacattacaaggaacggggcgttcatcaactggaaggaagctaagctgacgtggagttttttcaaacagagctttttgaagcagatcctgacagaaggagaaagatacgtcatgacatttcttaatgtcctgaattttggagaccagggcgtctacgatattgtgaacaatctggggtcgctggttgctcggctgatctttcaacccatcgaagaaagtttttatatcttcttcgcaaaagtacttgaacggggaaaggatgctaccctgcaaaagcaagaagacgtggccgtcgcagctgcggtcctggaatcgttgctgaaactggcactgctggcaggcttgacaatcaccgttttcgggttcgcctatagccagttggcgctcgatatatatggagggactatgctgagctccggaagcggaccagtcctgcttagatcatattgcttgtacgtgctgctcctggctattaatggcgtgaccgaatgcttcacgtttgctgccatgtcaaaagaggaagttgatcgatataatttcgtgatgcttgcacttagttcttccttcctggtactcagttatctattgacaagatggtgcggtagtgtggggtttattctcgctaattgtttcaacatgggcatcagaatcacccagtccttgtgcttcattcatcgatattatagaagatccccgcaccggccattggccgggctgcacctcagcccggtcctgctggggacgttcgctttgtctggtggagtgacagcagtctccgaagtgttcctctgctgcgagcagggatggccggccaggcttgctcacatcgctgtgggggcattctgcctcggcgcaacactgggtacggccttcttgacagagaccaaattgattcacttcctgaggactcaattgggtgtccctcgtagaacagataaaatgacctag

SEQ ID NO: 203203 - DNA, 1509 bp, Artificial Sequence
  Description of Artificial Sequence: Synthetic coding sequence
atgggcagccaggaggtgctgggccacgccgcccggctggccagcagcgggcttctcctccaggttttattcagattaatcacctttgtgctgaacgcctttattctgcgtttcctgagcaaggagattgtgggcgtggtgaacgtgcgggttccactgggagtgttctggagtctgttcctggggtggatatggctgcaattactggaggtgcccgaccctaatgtggtcccgcactatgccaccggagtggttttattcggcttaagcgcagtggtggagctgctgggcgagcctttttgggttctggctcaggcacacatgttcgtgaaacttaaggttattgctgaatctctcagtgtgatactcaaaagcgtacttactgcttttctagtcctatggctgccacattgggggctctatattttttccctggcccagctcttctatactacagtcctggtcctttgttacgtgatctactttactaagctgctgggcagccccgagagcaccaaactacaaaccctgccggtttcacggatcactgacctgcttcctaatattacaaggaatggggctttcatcaattggaaagaagccaagctgacatggtcctttttcaaacagagcttcctcaagcagatccttacagaaggcgagcgatacgtgatgacgtttctaaacgtgttaaacttcggggatcagggagtctacgacattgtgaacaatctgggtagtttggtagcacggctgattttccaaccgatcgaggaaagtttctacatcttctttgccaaagtgctggagcggggcaaagatgcgactcttcaaaagcaggaggatgtcgccgttgcagccgccgtcctggagtctctgctaaagctggctcttctcgctgggcttacaattacagtattcggcttcgcatactcccagctcgcgctggatatttatgggggaacaatgttgtcgtcgggctcaggccccgtgcttctgaggtcatactgcctgtacgtgctgctgttggcaatcaacggcgttacagaatgctttacgttcgctgccatgagcaaggaagaagtcgatcgttacaacttcgtcatgctagctctgtcctcctcttttctggtgctatcatacctcctgactaggtggtgtggctctgtcggtttcatacttgccaattgctttaacatggggattcgcattactcagagcctctgtttcatccaccgctattatagaaggtcgcctcatagacctcttgcggggctccacttaagtcctgtcctgttagggacatttgccctatcgggcggcgtcaccgctgtgagtgaagtgtttctgtgctgtgaacagggctggcctgcacgcttagctcacatcgctgtgggcgccttctgcctgggcgcaactctcggaactgctttccttactgaaacaaaactgatccatttcctgaggacccaacttggagtgccgcgtcggacagacaagatgacgtag

SEQ ID NO: 203204 - DNA, 4308 bp, Artificial Sequence
  Description of Artificial Sequence: Synthetic coding sequence
atggcccagacccccgacggcatcagctgcgagctgcggggcgagattacccgattcctgtggcctaaggaggtcgaattgctcctgaaaacttggctccccggcgagggggccgtccagaaccatgttctggcgctgctgaggtggcgagcttacctcctccacactacgtgcctgcctttaagggtcgattgcaccttctcatatctggaggtacaggcaatggctctgcaggagacacctcctcaggttaccttcgagctggagtctctccgcgaactcgtgctggagttcccaggggtagcagccttggagcagctggcacagcatgtggcggctgccataaagaaggttttccctaggagcaccttaggaaaattgtttaggcgccccacccctgcctcaatgctcgcccggcttgagcgaagcagcccctcagaatcgaccgacccctgttctccatgcggggggttcctggaaacttacgaggccctctgcgattacaacggatttccttttagagaagagatccagtgggacgttgataccatctatcatagacagggctgtaggcatttcagccttggagacttttcacacctggggtccagggacctcgcgttgagcgtcgcagcattgagctacaacctgtggtttcggtgtctttcttgcgtagacatgaaattgtcactggaggtttcggaacagatcttgcacatgatgagccagagtagccaccttgaagaactggtgctggagacatgttccctgcgcggagacttcgtcagaagactggctcaggctctggccgggcacagctcttctggccttagagaactgagtctggccggtaacctcctggacgaccgcgggatgaccgcgctatcacgccatctggagagatgtcctggagccctacgacgtctatccctggcccagacaggtctgacgcctagggggatgcgtgccctgggtagggctctggccaccaatgcagctttcgatagtacattaacccacctggacctttccgggaaccccggggcccttggggcctccgaggacagcgggggcctatactcattcctcagcaggcctaacgtgctgtcttttctgaacctagccggtacggacacagccctggacacagtgcgtggctgctccgtgggaggctggatgacaggaagggctgattggcgcgcaggcagggggggtctaggacctccggctggggttgccaattcgctcccccctcagttattcgcagctgtgtcccgaggatgttgtacttctctcacccatctggacgcgtcaaggaacgtgttcagtaggactaagagccgtgcagctcccgcagcccttcagctctttctgagccgggccaggaccctgcgccatttaggtctcgcagggtgcaagctgcctccagatgcactacgagcgctgctggacgggcttgcactgaatacccacttacgcgatctgcatctggacttaagcgcatgcgagctgcgctcggccggtgcccaggttatacaagacttggtgtgcgatgcaggggccgtctcgagccttgacctggcagacaatggatttggcagtgatatggtgacccttgtcttggccataggacgttctagatctctccgccatgtagctctgggtcgaaactttaatgtacggtgtaaggagaccctagacgacgtgctgcataggatcgtccagctcatgcaggacgacgactgccccctgcagtccctgagcgtcgcagaatcccgcttgaaactcggtgccagcgtgttactcagggctctggctaccaacccaaacctgacggcgctggacatctccggaaatgctatgggcgatgcaggggctaagttgctggcgaaagcacttcgggtcaactcccgtctccgatctgtggtttgggaccggaaccacacatcagccctcggcctgcttgatgtcgcgcaagccctagagcagaaccattcactgaaagccatgcccctgcccttgaatgacgtggctcaagcacaacggagccgccccgaactaacagctagagccgtacaccagatccaggcttgtctgttgagaaacaacagagccgatcctgctagctctgaccacacgactcggctgcagcctctcgggttggtatctgacccaagtgaacaggaagtgaatgaactttgccagtccgtgcaggaacatgtagagttgctggggtgcggtgccggtcctcagggagaagcggctgttcgacaggccgaggatgcgatacagaacgcgaattttagcctctcaatcctccccatcttgtacgaggctggcagtagtcctagccaccattggcagttaggacagaaactggaagggttgcttaggcaggttggggaagtgtgtaggcaggatatccaggacttcactcaggccacgcttgacacagcccgcagcctatgtccacagatgttgcaggggtcaagctggagggagcaactggaaggagtgttggcagggtctagggggctcccagagctgctgcctgaacaactgttacaggacgcattcacgcggttaagagatatgagactgtctattactgggacactggccgagtcaatcgttgctcaggccctggctggtctttccgccgctcgggaccagctagtggagagcctggcccagcaggctaccgtgacaatgcctcccgcactacccgctcccgatgggggtgagcccagtctcctcgagcccggcgaactcgaggggttatttttcccggaagaaaaagaggaggaaaaagagaaggacgacagcccgccgcagaagtggccagagttgtcacatggactccatctggtgccattcatccacagtgccgcagaggaggctgaaccggagcccgagcttgccgcccctggagaggatgccgagcctcaagctggaccctccgcgagaggatcccccagccccgccgccccagggcccccggccggccctctgcctcggatggacctgcctctggcaggccagcccctcaggcaccccacccgcgcccgacccagaccccggaggcagcaccaccacagaccacctccgggtgggccgcaggtgcccccagctctcccccaagaaggaaatggcttatccgctcgcgtggatgagggcgtagaggagttcttcagtaagcgcctcatacagcaggacagattatgggcccccgaagaggatcctgcaacagagggcggagcaactccggtgcctcgcacgctccgtaagaagcttggaaccctcttcgcctttaagaaaccaagaagcacacgcggcccgagaacagatctggaaactagtccaggggcagcaccaagaacccgcaagacaacatttggagatcttctcagaccgcccactagacccagtaggggcgaggagttggggggagcagaaggggatacctccagtccagatcccgctggaaggagtcgcccccgctatacacgggatagtaaagcttacagcatgatcctgttgccagctgaagaggaggctacgctgggcgcaaggccagataagcggcgccccctcgagcgcggcgagacggagttggctccctcttttgaacagagggtccaggtgatgttgcagcgtatcggcgtatctcgagggtcaggtggggccgaaggcaaacgaaagcaatctaaggatggggagattaagaaggccggctcagatggggatataatggactcctcaacagaagctcctcctatcagcatcaagtctcgcacacacagcgttagcgccgatccctcctgtaggcccggccccggctcacagggccctgaatcagccacctggaaaaccttgggtcaacagttgaacgccgagctcaggtcacgggggtggggccagcaggacggtcccggacccccgtcaccagggcaatcgccatcaccctgtcgtacatcaccatcccctgactcccttggcctgccagaggatccctgtttgggaccaaggaatgaagacggccagttaagacccaggccgctcagcgccggccgaagagccgtctccgtacatgaggatcagctacaggccccggccgagcgccctctgaggttgcaaagaagcccggtcctgaagcgcagacccaagttggaagctcccccctccccgagtctgggatccgggttggggacagaacctctaccccctcagcccaccgagccctcgtccccagagcgctcaccgccatcccccgcgacagatcagcggggcggtggccctaacccctag

SEQ ID NO: 203205 - DNA, 1335 bp, Artificial Sequence
  Description of Artificial Sequence: Synthetic coding sequence
atgccccccgccctgcccgcccccgacggcggcgagcccagcctgctggagccaggggagttagagggccttttcttcccagaagagaaagaggaggagaaagagaaggatgactcaccgccccagaagtggccggaactctcacacggactgcacctggtgcctttcattcacagcgccgccgaagaggcagagccagaacccgagctcgccgcgcctggtgaggatgccgaaccccaagcagggccgtccgcacgcggctcccccagtccagccgcccctggaccccccgccggccccttaccaaggatggatctacctcttgctgggcaaccattgcggcaccccacacgagcaaggccacgtccaagacgccagcaccatcatcggccgccacctggcggccctcaggtcccacctgctcttccccaggagggcaatgggctgtccgcccgcgttgacgagggcgtggaggagtttttttccaagaggctcatccaacaggacagactctgggcacccgaggaggatcctgccacagaaggcggcgccacccctgtaccaaggaccctgcggaaaaagctggggactttgtttgccttcaagaaacctagatctaccagagggcccagaacagatctggagacatcacccggagcggccccaagaacccggaagaccacatttggagatcttctgcgcccacccactcggccgagcagaggagaggaactgggcggggccgagggtgatacctcctccccggatccagcgggacgctcacgtccgcgttatactagggatagcaaggcttactcaatgattcttttgccggctgaggaagaagctactctgggggcccgaccagacaagcgcaggccgctggaacgcggcgagacagagcttgctccctcctttgagcagcgggttcaggtcatgcttcagcgtataggagtgtcccgggggtctggaggcgccgagggcaaacgaaagcagtcaaaggacggggagattaaaaaagctgggtcagatggtgacattatggattccagcacagaagctccacctatttccatcaagagccggacccattctgtgagcgccgacccctcctgtcgcccgggaccagggagtcagggtcctgaatctgctacttggaagacgctcggacagcagctgaacgccgagttacggtcgagagggtggggccaacaggacggccccggtcctccctcacccggtcaatcaccctccccttgtagaacaccaccccagacagcatgggcctcccagcggaccttggcttgggcccccgagatgaagaatggcccttag

SEQ ID NO: 203206 - DNA, 4119 bp, Artificial Sequence
  Description of Artificial Sequence: Synthetic coding sequence
atggcccagacccccgacggcatcagctgcgagctgcggggcgagatcactagatttctatggccaaaggaagtcgagcttctcttgaaaacgtggcttcccggggaaggcgctgtgcagaaccatgtgttggccctgctgcgctggagagcatatcttctgcacaccacctgtctgcccctgcgcgtggattgtacattcagctaccttgaggtgcaagctatggcgcttcaagaaacccctcctcaggttacatttgaactggagtcattgcgagaactcgtactggaattccccggggtagctgccctggagcagcttgctcagcacgtcgcagcagcaattaagaaagtcttcccccgaagcaccttgggcaagctgtttcgcagacccacaccagcctcaatgttagcacggctggaaaggtccagcccaagtgaaagcaccgacccatgctcaccatgtggaggattcctggagacatacgaggcgctgtgcgactacaatggcttcccctttcgcgaggagattcagtgggacgtggacactatctaccacagacaaggttgcagacacttcagtctcggcgacttcagtcatttaggtagtagagacctcgctctgagcgttgcggcactgtcttataatctctggtttcggtgtctatcatgcgtggacatgaagttatcactagaggtgagtgaacaaatcctgcacatgatgtcccagtcctcacatcttgaggagttagtgctcgagacatgttcactacggggggatttcgtacgtcgccttgcacaagctttggccggacactctagttcgggactccgggagctctctctggctggtaacctgctcgatgataggggtatgactgctctgtcacgccacctcgaacgctgccccggggcattgcggcgcctgtccttggctcaaacaggactgactcctcgtggaatgcgagcgctcggaagagcgctggctaccaatgccgcattcgacagcactctgactcacctagacctgtctgggaaccccggagcactcggagcaagcgaggattctggtgggctctactcgttcctgtcacggccaaatgtcttaagctttttaaacttggcagggactgatacagctttggatacactctttgccgctgtgtccagaggatgctgcacgagtctgactcacttagatgctagtcggaacgttttttcaagaacaaagtcccgagccgccccagccgccctgcagctattcctctctcgcgcaagaacactccgccatctgggcctcgctgggtgtaagttgccccctgatgccctgagggccctcttggatggccttgccttaaatacacacctgcgcgacctacacttggacctcagtgcctgcgagctaagatctgcaggggcacaggtcatccaggacttggtgtgtgacgccggtgctgtatcctctctggacctggccgacaatggatttggaagcgacatggtgacattagtgctggccatcggaagaagtcgatccctccggcacgtggccctcggccggaatttcaatgttcgctgcaaggaaaccttggatgacgtgctgcatcgcattgtgcagctgatgcaggacgacgattgcccacttcagagcttatccgttgcggagagccgactcaagctcggggcttcggtgttgctccgcgctctcgcgaccaatcctaacctgactgcactggatatctcaggaaacgctatgggcgacgccggcgctaaactcctagcaaaagcactgagggtcaatagccgactccggtctgtggtctgggatcgaaatcatactagcgcactgggcctgttagacgtcgctcaggccctggagcaaaatcatagcctgaaggcaatgcccttgcccctaaatgacgtcgcccaagcacagcggtcacggcctgagctgacagcccgagcggttcatcagatacaggcctgtctcctccgtaataatagagctgaccccgccagtagtgatcacacgacacgacttcagccccttggcttggtgagcgatcctagtgagcaggaggtgaacgagctttgtcagagtgtgcaagaacacgtcgaacttcttgggtgcggcgctggaccccagggggaagcagccgtgcgtcaggccgaagatgctattcagaacgccaatttttcactttccatcttgcccatcctgtacgaggccggctcctcaccctcccaccattggcaactgggccaaaagcttgagggactgctgcgtcaggtgggagaggtctgcaggcaagacatacaggatttcacacaggccacacttgataccgcgcggtcactttgcccacagatgctccagggttcctcttggcgcgagcagttagagggtgtgctcgccggatcccgaggactgcctgaattgttgccagaacagctgttacaagatgccttcaccaggttaagggatatgcgactaagcattacagggactctagccgaatccatcgtggcgcaggctcttgccggcctcagcgcggccagagatcagctggtagaatccttagcccaacaggccacagttaccatgcctcctgccctgcccgcccctgacgggggagaaccatctttattagaaccaggcgaattggaaggcctattcttccctgaggagaaggaggaagagaaggagaaagacgattccccaccgcaaaagtggcccgaactctctcacggcctgcatctagtccccttcatacattctgcagccgaggaggcagagcctgagcctgagctggccgcgcctggggaagacgccgagccccaggctgggcctagcgcaagagggagccctagcccagccgctccgggtccacccgccggacccctgccaagaatggatttacccttggcaggccagccgctccggcatcccacaagggcccgtcctagacctagaagacagcatcatcatcgccctccgccagggggcccccaggttccaccagcgctgccgcaggaagggaacgggctgtcagccagagtggacgaaggcgttgaggagtttttttccaagaggttgattcaacaagatcgcttgtgggcccctgaggaggaccctgccaccgaggggggagctaccccagtgccaagaaccctgagaaaaaaacttggtactctgttcgcgtttaaaaaacctcgctcaactcggggccctaggaccgatctagaaacttctcctggcgccgctccaagaacacgcaagacaacattcggagacctcttgagaccacccacccggcctagcaggggagaggaactgggaggagctgagggcgacacatccagccccgaccctgcaggccggagccgacccaggtataccagggactcaaaggcctactcaatgatcctgctccccgcagaagaagaggctactttaggcgcgaggccagacaaaaggcgcccccttgaaaggggagaaaccgaactcgccccttccttcgaacagcgcgtgcaggttatgctgcaacgaatcggagttagtaggggatctgggggcgccgagggtaaaagaaagcagtcgaaagacggagaaatcaaaaaagccgggtctgacggcgacattatggattccagtacagaagccccgccgatctctataaagagtcgtacccactctgttagcgccgacccttcctgcaggcctgggcccggaagtcagggccctgagagcgctacttggaagacactcgggcagcagcttaatgcagagctccgtagccgcggctggggccaacaggatggaccaggtccacccagtcccggccaatcccctagcccttgtcgcacctcaccaagcccggacagtctgggcctgccggaggatccatgcctcggtcctcgaaacgaggaaagacccttgcgcttgcagaggtctccggttttaaagaggcggcccaaactggaggcaccgcctagcccttctttagggagtgggcttggaacagaaccccttcccccccagccgacagaacccagttcccctgaaagatctcctccatctcccgccacagaccagagggggggaggaccgaacccgtag

SEQ ID NO: 203207 - DNA, 1305 bp, Artificial Sequence
  Description of Artificial Sequence: Synthetic coding sequence
atgggcatgggccggggcgccggccggagcgccctgggcttctggccaactctcgcatttctcttatgttccttccctgcagctacatccccgtgcaagattttaaagtgtaattcagagttctggtcagctacatcgggatcacatgcaccagccagtgatgacacacctgaattttgtgcagcattaaggtcgtacgccctctgtacacgcaggacagcccgaacctgtcggggggatctggcctaccattctgctgtccacggaatcgaggatttgatgagtcaacacaattgtagcaaggacggaccaacaagccagccaaggctgaggactctgcctccagccggcgacagtcaggagcgctctgactcccctgaaatttgccattacgaaaaatcttttcacaagcactctgctacacctaactatacccattgcgggctcttcggcgacccgcacctgcgcacttttacggacaggtttcagacttgcaaggtacagggggcctggcccctcattgataataattatctgaatgtccaggtaacaaacacccctgtgttgcctggctctgccgcaacagctacatctaaactaacaatcatcttcaagaattttcaggagtgtgttgatcagaaagtatatcaggctgaaatggacgaattgccagccgcttttgttgacggctccaagaacggcggagataaacacggagccaacagcttaaaaatcaccgagaaggtatctggacagcacgtggaaatccaggcgaagtatatcggcactacgatcgtagtgcgtcaggtgggcaggtacttgacgttcgccgtacggatgccggaggaggtagtaaatgccgttgaggactgggactcccagggactatatctttgcctgagaggttgtcccctcaaccaacagattgatttccaggcctttcacacgaatgctgaaggaacgggcgcccgcagactggctgcggcctctcctgctcctactgcacccgagacgtttccctatgaaacagccgtagccaagtgcaaagagaagctgcctgtggaagatctgtactaccaggcatgcgtattcgaccttctgaccactggcgacgttaacttcaccctggcagcatactatgcactcgaagatgtgaaaatgttacattcaaacaaagacaagttgcatctgtacgatcggacaagggatcttcctggtagagctgctgccggtctgcccctggctccaaggcctctgctgggggcgctggtgccactgctcgcgctgttgcccgtgttttgctag

SEQ ID NO: 203208 - DNA, 1353 bp, Artificial Sequence
  Description of Artificial Sequence: Synthetic coding sequence
atgcagcccccccgggagcggctggtggtgaccggccgggccggctggatgggaatgggtaggggggctggcaggtcagcattgggattctggccaaccttggccttcctgctgtgttcatttccggcggctaccagtccatgtaagattctgaagtgcaactcagaattctggtctgcaacttcagggagtcatgcgcccgcatctgatgataccccggagttttgtgccgccttgagatcatatgccctctgtacccgcagaaccgcccggacttgtcggggggatttagcttatcactctgctgtgcatggcatcgaggatctgatgtctcagcacaattgtagcaaggatggccctacctcacagcccagacttcgcacccttccccctgctggtgactctcaggagcgatcagatagccccgaaatttgtcactacgaaaaaagttttcataaacactcagccactccgaactatactcattgtggattattcggcgatcctcacttgcggaccttcaccgacagattccagacctgtaaagtccagggagcctggccacttatcgacaacaactatctgaacgtacaggtaactaacacccctgtgctccctggaagcgctgccaccgcaacatccaaactgacaatcatattcaaaaatttccaggagtgtgtggatcagaaagtgtaccaggccgaaatggatgagctgccggcagcattcgtggatggatccaagaatggaggagacaagcatggggccaattcattgaaaatcaccgaaaaagtcagtgggcaacacgtagagatccaggccaaatatatcgggaccaccattgttgtacgccaggtgggcaggtacctgacctttgccgtgcggatgccagaggaagtcgttaacgcagtcgaggactgggactctcaggggctatacctgtgcctgagagggtgccccctgaaccagcagatcgattttcaggcctttcacaccaacgcggaagggactggggcacggcggttggcggcagctagtcccgctccaacggctcccgagacatttccttacgaaactgcggttgctaaatgtaaggagaaactgcccgtggaggacctgtactatcaggcctgcgtcttcgatctgctgaccactggcgacgtcaacttcactcttgccgcttattatgcactggaagacgttaagatgctccattctaataaggacaagctgcatttgtacgaccgaacccgcgacctaccaggaagggccgcagccggcctccccctggcgccaagacccctgttgggcgccctcgttcctctgcttgctctgctgcctgtcttttgttag

SEQ ID NO: 203209 - DNA, 1305 bp, Artificial Sequence
  Description of Artificial Sequence: Synthetic coding sequence
atgggcatgggccggggcgccggccggagcgccctgggcttctggccaactctcgcctttttactttgttcatttcctgctgccacctcaccttgtaaaatcctaaagtgtaacagcgaattctggtccgcaactagcggctcgcacgcccctgcctcggatgatacccctgagttctgcgctgcacttagatcatatgctctctgcacccgtagaaccgctagaacatgtcgcggagacttggcttatcacagtgcagtgcatggaatcgaagacctgatgtcacaacataactgtagcaaggatggcccaaccagccagcccagactaagaactctgcccccagcaggtgattcgcaggaacggtcagactcccccgagatatgtcattatgagaaaagctttcacaagcactcagcaactccgaattacactcactgcgggctgttcggagacccacacctgagaacctttacagatcggttccagacgtgcaaggtgcagggcgcgtggcccctgatagacaataactatctcaacgtgcaagtgaccaataccccagtgctccctggatccgctgccacagccactagcaaacttaccataatctttaagaactttcaagaatgcgtggatcaaaaggtttaccaggccgaaatggacgaactgccagccgctttcgtggatggctctaagaatgggggcgacaagcatggagccaactctttaaaaatcactgagaaggtctccgggcagcatgtggagatacaggctaagtacatcggaacaaccattgtggtgcgccaagtgggacggtacctcacttttgcggtgcgcatgcccgaggaggtggtcaacgcggtcgaagattgggacagccaggggctctacctgtgtctgaggggttgcccgctcaaccagcagatcgattttcaggcgtttcacactaatgcagagggaacgggtgcccgccgactggcggcagccagcccagcccctaccgcacccgagacttttccttatgagaccgcggtggccaagtgcaaagagaaacttcctgtggaggatctgtattaccaggcatgcgtttttgacctgcttaccactggagatgtcaacttcacactggcagcatattatgcgctcgaagacgtcaaaatgctccatagcaacaaggataaactacatctctacgacagaacacgcgatttgcccgggcgagctgccgctggactgccccttgctccccgtccgctgctcggagcattggtacctctgcttgcactgctgcccgttttttgttag

SEQ ID NO: 203210 - DNA, 1026 bp, Artificial Sequence
  Description of Artificial Sequence: Synthetic coding sequence
atgagccagcacaactgcagcaaggacggccccaccagccagccccggctaaggaccctgcccccggccggagattcgcaggagcgaagcgactcccctgaaatctgccactacgaaaagagtttccataagcatagtgctacacccaattacacgcactgtggtttgttcggagacccacacttacgaaccttcactgacaggttccaaacttgtaaggttcagggagcatggccgttgatcgacaataactacttgaatgtgcaggttacaaacacacccgtacttccgggcagcgcggctactgctacatccaagctgaccatcatttttaagaattttcaagaatgcgttgatcaaaaggtgtatcaggctgagatggacgaactgcctgccgcttttgtagacggaagcaagaatggtggcgacaagcatggtgcaaattccctaaaaattaccgagaaagtgtccggacagcacgtggagattcaagcaaagtacatagggaccacaattgtcgtgaggcaggtgggacggtacctgacattcgcagtgcgaatgcccgaggaagtggtcaacgctgtggaggactgggacagtcaaggtctgtacctgtgcctgagaggttgcccgctcaaccagcaaatcgactttcaggcctttcacaccaacgccgagggaactggcgccaggaggctggccgctgcctctccagctccaacagccccggagacctttccttatgagaccgcggtggcgaaatgcaaggagaagctcccagtggaagacctctattaccaagcatgcgtgtttgatctgctgactactggagatgttaactttaccttggccgcctattatgccctcgaagatgtaaaaatgctgcattcaaataaggacaaactacatctctacgatagaacacgcgacctcccggggagggccgccgccggactccccctagccccccgccccctcttaggtgccctggtgcccctcctggcacttcttccggtgttttgctag

SEQ ID NO: 203211 - DNA, 1305 bp, Artificial Sequence
  Description of Artificial Sequence: Synthetic coding sequence
atgggcatgggccggggcgccggccggagcgccctgggcttctggcctaccctggccttcctcctgtgcagctttcctgctgctacaagcccctgcaagatcttgaaatgtaactccgagttctggtctgccacgtctggcagccacgccccggcttctgacgatacaccagagttctgcgcggccctgcggtcatatgccctctgcacccgccgcaccgctcggacatgcagaggagaccttgcctatcattccgcagtccatggcatcgaagatttaatgagccagcataactgctccaaagacggacccaccagccagcctcgtttaaggactcttcctccagctggggattcccaggagcgctccgacagtcccgaaatatgtcattacgagaagagtttccataagcactctgcaaccccgaattacacacactgtgggctgtttggggatcctcatctcaggactttcactgataggttccagacatgtaaggtacagggagcctggcccctgattgataacaattatctgaatgtgcaggtgacgaacacacctgtgttgccaggtagtgctgccaccgccacatcaaagctgacaattatcttcaaaaatttccaggaatgtgtggatcaaaaagtgtatcaggctgaaatggacgaactcccggccgccttcgtggacggcagtaagaatggtggcgacaaacatggagcaaactctctcaagattacggagaaggttagtgggcagcacgtggagatccaggcaaaatatataggaacaacaatagtagtgcgccaggtggggcgatatctcacctttgctgttagaatgcccgaggaggtagtgaatgccgtggaggactgggatagccaaggcctttacctctgtctacggggttgtcctctgaatcaacaaattgactttcaagcgttccatacaaacgcagaagggacgggagcccgcaggctggcagctgcctctcccgctccgaccgcacccgagacatttccctatgagactgccgtggccaagtgtaaagaaaagctccctgtggaagatctctattaccaggcttgcgtgtttgatctacttacaacaggggatgtcaattttacgctggctgcctactatgctttagaggatgtgaagatgcttcactcaaacaaagacaaactacacctctatgataggactagggacctgcccgggcgtgcagccgcgggtctgcctctggcccctaggccccttcttggcgctttagtgccactgctcgctctcttgccggtcttctgctag

SEQ ID NO: 203212 - DNA, 1377 bp, Artificial Sequence
  Description of Artificial Sequence: Synthetic coding sequence
atgggcggcctgggcccccggcgggccggcaccagccgggagcggctggttgtcactgggcgggcaggctggatgggcatgggtcggggcgctggacggtcagcactcggtttctggccgacactggcttttctgttgtgttcattcccagctgccaccagcccatgtaagatcttgaagtgtaacagcgaattctggagtgccacctctggctcacacgccccagctagcgacgatacacctgaattctgcgccgctctccggagctatgcactctgtacgcggaggacagcccgaacatgccggggagatctcgcctatcattcagcagtccatggcatcgaggatcttatgagccaacacaattgctcaaaggatgggcccaccagccagccccgccttcggactttgccccctgctggagattcccaggagcggtcagactccccagagatctgtcattatgaaaagagcttccacaaacacagcgccactcccaactacacccattgcggcctctttggcgacccacatctgaggacctttacagatcgtttccaaacttgcaaagtgcaaggagcatggccgttgattgataacaactatctaaacgttcaggtgaccaatacacccgtgctcccaggaagcgcagccactgccactagcaagctgacaattattttcaagaattttcaggagtgtgtcgatcagaaggtctaccaggctgagatggacgagttacctgccgcgttcgtcgatggaagcaagaacggtggcgacaagcacggtgcgaattctctcaaaataacagaaaaggtgtccggccagcatgtggaaatccaggctaagtatatcggcacaacaattgtcgtgcgtcaggtgggcaggtatctgacttttgccgtcaggatgccagaggaggtcgtcaacgccgtggaggactgggatagtcaaggactctatctgtgccttcgcgggtgccctctgaatcaacaaattgactttcaggccttccacacaaatgcagaggggactggcgccaggcgtttagccgccgcgagccccgctccaaccgcacccgaaacttttccgtacgaaaccgccgtggctaagtgcaaggagaagctgccagtggaggacctctactatcaggcttgcgtgtttgacttgttgactaccggagacgtgaatttcacactcgctgcctactatgcactcgaagacgtgaagatgctgcattctaacaaagacaaattgcacctgtatgatagaacacgtgatttgcctggtagagcagccgccggcctacctctagcaccacggccacttctcggggcacttgttcccttacttgcattattgccagtgttctgctag

SEQ ID NO: 203213 - DNA, 1437 bp, Artificial Sequence
  Description of Artificial Sequence: Synthetic coding sequence
atgatccggaagaagcggaagcggagcgccccccccggcccctgccggagccatgggcctcgccccgcaaccgctccggcacctccacctagcccagaacctacgaggcctgcctggacaggaatgggcctgagggcagcccctagtagcgccgcagcagccgccgcagaggtggaacagcgtaggtctccgggcttgtgtcctccacccctcgaactcctcctgctcctgctgttcagcttgggtcttctgcacgctggagattgccagcaaccagcccagtgtcggatacagaaatgtactacagacttcgtcagcctaaccagccacctcaactctgcggtagacggctttgacagcgaattttgtaaggctttacgggcctatgcaggctgtacccagcgcacgagcaaagcatgtagaggcaacctagtgtaccacagcgctgtgctggggattagcgatctgatgagtcagcgcaattgttcaaaggacggacctacatcctcaaccaatccagaggtaacccacgatccctgcaactatcacagccatgccggtgcacgcgaacatcggcgtggagaccagaacccaccgtcttaccttttctgtggcctcttcggtgacccacacctgcgcacctttaaggacaactttcaaacctgtaaggtggagggcgcttggccactgattgataacaactacctttcggttcaggtcacgaatgtgcccgtggtccccgggagctcagcaacagccacgaataaaattaccatcatattcaaggctcaccacgagtgcaccgatcagaaagtgtaccaggcagttacagatgatctacctgcggcattcgtggacggcacgacttcaggtggagacagcgatgcaaagtccttgaggatcgtggagcgagagagcgggcactacgtcgagatgcatgctaggtacatcggtactaccgtgtttgtaaggcaggtcggacggtacctaactctggcaattcggatgcccgaagacctcgccatgagctacgaggagagccaggatctgcagctgtgtgtgaatgggtgtccattaagtgagcgaattgatgatggtcaaggtcaggtatccgctatccttggccactccctgccaagaacgtcattggtgcaggcctggcctggctacaccctggagactgcaaacactcagtgccatgaaaaaatgccggtgaaggacatctattttcagagctgtgtgtttgacttgctgacaacgggcgatgcgaatttcacagcagccgcgcattctgcgctggaggatgtcgaagctctccacccaaggaaggagcgatggcacattttccccagctccggcaacggaacaccccgtggcggctctgatctgtctgtgagtctcgggttgacgtgcttgattctgatcgtttttctctag

SEQ ID NO: 203214 - DNA, 1314 bp, Artificial Sequence
  Description of Artificial Sequence: Synthetic coding sequence
atgggcctgcgggccgcccccagcagcgccgccgccgccgccgccgaggttgagcaaagacggagtcctgggctatgccccccccctttagagctcttgctgctgctgcttttttcccttggcctgctccatgcaggagattgccaacaacctgctcaatgtcgtattcagaagtgcactacagattttgtgtctctaacgagccacctgaacagtgcagtcgacggttttgactctgaattctgcaaagctcttcgtgcatatgccggctgcacccaacgtactagcaaagcttgccgcggcaatctggtctaccactctgcggtgttgggtatatccgacctaatgtcgcagcgtaattgctctaaagacggtcctaccagctcaaccaacccagaagtgacccatgacccctgcaactaccatagccatgccggggctagggaacaccgtcgcggagatcaaaatcctccatcttatttattctgcggtctgttcggagacccccatcttagaaccttcaaagataactttcagacatgcaaagttgaaggtgcctggccactcatagacaataactatttgagtgtgcaagttacaaacgtgcctgtggtgccaggttccagcgcaactgcaactaacaagatcacaatcatatttaaagcccaccacgagtgcacggaccaaaaagtgtaccaggctgtgactgacgatctacccgctgcctttgtggatggcaccactagcgggggagattcagacgcaaagtcactgagaatcgttgaacgggaatccggccattacgtcgagatgcacgctcggtatattggcaccacggtattcgtgcggcaggtaggtcgctatctgaccctagccatcaggatgcctgaggacctggctatgtcctacgaagaatctcaggacctgcagctgtgcgttaatggttgtcctctgtcggaaaggatagatgatggccagggccaggtttccgctattctcgggcattcactgcctcgcacgtccctggtccaagcttggcccgggtacacacttgagactgctaatacacagtgtcatgagaagatgcctgtaaaggacatttacttccagagctgcgtattcgatctacttacgaccggggacgccaacttcacagccgccgcccacagtgctttggaggacgtcgaagccctgcacccgcgtaaggagagatggcatatctttccgtcctctggcaacgggacacctagaggtggatctgatcttagcgtttctttaggtttgacttgtcttattctcattgtatttctctag

SEQ ID NO: 203215 - DNA, 1176 bp, Artificial Sequence
  Description of Artificial Sequence: Synthetic coding sequence
atgatcgaggtggtggccgagctgagccggggccccgtgttcctggctggcgaagccctagagtgcgttgtcactgtgaccaatcccctgcccccgactgcaacatcagctagcagcgaggcactggcctgggcgagtgctcagatccactgccagtttcacgcaagtgagagccgggttgccctaccgccgcctgacagctctcagccagacgttcaacccgatagccagaccgtctttctgccccataggggtgagagaggacaatgcatcttgagcacccctcccaagattctgttttgtgacctccgcctggatccaggggaaagcaagtcctatagttattctgaggtgctacctattgaggggccaccgtctttccgtggccaatccgtcaagtatgtttataagctgacaattggttgccaacgtgttaactcccctattaccctgttgagagtgcctcttagggtcttggtgctaaccggtctgcaggacgtgcgcttccctcaggatgaggcagttgccccttcttctcccttcctggaagaggatgaagggggaaagaaggactcgtggctggccgagctcgctggggagaggctgatggccgccaccagctgtcggtcactccatttgtacaacatctccgacggccgggggaaagtaggaacttttgggatctttaagtccgtttataggctgggcgaggacgtggtgggcaccctgaatctgggggagggcactgtcgcgtgcctgcaattttccgtctccctgcagaccgaggagcgcgtccagcccgaataccagcggcgacggggtgccggaggagtgccttccgtttctcacgtgactcacgctagacaccaagagtcctgccttcacactacacggacttccttttctctgccaatccccttgtctagcaccccagggttttgcaccgccattgtttccctaaaatggaggctacactttgagtttgtgacttcccgggaaccggggttggttcttttgccaccagtcgaacagcccgagcctaccacctggactggacccgagcaggtgcctgtggatactttctcatgggatctgcccattaaggtgctgccaactagtcctacattagctagttacgctgctcccgggccaagtacatcgactatcaccatctag

SEQ ID NO: 203216 - DNA, 1296 bp, Artificial Sequence
  Description of Artificial Sequence: Synthetic coding sequence
atgacccgggccctgagcggcctggcctgccgggccctgcccgccgggcgtgattctgcagaggggctcggcgtgccaatcccaagtgtggactatgcacgttccgacagcggggcagctatgatagaagttgtggccgagctctcccgcggccccgtgttccttgctggggaagccctcgagtgcgtggtaacagttactaaccccttacctccgactgccacctcagcgagctcagaagccctagcgtgggcctctgcgcagattcactgccagtttcatgcttcagaaagcagagtcgccctccccccacccgattcttcccagcccgacgtgcaacctgactcccagactgtctttttgcctcaccggggtgaacgggggcaatgtattctctccacaccaccaaaaatcctgttctgtgacctaaggctcgaccctggagagtccaaatcctattcttacagcgaagtcctgccaatcgagggcccaccgagcttccgagggcagagcgtcaagtacgtgtataagcttacaatcgggtgtcaacgtgttaatagtcccatcacactccttcgggtacctctccgggttttagtgctcacgggattgcaggatgtgcgatttccgcaggatgaggcggtggctccaagttccccattcctggaggaagacgaaggcggaaaaaaagattcctggttggcggagctggcaggcgagcgcctcatggcagctacatcttgccgctccctgcacctctataacatctccgacggtcggggcaaagttgggactttcggcatattcaagagcgtttatcgacttggtgaggatgtagtcggcacactgaacctcggagaaggaacggtcgcgtgcctgcagtttagcgtatctcttcagaccgaagaacgggtccagcccgagtaccagaggcggagaggggcgggtggcgtcccgtccgtctcccatgtgacgcatgcaaggcatcaggaatcctgtctccacacgacaaggacttctttctccctccccatccccctttcctctactcctgggttttgcacagcaattgtctccttgaagtggcgccttcactttgagtttgtgacgtcgagggagccaggactggttttgcttcctcccgtggaacagccagagccgactacgtggactggcccagagcaggtcccagtggacaccttcagctgggacctcccgattaaagttctgcctacatctccgacattagcgtcttacgccgcccctggcccatccacatcgactattactatttag

SEQ ID NO: 203217 - DNA, 1119 bp, Artificial Sequence
  Description of Artificial Sequence: Synthetic coding sequence
atgagcagcaagtacccccggagcgtgcggcggtgcctgcccctgtgcgccctgacccttgaggccgccctgatcctcctgttctactttttcacacattatgacgcgtccttagaagatcaaaagggtttggtcgcctcttaccaagtgggccaagacctgaccgttatggccgcgttggggttgggctttctgactagtaacttccggcgccattcctggagctctgtggcatttaacttgtttatgttggccctgggggtccagtgggccatcctgctggacggctttctgagtcaatttccccccgggaaggtggtgataaccctctttagcatcaggcttgccactatgtccgccatgtctgttctgatcagtgccggagcagtgctgggtaaggttaaccttgcacaattagtagtgatggttttggtcgaggtgacggcactaggaacactaaggatggtgatttctaatattttcaacacggattaccacatgaacctgcgtcacttctacgtgtttgctgcctacttcgggctgacagtagcatggtgtctgccaaagccgctccccaaggggacagaggataatgatcagcgggctaccattcccagcctctccgctatgctgggggccctcttcttgtggatgttttggccatccgtgaactcggcgttactccgctccccaatccagcgtaagaatgccatgttcaatacttattatgctctcgccgtatctgtagtcacggccatctccgggtcttctcttgctcaccctcagcggaagatcagcatgacctacgtccattccgccgtccttgcaggcggtgttgctgtgggcaccagctgccacctcatcccatccccatggctggcaatggtgcttgggctggtggctggtctgattagtatcgggggagctaaatgcctcccagtgtgctgcaacagggtcctggggatacaccatatcagcgtcatgcatagtatcttctccctgctgggactcctcggagaaatcacctacattgtgctgctggtcttacatacagtatggaacggaaatggtatgtttgctcctaagtcacagaatatggagtccacctcgtgcgggtag

SEQ ID NO: 203218 - DNA, 1254 bp, Artificial Sequence
  Description of Artificial Sequence: Synthetic coding sequence
atgagcagcaagtacccccggagcgtgcggcggtgcctgcccctgtgtgcactcacgctcgaggccgccctgatactacttttttacttcttcacccactacgacgcttctctcgaggatcagaagggactagttgcaagctaccaagtgggccaggatctgacagtaatggctgccctgggactgggttttctgacatcaaatttccggcggcactcctggagttccgtggcattcaacctgtttatgctggctctgggggtgcagtgggcaatcttgctggatgggtttctcagccaattccctcccgggaaggtcgtcatcaccctgttttctatccggttggcaacaatgagcgctatgtcagtgctcatcagcgcaggggccgttctagggaaggtcaacctggctcaactcgttgtgatggtcctggtagaagtcacagccctggggacccttaggatggtcatatccaatatcttcaacacagactaccacatgaacttgcgtcatttttatgtttttgcagcctactttggtttgacggtcgcctggtgcctgcctaagccattaccgaaggggaccgaagataatgaccaacgggctacaataccaagcctctccgccatgcttggggcactatttctttggatgttttggccttcagtaaactcagccctgctgcggtcgcctatccaacgcaaaaatgctatgtttaacacatattacgcgctcgccgtgtctgtggtgacggctatttcagggagctcactggcacaccctcaacggaaaatctctatgacatacgtccattccgccgtgctagcaggaggcgtcgctgtcggtaccagttgccacttaatcccatcaccttggctggccatggtcctggggttagtggctggactcatttctatcgggggtgccaaatgcctccccgtctgctgcaatagagtactggggattcaccatatcagcgttatgcatagtatcttctcccttttgggcctgctgggcgagattacttacatcgtgctgctcgtgctacacaccgtgtggaacggaaacggcatgatcggtttccaggtgctgctcagtataggggagctttcactagcaatcgttattgccctgaccagcggtctactcaccggccttctcctgaaccttaagatttggaaggcccctcacgtcgccaaatatttcgacgaccaggtgttttggaaatttcctcatctggccgtcggtttttag

SEQ ID NO: 203219 - DNA, 804 bp, Artificial Sequence
  Description of Artificial Sequence: Synthetic coding sequence
atgagcagcaagtacccccggagcgtgcggcggtgcctgcccctgtgtgccctcaccctggaggccgcactcatcttgttgttctacttttttacccactatgatgcctcactggaggaccaaaaggggctggttgcaagttatcaggtgggccaggacctgaccgtaatggcagcactgggtctgggctttctgacctctaacttccggaggcactcatggagttctgtcgccttcaatctttttatgctcgccctgggagtgcaatgggctatactgttggatggattcctaagtcagttcccccccggtaaagtagtcattaccctgttttcgatacggctagcgacgatgtcggcaatgtctgtgctaatctccgccggcgcagtgctcggcaaagtgaacctggcccagctggtggtgatggtgctggtggaggtcacagcattagggactctgcgtatggtcattagcaatatattcaatacatacgtacatagcgctgtactggctggtggagtggctgtgggcacttcctgtcacctcatcccatcaccatggcttgccatggtgttaggacttgtggccggtctgatttctatcggaggtgccaagtgtttgcctgtgtgctgtaatcgggtgctgggcatccaccatataagtgtgatgcactccattttttctctccttgggctgttgggtgagatcacctatatagtcctactcgtgctgcataccgtttggaacggcaacggcatgttcgcacctaagagtcagaacatggagagtacttcctgcggttag

SEQ ID NO: 203220 - DNA, 801 bp, Artificial Sequence
  Description of Artificial Sequence: Synthetic coding sequence
atgagcagcaagtacccccggagcgtgcggcggtgcctgcccctgtgcgctcttactctcgaggcggccctgatactgctgttctatttctttacgcactacgatgcgtcactcgaggaccagaagggcctggtggctagttaccaagtggggcaagatctcactgtaatggctgccctgggcctggggttcctcacatcgaatttccggcgtcactcctggtcatccgtcgcttttaacttgttcatgctggcattgggtgtgcaatgggctattctgctggatgggtttctgagtcaattcccccccgggaaggtcgtgattaccctgttcagtatacgcctggccaccatgagcgccatgagtgtattgatcagcgctggtgcggttctggggaaggttaacctggctcaactcgttgttatggtcctggtggaagtgacggccctgggaaccctgagaatggtcatctctaatatctttaacgtatgttgcaatagggtgcttggtatccaccatattagcgtcatgcattccattttctccctgcttggcctgctgggggaaattacgtatattgttttgctagttcttcataccgtgtggaacgggaacgggatgataggattccaggtgttactgtctatcggggaactgagcttggctattgtgatcgcgctgacctcaggtttgttgactggcctcctgcttaacttgaagatttggaaagcccctcatgtggctaagtacttcgatgatcaagtcttttggaagtttccacatctggctgttggcttctag

SEQ ID NO: 203221 - DNA, 1206 bp, Artificial Sequence
  Description of Artificial Sequence: Synthetic coding sequence
atgtacttcatcaaccagcggctgttcctgcggctgtggcgggtgcccgtgatgcgggccagtcactgttatcagagtcagggctggcggcccgtggctgtcggccaggatcttacagtaatggcagccttgggactgggttttctgactagcaatttccggagacattcttggtccagcgtggcatttaatctgtttatgctcgcgttaggagtgcagtgggctatcctgctcgacggctttctgtcccagttcccacctggcaaggtagtcatcaccctctttagcatccgacttgctaccatgagtgccatgtcggtgctgatcagcgccggtgctgtcttaggaaaggttaatttggcccagctggtggtaatggtcttagttgaggtgaccgccctcggaaccctgcgtatggttatttctaacatatttaacactgactatcatatgaacctgcggcacttttacgtgtttgctgcttactttgggctgacagttgcatggtgcttacctaaacctctccccaaagggaccgaggacaacgaccaacgggcaaccatcccttctctgtcggctatgctaggtgctttgttcctttggatgttctggccgtccgttaattctgcactgctcaggtcgccaatacagcggaaaaacgctatgttcaatacatactacgccctggctgtcagcgtggtcaccgccatctccggcagttctctggcccacccacagcgaaagatcagtatgacctatgtacacagtgccgtactggctggaggtgtagccgtcggcacatcctgtcatctgatacctagcccttggctagctatggttctggggttagtagccggactcatctcgatcgggggggccaagtgtctgccagtctgctgcaaccgagtgcttggtatccaccatatcagcgtcatgcatagcattttctccctgctgggcctgctgggggaaatcacatatattgtgcttctggtgctgcacactgtatggaacgggaacggtatgatcggcttccaggtcctgctctcgatcggcgaactttccttggccatagtgattgccctgacgtccggtctgctcaccggactgctgctgaatcttaagatctggaaggccccccacgttgctaagtatttcgacgaccaggtgttttggaagtttccccaccttgctgtgggcttctag

SEQ ID NO: 203222 - DNA, 1065 bp, Artificial Sequence
  Description of Artificial Sequence: Synthetic coding sequence
atgagcagcaagtacccccggagcgtgcggcggtgcctgcccctgtgcgccctcactctggaagccgcactaatcctgctgttctacttcttcacccattacgatgccagtctggaggatcagaaaggccttgttgcttcttatcaggtcggccaagaccttaccgtcatggcagccctgggtttggggtttttgactagtaacttccggagacatagttggagctctgtggcattcaacctttttatgctggccctgggcgtgcagtgggcaatactcctagacgggtttctgtctcagtttccaccagggaaggtggtgataacactcttctccatcagacttgcaactatgtccgccatgagcgtattgattagcgccggagccgtcttgggcaaggtgaatctcgctcagctcgtggtaatggtcctcgtggaggtgactgccctgggcacgctgcggatggtcatttccaatatattcaacacggactaccacatgaacctccgacatttttatgtttttgccgcatatttcggactgacagtcgcttggtgtctccctaaaccattgcctaaaggaacagaggataacgatcagagggcaacgatcccctctttgtccgcaatgctcggggctctgttcctctggatgttttggccaagcgtcaacagcgctctgcttcggagccctattcagagaaaaaacgcaatgttcaacacctactacgcccttgccgttagcgtggttactgcgatctctggttcaagcctggcccatccacaacgaaaaatcagtatgacttatgtacatagcgcagttttggctggaggagtggctgtaggcaccagctgccatctgatccctagtccatggctggcaatggttttaggccttgtggccgggctgattagtatcggcggagctaaatgcctgccagactggctccccggccccccccaacattggggcacacaactggggcatcgggacagcagccacgtgtggtctcctgataggttcgcacctaaatcacaaaatatggagtcaaccagctgcgggtag

SEQ ID NO: 203223 - DNA, 1206 bp, Artificial Sequence
  Description of Artificial Sequence: Synthetic coding sequence
atgtacttcatcaaccagcggctgttcctgcggctgtggcgggtgcctgttatgcgggcctcacactgttaccaaagccagggctggcgacctgtggcagttggacaggacctaactgtgatggctgctttaggcctgggatttctgacatccaatttcaggagacattcttggtcctcagtcgcttttaacctctttatgctcgcactgggtgtgcagtgggctatactgttggatgggttcctgtcacagtttccccccgggaaagtcgtaataacgctgtttagcatccgccttgcaacgatgtcagccatgagtgttttgatttccgcgggagccgttcttgggaaagtgaatctagcacagttggtggtaatggtcttggttgaggtcaccgcccttgggacccttaggatggtcatatctaatatctttaacactgattaccacatgaaccttcggcacttttacgtcttcgccgcctacttcggtttgacagtggcttggtgcctgccaaaaccactgcctaaaggaacagaggataacgatcagagggctactatcccaagtctttctgccatgctcggcgcattgttcctctggatgttttggccttccgtcaattcagcccttttgagatccccgatccagcggaagaatgcaatgtttaacacctactacgccctcgctgtgtcagtggtgaccgcgattagtggctcttctctggctcatccccagcgtaagatctccatgacatatgtccattcagccgttctggccggcggagtcgctgtgggaaccagctgccatctcataccctcaccctggctcgccatggtgttggggctggttgccggcttaatttccatcggtggggcaaaatgcctgcctgtctgttgcaacagagtgctcgggatccaccacatctccgtgatgcacagcatcttcagcctgctcggcctgctgggagaaatcacatacatagtgctgctcgtgttacataccgtttggaacggcaacgggatgattggattccaggtgctgctgagcattggcgagctaagccttgcaatcgtcatagcactgacgagcggtctcctgactgggcttctgctcaacttgaaaatctggaaggcgccacacgtggcgaagtactttgacgaccaggtattctggaagtttcctcatctcgcggtggggttttag

SEQ ID NO: 203224 - DNA, 1191 bp, Artificial Sequence
  Description of Artificial Sequence: Synthetic coding sequence
atgagcagcaagtacccccggagcgtgcggcggtgcctgcccctgtgcgcccttactcttgaggctgccctcatcctactgttttactttttcacccactacgatgcatccctcgaagaccagaaagggctcgtcgcctcttatcaagtgggacaagacctgaccgtgatggctgcactgggccttggattcttgacttcgaatttcagaagacattcttggtcgagcgtagcattcaacctctttatgctggcactgggggttcagtgggccatccttctcgacggatttttgtcccagttcccgcctggtaaagtggttattactctcttctctatccggctggcaactatgagcgccatgtccgtactcatctcagcaggcgccgttctgggcaaagtgaacctggcccagctggtggttatggtcctggtggaagtgaccgctctgggaacgctaaggatggtgatttcaaacatcttcaatacagactaccacatgaaccttcgccatttctacgtcttcgccgcgtattttggtcttacagtggcatggtgcttgccaaagcctctgccaaagggaacggaggacaacgaccaaagggccacaatcccgtccctatctgccatgctcggcgccttgtttttatggatgttctggcccagcgtgaatagcgccttgcttagatcaccaattcagaggaaaaatgcgatgttcaacacgtattacgccttagcagtatccgttgtcacagcgatctcagggtcatcccttgctcacccccagcgtaaaatctccatgacatatgtgcacagcgcagtgttagcaggaggagtggctgtcggcacctcatgccacctcattccctccccctggttggccatggtgctcggccttgtggccggactgatcagcatcggcggtgccaagtgtctgccggtctgctgcaatcgggtgctcggtatccaccatatcagcgtgatgcattctatttttagtctgttgggtctgctcggtgaaatcacctacattgttctgctggttctgcacacagtgtggaatggcaatggaatcttcttgatctggctgcttgatttcaagcagaagcaccctcggaaaacgaggccggtgcaaaagcaggataacttcctttcgctgttaccagcttttgtacgagagaagcggtcgtag

SEQ ID NO: 203225 - DNA, 927 bp, Artificial Sequence
  Description of Artificial Sequence: Synthetic coding sequence
atgagcagcaagtacccccggagcgtgcggcggtgcctgcccctgtgcgctttaactctggaggcagcccttatcctcttattttacttcttcacccattatgacgcctccttggaggatcagaaaggcctcgtcgcgtcgtaccaggtgggccaggatctgacagtgatggccgctctgggactcggcttcttgaccagcaatttcagacgtcactcctggagctccgttgccttcaatctgtttatgctggcgctgggagtgcaatgggccatccttcttgacggattcctcagccagtttccccctggaaaagtggttattacacttttctccatcaggctggccacgatgagtgcaatgtctgttcttatctccgctggggcagtccttgggaaggtcaacctggctcagctggtcgtgatggtcttggttgaggtgaccgcactgggaaccctacgcatggtcataagcaatatctttaacactgactatcatatgaatctccggcatttctatgtctttgccgcctatttcggtttgaccgtggcctggtgccttcctaaaccactgccaaaaggcacagaggataatgaccagcgtgctacaattccttccctcagtgccatgctgggagctttgttcctgtggatgttttggccctccgtgaattccgccctactgaggagccctatacagagaaagaacgccatgtttaacacctactacgccctggccgtctccgttgtgacagccatttctgggtcctccctcgcgcacccacagcgtaagatcagcatggattggctgccaggaccaccccaacactggggaacacaactgggtcatcgtgattcatcacacgtttggagccctgataggtttgcccccaaaagtcagaatatggaaagcacatcctgcggctag

SEQ ID NO: 203226 - DNA, 1197 bp, Artificial Sequence
  Description of Artificial Sequence: Synthetic coding sequence
atgagcagcaagtacccccggagcgtgcggcggtgcctgcccctgtgcgccctaacgctcgaggctgctctgattctgttgttttacttttttacacactacgacgcttcactggaagatcaaaagggactcgtggctagttaccaggttggccaagatctcactgtcatggcagcccttggactgggctttctgacatcaaactttcgacggcactcatggagctccgtggcgttcaatctattcatgctcgctctcggcgttcagtgggccattctcttggatggctttctcagtcaatttcccccaggcaaagttgttatcacgctgttcagcatccggcttgccaccatgtccgccatgagcgtgctaatctcggccggtgcagtactaggcaaggtcaatctggcccagctcgttgtcatggtgctagtggaggtgactgccctcggcacacttcgtatggtgatctccaacatctttaataccgactatcacatgaacctgaggcatttctacgtctttgcagcctatttcggcttgacagtagcatggtgcttacctaaaccactgcctaagggtacagaggacaacgaccagagagccactattccttctctttctgccatgctgggagcactgtttctctggatgttctggccaagcgtaaatagcgcgttgctgcgatcgcccatccagaggaagaatgctatgtttaatacttattacgccctcgccgtttccgttgttactgccattagcggatcatcattagctcacccgcagcggaagatcagcatgacctacgtccacagtgccgtcctggcgggcggcgttgccgtggggacatcttgtcatctgattcctagcccatggctcgccatggtgctagggctcgtggcagggctgatctccatcggcggagctaaatgcttgcccgtgtgttgtaacagagtgctcggaatccctcacctgaggcacgcactgcacctgcagcttgccggttccgcttggagggaccatctacactgtgccgccggtgcatcttactgtctggaaagacaatggcacgactggctgcccggtccgcctcagcactggggcactcagctggggcatcgtgattctagccacgtgtggagcccagaccgatttgcccctaagtctcagaatatggagagtacctcttgtgggtag

SEQ ID NO: 203227 - DNA, 939 bp, Artificial Sequence
  Description of Artificial Sequence: Synthetic coding sequence
atgagcagcaagtacccccggagcgtgcggcggtgcctgcccctgtgtgccctgacgcttgaagctgcactgatcctccttttctactttttcacccattatgatgcatctctggaagaccagaaggggctagtggcctcgtaccaggtcgggcaagaccttacagtcatggccgcattggggctgggctttttgacaagcaatttccgcagacattcttggagcagcgtggcgttcaatctgttcatgctggctctgggagtacagtgggcaatcctgttggacggtttcttatcgcagtttccgccaggaaaagtggtcattacgctgtttagtatcagattggcaacaatgtcagcaatgagtgtgcttataagtgccggagctgttctcggtaaagtaaacctcgctcagctcgtggtgatggtgctggtcgaggtgactgctttgggcactctcaggatggtgataagcaatattttcaacacatatgtccatagcgccgtcttggccgggggtgtggcggtgggcacgagctgccacctgatccccagcccatggctggccatggttctaggactggttgcaggcctgatttcaattggcggcgccaagtgtctgcctgtatgttgtaatagggtacttggcatccaccatatctccgtgatgcactctattttttccttgctaggcttattaggggagataacatacatagtgttgctagtcctccacactgtgtggaacgggaacggcatgatcggcttccaagttttattaagcattggggagctctctctagcaattgttatagctctcacctctggccttctgactggactgttattgaacctgaagatctggaaggccccccacgttgccaaatatttcgatgatcaagtgttttggaagtttccacacttagcagtgggtttttag

SEQ ID NO: 203228 - DNA, 1041 bp, Artificial Sequence
  Description of Artificial Sequence: Synthetic coding sequence
atgagcagcaagtacccccggagcgtgcggcggtgcctgcccctgtgcgcgctgactctggaggccgcattaatcttgctcttctactttttcacacactatgacgcaagcctggaggatcagaaaggcttggtggctagctaccaggtcgggcaggaccttacagtcatggcggctctcggcttaggattcctgacctccaacttccggcgccacagttggtcttctgtagcgttcaacctcttcatgttggccctgggcgtccaatgggctatcctcttggacggatttttgtctcagtttccacccggcaaggtagtaataactcttttttctatacgactggccaccatgagcgcaatgtcagtgctaatcagcgcaggagcagtgctcggcaaagtgaacttagcccagttggtcgtaatggtcctggttgaagtgacagcactgggaactctcagaatggtgattagtaatatatttaaccctagtgtgaacagcgccctgcttcgctcccctatccagaggaaaaatgccatgtttaacacatactatgctctggcagtgagcgtcgtcactgctattagcggaagttctctggctcacccgcagcgcaagatttctatgacgtacgtgcactcagctgttctcgctggtggagtggcagttggaacctcatgccacctgatcccatctccatggctggcaatggttttaggccttgtcgtctgctgtaatcgcgtgcttggcattcatcacatctccgttatgcactctattttctccctattgggacttttgggcgaaatcacctacatcgtgctgctggttttacatacagtatggaatggtaacggtatgatcggctttcaggtgctgctgagcattggtgaacttagcctggccatcgtgatcgcgctaacttccggattattaaccggcttgttgcttaacctgaagatctggaaagcgcctcatgtagccaagtattttgatgatcaggttttctggaaattccctcatttggcagttggattctag

SEQ ID NO: 203229 - DNA, 1254 bp, Artificial Sequence
  Description of Artificial Sequence: Synthetic coding sequence
atgagcagcaagtacccccggagcgtgcggcggtgcctgcccctgtgggcactgacacttgaggctgcactgatcctgctgttttacttcttcacacactacgacgccagcttagaggatcaaaaaggattagtggcatcctatcaggtggggcaagacttgacagtgatggctgcgatcgggttgggatttctcacctcttccttccggagacactcctggtcatcggtcgccttcaacctcttcatgctagccttgggagtccagtgggccattctgctcgatggtttcttgagccaatttccctccggcaaagtggttataactcttttcagcattcggcttgctaccatgagcgctctgtccgtgctcatcagcgtagacgctgtgctggggaaagttaacctagcccaactcgtagtgatggtcctggtggaggtcaccgccctaggcaatctacgcatggtcatatctaatatatttaacactgattatcacatgaacatgatgcacatctacgtgtttgctgcttactttggactgtccgtcgcatggtgtttgcccaagcctctccccgagggtaccgaggataaggatcagaccgccacgattccttctttaagtgcaatgttgggtgctttgttcctgtggatgttctggcctagctttaacagcgcgctcctacgaagccccatcgagcgcaagaacgcggtgtttaatacctactacgctgttgccgtctcagtggttacggcaatttcaggctcgagcttagctcatcctcaggggaaaatctcaaagacgtacgtgcattccgccgtgctggcaggcggcgtggcagtgggtacttcctgccatcttataccctcaccctggctcgcaatggtgctgggactggttgcagggttaatatctgttgggggggccaagtatttacctggatgctgcaatcgtgtcctcggaatcccacattcttcaatcatggggtataatttctcactgctggggttgctgggcgagatcatttacatcgttcttctggtgctggatacagtcggagcaggcaacggaatgattggattccaggtgctgctgtctatcggagagctcagcctcgcaattgtcatagctctaatgtctggcctgctcaccggacttctgctgaacctgaagatatggaaagcacctcatgaagccaaatacttcgacgaccaggtcttctggaagtttccccatctggcagtgggtttttag

SEQ ID NO: 203230 - DNA, 1482 bp, Artificial Sequence
  Description of Artificial Sequence: Synthetic coding sequence
atgagcagcaagtacccccggagcgtgcggcggtgcctgcccctgtgggcactcactcttgaagccgccttgattcttttattttatttctttactcactacgacgccagtcttgaagaccagaaggggctggtcgccagctatcaagtgggacaagacctcactgtcatggccgctataggcctgggcttcctaacctcaagcttccgccgacatagttggagtagtgttgctttcaacctcttcatgctcgctctcggcgttcaatgggctatactcttagacggatttctgtcacagtttcctagcggcaaggtggtaatcaccttgttctccataaggctagccaccatgtcagccctcagcgtgttgatttcagtggacgctgtcctcggaaaagttaacctggctcaactggtagtaatggtactagtcgaggttactgcactcggcaacctgcggatggttatctccaacatcttcaatacagactaccacatgaatatgatgcatatctatgtgtttgccgcatatttcggactttccgtggcatggtgtctgccgaaacctctccccgaaggcacagaagacaaggaccaaacagccaccatacctagtctatccgccatgctgggggcactgttcctatggatgttctggccatctttcaatagcgcgctgctaaggtctccaattgaaagaaaaaacgcggtgttcaacacatattacgcggtagcggtttccgtggtgacagccatctccggtagctctcttgcacacccgcagggcaaaatttcaaagacctacgtccactctgctgtgcttgcgggcggagttgcagtggggacttcatgtcacctgatcccatctccttggctggctatggtgctcggtctggtggccggtttgatcagtgtgggtggagctaagtatctgcctggctgttgcaaccgagtgcttggcattccccactcgagcatcatgggatataacttcagcctgctcggtctgctgggtgagattatctatatcgtgttactggtgttggacactgtgggcgctggcaacgggatgagcctcggatggaacttggctgttaagatggctgaagccggagacgaggaattaatgcgacttgacgtttcacagagaaatcatggcggagcagctgtgcccactggaagttggatgccgagcacagaaacgacgattgctcctaattatagagaccatattagcgtggtcagttcttttggctgctggatattgtctaagtctatccaggagaagcagggactgttcaaaaataaaacaacctcttcacactgttgcctgcatctctatgtgcgaaacgcgcatgattcgaaggtgtccaacgttagggctgggacaggcgtccgcgagaacggagtcgaatcctttctgtgccactcattaagacgtatttctccttttatcatgcactgccgcatccaacaatag

SEQ ID NO: 203231 - DNA, 1191 bp, Artificial Sequence
  Description of Artificial Sequence: Synthetic coding sequence
atgagcagcaagtacccccggagcgtgcggcggtgcctgcccctgtgggccttgacgctggaggccgcactgatcctgctcttttatttttttacacactatgacgcaagtttggaagaccagaaaggcctagttgcctcataccaagtaggccaggatttgactgtcatggcagcgataggactggggtttctgacctcttctttccgccggcacagctggagcagcgtcgccttcaatctgttcatgctggcgcttggtgtccaatgggccatcctgctagacggtttcctcagccagtttccatctggaaaggttgtcattacattgttttccatacgcctcgctacgatgtccgctctctccgtgcttatcagcgtggacgccgtcctgggaaaagtgaatctggcccaactggtggtcatggttttggtggaagtcacagcactgggaaatctgcggatggttatctccaacatattcaacaccgattatcacatgaacatgatgcacatctatgtctttgcagcatatttcgggctcagtgtggcatggtgcttacccaaacccttgcctgaaggaaccgaagacaaagatcagactgctactattccttcactgtctgcaatgctaggcgctcttttcctgtggatgttctggccctcattcaactccgctttactccgcagtcctattgaacggaagaatgccgtattcaacacgtactacgccgtggccgtgtccgtggtgacagccatctcgggatcctccctggcgcacccgcaaggaaagatttccaagacatacgttcatagcgccgtgctcgccggtggggtggcagtgggaacttcttgccatttgatccccagcccctggctcgcaatggtgttgggactggtagcaggcctgatctctgttggtggcgcgaagtaccttcccggctgctgtaaccgcgtgttgggtatcccccactctagtataatgggatataacttttccctcctggggctccttggggaaattatttatatagtgttgctggtgctggataccgtcggtgctggaaacggcatcttcctgatttggctgttagacttcaaacagaaacacccgagaaagacccgacccgttcagaagcaggataactttctgtcactgcttccggccttcgttagggaaaagcggtcttag

SEQ ID NO: 203232 - DNA, 1137 bp, Artificial Sequence
  Description of Artificial Sequence: Synthetic coding sequence
atgagcagcaagtacccccggagcgtgcggcggtgcctgcccctgtgggccctcactcttgaagcagctctcatcctgctgttctatttcttcacgcactacgatgcatctctggaggatcaaaaaggcctggtagcatcctatcaggtagggcaggacctgactgttatggcagctatcggtctcggcttccttacttcaagctttcgccggcacagctggagctccgtcgcttttaatctgtttatgctcgcgctgggggtgcagtgggccattttactggatggatttctctcccagttcccttctgggaaggtggtgatcacactgttcagtataaggctggctaccatgtcagcactgtcagtgcttatctccgtcgatgcagtactcggaaaggtgaacctagcgcagttggttgtaatggtgcttgtcgaagttacagcccttggtaacctgaggatggtgatttcaaatatttttaacacggactaccacatgaacatgatgcacatctacgttttcgccgcgtatttcggattaagcgtggcgtggtgcctgccaaagccgttaccagaggggactgaagacaaggatcagaccgctaccattccctcactctcagctatgctgggcgcacttttcctctggatgttttggccaagcttcaacagcgcactgcttcgctcgccaatcgaacgcaagaacgctgtgtttaacacttactatgctgtggcagtatccgttgtgacggctataagtggcagttcgctggctcacccccagggtaagatctccaaaacatatgtgcactccgccgtactagctggcggagtggcggtaggcaccagttgtcaccttatccccagtccatggctggcgatggtgcttggccttgttgccggtttgatctcagtgggcggagccaagtatctcccggattggctgcctgggcctccacagcattggggcactcaactgggccaccgggactcaagtcacgtatggtctccagacagtttcttaatctggctgttggatttcaagcagaagcatcctaggaagaccagaccagtgcagaagcaagataacttcctgtctctcctgcccgctttcgttcgagagaagcgctcttag

SEQ ID NO: 203233 - DNA, 1464 bp, Artificial Sequence
  Description of Artificial Sequence: Synthetic coding sequence
atgagcagcaagtacccccggagcgtgcggcggtgcctgcccctgtgggcactgacactggaggcggcattgatcctgcttttctattttttcacacactacgatgcatcgctcgaagaccaaaagggcttggtggcatcctaccaggtcggccaggatctgactgttatggctgccatcggtttagggtttctcaccagctcttttagaagacatagttggagctccgttgcgttcaacctgttcatgcttgcactgggagtgcagtgggctatcttactcgacggttttctttcccaattccccagtgggaaagtggtcatcacattgttttcgatccgtttggctactatgtctgcactgtcggtcctgatctctgtggatgcagtcctcggcaaagttaaccttgcacaattggtagtcatggttctggtagaagtcactgcactgggaaatctgcggatggtgatcagcaacatattcaatacagactatcacatgaatatgatgcacatctacgtgtttgccgcctactttggtttgtccgtggcctggtgtctaccgaaaccactgccagagggcaccgaggacaaggaccaaaccgccacaatccctagtcttagtgcaatgttgggggccctctttctgtggatgttttggccctctttcaatagcgccctgctcagaagtccaatcgaaagaaagaacgccgtgtttaatacttactacgcagtggcggtctctgtggtgacagcgatctctgggagcagtctggcacatccccaaggaaagatttcgaaaacatacgtgcacagcgctgtgctggccggcggggtagctgttggcacgtcttgccatctcatccccagcccctggctggctatggtcctgggtctcgtcgctgggttaatttccgttggaggggctaaatacctgcccgggtgctgcaatcgtgtgctgggaatccctcacagcagtatcatgggttataatttcagtcttttaggactccttggcgagattatttacatcgtactcctggtgttggacactgtgggcgcagggaatggaatgattggtttccaggtacttctatcaatcggtgagctcagcctcgctatagtcatagctctgatgtccggactattaacaggactgcttctcaacctgaagatttggaaggccccgcacgaggcaaagtattttgatgatcaggttttctggaaattcccgcacttggccgtgggtttctccaagtctattcaggaaaaacagggcttgtttaaaaacaagacaacatcttcccactgttgccttcacctttatgtacgtaacgctcacgacagtaaggtttcaaatgttcgtgctggaactggagtccgagagaacggggtggaatcttttctgtgtcacagtttacggagaatctctccttttatcatgcattgccgaatccagcaatag

SEQ ID NO: 203234 - DNA, 1296 bp, Artificial Sequence
  Description of Artificial Sequence: Synthetic coding sequence
atgagcagcaagtacccccggagcgtgcggcggtgcctgcccctgtgggccttaaccctggaagccgctctgatactcctgttttacttttttactcactacgatgcctcacttgaagatcagaagggattggtagctagctatcaggtaggacaggacctaactgttatggcggctatcggcctggggttcctgacatccagctttaggcgacacagctggagttctgtcgcattcaacctctttatgttagctttaggggtgcagtgggccatcctgcttgacgggtttttatcacaattcccttccggcaaggtcgtgattacactcttcagtatccgtctggctacaatgtcagcgctgtccgtactgattagcgtggacgccgtgctgggtaaggtcaacctcgcacagcttgtggtgatggtattggtggaggtcacagcactgggaaatttgagaatggttatctcaaatatcttcaacaccgactatcacatgaacatgatgcatatttatgtattcgctgcctactttggtctgtcggttgcctggtgccttcccaaaccgctgccagaagggacagaggacaaagaccaaaccgcaaccataccatccttgtccgcgatgctgggcgccctcttcctgtggatgttttggccgagctttaacagcgccttactgcggagtcctatcgagcgtaagaatgccgtgtttaatacttattatgcggtagcagtcagcgttgtcactgctatcagcggctcttcactggcccatccccaaggaaaaatatctaagacgtatgtccacagtgcagtgctggccggaggcgtagccgtgggcacgtcctgtcacctgatcccgtcaccttggctggcgatggtcctgggcctggtggccggactgatctccgtaggcggcgccaaatatctgccaggctgttgcaaccgtgtgctcggcatacctcacagcagcattatgggttacaacttttctctgttgggcctgctcggcgaaattatctacatcgtgctattggtcctcgacactgttggcgctgggaacggcatgagcctgggctggaaccttgccgtgaagatggctgaagctggggacgaagaactcatgagactggatgttagccaaagaaaccacggtggggctgcagttcctactggatcttggatgccatccacagagaccaccattgcgcctaactatagggaccatatctccgtggggcttgcaagcagatcgagcagtgccctcggtaattccgcctggccatcatag

SEQ ID NO: 203235 - DNA, 966 bp, Artificial Sequence
  Description of Artificial Sequence: Synthetic coding sequence
atgagcagcaagtacccccggagcgtgcggcggtgcctgcccctgtgggcccttacactcgaagctgcactgattctcctgttctacttcttcacccattatgatgcatccctggaagaccagaagggcctggtggcctcttaccaggttggacaggatctcactgtgatggcagccataggcttaggctttctcacctcgagttttagacgtcactcctggtcatctgtggcatttaacctctttatgctcgctcttggtgtacagtgggcaatactgcttgatggcttcttatcccagttcccctcgggcaaggtggtaatcactcttttttcaattagactcgcaactatgtcagccctgtctgttctgattagcgttgatgccgtgctcggtaaggtcaacctggcccagctggttgtgatggtactggtggaggtgacagccctaggcaatttgaggatggtcataagcaatatcttcaacaccgattatcacatgaacatgatgcacatatacgtctttgccgcctatttcggacttagtgtcgcctggtgtctaccaaaaccccttcccgagggtacggaggataaagaccagacggccactatcccctcactcagcgctatgctgggtgcgctctttttatggatgttttggccctcattcaacagcgccctgctgaggagccccatagagcgaaagaatgcagtgtttaatacatactacgccgtggccgtcagcgttgttaccgcgatttccggaagcagcctggcccatcctcagggtaaaatatcaaaaacttatgtgcatagcgctgtgttagctggaggcgtggcggtgggtacttcatgtcacttaatcccaagtccatggttggccatggtgctcggattggtcgcagggctaatctcggttggtggtgcaaagtatctgcccttcccccacctcgctgttggattctag

SEQ ID NO: 203236 - DNA, 294 bp, Artificial Sequence
  Description of Artificial Sequence: Synthetic coding sequence
atggccggcagccccagccgggccgccggccggcggctgcagctgccactcctgtgcctctttctccaaggagcaactgcagtgctttttgccgtgtttgttcggtacaatcacaagactgatgcggcactgtggcaccggtcgaatcactctaatgccgataacgaattctactttcgctaccccaacggggtgtcactccttctgccaagattggaatgtaacggcactattagcgcccaccacaatctgtgcctgcctggctctagtgactccccggctagcgtaagttag

SEQ ID NO: 203237 - DNA, 462 bp, Artificial Sequence
  Description of Artificial Sequence: Synthetic coding sequence
atggccggcagccccagccgggccgccggccggcggctgcagctgccccttctttgcctctttcttcaaggagcaaccgccgtgctgtttgccgtgtttgtccggtacaatcacaaaacagacgctgcgctgtggcaccggtcaaatcacagcaatgctgataatgagttttattttcgctaccccaaggagagccacagcgtcgcccaagcgggggtacagaggcgaaacctgggatctttacagccaagcccgccacggttacctggccgcgcatgtcatggcctgagaggactctggctgccacatgggctgcctgccgctttgaggttgcagcagaggggtctgcaccttcctcctggtcggctctgtccggccgtggttcacactgggccgggtctgagtccattattgcctagatggccccatccttgttggaggggggagcacgaccagtgctag

SEQ ID NO: 203238 - DNA, 1119 bp, Artificial Sequence
  Description of Artificial Sequence: Synthetic coding sequence
atggtgttcgtgggcttcggcttcctgatggtgttcctgcagcggtatggttttagcagcgttgggtttacttttttacttgctgcattcgcgctccagtggtctacgcttgtccagggatttctgcactcctttcacgggggtcatattcacgtgggcgtcgaatctatgatcaatgctgatttctgcgccggtgcagtgctgatctcattcggagcagttctgggtaaaactggccccacccagttattgctcatggccttgctcgaggtggttctgtttggaattaatgaatttgttctgctccacttattgggagtcagagacgccggaggttctatgacaattcatacctttggtgcttattttgggctggtgttgtctagagtgctgtaccgtccacagcttgaaaaatccaaacacagacagggcagcgtttatcatagcgacctcttcgcgatgatcgggacaatattcctgtggatcttttggcctagctttaatgcggcgctgaccgctttgggcgccggacaacaccggacagcacttaacacgtactattcattggcagcgagtaccttgggaacatttgctctctccgccctcgtgggggaggatggccgcctggacatggtgcatattcagaacgccgcgctcgctggcggtgtggtagtgggcacaagttcggaaatgatgttaacacctttcggagcccttgcagctggatttctggccggtacggtgtcaactctcggctacaaattcttcacacctattctagaatccaagtttaaggtacaggatacttgcggagtgcacaatctgcacggcatgcccggcgtgctcggagcccttctgggggtgctcgtggcaggtttggctacgcacgaagcatatggggatggattagaaagcgtgtttcccctgattgcggaaggacagcggtctgcaacgagtcaagccatgcaccagctgtttggactgtttgtgactttgatgttcgctagcgtgggaggaggcctcggggggttgctgctaaagctgcccttcttggatagtccacccagactgcccgccctgagggggccttcgtccctggctggcgcttggcgggcctag

SEQ ID NO: 203239 - DNA, 1374 bp, Artificial Sequence
  Description of Artificial Sequence: Synthetic coding sequence
atggccggcagccccagccgggccgccggccggcggctgcagctgcctctcctctgtctgtttctccaaggggccacagcagtgttgttcgcagtgtttgtcaggtacaatcacaagactgatgcagcgttatggcacaggtccaatcattcaaacgcagacaatgagttttattttcgctacccatcctttcaggacgtgcacgcaatggtctttgttggcttcggctttctgatggttttccttcagaggtatgggttttccagcgttggcttcacgtttttgcttgcagcgttcgccttgcagtggagtactctggtccagggtttcctgcacagctttcacgggggtcatatccacgtgggggtggaatctatgatcaacgcagacttctgtgcaggcgccgtgctaatcagcttcggcgctgttcttggaaagactggtccgactcagcttctgctgatggctctgctggaggtagtcctgtttggaatcaacgagttcgtgctgttacacctgctgggagtgagggacgcagggggtagtatgacgatccacacattcggcgcctatttcggactggttcttagccgcgtgctgtacagaccacagctcgaaaaatccaagcatcgccaaggcagtgtctaccactctgacttgttcgcgatgatcggaacaatcttcctgtggattttttggccctcttttaatgccgccctgactgccctgggggccgggcaacatcgtactgcgctgaatacgtactatagtctggccgctagcacactgggaacctttgccttgtccgctctagtgggagaggacggaagactggatatggtgcacatccagaacgcagctctggctgggggagtggttgtcggcacttcctcagaaatgatgctgactcctttcggagccctggccgcaggtttcttggccggtactgtttccacactggggtacaaattttttacccctatcctggaatctaaatttaaggtgcaggacacgtgtggagtgcacaatctccacggtatgcccggcgtactgggcgcactcctgggagtgctcgtggctggacttgccacccatgaagcttatggggatggacttgaatccgtgttcccacttattgccgaagggcagcgcagtgccacatcccaagcaatgcatcagttattcggactattcgtgacactgatgtttgcttcagtggggggcggattgggcggactgcttctgaagctcccgttcttggacccccccgatagccagcactacgaggaccaggttcattggcaggtgcctggggagcacgaagataaggcacagcggcctctccgagtggaagaagctgacacccaggcctag

SEQ ID NO: 203240 - DNA, 1326 bp, Artificial Sequence
  Description of Artificial Sequence: Synthetic coding sequence
atggccggcagccccagccgggccgccggccggcggctgcagctgcccttactgtgtcttttcctgcagggggctaccgccgtgttgtttgcggtctttgtgcgctacaaccacaaaaccgatgccgccctgtggcaccgttcaaatcattccaatgccgacaacgagttttactttagatacccaagctttcaagacgtgcacgccatggtctttgtgggttttggtttcttgatggttttcctacagcggtatggattctcaagcgtgggctttactttcctcttagccgcctttgcgctccaatggtctaccttggtgcaagggttcttgcacagctttcatggcggccacattcatgtgggggttgaatctatgattaacgccgacttttgtgccggcgccgtgctgattagttttggtgccgtgcttgggaaaacggggcccactcagttactgctaatggccctcttagaagtggtgcttttcggaattaacgagtttgtactcctgcatctactgggcgttcgcgacgccggaggctccatgacgatacatacctttggtgcctattttggcctggttctgtctcgcgtcctctatagaccacagctggagaaatcgaaacaccggcaaggctctgtctaccactccgatctgtttgccatgatcgggacaattttcctgtggattttctggccttcgtttaacgccgctctcaccgcgctgggcgctggacagcatcgcacggctttaaacacctattactctcttgctgcctcgaccctaggcaccttcgccttgtccgccctcgtcggcgaagacggtagactggatatggttcacatccagaatgccgcgctggcgggtggtgttgtggtaggcacatcatccgagatgatgttgacaccattcggcgccttggccgccggttttctggcaggaaccgtatcgacactgggctacaaattctttactccgattctggaatctaaattcaaagtgcaggatacctgcggagtgcataacctccacggtatgcccggtgtgctcggcgctctgttaggtgttctcgtagctggtcttgccacccacgaggcgtatggtgatggactggagagcgtttttcctctgatcgcagaagggcaacgaagtgcaacttcccaggccatgcatcagcttttcggcctgttcgtcacactgatgttcgcatcagttggcggtgggttaggagggctcttacttaagttaccgttcctggattccccccctcggctgccggctctgagggggcctagttccttagccggagcttggagggcttag

SEQ ID NO: 203241 - DNA, 1230 bp, Artificial Sequence
  Description of Artificial Sequence: Synthetic coding sequence
atggtgttcgtgggcttcggcttcctgatggtgttcctgcagcggtatggtttttcaagcgtaggttttaccttcttattggccgccttcgccctgcagtggagcactctggttcagggattcctacactcgtttcacgggggccatatccacgtgggtgtcgaaagcatgatcaacgcggacttttgtgcgggagctgtgctcatctcctttggagctgttcttggaaaaaccggaccgacccagttgctcctgatggctctgctcgaggtggtcttgtttggcattaacgagtttgtgcttctgcatctgttaggggtacgggtctggggcggcatggaatctggggtcggaggaggacagggacagcccctatcccaggaaaggggtggagggggaggagtgctgccactgacaccccccccccaggtgcgtgatgccggagggtctatgaccattcatactttcggagcttatttcggattggtgctctcccgagtgctttatcgcccacaactggaaaaaagcaaacaccggcaggggtctgtgtaccacagtgacctttttgcaatgatcggtacaatcttcctatggattttttggcccagttttaatgcggctctcacagccctgggggcaggtcagcatcgtactgccttgaacacctattacagcctcgctgcgtccactctgggaacattcgcactgtccgcattggttggagaagatgggagactggacatggtgcacattcagaatgccgctctcgcaggcggagtggtggtgggcacctcatcagagatgatgctgaccccatttggcgccctagctgccggcttcctggcgggaaccgtctccacattgggatacaagttcttcactcccattttggagtctaaatttaaggtgcaggatacttgtggcgttcataacctccatggaatgccaggagtgttaggtgcactgctgggcgttcttgtagcggggctcgctacccacgaggcttatggagacggccttgaaagtgtattccctctgattgctgaggggcagcggagcgcaacgtcacaagccatgcaccaactgtttgggctgttcgtgactctgatgttcgcaagtgtcggtggcggcctgggtggcctgctcctgaagctgccctttttagactctcctccacgcttacctgcactgcggggcccatcaagcctcgccggggcgtggcgtgcttag

SEQ ID NO: 203242 - DNA, 1125 bp, Artificial Sequence
  Description of Artificial Sequence: Synthetic coding sequence
atggtgttcgtgggcttcggcttcctgatggtgttcctgcagcggtacggcttctcatccgtgggttttacttttcttctagccgcgtttgccctgcagtggagcaccctggtccaaggttttttacactcctttcacgggggccacattcacgtgggagtggagtcaatgattaatgcagacttctgcgcgggggctgttctaatctctttcggcgctgtcttaggtaaaacagggcccacccagctgctgcttatggccctccttgaggtggtcttatttggcattaacgaattcgtactgcttcatctgctaggggtcagggtgtggggcggtatggagtccggagtggggggaggtcagggccagccactgagccaggagcggggcggtgggggcggagtgctcccattgactccaccgccccaggttcgggacgctggcgggtcaatgaccatacacacattcggagcatacttcggcctggtgttgtcccgcgtgttataccgaccgcaactggaaaaaagtaaacatcgccagggtagcgtgtatcactctgatctgttcgcaatgattggaactatctttttgtggatcttttggccatcctttaacgccgccttaacagcactaggagcggggcagcatcgcactgcgttgaacacgtattactccctggctgctagtaccctcggtacctttgcactgtctgccctggtgggcgaagacggaaggctggatatgcctatcctggaaagtaagtttaaagtgcaggacacttgcggtgtgcacaatctgcatggaatgcccggggttctgggggcacttctaggcgtgctcgtggccgggctggctacccacgaggcatatggcgatggtttggaatctgtgttcccgcttatagccgagggacaacgcagtgccacttcccaggcgatgcaccagctctttggcctattcgttactctgatgttcgcctccgtgggcggtgggttaggcggcatcatcctggtgttgtgtctgctggacccttgtgcgctgtggcattgggtcgcaccaagctccatggtgggaggcagagaagcgtcccaaattctgccctaccaccatcagggttcctgctag

SEQ ID NO: 203243 - DNA, 687 bp, Artificial Sequence
  Description of Artificial Sequence: Synthetic coding sequence
atggccggcagccccagccgggccgccggccggcggctgcagctgccattattgtgtttgtttctccagggtgccacagccgtcctgttcgcagtttttgttcggtacaaccataagacggatgcagcactatggcacagatccaaccacagtaacgcagacaatgagttctacttcagatacccccgcacaatcttcctgtggattttttggccttctttcaatgctgcccttactgccctgggtgcaggtcaacatcgaacagcattaaacacctactactccctggcagcttcgactctcgggacattcgcgttgagcgctctggtaggcgaggatggacgcctggacatggtgcatattcaaaacgccgccttggctgggggcgtggtggtggggacaagtagcgaaatgatgctgacaccctttggcgcgctggcagcaggttttctagccgggacggttagcaccctgggtccaagcctcaaccagaacagcaagtctaaaacccatgtggaaagtacaaccagcatggggtgtcgcgggtcgtggggaccaagttggggaagcctgtggctggatctccctcctatgaaactaactgagatgggcgaattcccgcccaatccctactgcagtcgtcatccgtccggcatgacctcggtgatcctctttcactgcgtctag

SEQ ID NO: 203244 - DNA, 1440 bp, Artificial Sequence
  Description of Artificial Sequence: Synthetic coding sequence
atggcctggaacaccaacctgcggtggcggctgcccctgacctgccttctgctccaagtcatcatggtgatcctcttcggcgtcttcgtgcggtatgattttgaagcggatgcacactggtggagtgagcggactcacaagaacctgtctgacatggaaaacgagttctattataggtatccatctttccaggacgtgcatgtcatggtgtttgtcggcttcggcttcctgatgaccttcctgcagcgttatgggttctcggctgtgggctttaacttcttgctcgccgcctttggtatccaatgggcccttctgatgcaaggctggttccacttcctgcaggaccgatacattgtggttggggtcgagaatctcatcaatgccgatttctgtgtggcttcggtctgtgtcgcttttggcgcagtgttggggaaggtgagcccgatccagcttctgattatgacctttttccaggtgacactgttcgcagtcaacgagttcatactgctgaacctcctcaaggttaaggatgctggggggtcaatgacaatccatacatttggcgcttactttggcctgactgtgacgcggatactgtataggcgaaatctagagcaaagtaaggaaagacagaatagcgtgtatcagagcgacttattcgccatgatcggaaccttatttctgtggatgtactggccctccttcaatagcgctattagttatcacggcgattctcaacaccgagctgctattaacacttactgctctcttgcggcgtgtgtcctgactagtgtcgccatctcctctgccctccataaaaagggaaagttagacatggtacatatccagaacgcaaccctggctggtggagtcgccgtgggaacagccgcggaaatgatgctcatgccgtatggcgcgctaatcatcggcttcgtctgcggcatcatctcgaccctaggattcgtgtacctgacacccttcttagaaagccgcctccatatccaggacacttgtgggatcaacaatcttcatggaatccctggtattatcgggggtatcgttggcgctgtcactgccgcctctgcctcccttgaggtatatggaaaagaagggctggtgcacagctttgattttcaaggatttaacggcgactggactgccaggacgcaggggaagttccagatttatgggttgctcgtcactctggctatggctttaatgggcgggatcattgtaggcctgatcctgcgactgcctttttgggggcaaccatctgacgaaaattgtttcgaggacgccgtgtattgggagatgccagaaggaaactctaccgtgtacataccggaagaccccacatttaaacccagcggacccagtgtaccttcagtgccaatggtcagccccctacccatggcaagctcagtgccactggttccctag

SEQ ID NO: 203245 - DNA, 1413 bp, Artificial Sequence
  Description of Artificial Sequence: Synthetic coding sequence
atggcctggaacacctgcctgctgctgcaggtgatcatggtgatcttgtttggtgtgtttgtgcgatatgactttgaggcggatgcccactggtggagcgagcgcacacataagaatcttagtgacatggaaaacgaattctattatcggtacccttctttccaggatgtccacgttatggtgttcgtgggattcgggtttctgatgacatttttgcaacgctatgggttcagcgctgtgggttttaatttcctcctggccgcattcggaatccagtgggctcttctgatgcagggctggttccacttcctccaggaccgatatatcgttgtgggcgtagaaaacctaattaatgctgacttctgcgttgcttccgtgtgtgtggctttcggagccgtattgggtaaagtgagccccatacagttgctcattatgacgttcttccaagtgactctgtttgctgtgaatgaatttattctgttgaacctgttgaaagtgaaggacgcaggggggtccatgacaatacatacgttcggtgcctacttcgggcttaccgtaacacgaattctctatcgtagaaaccttgaacaaagcaaagaaagacagaacagcgtgtatcagtcagacctgtttgcaatgatcgggaccctgtttctgtggatgtactggccatcattcaactccgcaatttcgtaccatggagatagccaacatcgggcagccattaacacatactgctctctcgccgcgtgcgtccttactagcgtggctatctcctcagccctgcataagaaaggcaaactggatatggtgcacatccaaaatgctacactggccgggggagtggctgtgggcacggctgccgagatgatgctgatgccatacggagccctgataatcggattcgtctgtgggatcatatctacactggggttcgtctaccttactccttttctggaaagtaggctgcacattcaggacacctgtggtataaataacttacatggaatccctgggatcatcggagggattgtgggggcggtgaccgccgcctccgccagtctggaagtgtatggtaaagaggggctggttcactccttcgatttccagggtttcaatggggattggacagcaagaacccaaggtaaatttcagatctacggtctgttagtcaccctggccatggccctcatggggggcatcatcgtgggtctaatcctgaggctgcccttttggggccaaccttccgacgaaaactgctttgaggatgctgtatactgggaaatgcccgagggaaattctacagtgtacatccccgaagaccctacctttaagccttccggaccttccgttccgtcagtcccaatggtatcccccctccctatggccagctccgtacccctggttccttag

SEQ ID NO: 203246 - DNA, 1338 bp, Artificial Sequence
  Description of Artificial Sequence: Synthetic coding sequence
atggcctggaacaccaacctgcggtggcggctgcccctgacctgcctgcttctgcaggtgatcatggttattctatttggggtgttcgttcgctacgactttgaagctgacgcccattggtggagtgagaggacacataagaatctgagcgacatggaaaacgagttttactacaggtacccatcattccaggacgtgcacgtgatggtgtttgttgggtttgggtttcttatgacgtttctccaacgatatggatttagcgccgtcgggtttaactttctgctggctgcctttggtatccagtgggccctcctcatgcaagggtggtttcatttcttgcaggataggtacattgtagtgggcgttgagaatctgattaacgctgacttctgcgtcgcttctgtctgcgtggcttttggagcagtgctgggaaaagtcagtcctatccaactgctaatcatgacattcttccaggtgaccctctttgccgtaaatgaattcatcttattaaatttactgaaggtaaaagatgcgggcggttctatgacgatccacaccttcggggcctactttggcctaacagtcaccagaatcttataccggaggaacttggagcagagcaaagagagacagaactctgtgtaccagtctgatctgttcgcgatgatcgggaccttgtttctctggatgtattggccctcgttcaattctgctatatcctaccacggtgactctcagcaccgggccgccatcaacacgtactgctctctcgctgcctgtgtcttaaccagtgtagctattagtagcgcattgcataagaaggggaagttagacatggttcatatacagaacgccactttagcaggtggagtggcagtgggcaccgccgccgaaatgatgctgatgccatacggagcactgattatcggttttgtgtgtggcatcatcagtactctcgggttcgtttacctcacaccttttctcgagagtagactgcacattcaggatacttgcgggatcaataatttgcatggaataccaggaattatcgggggaattgtcggcgccgtaactgccgcttccgctagtctcgaggtgtatggcaaagaagggcttgttcactcctttgatttccagggattcaacggagactggaccgctagaacacaggggaagtttcagatttacggccttcttgtgacactggctatggctttgatgggcgggattattgtggggctgatcctgcggctccctttctggggacagcccagcgatgagaactgtttcgaagacgcggtttattgggaggatctcgagctagcccctaaccagtag

SEQ ID NO: 203247 - DNA, 714 bp, Artificial Sequence
  Description of Artificial Sequence: Synthetic coding sequence
tgagacagccagcaccgggccgccatcaacacctactgcagcctggctgcctgtgttttaaccagtgttgccatctcatcagctctgcacaagaagggaaaattggacatggtgcatattcagaatgctacactggccggaggcgtcgctgtgggaactgctgccgagatgatgttaatgccatatggggctcttatcatcggatttgtttgcggaatcatttcgacccttggcttcgtgtaccttaccccgtttctcgagtctcgacttcacattcaggatacttgtggaatcaacaacctgcacggtattccaggcatcatcggaggaattgtcggggctgttacagccgcatcagccagcctcgaggtatacggtaaggagggtttggtgcactcctttgattttcaggggttcaatggagattggactgctagaacacagggtaagttccagatctatggattactggtgacactggctatggcactgatgggaggcatcatagtgggtctgattttgagactacccttctggggccagccgagcgacgaaaactgctttgaagatgcagtatattgggagatgcctgaggggaacagcacagtctacatccctgaggatccaactttcaaaccttctggtcccagcgtgcccagcgtgcctatggtgtccccactccctatggcttcaagcgttccgctggtgccctag

SEQ ID NO: 203248 - DNA, 429 bp, Artificial Sequence
  Description of Artificial Sequence: Synthetic coding sequence
atggccgccgccgtggccgccgccggcgccggcgagccccagagccctgacgagctcttgccaaaaggtgacgccgagaagcccgaggaagaacttgaggaagacgacgacgaagagttggatgagacgctgagcgaacggctgtggggactgactgagatgttccccgagcgggtgcggtccgccgccggagccacattcgaccttagtctctttgtggcccaaaagatgtacaggttctcacgagccgccctgtggatcgggaccacctcctttatgatactggtattgcccgtcgtgtttgaaacggagaagctgcaaatggagcagcaacagcagctgcagcaacgtcagatacttttggggccaaataccggcctgagcggcggtatgccgggtgccctgccttcacttcccggcaaaatctag

SEQ ID NO: 203249 - DNA, 1083 bp, Artificial Sequence
  Description of Artificial Sequence: Synthetic coding sequence
atgagccaggagcggcccaccttctaccggcaggagctgaacaagacgatctgggaagttccagagcgttaccagaacctgtctccagttgggtccggggcctatgggtcagtttgcgcggcatttgatacaaaaacaggactgcgtgtggcggtcaagaaactgtctaggccttttcagagcatcattcacgcgaaacgaacctatagggagcttcgccttctgaaacacatgaagcatgagaatgttatcggtttgctggatgtttttacaccagccagatcacttgaagaatttaacgatgtctatttggtgactcacctgatgggcgccgatctcaataacattgtcaaatgccagaagctgacagatgaccacgtccagttcctgatatatcagatccttagaggtctaaagtacatacatagtgccgacatcatccatcgagatttaaagccttcaaacctggcggtgaatgaagactgcgagttaaaaatactcgatttcggactggctaggcatactgacgacgagatgacgggttatgtcgccactagatggtatcgcgcccctgagataatgctgaactggatgcattacaaccagacagtggatatttggtcagttggatgcatcatggccgaactgctgaccgggaggactctgtttccaggcacagaccacatcaatcaactccagcaaattatgcggttgacaggcactcccccggcttacctcataaacagaatgccgagccacgaggcccgaaactatattcagagccttacccagatgcctaagatgaactttgctaatgtgttcatcggcgcaaacccattggccgtggacttgctggagaagatgctcgtcctagattctgataagaggattacggcagctcaagctctggcccatgcgtactttgcccagtaccacgatcccgacgacgagccagtcgccgatccatatgaccagtccttcgagagccgggatctattaatcgacgagtggaagtccttaacatacgatgaggtcatctctttcgtcccacctcccctcgaccaagaggagatggagtcctag

SEQ ID NO: 203250 - DNA, 1230 bp, Artificial Sequence
  Description of Artificial Sequence: Synthetic coding sequence
atgcggttcaccttccccctgatggccatcgtgctggagatcgccatgatcgttctgtttgggctgttcgtagagtatgagaccgaccagaccgtgctggaacaactgaacataactaagcctaccgatatggggatcttttttgagctgtaccctcttttccaagatgtccatgtgatgatcttcgtgggctttggctttctgatgacattccttaaaaagtacgggtttagtagcgttggtattaacttactggtggctgcgctaggccttcagtgggggaccattgtccagggaattctgcaatctcagggacagaaatttaacatcggtatcaaaaacatgatcaacgccgactttagcgctgctaccgttttgatttctttcggagccgtacttggcaagaccagtcccacacagatgttgataatgaccattctcgaaatagtattcttcgctcataatgagtacctcgtgtccgaaatcttcaaggcttccgacatcggggcgagtatgaccatccacgctttcggggcctacttcggattggcggtggcaggaatcctttatagaagcgggctgaggaaaggccatgagaatgaggagtcggcttactactcggacctgtttgcgatgataggcactctttttttgtggatgttttggcctagtttcaattcagcaattgcggaacctggggataaacagtgtcgtgctatcgtgaacacgtacttctccctagccgcctgcgttctgactgcattcgcattcagctcactagtggaacatcgcggaaaacttaatatggtgcacattcagaacgccaccttggctggtggcgtggcagtcggaacatgtgccgacatggccattcatccctttggatccatgatcataggatctattgccggaatggtgtccgtgttaggttacaagttccttaccccattgtttaccaccaagctgcgtattcacgatacctgcggtgttcacaacctgcacggcctccccggcgtcgtgggtggcctcgccggcatagtggccgtcgcgatgggcgcctcaaatacatcaatggcgatgcaggccgcagcactgggctctagcatcggtactgccgtcgtcgggggcctgatgacggggctcattctcaaattgcctctgtggggccagccaagcgatcagaactgctatgatgattccgtttactggaaggtgcccaagacccgctag

SEQ ID NO: 203251 - DNA, 1233 bp, Artificial Sequence
  Description of Artificial Sequence: Synthetic coding sequence
atgcggttcaccttccccctgatggccatcgtgctggagatcgccatgatcgtacttttcgggctgttcgtcgagtatgaaacggaccaaacagtgctggagcagctgaacatcaccaagcctaccgacatgggcatctttttcgagctctatcccctattccaggatgtgcacgtgatgatcttcgttggctttggttttttgatgactttcttgaagaaatacggattctcatctgtgggcatcaaccttttggtggccgcattgggactccaatggggcacaatcgtgcaagggattctccagtcgcagggtcagaagtttaatataggtattaagaacatgataaatgcagatttttcagccgctacagtcctgatcagtttcggcgcggtgttgggcaagactagccccacccagatgttgataatgacaatccttgagatcgtcttcttcgcgcacaacgagtacttagtgtcagaaatctttaaagctagcgatatcggggctagcatgacgatacatgcctttggtgcatactttggactcgccgtcgccggcatcctgtatcgatccgggcttagaaaggggcatgaaaacgaggaatcagcatactactccgatctttttgccatgattggcactttatttctatggatgttttggccctccttcaacagcgccatcgccgaaccaggcgataagcagtgtcgggcgattgtcaatacttacttcagcctcgctgcatgtgtactcacggccttcgccttctctagtctcgtggaacatcgagggaaacttaacatggtgcacatccaaaatgctacgctcgctggcggggtcgctgtgggaacatgcgccgacatggccatccatccttttgggagcatgataattggtagtattgcagggatggtgtccgtactgggttacaagtttctgactccattgtttacgaccaagttgagaatccatgacacatgtggagtgcacaacttgcatggcctgccaggggtggtgggcggcctagctggaatcgtcgctgtggccatgggtgcctcaaatacttctatggccatgcaggccgcagctttggggtcctcaatcgggactgccgtcgtgggcggcctgatgacaggcttaatattgaaactacctctgtggggtcagccgtcagatcagaattgctatgacgacagcgtttactggaaggtacccaagactagggtgtag

SEQ ID NO: 203252 - DNA, 1146 bp, Artificial Sequence
  Description of Artificial Sequence: Synthetic coding sequence
atgcggttcaccttccccctgatggccatcgtgctggagatcgccatgattgtcctattcggtttatttgttgaatatgagacggatcagactgttctagaacagctgaacattactaaacctacagatatggggatctttttcgagctgtatcctctcttccaggatgtacatgttatgatctttgttggcttcggcttcctgatgactttcctgaaaaagtatggtttttcaagcgttggcatcaatcttctggtggccgctttgggactccagtggggtaccattgttcagggcatcctacagagccagggccagaagtttaatatcggcatcaagaacatgatcaacgccgacttctcagctgctaccgttctgattagtttcggtgctgtgctggggaagacatctcctacacagatgctgatcatgacgatccttgaaatcgtgttttttgcccacaatgagtacctggtgtctgaaatctttaaagccagcgatatcggagcaagtatgacaatccatgcgttcggcgcctacttcggcctagccgtagccgggatcctctataggtccggtctgcgcaaggggcacgagaatgaggagtccgcttattactccgacctcttcgctatgatcggaactttgtttttgtggatgttttggcccagtttcaatagtgcaatcgccgaacccggggacaagcaatgccgggccattgtgaatacgtatttttccttagccgcctgcgtcctgaccgcttttgcattttcttccttggtggagcatagaggaaagctaaatatggtccatatacagaacgctactctggcaggaggcgtcgcagtggggacatgcgcagacatggcgatccatccctttggctctatgatcataggaagtatcgccgggatggtttccgtgctgggctacaagttcctcaccccgctgttcactacgaagctgcggattcacgacacttgcggcgtccacaacctccatggcctcccgggagttgtcggtggcttggccggaatcgtcgccgtcgcaatgggagcttccaatacctccatggccatgcaggctgccgcactgggctcctccatcggcacagccgtggttggcgggctgatgacaggcacctag

SEQ ID NO: 203253 - DNA, 387 bp, Artificial Sequence
  Description of Artificial Sequence: Synthetic coding sequence
atgaagagcctgatcctgctggccatcctggccgccctggccgtggtgaccctctgctacggagaatggcagaaagaggagaatttcggattcgacattgtatctgtcctgagtcttaactggcatagggcacaggagagtcatgagtcaatggaatcttacgagttaaacccctttatcaataggcgcaacgctaatacctttatatctccacagcagcgatggcgggctaaagtgcaggaacgcattagagagcgctccaaacctgtgcatgagcttaacagggaggcctgcgatgattaccgtttgtgtgagcgctatgccatggtgtatggctataacgcagcttacaatagatactttcgcaagagaagggggacgaagtag

SEQ ID NO: 203254 - DNA, 339 bp, Artificial Sequence
  Description of Artificial Sequence: Synthetic coding sequence
atgaccgagaaggcccccgagccccacgtggaggaggacgacgacgatgagctggattcgaagctcaattacaagccacccccccagaagtccctgaaagagctgcaggagatggataaagatgatgagagcctaataaagtacaagaagactctattaggagacggacctgtggtgaccgatccgaaagccccaaacgtggtcgttacgagacttaccttagtatgcgagagcgctcccggcccgattaccatggacctgaccggcgatctggaggctctgaaaaaggaaactattgtactcaaggaaggctccgagtatcgcgtgaagattcattag

SEQ ID NO: 203255 - DNA, 606 bp, Artificial Sequence
  Description of Artificial Sequence: Synthetic coding sequence
atgaccgagaaggcccccgagccccacgtggaggaggacgacgacgatgagttggattctaaactgaactacaagccacctccccagaaaagcctgaaggagcttcaggagatggataaggacgacgaaagtctaattaagtataagaagacattactaggggacggacccgtcgtcactgaccccaaagcgcccaacgtggttgtcacccgtttgaccctggtgtgcgaatccgcccccggccccatcacaatggacttgacgggcgatctggaggcactgaaaaaggaaacgatagttctgaaagaaggctctgaatatcgcgtgaagatccactttaaggtgaaccgggatatagtctccgggttaaagtatgtacagcacacatatcggaccggcgtgaaggtggacaaagctactttcatggtgggttcctacggaccgcggccagaagagtatgagttcctgacccccgtggaggaggcccctaagggcatgctggcccggggtacctaccataacaaatctttttttacagatgatgacaagcaagatcacctttcgtgggaatggaacctgtcgattaagaaggaatggaccgagtag

SEQ ID NO: 203256 - DNA, 606 bp, Artificial Sequence
  Description of Artificial Sequence: Synthetic coding sequence
atgaccgagaaggcccccgagccccacgtggaggaggacgacgacgatgagctagacagcaaattaaactataaacccccgccccagaagagcctgaaggagctgcaggagatggacaaggacgacgagtcccttatcaaatacaagaaaaccctgctgggggacggtcctgtcgtgactgatcccaaagcccctaacgtagttgtgacgagattgacattggtgtgcgaatctgctcccggacccatcaccatggatctgactggcgaccttgaagccctgaagaaggaaaccattgtattaaaggagggatctgagtatcgcgtcaagatacacttcaaagttaatcgcgacattgtatctggcctgaaatatgtgcagcatacataccgtactggagtgaaggtcgacaaggcaacatttatggtaggcagttacggtccaaggccagaggagtacgaatttctgaccccagtagaggaagcgccaaaaggcatgctggcgagagggacttaccacaacaagagtttttttaccgatgatgacaagcaggatcacctatcttgggagtggaacctgagcatcaagaaggagtggacagagtag

SEQ ID NO: 203257 - DNA, 267 bp, Artificial Sequence
  Description of Artificial Sequence: Synthetic coding sequence
atgaccgagaaggcccccgagccccacgtggaggaggacgacgacgatgagctcgattccaagctgaattataagccgcctccccaaaaaagtctgaaggaactgcaggaaatggataaggacgatgagtcactcatcaagtacaaaaagacacttctcggagacggaccagtcgtaaccgaccccaaggcccctaatgtggtggtgacccgcctgaccttagtttgcgagtctgcccccggcccgataacaatggacttgacgtag

SEQ ID NO: 203258 - DNA, 480 bp, Artificial Sequence
  Description of Artificial Sequence: Synthetic coding sequence
atgaccgagaaggcccccgagccccacgtggaggaggacgacgacgacgagctcgatagcaaactgaattataaacctcctcctcaaaaatcgctgaaagaattgcaggaaatggacaaggacgatgagtctcttataaaatacaaaaagaccctcctaggtgacgggcccgtcgtgacggaccctaaagctcctaacgttgtagtcacccgcttgaccctggtgtgcgagagcgcacctgggccaatcacgatggacttgacaggagatctcgaagctctgaaaaaagaaacaatcgtcctgaaagaggggtccgagtatcgcgtgaagattcactttaaggtcaatcgggatatcgtttccggactgaaatacgttcagcatacctacaggactggggtgaaggtggacaaggcgacctttatggtgggctcctacggaccccgcccagaggagtacgagtttctgacccctgtgtag

SEQ ID NO: 203259 - DNA, 1320 bp, Artificial Sequence
  Description of Artificial Sequence: Synthetic coding sequence
atggaccccctgagcgagctgcaggacgacctgaccctggacgacacaagtgaggccttaaatcagcttaagctcgcctcaattgacgagaaaaattggccgtctgatgagatgcccgatttccccaagtctgacgacagcaagtcatcaagtcctgaacttgtgacgcacctgaaatgggatgatccttattatgatattgcaaggcaccaaatagtagaggtggcaggtgatgacaaatacggcagaaagattatcgtgttcagcgcatgtaggatgcccccttcccaccagctcgatcacagtaaattactgggatatcttaagcacaccctcgaccaatacgtggaaagtgactacaccctactgtaccttcaccatgggttaacaagcgataacaaaccaagcctgtcttggctgcgggatgcttaccgggaattcgacagaaaatacaaaaagaacataaaggccctgtacatagtgcacccgaccatgtttattaagaccttactgatcctctttaagccactgatctcttttaaattcggacagaagatcttctatgtaaattatctcagcgaactgtccgaacacgtcaagcttgagcaattaggaattcctaggcaggtgctgaaatatgacgacttcctgaaaagcacccagaagagccccgccaccgcccctaaacccatgccgcccagacctcccttgccaaaccagcagtttggtgttagtctgcaacacctacaggaaaagaacccggaacaagaaccaatccctatcgttctgcgtgagaccgtggcctatctgcaggctcacgccctgacgaccgaggggatcttccggcgttcagccaacacccaggtcgtgcgagaggtccaacagaagtacaacatgggactcccggttgactttgaccagtataacgagctgcacctgccagctgtcattttaaagacatttctgcgggagctgccagagcctctgctaactttcgacttgtacccccacgttgtgggcttcctaaacatcgatgagagccaaagggtcccggcaacccttcaggtgctgcaaactcttccagaagaaaactaccaagtgctgaggttcctgacagcctttcttgttcagatctcagcgcactctgaccagaacaagatgaccaatactaacttggccgtagtctttggccccaatctgttgtgggccaaggacgcagccattacacttaaagccattaaccctatcaacacgttcacaaaattcctcttggaccatcagggcgagctttttccttctcctgacccatccgggctgtag

SEQ ID NO: 203260 - DNA, 1377 bp, Artificial Sequence
  Description of Artificial Sequence: Synthetic coding sequence
atggaccccctgagcgagctgcaggacgacctgaccctggacgacacctccgaagctctgaatcaactcaagctggcaagcattgatgagaagaactggcccagcgacgagatgcccgacttcccaaagagtgatgacagtaaatctagcagcccagagctggtaacgcacctcaagtgggatgatccttactacgacatcgccaggcaccagattgtagaggtggcaggtgatgataaatacggaaggaagatcatcgtgttctctgcctgtcggatgcctccatcccatcagctggatcactccaagctgctgggttatctcaaacacacactggatcagtatgtggagtccgattatacacttctttacttgcaccatggcctgacctctgacaacaaacctagcctctcctggttgcgtgacgcataccgagaatttgaccggaagtataagaagaacatcaaggctctctatatagtgcaccccacaatgttcatcaagaccctcctgatactttttaagcccctcatctcattcaagtttggccaaaaaatattctatgttaactacctctcagagctctcagaacacgtgaagctcgagcagctgggaatccctaggcaggtcctaaaatatgatgatttcctcaagagcacgcagaaatccccagccactgctccaaagcctatgcctccccgtcctccacttcctaatcagcaatttggggtttccctccaacatcttcaggagaaaaatcccgagcaggaacctattccgatagtgctgcgagaaaccgtggcctatttgcaagcccacgctttgacaacagaaggcattttccgacgctctgccaatacacaagttgtgcgtgaggtccagcagaagtataacatggggctcccagtagactttgaccagtacaacgaactgcacctgcctgctgtcatcctgaaaactttcctgcgggaactgccagagccactcttgaccttcgatctgtatccacacgtggtgggctttctcaacattgatgaatctcagagagtgcctgccaccttgcaggtgttgcaaacccttccagaggagaactaccaggtcctgcggtttcttactgcctttttggttcagatctcggctcacagcgaccagaacaaaatgaccaatactaacctcgccgttgtctttggcccaaatctcctgtgggccaaagacgcggctataactttaaaagctatcaatcctatggctactttcttcttctttttccttaggtggagtctggcactgtcccccggatggtcagccgtagctcgaagccggcacactagcgctttctgggtgcaggctatcttgttgcctcaaccccccgagtag

SEQ ID NO: 203261 - DNA, 579 bp, Artificial Sequence
  Description of Artificial Sequence: Synthetic coding sequence
atggaccccctgagcgagctgcaggacgacctgaccctggacgacacctctgaggcccttaaccagcttaagctggcaagcattgatgagaagaactggccttcggacgagatgcccgattttccgaaaagcgatgacagcaagtcgtcaagccccgaactggtaactcacctgaagtgggatgacccatattacgacatcgctcggcaccaaatcgtagaggtcgcaggcgatgataaatacggccgcaaaattatcgtgttctctgcttgcagaatgccgccaagccatcagctggatcattccaagctgttgggatacctgaaacataccctcgatcagtatgtcgaatccgattacactctgctgtacctgcatcacggcctgacatctgataataaaccctccctgtcatggttgcgtgatgcctatcgggaattcgacaggaaatacaaaaaaaatatcaaagccctttatattgtacaccctacaatgttcattaagacccttctgattctgttcaagcctctcatctcctttaaatttggacagaaaatcttttatgtgaattacttatag

SEQ ID NO: 203262 - DNA, 2361 bp, Artificial Sequence
  Description of Artificial Sequence: Synthetic coding sequence
atgggcctgcagcccctggagttcagcgactgctacctggacagcccgtggtttagggaacgtatacgagcacacgaggccgagctggagaggaccaacaaatttattaaagaactcatcaaggacggaaaaaacctgatcgccgctaccaagagtctatctgtcgcacagagaaagttcgctcattcccttagagactttaagttcgagtttatcggcgatgctgtgacagacgatgaaaggtgcattgatgcttccctgcgcgagttctcaaatttcctgaaaaacctggaagaacagcgagagatcatggccttgagcgtcaccgagaccttaatcaaacccctggaaaaatttaggaaagaacagttgggagcggtaaaagaagagaaaaaaaaattcgacaaggaaactgagaaaaattattccctaatagataagcacctgaacctttccgcaaagaagaaggatagccatctacaggaagccgatatacaagtggagcagaaccggcaacatttctatgaactctccctggagtacgtctgtaaactgcaggaaattcaggaaaggaagaaattcgagttcgtcgagccgatgctgtccttcttccagggcatgtttactttttatcaccagggccacgagcttgccaaggattttaaccactataagatggagttgcagattaacatccagaatacacgcaacagattcgagggcactcgcagcgaagtggaggaacttatgaacaaaattcgccaaaacccaaaggatcataagcgggcgtcccaatttactgctgaggggtatctgtatgtgcaggagaaacgcccggctcctttcggttcctcctgggtgaagcactattgcatgtaccgaaaggctgcaaagaagtttaacatgattccattcgagcaccgctcaggaggtaagttaggggacggggaagttttctttctgaaagagtgcacaaagcgacacacagatagcatagacagaaggttctgttttgacattgaagccgcagataggcctggtgtctcactgacgatgcaggctttctctgaagaagaacgtaaacaatggctggaggcccttggcggcaaggaggcgctttcccactcattcaatacggcaattatacctcgcccagaaggaaacgcccagctcgataagatggggttcaccatcattaggaagtgtatctccgctgttgagactagaggaatcaatgaccagggactgtaccgggtagtgggtgtctcttctaaggtccagcggttgctgtctatgctgatggacgtcaaaacctgcaacgaagtcgatctcgagaacagtgccgattgggaagtgaagactatcacatctgcactgaaacaatatctccgcagtctacccgaacctttgatgacctacgagttgcatggcgacttcattgtaccggccaaaagcggctccccagagagtcgcgttaacgcaatccactttctggtgcacaaactgcccgagaagaataaagagatgcttgatatcctggtgaagcacttaacaaacgtgtctaatcacagtaagcaaaacctcatgacagtggccaacctgggcgttgtctttggacctactctcatgcgcccacaggaagaaaccgtggccgctctgatggacttgaaatttcagaatattgtggtggagatcctgatcgagaaccatgagaagatttttcggacaccccccgataccacctttccagagccaacatgcctgtcagcatcacctccgaacgcaccgccacgccagtcaaagcgccaggggcagagaaccaaacggcccgtcgcggtgtataatctgtgcctggagctcgaggatggtgacaacccttatccaagcaaggaggacacccccacctcttccttggattccctctctagcccatcacctgttaccacggccgtacccggtccacctggccccgataagaaccatttacttgccgacggcggatctttcggggattgggcctccacaatccccgggcagacaaggtccagtatggtccagtggctgaatccgcagtccccaactacaacctcttccaactccgctgtaacacctctgagtcccggttcctctccctttccgttctcgccacctgctaccgtggcggacaagccccccgaatctattcgatcccgtaaggccagagccgtgtacccctgcgaagctgagcattcctcagagctctcttttgaaattggggcaatcttcgaagatgtgcaaacctcaagagagccaggatggctcgaagggaccctgaatggaaaacgcgggctgatccctcagaactacgtcaagctattgtag

SEQ ID NO: 203263 - DNA, 1155 bp, Artificial Sequence
  Description of Artificial Sequence: Synthetic coding sequence
atgcaggccttcagcgaggaggagcggaagcagtggctggaggccctgggaggcaaggaagcactatctcattcttttaacaccgccattataccccgaccagaggggaacgcccagttggacaagatgggtttcaccattataagaaagtgtatttccgccgtcgagaccagaggaattaacgaccaggggctctatcgggtggtcggtgtgagttccaaggtgcagaggctattgtccatgctgatggatgtcaaaacttgcaacgaagtcgacttggaaaactctgctgactgggaggtgaaaaccatcacatcagccctcaagcagtacctgagaagcctgcccgagcccctgatgacatacgagttgcacggcgactttatcgtgccagctaagtcaggtagcccagaaagtcgcgtcaatgcaatccacttcttggtccataagttgcctgaaaagaataaggaaatgctagacatactcgtgaagcacttgacgaatgtgagcaatcacagtaagcagaacctgatgactgtcgccaacctgggggtggtgttcggtcctaccctgatgcggcctcaggaagagacggtggctgctctgatggatctgaagttccagaacattgtggtggagatcttgattgagaaccacgagaaaatatttcgtactccccctgacaccacatttcctgagccaacttgcctgtcagctagcccacccaacgcacctcccaggcagagcaagcgccagggccagagaacgaagcgcccggttgcggtctataatctctgccttgaactggaggatggggacaacccttatccttcaaaagaggataccccaacgtcatcgctcgattcccttagcagcccaagcccagtgaccactgcagtccctggcccacccggccccgacaagaatcacctgctagccgacggggggagtttcggcgattgggcctcaactattataagaagcagaaaagcacgtgcggtctacccctgtgaagccgagcattcctccgaactgtcatttgaaatcggggcgatctttgaagatgtacagacgagtcgagagcctgggtggcttgaaggtacactgaacggtaagagagggctcattcctcagaactatgtaaagctgctgtag

SEQ ID NO: 203264 - DNA, 3072 bp, Artificial Sequence
  Description of Artificial Sequence: Synthetic coding sequence
atgtgggaccagcggctggtgcggctggccctgctgcagcacctgcgggcattttacgggattaaggtaaaaggtgtgcgaggacagtgcgatagaagaaggcatgagacggcagccactgagatcggcggtaagatctttggcgtcccctttaatgccctgcctcatagcgccgtccctgagtacggacatataccctcctttttggttgacgcgtgtacctcacttgaagatcatatccacaccgaggggctcttcagaaaaagtggctcagttatcaggcttaaggccctcaaaaataaggtcgatcacggtgaaggctgtctcagctccgccccaccatgtgacatcgccggactgcttaagcagttcttcagggagctgccagaacccatactgcccgcagatctccacgaagctctgctaaaagcccagcagctgggcaccgaagaaaaaaacaaggccactctcctcttgtcttgtttgttagcagatcatactgtacatgtgttgcgctattttttcaattttctgagaaatgtctccctacgaagttctgagaacaagatggatagttctaacttagcggtgattttcgcccccaatttgctccaaacctctgaaggccatgagaagatgtcctctaacacggaaaagaaactccgccttcaggctgccgtggtacagaccttaattgattatgccagtgatattggaagagtacccgattttatactggagaagatccccgcgatgctgggcattgatgggctgtgtgctacaccgtctctggagggattcgaggaaggggagtacgagacacccggcgaatataagagaaagagaaggcagagcgtgggggactttgtgagcggtgcattgaacaagttcaaacccaaccggaccccttccatcacgcctcaggaagaaaggatagcacagctgtccgagagcccagtgatcctgactcctaatgcaaagaggactctgcccgtagattcttctcatggctttagctcaaagaagcggaaatctataaaacacaacttcaattttgagctgctgccctctaatttattcaattctagcagtacccctgtgtcagtgcatatcgatacttccagcgagggtagtagccaatcaagtctgagcccggtccttatcgggggcaaccacctaattacggccggagtcccccgacgcagtaaacggattgcaggaaaaaaagtttgtcgggtggagtccggcaaggcaggatgcttcagcccaaagatatcccacaaagaaaaagtgaggcggagtctgaggttaaagttcaatctgggaaaaaatgggcgcgaagtgaatgggtgcagcggggtgaataggtatgagtctgtcgggtggaggctggccaatcagcagtccctcaaaaaccgtatcgagagcgtcaaaaccggcctacttttctcgccagacgttgatgaaaagctgcctaaaaaggggtcagagaaaatctccaaaagcgaggagaccctgctgacacccgagcggttagtggggacaaactaccgcatgtcatggacgggccccaacaatagctcattccaggaagtcgatgcaaacgaagcctcaagcatggtggagaacctggaagtcgagaactctctcgaaccggacatcatggttgaaaagagcccagcaacctcctgtgaactaactcccagtaatctgaacaacaaacacaatagtaacattacctcatctccgttgtcaggagacgaaaacaatatgaccaaggaaacccttgtaaaagtgcaaaaggcattttctgaatccggctccaacctgcacgcactgatgaaccagaggcagtcatcagtcactaatgtgggtaaggtcaaactgacagagcccagctacctggaggacagcccagaggagaacctgttcgagacaaatgacctgacaatcgtggaaagtaaagagaaatatgaacaccataccgggaaaggggaaaaatgtttcagcgaaagagactttagtcccctgcagacacagacctttaacagagaaacaactatcaaatgctattccacccagatgaagatggaacacgaaaaggacattcattcgaatatgcccaaagactatttatctaaacaggagttttcttctgatgaagaaatcaaaaagcagcaaagtccaaaagataagcttaacaacaaactgaaagagaatgagaacatgatggagggaaatctacctaaatgtgccgcacattcaaaggatgaagcaaggagctcttttagtcaacagtcaacctgcgtcgtgactaatctaagtaagcctagacctatgcggattgctaaacaacagtctttagagacctgcgagaagacagtgagcgaaagctcacaaatgactgagcaccggaaggtgtccgatcatatccagtggttcaataaactcagcctgaatgagccaaacaggatcaaagtcaaatctcccctgaagttccaacggacgcccgtgcgccagagtgttcggcggataaatagtcttttggagtactcacgccaaccaactgggcacaaactggcttcactgggggataccgcatcccccctggtgaagtccgtgagctgcgacggcgccctttcatcctgcatcgaatctgccagcaaggactccagtgtttcttgcatcaagtctggcccgaaggaacagaaatctatgagctgcgaagaatccaatattggcgctatctctaagtccagcatggagcttccctctaaaagcttccttaaaatgcgcaagcaccccgacagtgtcaatgcctctctccgtagtactaccgtctataaacagaaaatcctgagcgatgggcaggtcaaagtgccccttgatgacctgaccaatcatgatatagtcaaaccagtggtgaacaataatatgggcataagctcgggcattaacaatagggttctgagaaggcccagtgagcgaggtcgcgcctggtacaagggttcacccaaacatcctattggcaaaacccagcttctccctacctctaagccagtcgacctgtag

SEQ ID NO: 203265 - DNA, 2505 bp, Artificial Sequence
  Description of Artificial Sequence: Synthetic coding sequence
atggacagcagcaacctggccgtgatcttcgcccccaacctgctgcaaacctccgagggccatgagaagatgagcagcaacactgaaaagaaactgagattacaggcagccgtggtacagaccctgattgactacgccagcgatatagggcgagtgcctgactttatcctggagaagattcctgctatgctcggaatcgatggactgtgtgccaccccttcccttgaaggattcgaggagggggagtacgagaccccaggcgaatacaaacgcaaacgccgtcagtctgtgggagatttcgtcagcggcgccttgaataaatttaagcctaatcgtactccctcaatcacaccgcaggaagaacggattgcccagttgtccgaaagtcccgtcatcctgacacccaacgcaaagaggacactccccgttgattctagtcatggtttctctagtaaaaaacggaagtccatcaaacataactttaactttgagctgctgccgtctaatctatttaattcttcctcaacgcctgtaagtgtacacatcgacacgtctagcgaaggttcaagtcagtccagcctttctcccgttctgatcggaggaaaccatttgataacagcaggcgttcctaggagaagcaagcgtattgccggtaagaaggtttgtagagtcgaatcgggaaaggcgggctgctttagtccaaagatctctcacaaagaaaaggttagacgttcactgaggttgaagttcaaccttggtaagaacgggcgagaggtgaacggttgctcaggggtcaaccgatatgaatccgttggctggagactggccaaccaacagagccttaaaaatcggattgagagcgtaaagactggccttctgttctcacctgatgtggatgagaaattgcctaaaaagggtagcgagaaaatcagtaagtctgaagaaaccctgctgacacctgagagactggtgggtacaaactatcgaatgtcatggacgggcccgaacaacagcagtttccaggaagttgacgccaacgaagcctcatcaatggtggagaacttggaggtggagaatagcctagagccagacattatggtggaaaaatctcccgcaactagctgcgaactgaccccttcaaaccttaataataagcacaactccaatataacatcaagccctctgtccggcgatgagaataatatgacgaaggaaaccctggtaaaagtgcagaaggcattctccgagagtggatccaacttacatgcactcatgaaccagcgtcagtcgtctgtcaccaacgttgggaaggtgaagttgacagagcctagctacctcgaggatagtccagaggagaatctttttgagactaatgacttgactatagttgagagtaaggagaaatatgagcatcataccggaaagggcgagaagtgcttctctgaacgcgacttctccccgctgcagacccagacatttaacagggaaaccaccatcaaatgctactcaacccagatgaaaatggaacacgaaaaggacattcattcaaacatgccaaaagactatctcagcaagcaagagttcagcagcgacgaggagattaagaaacagcaatcccccaaggataagctgaataacaaacttaaagaaaatgagaacatgatggagggcaacctccccaaatgcgctgcccactccaaggatgaagcccggtcgtctttctcccagcagtctacctgcgtcgtgaccaacctctcaaagccaagacctatgaggatcgcaaagcagcagagtcttgagacctgcgagaagacagtttcagagagcagccagatgacggaacatcgcaaggtttcagatcatattcaatggtttaacaaactatccctgaatgagcccaacagaattaaagttaagtccccgttgaagttccaacgaacaccggtgagacagtcagttcggcgaattaatagcctgctggaatattctagacagcctaccggccacaagctggcttctttgggagatactgccagcccactcgtgaagagcgtgtcttgcgatggggcattgagctcctgcatcgagagcgcaagcaaggattcttccgtgtcctgcattaagtctggccccaaagagcagaagtccatgtcctgtgaggaatcaaacatcggggcaatttctaaaagctcaatggaactgccctctaagtcttttttgaaaatgaggaaacaccccgattcagtcaatgcttccctaagaagtacgactgtttacaagcagaaaatcttaagcgatggacaggtaaaagttccacttgacgacctgaccaaccacgatatcgtgaaacccgtcgtcaataataacatgggcatctcttccggaataaacaatcgcgtgttgagacggccatctgagagggggagagcctggtataagggcagccctaagcaccctattggcaaaacccagctgctccccaccagcaaacctgtcgacctgtag

SEQ ID NO: 203266 - DNA, 1506 bp, Artificial Sequence
  Description of Artificial Sequence: Synthetic coding sequence
atgtgggaccagcggctggtgcggctggccctgctgcagcacctgagggctttttatgggatcaaggtcaaaggggtgcgggggcaatgcgacagaaggcgacacgaaactgctgccacagaaattggcggcaagattttcggcgtgccgtttaatgcccttcctcacagtgccgtcccagagtacggtcacataccaagctttcttgttgatgcttgtacctctttggaagatcacatccacacggaaggcctgtttaggaagagcgggtccgttatccgcttgaaagctctgaaaaacaaagtggaccacggcgaagggtgcctctcatcagcaccaccttgcgacatagccggcctcctcaaacaattctttagggagctcccagaacccatcctccctgctgacctgcatgaggcactcctgaaggcccaacaattaggcacggaggagaaaaacaaggccacactcctcctgagctgcttactagccgaccacaccgtgcacgtgcttaggtacttcttcaattttttaaggaacgtgagtcttagaagctctgagaataagatggactcctcaaacctagccgtgatctttgcaccaaaccttctacaaaccagcgaaggacatgagaagatgtcctcaaatactgagaaaaaattgagactgcaggccgcggtcgtgcagactcttatcgactatgcctctgatataggaagggttccagacttcatcctggaaaaaatccccgccatgcttggaattgacgggctatgtgcaacccctagcctggaaggattcgaggagggagagtacgagactcccggtgagtataagcgcaagcggaggcagtcggttggagattttgtttccggtgcactgaataagtttaaaccaaaccggaccccttcaatcacaccgcaggaggagaggatagcccagctctcagagtcacccgtgatcttgacgccaaatgccaagcgaaccctgcccgtcgattcaagccacggcttttccagtaagaagcggaagagcattaaacataactttaacttcgagctcctgccgtcaaatctgtttaatagctcctctaccccagtgtctgtgcatatcgatacgagctcagagggatctagccagtcatccctatctccagtactgattgggggaaatcacctcattacagctggtgttccacgacgatctaagcgcatcgccggcaagaaagtgtgccgggtggagagcgggaaagccggatgtttttcaccaaaaatctctcacaaggagaaggtgagacgctccctgcgactgaagtttaacttagggaaaaatggccgggaggtgaatgggtgttccggagtgaaccgctatgaatccgtggggtggcgcttagccaatcaacagagcctgaaaaatcgtatcgagtccgttaagacaggactgctcttttcaccagatgtagatgaaaagcttccgaagaaaggcacattcacgtactattgttag

SEQ ID NO: 203267 - DNA, 2385 bp, Artificial Sequence
  Description of Artificial Sequence: Synthetic coding sequence
atgaagatggccgaccggagcggcaagatcatccccggccaggtgtacattgaagtagaatatgactatgagtacgaggcgaaagaccgcaagatagtaatcaagcagggagaacggtatatattagtgaaaaaaactaacgacgactggtggcaggtgaagccagatgagaatagcaaagccttctatgttcccgcccagtacgtgaaggaagtaaccaggaaggccctcatgcctccggtgaagcaggtggccgggctgcctaataacagcactaaaatcatgcagagtcttcatctacagcggtctaccgagaatgtgaacaaactacccgaattgtctagttttggcaagcccagttcttctgtgcaaggaaccggcctgattcgggatgcaaaccagaactttggcccatcttacaatcaaggccagaccgtgaacctcagcctggaccttacccacaacaatgggaagttcaataatgacagccactcacctaaagtgtcaagccaaaatcgtacaagatcattcgggcacttccctggaccggagtttctcgacgtggagaaaacgtcctttagtcaggagcaaagttgcgattctgccggcgagggctccgagcgcatacaccaagacagcgagtccggcgacgaactttcatctagcagtacggagcagatccgcgctacgaccccgcctaaccagggccggccagacagccccgtctacgccaatctccaagagcttaaaatctctcagtctgccctccctccactccctgggtctcccgccatccaaattaacggcgagtgggaaacccacaaagacagctcaggcaggtgttattattataaccgagggacgcaagagagaacctggaaacctcccaggtggacccgagacgcttcaatttctaaaggagactttcagaacccaggagatcaggaatggctcaagcacgtagacgatcagggcaggcagtattactatagcgccgatggctctcggtcggagtgggagctccctaagtataacgcttcgagtcagcagcagcgtgagatcatcaagtcacggtccctggaccggagactccaggaacccatagtactgaccaagtggcggcattccacaatcgtgctggatacaaacgataaggagtcccctacggcttctaaaccttgtttcccggaaaatgagtctagtccatcatcccctaagcatcaagacaccgatcaggaaaagtatgggcttctgaacgtgacaaaaatagccgagaacggtaaaaaagtgcggaagaactggctgtccagctgggcagtgctgcagggtagttccctgttgtttaccaagacacaggggtcgtcaactagttggttcggtagcaatcagagcaagccagagttcactgtcgatttaaaaggggcaactatagagatggcttctaaggacaaaagtagtaagaagaatgtctttgagctgaaaaccagacagggcacagaacttttaatccaaagcgacaacgacactgtgatcaatgattggtttaaggtgctcagtagcaccataaataaccaagccgtcgagaccgacgaggggatagaagaagagatacccgacagccctgggattgaaaagcacgacaaagagaaggagcagaaggaccctaagaagcttcggtcttttaaagtgtcctcaatagactcctctgagcagaagaaaactaaaaaaaatcttaagaagttcctgacccgcaggcctacactgcaggccgttcgcgagaagggatatatcaaggatcaggtgtttgggagcaacctggccaacctgtgtcagcgcgagaacggcaccgtgcctaaatttgtaaagctctgtatcgagcatgtcgaagagcatggactggacattgatggtatctacagagtttccggcaacttagcagtcattcaaaaactgcgtttcgccgtgaaccatgacgaaaagctagacctgaacgacagcaaatgggaggacattcatgtcattaccggggctctcaaaatgttttttagagaactccctgagcctctattcacattcaaccactttaacgatttcgtaaacgccattaagcaagagcccaggcagcgcgtggccgccgttaaggatctcatccggcagctaccaaagccgaaccaagatactatgcagattctgtttaggcatctgcgacgtgtcatcgaaaacggcgagaaaaatcgcatgacctaccagtccatcgcaattgtgtttggccccacactgctcaaaccggaaaaggagacagggaatatagccgttcatacagtgtaccagaaccagatagtggagctaatcctactggaactttcaagtattttcggaaggtag

SEQ ID NO: 203268 - DNA, 2541 bp, Artificial Sequence
  Description of Artificial Sequence: Synthetic coding sequence
atgaagatggccgaccggagcggcaagatcatccccggccaggtgtacattgaagtggagtatgattacgaatatgaagccaaagaccggaaaatcgtgattaaacagggcgagcgttatatacttgtgaagaagacaaatgatgactggtggcaggttaagcccgatgaaaacagtaaagcattttacgtcccagcccagtatgtgaaggaggtgacacggaaagcactaatgccaccggtgaaacaggtggctgggctccccaataatagcacgaaaataatgcagagcctccatctgcaaagatccaccgagaatgttaacaagctgcccgagctttccagcttcgggaagccgtccagctccgtacagggcacaggcctcatcagggatgccaaccagaactttggtccctcctacaatcaggggcaaacagtgaacctgtccctcgaccttacgcacaataatggaaagttcaataatgattctcatagccctaaagtgagctcccaaaacaggacaaggagtttcgggcattttcctggcccagagttccttgacgtcgaaaaaacatccttcagtcaggagcagagctgtgactctgccggcgagggtagcgagagaatccatcaagattcagaatccggcgacgaactatcctcatcctccacggaacagatcagggccacgactccccctaatcaggggcgcccggatagccccgtctatgcaaatttacaagagctgaaaatttcccagtccgccttgccgccactgcctgggagcccagctatccagatcaacggcgaatgggagacacacaaggactcgtccggacggtgctattattataaccgtgggacccaggaaaggacctggaagccgccccgctggaccagagacgcatcgatcagtaagggtgattttcagaatccaggagaccaggaactgctgtctagcgaggagaactactatagcacttcttatagccagagtgattcccagtgcggatctcctccccgtgggtggagtgaggaattggacgaacgcggtcacaccctgtacacctccgactacacgaacgaaaaatggctgaagcacgtcgatgatcaaggcaggcagtattactatagtgctgatggcagcaggagcgaatgggaacttcccaagtacaacgcttcctctcaacaacaacgagaaattatcaagagcagatctttggatagaagacttcaggagcccatcgtgttgacaaaatggaggcactctacaattgtgctggatacaaatgataaggagtccccgaccgctagcaaaccctgcttccccgagaatgaatcctctccatcctcgcctaaacaccaggacaccgcgagcagcccaaaagatcaggaaaagtatgggctcctgaacgtcaccaagattgccgagaatggcaagaaggtgcgtaaaaattggctgagctcttgggccgtgctgcaaggatcaagcttgctgttcactaaaacccagggcagttcaacctcctggttcggatcaaatcagtccaaacctgagtttaccgtcgatcttaaaggggctaccattgagatggcatccaaggacaagtcctccaagaagaacgtgtttgaactgaaaacacgccagggaacagagttgctcatccagtcagacaatgatacggtcatcaatgattggtttaaagtgttgtcaagcactatcaacaatcaggccgtggagaccgatgagggtatagaagaggaaatacccgattctcctgggatcgaaaaacatgacaaagagaaagagcagaaggatcctaaaaaactgaggtcttttaaggtgtcgagtatcgatagctctgagcagaagaaaaccaaaaagaacttgaaaaagttcctgactagaaggccaacccttcaggctgtccgggaaaaggggtacatcaaggatcaggtttttggctcaaatctcgctaatctgtgccagagggagaacggcacggttcccaagttcgtgaaactctgcatcgagcatgtcgaggaacacggcctcgacattgatggcatttacagagtgtctggaaacctggctgtgattcagaaactgcgattcgcggtgaatcacgatgagaagctagacctcaatgacagcaaatgggaagacattcatgtaataacaggtgccctgaagatgttcttcagggaactccctgagcccctcttcactttcaatcacttcaacgatttcgtgaacgccatcaaacaagagccacggcagcgggtcgctgcagtcaaggatctaatacgtcaactgcccaagcctaatcaagatactatgcagatcctctttagacacctgagacgcgtcatcgagaatggcgagaagaatcgcatgacctatcagtctatcgctatcgtgtttgggcctacactactgaaacctgagaaggagactggtaatattgccgttcacacagtataccagaatcagattgttgagctgatcctactggagctttccagcatcttcggacggtag

SEQ ID NO: 203269 - DNA, 2385 bp, Artificial Sequence
  Description of Artificial Sequence: Synthetic coding sequence
atgaagatggccgaccggagcggcaagatcatccccggccaggtgtacatcgaagtggaatacgattacgagtatgaagcgaaggataggaaaatcgtgatcaaacagggcgaaagatatatattagtcaaaaaaaccaacgatgattggtggcaagtgaagccagacgagaattccaaggctttctatgtgcccgctcagtatgttaaggaagttacaagaaaggccctcatgcctcccgtgaaacaagttgctggccttcccaataattcgaccaaaatcatgcagagtctgcatctccagcggagtaccgaaaacgtcaataaattgcccgaactgtcttcctttggtaagccctctagcagcgtgcagggcacgggcctcatacgggacgcaaaccagaattttgggcccagctataatcagggtcaaacagttaacttgagtcttgatctgacccacaacaacgggaagtttaacaatgattcacactccccaaaagtgagtagtcagaatcggacgcgttcattcggacatttccctgggcccgagttcctggatgtggagaaaacaagtttttcccaggaacagtcttgcgactccgccggggagggaagcgagagaatccaccaagactcagagtctggagacgagctaagcagctccagcaccgaacagatccgcgccactacaccccccaatcaggggaggcctgactctcctgtttatgccaatcttcaggagctcaaaatctcccaatcagctttacctcccctcccggggagtccggccatccagatcaatggggagtgggagacacataaagactctagtggtcggtgttactactacaataggggaacccaggagcgaacgtggaaaccaccaagatggacccgggatgccagtatttctaagggtgattttcaaaatccaggtgatcaggaatggctaaaacatgttgacgatcagggacgccaatactactatagtgctgacggctccaggagcgagtgggaactccctaagtataatgcctcctcccagcagcagcgggagattattaagagccgatctctggaccgcaggctacaggagccgatcgtcctgacgaagtggcgccactccactatcgttttggacacaaacgacaaggaatcaccaaccgcaagtaagccgtgctttcccgaaaacgaatccagcccctcctcgccaaagcaccaggacactgaccaggaaaagtatggccttctcaacgtgactaaaatcgccgaaaacggcaagaaagtacgcaaaaattggcttagcagctgggccgtgctgcagggctcatcgttgttattcaccaaaacccaggggagcagtacctcctggttcggttcaaaccagagtaagcccgagttcacagtcgacctcaagggcgctacgattgaaatggctagtaaagacaaaagtagcaaaaaaaacgtgttcgagctgaagacacgacaggggacagagctgttgatacagtcagataacgacactgtgatcaacgactggttcaaggtgctgtcatctaccattaataaccaggcagtggagacggatgaaggaattgaggaagaaatccccgacagccctgggatcgagaagcatgacaaggagaaggagcagaaagacccgaaaaagctccggagtttcaaggtctcttctatagacagcagtgagcaaaagaagaccaaaaagaaccttaaaaaatttcttacgaggcgacccacactccaggccgtgagggagaagggatacatcaaggatcaggtcttcggatctaatctggctaatttgtgtcagcgagagaacggaacagtgcccaagtttgtgaaactgtgtattgaacatgttgaggagcacggcctcgatatagacggtatttaccgggtgtcaggaaaccttgccgtgattcagaaattaaggttcgctgtgaatcatgatgagaaactagatctcaacgactccaagtgggaagatattcatgtgatcaccggtgcactgaaaatgttctttagagagctcccagagcccctctttacctttaaccacttcaacgattttgttaacgctatcaagcaggagccgaggcagagagtggccgccgttaaagatcttatccgccagttgccaaaacctaatcaggacaccatgcaaattctcttccgccatctccggcgcgtaatcgagaacggggagaagaatcggatgacatatcaaagtattgctatagtttttggtcctactctgctgaagccagagaaagagaccggaaatattgctgtccacaccgtataccagaaccagatcgtggaactcattctgctcgagctgagtagcatctttggccgttag

SEQ ID NO: 203270 - DNA, 2451 bp, Artificial Sequence
  Description of Artificial Sequence: Synthetic coding sequence
atgaagatggccgaccggagcggcaagatcatccccggccaggtgtatatcgaggttgaatatgactacgagtacgaggccaaggacagaaagatcgtgatcaaacaaggagagaggtatatcctggtgaagaaaactaatgatgattggtggcaagtgaagcccgatgagaacagcaaggcgttttacgtgcccgcccagtatgtgaaggaggttacccggaaggccctgatgccaccagtaaagcaggtggcggggcttccaaacaattcaacgaagatcatgcagagcctgcacctgcaaagatctacagaaaatgtgaacaaattgcctgaacttagtagcttcggaaaacctagcagctccgtccagggaacagggttaatacgtgatgcaaaccagaactttggcccttcatataaccaggggcagaccgtgaatctgagcttggacttgacccacaataacggcaagttcaacaacgactcacactcacccaaggtcagctcccaaaaccggactaggagcttcgggcacttccctggacccgagttcctcgatgtcgaaaaaacctcatttagtcaggagcagagctgtgactccgcgggtgagggctccgaaaggatccaccaggactcagagtccggggacgaactgagttcttcctctacggaacagatcagagccacgactcctccgaaccaaggcaggccggatagccccgtctacgcgaacctgcaagagctgaagatctcccagagcgccttacccccactccctggttcgccggcgatccaaatcaacggtgagtgggaaacacacaaagatagctccggaagatgttactattataaccgaggaacacaagagaggacatggaaaccccccaggtggacgagggatgctagcatatccaagggtgacttccagaatccaggggaccaggagctgttgagctcagaggaaaactattactccaccagctattcacagagcgatagtcaatgcggttctcctcctagagggtggagtgaagaactggacgaacggggtcacaccctctacaccagcgactacacaaacgagaagtggctgaagcacgtggacgatcaggggcggcagtactactactctgctgatggatcccggtcagagtgggagctccccaagtataacgcgtcttcgcaacaacaacgcgaaattatcaaaagccgtagtctggatcgcagactgcaggaacccatcgtcttgacaaagtggagacattccaccattgtcctggataccaacgataaagaccaggaaaagtacggactccttaatgtgaccaagattgcagagaatggaaaaaaggttcgcaaaaactggctcagttcttgggcagtgctgcaggggagctcacttttattcacgaaaacgcaggggagttccacatcatggtttggatcaaaccagtccaaacctgagttcacggtggacttaaagggcgccactatcgagatggcctctaaagacaagagttccaagaagaatgtgtttgaactgaaaacgaggcaggggaccgagcttctcatacaatctgacaacgataccgtcatcaacgactggttcaaggtcctgagttcgacgatcaacaaccaggctgtggagactgatgagggtatagaagaagagattccagactcccccgggatcgaaaaacatgacaaagagaaagagcagaaagatcctaaaaagctgaggagcttcaaggtgtcttcaattgacagttctgaacagaagaaaactaaaaagaacctgaagaaatttctgacccgacgccccacactccaagcggtaagagaaaaaggctacatcaaagatcaggtcttcggaagcaatttggccaacctgtgtcaaagggagaatgggacagttcccaaattcgtaaagttgtgtattgaacacgtagaagagcacgggctggacatcgatgggatataccgggtctccggcaatttagccgtgattcagaaacttagattcgcggtgaaccatgacgagaagctggatctgaacgattctaagtgggaagatatccacgttatcactggagcactcaaaatgttctttcgtgagctgcctgagccgctgttcacttttaatcactttaacgatttcgtcaatgccatcaaacaggagccccggcagcgggtcgccgctgtgaaagacctgattcgacagctgcctaaaccaaaccaggataccatgcaaatcctctttaggcatctaaggagggttattgagaacggcgaaaaaaacaggatgacatatcagagcattgccattgtcttcggcccaactctcctcaagccagagaaggaaaccggaaatatcgccgtgcacacagtgtaccagaaccagattgtggagctgattctgctggagctgtcatctatctttgggcggtag

SEQ ID NO: 203271 - DNA, 2526 bp, Artificial Sequence
  Description of Artificial Sequence: Synthetic coding sequence
atgaagatggccgaccggagcggcaagatcatccccggccaggtgtacattgaggtagaatacgactacgaatacgaggccaaggatcgaaaaattgtgattaagcagggggaacgctatatcctggtcaagaagactaatgacgattggtggcaggtcaaacccgacgaaaactccaaggccttctacgtgcccgcccagtatgtgaaggaggtgactcggaaggcgctcatgcctcctgtcaagcaggtcgccggcctgccaaacaatagcaccaagataatgcagtccctgcacctgcagcgcagcactgagaatgtcaataagttgcccgaactatccagttttggcaagccgtccagctctgttcagggcaccgggctcatcagagatgccaatcagaatttcggaccgtcatacaatcaaggccagactgtcaatctttctctggacctgactcacaacaatggaaaatttaataatgattctcactccccaaaagtaagctcgcagaacagaacccgcagttttggacacttccccgggcccgagttccttgatgtagagaagactagtttttctcaggaacagtcctgtgattccgcgggagaaggatcagaaaggattcatcaggacagtgagtccggggatgaactgtcctcctccagcaccgaacagatcagagcaaccacccctcccaaccagggtcggcctgattcccccgtgtatgccaacctgcaggagcttaagatctcccagtccgcgctgcctccactcccggggtctccggccatacagatcaatggggagtgggagacacataaggattccagtgggcggtgttattattacaataggggcacgcaggaacgcacctggaaacctcctaggtggacccgggacgcaagcataagcaagggggactttcagaaccccggggatcaagagttactctcaagcgaagagaactactatagtacttcgtatagccagtcagacagtcaatgcggatccccgccacgagggtggagcgaggagctcgacgaaaggggacacactctgtatacatccgactacactaacgaaaaatggctgaagcatgtggacgatcaggggcgccagtactattactctgcggatggcagtagatcggagtgggaactgcccaagtacaacgcctccagccagcagcagagagaaatcatcaagagtagatctctggatcgacggctgcaggaaccaatcgtgctcaccaagtggaggcattctacaattgtgctggataccaatgataaggagagcccgactgcctcgaagccctgtttccccgagaacgagtccagccccagcagcccaaagcaccaggataccgatcaagagaaatatggactgcttaacgtgacaaagatagccgaaaacggtaaaaaagttcgcaagaactggctcagctcgtgggccgtgctgcagggcagctccctcctcttcacgaagactcaggggagttcgacatcctggttcggaagcaaccagtcaaaacctgagttcactgtcgacctcaagggcgcaacaatcgagatggcttctaaagacaaatcgtcaaaaaagaacgttttcgagctgaagacaagacaaggcaccgaactgcttatccagtcagataatgacacagtgatcaatgactggtttaaagtgcttagttctactattaataaccaggccgttgagacagacgagggaattgaggaggaaattccagattctccaggcatcgaaaagcacgataaggagaaggagcagaaagatccgaagaagctaaggagcttcaaagtcagctcgatagactcctccgaacagaagaagactaaaaaaaatttaaagaaattcttgacacgcaggccaacactccaggccgttagagaaaaggggtacatcaaggaccaggtttttggtagtaatttggctaacttatgtcagcgggagaacgggaccgtgcctaagttcgtcaagttgtgcattgagcatgttgaggagcacggcctagatattgatggtatctaccgggtgtcagggaatcttgccgtcatacagaagctgcgatttgctgtaaaccatgacgaaaagcttgatcttaacgactctaaatgggaagacatccatgtcatcacaggagccctcaaaatgttttttcgggaattacctgaaccacttttcaccttcaaccactttaatgactttgtgaatgctatcaagcaggagcctaggcaaagggtggcagccgttaaagatttaatacgccagctgcccaaacccaatcaggacaccatgcagatactttttaggcatctcaggagggttattgagaacggcgagaaaaatagaatgacttatcagtccattgccattgtttttggccctaccctactgaagcccgaaaaggagacaggtaacatcgccgttcacaccgtgtatcagaatcaaatagttgagttgatattgttagagttgtcttcaatcttcggcagatag

SEQ ID NO: 203272 - DNA, 591 bp, Artificial Sequence
  Description of Artificial Sequence: Synthetic coding sequence
tgaagcaccagctacagccagagcgacagccagtgcggcagccccccacgcgggtggtctgaggagctcgacgaacgggggcacacactttacactagcgactacactaatgaaaagtggttaaaacacgtggatgaccagggcaggcagtactattacagcgccgacgggagccggtccgagtgggaattgcctaagtacaatgccagcagccaacagcagagagagatcatcaagtctcgcagcctggatcggcggctacaggaaccaattgttctcactaagtggcgacattccaccatcgttctggacaccaacgataaggaatcaccaacagcatcaaaaccatgcttccccgagaatgagtcttcaccttctagcccaaaacatcaggacactgatcaggagaaatacggcctgttgaacgtcaccaagatcgccgaaaacgggaagaaagttaggaagaattggctgtcaagctgggctgtacttcagggaagctcacttctattcaccaagactcagggatccagcacgtcttggtttggctccaaccagtctaagcctgagttcactgtggaccttaagtag

SEQ ID NO: 203273 - DNA, 2646 bp, Artificial Sequence
  Description of Artificial Sequence: Synthetic coding sequence
atgaagaagcagttcaaccggatgaagcagctggccaaccagaccgtaggccgcgcagaaaaaaccgaagtgttatctgaggacttgctgcagatcgagcggagattggacactgtgaggtcaatttgtcatcactcacataagagacttgtcgcatgttttcagggacagcatggaacagacgccgaaagacgccacaaaaagctgcccttgacagctttggcccaaaacatgcaggaggccagcacccagctcgaggatagcctcctaggcaaaatgcttgaaacctgcggggatgctgaaaaccaactcgccctcgaattatcacaacacgaggtgttcgtcgagaaagaaatagtagatccactctatggcattgctgaggttgaaatccccaacattcagaaacagcgcaagcagcttgcccggctggtgctcgactgggactcagtgagggcccggtggaaccaagctcacaagagctcaggcactaacttccagggtttgcccagcaagatcgatactctgaaggaggaaatggacgaagccggtaataaagtggagcagtgcaaggatcagctggccgccgatatgtacaatttcatggctaaggagggggaatacggcaagttcttcgtcacgctgttggaggcccaggcagactatcaccgcaaggctctcgcagtgctcgagaaaactctccctgaaatgcgcgctcaccaagataagtgggctgagaaacccgcctttgggacacccttggaggaacacttgaaacgctctgggagggaaatagccctccccatagaagcatgcgtgatgctgctactagagactggaatgaaggaagaagggctgtttaggatcggcgcaggagccagtaagctcaaaaagcttaaggctgctcttgattgttccacttctcatttagacgagttctatagtgaccctcatgccgtggcgggcgctttgaagtcatacttgcgagagctcccggaaccactcatgactttcaatctctacgaagagtggacccaggtggcatccgttcaggaccaagataaaaagctgcaggacctgtggcgaacttgccagaagttgcctccacaaaatttcgtgaacttccggtacctcatcaagttcctggcaaagctggcccagactagcgatgtgaacaaaatgaccccctctaatatcgcaattgtgcttggtccaaatttgctgtgggccaggaacgagggcacactcgctgagatggccgctgctacctctgtgcatgttgttgctgtgatcgaaccaatcatccagcatgccgattggtttttcccggaggaagtcgagttcaatgtctcagaagcatttgtgccccttacaaccccttcctccaatcattcttttcacaccgggaatgatagcgacagtggaaccttagaaaggaaacgacccgcttcaatggctgtgatggagggcgacttggtaaagaaagaaagcttcggagtgaaattaatggacttccaggctcacagacgaggcggaacactcaacagaaagcatatttctcctgcgttccagccgccattgccccctactgatggatctacggtagtgcccgccgggccggagccaccaccccagtcaagccgggctgagagcagctctgggggcggcactgtcccatcctccgcgggtatccttgaacaggggccgtccccgggagatgggtctccacctaagccgaaagatcctgttagcgcggctgttccagccccgggcaggaacaactcccagattgcttctgggcagaaccagccacaggcagctgcgggatcacatcagctcagtatgggccaaccccacaatgcagccgggccgtccccccacactttgcggcgcgcggtgaaaaaacctgctccggctccacctaaaccaggaaacccacccccaggccacccaggaggccaatcctcgagcggcacctcacaacatccaccttccctgtcgcccaagcccccgacccgcagcccgagccccccaacacagcataccgggcagcccccaggccagccaagtgcaccatctcagctgagcgcccccagacggtactcctccagtttgtcacctatccaggctcccaatcatcccccaccccagccgccaacacaggcgacacctctgatgcacactaaacctaactcccagggcccaccaaatcccatggctcttcccagcgagcacggtctagagcaaccttcccacacaccaccccaaacacccactcctccatccacgccaccccttggaaagcagaacccttcactgccagccccacagactctggcaggcgggaaccccgaaacggcccaaccccatgctggcactttaccaagacctcgacccgtgcctaaacccagaaacaggcccagtgtccccccacctcctcagccacccggagtgcactcagctggtgattctagcctcacaaatactgcaccaaccgcaagcaagattgtgactgactctaactcacgcgtcagcgagccacatagatctatcttcccagaaatgcattctgactctgcctctaaggacgtgccaggccgtattcttctggatattgacaatgacacagaatccactgccctctag

SEQ ID NO: 203274 - DNA, 2412 bp, Artificial Sequence
  Description of Artificial Sequence: Synthetic coding sequence
atgaagaagcagttcaaccggatgaagcagctggccaaccagaccgttgggcgcgccgagaagactgaagtgctctcagaggacctgcttcagatagaacggagactcgataccgtgcgctcaatctgtcaccatagtcataagagattggtggcttgctttcagggacaacatgggaccgatgccgaacgtaggcacaaaaaattgcccttgaccgccttggcccagaacatgcaagaggccagcacccaactggaagatagtctgctggggaaaatgctcgaaacttgtggtgacgcggaaaaccaactcgcgctcgaactgagtcagcacgaggtgtttgtagaaaaagagattgtggaccccctgtacggcatcgctgaggtggagatccccaacattcagaagcagcgaaagcaattggcacgtctggtccttgattgggacagcgtgcgggccaggtggaatcaggctcacaaatcttcggggactaattttcagggcctcccttcaaagatcgacacccttaaggaggagatggatgaggctggaaataaggttgagcaatgtaaggatcaattggcggccgatatgtataattttatggccaaagaaggcgagtatggcaagttctttgttaccttgctggaagcccaggccgactaccatagaaaggccctcgcagtccttgagaagactcttccagaaatgagggcccaccaggataagtgggctgagaagcctgcttttggtactcctctcgaggagcaccttaagcggtccggacgcgagattgcgctgccaatcgaagcctgcgttatgctattgctcgagaccggtatgaaggaggaggggctcttccgtattggcgccggcgcttctaagctgaagaagctgaaagccgctcttgactgctcaacttcccacctggacgagttctactcagatccgcacgccgttgccggtgcactgaaatcctacctacgtgagctcccagaacccctgatgacattcaatctgtatgaggagtggacacaggtagcttcagttcaagaccaagacaaaaaactccaggacctgtggaggacctgccagaagttaccccctcagaactttgtcaactttaggtacctcattaaattccttgctaagctcgcccagactagcgatgtgaacaagatgacgccatcaaatatagccatcgtgttggggcctaatcttctctgggcccggaatgagggaaccctagctgaaatggctgcagcgactagcgtacacgttgtggccgtgatagaacctataattcaacacgcagactggttctttcctgaggaagtcgaattcaatgtcagtgaagcgttcgtccccctgaccactccaagctcaaatcacagttttcacactggcaacgattcagactctggaacactggaacgcaaaagacccgctagcatggccgtgatggagggtgacctggtgaagaaggagtcaccccccaaacctaaggaccccgtatcagctgcggtcccggctccggggcgaaacaactctcagatcgctagcggtcagaatcagccccaagctgccgccggctctcatcagctgtcaatgggccagcctcataatgccgcgggaccatcccctcatacactgagacgtgccgtgaaaaagcccgctccggcaccccctaagcctggcaaccctccacctgggcaccccggagggcagagttcatccgggacctcccagcatccccccagcttaagcccaaagcctcccacccggagcccttcccccccaacccagcacaccggccagccccccgggcagccatctgcaccctcccagctgtctgcaccacggagatacagctcatctctctctcccattcaagctcccaaccacccacctccccaacctcctactcaggctactcctttgatgcatactaaacccaattctcagggccccccaaaccccatggccctaccatcagaacacggactcgagcagccatctcatactccaccacagaccccaactcctccctctaccccccccctgggtaaacagaatccctctctgcccgcccctcaaacactggccggcggaaaccctgaaacagcccagccccatgcggggacgctgccccggccgcgcccggtgcctaagcctcggaaccggccatccgtgcctcccccccctcaaccacccggcgtgcacagtgcgggagacagttcgttgacaaataccgccccgaccgcttcaaaaatcgtcactgacagcaactcccgggttagtgagccgcaccggtcgatctttcctgaaatgcattctgactcagctagcaaagatgtgcctggccgcattctcctcgatatcgataatgacactgaatctacagccctatag

SEQ ID NO: 203275 - DNA, 681 bp, Artificial Sequence
  Description of Artificial Sequence: Synthetic coding sequence
atgaagaagcagttcaaccggatgaagcagctggccaaccagaccgtgggcagagcagaaaagacagaagtgcttagcgaggatctactccagatcgaacggagattggacacagtccgctcgatttgccaccacagccataagcgtctagttgcatgttttcagggccagcacgggacagatgccgaaaggcgacataaaaagctgcccctgaccgccctggcccaaaacatgcaggaggcctccactcagctagaggactctctcctaggcaagatgctggaaacgtgcggggatgccgagaatcagcttgcactggaactcagtcagcacgaggtattcgtcgagaaggagattgttgaccccctctacggaatcgctgaggttgaaattccgaatattcagaaacagcgaaagcaactagctcggttagtcctggactgggactccgtccgcgcaagatggaaccaggcccacaaatcatccggcaccaactttcagggtctgccttctaagattgatacgcttaaagaagagatggacgaagccgggaacaaagtcgaacagtgtaaagatcagctggcagccgatatgtacaattttatggcgaaagaaggtgaatatggcaaattttttgtcacaattagcggccgcaagaaccaaccgctgggccttccctag

SEQ ID NO: 203276 - DNA, 2523 bp, Artificial Sequence
  Description of Artificial Sequence: Synthetic coding sequence
atgaagaagcagttcaaccggatgaagcagctggccaaccagaccgtcgggcgggccgaaaagaccgaggtcctgtccgaagacctcttacagatcgaacgccgcttggacactgtcaggtccatttgtcatcactcgcacaaacgccttgtcgcttgctttcagggccaacacgggactgatgctgaaaggaggcataagaagctgcccctcacagctctcgctcaaaatatgcaggaggccagtacacaactggaggacagtctgctaggaaagatgctggaaacatgcggcgacgccgagaaccaactggcattagagctctctcagcatgaggtcttcgtggagaaagagatagtagaccctctctatggaattgcagaggttgaaatccctaatatccagaagcagcgcaagcagttggcaagacttgtcctggattgggattccgttcgcgccagatggaaccaggcccataaaagtagtgggacaaacttccagggtcttcctagcaaaatcgacactttgaaggaagaaatggacgaggctgggaataaggttgaacagtgcaaggaccagctggctgctgacatgtataatttcatggcgaaagaaggtgaatacgggaagtttttcgtcacacttctcgaagcgcaggccgactaccatcggaaagccctcgctgtccttgagaaaactctgcctgagatgcgagctcatcaggataagtgggccgaaaagccggcctttgggacacccctagaggagcacctaaaacgaagtgggagagagatcgccctgcccatcgaggcctgtgtcatgctcttgctagagaccgggatgaaggaagagggcctgtttaggatcggagcgggcgccagcaagcttaagaaactgaaagcagccctcgactgttctacaagtcatctagacgaattctattccgacccacatgctgtcgccggggctctcaaatcttacctcagggaactgcccgaacctctgatgacctttaatctgtacgaggaatggacacaggtggcctccgtgcaagatcaggacaaaaaactccaagacctgtggcggacttgtcagaagctgcccccacagaactttgttaatttccgatatctgatcaaattccttgcaaaactcgcccagacatcagacgttaacaaaatgaccccatctaacattgcaattgtccttgggcccaatttgctgtgggccaggaacgaaggaacgcttgcagaaatggcagccgctacttccgtgcacgtggttgctgtgatcgaacccattatccagcatgctgactggttcttccctgaggaggtcgaattcaacgttagtgaagcttttgtccctctgactacgcccagctcaaaccactcctttcacacaggcaacgattccgactccggcacgctcgagcggaagcgtcccgcctctatggccgtgatggaaggtgatctggtgaaaaaggagtccttcggggtgaagttaatggatttccaagctcacagaaggggcggaaccctcaatcgcaagcatatctcgcctgcatttcagccgccgctcccacctactgatggcagtactgtggtgcctgctggacccgagccgcctcctcagagttcccgtgcggagtccagtagcggtggcggaacggtcccatctagcgccggcattctggaacagggaccatctcctggcgatgggtctcctcctaagcccaaagaccccgtttcagccgcagttccggcccctggccgcaacaattctcaaatcgctagcggccaaaatcagcctcaggccgcagcaggcagccaccagctctcgatgggccagccccacaatgcagccggtccaagccctcataccttacgaagagcagtaaagaaaccggcccccgccccacccaaacccggtaacccccctcctggacacccgggaggacagagctcatcaggtacatctcagcaccccccctcgttgtcaccaaagccaccaacgcggtccccaagccctcccacgcaacatacaggacagccacctggccagccgtcagcaccaagccagttgagtgctccacggcggtattcaagctctttgagtccaatccaagcgcccaaccacccaccgccgcagccaccgacccaagcgactcccctcatgcatactaagccaaatagccagggaccccccaatcccatggcactgccatcagaacatgggttggagcagcctagccatactcctccacagacacccacgcccccgagtacccccccactgggcaagcagaatccgagtcttccagccccccaaaccttggcaggtggtaatcctgagacagcccagccgcatgcgggcaccttaccgcggccccggcccgtgcctaaacctaggaacagaccttccgttcccccccccccacaacctcctggtgtgcatagcgcaggggattcgtctttgaccaacaccgcccccaccgccagtaagattgtcactggagtctag

SEQ ID NO: 203277 - DNA, 1992 bp, Artificial Sequence
  Description of Artificial Sequence: Synthetic coding sequence
atgagctggctgagcagcagccagggcgtggtgctgaccgcctaccatccttcaggaaaggaccaaaccgtggggaatagtcacgccaaagccggagaggaagccaccagctcgcgtagatatggccagtacacaatgaaccaggagtcaaccacaataaaggtaatggaaaaacctccatttgatcggagtatctcccaagactccttagatgagctgtccatggaagattactggatagagcttgaaaatatcaaaaaaagcagtgagaattcccaggaagaccaggaagtagtggtcgtcaaagagcccgatgagggcgagctcgaggaggaatggctcaaagaggctgggctctccaacctgtttggcgaatcagccggggatcctcaggagtctatagtattcttgagcaccctgaccaggacccaggcggcagcagtgcagaaacgtgtggaaacggtttcacaaacgttgcggaagaagaacaagcagtaccagataccagatgtccgcgacatcttcgctcagcagagggaaagcaaagaaacagcccccgggggcaccgaaagccagtctctgcggaccaacgaaaacaagtatcaggggagagatgacgaagcgagcaatttggtcggcgaggaaaagctcatacctcccgaagaaaccccagcaccagagacggacatcaatctggaggtgtctttcgccgagcaggccctgaaccagaaggagagcagtaaggaaaaaatccagaagagcaaaggcgacgacgccacactcccatcctttcgtctccctaaagacaaaacaggaactaccaggatcggcgacctggctcctcaggacatgaaaaaggtgtgccacttggctctcatagagttgacagctctgtatgatgtgctggggatagaactgaagcagcagaaggcggtgaagattaaaaccaaggattcaggactgttctgcgtcccactcactgcacttctcgagcaagatcagagaaaggtgccgggcatgagaattcctctcatttttcagaaactgatttctcggatcgaagaacggggcctggaaaccgaaggtctgctccggattcctggtgcggctataaggatcaagaatctttgccaggaactggaagccaagttctacgagggaacctttaattgggagagcgtcaaacaacacgacgccgccagcctcttgaagcttttcattcgggagctgcctcagccacttctgtcagtcgagtacttgaaagcatttcaggctgtgcagaatctgcctaccaagaaacagcagttgcaggccctcaacctattggtcattctcttaccagatgcaaatcgagatactctcaaggccttgcttgaattcctgcagcgtgtcattgacaacaaagaaaaaaacaagatgaccgtcatgaatgttgctatggtgatggcaccaaatctgtttatgtgccatgccctcgggctcaagtcaagcgaacaacgcgagtttgtgatggctgccggaaccgctaacaccatgcatctattgatcaagtatcaaaaactcctgtggactatccctaagtttatcgtgaatcaggtgagaaagcagaatactgaaaatcataagaaggataaacgggcaatgaaaaaattattgaagaagatggcctatgatcgggaaaagtacgagaaacaggacaagtcaacgaatgatgctgatgtgcctcagggagtcatccgggttcaggctccccatctgagtaaggtctccatggccattcagctgaccgaagagttgaaagctagtgatgtgctggctaggttcctgtcccaggaaagtggcgtggctcagacattgaaaaaaggagaagtgttcctctacgaaattggtgggaatattggcgagcgatgcctcgatgatgacacatacatgaaagacctctatcagcttaatcctaatgcagagtgggtcatcaaaagtaaacccttgtag

SEQ ID NO: 203278 - DNA, 1857 bp, Artificial Sequence
  Description of Artificial Sequence: Synthetic coding sequence
atgaaccaggagagcaccaccatcaaggtgatggagaagccccccttcgataggagcataagccaagacagcttggatgagttgagcatggaagattactggatcgagctggagaatatcaagaagtcttcagagaattcacaagaagaccaggaagtggtggtcgtgaaagaacctgatgagggcgaactggaggaggaatggttgaaggaggcagggctaagcaatttattcggcgagtcagctggcgacccccaagagagtatcgtctttcttagtaccctgactcgtacacaagcggcagcagtgcagaagcgcgttgaaactgtttcacagaccctgaggaagaagaataagcaataccaaattcccgatgtgcgcgatatatttgctcagcagagggaatcgaaagaaactgctcctggaggtacagaatctcagagtttgagaaccaatgagaacaagtatcagggcagggacgacgaggcctccaaccttgttggggaagagaagctaatcccaccagaggagacacctgccccggaaacagatattaacctagaggtgtcattcgcggagcaggcactgaatcaaaaggagtccagtaaagaaaaaatccagaaaagcaagggtgacgacgccactctgccaagcttcagactccctaaggataagaccggcaccaccaggattggtgacctggcacctcaggacatgaagaaggtgtgccatttagcgcttattgaactcaccgcactatatgatgtcctaggtattgagttgaagcaacagaaggcagtaaaaattaagacaaaagattctggcttgttctgtgtccctctcactgcactcttagagcaggatcagcgaaaggtgcctggaatgagaattcccttgatatttcagaaactcatctcccggatcgaagagcggggcctggaaaccgagggtttactgagaattcccggggctgccatacgtataaagaacttatgtcaggagctagaagccaaattttatgagggcacttttaactgggaatccgtgaagcaacatgacgcagcctcacttctcaaacttttcatccgagagttaccacagccgctattgtctgttgagtatctaaaggcctttcaggcagtgcagaatctgcctacaaagaagcaacagcttcaggctcttaatttgctagttatcttacttcctgatgccaaccgggataccttgaaggccttgctcgagtttttgcaacgggtgatcgataataaggaaaaaaacaagatgactgtgatgaatgttgccatggtgatggcacccaacttattcatgtgccacgcgctcggcttgaaatcgtctgagcaaagagagtttgtcatggccgccgggactgccaacacaatgcacctcctcattaaatatcagaaactcctatggacgattcctaaatttattgtgaatcaggtgcgcaagcaaaacaccgaaaaccacaagaaggacaagcgcgcgatgaaaaagttactcaagaaaatggcctacgatcgcgaaaaatacgagaagcaagataaatccaccaatgacgccgacgtccctcagggggtgattagagttcaggctcctcatctaagtaaagtgagcatggcgatacagcttacagaagagttaaaagcttccgatgtgctcgcccgcttcctgtctcaggagagcggggtcgcacagaccttaaaaaagggcgaggtgtttttatacgagattggggggaacattggcgaaaggtgcttggacgatgacacatatatgaaggacctctaccagcttaacccgaacgccgaatgggtgatcaaaagcaaacctctgtag

SEQ ID NO: 203279 - DNA, 1485 bp, Artificial Sequence
  Description of Artificial Sequence: Synthetic coding sequence
atggccaccgaggcccagagcgagggcgaggtgcccgcccgggagtccgggcggagtgatgcgatctgtagtttcgtcatttgtaatgacagctcactgaggggccagcctatcatctttaaccccgatttctttgttgagaaactccggcacgaaaaaccagagatctttacagaactggtagtttcaaacatcactagactgatcgacctgccaggtaccgaactcgctcagctcatgggagaagtggatctgaaacttcccgggggcgccgggcccgctagcggttttttccgttccttaatgtctctcaagcgtaaagagaagggggtgatcttcggttcccctctcacagaggagggaatcgcacagatctatcagttgattgaatatctgcacaagaacctgcgggttgaagggttattccgagtacccggcaattctgtgcgtcagcagatcctgcgtgatgcactaaataatggcaccgacatagacctggaatccggcgagtttcattccaacgatgttgccaccttgttgaagatgttcctgggagagttgcctgaaccgctgttaacccacaagcactttaacgcacaccttaaaattgcagacttaatgcagtttgatgacaaaggcaacaagacaaatatacccgacaaagacagacaaattgaagccttacagctgctttttctcattctcccgccccctaaccggaaccttctgaagctcctgttggacctgttatatcaaacagcaaaaaagcaggataagaacaagatgagcgcctataacctggccctcatgttcgcccctcacgtcctgtggcctaagaacgtcacagcgaacgatcttcaagaaaacatcaccaagctgaattcaggtatggcttttatgattaagcacagtcagaaactgttcaaggcaccagcatatatcagggagtgtgctcgcctccactatctcggatctaggacccaggcctctaaggatgatctcgacctcattgcttcctgtcacactaagagttttcaacttgcgaagtcccagaaaaggaatcgggtcgattcttgcccacatcaggaagagactcaacaccataccgaggaggctcttagagagttgttccaacacgtgcacgacatgcccgagagtgccaagaagaagcagctgataaggcagtttaataagcagtccctgacccagacaccaggccgggagccttctactagtcaggttcagaagcgcgcaaggtctaggtcatttagcggcctcatcaagcggaaagtgctgggcaatcagatgatgagcgaaaaaaagaagaagaaccccacaccagaaagcgtggccataggagagctaaagggaacatcaaaggaaaatagaaatctacttttcagcggaagtcctgcagttactatgaccccaacgaggctgaaatggagcgaaggaaagaaagaagggaaaaaagtgttcctgtag

SEQ ID NO: 203280 - DNA, 1458 bp, Artificial Sequence
  Description of Artificial Sequence: Synthetic coding sequence
atgccccaccagaagctgagcgccctgatcgacgccatctgcagctttgttatctgcaatgacagtagccttaggggacagcccatcattttcaatccagacttctttgtcgaaaaactccgacacgaaaaacctgagatattcacggaacttgtagtatcaaacatcactcgactgatagatctccctggcaccgaactggcacagttgatgggagaggtggacctgaaactgcccggcggggctggtccagcctccggattcttcaggtccctcatgtcactgaagaggaaggaaaagggtgtgatctttgggtcccctctcacagaggaggggattgctcagatataccagctaatagagtacctacacaaaaatctgcgggttgaaggcctatttagagtgccaggcaattcagtccgccaacagatcctgagggatgcactgaacaatggaacagacatagatctggagtctggcgagttccactcaaacgacgtggctacacttttgaagatgttccttggtgagctgcccgaaccgcttctcacgcataagcactttaatgcccacctcaaaattgctgaccttatgcagttcgatgacaagggaaataagaccaatatccccgataaggacagacagatagaggcgctgcaattgttgtttctgattttaccaccacctaatcggaacctcctgaagcttctgttggatctgctctatcagacagctaagaagcaggataagaacaaaatgtctgcctacaatctggctctcatgttcgcaccacacgtcctttggcctaagaacgtcactgccaacgacttacaggagaacattaccaagctcaattccggaatggcctttatgatcaagcattcacagaaactgtttaaagctccggcctacatcagagagtgcgccagactccattatctgggttcgaggactcaggcctcaaaggacgatctggacttgattgcatcgtgtcatacaaaatcctttcaattagctaagagccagaaaaggaatagagtcgatagttgcccccatcaggaagagactcagcatcatacggaggaggccctcagagagctgtttcagcacgtccacgatatgcctgagtcggctaagaaaaaacagttgattcgacagtttaataaacagtccctgacacaaaccccaggccgcgaaccctccacctcccaggtccagaagcgtgcaaggtccaggagcttttcaggcctgataaagaggaaagttcttgggaaccagatgatgagcgaaaaaaagaaaaagaacccaactccagagtccgttgccattggggagctgaagggaaccagtaaagaaaatagaaatcttctgttttcaggctccccagccgtgactatgacccctacgaggctcaagtggtctgaggggaagaaggagggtaagaaggtcttcttgtag

SEQ ID NO: 203281 - DNA, 1398 bp, Artificial Sequence
  Description of Artificial Sequence: Synthetic coding sequence
atggccaccgaggcccagagcgagggcgaggtgcccgcccgggagagcggcagaagtgacgccatttgcagcttcgtgatatgcaacgatagctctcttagagggcagccaataatattcaaccctgatttcttcgtggagaagcttcgccacgaaaagcctgaaatctttaccgagctggtggtgagtaacatcactcggttgattgacctacccgggacagaactggctcagctgatgggggaagtcgacctgaaactgcccggcggcgcaggacccgcaagcggattttttcgctcactaatgtctttgaagaggaaagaaaaaggggtaatcttcggatcccccttgacggaagagggcatcgcccagatctatcagttgatagagtacctccacaaaaacttgcgcgtcgaaggccttttcagggtccccggcaatagcgtaagacagcagattctccgggacgcactcaataatgggacagacatcgatctcgaatctggggaattccactcaaatgatgtggccacattactgaaaatgttcttgggtgagcttcctgagcctctcctgacacataaacattttaatgcccacttaaaaattgccgacctgatgcagtttgatgataaggggaacaagaccaacattccagacaaagaccgccagatcgaggctcttcagcttctgttcttgattctaccaccccctaaccgtaatctcttaaagttactcctcgacttgctgtaccagacggcaaagaaacaggacaaaaataagatgagcgcgtacaatttggctttgatgtttgccccccatgtgctctggccaaaaaacgcccccgcttacatcagagaatgtgcccgtctgcactaccttgggagccggactcaggcgtcaaaggacgaccttgacctgatcgcctcgtgtcatactaaaagtttccagctcgccaagtcacaaaagcgaaatcgggtggacagttgtcctcaccaggaggagacacagcatcatacggaagaagcattaagagagctttttcagcacgtccacgacatgccggaatcggccaagaagaaacagctcatcaggcagttcaacaagcagagcttgacacagacccccggcagagagccctccaccagtcaggttcagaaaagagcccgcagtagatccttctcagggctgataaaacggaaggttctgggaaaccagatgatgtccgaaaagaagaagaagaaccctacgcccgaatccgtggcgattggggagttgaaaggaacatcaaaagagaatcgcaacctgctgtttagtgggagtcccgccgtcacaatgacgcccactcgtctcaagtggtctgagggaaagaaagagggaaagaaagcatttgtctag

SEQ ID NO: 203282 - DNA, 1485 bp, Artificial Sequence
  Description of Artificial Sequence: Synthetic coding sequence
atggccaccgaggcccagagcgagggcgaggtgcccgcccgggagagcggccggtccgatgccatctgcagtttcgttatttgtaatgactcatctcttcgaggccagcccattatctttaaccctgattttttcgtggaaaagttgcggcacgagaaaccagagatcttcacagagctcgtggtcagcaacataacacggctgatagacctcccgggtactgagttggcacagctcatgggtgaggttgatctgaagctgcccggaggagctggacctgcgagcggattcttccgttccctgatgtcccttaaacggaaggaaaagggcgtcattttcgggtcccccctgacagaagagggtatcgcccagatatatcagctcatcgagtatttgcataagaacctgcgtgtggagggactctttagggtcccagggaattccgtgcgccagcagattctgcgagatgctttgaacaacggaaccgacatcgacctcgagagcggcgagttccattccaacgatgtggcgaccctgcttaagatgttcttgggcgagctgcccgagcccctcctgacacacaaacattttaatgcccatctgaaaattgcagatctcatgcagttcgatgacaaaggcaataaaactaacattcctgacaaagaccgccagatcgaagctctccagttgctctttcttattttgccccctccaaaccggaatttactgaaactgttactggacctcctgtatcaaaccgccaaaaaacaggataaaaataaaatgtcagcctacaacctggcgttgatgtttgcgccacacgtcctgtggcccaagaatgttacagctaacgacctgcaagaaaacatcaccaagctgaattctggaatggcattcatgattaagcatagtcaaaaactgttcaaagctccagcatacatccgcgaatgtgcacggttgcactatttaggctcccgcacacaggcaagcaaggacgatttggatctgatcgcctcctgccatactaaaagttttcagctggcaaaatcacagaagcgaaacagggttgactcatgtccacatcaggaagagactcagcatcacaccgaggaggccctgagggagttgttccagcatgtgcacgatatgcccgaatcagcaaaaaagaaacagctgatccgccaattcaacaaacaatccctcacacagaccccaggcagggaaccgagcaccagtcaagtacaaaagagggcacggagtaggtccttcagcggccttattaaacggaaggtgcttggtaaccagatgatgtctgagaagaagaagaaaaatccaacacccgagagtgtagctataggggagcttaagggaacctctaaagagaatcggaatctcctgtttagcggatcccctgctgttactatgactcctactagactcaaatggtctgaagggaagaaagaggggaaaaaaggcttcctttag

SEQ ID NO: 203283 - DNA, 1458 bp, Artificial Sequence
  Description of Artificial Sequence: Synthetic coding sequence
atgccccaccagaagctgagcgccctgatcgacgccatctgcagctttgtcatctgtaacgattcttctcttagagggcaaccaatcatttttaatccagatttttttgtggagaaactgcgccacgaaaaacctgagatcttcaccgagttggtggtttctaatattactaggctgatcgacctgcctggcacggagctcgctcagttgatgggagaagtggatctgaaacttcccggcggtgctgggcccgcatcaggctttttccggtcactcatgagtttgaagcgcaaagagaagggagtcatattcggtagccctcttacagaggaaggaattgctcaaatctatcagttgatcgagtatttgcacaagaatctacgggtcgaggggctgtttcgagtccctgggaattcagtgcgacagcagattctgcgtgatgccctgaacaacggcaccgatatagacctggagagcggagaatttcattccaacgatgtcgcgaccctgctgaaaatgtttcttggggaactgccagagcctctgctaacacacaagcactttaatgctcacttgaagattgcagacctgatgcagtttgacgataaggggaacaagaccaatatccctgacaaagatcgccagattgaagccctgcaactgctttttctgattctgccgccccccaatcgcaacctcttgaaactgctcctcgacctactttaccaaaccgcaaagaagcaggacaagaataagatgagcgcatacaatttggcccttatgtttgctcctcacgtcctatggcccaagaacgtgactgcgaatgacctccaggagaatatcaccaagttgaactctggtatggccttcatgattaagcatagccaaaaactgttcaaggcacccgcctatatccgggaatgtgctagacttcactatctcggctctagaacccaggccagtaaagacgacctcgatctaatcgctagttgtcatacaaaatccttccagctggctaagtcacagaagaggaaccgggttgactcctgtccccaccaggaagagactcagcaccacacagaagaagcgctccgtgagttgttccagcacgttcacgatatgccagaatccgccaaaaagaaacagttgatcagacagtttaataaacagagccttacacaaacacccgggagagaaccctctactagccaagtacagaaaagagctcggagtcgctcgttctccggtctgataaaaaggaaggtgttgggcaaccagatgatgagcgagaaaaagaagaaaaatcctaccccggaatccgtggccattggcgaattaaaggggacgagcaaagaaaaccgcaacctgctcttcagcggtagtccagcagttacaatgacccctactcggctgaagtggtccgaggggaaaaaggaagggaaaaaagggttcctttag

SEQ ID NO: 203284 - DNA, 942 bp, Artificial Sequence
  Description of Artificial Sequence: Synthetic coding sequence
atgttcctgggcgagctgcccgagcccctgctgacccacaagcactttaacgctcatctgaaaatcgccgacctgatgcagttcgacgataaggggaataaaacaaacatccccgacaaggatcggcagatcgaagcattgcaactgctctttctaattctgccgccaccgaatcggaacttactaaaattgctcctagatttgttgtaccagaccgccaaaaagcaggataagaacaaaatgagtgcttataacctcgcgttgatgttcgccccacacgtgctgtggccaaaaaacgtaacagcaaacgacttgcaggaaaacatcacaaaacttaattccggaatggccttcatgataaagcattcacagaagctgttcaaagcgcctgcgtacatccgagagtgcgccaggctccattaccttgggagtcggacgcaggccagtaaggacgacttagatcttatcgcctcgtgccatacaaagagtttccaactggctaaaagccagaaaaggaaccgggtcgactcctgtccgcatcaggaggagacccagcatcacacagaagaagcactcagagaattattccagcacgtacacgatatgccggagtctgcgaaaaaaaagcagctcatccggcagtttaacaagcagtctctgacacagaccccaggccgggagccttctacttcacaggtccagaagagggcaaggagcagatcattctctggcttgatcaaacgtaaagtcctcggtaatcagatgatgtcggaaaagaaaaagaaaaaccccacccccgagagcgtggccattggcgaactcaaggggacgtctaaagagaacagaaatctgttattctcaggatcacctgcggtgaccatgactcctactcgactcaaatggtcagaggggaagaaggaaggtaagaaggggttcttatag

SEQ ID NO: 203285 - DNA, 1554 bp, Artificial Sequence
  Description of Artificial Sequence: Synthetic coding sequence
atggccaccgaggcccagagcgagggcgaggtgcccgcccgggagagcggccgcagcgatgctatttgcagctttgttatatgcaacgactcaagcctgaggggacagcccataatctttaatccagacttttttgtggaaaaactgcgacacgaaaaaccagagatctttacagaactggtcgtgtcaaacattacccgtctgatagatctgcccgggacagagcttgcacaactcatgggggaggtggacctaaaattacccggaggcgccggcccagctagcggattcttccgctccctgatgtccctaaagaggaaggagaaaggcgtgattttcgggagcccgttgaccgaagaagggatcgctcaaatctaccagctgatcgaatacctgcacaagaaccttagggtggagggcctgtttcgggttcctggcaatagcgttagacagcagatactgcgcgatgcactcaataacgggaccgatattgatctggagtctggagaatttcactcgaatgacgtggctacacttctcaagatgttcctgggcgaactccctgagcctctactcacccacaaacacttcaatgctcatttaaagattgctgatctcatgcagttcgacgacaaggggaacaagaccaacattccggataaggaccgccaaatagaagcccttcagctactttttctgattctgcctcctcctaatcggaatctcctgaagttgctgctggatctcctgtatcagaccgcaaagaagcaggataaaaataaaatgagcgcctacaacttggctttaatgtttgccccgcatgtcctctggcctaaaaacgttaccgccaacgatttgcaggaaaacatcacaaagctgaattctgggatggccttcatgataaagcactcccagaagttattcaaggcgccagcatatattagagagtgcgccaggttacactacctgggcagtcgaacccaggcatccaaggatgacttggacctgatcgcctcctgtcataccaaaagtttccaactcgccaagagccagaagaggaacagggtggacagctgtccacatcaggaggagactcagcatcacacagaagaagcactacgggaactgtttcagcatgtccacgacatgcctgagtcagcgaagaagaagcaactgatccggcaattcaataagcagagcttaacgcaaacccccggcagagaaccttccacctcccaggtccaaaaaagggcccggagccggagcttttccgggttaataaagcggaaagtgctggggaaccagatgatgagcgaaaagaaaaagaagaaccccacgcccgaatctgtggctatcggcgaacttaagggcactagtaaggaaaaccgcaatttgctgttttctggcagcccagctgttacgatgactcctacacgcctgaaatggtccgaggggaaaaaagaaggaaagaaggggaattccatggccaccacctcgctgggctccatccgcatgactctgagagggtctagcagctgcgggtgttgctcatag

SEQ ID NO: 203286 - DNA, 3654 bp, Artificial Sequence
  Description of Artificial Sequence: Synthetic coding sequence
atggcccagcccgtggagatcagcccccccgacagcagcctgagcaaacagcagacctcaactcctgtgctgacacagccaggccgggcctaccggatggagatccaggtgcccccatcgcccaccgacgtcgctaagagcaacacagccgtgtgtgtatgcaacgaatcggttagaacagtgatcgttccctctgagaaggtcgtggatctgctctctaatcgcaacaatcatacaggcccaagccacagaaccgaagaagtgcgctatggcgtctctgagcagacttccctgaaaacagtctcgagaacgaccagcccacctttatctattcccactacccacctcattcaccagccagcggggtctcgttctctggagccgtcaggcatccttctgaagtccggtaactacagcggtcacagcgacggaatctcatcgtcaagaagtcaggccgtcgaagcacctagtgtgtctgtaaaccattattcacccaactcgcatcaacatattgactggaagaactacaagacctacaaagaatacatcgacaatcgacggttgcacattggttgtcgcaccatccaggaaagacttgactcgctgcgcgccgctagtcagtctaccactgactacaatcaagtagtgccaaaccgaacaaccctgcagggcaggagacgtagcacttcacacgatagagtgccacaatcagtgcagattcgccagcggtcagtttcacaagagaggctagaagattctgtgctgatgaaatactgtcctaggagcgcctcgcagggggctctgaccagtccaagcgtgtctttctcgaatcatcggactcgatcatgggattacatcgagggtcaagatgaaacacttgaaaatgtgaactcaggtactccaattccagacagcaatggcgaaaaaaagcaaacttataaatggtctgggtttactgagcaggatgatcggagaggcatctgcgaaagaccacggcagcaggaaattcacaagagttttcgagggagcaactttaccgtcgcaccctctgtcgtaaatagcgacaataggcgaatgtcaggccgtggtgtggggagcgtgagccaattcaagaagattccccctgatttgaaaacgttacagagcaacaggaacttccagactacctgcggcatgagcctgcctcgaggaatttcccaggatagaagcccactggtgaaggtacgctccaactctcttaaagcccccagtactcacgtaacaaaacctagtttcagtcagaagagcttcgtgagcatcaaggaccagcgccccgttaaccacctccaccaaaactctctcctgaatcagcaaacttgggtacgaacggattctgctcctgaccagcaggtcgaaaccgggaaaagcccatctttgagcggcgcctctgcaaaaccagctcctcaaagttctgaaaacgccggcaccagcgacctggagttgcccgtgtctcagcgcaaccaagatctgtccctgcaggaagccgagacagagcagagtgatacgctcgacaataaggaagctgttatcctccgtgagaagccgccttctggccgccaaaccccgcagcccttgcggcaccagtcatatattctggccgtaaacgaccaggaaaccgggagtgataccacttgttggctgcccaacgacgctagaagggaagttcacattaagcgcatggaggagaggaaagcctcgtccaccagcccacctggagactcgctggcatctattccctttatcgacgagcccacatctccctctatcgatcacgatatcgcgcatattcctgctagcgccgtgatctccgcgtccacaagtcaggtaccgagcattgctacggtgccgccatgcttaactactagtgctccccttattagacgccagctgagccatgatcatgagtcagtaggtccaccttcactggacgcccagcccaattccaagaccgagcgatccaaaagttacgacgaaggtctggatgattatagggaggacgctaaactgagctttaagcatgtaagctccttgaagggcattaagatcgcggacagccagaagtccagcgaagacagcggaagcaggaaagatagttctagcgaagtgttcagcgatgcggctaaagaagggtggctgcacttccgccccttagtcactgacaagggtaaacgcgtagggggcagtatccgtccctggaagcagatgtacgtggtgttgcgaggtcattccctctacctctacaaggataagagagagcagactacgccaagtgaggaggagcagccgatctccgtgaacgcttgcctgatagatatttcctatagtgaaacaaaacggaaaaatgtcttcagattaacaacgtcagactgtgaatgcttgtttcaggccgaggacagggacgatatgttggcatggatcaaaacaattcaggagtcttctaacttgaatgaagaagatacgggcgtgacgaatagagacttgatcagtaggcggatcaaggagtataataacttgatgtccaaagccgaacagcttccaaagacaccccgccaaagcttaagtataaggcagaccctgctcggtgcaaagtctgagccaaagacacagtctccacattctcctaaggaggaatctgagcgcaaactcctcagcaaggacgacacaagccctcccaaggataaaggcacatggcgaaagggtattccttctataatgcgcaagactttcgaaaagaaaccgacagccactggaacatttggagtgcgcctggacgattgcccgcccgcacatacgaaccgatacatacctttaatcgtggacatctgctgcaagctggtcgaagagcgaggcctcgagtacactggaatataccgagtcccggggaataatgccgcgattagcagcatgcaggaggagctgaacaagggtatggctgacatagacattcaggatgacaaatggagagacctaaacgtgatctcctcactactaaaatcattctttagaaagttacccgagcctctgttcactaatgacaaatacgccgatttcatcgaggcaaataggaaagaagacccactggatagactcaagaccctgaaaagactgatccacgatctacccgagcatcactatgaaactttgaaatttctgagtgctcacctaaagactgtggctgagaacagcgaaaaaaacaaaatggagccacgtaatctagctatcgtgtttggaccaactctggtgcgaacatccgaagacaacatgactcacatggtcacacacatgcctgatcagtataagatagtggagacgcttattcagcatcacgactggtttttcactgaggaaggggcagaggaaccactcaccactgtgcaggaggagtccacagtggattcccagcctgtgcctaacatagatcacctactcaccaatatagggagaacgggcgtttcacccggcgatgtttctggcgaggtaggtggcgtttaccacacagtcatgagtctcgtcgattctgtgatgtccttaatggatagctggaattgtcgtaagaaagaggactgctgcccccactgtagttgtctcgtctgtcggaatcccagattcctgtag

SEQ ID NO: 203287 - DNA, 3498 bp, Artificial Sequence
  Description of Artificial Sequence: Synthetic coding sequence
atgatggccacccggcggaccggcctgagcgagggcgacggcgacaaactgaaagcctgcgaggtgtccaagaacaaggatggaaaagagcagagtgagaccgtgagtctctctgaagacgagactttttcttggcctgggccaaagacagtgactctgaagcggacatcccagggctttggttttacactgaggcatttcattgtctacccccccgagagtgccatacagttttcctataaagacgaagagaacggaaacaggggcggcaaacagcgaaaccggttagaaccgatggacacaatattcgtcaaacaggtcaaagaggggggtcccgccttcgaggccggtctatgtacaggcgatagaatcatcaaagtgaacggagagtctgtaattgggaagacctactctcaggtgatcgcactcatacaaaattccgatacaactctggaattaagtgtcatgcctaaagatgaggacatcctgcaagtcgcttatagtcaggatgcctatctcaagggaaacgaagcatattcaggaaacgcgcggaacataccagagccgcctccaatctgctatccatggctcccgtctgccccatcggccatggcccagccagtcgagattagtcctcctgattcctccctcagcaagcagcaaacttcaacgcctgttctaactcagccggggcgggcctataggatggaaatccaggtgccaccgtctccgaccgacgtcgccaaaagcaatacagcagtctgtgtttgcaacgaatctgtgaggaccgtcattgtgcccagtgagaaagtggtcgacctactttctaaccggaataatcacactggccccagccaccggaccgaagaggttaggtacggcgtgagtgagcaaacttctcttaaaaccgtgtccaggacaacaagcccgcccctctcaatcccgactactcacctgattcaccagccagcaggatccaggtcccttgaacctagtggaattctgctgaaaagcgggaactatagtggacattctgacggtataagctcctcaaggtcccaggcggtggaggcaccaagtgtgtccgtgaaccattactcacctaacagccatcaacacatcgattggaagaattataagacctacaaggagtacatcgacaaccggagattgcatattgggtgccgcaccatacaggaacgactggattcgttgcgagcagcaagccaatccacaacagactataatcaggtcgtgcccaaccgcaccacacttcaagggcgtcggaggtccacatcacatgatcgtgttccgcaatccgtgcaaatcagacagagaagcgtgagccaggaaagactcgaggactcagttctgatgaagtactgcccacggtccgctagtcaaggcgctcttactagcccaagtgtctcgttctctaatcacaggacccggagctgggactacatcgaaggccaagacgagactcttgagaacgtgaattctggcactcccattcctgacagcaacggagaaaaaaagcagacatacaagtggagtggtttcaccgagcaggatgacagacgcggcatctgtgagcgccctcggcaacaggagatccataaaagttttcgcggatctaacttcaccgtggcgccgtctgtcgtgaactccgacaaccgacgcatgagcgggaggggtgttggatccgtgtcacagttcaagaaaataccacctgacttaaagacactccagtccaaccgaaacttccaaacaacatgcggcatgagtcttcctcgaggcattagccaggatcgttcaccactggtcaaggtgcggtcaaattccttgaaggcacccagcacccacgtgactaagccctctttttctcaaaagtcctttgtgtctatcaaggaccaacgtcctgttaatcatcttcatcaaaactcattgctaaatcagcaaacctgggtgaggacggactccgcgccagaccaacaggtggaaacaggtaagtccccatcactgtccggagcatctgccaagccagccccacagtcctccgaaaatgctggaacaagcgatttagaattacccgtgtcccaacggaaccaggacctatctctgcaggaggccgagactgagcagagcgatacactggataataaagaggccgtgattcttcgtgaaaaacctcctagcggaaggcaaacgccacagccccttcggcatcagagctatattctggctgtgaatgaccaggaaactgggtcagataccacatgctggctgcccaacgatgctcgacgggaggtgcacattaagcgcatggaggagcgcaaagccagcagtacctcaccgccaggcgacagtctggccagcatccctttcatcgatgaaccaacttcgccatcaatcgaccacgatatcgctcacatcccggccagcgccgtgatctcagcctctacaagccaggtcccgagcatcgcaaccgtcccaccttgcctaacaacgtctgcacccctgatccgcaggcagttaagtcatgatcacgaatctgtaggcccacccagcctggacgcgcagcctaatagcaagaccgagagatccaagagttatgacgaagggctggatgattatcgtgaagatgctaagctatctttcaagcacgtatccagcctcaagggtatcaagatcgcagattctcagaaatcctcagaagactctggatcaagaaaagactccagctccgaggttttctcagatgccgcaaaagaggggtggctgcatttcaggccactagtgaccgataagggaaagcgcgtcggtggctccattagaccttggaagcagatgtacgtagtcctgagaggacatagtctttacctttataaggacaagcgcgaacagaccactccgagcgaggaagagcagccaatctcagtgaatgcatgtctaatagatatttcttacagcgaaacgaagcgtaaaaatgtctttaggcttacaacttctgactgtgaatgcctgttccaggccgaggaccgggatgacatgctggcctggatcaagacaattcaagagtctagtaatcttaatgaggaggatactggagtaactaatcgggacctgatcagccgtagaatcaaggagtataacaatctgatgtccaaagctgagcaactccctaaaactcccagacaaagcctgagcatcagacaaaccctacttggcgctaaatctgaaccgaagacacaatctccgcatagtcctaaagaggagagcgaacggaagctactaagtaaagacgacacctcacctccaaaagataaaggcacatggaggaaagggatcccttccattatgaggaagacatttgaaaagaaacctaccgcaacgggtacctttggcgtgaggctcgacgactgtccccctgcccacaccaatagggtcggcgacactagcccacccgattttcttaaaagtctcattcagttctag

SEQ ID NO: 203288 - DNA, 5877 bp, Artificial Sequence
  Description of Artificial Sequence: Synthetic coding sequence
atgatggccacccggcggaccggcctgagcgagggcgacggcgacaaattaaaggcttgcgaggtgtctaagaacaaagacggaaaagagcaatccgagaccgtttcattatcggaggatgaaacattctcctggcctggcccaaagacagttactctgaaacgcacatcccaaggcttcggttttacacttcggcactttatcgtgtaccctccagaaagtgccatccagttctcctacaaggatgaagagaatggaaacagaggtggaaaacagcggaacagactagagccaatggatacaatcttcgtaaagcaagtgaaagaaggcggacctgcctttgaggctggactgtgcactggtgatagaattattaaggtgaacggggagagcgtgatcggcaaaacatacagtcaggtgatcgcactgatccagaactccgacacaaccttggagctgtctgtcatgccgaaggatgaagacatcttacaggtgctccagtttacaaaggatgtaactgcactggcctactcacaggacgcttatctgaagggaaatgaggcatacagtggtaatgctagaaatattccggagccacctcctatctgctatccctggctgccttctgccccctctgcaatggcacaacccgtggaaatcagcccgccagattcaagtttgagcaagcagcagacttcaaccccagtgcttacacagccggggagggcctaccggatggagattcaggtgcccccttctcccacggatgtggcaaaatcaaatacggctgtctgcgtgtgtaatgagagcgtcagaacagtcatcgtgccatccgaaaaggtggtggatttgttaagcaatcgaaacaaccataccgggccgagtcacaggaccgaagaggtgagatacggtgtaagcgagcaaacctctttgaaaactgtgagccgcactacctctcctcccctgtccatccctactacgcacctcattcatcagccagcagggtcaaggtcccttgaaccgtcaggcatcctgttaaaatccgggaattatagcggacacagtgatggcatttcatctagcaggtcccaggccgtcgaggccccatcagtgagcgtgaatcactatagcccgaatagccatcagcatattgactggaaaaattataagacttacaaggagtacatcgataaccgccgactccacatcgggtgccgcactatccaagagagactggattctttgcgagcagcctcccagagcacaacagactacaaccaagtcgtgcccaacaggactacactacaggggagacgacgctcaacaagtcacgacagagttccgcagagcgtgcagatcagacagagaagtgtcagccaggaacggctggaggattcagttctgatgaagtactgtccccgatcggctagccagggcgcgctgacctccccgtcagtgtctttttcgaaccaccgtactcgttcttgggactacatcgaaggccaagacgagaccctggaaaatgttaacagcggcacccctatccccgatagcaacggcgagaagaagcaaacgtataaatggagcggcttcacagagcaggacgaccggagaggaatctgcgagcgaccgcggcagcaggagattcacaaaagctttagaggttctaactttactgtggccccaagcgtagtaaacagcgacaatcgtagaatgagcggcagaggtgtgggcagcgtctcacaattcaagaagatccctcccgatttgaagaccctacaatccaatcggaatttccagacaacctgcgggatgagcctccctcgcggcatcagtcaggatcgcagtcccctcgttaaagtgcgcagcaactccctgaaggccccatcgacacatgtcaccaaaccatcctttagccagaaatcatttgtcagcattaaggatcagaggcccgtgaatcaccttcaccagaactcattgctcaaccaacaaacatgggtccggacagacagcgcgcctgaccagcaggtcgagaccggcaaatcaccttcgctcagcggcgcttccgcgaagcccgccccacagtcatccgaaaatgcaggaacatcggacctggaactgcctgttagccaaagaaatcaggatctgagcctgcaggaagccgaaaccgagcagtcagacacccttgataataaagaagcggtgatcctgcgcgaaaaacctccttccggacgccagactcctcagccactgcgtcaccaatcctatattctggcagttaatgatcaggagacgggatctgatacaacctgttggctgcccaacgacgcaaggagggaagttcatattaaacggatggaggagcggaaggctagctccaccagtcccccgggcgattctcttgcgtccataccttttatcgacgagcccacttccccctccatcgatcatgacattgctcacattccggcctcggcagtgatctcagctagtacatcacaggttcccagtatagcgactgtgcctccttgcttgaccacttcagctcccttaattcggaggcagctgtcgcacgatcacgaaagcgtggggcccccaagtctcgatgcacagccgaatagtaagactgagagaagtaagtcttacgatgaaggcttagatgattatagggaagacgcaaagctctctttcaagcatgtgtcatctttgaagggcattaagattgcggatagccagaaatctagtgaggattcaggatcccgcaaagactcatcgagcgaagtattcagcgacgccgcgaaggagggatggctgcacttccgcccactcgttacggacaagggaaaacgggtggggggttctatccgaccctggaagcagatgtatgtcgtgttgcgaggacactctctgtacctgtataaggacaagcgggaacagaccaccccgtctgaagaggagcaacccatcagcgtgaatgcctgcttgatcgacatatcctatagcgaaacgaagaggaaaaatgtgtttcgcctgacgacttcagattgcgagtgcctgttccaagcagaggacagagatgatatgctcgcatggattaagaccatccaggagagtagcaatctgaacgaagaagacaccggcgtgaccaaccgggatctgatctctcgaagaattaaagaatacaataaccttatgtccaaggccgagcagctgcctaaaaccccccgacaatccttgtcaatccgacagaccctgcttggggcgaagtcagaaccaaagacacagtccccccacagccctaaagaagagagtgaaaggaaactgctctcaaaggatgacactagcccccccaaggacaaaggaacctggaggaaaggcatcccttcgattatgagaaaaacatttgaaaagaaaccaacagcaaccggcacgtttggcgtgaggctggacgactgtccccccgctcataccaaccgctatattccgcttattgtcgacatatgctgtaagttggttgaggagaggggactcgaatatacagggatctacagggtgcccgggaacaacgctgctatctcttctatgcaggaggagttgaacaaggggatggccgatatagacatccaagatgataaatggcgcgacctcaacgtgatttctagtctcttgaaatctttcttccggaagttacccgagcctctattcaccaatgacaagtacgccgatttcatcgaagcgaaccgcaaggaggatccactagaccgtctcaaaacgctcaagcgtctgattcatgacttacctgaacatcactacgagaccttaaaatttctaagcgcccatttaaagacggtggccgagaattccgagaaaaataagatggaacctcggaatctcgccatcgtgtttggcccgactttagtaagaacatccgaggataatatgacccacatggtaacgcatatgcccgaccagtataagatcgtggaaaccctaatccagcaccacgactggttttttactgaggagggggctgaggaacctctcacaacagtgcaggaggaatcaaccgtggatagtcagcccgtacccaacatagaccacctgctgactaatataggcaggaccggggtcagccctggggacgttagtgactccgccactagcgattcaacaaagtccaaagggtcttgggggtctggcaaagatcagtacagtagggagctcttggtgtcttcaatctttgcagccgctagccgaaaaagaaaaaagcccaaggagaaggcacaaccaagctcgtcagaagacgaactggacaacgtcttctttaagaaggaaaacgtagagcaatgccacaatgacacaaaggaagaatcgaagaaagagagtgaaactttgggacgcaaacagaagatcataattgctaaagagaactcaactaggaaagaccctagtaccaccaaagacgagaaaatttccctaggcaaagagagcactccatccgaggaaccctctccaccacacaattctaaacacaacaagtcaccaacacttagctgccgatttgccattctaaaagagagccctcggtcactcctcgcccagaagtcatcacaccttgaagaaacagggtcagactcaggaacgttgcttagtacctcgagtcaggcatccttggccaggtttagtatgaaaaaatcaactagcccggaaacaaaacactccgaattcctggcaaatgtctcgacaattaccagcgactattccaccacctccagcgccacttacctgacctcactcgacagcagcagactcagcccagaggtacagtcagtcgcagagtcaaagggagatgaggcagacgacgaacgcagcgagttgatatccgaggggaggcctgttgaaactgatagtgaaagtgagtttccagtgtttcccactgcattgacatcggaaaggctttttcgtggaaagctgcaggaggtcaccaagagcagcagacggaattccgagggctctgaactcagctgcactgaaggttctttgacttcaagcctggactccaggcgccagttattttcgagtcacaagctgattgaatgcgatacattatctagaaaaaagagtgccaggttcaagagcgactccggcagtctgggcgacgccaaaaacgaaaaagaagctccatctctgactaaggtgttcgatgtgatgaagaagggtaaaagtacaggctctctgttgacgcccactcgcggcgagagcgaaaagcaggaacctacatggaaaaccaagattgccgacagactgaagctgcgaccccgtgcaccggccgacgacatgtttggtgtcggcaatcacaaggtgaacgcagagacggctaagcgcaaaagtatcaggcgccgccatacattaggcgggcaccgcgatgccaccgaaatctcagtgctcaacttctggaaggtgcacgagcaatccggcgagcgtgagagcgagttaagtgcagtaaaccggttgaaacctaagtgcagtgctcaggatctctcaatcagcgactggcttgccagagagcggttgaggacttcgacgtctgatttgtcaagaggtgaaataggcgaccctcagaccgaaaatcctagtacacgagaaattgccacgacagacacaccactgagcctgcactgtaatactggctcttcttcttcaacgcttgcgtccactaatagacctcttctgtccatcccaccacagtccccggatcagattaatggcgagtctttccagaatgtcagcaaaaacgccagcagtgctgcaaatgctcagcctcataagttaagcgagactcctgggagcaaggcagaattccacccgtgtctgtag

SEQ ID NO: 203289 - DNA, 594 bp, Artificial Sequence
  Description of Artificial Sequence: Synthetic coding sequence
tgaaacaacgccgccatcagcagcatgcaggaggagctgaacaagggaatggcagatattgatatacaggatgacaaatggagagacctgaatgtcatctctagcttgctaaagtccttcttcaggaaactcccggagcctctgtttacaaacgataaatatgctgatttcatagaggctaacaggaaggaagatccattggatcgcctgaaaactctgaagcgcctcatccacgacttgcctgagcaccactacgaaactctgaaattcctttccgctcacctgaagacagtcgctgaaaactctgaaaagaataagatggagccacgcaacctggctatcgtgttcgggcccactctggtacggacaagcgaggacaacatgacccacatggtgactcatatgccggatcagtacaaaatcgtagagactctcatacagcatcacgactggttctttacagaggaaggtgctgaagagccactgattcagcttttggttacgcagcaaaatctgagagtgctgggagaccttgagcgaatctcaatagccggaaactgcctgtgcccgccctcactccagctcctggtgtag

SEQ ID NO: 203290 - DNA, 342 bp, Artificial Sequence
  Description of Artificial Sequence: Synthetic coding sequence
tacatccccctgatcgtggacatctgctgcaagctggtggaggagagaggcctggaatacaccggcatttaccgcgttcccggcaataatgcagcaatttcttctatgcaagaggaactgaacaagggcatggctgacattgatatccaagatgacaagtggagagacctcaatgtgatttcatctcttttaaagtccttcttccgcaagttgccagagccgctgttcaccaacgacaagtatgcagacttcatcgaagccaacaggaaagaggacccacttgatcgtttgaaaaccttgaagcggctgtttctctctgcccatctaaaaaccgtcgcatag

SEQ ID NO: 203291 - DNA, 2724 bp, Artificial Sequence
  Description of Artificial Sequence: Synthetic coding sequence
atgcccaaggacgaggacatcctgcaggtggcctacagccaggacgcttacctgaaaggcaatgaggcgtattcgggcaatgcccggaatattcctgaaccccctcctatttgttacccatggctgccatctgccccatctgcaatggcccagcctgtggagatatcaccccctgattcatccttgtccaaacaacagactagtacgcccgttctaacacagcccgggagggcctacaggatggaaattcaggtgcctcctagtcccaccgacgtcgccaagagcaacactgcagtttgtgtttgcaatgagagcgtgcgaactgtgattgttccatctgaaaaggtcgtcgacctgctgagcaatcggaacaatcatacaggcccatcacatagaacagaagaggtgcggtacggggtgagtgaacaaaccagcctgaaaaccgtttctcgcactacatctccccccctgagtatacctaccacccacctcattcatcagcccgcgggctctaggagcctggagccgtctggtattttgctaaaaagcggtaattactcgggccactccgatggaatttcctcctcaaggagtcaagctgtcgaggctccaagtgtgtctgtcaaccactattcccctaatagccaccagcacattgattggaagaactacaaaacctacaaggaatatatcgataatcggagacttcacattggctgtaggacaatccaggagaggctggatagtctgcgggctgcatctcagtccacaactgattacaaccaggtagtgcctaataggacgactcttcagggacggcgccgatccacctcccacgatcgggtgccacaatcagtgcagattagacagcgcagtgttagtcaggaaaggctggaagactctgtcctgatgaaatactgccctcggtcggcgtcacagggcgcccttactagcccttctgtgtcattcagtaatcatcgaaccaggtcttgggactacatcgaaggccaggatgagacgctggagaacgtgaatagcgggactcctatccctgactcaaatggggaaaagaagcagacctacaagtggtctggttttaccgaacaggacgacaggcggggaatctgcgagcgtcctaggcaacaggaaatccataaaagctttcgtgggagcaatttcactgtcgccccatcagtcgtgaacagtgataacaggagaatgtccgggcggggagtcgggtcagtgagccaatttaaaaagatcccacctgatctgaagactctgcagagcaataggaattttcagactacttgcggtatgtctctaccacgggggatttctcaagatcggtcgcctctagtaaaagtcagaagtaattcccttaaggcacccagcacgcacgttacgaaaccaagcttctcccagaagagttttgtcagcatcaaagaccaaaggcccgtgaatcacctacaccaaaactcacttctaaaccagcagacctgggtcagaaccgacagtgcccccgaccagcaggtggaaaccggaaaaagcccctccctgagtggggcttcagcgaagccagcacctcagagctccgaaaatgctggtacctcagatctagagcttcctgtctcccagcgaaatcaggacctgtccctccaggaagctgagaccgaacagagcgacacactggacaacaaggaggctgtcattctgcgcgaaaaaccgccgtcagggcggcagacacctcagccacttcgccatcagtcgtacatcctggccgttaatgatcaggagactggtagtgacacaacctgctggctgcctaacgatgctagaagggaggtgcatattaaacgtatggaagaaagaaaagccagcagtaccagcccacctggagacagcctggcgagtattccgtttattgacgagcctacatcgccatctattgaccacgatatcgcacacatccccgccagtgccgtcatcagtgcatcaacgtctcaggtaccttcgattgccactgtccctccctgtctgacaactagtgcaccactgatccggcggcagctgtcccacgaccatgagtctgtgggcccgcccagcttggatgcccagccaaactctaagacagaaaggagcaaatcctacgacgaagggctggacgactaccgagaggacgcgaagctgagcttcaagcatgtgtcatcactcaaggggatcaaaatcgccgattctcagaaatcttcagaagatagtggtagtaggaaggactcctcctccgaggttttttccgatgcagctaaggaaggttggttgcatttccgaccattggttacagacaagggcaagagggtcggaggctccattcggccctggaaacaaatgtatgtagttctgcgcgggcactctctctatttatacaaagataaacgagagcagacgacacccagcgaggaggagcagcctatctccgttaacgcttgcttgatcgatatatcctactctgagacaaaaagaaagaacgtcttccgccttacaaccagtgattgtgaatgtttgtttcaggccgaagatcgtgatgacatgctcgcttggattaagaccattcaggaatcatcgaatctgaatgaggaggacacaggagtcaccaacagagacctgattagtaggaggatcaaagagtacaataacttaatgagcaaggccgagcagctgccctag

SEQ ID NO: 203292 - DNA, 3396 bp, Artificial Sequence
  Description of Artificial Sequence: Synthetic coding sequence
atgatggccacccggcggaccggcctgagcgagggcgacggcgacaagctgaaggcttgtgaggtcagcaagaacaaggatgggaaggagcagtccgagactgtttccctgtcagaggatgaaacgttcagttggcccggcccaaagaccgtgactctgaagaggacctcccagggctttggattcaccctgcgccatttcatcgtataccccccagagtccgcaattcagtttagctacaaagacgaggaaaacggaaatcgtggtgggaagcagcgtaacaggctggagcccatggacaccatttttgttaagcaggtcaaggagggaggtccagcctttgaggcaggactctgtacgggggacagaattatcaaggtaaatggtgagagcgtgatcggcaagacttacagccaggttattgcactgattcagaacagtgacactacactcgaactatctgtgatgcccaaggatgaggatatactccaagtactgcagttcacaaaggatgttactgccctcgcttactctcaggatgcttacctgaaaggaaatgaggcctattccggtaacgcgcgtaatatacccgaaccccctccaatttgctacccttggttaccatctgcccccagcgccatggcccagccagtggagatcagtcctcctgattcttctctaagtaaacagcaaacaagcacacctgttcttacccagcccggccgggcataccgaatggaaattcaggtccctccttcacccacagatgtcgccaaatccaacacagccgtgtgcgtgtgcaatgaatcagtcaggacagtgatcgtaccttctgagaaggtcgtagatctcctttccaaccggaataaccacacaggacccagtcaccgcacagaagaagtcaggtatggcgtctctgaacagaccagcctgaaaaccgtgtcacgcactaccagcccaccattgtccatcccaactacccacctcatccaccaacccgccggaagccgtagtctggaaccatctgggatactgctcaaatctggtaactattctggtcattcagatgggatctcctcctcccggagccaggctgtcgaagccccatcagttagcgttaaccactactcccccaactcccaccagcacatcgactggaaaaactataaaacatacaaggagtatattgacaacaggcgcttacacatcggctgtaggacaatccaggaacgtctcgacagtctgcgagcagcaagccaaagtaccacggattataaccaggtcgtgccgaatcgcacgaccctgcagggcagaagacgctctacatcgcacgaccgggtgccacagagcgtgcagattcggcagaggtcagtgtctcaagagcgcctggaggactcggtgctgatgaaatattgccctcgtagcgcctctcagggcgcactcacctctccctctgttagcttctccaaccatcgcacccgctcctgggattatatagagggccaggatgaaactcttgagaacgtaaacagtggcaccccgatccccgactcaaatggtgagaagaaacaaacttataagtggtcagggttcaccgaacaggatgaccgtcgaggcatttgcgagaggcctcgacagcaggagatccataagtcttttcgggggtctaattttactgtggcgccttccgtggtgaatagtgacaatagaaggatgtctgggcgtggcgtaggtagcgtttcacagttcaaaaagatcccgcctgaccttaagactctacagagcaatcgaaattttcaaaccacctgtgggatgtcccttcctcgcgggatttctcaggatcgaagtcccttagtcaaggtgcgctctaattccctcaaggcacctagcacgcacgttacaaaacccagcttctcccagaaatccttcgtgtcgattaaggaccagcggcccgtgaaccatcttcatcagaatagcctgctgaatcagcagacctgggtacgcactgactctgcacccgaccagcaagttgaaaccggtaagtcaccgagccttagcggggctagcgcgaagcctgctcctcaatcttcagaaaatgctggaacctccgacctcgaattgccagtgtctcagaggaatcaagatctctccctccaggaggccgagactgaacagagtgataccctggataacaaggaggccgtgatcctcagagaaaagcctccatctggacggcagacaccacagcctctgaggcaccagtcatatattcttgcagtgaacgaccaggaaactggaagcgataccacctgctggctcccaaacgatgcgaggcgggaagtccacatcaagaggatggaagagcgaaaggcgtcctccacctcacctcccggagacagtttagcttcaattccattcatagacgagccaacttctccgtccatagatcatgatatcgcgcatatcccagcctctgcggtcatctctgcatccacgagtcaggtgccctcaatagccacagtcccaccttgtctgaccacctcggctcccctgataagaaggcagctatcgcatgatcacgaatctgtcggccctcctagcctcgacgcgcagccaaatagcaaaactgaacggtccaaaagttatgacgagggcttagacgactaccgcgaggatgccaagttgtctttcaagcatgtgtctagtcttaaaggtatcaagatagcagattcccaaaaatcgagcgaggatagcggatccaggaaagattcttcttccgaggttttctccgacgctgcaaaggagggctggttgcatttccgccctttggttaccgataaaggcaaacgtgtgggcggcagtattcgcccatggaaacagatgtacgtggttctgcggggccacagcctctatttgtataaggacaaaagagagcagaccactccaagtgaggaggagcagccaatatcagtcaatgcctgtctgatcgacatttcttattctgaaaccaagcgaaagaacgtgttcaggctgacgacaagcgattgcgagtgtctctttcaggccgaggatagagacgacatgttggcctggatcaaaaccatccaggaatcctcgaatttgaatgaggaggacactggagtgaccaaccgtgacttgattagccgccggatcaaagagtacaataatctaatgtcaaaagctgaacagctacccaaaacaccacgccagtctctaagcattcgccagaccctccttggagcgaagagtgagcccaagactcagtccccccacagtcccaaggaggagtctgagcgcaaactcctgtctaaagacgacacctctcctcccaaggacaagggaacttggaggaaaggaattccctccattatgtag

SEQ ID NO: 203293 - DNA, 4224 bp, Artificial Sequence
  Description of Artificial Sequence: Synthetic coding sequence
atggccacccggcggaccggcctgagcgagggcgacggcgacaagctcaaagcctgcgaggtcagtaaaaataaggatggcaaagaacagtcagaaaccgtgtctctgagtgaggatgaaactttttcttggcccggaccgaaaacggtgacacttaagagaaccagccagggattcggttttactttgcggcacttcatagtgtatccaccagagtccgcaattcaattctcttataaagatgaggaaaatggtaatcgcggcggaaaacagagaaatcggcttgagcccatggatacaatcttcgtgaagcaggtgaaggaaggcggaccggcctttgaggctgggctatgcacaggcgatcggattattaaagtaaatggggagagtgtgatcggcaagacatattcccaggttatcgctctgatccagaacagcgatacaaccctcgaactctctgtcatgccaaaggacgaggacatattgcaggtggcatatagccaggacgcgtacctgaagggaaacgaagcttactccgggaacgcccgtaacatcccagagccccctcccatttgttatccgtggctgccttctgcccccagcgcgatggcccagcccgtggaaattagccctccagacagctccctcagcaaacagcagactagtacaccggttctcacccagccaggaagagcgtaccgcatggagatacaagttccccctagccctactgatgtcgctaaatctaatacagctgtgtgtgtctgtaacgagtctgtaaggactgtcatcgtcccaagcgagaaggtagtggacctgctgagcaatcgcaacaatcatacaggccctagccaccgaacagaggaagtgcgttatggtgtatcggagcaaacgtctctcaagaccgtgagcagaacaacctctccaccactttcaattcctactactcatttaattcaccaacctgccgggtcaagatcgttggagccctctggcattctcttgaagagcgggaattatagtggccactcagatggcataagtagtagccgttcccaggctgtcgaagctccttctgtgagcgtcaatcactactcacctaatagtcatcagcatatagactggaagaactacaagacatacaaggaatacattgacaatcgccgcctgcacattggatgcaggacaatccaggagcgtctggacagcttacgggccgcctcacagtctactaccgattataatcaggtcgtgcccaaccgtacaacactgcagggccggcggcgttcaactagtcatgacagagttcctcagtcagtccaaattagacaacgatctgtctcccaggagcgcctcgaggactctgtgctgatgaaatactgcccccgatccgcgtctcagggagctctcaccagtccatcagtgtctttctctaatcatagaacacggagttgggattacatcgaggggcaggacgagaccttggagaatgtcaattccggaactcccatccccgactccaacggcgagaagaagcagacgtataaatggtccgggttcacggaacaagacgaccgaagaggtatttgcgagaggccccgacaacaagagatacacaaatcttttagagggtccaacttcacagtagcaccctctgtggtgaactcagataataggcggatgtctggtcggggtgtgggtagtgtcagccattggagaaaggggattccctccattatgagaaaaaccttcgaaaaaaagcctacggcgaccgggactttcggcgtgcgtctggacgattgcccacccgcgcacactaatcgatacatacccctcatagtggatatttgctgcaagttagtggaagagaggggactagaatacaccggtatttatcgggttcctgggaataatgctgcaatctccagcatgcaggaggaactgaataaaggaatggcggacattgacatccaggacgataaatggagagacctcaacgtcatttcttcactcttgaaatccttttttcggaagctgcccgagccactgtttacaaatgacaaatatgccgattttattgaggccaaccggaaggaagatcctttggatcgcttgaaaaccctgaaaagactgatacatgaccttccggagcaccactacgaaacactgaaatttctttctgcccaccttaaaaccgtggcagagaactcagagaagaacaaaatggagccacgcaacctcgctatcgtctttggcccaacacttgtccgaaccagcgaggacaatatgactcacatggtgacgcacatgcccgatcagtacaaaattgtggagaccttgattcaacatcacgattggttttttaccgaggaaggagcagaagagccgctcacaacagttcaggaagagtctacagttgacagtcagcctgtgcccaacattgatcacctgttgacaaacatcggacgaacaggcgtgtccccaggagatgtgagcgactccgctacatcagacagtaccaaaagcaaaggctcatgggggagcgggaaggatcagtatagcagagagctgctggtcagtagtatctttgcagcagccagtagaaagcgcaaaaagcccaaagaaaaagcccaacctagcagcagtgaggatgaactcgataacgttttttttaaaaaagaaaatgtggagcaatgtcacaacgacacaaaggaggaatctaagaaggagtccgagacattgggacgtaagcaaaaaatcataatcgccaaggagaactccacccgcaaggatccaagtacaacaaaagatgagaagatttctctaggaaaagaaagtacaccaagtgaagagccatctccccctcacaattcaaaacataacaaatccccaaccctgtcctgtcgcttcgccatcctgaaggaaagtccacggagtctgctcgcacagaaaagctcgcatctggaggaaacgggctccgacagcggcaccttgctctctacctcttcacaggccagcctggcacggttttccatgaagaaaagtaccagtccggagaccaagcacagtgaatttctggccaacgtgagtacaatcacctctgactattccacgaccagctcagcaacgtacctcacatctttggattcctcacgactgtcgccggaagttcaatcagtggccgagagtaagggggacgaagctgacgacgaaaggagtgagctcatcagcgagggaagaccagtcgagaccgacagcgaatccgaatttcccgtgttcccaaccgcactcacctctgagaggctgttcagggggaagctgcaggaggtcacaaaaagcagcagacgaaatagcgaggggagcgaactatcttgtaccgaaggttcactgacgagcagcttggatagtaggcgccagctattttcgtcccataaactgatcgagtgtgacacactgtcacgcaagaaatctgcacgtttcaagagtgactcaggatcactcggggacgcaaagaatgagaaagaagcaccgtccctaaccaaagtctttgacgtcatgaaaaaaggaaaaagcacgggaagtcttttaactcccacccgaggtgaatctgaaaagcaggagcctacatggaaaacaaagattgccgatcggctgaagctccgcccgcgtgcccccgcagatgatatgttcggggtggggaatcataaggtgaatgccgagactgctaagcggaagagcattcgtagaaggcacacgctgggtggacatagggacgctactgaaatctctgtattgaatttctggaaggtacacgagcagtccggcgaacgtgaatccgagctgtcagccgtgaaccgcctgaagcctaaatgtagcgcccaggacctctcaatctcagactggttagcgcgcgagaggttacgtacttccacttccgatctgagcagaggggaaatcggggacccacagacggagaatccctctacacgcgagatcgcaaccacagacacaccactaagtctacactgcaacaccggatcaagttcaagcactctggcttcgacaaatcgcccactgctgtcgattccgcctcagagccctgatcagattaatggtgagtctttccaaaatgttagcaaaaatgcaagttccgccgcaaatgctcaaccccataagttgagcgaaacgccgggttccaaggctgaattccatccttgcctgtag

SEQ ID NO: 203294 - DNA, 279 bp, Artificial Sequence
  Description of Artificial Sequence: Synthetic coding sequence
atggacaccatcttcgtgaagcaggtgaaggagggcggccccgcctttgaggccggcctctgtacaggcgatcgcatcatcaaagttaatggcgaatccgtcatcggaaaaacttattcccaagttattgcacttatccagaactccgacaccacacttgagctgtctgtcatgccaaaggatgaggacattctccaggtcaaccttgaatttagtaccttttacaaaaatacaatcgccaaattcctgcaattaagcgatatggaaatgctttgttag

SEQ ID NO: 203295 - DNA, 4476 bp, Artificial Sequence
  Description of Artificial Sequence: Synthetic coding sequence
atgaacggcgtggccttctgcctggtgggcatccccccccggcccgagcccagaccgcctcagctgccccttggacctcgggatggttgttcaccccgaagaccttttccctggcagggccctaggacacttttgctgtacaaatcaccacaggatgggtttgggtttactctccggcacttcatcgtgtaccccccggagagcgcggtccactgctcattaaaggaagaagagaacggcggtaggggaggcgggcctagcccgaggtatcgcctggagccaatggacacgatctttgttaagaacgtgaaagaggatggtcccgcccatcgggcaggtctgagaaccggggatcgcctcgtcaaggttaacggagaatcagtgatcggaaagacgtatagtcaagttatcgccctcatccaaaactccgacgatacactcgaactgtcgatcatgcccaaagacgaggacatcctgcagctggcttattcccaagatgcatatctcaaagggaatgaaccttatagcggcgaggcccgatccataccggaaccgccaccgatctgttaccctcggaagacctatgcccctcccgcacgcgcttcaaccagagctacaatggtccccgaaccaacatcggcgctgcccagcgatcctcgcagtccagctgcctggagtgaccccggtcttcgcgtgccccccgccgctcgagcccatctggacaactcctccttaggaatgagccaaccacggccttccccaggtgctttcccacacctcagctctgagcctcggaccccaagggcctttcctgaacccgggtctagggttcctccatcgcgcttagagtgtcagcaggctttatctcattggttaagtaatcaggtgcccaggcgcgccggtgagcgcagatgcccagcaatggccccccgcgcaagaagcgcgtctcaggatcgtctcgaagaagtagcagccccacggccctggccttgctctacatctcaagatgccctgagtcaactcggccaagaagggtggcatcgcgcccgctcagatgactatttgagcagggctacgcggtcggccgaggcgctcgggccaggcgccctcgtaagcccccgttttgagcgctgcgggtgggcgtcccagagaagctcagcaagaacacccgcttgccctactcgagacctacctggcccccaggccccccctccctctggacttcagggactggacgacctgggatatatcggttataggagttattcccctagtttccagagaagaaccgggctgctgcacgctcttagctttagggatagtccctttggcgggctgcccacctttaacctggcccagtctcctgcaagtttcccacccgaggcgtccgagcccccccgagtggtgaggccagaaccttcaacgcgagctctcgagccgcctgctgaagatcggggcgacgaggtggttttgaggcagaagccaccaacaggcagaaaagtgcaactgacacctgcccggcagatgaacctcggtttcggcgacgaatcgcctgagccagaggcaagtggacgaggagagcgtctcgggaggaaggtggcaccactggcaactacagaggatagtctggcttccattccatttatagatgaacctacatctcctagtatcgatttgcaggccaaacacgtccctgcttccgctgtagtcagttccgccatgaacagtgcccctgtcctcggtactagtcccagcagtcctacatttacattcaccctcggccgccactattcacaggactgctctagtatcaaggctgggcggcggtcatcctacttgcttgcaataaccactgagcgcagtaaaagttgcgatgacggactcaataccttcagggatgaggggagggttctcagacgtctgcccaatcgaatcccatctctccggatgttgcggtcatttttcacggatgggtccttggatagctggggcacatcggaagatgcagatgcgccctccaaacgacatagcacctcagatctgagcgacgcaacattctccgatatccgcagggaaggctggttgtactataagcaaattctgacaaagaaaggaaagaaggctggatctggtctgaggcagtggaaaagggtgtacgctgctctcagggcccggtcactcagcctcagtaaggaacgtcgcgagcctggacccgctgcagccggtgcggcagctgctggggccggtgaggacgaggccgctccagtttgcattggaagctgtctggttgatatttcttattctgagacaaaacgacggcatgtgtttcggctgaccactgccgatttctgcgagtatctgttccaggccgaggatcgggacgatatgttgggttggattcgggcgatccgcgagaattcccgagctgagggcgaggaccctggctgtgctaaccaggccctgattagcaaaaaactgaatgattaccgtaaagtgtctcattctagtggacccaaggccgactcctccccaaagggctcaaggggtctcggcgggctgaagtctgagtttcttaaacagtccgcagctagaggactgcggacacaagacttaccagcaggctctaaggacgactcagcagccgctcccaaaacgccatggggaattaatattattaagaagaacaagaaggccgctccaagggccttcggcgtccgcttggaggaatgccagccagcgacagagaatcagcgcgtgccacttattgtggccgcctgctgcagaatagtggaagcaagaggactagagtcgactggaatctatcgggtccccggcaataatgccgttgtctcctctttacaggagcagcttaacagaggccctggtgacattaacttacaggacgagcgttggcaggatctaaacgtcatctcctctcttcttaagagtttctttcgtaagctacctgagccactttttacagatgacaagtacaatgattttatcgaggccaaccgaatagaggacgcgagggaacgaatgcgcactcttcgcaagctgatccgtgaccttccgggacattactacgaaacactgaagtttttggtgggacacctgaagacaatcgcagaccattccgagaagaacaagatggagcctaggaacctggccttggtgtttgggcctaccctggtgagaaccagcgaggacaatatgacagatatggtgacacacatgccagatcggtataagattgtggagaccctaatccaacacagcgattggtttttttcagatgaggaggacaaaggcgagcggaccccagtaggggataaagagccgcaggctgtcccgaacattgagtacctgctccctaacatcggaagaaccgtgccacccggggatccgggatctgacagcacaacatgcagtagtgccaagagtaagggaagctgggccccaaaaaaagagccttacgcacgggagatgctcgcgatttctttcataagtgctgttaatcgtaagcgaaagaagcgccgcgaggctcggggcctcggctcatctacggatgacgacagtgagcaggaggctcacaaacctggggccggtgccactgcccctggaactcaggaacgaccacaaggccctctgcctggagccgtggctccagaggctccaggccgtctttctcccccagcagctccagaagagcgaccggccgcagacacccggagcatagtgtccggctatagtactctgagcactatggataggtccgtgtgctctggcgccagtggacgtcgagctggtgccggtgacgaggccgacgacgaaagatccgagctcagtcacgtcgaaactgacactgaaggtgcagcgggggccgggcccggcggcaggttaacaagacgcccaagcttcagttcacatcatctcatgccatgcgacacccttgctaggcgacgtctggcacgcgggcgcccagacggagaaggggctggacgaggagggcctcgcgctcctgaacctcccggaagcgccagtagcagtagccaggagtctctcagaccgcctgctgcagctttggcctctcgcccatcgaggatggaggcactgcggctacggctgcgggggaccgctgacgatatgttggcggtgcgacttcgaagaccactttcccccgagactagacgccgacgttcttcatggagacgccataccgtcgtagttcagtcgcctcttaccgacctgaattttaacgagtggaaagagctcggcggcggtggacctcctgaacccgcgggcgctcgcgcccacagcgacaataaggactcaggcttgtcgtcattggagtccaccaaagcccgggctccaagctctgccgcctcccagcctcctgccccaggcgacaccgggtctctgcaaagtcagcctccaagacggtcagccgcttcgaggctccatcagtgcttatag

SEQ ID NO: 203296 - DNA, 3435 bp, Artificial Sequence
  Description of Artificial Sequence: Synthetic coding sequence
atgaacggcgtggccttctgcctggtgggcatccccccccggcccgaacctcgccctccccagctgcccttagggcccagagacggctgctctcccaggaggccttttccctggcaggggcctcgtacactgttgctctataagtccccacaggatggatttggatttactctccgacacttcattgtttatccccctgagtctgccgtccactgctcacttaaggaggaagagaacggcggccgcggcgggggcccatcaccacggtatcgtctcgagcctatggacactattttcgttaagaatgtgaaggaggacggacccgcccatcgggcaggattgcgcacaggagataggctagtcaaagtcaacggggaaagtgtcataggaaaaacttattcccaggtcattgccttaatccagaacagtgacgacacactggagctgtccattatgcccaaggatgaagatattctccagctggcatactcccaagacgcttatcttaagggcaatgaaccttattccggcgaggctcggtccatccctgagcctccacctatttgttacccgcgcaaaacatacgcaccgcctgctcgtgcttctactcgagccaccatggtaccggagcccactagcgctttaccttccgacccccgcagccccgcggcctggtcagatcccggcctgcgagtcccccccgcagccagagcacacctggataactcaagcctgggtatgtctcagcctcggccttcccctggagcctttcctcacctgagtagtgaacccagaactccaagggcctttccagagcccggaagcagagtccctccatccaggctcgagtgtcagcaggccctgtctcactggttatctaatcaagtaccccggcgggctggtgagcggcgctgtcctgccatggcaccccgcgctagatccgcaagccaggaccggttggaggaagtcgctgcccctcgaccctggccctgttctacctcccaggacgcactgtcccagctgggccaggagggctggcaccgagcgagatccgacgactatctgtcccgcgcaaccagatcagcggaggccttaggccccggagccctggtctctccaaggtttgaaaggtgtggatgggcttctcagagatcttcggcccgtaccccagcatgccctacacgtgacctgcctggccctcaggctccaccgccttcaggccttcagggtctcgatgacttaggctatatcggttaccgatcctatagtccctctttccaacggaggaccggccttttgcacgccctttctttcagggattctccttttggaggacttcctacattcaacctggcacagtcccctgcatccttccctccagaagcctccgaaccacctagggtggttagacccgagccgagcactagagctctggagccaccagccgaggacagaggcgacgaagtggtcctacgccagaaacctccaacagggagaaaggtgcagctaactcccgccaggcagatgaatctcgggttcggcgacgagagccctgaacctgaggcgagtggccgaggtgaaagactaggaaggaaggttgcccccctggccacaacagaggattcactcgctagcattccgtttattgacgagcccacatcacccagcatcgacctgcaagccaaacacgttcctgcatcagctgttgtgtcctcagcaatgaattccgcacctgtgctgggaacaagcccgtccagccctaccttcacttttaccctcggcaggcattactctcaggactgctctagcatcaaggcgggccgcagaagttcctacttgctagccattaccacggagcggtctaagagctgtgatgatggcctgaacacatttcgggacgaaggccgcgtactgcgcaggcttccgaaccgcatccctagccttcgcatgttgcggagcttcttcacggacgggtcactggacagttggggaactagcgaagacgctgatgccccttctaaaaggcatagcacttcggatctgtcagatgccactttttctgacatcaggagagagggctggctgtactacaagcaaattctgacaaagaagggaaagaaggcgggcagtgggctccgacagtggaaacgggtctatgccgctttaagggctcggtcactgtctctgtcaaaggaacggagggagccaggccctgctgccgctggagcagcagctgcgggcgcaggggaggatgaagcagcccccgtctgcataggctcatgcttggtggacataagttactctgaaactaaaagacgccatgtctttcgcttgaccaccgctgacttctgtgagtacctttttcaggctgaagacagagatgacatgctggggtggatcagggcaatacgggagaacagcagggccgaaggcgaagatccagggtgcgcaaaccaagcactcattagcaagaaattgaacgactaccggaaggtgagtcattcctcagggccaaaggcagatagcagccccaaaggtagccgggggctggggggcctgaaaagcgaattcctgaagcagagtgccgcccggggactgcggacacaggatcttccagcaggctctaaggacgacagtgccgcggcacccaagacaccgtggggaatcaatatcattaaaaagaataagaaagctgcaccacgcgctttcggagtgcggctcgaggagtgtcagcctgcgactgagaatcagcgggttccactcatcgtggccgcttgttgtaggattgtcgaagccagagggctggagtctactggaatttacagagttcccggcaacaacgcagtggtgtcaagtctgcaggaacaacttaatagagggcctggcgatattaatctgcaggatgaacgctggcaagacctgaacgtaattagttcactgctgaagagtttcttccgtaagctgcccgagcccctgttcacagacgacaaatacaatgatttcatagaagccaaccggatcgaagacgccagagaacgaatgaggactctgaggaaattaatccgggacctgccaggccactactacgaaaccctcaagttcctcgtgggccatctcaaaactattgcagatcactccgagaagaataagatggagccgagaaatctggcgctggtctttggacctacattggtccggacatccgaagacaacatgactgatatggtaacccacatgccagacagatataaaatagttgagaccctcatccagcactccgattggttcttctccgacgaggaggacaaaggggagcgtacacctgtgggcgacaaggagccgcaggccgttcctaatattgaataccttttacctaatataggacgtacagtacctccgggggatccgggcagcgcagacttattggagatctag

SEQ ID NO: 203297 - DNA, 4194 bp, Artificial Sequence
  Description of Artificial Sequence: Synthetic coding sequence
atggacaccatcttcgtgaagaacgtgaaggaggacggccccgcccaccgtgccggtctcaggacaggagatcgcctcgtgaaggtcaatggagagtcagtgattggcaaaacgtattctcaagtcatcgccttgattcaaaactcggatgacaccctggagcttagcatcatgcccaaagacgaggacatactacagctcgcatactcacaggatgcctacctgaaaggaaacgaaccctatagtggcgaggcccgctctatccctgaaccccctcctatttgctatcctcggaagacctatgcgccaccagcccgcgcttcaacccgggcgactatggtgccggagcccacttcggccttaccaagtgatccaaggagccctgccgcttggtctgaccctgggctacgggttcccccggctgcgcgagctcacttggataatagttcacttggcatgtcccagccccgaccctcacctggcgcatttcctcatttatcatcagaaccgcgcaccccgagagcttttcctgagccaggatccagggtgccacccagtagattggaatgtcagcaggctttgagccactggctgtcaaatcaggtccctcgacgcgcgggtgagcgacggtgccccgcaatggcgcccagagcccggtcagcgtcacaagacaggctggaagaggtggctgctccacggccatggccttgttcgaccagtcaagacgcactctcacagctcgggcaggagggctggcaccgcgctcggtccgacgattatcttagtcgtgccactcgaagcgccgaagcactgggacctggggccctcgtttccccacggttcgaacgttgtgggtgggcgagccaaagaagttccgcccgcaccccagcttgtccgaccagggacctgccagggccacaggctcccccaccatccgggctccagggtctagatgacctcggctatattggttacaggagttactccccaagttttcagcggagaaccgggctgcttcatgctctgtcctttcgtgatagccccttcggcggattacctacctttaacctggcacagagccccgcgagctttccgccggaagctagcgagcccccccgggtcgtgcgccccgagccttctacccgcgcactcgagccccctgcagaggaccgcggagatgaggtggtgttaagacagaagccaccaacagggcggaaagtgcagctgacacctgctaggcagatgaacctgggcttcggcgacgaatcccccgagcctgaggccagcgggaggggcgagcgcctcggaagaaaagtcgcacctttggcaactacggaagactctctcgcatccatcccattcattgacgagccgacttcaccctccatcgacctacaggccaagcatgtccctgcctctgctgtggtttctagcgccatgaactctgccccagttctcgggacttctcccagctcacccacattcacatttacactggggcgccactactcacaagattgttcctcgataaaggctggacggcgttcatcttacctgctcgcaattaccactgaacgatcgaaatcatgtgacgatgggctgaatacgttccgagacgaaggtagggtcctgagaaggcttccaaatcgcatccccagcctgcggatgcttcggagctttttcaccgacggctcattggactcttggggcacctccgaagacgctgatgcacctagtaaacgacactctacatctgacctgagcgacgccacgtttagcgacatcagacgggagggatggttgtactataagcagatcctcactaaaaagggaaagaaagcaggctccggactacggcaatggaaaagggtctacgccgccctgcgcgctcggtcgctgagtctttcaaaggaacggcgcgagcctggtccggccgcggctggggccgccgccgcaggcgccggcgaagatgaggctgcccccgtatgtatcgggtcctgtttggttgatatttcatactctgagacaaaaaggcggcacgtgttccgccttacaacagctgatttctgtgaatatctgttccaggctgaggatagagatgacatgctggggtggatcagagccataagggaaaactctcgggctgaaggggaagaccccggctgcgccaaccaagccctcatttccaaaaagctaaatgactatcgaaaggttagccattccagcggtccgaaggccgattcttcccctaagggttctcgcggtctcggcggtcttaagagcgaattcctgaagcaatcagcggcgaggggcctgcgcacgcaagatttaccagccggatccaaggatgatagtgcagctgctccaaagactccctggggaataaatattatcaagaaaaacaaaaaagctgccccaagggcctttggtgtgaggctggaagagtgtcagccagcgacagagaatcaacgagtgccactcattgtggcagcttgttgcagaatagtggaggctaggggccttgagtctaccggaatctacagagtgcctggcaataatgcagttgtctcatccttacaagaacagttaaaccgtggcccgggagacattaacctccaggacgaacggtggcaagaccttaacgtgattagcagcctactgaaatccttttttcgcaaactcccagaacctctctttacggatgataaatacaatgattttatagaagccaatcggattgaagatgcgagagaaagaatgcggactctccgcaagttgattcgagatcttccagggcattattacgagaccctaaagtttctggtagggcatctgaagacgattgccgaccattctgagaagaacaaaatggagccacgtaatttagctctggtattcgggccaacactcgtacggacctctgaagataacatgactgacatggtgacccatatgcctgatcggtataagatcgtggagaccctcatccagcattctgattggttcttctccgatgaggaggataagggcgagagaacaccggttggggacaaggagccgcaggcggtgcctaatatcgaatacctcttgccaaacattggccgcactgtgcctcccggcgaccccggaagtgacagcacgacctgttccagcgctaagagcaaggggagctgggctcctaaaaaagagccttatgccagggagatgctggcaatctccttcatttcggctgtgaaccgcaaaaggaagaaaaggcgggaagcacgagggctcggttccagtacagacgatgatagtgagcaggaagctcacaaacctggcgcaggcgccaccgcaccgggtacgcaggagaggcctcaagggcccttgcccggggccgtggcccccgaagccccaggccgattatctccacccgccgctcctgaagagaggcccgctgcggacacacgctctattgtgtccgggtattcgaccctgtccaccatggatcgttctgtgtgctctggcgcctccggcagacgggcgggcgcaggcgacgaagcagatgacgagcggagcgaactcagccacgtcgagaccgataccgaaggagcagcgggagcaggccctggtggacgtctaaccaggcggccaagttttagctctcaccacctgatgccctgcgatacccttgccagaagacgactggcccgcgggcggccagacggagagggcgcgggccggggcgggccacgtgccccagagccccccggttctgcaagcagcagctcccaggagtcgctgaggccacccgccgccgctcttgcctccaggccgagtcgcatggaggccttacgcctcaggctgcgtgggaccgcggacgacatgctagccgttcgattaagaagaccactatctccagagacacgaaggagaaggagctcttggcgcagacacaccgtcgtcgtccagtcaccactaacagatctcaactttaatgagtggaaagagttaggcggcggaggtccgcctgagcctgcgggagctcgggcacactccgataacaaagattctgggctctcttcccttgagagtaccaaggcgagagccccgtcgtctgccgctagccagccgccagcaccgggcgatactggatcattgcaaagtcagccgcctaggcggagcgctgcgagtaggctccaccaatgcctgtag

SEQ ID NO: 203298 - DNA, 1968 bp, Artificial Sequence
  Description of Artificial Sequence: Synthetic coding sequence
atgcccgaggaccggaacagcggcggctgccccgccggcgccctggccagtacacccttcatcccgaaaactacatacaggaggattaaacggtgcttctccttccgaaaaggaattttcggtcagaagctggaggacactgtgagatacgagaaaagatacgggaataggctggccccaatgctcgtggagcagtgtgtggattttatccgccagcgaggactaaaagaggagggcctgtttcgcctgccagggcaagctaacctggtgaaagagttgcaagacgcttttgattgcggggagaagccatcttttgactccaatactgacgtgcacaccgttgcatccctcctgaaactgtatctgagagaactgcccgagcctgtgattccgtatgctaagtacgaggacttcttgagctgcgcaaaattactgtctaaggaagaagaggcgggggtcaaagaactcgctaagcaggtgaaatcgctaccagtggtgaactacaacctcttaaaatacatttgccggttcctggatgaggtgcagtcctacagtggagtgaacaagatgagtgttcagaacctggctactgtattcggccccaatatcctgcgccctaaagtcgaggacccgctaacgatcatggagggcacagttgtggtgcagcagctgatgagcgttatgatcagcaagcatgactgcttgtttcctaaggacgccgagttgcaatccaaaccgcaggacggagtcagtaacaacaatgagatacagaaaaaggccacgatgggccagttgcaaaataaggagaataacaacacgaaggattcacccagtcgtcagtgctcctgggacaaaagcgagtccccccagagaagcagcatgaacaacggctcaccaacagccctttccgggtctaagaccaactctccgaagaatagtgtacataagctagacgttagcaggtcccctcccctcatggttaaaaagaatcccgctttcaataaggggagcggaattgtcaccaacggaagcttttcatcttcaaatgccgagggcctagaaaagacccagactacaccaaacggatccctgcaggccaggcgctcttccagcctgaaagtcagtggtactaaaatggggactcacagcgttcagaatggaaccgtgcgcatgggaatcctgaacagcgatactcttgggaaccctactaacgtgcgaaacatgtcatggcttcctaatgggtacgttacgcttcgtgacaacaaacagaaggagcaggcaggcgaactgggccaacataaccgccttagtacatacgataacgtgcatcagcagttctccatgatgaatttggatgacaaacagtcaatagactctgccacatggtctactagcagctgcgagatcagcctcccagagaattcaaatagttgtcgaagcagcacaaccacctgccccgaacaggatttctttggaggtaacttcgaggaccctgttctggatgggcctccacaggatgatttatcccaccctcgagattacgaaagcaaatctgatcaccgctctgttggtggtagatcttcacgggccacctcatcatcagataattcagagactttcgtgggtaatagttcaagcaatcactccgctcttcattctctggtgagcagcttgaagcaggagatgacaaaacagaaaatagagtacgaaagtcgaattaagagcctcgaacaaagaaatttaaccctggaaactgagatgatgagtctccatgatgaactggatcaggagaggaaaaagttcaccatgattgagattaaaatgaggaatgctgaaagggcaaaagaggacgccgaaaagaggaacgacatgctgcagaaagagatggagcagtttttcagcactttcggggagctgactgtggaaccgcgtcgcacggagagaggcaataccatttggatccagtag

SEQ ID NO: 203299 - DNA, 1962 bp, Artificial Sequence
  Description of Artificial Sequence: Synthetic coding sequence
atgaccgccaaccacgagagctacctgctgatggccagcacccagaatgacatggaggactgggtgaaaagtatccgtcgagtgatttggggaccctttgggggcggaatttttggccaaaagcttgaagataccgtacgatatgagaagcggtatgggaaccggctcgctccaatgctggtggagcagtgtgtcgatttcattcgacaaagagggctgaaggaggagggcctttttcggttgccaggtcaggcgaacctcgtcaaagagctgcaagatgccttcgactgcggtgagaaaccaagcttcgattcaaatacagacgtccacacagtcgcatccctccttaaattgtatcttcgggagctgccagaacccgtcatcccatatgctaagtatgaagatttcctgtcatgcgctaagctcctgagcaaagaggaggaggccggcgttaaggaattagcaaagcaggtgaagagcctacccgtagttaactataatcttctcaaatacatatgtcgcttcctggacgaagtgcagtcatatagcggggttaataagatgagtgtgcagaacctggccactgtttttggccctaacattttgcggcccaaagtcgaggacccgcttactataatggaaggcacagttgttgtgcagcagctgatgtcagtcatgatttccaaacacgattgcctttttcccaaagacgcagaactgcagtctaaacctcaggacggggtgtctaacaacaacgagatccaaaagaaggccaccatggggcagttgcagaataaagagaataacaatacgaaggatagcccctcacgccagtgttcgtgggataaatccgagtcaccccaaagaagttcaatgaataacggttctcctaccgcgttaagtgggagtaaaaccaattcgccaaagaattccgttcataaactggacgtgtcccggagccctcccctgatggtgaagaagaaccctgctttcaataagggctccggcattgttaccaatggcagcttcagctctagtaacgccgagggcctggaaaaaactcagacgaccccaaatgggagcctgcaggccagacgcagctcatccctgaaagtgagcggcacaaaaatgggcacacacagtgtccaaaatgggacagtgcgaatgggtatcctgaatagtgatactttaggcaatcctaccaatgtgagaaacatgtcatggctgccaaacggatatgtgaccctccgagataacaagcagaaagagcaggccggcgagctcgggcagcataacagactcagcacttacgataacgtccaccaacagtttagcatgatgaaccttgacgacaagcagtctatagattccgcaacctggtccacatcctcttgcgaaattagcttgcccgaaaactccaacagctgtagatccagtaccaccacgtgcccagagcaggacttctttggcggtaatttcgaagaccctgtcctagacgggccgcctcaggatgatctgagccatccgagagactacgaaagcaagtcagaccatagaagcgtggggggccggtcctcacgggctacttcctcctccgataactctgagactttcgtgggcaatagctcgtctaaccattccgcattacactccctggtcagctctcttaagcaagaaatgactaagcagaaaattgaatacgagtctagaattaagagccttgaacaaagaaacctgaccctggaaacggaaatgatgagcctccatgacgaactggatcaagaaaggaagaagtttactatgatagagattaaaatgcggaacgccgaaagggcgaaggaagacgcagagaaacgaaacgatatgctacagaaagagatggaacagttcttttccacctttggggagctgaccgtagagcccagacgcactgaacgaggcaacacgatatggatccaatag

SEQ ID NO: 203300 - DNA, 2247 bp, Artificial Sequence
  Description of Artificial Sequence: Synthetic coding sequence
atggaggagaacaacgacagcaccgagaacccccagcagggccagggaaggcagaatgcaatcaagtgtggatggctgcggaagcaaggcggttttgtgaagacatggcatacgcgctggttcgtactgaagggggaccagttgtactacttcaaagacgaagacgaaacgaagcctctcggtactatcttcctgcctggcaataaagtctccgaacacccatgcaacgaggaaaatccgggcaagttcttattcgaagtcgtgccaggcggagatagggatcgaatgaccgcaaaccacgaatcttaccttctgatggcaagcactcagaatgatatggaagactgggtgaaaagcatccggcgggttatctggggacctttcggcgggggtattttcggccaaaaactggaggataccgtgcgatacgaaaaaagatacggcaacaggctggctcctatgctcgtggaacagtgtgtcgactttataagacagagaggattgaaggaggaaggcttatttaggctccctggtcaagctaacctggtgaaggaattgcaagatgcgtttgattgtggggaaaagccgagcttcgatagtaacactgatgtccatacagtggccagcctgctgaagttatatctccgggagctgcccgaaccagtcataccttacgcaaaatatgaggacttcctctcatgcgccaagctgttgtccaaggaggaggaggcaggagttaaagagctggccaaacaggtaaaaagcttgcccgttgtcaattataacctgctcaaatacatttgcagattcttagacgaggtgcagagttattctggcgtgaataagatgagcgtgcagaacctggctacagtcttcggacccaatattctgaggcccaaggtcgaggacccactgactattatggaaggcaccgtcgtggtccagcaactcatgtcagttatgatttctaaacatgactgcttgttcccaaaggacgcagagcttcagtcgaagccacaggacggtgtgagtaataataatgagattcagaaaaaagcgacaatgggacagctacagaacaaggagaacaataacaccaaagacagtccaagccgacagtgctcatgggacaagtccgagagcccccagagatcctccatgaataacggctcacctacagcactctcgggcagcaagaccaacagtcccaagaattctgtacataagctcgatgtgtctaggtcccccccattgatggtgaagaagaacccagcgttcaataaaggatcaggcatcgtaaccaacggatccttctcaagcagtaacgccgagggcctcgagaaaacacaaacgacgcctaatggctcactgcaggcccgcaggtccagtagcttgaaagtcagcggcacgaaaatgggcacacactccgtgcagaacggaactgtaagaatggggattcttaattcagacacactcggtaaccccaccaacgtgcgcaatatgtcttggctccccaacgggtatgtaacactacgtgacaacaaacagaaagaacaagccggtgagctgggtcaacataatagattgtccacatatgataatgtccaccagcagttttccatgatgaacctggacgacaagcagtccattgactctgccacatggtctacctctagctgtgaaatctccttgcccgagaattcgaattcctgtcgctctagcactaccacctgtccagaacaggacttctttggcggcaattttgaggatccagtgctggatggccccccccaagatgacttgtcacaccctagagattacgaaagtaagtctgatcaccgtagcgttggggggcggtctagtcgcgccacctcctctagcgataactccgagaccttcgttggcaactcctcttccaaccattccgcactgcacagtttggtctctagcctgaaacaagagatgactaagcagaagatcgagtatgaaagccggatcaagtccctggaacagaggaatctaacattagaaaccgaaatgatgtcactgcacgatgaactcgatcaggaaagaaaaaaattcaccatgatagagattaaaatgcggaacgcagaacgtgccaaagaggatgcagaaaagcggaacgacatgttgcaaaaggaaatggaacaatttttttccaccttcggagaactgactgttgaaccgcgccggacagaaagaggaaacaccatttggatacagtag

SEQ ID NO: 203301 - DNA, 741 bp, Artificial Sequence
  Description of Artificial Sequence: Synthetic coding sequence
atggaggagaacaacgacagcaccgagaacccccagcagggccagggacgacagaatgccatcaaatgtggctggttgcggaaacagggcggctttgtgaagacatggcacactcgatggtttgtcttgaagggtgaccaactctactatttcaaggacgaagatgaaaccaagcccctgggaaccatctttttacctggtaacaaagtcagtgaacacccctgtaacgaagaaaaccccggcaagtttctgtttgaagttgtgcccggaggcgacagggatagaatgacagcaaatcacgaatcctacctgctcatggcatccacccagaacgacatggaagactgggtgaagtccatcaggcgggttatatggggacccttcgggggtggaatattcggtcagaagctggaagacactgtgcggtacgaaaaaaggtatggcaatcggttggcccccatgttggtagagcagtgcgtggactttatccgccagaggggactgaaggaagagggcctgttccgcctgcctggtcaggccaatctcgtgaaggaattacaggacgcctttgactgtggggaaaaacccagtttcgactcaaacactgatgtgcacacagtggcctctctcctgaagctctacttgagggagttgcctgagcccgtgatcccatacgctaaatacgaggatttcctcagctgtgctaagcttctgtctaaggaagaggaggcggtcagctag

SEQ ID NO: 203302 - DNA, 249 bp, Artificial Sequence
  Description of Artificial Sequence: Synthetic coding sequence
atgaccgccaaccacgagagctacctgctgatggccagcacccagaatgatatggaggactgggtgaagagtatccgtagagtgatttgggggccatttggagggggcatttttggacaaaagctggaggatacagtacgatatgagaagaggtacggcaacagactggcaccgatgctggtggagcagtgtgtggacttcataagacagcgtggtcttaaagaagaaggccttttcagactgccttag

SEQ ID NO: 203303 - DNA, 1938 bp, Artificial Sequence
  Description of Artificial Sequence: Synthetic coding sequence
atgagcctgaagctgccccggaactgggacttcaacctgaaggtggaagcagctaaaatcgcccgctcaagaagcgttatgacgggggagcagatggctgccttccatccatcctcgactccgaaccccctagagagaccaataaagatgggctggctaaaaaagcaacgtagtattgtcaaaaactggcaacagagatattttgtgctccgggcccagcagctgtactattataaagacgaggaggacaccaaaccccagggatgtatgtatctgcccggttgtactataaaggagattgcaacgaacccggaagaagccggcaagtttgtgttcgagatcatccccgcttcctgggatcagaatcgaatgggccaagattcttacgtcctgatggcaagtagccaggcagagatggaagaatgggttaagttcctccggagagtggccggcacgccatgcggagtctttgggcagcgtttggatgaaaccgtggcctatgaacaaaaatttggcccccacttagtccccatcctcgtagaaaaatgtgcggaattcatcctggagcatggaaggaacgaagaaggaatctttcgcttgcctggccaagataacctggtcaagcaactgcgcgacgccttcgacgccggggaacgcccgtccttcgaccgtgatacggacgtgcatacagttgcctctttactgaagttgtacctgcgggatctccccgagcccgtggtgccctggtctcaatacgaaggttttctgctttgcggccaactcacaaatgccgatgaggcgaaggctcagcaggaactcatgaagcagctttctatccttccaagagacaactacagcctgctgtcatacatatgcaggtttctgcacgagatccaactaaactgcgctgtgaacaagatgagtgtggacaatctcgcgactgttataggggtgaacctgatccggagcaaagtcgaggatcccgctgtgattatgaggggaacaccccagattcagagggtcatgactatgatgatcagagatcatgaggtgctcttccccaagtccaaggatattcccttatccccgcccgcccagaagaacgaccctaaaaaagcacctgtcgcgagaagcagtgtgggctgggatgcaaccgaggacctgcggatctcacgtaccgactctttcagtagcatgactagcgatagtgacacaacttctcccacaggccagcagccttctgacgcattccccgaggacagcagcaaagtcccacgggagaagcctggggactggaaaatgcagtccagaaaaaggacgcaaactttacctaaccgaaaatgctttctgacaagcgccttccagggtgcaaatagcagcaagatggaaatctttaaaaatgaattctggtccccctccagcgaggccaaggccggcgaggggcataggcgaaccatgtcacaggacctgaggcagttgtccgactcgcaacggaccagtacttacgataacgtcccatcattgcctggatccccgggtgaggaggcttccgcgctatcgtcccaagcctgcgattccaaaggggacaccctggcttccccaaacagtgagacagggccgggcaaaaaaaatagcggcgaggaagaaatagatagtctgcaacgtatggtccaggaactgcgaaaagaaatcgagacccaaaagcaaatgtacgaagagcaaataaaaaacctcgaaaaagagaattatgacgtatgggcgaaggttgtgagacttaatgaggagctcgagaaggagaagaaaaagtccgcggctctcgagatcagtctgcggaatatggaaaggtcacgcgaagatgttgaaaaaaggaacaaagctctggaggaagaggtaaaggaattcgtaaagtccatgaaggaaccgaaaacagaggcgtag

SEQ ID NO: 203304 - DNA, 1917 bp, Artificial Sequence
  Description of Artificial Sequence: Synthetic coding sequence
atgagcctgggccagagcgcctgcctgttcctgagcatcgcccggtcccgctcagtgatgaccggagagcagatggctgcctttcaccccagttcgacaccaaatccactggaacgcccgataaagatggggtggttgaaaaaacagagatctatcgtgaagaactggcagcagcggtattttgttcttagggcacagcagctgtactactataaagacgaagaagacaccaagccgcaaggttgtatgtatctcccagggtgcactatcaaagaaattgcaacgaatcccgaagaagccggaaagttcgtattcgaaatcatcccagcatcatgggaccagaataggatgggtcaagacagttacgtgctcatggcttcttcacaggccgagatggaggaatgggtgaagttcttgcgccgagtcgctggaactccttgtggagtgttcggacaacggttggatgagacagtcgcatacgaacagaaattcggtcctcacctggtgcccatcctagttgagaagtgtgcagaattcatccttgaacacggtaggaacgaagagggtatcttccgtctacccgggcaggataatctcgtgaaacagcttagggatgcattcgatgcaggcgagcgtcccagctttgatcgtgacacagacgtacatacagtcgcctccctcctgaagctgtacttgcgcgatctgcccgaaccggtcgtgccatggtcacaatacgagggcttcctcctgtgcggacagctgaccaacgccgacgaggccaaggctcagcaggaactgatgaaacagcttagcatactcccacgtgataattactctttactgtcctatatatgccgtttcctccacgagattcagctgaactgcgctgtgaataagatgtccgtggacaaccttgccacagtaatcggtgtcaatctgatccggtcaaaggtggaggatcctgccgtgattatgagaggcacgccccaaatccagcgtgtgatgacgatgatgatccgcgaccacgaggtactgttccctaagagtaaggatattcctctgagcccacctgcccagaaaaatgatcctaagaaagcccccgtcgcgaggagttccgtgggctgggatgcaaccgaagatctgagaatctccaggacggatagtttttcttctatgacatctgatagtgatacaacgtcacccacaggtcagcagccttctgatgcttttcccgaggacagctctaaggtgccgagggaaaagccgggcgactggaagatgcagagcagaaaacgcacccaaactctcccgaataggaagtgcttcctcacctccgctttccagggagccaatagctccaaaatggaaatcttcaaaaatgagttttggtccccttctagcgaagcaaaggctggcgagggacacagacggacaatgagccaagatctgagacagttgtcagattcccaacgaacatcaacgtacgacaacgtgccctccctgcctgggtcgcccggagaagaggcaagtgcacttagctctcaggcttgcgatagcaagggagatacactggctagcccaaactctgaaacgggcccaggcaagaagaactctggtgaggaggaaatcgacagtctgcagcggatggttcaggagctgagaaaggagatcgagacacagaagcagatgtatgaagagcaaatcaaaaatctagagaaagagaattatgacgtttgggctaaagtagtgcggcttaatgaggagctggagaaggagaagaagaaatccgcagccttagaaatttcactaagaaacatggagagaagtagggaagacgtcgagaagcgcaacaaagcattagaggaggaagtcaaagaattcgtgaaatcaatgaaggagcctaaaacagaagcttag

SEQ ID NO: 203305 - DNA, 1941 bp, Artificial Sequence
  Description of Artificial Sequence: Synthetic coding sequence
atgagcctgaagctgccccggaactgggacttcaacctgaaggtggaggccgccaaaattgccaggtcgagaagcgtcatgactggtgagcagatggcagcctttcaccccagctctacccccaatccgctggaaaggcccatcaaaatggggtggctgaagaaacaacgaagcatcgtcaagaactggcagcagaggtatttcgtgctccgggctcagcagctttactactataaagacgaagaagacactaaaccacaggggtgcatgtacctccccggatgtacaataaaagaaatcgctaccaaccccgaagaggcagggaaattcgtctttgagattattcctgctagttgggaccaaaatagaatgggacaggactcatacgtgctcatggcctccagtcaggcagagatggaggaatgggttaagtttctgaggcgcgtcgcagggacaccctgcggagccgtatttggacagcggcttgatgaaacagtggcgtacgaacagaagttcggtcctcatctagtgcccatccttgtggagaaatgtgcagagttcattctcgagcatgggcgcaatgaagaaggtatctttcggctgcctggccaggacaacctcgtgaagcagttgagagatgccttcgacgctggcgagcgaccaagcttcgatagggatactgacgtacacacagtggcgtccctgctgaagctttacttgcgcgacctccctgaaccagtggtgccatggtctcagtatgaaggattcctgctgtgtggccagctgaccaacgctgatgaagctaaagctcaacaggaactgatgaaacagttgagtattctgcctagggataactactcactcttgtcgtatatttgcagattcctccatgaaatccaattgaattgcgccgtgaacaaaatgtccgtggacaacctcgccaccgtcattggtgtgaatctcattcggtcaaaagtggaagaccctgcggtgatcatgcgtggcaccccacagatacaacgggttatgacaatgatgatcagagaccacgaagtgttgttccccaaatcaaaggacatcccactgagcccaccagctcagaagaacgaccctaagaaggctcccgttgccagaagctctgtaggctgggacgcaaccgaggatctgaggattagcagaacggacagcttttcttccatgacttcggactctgatacaacatctcccaccggtcagcagccaagcgacgcttttcccgaggacagcagcaaagtccccagagaaaagccaggggattggaagatgcagtccaggaaacgcacccaaaccctccccaatcggaagtgttttctgacttctgcttttcagggagccaacagtagcaagatggagatatttaaaaatgaattttggtctccttcctcagaggctaaggctggggaggggcatagacgtaccatgtctcaagatctgaggcaattgtcagactcccagcggactagcacctacgataacgtgcccagcctgcccggtagtcccggcgaggaggccagcgctctcagcagccaagcgtgtgactctaaaggcgatacactcgcctcccccaattcggagacgggacctggtaagaaaaacagcggggaggaggagatcgattcccttcagaggatggttcaagagctgcgcaaggagattgaaacacaaaagcagatgtatgaggaacagatcaaaaatctcgaaaaggaaaattatgacgtctgggccaaggtagtgcgcctcaacgaggagctggaaaaggagaaaaagaaaagcgccgcgctggagatctcccttcgaaacatggagcggtcaagagaggatgtggagaagcgaaataaagcattagaagaggaagtgaaagagttcgtcaagagtatgaaagagcccaagacagaggcttag

SEQ ID NO: 203306 - DNA, 1920 bp, Artificial Sequence
  Description of Artificial Sequence: Synthetic coding sequence
atgagcctgggccagagcgcctgcctgttcctgagcatcgcccggtctagaagcgtaatgaccggcgagcagatggctgccttccatccctcgagtacacctaatccacttgaacgaccgatcaagatgggctggctgaagaaacagagatccatagtcaaaaactggcagcagcgatactttgtcctgagggcgcagcagttgtattactacaaggacgaagaggacacaaaaccacagggctgcatgtatttgcccgggtgtacaattaaggagatcgccaccaatcccgaggaggctgggaaattcgtgttcgagattataccggcatcctgggatcagaaccgtatgggacaagatagctatgtgttaatggccagctcccaggccgagatggaagaatgggtgaaatttctgcgcagagtcgccggcacaccatgtggggccgtgtttggccagcgcttggacgaaaccgttgcgtatgaacagaaattcggtccacatttagtcccaatcctggtggagaagtgtgctgaatttattctggagcacgggcggaacgaagaaggcatcttccgcctccccggacaggacaatttagtaaaacaactgagggatgcgttcgacgccggcgaacgaccttcttttgatcgcgatactgatgtccataccgtcgcaagcctgctgaaactgtatctgcgcgatctgccagagccagttgtcccttggagtcaatacgagggttttctgttatgcggtcagctcaccaacgctgatgaggccaaggctcagcaggagctcatgaagcagctgtctattctgccaagagataactactccctcctatcctacatctgtaggttccttcacgagatccagctaaactgcgccgtcaataaaatgagtgtggacaacctggccacagtgattggcgttaacctgattcgttccaaggtagaggaccctgcagtgatcatgagaggcaccccacaaattcagcgggtcatgactatgatgattcgagaccacgaagtcctcttccccaaaagcaaggacatcccactgtctcctccagcccaaaagaacgaccccaaaaaggcacccgtggctagatcttccgtaggttgggatgctactgaagaccttcggatttccagaacagattcattctcatccatgacatccgactcagacaccacatctcctaccggacaacaacctagcgacgcctttcctgaagacagcagcaaggtccccagggagaagcccggagattggaagatgcagtccagaaagcggacccagaccctgcccaaccgaaaatgcttcctcacatcagccttccaaggggctaatagttctaagatggaaatttttaagaacgagttttggagcccgagcagtgaagccaaagcgggggaaggccatagaaggaccatgagccaagaccttaggcagttgtccgactcccaaaggaccagcacatacgacaatgtacccagcctgcccgggtccccaggtgaggaagcctccgcgctgtcttcccaggcctgtgattcaaagggtgatactctggcctctcccaactccgaaaccggcccaggaaagaaaaattcgggggaggaggagattgacagcctgcagcgcatggtgcaggagttgcgcaaagagatcgagacccagaaacaaatgtacgaagagcagattaagaatctggaaaaggaaaactacgatgtatgggccaaggttgttcgcctgaacgaagaattggagaaggaaaagaagaaaagtgccgcgctggagatatctttaagaaatatggaacgctccagagaggatgtggagaaaaggaataaggccttggaagaggaggttaaagaattcgtgaagagtatgaaagaaccaaagactgaggcatag

SEQ ID NO: 203307 - DNA, 852 bp, Artificial Sequence
  Description of Artificial Sequence: Synthetic coding sequence
atgaccggcgagcagatggccgccttccaccccagcagcacccccaacccattagagcggccgattaagatgggctggctgaagaagcaaaggagtatcgtgaaaaactggcaacagaggtacttcgttctgcgagcccagcagctctactattataaggatgaagaggatacaaagccacagggatgtatgtatctgccggggtgtaccatcaaggagatcgccaccaatcccgaggaggctgggaaattcgtcttcgaaatcattcccgccagttgggaccaaaataggatgggtcaggatagttatgtcctgatggcatcatctcaggccgaaatggaggagtgggtgaagttcctgcggagggtggctggcactccatgcggagcagttttcgggcaacggcttgatgaaaccgtagcctatgaacagaagttcggccctcacctggtgccaatcctggtcgagaagtgcgcagaattcatcttagagcatgggagaaacgaggagggaatatttagactgccaggccaggataatctggtgaagcagctgcgggacgcgtttgatgctggcgagcgcccatctttcgacagggatactgatgttcatactgtggccagtctcctcaagctatatttacgggacctgcccgaacccgtagtgccatggtctcaatacgaaggctttctgctctgtggacaactcactaacgcagatgaagcaaagaactaccgcaatcgaaacgactgtcagtcagtggtgtcggcccagattcaccagttctgcccgagggtgtccctgttagcacatggacaggcccatctgctcgtgaatgacttactggtgtag

SEQ ID NO: 203308 - DNA, 1776 bp, Artificial Sequence
  Description of Artificial Sequence: Synthetic coding sequence
atgagcctgggccagagcgcctgcctgttcctgagcatcgcccggagccggtctgtgatgactggagaacagatggctgcctttcacccatcttcaactccaaatcccctggaaagacccattaaaatgggttggcttaagaaacagagaagtattgtgaagaattggcagcagcgatacttcgtccttagggcgcaacagctgtattattacaaagatgaggaagatacaaagccacagggctgcatgtacctgcccggctgcacaatcaaagaaattgccactaatcccgaagaggctggaaaatttgtgtttgagataatccccgccagctgggaccaaaaccggatgggccaggattcgtatgtcctgatggcctcttcacaggcagagatggaggaatgggtgaaatttctgcgaagagttgccggcacaccctgtggcgccgtctttggacagaggcttgatgagacggtggcatacgagcagaagttcgggccccacttggtaccgattctggtagaaaagtgcgcagagtttatattggagcatggtagaaacgaggaaggaattttcagactccccggacaggataacctagttaaacagctgcgggacgccttcgatgcgggtgaacgaccctcattcgaccgggatacagatgttcacaccgttgcatctctgttgaagttgtacttacgagacctgcctgagccagtggttccctggagccagtacgagggcttcctgttgtgtgggcagctgaccaacgcggatgaggcgaaggcccaacaggaactcatgaagcaattgtccatccttccacgcgataactactctctgctgtcctacatatgccggtttctgcatgagatccaactgaattgcgccgttaacaaaatgtcagtggataatctcgccacggtgatcggagtgaaccttatccgttctaaggtagaagatccggctgtaatcatgcggggtaccccccaaattcagagagtgatgaccatgatgatcagagaccacgaggtccttttccctaaaagcaaagacatcccactgtcaccccccgctcagaaaaacgacccaaaaaaagcccccgtcgctagaagttcggtcgggtgggatgccacagaggatttgcgtatatccaggacggatagcttttcctctatgacttccgattcggatacgactagtcctaccggccaacagccctctgacgcttttcccgaagactcttctaaagtgcctcgggagaaacctggggactggaagatgcaatcaaggaagagaacgcagaccctgccaaacaggaagtgctttttgacctccgccttccagggagccaattcctcaaagatggagatttttaagaatgagttctggagtccatccagtgaggccaaggcaggggagggccaccggcggaccatgagccaggatctgcgtcagctgtccgatagtcagcggacctctacgtacgataacgtacccagtctgccagggtcgccgggcgaggaggcaagcgcactatcctcacaggcttgcgatagcaagggtgacactctagcctcaccaaactctgagacagggcccggcaaaaaaaactctggcgaggaggaaatcgactccttacagcggatggtgcaggagttgcggaaggagatcgagacgcagaagcagatgtacgaggagcagattaagaacctggagaaagagaattacgacgtctgggccaaagtagtccggccattccttagcgcaatctag

SEQ ID NO: 203309 - DNA, 1377 bp, Artificial Sequence
  Description of Artificial Sequence: Synthetic coding sequence
atgagcctgggccagagcgcctgcctgttcctgagcatcgcccggtcacgctccgtgatgaccggcgagcagatggctgctttccatccttcaagtacccccaacccacttgaacgcccaatcaagatgggctggttgaagaaacagcgcagcatagtgaaaaactggcaacaacgctatttcgtgctccgcgctcagcagttgtattactataaggatgaggaggacacgaaacctcagggatgtatgtacttaccagggtgcacaattaaggagattgctaccaacccggaggaagcgggtaaatttgtctttgagatcatacccgccagctgggaccagaacagaatggggcaggatagttacgtgcttatggctagcagccaagcggagatggaagagtgggtaaagttcttgcggagagtggccggcactccatgcggtgccgtcttcgggcaacgactggatgaaacagtcgcttacgaacagaagttcggcccccacctggtgcctattctagttgaaaaatgtgctgaattcatcctggagcacggacgtaacgaggaaggcatttttcggctgcctggtcaagacaatctggtcaagcaattgcgggatgctttcgatgctggggagcggccttccttcgaccgcgatacagacgttcataccgttgccagccttcttaagttgtacctgcgggacctgccggagccagtcgtgccctggtcacagtacgagggatttctgctgtgtggccagctgaccaacgcagacgaagcgaaggcccaacaagagctaatgaaacagttaagcatactgcctagagacaactattccctgctctcctatatctgtagattcttgcacgagatccagttgaactgtgccgtcaacaaaatgtccgtggacaacctggcgacagttattggcgtgaacttaatcagatctaaggtggaagatccagcagtcattatgcgaggcacccctcagatccaacgagttatgacaatgatgatcagagatcacgaagtgctgtttcctaagtctaaggatatacctctctccccaccggctcagaaaaatgaccccaagaaagcccctgtcgcaagaagttccgttggctgggatgcgactgaagacctgcgcatcagtagaaccgacagctttagttcgatggttagatgcagagaaccaagctgttttcactgggtgctgcccctcgtgcaggcaatcccgtgcaaggcatgtagtcgcgtggccatttggggcgttcttggggatgctgttgccgtaggtgccgctgctacagatagttcagagcacactctcaaggcatggccactgagtaaaagttctttctactggcacctgtag

SEQ ID NO: 203310 - DNA, 1893 bp, Artificial Sequence
  Description of Artificial Sequence: Synthetic coding sequence
atgagcctgggccagagcgcctgcctgttcctgagcatcgcccggtctcggagtgtgatgaccggggagcaaatggcagctttccatccttccagtacccctaaccccttagagcggcctatcaaaatggggtggctcaaaaagcaacgcagcatcgtcaagaattggcagcagagttattattacaaagacgaggaggataccaagccacagggttgtatgtacttgcctggatgtacaattaaggagatcgccacgaatcctgaggaggcaggaaaatttgtttttgagataatccccgcctcttgggaccagaatagaatgggccaagacagttacgtgctgatggcatcctcacaggcggaaatggaagaatgggtaaagtttttgcggagggtggctggaactccttgcggcgccgtgtttggtcaacgtctggatgaaaccgtagcctacgagcagaagttcggaccccatcttgtgccaattctggtggagaaatgcgcggagtttatccttgagcacggccggaatgaagagggaattttcaggctgccaggacaggacaacttagtgaagcagttacgcgacgcattcgatgccggggagcgcccctcgtttgaccgtgataccgacgtccacacggttgcatccctcctcaagctgtatctgcgggacctgcctgagccagtcgtgccttggagtcaatacgagggcttcctcctgtgcgggcagttaactaacgccgatgaggccaaggcccaacaggaattgatgaaacagctttccatcctcccgcgggacaattacagcttactcagttatatttgtcggttcctgcatgagattcaactgaactgcgcggtcaacaagatgagcgtcgacaacctggcaactgtgatcggcgtgaacctgatccgaagtaaggtcgaggaccccgccgtgataatgaggggtactccccaaattcaaagagtaatgacaatgatgatcagggaccatgaagtcctgttccctaagtctaaagacattcctctctccccgcccgcccagaagaacgaccccaagaaggctccggtggcccggagtagtgtgggatgggatgctaccgaagacctacggatttcaagaaccgactccttcagttctatgaccagcgattcagacaccacaagtcccaccgggcagcagccgtcggacgccttccctgaagacagctccaaagtgccaagagaaaaaccaggcgattggaaaatgcagagtcggaagagaacccaaacgctgcctaatcgcaagtgctttctgaccagtgccttccagggtgctaattcaagcaagatggaaatttttaaaaatgagttttggtccccttcgtccgaagctaaagcgggggaaggccaccgcagaaccatgtctcaggaccttaggcagttgtcagacagccaacggaccagcacttatgataacgtgcccagcctgcccggatcccctggagaggaagcgtcggcgctctcctcgcaggcatgtgatagcaaaggcgatacgttggcttctcccaactctgaaactggaccagggaaaaaaaactccggggaggaggagatagattctctccaaaggatggttcaggagctaaggaaggagatcgagacccagaaacagatgtatgaggagcagatcaagaacctcgagaaggagaactatgatgtctgggccaaggtagtcaggctcaacgaggagctggaaaaagaaaagaagaaatccgctgctttagagatttcgctgagaaacatggaacgttcccgcgaggacgttgaaaagcgcaataaggccctggaggaggaagttaaggagtttgtgaagtcaatgaaagaacccaaaactgaagcttag

SEQ ID NO: 203311 - DNA, 852 bp, Artificial Sequence
  Description of Artificial Sequence: Synthetic coding sequence
atgaccggcgagcagatggccgccttccaccccagcagcacccccaatcccctcgagcgcccgatcaagatgggatggttgaagaagcagcgttccatagtgaagaactggcagcagcggtactttgtgctgcgggcacagcagctatactactacaaagacgaggaagacaccaaaccacagggctgtatgtacctgccgggctgcacaatcaaagagattgcgacaaatccagaggaggcaggaaaatttgtgtttgaaattatccccgcatcatgggaccagaataggatgggccaggactcgtatgtacttatggcaagctcacaggcggagatggaggaatgggtaaaatttctcaggcgggtggccgggaccccctgtggggccgtgttcggtcagcgcttggatgagacagtagcatatgagcagaagttcggaccccacctggtgcccattctggtcgagaaatgcgccgagtttatcctcgaacacggacgtaacgaagagggcatattcaggctgcccggccaggataatttggtaaagcaactcagggacgccttcgacgcgggcgagaggccaagcttcgaccgtgacaccgacgtccatactgtggcaagcttgctgaaattgtatctcagggatctgccggagcctgtcgtaccctggtcccagtatgaggggtttcttctctgtggacagttgactaacgctgacgaggcgaagaattatcgcaacagaaacgattgtcagtccgtggtttcagctcagatccatcagttttgccctcgtgtcagccttttagctcacggacaggctcatttgctggtgaacgatctgctagtgtag

SEQ ID NO: 203312 - DNA, 1821 bp, Artificial Sequence
  Description of Artificial Sequence: Synthetic coding sequence
atgagcctgaagctgccccggaactgggacttcaacctgaaggtggaagccgccaaaatcgctcggagtcgtagcgtgatgacaggagagcaaatggccgcttttcatccaagctcaactccaaatcccctggagaggccgatcaagatgggctggctaaagaagcagagatcaatagtaaaaaactggcaacagagatacttcgtgctgagggctcaacagttgtactattacaaagatgaggaagataccaaaccacagggatgtatgtatttgccaggttgcaccatcaaggagattgcaaccaatccagaagaggcgggaaagttcgtttttgaaataattcctgtgtttggacagcgactggacgaaactgtagcgtatgaacagaaattcggtcctcaccttgttccgatactggtggagaagtgtgctgagtttatcctggaacatggtcgcaatgaagaaggcatcttccgtttgccaggccaagataatctcgtgaagcagctccgcgacgcattcgatgccggcgaacggccttcctttgatagggacaccgatgtccacactgttgcctcactgctgaagctgtaccttcgggatctgccggagcctgtggtaccctggtcgcagtacgaaggctttcttttatgcggccaactgacgaacgccgacgaagcaaaggcccagcaagagctgatgaagcagctctctattctgccccgggacaactatagcctgcttagttacatttgtcgatttctgcatgaaattcagctgaactgcgctgtgaacaagatgtccgttgacaatctggctactgttattggggtgaatctgattcggtccaaggtcgaggacccagcagtgatcatgagggggacacctcagattcagagggtgatgactatgatgatcagagaccacgaggtgctcttccccaagtcaaaagacatacctctcagtccacctgcccagaaaaatgaccccaaaaaggcccccgttgcacgctcttcggttggatgggacgctactgaagacctacggatttccagaaccgattcgttttcctccatgacgtcggactccgacactacatcccctacggggcaacaaccaagcgacgcattccccgaggattcgtccaaggtgccccgtgaaaagcctggcgattggaagatgcagtctcgcaaacggactcagacactcccaaacagaaagtgctttctgacttcggcattccagggcgccaatagtagcaaaatggagatttttaaaaatgagttttggtcgccttccagcgaagctaaggctggggaagggcaccgtcggactatgtctcaggacctgcgtcagctgtccgactcccaacgaacctcgacatacgacaacgtgcctagtcttccaggcagtccaggtgaggaggcctccgccctctcatcacaagcatgtgattccaagggtgatacactggcatctcccaacagcgaaacaggacctggcaagaaaaatagtggtgaagaagagatcgactccctccagcggatggttcaggagctgaggaaggagatcgaaacacagaaacagatgtatgaggaacaaatcaagaatcttgagaaggagaactacgatgtttgggctaaagttgttaggctcaacgaggagcttgagaaagaaaagaaaaaaagcgccgcattggaaatttcgcttagaaacatggagcgttcgcgggaggatgtcgaaaagagaaataaagcactggaagaagaggtcaaggagttcgtgaagtcaatgaaggagccaaagacagaagcctag

SEQ ID NO: 203313 - DNA, 2445 bp, Artificial Sequence
  Description of Artificial Sequence: Synthetic coding sequence
atgggcctgcccgccctggagttcagcgactgctgcctggacagcccccacttccgagagacattgaaatcccacgaggccgaattagataagacgaataaatttattaaggaactgatcaaagacggcaagagtctgataagtgccctgaagaacctgagctctgctaagagaaagttcgctgatagtttgaacgagttcaagttccaatgcatcggagatgccgaaacagatgacgaaatgtgcatcgccagaagcctgcaggagtttgctaccgttctccgaaaccttgaggacgagcggatccgaatgattgagaacgcgtcagaggtccttattacacctttagagaaatttaggaaagaacagataggtgccgctaaggaggccaagaagaaatatgacaaagagaccgagaaatactgcggaatacttgagaaacacctgaatttaagcagcaagaagaaggaatctcagctgcaagaggcagatagccaggtggacctcgttcgacagcacttctatgaggtatccctagagtacgtcttcaaggtccaggaagtccaggagcggaagatgttcgagttcgtcgagccattactggcttttctgcagggcctgtttacattttatcatcacgggtacgagctcgcaaaagatttcggggatttcaagactcagctgaccattagtattcagaacacccggaacaggttcgagggcacacgatccgaggtcgagtcgctgatgaaaaagatgaaggagaatccccttgagcataagacaatttccccatatacgatggagggttacctatacgttcaagagaagcggcatttcggaacttcttgggtaaagcactactgcacctatcagcgtgatagtaagcagatcaccatggtgccattcgatcagaagtcaggaggcaaaggcggggaggacgaatccgtcatccttaaatcttgtactcggagaaagacggactccatcgagaaaaggttctgcttcgatgtggaggcggtggatcgaccaggggttatcaccatgcaagctctgtcagaggaggataggagactgtggatggaggcaatggatggaagagagcccgtttacaattctaacaaggatagccaatcggagggcaccgcacagctcgatagcattgggttttcaattatcagaaaatgtattcacgctgttgagacacggggtataaacgaacaaggattgtacagaatagtcggtgtgaatagcagggtgcaaaaactgctgtccgtcctgatggacccaaagactgcctccgagaccgaaaccgacatttgtgctgagtgggagattaaaacaatcacctctgcattaaaaacatatctgagaatgctgcctgggccgcttatgatgtaccaatttcagagatctttcatcaaggcggctaagctcgagaatcaagagtcccgggtaagcgagattcactctttggtgcatcgcctcccagagaaaaataggcagatgcttcagctgctgatgaaccacctggccaatgtagccaataatcacaaacagaacttaatgacagtcgcaaacttgggcgtcgtcttcggtcctactctgttgcgccctcaagaagagacagtcgccgctattatggacattaagtttcaaaacattgtgatagagattcttatcgaaaaccatgagaagatctttaacacagttccggacatgcccttgacgaacgcccagctgcacctcagccgtaagaagagtagtgattcaaagcccccatcctgttcagagcgacctttgaccttatttcataccgtgcagtccacagagaaacaggaacagaggaactctatcattaactctagccttgaaagcgtgtcttcaaaccctaacagcatcctgaatagtagtagcagcctgcaaccgaatatgaactcaagcgacccagatctggcagtggtaaagcctaccagacctaactctcttcctccaaacccctcaccaacaagcccactcagcccaagttggcccatgttctcagccccgagttctccgatgcccactagcagtacgtctagcgatagctccccagtcaggtctgttgccggctttgtttggtttagcgttgccgcagtggtcttaagcttagcccgctccagtctacacgctgtcttcagcctactggtcaacttcgttccatgccacccaaaccttcacctgctgttcgatagacctgaagaggctgtccatgaagacagctcaactccgtttcggaaagctaaggcgctgtatgcttgtaaagccgagcatgattctgaactcagcttcaccgcaggaaccgtgttcgacaacgtccatcccagccaggagcccggatggctggaaggaaccctgaacggaaaaaccgggctaattcccgagaactatgtggagtttctgtag

SEQ ID NO: 203314 - DNA, 2280 bp, Artificial Sequence
  Description of Artificial Sequence: Synthetic coding sequence
atgggcctgcccgccctggagttcagcgactgctgcctggacagcccccacttcagagaaaccctgaagtcacacgaggccgagctagataagactaataaatttatcaaggagctgatcaaggatgggaaaagcttgatttccgccctgaagaatctcagctccgcaaaacggaagttcgccgactccctgaatgagttcaaatttcagtgcatcggggacgctgagaccgacgacgagatgtgtattgctaggtcactgcaggaatttgccacagttctacgaaacctggaagatgagcgaattcggatgatcgagaatgcttctgaggttctgatcacacccctcgaaaaattcaggaaggaacagattggtgctgcaaaggaagctaagaaaaagtacgataaggaaactgagaagtactgcgggattttggagaaacatctaaacctctcttcaaaaaagaaagagagccagcttcaggaagctgattcacaggttgatctggtaaggcagcacttttacgaggtgtccctcgagtatgtgttcaaggtccaggaggtgcaagagcgaaagatgtttgagttcgttgagccgctgttggctttcttacagggcttatttacattctatcaccacgggtacgagctggcaaaagacttcggggatttcaaaacccagttaacgatttcaatccagaatacaagaaatagattcgagggcacacgaagtgaggtggagtccctgatgaagaaaatgaaggaaaaccctctggagcacaagactattagtccatacaccatggaaggctacctctacgtgcaagagaagaggcatttcggaacatcctgggtcaagcattactgcacctatcagcgggattcaaagcagattaccatggtgccattcgaccaaaagtccgggggcaagggcggcgaggatgaatcagttatcttgaagagctgcacgcggcgtaaaacagactcaatagaaaagagattctgttttgacgtggaagctgtggatcggcccggggtcataacaatgcaggccctgagtgaggaggaccgcaggctttggatggaggcgatggatggccgggagcccgtgtataatagcaacaaagacagccagtcagagggaacagctcaactggacagtatcggttttagcatcattagaaagtgcattcatgccgtggagaccaggggaattaatgagcaagggctgtataggattgtcggagtcaacagccgggtacagaaacttctgtcagtcttgatggaccccaagactgctagcgaaaccgagacggatatatgtgcagaatgggagatcaagaccattacctctgcactcaaaacgtacctgcgcatgctgcccggccccttaatgatgtatcaattccagcgcagcttcatcaaggctgccaagctcgagaaccaggagtcccgagtgtccgagattcacagccttgtccatcgattgcccgagaaaaatcggcagatgctccaacttctgatgaatcatctggccaatgtggctaataaccacaagcagaatctcatgacagtcgcgaatctcggcgtggtctttggcccaacccttctcaggccccaagaggaaacagtcgcggcaatcatggatattaaattccagaacattgtgattgaaattctaattgaaaatcacgagaagatcttcaacaccgtgccagacatgccactgacaaatgcacagctgcacctgagtcgcaaaaagtcaagtgactccaaacctccatcatgttcagagcgcccattaacactgttccacaccgttcagagtacagaaaagcaggagcagcgcaattcaatcattaatagtagtctggagagcgtgagctccaacccaaattcaatcctgaattccagttcctccctgcagcctaacatgaacagctcggatccagacttggctgtggtgaagcctacgcgcccaaattccttgccccccaatccaagcccaacgtcccctctttctccttcatggcccatgttttccgccccaagctctccaatgccaacctcttcaactagctctgatagctctcctgtgagcaccccgtttcgaaaggctaaggctctttacgcatgtaaggctgagcacgactcagagctcagctttactgccgggacagtgtttgataacgttcatccaagccaggagcccggatggctggagggaaccctgaatggaaagaccggtcttattccggaaaattacgtagagttcctgtag

SEQ ID NO: 203315 - DNA, 885 bp, Artificial Sequence
  Description of Artificial Sequence: Synthetic coding sequence
tgacccaagaccgccagcgagaccgagaccgacatctgcgccgagtgggagataaagacaataactagcgcattaaaaacctatctacggatgctacccgggcctctgatgatgtaccagtttcagcggtcttttatcaaggccgcaaagttagagaatcaagagagcagggtgagcgagatccattccctagtacaccgccttcctgagaagaacagacaaatgctgcaattactcatgaaccacctggctaatgtagcaaacaatcacaaacagaatctcatgactgtggccaatctgggagtggtattcggacctactttgctgaggccccaggaggagacggtggctgctatcatggacattaaatttcagaacattgtgatcgaaattctgatcgagaaccatgagaagattttcaacacagtgcccgacatgcctcttactaatgctcagctccacctgtctagaaagaaatccagtgacagcaagccaccatcctgttctgaaaggccactcacactgttccataccgtacaatctacagagaaacaggaacaacgtaattcgatcatcaactccagcctggaatccgtcagttctaatcctaactctatcctcaacagtagcagtagcctccagcctaatatgaactctagcgaccccgatcttgccgtggtcaagccgactcggccaaactctctgacgcctttccggaaggctaaagcactgtatgcgtgcaaggcggagcacgattctgaactctcgttcacggctggtacggtatttgataatgtgcatccctctcaggaaccagggtggctggaaggaacacttaatggaaaaacgggcttgattccggagaactatgtagaatttttgtag

SEQ ID NO: 203316 - DNA, 861 bp, Artificial Sequence
  Description of Artificial Sequence: Synthetic coding sequence
atggaccccaagaccgccagcgagaccgagaccgacatctgcgccgaatgggagatcaagacaatcacttctgccctgaagacttatctgcgtatgctccctggacctttaatgatgtatcagtttcaacggtcttttatcaaagccgccaaactggaaaaccaggagagtagagtgagcgaaatccattcactggttcatagactgcctgagaagaatcggcaaatgcttcagcttcttatgaaccacctggccaatgtagcaaataaccacaaacaaaatttaatgactgtggctaacctcggggtggtctttggcccaaccctgctgcgaccgcaagaggagactgtggccgctattatggatattaaatttcagaatattgttatcgagattctcattgaaaatcatgagaagatcttcaacacggtgccagacatgccgctcacaaatgcccaactgcacctctctcgtaagaagagctctgactctaagcccccctcctgtagcgagagacccctgactttgttccacaccgtgcaatcgaccgagaagcaggaacaaaggaattccattattaacagttctctggagagcgtgagttcgaatcccaattccattctgaacagcagtagctctctccagcccaacatgaacagcagcgatcctgatctcgcagtagtcaagcccaccaggcctaactccctaccacccaatccttcacccacatctcctttgtcaccatcctggcctatgttttctgctccgagctcccctatgcccacctcctctacgtcttctgacagctcacccagaatcacctggtcgtctagcaacaggggtccccagcagaattgctag

SEQ ID NO: 203317 - DNA, 1167 bp, Artificial Sequence
  Description of Artificial Sequence: Synthetic coding sequence
tgagcccagctggacagcatcggcttcagcatcatccggaagtgcatccatgccgttgagaccagaggcataaatgaacaaggactgtaccgcattgtcggggtcaattcacgggtgcaaaagctactgtccgtccttatggacccgaagactgcctcagagaccgaaaccgacatttgcgcagaatgggagattaaaactattacttccgccttgaagacatatttgcggatgctgccaggcccattgatgatgtaccaatttcagagaagtttcattaaggccgccaagctcgagaatcaagaatcacgggttagtgagatccactctctggtccatagactcccagagaaaaacagacagatgctgcagctgcttatgaaccacctggccaatgtggccaataaccacaaacaaaatcttatgaccgtcgccaatctcggcgtggtgtttggtccaaccctgctgagaccccaggaggaaaccgtagctgccattatggacatcaagtttcagaacatcgtgatcgaaatactcattgaaaatcatgagaaaatctttaacaccgtgcctgatatgccacttacaaatgcccaactgcacttaagtaggaagaaatccagtgattccaagcccccatcctgttccgaacggccactcacgctcttccacacagtgcaatctacagagaaacaggaacagcgcaatagtattattaactcaagccttgaaagcgtgtcgagcaaccctaatagtatcttgaacagctcctccagtctccagcccaatatgaattcttcagatcccgacctggccgtggtgaagcctacgcggcccaattcacttccaccaaatccttcccccacctctcctctgtctcctagctggcctatgttctctgctccttcctccccaatgcccacctccagcacatcaagcgattcgtcacctgttcgcccagaggaagccgtgcacgaagacagttccactcccttcagaaaagcaaaggcgctatacgcttgcaaagctgaacatgactcagagttgtcctttaccgcgggcacagtctttgataacgtgcatccgtctcaggagccgggttggctcgagggaacccttaatgggaaaacaggcctgattcccgaaaattatgttgaattcctgtag

SEQ ID NO: 203318 - DNA, 792 bp, Artificial Sequence
  Description of Artificial Sequence: Synthetic coding sequence
atggccgccgacgtggtgggcgacgtgtacgtgctggtggagcacccctttgaatatacaggtaaggatggtagacgtgttgctatcagaccaaacgagagataccgtctgttgcgacgctccactgaacattggtggcatgttcgacgtgaaccagggggtcggcccttctaccttcccgcccagtacgtccgcgagctcccggcactaggaaatcctgccgcggccgcaccccccgggccacatccttcgcccgcggcccctgagcctctggcatatgactaccggtttgttagtgcggccgctactgccgggccagatggggcgcctgaggagtcaggcggcagagcctcatccctgtgtggccccgcacagcgcggggctgctacccagagatccagcctggctcccggcctgcctgcatgcctttatttgagaccagccgcccccgtgcgaccagcccagagcctcaacgacctggcatgcgctgcagtatctccgcccgctggactcttaggatccagcggcagtttcaaggcctgcagcgtcgccggctcatgggtgtgccctagaccactggccaggagcgactcggagaatgtatacgaggtgatccaggacctgcatgtacccccacctgaggagtctgccgaacaggtgcccccccgcgcactgggacgcggtggaggatggcgagcccgcgatcgggcccgcacagagcccggtcggaaagagactcgatctgcgcagcggcgcgcccgccgaccacctttgtctgaggatttcggctag

SEQ ID NO: 203319 - DNA, 1647 bp, Artificial Sequence
  Description of Artificial Sequence: Synthetic coding sequence
atgcagcccggcctgagccccggcagccccggcgacccccggccccccacaccagagaccgactatccagaatctctgacctcttacccagaagaagattactcccccgtgggatcttttggagagccaggtccgacaagccctttgaccacgcctcccggctggtcatgtcacgtcagtcaggataaacaaatgttgtatacaaatcatttcacccaggagcagtgggtacgcctggaggaccctcacggaaaaccatatttctacaacccagaggactccagtgtgcggtgggagctgcctcaggttcccgtccctgcgccaagatcaatccacaaatctagtcaagatggagacacgccagcacaggccagccctcccgaggagaaggtgcccgcagagttagacgaggtgggttcttgggaggaagtgtcgccagccacggcggcagttaggaccaaaacattggacaaggcaggggtgctgcaccggactaagacagcggacaagggcaagcggctgagaaagaaacattggtccgcctcctggacggtgctggaaggaggtgtgttgacattttttaaagactctaaaacttctgcagccggaggactgcgccaaccttccaaatttagcactccagaatacactgtcgaactgaggggtgcaacactatcatgggcacccaaagacaaatcctcccgcaaaaacgttttggaacttaggtctcgggatgggtccgagtacctcattcagcacgacagcgaggcaatcatctctacatggcataaggctatcgcccagggtattcaggagctgtcagctgagttgcctccggaggaatctgaaagctcccgcgtagacttcggtagctctgaacgattaggctcttggcaggaaaaggaagaggacgctagacccaacgctgccgctcccgccctggggcccgttgggttagagtctgacctgagtaaggttagacacaagcttagaaaatttcttcaacggcgacctactttgcaatccctccgtgaaaaaggctatatcaaggaccaagtgttcggatgtgccctggccgccttgtgcgagagagaaagatcccgagtgcctaggtttgttcagcaatgtatccgtgccgttgaagcaagaggactggacattgacggactctacagaatttctggaaatcttgcaacaattcagaagctccgctataaagtggaccatgatgaacggcttgacctggatgatggacgatgggaggacgtacacgtaatcactggtgccctgaaactattcttcagggaactcccagaacctctgtttccattctcacattttcggcagttcatcgcagccataaagctccaggaccaggcacggagaagcagatgtgttagagacctggttcgttcacttcctgcccccaaccatgatacactccgcatgctgttccagcacttatgccgggtcatagaacatggagagcagaacagaatgtccgtgcagagtgttgctatagtcttcgggcctactcttctgagaccagaggtggaagaaacctcgatgcctatgacgatggtctttcagaaccaggtagtggaactgattcttcagcagtgcgcggacatctttcccccccattag

SEQ ID NO: 203320 - DNA, 2670 bp, Artificial Sequence
  Description of Artificial Sequence: Synthetic coding sequence
atggccgccgacgtggtgggcgacgtgtacgtgctggtggagcacccatttgaatacacaggcaaggacgggcgcagggtagcaataagacctaacgagaggtatagactgctcagaaggagtacggagcactggtggcacgtccgccgcgagccaggcggtcgacctttctatttgcccgctcagtatgtcagggaacttcctgcactcggcaacccagctgccgcagccccacctggcccgcaccccagcccagcagcccccgagcctctggcttacgactacaggttcgtttctgctgctgccacagcaggccctgacggcgcacctgaggagtccggcgggcgggcgtcttctttatgcggtcctgcccagcggggagcagccactcagcggagttcacttgctcccggcttaccggcttgcctgtatttacggcctgccgccccagtccgacccgctcaatcactcaacgatctggcctgcgcggccgtatccccacccgcaggactgctggggagtagcggcagttttaaggcttgttccgtcgcgggctcatgggtctgtccgaggcctctggcccggtcggactccgaaaacgtctatgaggtgatccaggacttgcacgtcccaccaccagaagaatccgctgagcaggtggacgaccccccggagcctgtctacgccaatattgagcggcagccacgcgccacatctccaggggccgcagcggccccacttcccagcccagtgtgggagacccataccgacgctggcacaggaaggccttactattacaacccagatactggcgtaacaacgtgggagagcccctttgaggccgccgagggcgctgcatcacctgcaacatctcccgcctccgttgatagccacgtgtccctggagacagagtggggccagtactgggacgaggagagccggagagtgttcttctataaccctttgacaggggaaacagcttgggaagatgaggccgagaatgagcctgaagaagagctcgagatgcagccaggactgtcccccggatcgcccggggaccctcgaccgccaacgccagaaacagactacccagagagcctgacctcttaccccgaggaggactatagtccagtgggaagctttggcgagcccggtcctacgtcaccactcaccaccccgcccggctggtcctgccatgtgtcacaggacaaacagatgctttataccaaccacttcacccaggaacaatgggttagactggaggacccccacggtaagccatacttctataaccctgaggattctagcgtccgatgggagctcccccaggtcccagtacccgccccccgctccatacataagagttctcaggacggcgatactcccgcgcaggcaagccctcctgaggagaaggtccccgcagagttggatgaggtggggtcatgggaggaggtgtcccccgccaccgccgccgtgagaactaaaaccttagataaagctggtgtcctgcatcgtaccaaaaccgctgataaggggaagcgcttgcggaaaaaacattggagcgctagctggacagttctggaaggaggagtcttaacctttttcaaggactccaaaacatccgccgctggaggcctgagacagcccagcaagttcagtacacccgaatacacggtagagctcagaggggcaacgctgtcttgggctcctaaggataaatcttctaggaaaaacgtgttagagctgcgttcgcgggacgggagtgagtatctcatccagcacgattccgaagctatcatctcaacctggcataaagcgattgcccaggggattcaagagttgtccgccgaattaccacctgaggaatcggagtcgtcccgagtggacttcggatcatccgagagactcggctcttggcaagaaaaagaagaagacgctaggcctaacgcggccgcacccgcactgggcccagttgggctcgagagcgatctgtctaaggtacgacacaagctgcggaaattcctgcagagacgaccaacgttacagagcctccgggaaaaggggtacatcaaggatcaagtatttgggtgcgccctggccgccctctgtgagagagagcggagtcgagttcctcgcttcgtccagcagtgcattagggcagtcgaggccaggggactggacatcgatggactatacagaatcagtggtaacctggcgacgatccagaaactgaggtataaagttgatcatgacgagcgacttgacctggacgacggccggtgggaagacgttcatgtgatcactggcgcactcaagctgttcttccgcgaactccccgaaccgctgttccccttcagccacttcagacagttcattgccgccatcaagctacaggatcaagccagacggtcaagatgcgtccgggacctagtccgctccttacctgcccccaaccatgacacgctgaggatgctcttccagcacctctgtcgcgtcatcgaacatggggagcagaatagaatgtctgttcagtctgtagccatagtattcggccctacactgctgcgccctgaggtagaagagacatccatgcctatgactatggtatttcagaaccaggtggtcgaactgatcctacagcagtgcgccgacatctttcctccgcactag

SEQ ID NO: 203321 - DNA, 2589 bp, Artificial Sequence
  Description of Artificial Sequence: Synthetic coding sequence
atggccgccgacgtggtgggcgacgtgtacgtgctggtggagcaccccttcgagtataccggcaaagatggtcgtcgcgtggccatcaggccgaatgaacggtaccggctactccgcaggagtaccgaacactggtggcacgtgcgccgagaacccggcggacgccccttttacctgccagctcagtatgttagggagctgccggcgctgggtaaccccgccgcagccgcccctccaggtccccacccatctcccgcagctcctgagccactggcttacgactatagatttgtttcggcggcggctacagcaggacccgacggcgcccctgaggaatcaggaggccgggcatcatctctgtgtggtccagcccagagaggagccgcaacccagagatcgtccttggctccaggcttgcctgcttgtctttatctaagacccgccgccccagtacggccagcacagagtttgaacgacctagcatgtgccgccgtcagtcctcctgcaggtttgctgggttcctcaggcagctttaaagcatgttcagttgccggatcatgggtgtgtccccgcccactggcccggagtgactccgaaaacgtttatgaagttatacaggatttgcacgtgcctccaccggaagaaagtgcggagcaggtggacgaccccccagaaccagtctacgcgaacattgaacgccagcctcgggctacatcacccggtgctgctgccgcacctctcccctcccctgtgtgggagacacacacagatgctgggacaggtaggccttattattacaatccggataccggggtcacaacatgggaaagccccttcgaggctgcagaaggagccgcgtctcccgctacgtcacccgcgtcagttgacagccacgtttcgctcgagacagagtggggacagtattgggatgaggaaagcaggcgcgttttcttctacaatcccttaaccggagaaaccgcttgggaagacgaagctgaaaatgaacctgaagaggagctcgagatgcagccggggctttctccaggcagcccgggcgatccacggccacctacccctgagacagattatcccgaatcgctcacatcataccccgaggaggactattctcccgtgggctccttcggcgaaccagggcctacaagcccattgactaccccgcctggttggtcctgccatgtgtcacaagacaaacaaatgctctacacgaatcacttcacacaggagcaggtgccggttcctgcaccccggagcatccacaagtcatcacaggacggcgacacccccgcacaggcttctccgccagaggagaaagtgccagccgagcttgatgaggtgggctcctgggaggaagtgagtccggccaccgccgctgtgcgtactaagaccctagacaaggctggcgtgttgcatcgcaccaaaaccgccgataaggggaaacgtttgcgcaagaaacactggtccgcctcctggacagtgttggaaggaggagtgcttacattttttaaggacagcaaaacttctgcagcaggcggcctgcgtcaacctagcaagtttagcactcctgagtacacagtggaactgcgcggcgcgacgctttcttgggcaccaaaagacaaaagcagtcgcaagaacgtgctggagctgaggtcacgggacgggagtgaatatctgatacagcatgatagtgaggccatcatcagtacctggcataaagccatagcccagggaatccaggagctgtcagcagagctgcccccagaagagtcagaaagttcccgagtcgatttcggttccagtgaaaggttggggagctggcaggaaaaggaagaagatgcgagaccaaacgccgccgctcctgccttggggccagttgggctggaaagcgatctttctaaagtgcgacacaaactgcgcaaatttctgcaaagaagacccaccctgcagtctctgcgggagaagggttacatcaaggatcaagtgttcggttgcgctctggccgcactctgtgagagagagaggtctcgagtgcctcgcttcgtccagcaatgcatccgcgctgtggaggcaagggggctggacattgatgggctgtaccgcatctcaggaaatctggcaactatccagaaactacgttacaaagtcgaccacgatgaaagattggatctggacgacggaaggtgggaggacgttcatgttatcaccggtgctctaaaactcttcttccgggaacttcccgaacccctttttcccttttcccatttccgccaattcatagctgccatcaaactccaggaccaggctcgacggtccagatgtgtccgtgatctggtccggtctctccctgctcccaaccatgacacattgcgcatgctttttcagcatctgtgcagagtcattgaacatggggaacagaaccggatgtcagtgcagtcggtggccatcgtctttgggcccacgctcctgcgccccgaggtcgaggagacctcaatgcccatgacgatggtttttcagaatcaggttgtggagctgatcctgcagcaatgcgccgacattttccccccgcattag

SEQ ID NO: 203322 - DNA, 1647 bp, Artificial Sequence
  Description of Artificial Sequence: Synthetic coding sequence
atgcagcccggcctgagccccggcagccccggcgacccccggccccctacccccgagacagactacccagagtctctcacatcctatccagaggaggattactcgcccgtcggctcgttcggcgaacccggccctacgtccccactgaccactcctcccggatggtcttgccacgtcagtcaggacaagcagatgttgtataccaaccatttcacacaggaacagtgggtacgccttgaagacccgcatggaaagccttacttctataaccccgaagattctagtgttcgttgggaactgccacaggtaccagtacctgcccccagatccatccacaaatccagccaggacggcgatacaccagcacaggcaagtccacctgaagaaaaagtccccgccgaacttgacgaggtgggaagctgggaggaagtgagtcctgcgactgctgccgtgcgtaccaagactcttgataaggccggcgtgctccatcgcaccaagactgccgataagggtaaacgactacgaaagaaacattggtcagcttcttggaccgtgctagagggcggcgtcctgactttttttaaagactcaaagaccagcgccgcggggggcctgcgccaaccttcgaagttttctaccccagagtataccgtcgagcttaggggggctacactgagttgggctccgaaggataagtcatctcgcaaaaatgtattagagctcaggtcccgcgacggtagtgagtatctcatccagcacgattcagaggccatcattagcacttggcataaggccattgcccaggggattcaggagctgtcagccgagcttccgccggaggaaagtgaaagcagccgcgtcgattttgggtctagtgagagactggggagctggcaggaaaaggaagaagacgcaaggcctaacgccgctgcccctgctttgggccccgtaggcctggaaagtgacctcagtaaagtccgtcacaaactgcgcaaatttttgcagagacgaccaaccctgcagagtctgcgcgagaaagggtacattaaggatcaagtgttcggttgcgcgctggctgccttatgtgagcgggagcggtcacgcgtgcctagatttgtccagcaatgcattcgagctgtagaggcccgaggcctcgacatcgacggattgtaccgaataagcgggaacttggccactatccagaagctgaggtacaaggtggaccacgacgaaagactggacttggacgacggacgttgggaggatgtccacgtgatcacaggagcattgaaactgttcttccgcgagttgcctgagccactttttcctttctctcacttcagacagttcatcgcagccatcaagctgcaggaccaagctcggcggtctcgctgtgtgagagacctggtccggtccctgccggccccgaatcatgataccctgcgcatgttgtttcaacatctgtgtagagtcattgagcatggggagcagaataggatgtctgtgcagtcagtggccattgtgttcggaccaactctgctgcggccagaagtcgaggaaaccagcatgccaatgactatggttttccagaaccaagtcgtcgagctgatcctgcagcagtgcgcagatatcttccctccacattag

SEQ ID NO: 203323 - DNA, 792 bp, Artificial Sequence
  Description of Artificial Sequence: Synthetic coding sequence
atggccgccgacgtggtgggcgacgtgtacgtgctggtggagcacccgtttgaatatacaggcaaggatgggcgccgggttgcaatccgtcctaacgagagataccgccttctgcgccgttccacggagcattggtggcatgtgaggcgagagccaggcggccgccctttctaccttcccgcccagtacgtaagagaactgcctgctctggggaatccagctgcggctgcaccacctggcccccaccctagtcccgcagcccctgagccccttgcctacgattacagattcgtgtcagccgccgcgacagccggaccggacggagcaccagaggagtctggaggaagagcaagtagtctttgtggccccgctcagagaggcgccgctacgcagagaagttctttggccccggggctcccggcttgcctctatctgcggccagctgctcctgtgagaccagctcagtccctgaatgatctcgcttgcgctgccgtcagcccccctgccggtctattgggttcttcaggatctttcaaagcttgcagcgttgcaggcagctgggtgtgccctagacctctcgcgaggagtgacagcgagaatgtatacgaagtgatacaagacctgcacgtacctcccccagaggaatctgccgagcaggtgcccccccgggcactggggcgaggtggtggttggagagcgcgagatcgagccagaacagagcctggaaggaaagagacacgtagtgctcagagacgggctcggagaccgcctttgagcgaagattttggctag

SEQ ID NO: 203324 - DNA, 1566 bp, Artificial Sequence
  Description of Artificial Sequence: Synthetic coding sequence
atgcagcccggcctgagccccggcagccccggcgacccccggccccccacacccgagactgactaccctgaatcactgacttcatacccagaagaagattattctcccgtcgggagtttcggcgagccagggccaacgagcccacttactacccccccaggctggagttgtcatgtctcccaggataaacagatgctatatactaatcactttacccaggaacaggtgcccgtccctgcaccccgatctattcataagtccagccaggatggcgatacacctgctcaggcttctcctcccgaggagaaagtcccagccgagctggacgaggtcgggtcttgggaggaggtgtcaccagctacagctgctgtccggacaaaaactctcgataaggctggcgtgctgcaccgaaccaaaactgctgacaagggaaagcgactgcgcaagaagcactggtccgcaagctggactgtactggaggggggtgtgctgaccttcttcaaagactctaaaactagtgctgcaggcggactgcgccaaccaagcaagtttagtactcctgagtacactgtggaattgaggggcgctaccctgtcatgggctccaaaggacaaaagtagccgaaagaacgtactcgaactccgcagccgtgacggttccgaatatctgattcaacatgacagtgaggctatcatctctacttggcataaggccattgcccagggtatacaggagctctccgcagagctgccacctgaagaatccgaaagttctagggtcgatttcggcagctccgagaggttgggcagttggcaggaaaaagaggaagacgctcgaccgaatgccgccgcaccggcacttggtcccgtgggccttgagagtgatctgagcaaggttcggcataagcttagaaaatttcttcagcgccggccaacacttcagtccctccgcgaaaagggctatatcaaggatcaggtcttcggctgcgctttagccgcgctgtgtgaaagggagcggtccagggttcctcgtttcgttcaacagtgtattcgagcagtggaggccaggggactcgatatagatggactctaccgcattagcggaaatctcgcaactatacagaaactgaggtataaagtggatcatgacgagaggctggatcttgacgacggccgctgggaagatgtgcacgtcatcacaggcgctctaaaactcttttttagagaattaccagagcccctttttccctttagccatttcagacagtttatcgctgccattaaattacaggaccaggcgcgtagatcaagatgtgtcagggatctcgtcaggagcctaccagcccctaatcacgataccttaaggatgcttttccagcacctctgccgggtcattgaacatggggaacagaatagaatgagtgttcagtctgtggctatcgtcttcggccccaccctgttaagacccgaagtcgaagagactagtatgccgatgactatggtgtttcagaatcaggtggtggaactaatactacaacaatgcgccgatatatttccaccgcattag

SEQ ID NO: 203325 - DNA, 2013 bp, Artificial Sequence
  Description of Artificial Sequence: Synthetic coding sequence
atgctgagcaacgagagcctgcacccccccgccttcagccggagcaatagcgaggcttccgtggatagtgcatctatggaggatttctggagggaaattgaatctatcaaggactccagcatgggtggccaggaggagccaccccctgctgaggtgaccccagtcgatgaaggggagctggaggccgaatggctgcaagatgtgggcctctccactctcatctcgggtgatgaagaggaagacggaaaagcgctcttgtccacgctgacacggactcaggcagcggctgtacagaaaagatatcatacctacactcaaaccatgaggaagaaagataagcagtccatcagagacgtgcgagacatcttcggagtatctgaaagccctccacgagacacttgcggaaatcatactaatcagttagatggcaccaaggaagagcgggagttgcctcgtgtgatcaaaactagcggtagtatgccggacgatgcctcattgaactctactaccctgagtgatgccagccaggacaaggagggatcttttgccgtccctcgttctgattccgttgccattctagagacgatacctgtccttcctgtgcactcaaacgggagccccgagccaggacaaccggtgcagaacgccattagcgacgatgacttcctggaaaaaaacataccacctgaggccgaggaactctcctttgaggtcagttatagcgaaatggtcacagaagccctgaagcgcaataagttaaaaaaatctgagatcaaaaaggaggattatgtgctcaccaagtttaacgtgcaaaagacccgctttgggcttactgaggcaggagatctgtccgccgaggacatgaagaaaattcggcatctgtccctgatcgaactgactgcattttttgatgcttttggtattcagctcaagaggaacaaaacggaaaaagtcaagggaagagacaatgggattttcggggtaccacttaccgtcctgttagacggcgacaggaaaaaggaccccggcgttaaagtgcctttagtgctacagaaattctttgagaaggtcgaggaaagcgggctagagagcgaagggatcttcaggctgagcggatgcactgcaaaggttaagcagtatagggaagaactggatgctaaattcaatgcggacaagttcaaatgggacaaaatgtgtcatagagaggccgcagtcatgctcaaagcgttcttccgcgagctccccacatccttatttccagttgagtatatccctgcattcatcagtctgatggagagaggtccccacgtgaaagtccagtttcaggcccttcacctaatggtgatggccctgcccgacgcaaaccgcgacgccgctcaggccctcatgacattctttaataaagtgatcgcgaacgagagtaaaaaccgcatgtctttgtggaacatctcaacggttatggcaccgaatctcttctttagcaggtcaaaacattcggattatgaggagctgttactggccaacaccgcggcccatatcatccgcttgatgctcaagtaccagaagatcctgtggaaagtgccaagcttcctgatcacacaggtgaggcggatgaacgaggcaacaatgttgttgaagaagcaactgccaagcgtcagaaaactgctcagacgaaaaaccctggaacgagaaacagcctcgcctaaaaccagcaaggtccttcagaagtcccctagtgcccggcggatgagcgacgtgccggagggcgtgattagagtgcatgccccactgctatccaaagtttctatggccatccagctgaataatcagacgaaagccaaagacattctggccaagttccaatacgaaaatagaatccttcattggcaacgcgccgccctttcattcttgaacgggaagtgggtgaaaaaggagcgagaggaatctaccgagaccaaccggagcccgaagcacgtgttcctgttcaccattggtctggatatttcaacctag

SEQ ID NO: 203326 - DNA, 1713 bp, Artificial Sequence
  Description of Artificial Sequence: Synthetic coding sequence
atgcggaagaaggacaagcagagcatccgggacgtgcgggacatcttcggtgtcagtgagagcccccctcgtgacacatgcggaaaccacaccaaccagctggacggtacaaaggaggaaagagaattgccccgggtcatcaagacctccggatccatgcctgatgacgcatccctaaactctacgactttgagcgatgcctcacaggacaaagaggggagctttgcagttccacgctctgactccgtggccattctggagactattcctgtgttgcccgtgcattctaacggaagccccgaacccggccagcccgtgcagaacgctatctccgacgatgatttcctggagaagaatataccaccagaggctgaggagctcagttttgaggtgtcttactctgaaatggtgaccgaggcgctcaaaagaaacaaacttaagaagtccgagattaaaaaggaagattatgtgctcaccaaatttaacgtccagaagacgaggtttggcctcaccgaagcgggggacctcagcgcagaggatatgaagaagatacggcacctttccttaattgagctgactgcctttttcgatgcatttggtatacagctgaaacgtaataaaactgagaaggtgaagggccgggataacgggatctttggcgtgcctctcaccgtgctgctggacggggatcgaaaaaaggatccaggggttaaagtgcccctcgtgctccagaagtttttcgagaaggtcgaagagagcgggctcgagtcagagggcatcttcaggctgtctgggtgtaccgccaaggtgaagcagtacagagaagaactggatgctaaattcaacgctgataagtttaaatgggacaagatgtgccatcgagaggctgccgtaatgcttaaggccttcttccgggaactgcctactagtctgttccctgtggagtacattcctgccttcatctccctgatggaacgggggcctcatgtgaaagtacagtttcaggcactgcatcttatggttatggcactgcccgatgccaaccgcgacgcagcacaggctctgatgacgttttttaacaaggttatcgctaatgaatccaaaaaccgcatgtctctgtggaacattagtacggtgatggctcctaatctcttcttttcgcggtctaaacatagcgactacgaagagctgttactggctaatactgccgcacacattattagactgatgctgaaatatcagaaaattctgtggaaggtccctagttttctcataacccaagttaggagaatgaacgaagcaacaatgttactcaaaaagcagcttccaagcgtgcgcaagttattgaggcgcaagaccctcgagagggaaacagccagccctaagaccagtaaagtgctgcagaagtctccctccgcccggcggatgtccgacgtgcccgaaggggtaatccgagtccacgcaccactcttgagtaaagtgagtatggctatacagctgaacaaccaaaccaaagcaaaggatatactggcgaagtttcaatacgaaaatagccacggctccagcgagtgtataaagatccaaaaccaacgactgtacgaaattggcgggaacatcggggagcactgcctagaccctgatgcgtatattctagacgtttataggattaatcctcaagccgagtgggtaattaaaccccaacagtcctcatag

SEQ ID NO: 203327 - DNA, 1638 bp, Artificial Sequence
  Description of Artificial Sequence: Synthetic coding sequence
atgaacgagctgccccgggacacctgcggcaaccacaccaaccagttggatggtactaaggaggagcgcgaactgccgcgtgtcattaagactagcggaagtatgcctgacgacgcctcgcttaactcaacgactctgtcggacgcatcgcaggataaagagggtagttttgccgtaccgcgatcagattccgttgcaattctggaaaccattccagtgctccccgtacattcaaacggtagtccggagccgggccagcccgtgcaaaatgcaatcagtgatgatgacttcctcgagaagaacataccccctgaggcagaggaactctcctttgaggtgtcctactccgaaatggtaactgaagccctgaagcggaacaagttgaagaaatcggagattaaaaaggaagattatgtcctcaccaagtttaacgtgcagaaaaccagatttggactcactgaggctggggatctttcggccgaagatatgaagaaaattcggcatctaagtcttattgaattaacagcgttttttgacgcttttgggattcagctcaagcgcaacaagaccgagaaagtcaaaggtagggacaatgggatttttggcgtgcccctaactgtacttctggacggcgatcgcaaaaaggacccaggggtgaaagtgcccctggtgctgcagaaattctttgagaaggtggaggaaagcggcctggaatcggagggcatttttagactgtccggatgcacggctaaagtgaagcaatatcgcgaggagctggatgccaaatttaacgcagataagttcaagtgggacaaaatgtgccatcgcgaggccgccgtaatgctcaaggccttcttcagagagctccccacgagtctctttcctgtggagtacatccccgccttcatcagcctgatggagagaggacctcatgtgaaagtacaattccaagccctgcacctcatggtcatggctctgcctgacgcaaatagggatgctgcccaagcgttgatgacgttcttcaacaaagtcatcgctaacgaatccaagaaccggatgtctctctggaatataagcacagtaatggccccaaatttgtttttcagtaggtctaaacatagcgactatgaggaactgctcctagcgaataccgccgcccatataattcgccttatgcttaagtaccagaaaatcttgtggaaagtgccttccttccttattactcaagtgcgcagaatgaacgaagcaaccatgctgttaaagaagcagttgccaagcgttaggaagctgctccgacggaaaacactcgagagagaaacggcctcacccaagacttccaaagtcctgcaaaaaagccccagcgcacgacgaatgtcagacgttcctgagggcgttattcgcgtgcatgctccacttctgtcaaaagttagcatggccattcagctgaataatcagactaaggcaaaggatatcctagctaagtttcaatacgaaaatcgaatccttcattggcagagggcggctctgtccttcttgaacggtaagtgggtaaagaaggagagagaggagagcacagaaacaaatcggagtcctaagcacgtgtttttgtttactattggcctagacatctctacttag

SEQ ID NO: 203328 - DNA, 2169 bp, Artificial Sequence
  Description of Artificial Sequence: Synthetic coding sequence
atggaggtggaggacagcggcggcgtggtgctgaccgcctaccacagttatgcccgcgcgcaaccccctaacgcggagtctcgttgtgcacccagagcagcggcgtcccacccactcagccggaaatctattcctagatgcaggagaatcaatcggatgttaagcaatgagtctctccatcctcctgcttttagtcgctcaaattcagaggccagcgtggattctgcctctatggaagacttttggcgcgagattgagtcgattaaagactctagcatgggaggccaggaagagcctcctcctgccgaggtaacccctgtcgatgaaggggagcttgaggccgagtggctgcaagatgtggggctgagcaccctcatcagcggcgatgaagaagaagatggaaaggcgctgctgtccactctgacccgaacacaggccgcagctgtccagaaacggtatcatacctatactcagaccatgcggaaaaaggacaaacaaagcatccgagacgtgagggacatctttggggtgagcgagtccccgcctagagatacttgcggcaaccataccaaccagctcgacggcacaaaggaggaacgagaactgccccgcgtgatcaagacatctggcagcatgcctgacgacgctagcttgaattccactacactgagcgacgctagccaggacaaggaggggtcgttcgccgttcccagaagtgacagtgttgccattctggagacaatcccagtcttgcccgtccattctaatgggtcccccgagccaggacagcccgtccagaacgccatatcagacgacgacttcttggagaagaacattcctccagaagccgaagaactgtcctttgaggtgtcttatagtgagatggtgacagaggccctgaagcgaaataagcttaaaaagtccgagattaagaaagaggattacgtgctcactaaattcaacgtgcagaagacacggttcggtcttactgaggccggagacttgagcgcggaagatatgaagaagattagacatctgtctcttattgagctgactgccttctttgacgctttcggaattcaactgaagcggaacaagactgagaaggtgaaaggcagggacaacggcatctttggagttccactgaccgtcctgcttgatggcgacaggaagaaggaccccggagttaaggtgcctcttgttttgcagaaattcttcgagaaagtggaagagagcggtctggaaagcgagggtatcttccgcttgagtggttgtactgctaaggtgaaacagtaccgggaggagcttgacgccaaattcaacgcagataaatttaagtgggataaaatgtgtcacagagaagccgcagtgatgttgaaagcctttttcagagagctgcccaccagcctgtttcctgtcgagtacataccagcttttatcagcttgatggagagaggtccacacgttaaggtccaattccaggctttgcacttgatggtaatggcactcccggacgctaatcgcgacgcagcccaggccttgatgaccttctttaataaggttattgcaaacgaatccaagaaccggatgagcttatggaatatctccacggtgatggctccaaacctcttcttcagtcgatctaagcacagtgactatgaggagcttctgctggccaacacagctgctcatatcattagactgatgctgaaataccagaagatcctgtggaaagtgccctcttttctgattacacaggtgcgcaggatgaatgaggccacaatgctactaaagaagcagttaccctcagtgagaaaacttcttagacgcaaaactttggagcgcgagacagcatcacctaagacttctaaagtgctccaaaagtctccttctgcccgacgcatgagtgatgttcctgaaggcgttatccgcgtccatgcaccgttactgagcaaggtgtccatggctatccaactgaacaatcagacaaaggctaaggatattttagcaaagtttcagtacgaaaaccgcatacttcattggcagcgcgccgctctgagctttctcaatggcaaatgggtgaagaaagaaagagaggagtctaccgaaacaaatcgctcaccaaagcacgttttcctgtttaccatcggactcgatatatcaacttag

SEQ ID NO: 203329 - DNA, 1692 bp, Artificial Sequence
  Description of Artificial Sequence: Synthetic coding sequence
atgcggaagaaggacaagcagagcatccgggacgtgcgggacatctttggcgttagcgagtctcctccacgggacacgtgcggaaatcacaccaaccagctcgacgggacaaaagaggaacgcgaacttccccgcgtgatcaaaacaagcgggtctatgcccgatgatgcttcactgaacagtaccactctctctgacgcctcacaagacaaggagggaagctttgccgttccgcgttccgactctgtagcaatattggaaacaatcccagtgctcccagtgcatagcaacgggagtccagagcctggtcagcccgttcagaatgctatcagtgacgatgatttcttggagaagaacataccccccgaggctgaggaactgtcatttgaagtgtcatacagtgaaatggtcacagaggccttgaagcggaataagttgaagaagagcgaaatcaagaaagaggattacgttttgacaaagttcaacgtgcaaaagacacgcttcggattgaccgaggctggtgacctttctgccgaggacatgaaaaagatccggcacctttcacttatagagctgaccgcattttttgacgcatttggcatccagttgaaaagaaataaaactgagaaggtgaagggccgggataatggaatattcggagtgcccctcacagtgctgcttgacggcgaccgcaaaaaggaccccggtgtcaaagtgcccctggtgttacaaaaattcttcgaaaaagtcgaagagtctggccttgaaagcgagggaatctttaggctaagcggctgtacagcgaaagttaaacagtaccgggaggaactcgacgctaaatttaacgctgacaagtttaagtgggacaaaatgtgccacagagaggccgctgtgatgttaaaagccttttttcgtgaactccctacctcactgttcccggtcgaatacatccccgcgttcatcagtctgatggagagagggccacatgttaaggtccagtttcaggccctgcatctgatggtcatggctttgccagatgccaatcgggacgccgcacaagctctaatgacatttttcaacaaagtcatcgctaacgagagcaagaatcgcatgtctctctggaatatctccaccgtcatggctcctaatctgttcttctcccggagcaaacatagtgattatgaggaactgctcctggccaacactgccgcgcatatcattcgactaatgcttaaataccagaaaattctgtggaaggtaccctccttcctgatcacacaggtcagaagaatgaacgaagctactatgttgctgaagaaacagctgccctcggtgaggaaactcctgaggaggaagacactcgaacgcgaaactgctagccccaaaacttctaaggtactgcagaaaagcccatctgctaggcgaatgtcggatgttcctgaaggggtgatccgagtacacgctccgctattaagtaaggtcagcatggccattcagctgaacaatcagacgaaggccaaagacatcctggccaaatttcagtatgagaaccgtatactccactggcagagagccgctctgagctttcttaacgggaaatgggtgaagaaggaacgggaggagtctactgaaacaaacaggagccccaagcacgtattcctgtttaccattggactggacatctctacatag

SEQ ID NO: 203330 - DNA, 1713 bp, Artificial Sequence
  Description of Artificial Sequence: Synthetic coding sequence
atgcggaagaaggacaagcagagcatccgggacgtgcgggacatcttcggtgtgtcagaaagtcctccccgagatacctgtggaaatcatacgaaccagctggatggtaccaaggaggaacgcgagctgccccgggttatcaagacttcaggctctatgcccgacgacgcctctttgaacagtaccactctgagtgacgccagccaagacaaggagggaagtttcgcggtccctaggtctgactcagtggcaattctggaaacaattcccgtgctgcccgtccacagcaatggaagccctgaacccggtcagccggttcagaatgctatctccgatgatgacttcctggagaaaaacattccacctgaggccgaggagttatccttcgaagtgtcttacagcgaaatggtgacagaagctctgaagagaaacaagcttaagaaatcagaaatcaaaaaagaagattacgtcctgactaaatttaacgtgcagaaaacacggttcggtctgaccgaggctggagatctctcagctgaggatatgaagaaaatacggcacctctcactaatcgagttgacagcgttttttgacgcctttggaatacagctgaagcgaaacaaaacggaaaaagtgaagggacgcgacaatggtattttcggcgtccctcttacagttctgctggatggagaccgcaagaaagatccaggggttaaggtccctctggttcttcagaagttctttgaaaaggtcgaagagtcagggttagagtccgaggggatctttagactgtccggttgtacagccaaagttaaacagtatcgggaagaactcgatgcgaagttcaacgccgataaatttaagtgggacaagatgtgtcatcgggaggcagccgtcatgctgaaggctttcttcagggagctgcctacgagtttgtttcctgttgagtacatcccagcatttatcagtctgatggaaaggggccctcacgtaaaggtgcagtttcaggcactgcacctgatggtgatggcgctgcctgacgccaacagagatgcagcccaggccctgatgaccttcttcaataaagtcatcgcaaacgaaagcaaaaaccgcatgagcctctggaacatcagcacagtgatggctcccaacctttttttctctcgatccaagcattcagactatgaagaacttctgttggcgaatactgccgcgcatatcatacgccttatgctcaagtaccagaagattctctggaaggtgccctcttttctcataacccaggtgaggcgcatgaacgaagcaacaatgctgctgaagaagcagctaccgtccgttcgaaaattactcagacgtaagactctcgaacgggagactgccagtcccaagacgtcgaaagtcttacaaaagagtcccagtgccagaagaatgtctgatgtgccggagggtgtcatccgcgtccatgctcccctgctcagtaaggtttctatggctatccagctaaataaccagacaaaggccaaggacattctcgcaaagttccagtatgagaacagccacgggtcttcagagtgcatcaaaattcagaatcagaggttatatgagattggtgggaatatcggcgaacactgtctggacccagatgcctacatcctcgacgtctataggatcaatccccaagccgagtgggtgattaagccacagcagtccagctag

SEQ ID NO: 203331 - DNA, 354 bp, Artificial Sequence
  Description of Artificial Sequence: Synthetic coding sequence
atgctgagcaacgagagcctgcacccccccgccttcagccggagcaactccgaagcctccgtggattctgcttctatggaagacttctggagggaaattgagtctatcaaagatagcagcatggggggtcaggaagagcccccaccagctgaagtgacccctgttgacgagggagaactggaggcagagtggttacaggatgtcggactaagtactttaattagcggcgacgaagaggaagacggaaaagctttactttcaacactgacacgaacacaggcagctgctgtacagaagcgatatcacacatatactcagaccatgcgcaagaaggataagcagtcaatccggtag

SEQ ID NO: 203332 - DNA, 1665 bp, Artificial Sequence
  Description of Artificial Sequence: Synthetic coding sequence
atggccttcatgcggatcaacgtgatcatgaacgagctgccccgggatacatgtggcaatcacacgaatcaactggacggcaccaaggaagagagggagctcccacgtgttattaagacatccgggtccatgcctgatgatgccagcctgaactcgactaccctgagcgatgcatcccaagataaggaggggtcttttgctgtgccccgctctgatagcgttgcaatcctggagaccattcctgttctgcctgtgcattcaaacggcagtccagaacccggccagcctgtacaaaacgccattagcgacgacgacttcctcgagaaaaacattccacccgaggctgaagaattgtccttcgaggtttcatatagcgagatggttacagaagctttgaagcgcaataagttaaagaagtcagaaataaaaaaggaagactacgtccttacgaaatttaacgttcagaagacccggtttggcctgactgaagccggagatctgtcagcagaagatatgaaaaaaattcgtcatctgtcactgatcgaactcaccgcattttttgatgcttttgggatacaacttaagcggaataaaactgaaaaagtcaaggggagggacaacgggatcttcggagttccattaacagtactcctcgatggggaccggaaaaaagatcccggggtgaaggtgccactggtgttacagaaattctttgagaaagtggaagagagcgggctggagtctgaaggcatattccgcttatcaggatgtacagcaaaagtgaagcagtaccgggaggaactcgatgcaaagttcaacgccgacaagttcaagtgggacaagatgtgtcacagagaggcagctgtgatgctaaaggccttttttagggaactgcccacttccctgtttcccgttgagtacattcccgcatttattagcctcatggagagaggcccacacgtgaaggtgcagtttcaggcgctgcatctgatggtgatggcccttcccgatgcaaaccgggacgcagcacaggccctgatgaccttttttaataaagtcatagcaaatgaatccaagaatcggatgtcactatggaacatctccacagttatggcaccaaacctgttctttagcaggagcaaacacagcgactacgaagagctgttactcgctaacactgcggcccacataatccggcttatgctgaaataccaaaagatcctctggaaggtgccctcttttctgattacacaggtccgacggatgaacgaagcgacaatgctcctgaagaagcagctcccatcggtccggaaacttctaaggcgcaagacactggagagggaaacagcctcgccaaaaacgagcaaggtcctccagaaaagccccagcgcaagacggatgtccgacgtgcctgagggagttatcagggtgcacgctccccttctcagcaaagtgagcatggcaatccaacttaacaaccagacaaaagcaaaagacattctggccaagttccagtacgagaatcgcattctgcattggcaacgcgctgccctcagctttctcaatgggaaatgggtgaagaaggagcgcgaagagagtacggaaaccaataggtctccaaaacatgtgttcctttttacaattggcttggacatctcaacatag

SEQ ID NO: 203333 - DNA, 3786 bp, Artificial Sequence
  Description of Artificial Sequence: Synthetic coding sequence
atgatcgcccacaagcagaagaagaccaagaagaagcgggcctgggcaagtgggcagctgagcacagatatcaccacctcagaaatggggttaaagagtctatcgtctaactctatttttgatccagactacatcaaagaactggtgaatgatatacggaagttcagccacatgctgctctaccttaaagaagccatcttttccgattgctttaaagaggtcatacacatcaggttagaagagcttttacgggtgttaaagtccataatgaacaaacatcagaatctcaacagcgttgacctgcagaatgccgccgaaatgctgaccgcgaaggtcaaagccgtcaattttaccgaggttaatgaggagaacaaaaacgatctttttcaagaagtgtttagtagcattgagacgctagcattcactttcgggaacattctcaccaacttcctcatgggcgacgttggaaacgatagcctgctaaggctacctgtgtcacgtgagacgaagtcctttgaaaatgtttcagtcgaaagcgtcgattcctcttcagaaaaggggaatttctcccctctcgaactggacaacgtgttactgaagaataccgacagcatcgaactagccttaagctacgctaagacctggagcaaatacactaaaaatatagtctcctgggttgaaaagaagttgaatttggagctcgagtcaacccgcaatatggttaagcttgcagaggcaacccgcaccaacattggcatacaggaattcatgcccttacagtctctcttcactaacgcattgttaaacgacatagaatcgagccaccttcttcaacagaccattgccgccttacaggccaataaattcgttcagccactgcttggccggaagaacgaaatggaaaaacagcgcaaggaaatcaaggaattgtggaaacaggagcagaacaagatgctcgaagctgaaaatgcactgaaaaaagctaagctgttgtgcatgcagcgccaagatgagtacgaaaaggcaaagtcctctatgttcagggccgaggaagagcacctgagctcctccggcggactcgccaaaaatttaaataagcaactcgaaaagaagcgccggctcgaggaggaggcgctgcagaaggtggaggaagccaatgaactgtacaaagtgtgcgtgactaacgttgaggagcgccggaatgatctcgagaatacaaaacgcgagatcttggcacagcttaggacacttgtgttccagtgcgaccttacactcaaggccgtgacagtcaatctgttccatatgcagcatctccaggcggcaagcctggccgacagtctccagagtttgtgcgactccgctaaactgtacgaccccggacaggaatactccgaatttgtaaaggccacaaactccaccgaagaagagaaggtcgacggaaacgtcaacaagcacctcaatagttcccaaccatctggttttgggcccgccaactctctcgaggatgtggtgcgcctgcctgactcctccaacaagatcgaggaggaccgctgcagcaactctgctgatattactggtccctctttcatccgctcatggacattcggaatgttctcagattccgagagtacgggaggcagctccgaaagcaggtccctggatagcgagtctatctctcccggtgatttccataggaaactgccgcggactcccagttctggaaccatgagttccgccgacgaccttgacgagagggaacctccttcccccagcgaaaccggcccaaactcactggggacattcaagaaaacgctcatgtcaaaggctgcgcttacccataagtttcggaaactgcgctcacccacaaaatgtcgggattgcgagggaattgtcgtgttccagggagttgagtgcgaggagtgtctgctggtatgtcaccggaagtgcttagagaacttagtcatcatttgtggtcatcagaagttgcctggaaagattcacttatttggagccgaattcacccaggtcgctaagaaggagccagatggaatcccatttattctgaagatatgtgcatccgagatcgaaaatagagcattatgtctgcaggggatctaccgcgtgtgcggtaataaaattaagactgagaagctgtgccaggccctcgagaatggcatgcatctggtcgacatcagcgagttttcctcccacgacatatgcgacgtactgaagctgtatttgagacaattgcccgagcccttcattctctttcgactttataaggaatttattgatcttgccaaagagattcagcacgtaaacgaggagcaggagactaagaagaacagcctggaggacaagaagtggcccaatatgtgcatcgagattaatcggatcctgcttaagagcaaggacctactgcgacagctgcccgcgtctaatttcaacagcttgcactttctgattgtgcacctgaagagggttgttgatcacgctgaagagaataagatgaattccaagaacctcggagtgatctttggaccctccctgattcgtcctcgcccaactacagcacctattaccattagttctcttgccgagtactccaatcaagcacgcctggtggagtttctgattacttactcacagaagattttcgatggatctctgcaacctcaagatgttatgtgttctatcggcgtggtggaccagggatgcttccccaagcccctgttgtcaccagaggaaagagatatcgagcgcagcatgaaaagcctatttttctctagcaaagaggacatacataccagtgagtctgaaagcaagatattcgagcgtgcaaccagtttcgaggaatccgagcggaagcagaatgcgcttggcaagtgcgatgcatgtctatcagataaggcccagctgctcctagatcaggaggctgagtccgcctcacagaagatcgaggacgggaaaacccccaagcccctgtctttaaagtcggatcgttctaccaataatgtggaacgccacacacctagaacaaagataagaccggtgtccctacccgtcgaccggcttctgctcgcatccccccccaacgaaagaaacggccgcaacatgggaaacgtcaatctcgacaagttctgcaagaaccctgcattcgagggggtcaatcgaaaggacgccgccaccacagtctgtagcaaatttaatggattcgaccaacagaccctgcagaaaatccaggataaacaatacgaacaaaatagcctaaccgccaagacaaccatgatcatgccttccgcacttcaggaaaagggcgttaccacatcccttcagatttctggtgatcactcgattaacgcaacgcaaccaagtaaaccgtatgctgaaccagtgcgttccgttcgcgaggcctccgagcggcgtagttcggatagctaccctcttgcccccgtcagggcaccccggactctccagcctcaacactggaccaccttctacaaaccccatgcccctataatctccatacgcggcaacgaagaaaaacccgcctcacccagcgccgctgtgccccccgggaccgatcacgacccccatggcctagtcgtaaaatcgatgccagaccccgataaggcatccgcctgcccagggcaggccactgggcagcccaaagaagattccgaggagctcggattgcctgacgtgaatccgatgtgtcagcggccccggctgaaaaggatgcaacagttcgaggatctggagggagagatccctcagttcgtgtag

SEQ ID NO: 203334 - DNA, 1182 bp, Artificial Sequence
  Description of Artificial Sequence: Synthetic coding sequence
atgatcgcccacaagcagaagaagaccaagaagaagcgggcctgggcatctggacagttgagtaccgacatcaccacctctgagatggggctgaagtccttgagtagtaactctattttcgaccctgactacattaaggaacttgtaaacgatattcggaagttctcacatatgttgctgtacctgaaggaggccattttcagtgactgcttcaaagaggtgatccatataaggcttgaggaactgctgcgggtgctgaagagcattatgaacaaacaccaaaacctcaactcggtagatttgcagaacgccgctgaaatgttaaccgccaaggtcaaggctgtcaattttactgaagtcaacgaagaaaataagaatgacctttttcaggaagtattctcctccatagaaacattggcttttaccttcgggaacatcctgaccaactttttgatgggagacgtgggcaatgattctctcctgcggctcccggtgagccgggagactaagtcctttgaaaacgtatcagtggagtcagtggatagctccagcgagaagggtaacttttcaccattggagctggacaacgttttgctgaaaaataccgattccatagagctggccctgagttatgccaaaacctggtcgaaatacaccaagaacatcgtgagctgggtggagaaaaagctgaatctggagctggagtcaacccgcaacatggtgaagctggctgaggctactcgcacaaatattggcattcaggagttcatgcctctccagagcctgttcaccaatgcactgttgaacgacatagaaagctcacacctcctgcaacagacgattgcagccctgcaggctaacaaattcgtgcagcctctgttgggtaggaaaaatgagatggagaaacagagaaaggaaatcaaagagctgtggaagcaagaacagaacaagatgctggaagctgagaacgcgctgaaaaaggccaaattactctgcatgcagcggcaagatgagtacgagaaagccaaaagctcaatgtttcgggctgaagaggagcatctttcgagctcaggcggactggctaaaaacctgaacaaacagctcgaaaaaaagcgtcgattggaggaggaagctctgcaaaaggttaccatctttttcttctttatctgcaagctcaactag

SEQ ID NO: 203335 - DNA, 3306 bp, Artificial Sequence
  Description of Artificial Sequence: Synthetic coding sequence
atgaagagccggcagaagggcaagaagaagggcagcgccaaggagcgggttttcggttgtgacctacaggagcatctccaacattccggacaggaggtgccacaagttttaaaatcatgtgcggagttcgtcgaagagtacggtgttgtcgacggaatttaccgcctctctggcgtgagcagcaatattcagaaattaagacaggaatttgagtctgaacggaagcccgacctgcgaagagacgtttacttacaagatatccactgtgtctcgtcattatgcaaggcctacttccgggagctgccagatccccttctcacatatcggctgtatgacaaattcgcagaagcagtgggagtccaattagaacccgagaggctagtcaagatcctggaggtcctccgggagctgccagtcccaaattatagaaccctcgaattcctaatgcggcacctggtacacatggcctccttcagtgcccagaccaatatgcacgcccgcaatctggcgatcgtgtgggctcctaacctacttcgcagtaaggatattgaggcttccgggtttaatggtactgccgcttttatggaagtaagagtgcagagtatcgtagtggagttcattctgactcacgtggaccagttgttcgggggggcagctttgagcggcggcgaggtggaaagtggctggcgctcgcttcccggcacaagagcaagcgggagcccggaggatctgatgcccaggcccctaccttatcacctgccctctatcttacaggcaggggatggtccgcctcagatgcggccctaccacacaatcattgagatcgccgagcacaagaggaaaggctctctaaaagtcagaaagtggaggagtattttcaatttgggcaggtctggacatgagacaaaacgtaaactacccaggggagccgaggacagggaggacaagtctaataaagggacattgcggcccgctaaatcaatggattcacttagtgccgcggccggtgcctcagacgagccggagggcttagtaggtccttcttcccccagaccatccccacttctgcccgagtcactggaaaacgactccatcgaggcagcagaaggcgagcaggagcctgaggctgaagctctgggcggcaccaactccgagcctggcacccccagagctggaaggtcagcgataagagcaggcggatcctcccgagcagagcgatgcgctggagtgcacatcagcgatccctacaacgtaaacttgcccttgcatattacctctatcttgagtgtgccccctaacattatttccaatgtcagcctggccaggctcacacgggggctcgagtgccctgctctgcaacaccgcccttcccccgccagtgggccagggccaggaccgggcctgggccctggccccccggacgaaaagttagaggcctcccctgcgtcttctccacttgcggacagcggacctgacgatcttgcgccagctctagaggatagcctgtcccaggaagtccaggattcattcagtttcttggaagacagcagcagctccgagcccgaatgggtcggagcggaagacggtgaggtggcccaggccgaggctgccggggctgcattctccccgggggaggacgatccaggaatgggatatctcgaggagctcctcggggtcgggccccaagtagaggagttctccgttgaacctccgttggatgacctttcccttgacgaggcgcagtttgtgctggctccgtcctgctgctccctggactccgctgggccccgacccgaggtagaggaggaaaatggcgaagaggtcttcctgtccgcctatgacgacttgtctccgctattaggacccaagccccccatctggaagggctccggctcactggagggggaggctgccgggtgtggccgccaggcattgggacagggcggcgaggagcaggcttgttgggaagttggcgaggacaaacaggctgagccagggggccgactcgacattcgcgaggaggccgaagggagccccgagaccaaggtcgaggctggaaaagcttccgaagatcggggggaagcagggggaagtcaggagaccaaggttcggctgagggaagggtcccgtgaagagactgaggcaaaagaggagaaatccaaaggtcagaaaaaggccgatagcatggaggccaaaggggttgaagagcctggcggtgacgaatacacggatgaaaaggagaaagaaattgagcgagaagaggacgaacagcgtgaagaggcccaggtcgaggcgggcagggacctggagcaaggagcacaggaggaccaggtagctgaagaaaagtgggaggtcgtgcagaaacaggaggcggagggggtgcgggaagacgaggataagggccaacgcgagaaaggctaccacgaggcaagaaaagaccagggtgatggggaggactcccgttctcctgaggctgctacagaaggcggggcaggcgaagtaagcaaagagcgggagtcaggggatggagaggcagagggggatcagcgggctggcgggtattatctggaggaggacaccctgtctgaaggtagcggtgttgctagtctcgaggtggactgcgccaaggaggggaatccacatagttctgagatggaggaggtagcaccccagccaccccagccggaagaaatggaacccgagggacagccctccccagatggctgcctgtgcccttgttccttaggattgggaggagtgggtatgagattggcctctaccctcgttcaggtccagcaagtcaggagtgtgccggtggttccccccaagcctcaatttgccaagatgccttccgcaatgtgcagcaaaattcacgtagccccagcaaacccctgccctaggcctggccgtctagatggaacacccggagagagggcttggggttcccgagctagccgtagctcctggcggaacggagggagtcttagctttgacgccgcagtcgctttggcacgggacagacagagaacagaagctcagggcgtgaggagaacccagacttgtacagaggggggggactattgtcttatacccagaacttcaccttgctctatgatcagcgctcattcaccacggccactgtcttgcctggagttgccatccgaaggagccgaaggttctggctctaggagtcgcctgtcccttcctcctagggagcctcaggtgccggatccgctgctgagctcccagagacgttcatacgctttcgaaacccaggcaaatccaggcaagggcgaaggactgtag

SEQ ID NO: 203336 - DNA, 2673 bp, Artificial Sequence
  Description of Artificial Sequence: Synthetic coding sequence
atgaagagccggcagaagggcaagaagaagggcagcgccaaggagagggtcttcggatgcgacttgcaggagcatctccagcacagtggccaagaagttccccaggtgctcaagagttgtgccgagtttgtggaggagtatggcgtggttgacggcatataccgcctctcaggggtttcttctaacattcagaaactaaggcaggagttcgagtccgaaagaaagcctgacttgagacgcgacgtgtacctccaagacatccactgtgtctcttccctttgcaaggcctattttcgggagttgcccgacccactgttgacatacaggctgtatgacaagtttgccgaggctgtaggggtccagttggagcccgagcgtttggttaaaattctagaggtcctgagagaacttcccgtgccaaattacagaacacttgagttcttgatgcgccacctggtccatatggcttccttctctgcacagacaaatatgcacgcgagaaatttagctattgtttgggctcctaacctgctccgaagtaaggacatagaagccagcggctttaacggcacagccgcatttatggaagtccgggttcagtcaatcgtcgtggagttcattctgacccacgtggaccagctgttcggcggcgccgccctgagtgggggagaagtagagtctggatggcggtccttgccggggacgcgagcttccggttcccccgaggacctgatgcctaggccactgccttatcacctgccttctattctgcaggccggtgacggcccgccgcagatgcgcccataccataccattattgagatagcagaacacaaaaggaagggatcattgaaggttaggaagtggcgaagtatattcaatctgggtcgcagtgggcatgagaccaagcgcaagcttccaagaggggcggaagaccgggaagataagtccaacaaaggcactctgcggcctgcaaagtccatggactcgctgtccgcagctgccggagcctcggacgagcctgagggactcgtcggaccgagcagtccccgtccaagcccactgctccctgaatcattagaaaacgactccattgaagccgcagagggtgagcaagagccagaggctgaggccctggggggaaccaacagcgagcccggcacaccacgagccggaagaagtgccataagggctggcggctcgagcagagccgaacgttgcgctggagtacatatttccgatccatacaatgtgaatttgcctctccacattactagcatcttgagtgtgccgcccaatattatctccaatgtctcactggctaggctcactcgcggcctcgagtgtccagcgctacagcatcgaccatcccccgcctccgggccgggtccgggcccaggccttgggccaggcccaccagatgaaaagctcgaagccagtcccgcgtcctcccccttagctgattccggccctgacgatttggcccccgccctggaggattccctgagccaagaggtacaggacagctttagctttttggaggacagctcttcaagcgagcctgaatgggtgggcgccgaggatggtgaggtggcgcaagcagaggcagccggcgctgctttttcccctggagaagatgaccccggcatggggtacctagaggaacttctgggcgtcggaccccaagtggaagaattttctgtggaacccccgttagacgacctcagcctggatgaggcccaattcgtgttggcgccaagctgctgcagtcttgacagcgccggtccccgccccgaggtggaagaggaaaacggcgaagaggtttttctgtctgcctatgatgatctatcgcctctgctgggacccaaacctcctatctggaaaggatccgggagtctggagggcgaggcagcaggatgtggaagacaggctttgggacaggggggggaagagcaggcatgctgggaggtcggtgaagataagcaagccgagccaggagggaggctggacattcgcgaggaggccgaaggaaccccccagccccctcaacctgaggagatggaacctgaagggcagccatcacctgatggctgcctgtgcccatgttcactcggtttgggtggagtcgggatgaggctggcgtctacgcttgtgcaggttcagcaggttcgttcagttccggtcgtcccgcctaaaccccagttcgccaaaatgccttccgcaatgtgttcaaagatccacgttgcaccagccaatccttgccccagacctggtcgcctggacgggacaccgggcgagagggcctgggggagtcgggccagtaggtcctcttggcggaacgggggctccttgtcgtttgatgctgcagtggcactggcacgcgacagacaaagaactgaggcccagggagtgcggcgaacacaaacttgcacagaagggggagactactgtcttattcctcgcacgagcccgtgttctatgatctcggctcactcccctcgccctctctcatgtctggaattgcctagtgaaggcgctgagggctccggctcaaggagtaggctgagcctccccccgagggagccacaggtgccagaccccctgctgtccagccaaaggcgcagttacgcattcgagacgcaagcaaatcccggaaagggagagggcctgtag

SEQ ID NO: 203337 - DNA, 1500 bp, Artificial Sequence
  Description of Artificial Sequence: Synthetic coding sequence
atgcggcacctggtgcacatggccagcttcagcgcccagaccaacatgcatgccaggaacctggcaattgtctgggcgccaaaccttctcaggtccaaggatattgaggccagcgggttcaacgggaccgctgcatttatggaggtgcgcgtccagtcgatcgtggtagagttcattctcacacacgtggatcaactgtttggaggagccgccctgtctggtggcgaggtcgagtctggttggcgttcattgccaggtactcgcgccagtggatcccccgaagatctgatgcctcgaccattgccctaccatcttccatccattctacaggcaggtgatggaccaccccagatgcggccatatcacaccattattgagattgcagaacataagaggaagggaagtctgaaagtaaggaaatggcgatccatttttaacttagggcgcagtggccacgagaccaaacggaagttacctcgcggcgcagaggatcgagaggataagtcaaacaagggaaccctacgacctgcaaagtctatggatagcttgtctgcagcagctggtgcctcagacgaacctgagggactcgtgggaccgagcagcccgcgaccctcgccgttactgcctgaatcactcgaaaatgactctattgaggccgcggaaggcgagcaggaaccagaggcggaagcactggggggtacaaactcagaaccagggactccacgggccggaagaagcgccatccgggctggcggatcgagtagagcggaacgttgtgcgggtgtgcacatttctgatccttacaacgtaaacctaccccttcacatcacgagtattctctctgttccaccaaatataatttccaacgtgtcactggcaagactgacccggggccttgaatgtccggccctgcagcatcgacctagtcccgcctccgggcccggtcctgggccagggctcggcccagggcctccggacgagaagctggaggcatctcctgctagttccccgctggctgactctgggccggatgatctcgcacccgctttagaagattccctgtcccaggaggtgcaggattccttcagttttctcgaagactcatcctcctctgagcctgagtgggtgggcgctgaagacggagaggttgcccaggccgaagcagctggagccgccttctcacctggcgaggacgatcctggcatgggctatctcgaggaactgctgggcgttggcccacaggtggaagagttttctgtggaacctccactggatgatctgtctctcgatgaagcacagtttgtgctcgccccaagctgctgttcactggactccgctgggccaaggcccgaggtggaagaggagaacggcgaggaagtgtttctgtcagcctacgacgatctctcccctgccttaggactgctcttgcaaccaggatgggggcaccgcagtcacagctccgagggccagtgtctgagaatcaaggccgtgtttctgtag

SEQ ID NO: 203338 - DNA, 4335 bp, Artificial Sequence
  Description of Artificial Sequence: Synthetic coding sequence
atgaagaacaagggcgccaagcagaagctgaagcggaagggcgccgcctccgcttttgggtgtgatctcaccgagtacctggagtcatcgggtcaggacgtgccatacgtgctgaagagctgcgctgaattcattgagactcacggcatcgtcgatggcatctaccgcctgtcaggagttacatccaacatccaaagacttcgacaggagtttggctcagaccaatgtcctgatctgacccgagaggtctacctgcaggatatccattgcgtcgggagcctctgtaagctgtattttagggagctccccaaccccttactaacttacgaactgtatgaaaaattcactgaggccgtgtctcactgccccgaagaagggcaactggccaggatacagaacgttatccaggagctccctccttcccactatcggaccctggaatatctgatccggcacctggctcacatcgcatcttttagcagtaaaacaaacatgcatgctcgcaacttggccctggtttgggcgccaaatcttcttcgctctaaagagatcgaggccacaggatgcaacggagacgctgccttccttgccgttcgagtgcagcaagtagtgattgagttcatcttgaatcacgttgatcagattttcaataacggagccccaggcagccttgagaacgatgagaaccggccaataatgaagtctctgacgttacccgccctgtccctgccgatgaagttagttagccttgaagaggcccaggcaagatcacttgccactaaccatccagcgaggaaggagcgcagggagaacagcctgccagaaattgtgcctcccatgggcactctctttcatactgtgctggaactgcctgacaataagcggaaactgagtagcaagtctaagaaatggaaaagcatatttaacctgggcaggtctggatcagactcgaaaagcaagctctcacggaatggcagcgtgtttgttaggggccaacgattgtcagtcgaaaaggctacaattcggcctgccaaaagtatggattcactatgcagcgtccccgtagagggaaaagagaccaaaggtaattttaatagaaccgtaaccactggcggattctttataccagccactaagatgcacagcactggcactgggtcctcctgcgacctaactaaacaggaaggggaatggggacaggagggcatgccccccggagccgagggagggttcgacgtctccagcgatcgttcacacttgcagggtgcacaggctagacccccaccagagcagctgaaggtatttcgtccagtggaagaccctgagtcggagcaaaccgctcccaaaatgctgggcatgttctatactagcaacgatagccctagcaaatctgtgttcaccagctcgctgttccagatggagcccagtccacggaaccagagaaaggcccttaacatctctgaacccttcgccgtaagtgtgccactgcgagtcagcgctgtgatttccactaactcgactccttgccgaacgcctccgaaggaactgcagagtctgagtagtctcgaggaattctcttttcatggaagtgaatccggcggatggcccgaagaggagaagcctttaggcgccgaaacttcagctgccagcgtgccgaaaaaagcggggctggaagatgccaaagcagtgcctgaagcccctgggaccgtcgagtgtagtaaagggttaagtcaggagcccggcgctcaccttgaggagaaaaagacaccagagagcagtctgtcttcccagcacttaaatgagctggagaagagaccaaatcctgagaaagtggtagaggaaggcagggaagccggcgaaatggagagtagcactcttcaagagtcccctcgagctcgggccgaggctgtactacttcatgagatggacgaagacgatctggccaacgccctcatctggcctgaaatccaacaggaactgaagattatagaatcagaagaggagttgtcttctttgccaccacccgcattaaagacatctccgatacagcccattctcgaaagctcactcgggccctttatcccctcagaacccccaggcagtctgccttgcggaagctttccggcgccggtgtctacgcctttggaggtgtggacccgagatcctgccaatcaaagtacccagggagccagcacagccgcctccagggagaagcccgagcccgagcaggggttgcaccctgatctggctagcttggcccccctggagatcgtgccatttgagaaagcctctccacaagccacagtggaggttggcggcccaggtaacctgagccctccattgccccctgcccccccaccaccaacacctttggaagagtctacgcccgttctgctctcaaaggggggtccggaaagggaagacagtagccgcaagctaaggactgatttgtacattgatcagctgaagtctcaagattctccagagatctcctctctgtgccaaggagaggaggctactccacgtcactcagacaagcagaacagtaagaatgccgctagcgaaggtaagggatgtggtttcccctcaccaactagagaagtggagatcgtttctcaggaggaagaggacgtgacccactccgtgcaggaaccaagtgactgcgacgaagatgacaccgtcactgacattgcccagcacggactcgagatggtcgagccttgggaggaacctcagtgggttaccagtccgttgcattctcccactttgaaagatgcccataaggcccaggtgcagggactccagggccaccagttggagaagagactgtcccatcggccatcattgaggcagtcgcattccctggattccaagcctactgtgaagtcacagtggactcttgaggtgccgagcagttctagttgcgccaacttagaaaccgaaagaaattccgatccccttcagccccaagcccccaggcgcgagattacaggatgggacgaaaaggcactcagaagctttcgtgagttttcaggtctgaagggcgcagaggctccacccaatcagaaggggccctccggcgtccagcctaacccggccgaaactagccccatttcacttgctgaggggaaggaattgggtacccacttaggccacagcagccctcagatcaggcagggaggagttccagggcctgagtcctcaaaggaatcttcccctagcgttcaggactcaacgtctcctggtgagcaccctgccaagcttcagctgaaatccaccgagtgtggcccgcctaaaggcaaaaaccggccctctagcctgaatttggatcctgctatacctatcgcagacttgttctggtttgaaaatgtggctagctttagcagcccaggaatgcaggtgtccgaaccaggcgatcccaaagtgacctggatgacaagcagttactgcaaggccgatccgtggagggtgtattcgcaagaccctcaggaccttgatatcgtcgcacatgccctcacgggcagaaggaattcggcacccgtgtcagtttctgccgtgcgcacgtcctttatggttaagatgtgccaagcccgtgctgtccccgtgataccacctaagatccagtatacacagatcccacaaccattacccagccagtcttctggggagaatggtgtgcaacccctcgagcgctcccaggagggaccatcctccactagcggtactacccagaagcccgccaaggatgactcgcccagctcactagaatcttctaaagaggagaagccaaagcaagatcctggcgctatcaagagcagcccggttgatgccaccgctccatgtatgtgcgaggggcctactctttctcctgaaccaggctctagcaacctgcttagcactcaggatgctgtggtgcagtgtcgtaagaggatgtcagaaactgagccgagcggagataatctcctgtcctccaagcttgaaagacccagcggcggaagcaaaccttttcatcgtagccgcccaggtcggccgcagtcactgatcttgttttccccgccatttcctattatggaccacttacccccttctagcacagtgactgatagtaaggtgttgctctcacctataagatcacctactcaaactgtaagtcccgggctcttgtgcggcgaactagccgagaacacctgggtgacccccgagggagtcactttaagaaataaaatgacgatcccaaagaatggacagaggctggaaaccagcacatcgtgcttttaccagccccagcggcggtcagtaatattggacggaaggtccggcaggcagatcgagtag

SEQ ID NO: 203339 - DNA, 3300 bp, Artificial Sequence
  Description of Artificial Sequence: Synthetic coding sequence
atgaagaacaagggcgccaagcagaagctgaagcggaagggcgccgcatcagcattcggctgtgatctcacagaatatcttgaaagctcgggtcaggatgttccctatgtattaaaatcgtgcgcggagtttatagagacacatggcatcgtggacggcatctaccgattaagcggagtgacgtccaatatccaaaggttgcgacaagagtttggcagtgaccagtgcccagaccttacgagagaagtatatttacaggacatccattgcgtgggtagtctgtgtaaactgtacttcagggagctacctaacccgctgcttacgtacgaactttatgagaagtttaccgaggccgtctcccattgtccggaggaaggtcagctggcccgtattcagaatgtgattcaagagctgccaccatctcactacaggactttagagtacctgattcgccaccttgcccacatcgcatcattctcatcaaaaactaatatgcacgcacggaatctagctcttgtgtgggccccaaatctactgcgctctaaagaaatagaggccactgggtgcaacggcgacgcggcgttcctggcagtgcgagtccagcaggtggtcatcgagttcattctgaaccatgtagatcaaattttcaataacggtgcaccagggtccctcgagaatgacgagaaccggccaattatgaagtcacttaccctccctgctctaagcctgcccatgaagctggtcagcctagaggaggcccaagctaggagccttgctaccaatcatcctgccagaaaagaacggcgagaaaactccttacctgagatagtgccaccgatgggcactctcttccataccgtcctcgagctacccgataacaaacggaagctaagttcaaagtcaaagaagtggaagagcatcttcaatcttggccggtctggcagtgactccaagtctaagctctcaagaaacggcagcgttttcgtgaggggccaacgcctgtcagtcgaaaaggctaccatacgcccagccaagtcaatggatagcctctgtagcgtgccagtggaggggaaggagactaaggggaatttcaatcgcacagtcactacgggtggattctttatcccagcaaccaagatgcactccacaggcactggcagttcttgcgatctcaccaaacaggagggcgagtggggccaggagggaatgccgcccggtgcagaaggtggtttcgacgttagctctgaccgctcacacttgcagggcgctcaggctaggccaccaccagaacaacttaaggtattccgaccggtagaggatcccgagtcagaacaaacagcacccaagatgctgggcatgttttacacttccaatgatagccctagcaaatcagttttcaccagttccctgtttcagatggagccgagcccacgcaatcagcgcaaggcactgaatatcagtgagccttttgctgtatcagttccactgcgcgtgtcagcggtgatctccaccaattctacaccctgtagaactcctccaaaagagttgcaatctctcagttccctcgaagaattttccttccacgggagtgagagcggagggtggcccgaggaagaaaagcccctcggagctgagacaagcgccgctagcgtgccaaagaaggctggccttgaggatgccaaagccgttcccgaggcgcctggtaccgtcgagtgctcaaaagggctttcacaagagccaggagcgcatctagaagagaagaagactcctgagtcgtccttgagcagccagcaccttaatgagcttgaaaagcgacccaatcctgaaaaggtggtggaagaggggcgtgaagccggagaaatggagtcatccaccctgcaggaaagtccgcgcgccagagcggaggccgtgcttttacatgagatggatgaggatgatctggcaaacgccctgatttggccggagatacagcaagagttaaaaattatagagagtgaggaagagctctctagcctccctcccccagcgctgaagaccagccccattcagcccattctggagtcaagtctcggacccttcattccctccgaacccccggggagcctgccctgtgggtcctttcctgctcccgtgagcaccccactggaggtttggactagggatcctgccaaccagagcacccagggcgcaagtactgcggcatcacgtgagaaacccgagcccgagcaaggactccatccagacctggccagcctagccccgttagagattgttcctttcgagaaagcctcacctcaggctaccgttgaagtgggaggtccgggtaacctctcaccccctttaccacctgcccctcccccaccaacacccttggaggaatctaccccagttctgctcagcaagggaggacccgagcgtgaagatagtagccggaagctgcgcaccgatctatatatcgaccagctgaaaagccaggacagccccgaaatcagctccctttgccagggtgaggaagctacccctaggcatagcgacaagcaaaattccaagaacgccgctagcgaaggaaaaggatgtggattccccagtcccacgcgagaggttgaaattgtttcacaggaggaggaagatgtgacacacagcgtgcaggagcctagtgactgtgatgaagacgatactgtgacagatatcgctcaacacggtctagagatggtggagccatgggaagaacctcagtgggtgacatccccacttcatagtcctacactcaaagatgcccacaaggcacaagtgcaaggactacaagggcaccaacttgagaagcgcttatcccacagaccctcgctacgccagtcccactctctagacagtaaacctacagtgaaatcccagtggacattggaagtcccttcctcttcctcttgtgctaacttggaaaccgagcgaaactcagaccccttgcagccccaggctccaagacgggagatcaccgggtgggatgaaaaagccctgcgtagcttccgtgagttcagcggcctgaagggcgctgaagctcctcccaatcaaaagggccctagcggggtccagcccaaccccgcacagcccgtcggccctttaaggaatctgccaaagatgattcttcctccaccctggaaggctcagagaaaaaaaaaccaatccaaaattccagagcccctgtctcctcaccagtggatgcccctgcacccggcttgtgctagggacctgccgttcctgcagaatcaagcacggctgacgtgtagtcccccccgcatgcagtag

SEQ ID NO: 203340 - DNA, 4509 bp, Artificial Sequence
  Description of Artificial Sequence: Synthetic coding sequence
atgatggccaagaacaaggagccccggccccccagctacaccatctcaatagtggggctctccgggaccgagaaagataagggaaattgtggtgtggggaaaagctgtttgtgtaataggttcgtacgaagcaaagccgatgagtactatcccgagcacacttccgtattatccaccatcgatttcggtggccgggttgtcaacaacgaccacttcctgtattggggggacattattcagaattcagaagacggtgtcgaatgcaaaattcatgttattgagcagacagagtttattgatgaccaaacctttctcccacacagaagcacaaacctgcagccttatataaagcgggctgccgcaagtaaactgcagtcagcggagaaactgatgtatatatgcactgaccagttaggccttgagcaggactttgagcagaagcagatgccagagggaaagctgaatgtggacgggtttctcctgtgtatcgatgtgtcacagggatgtaatcgcaagttcgacgaccagctaaagttcgtcaataatctttttgtgcaactgagcaaatccaagaaacccgtaattatagctgccacgaagtgcgatgaatgcgtagatcactacctgagagaggtccaggccttcgcctccaataaaaaaaatctgctggttgtggagactagtgcacgttttaacgtaaatattgagacctgctttacagccctagtgcagatgttggataagacaaggtccaagcccaaaattattccctacctggatgcatataagacccagaggcaacttgtggtaactgctaccgacaaattcgaaaagcttgtccagaccgtgagggactatcatgctacctggaagacagtgtccaataaacttaaaaatcatccagattacgaggaatacattaacctggaaggtacccgaaaggcccgtaatactttcagtaagcatatcgaacagctcaaacaggaacatatacggaagcgtagagaagagtatattaatactcttcctcgggctttcaacactcttttgccaaacctggaggagatcgaacacctgaattggtctgaggccctgaaactgatggaaaaacgggccgacttccagctgtgctttgttgtcctggaaaagacgccgtgggatgaaactgatcatatcgataagatcaatgataggcggataccctttgacctgctcagtaccttggaggccgaaaaagtctatcagaaccatgttcagcacctcatctcggagaaaagaagagtggaaatgaaagagaaatttaagaagaccttagaaaagatacagttcatttcccctggccagccatgggaggaggtgatgtgttttgtcatggaggacgaagcctacaaatatattactgaggctgacagtaaagaagtctacgggagacatcagagagagattgttgaaaaagcaaaggaggagttccaggaaatgctattcgaacacagcgaactgttttacgacctggacctgaatgccactcctagttctgataaaatgtcagagatccacactgtattgagcgaagaacccagatataaagctctccagaagctggcacccgatcgcgaaagtctcctgctgaagcacatcggattcgtgtaccaccctaccaaggagacatgcctttcagggcaaaattgcaccgacattaaggtcgagcagctgctggcatcttcccttctgcagctggaccatggcaggcttagactgtatcatgatagcaccaatatcgacaaggtgaatttgttcatactggggaaagatggcttagcacaagagctcgccaacgagatccgtacacagtctaccgacgatgagtacgcactcgatggcaagatctatgaactggatctgagacctgttgatgccaagagcccatatttcctttctcagctgtggacagccgcatttaagccacacggttgtttttgcgtgttcaacagcatagaaagcctaagctttattggagaattcatcggcaagattcgtactgaagcttcccaaatccgaaaagataaatatatggcgaatctccctttcactttgatcctcgccaatcaacgggacagtatttctaagaatctgcctatcttgaggcatcagggacagcagcttgcaaataaactgcagtgtccttttgtcgacgtgccagccggcacatatccacgaaagtttaacgaaacccagatcaagcaggcactgcggggggtgctggaatctgtcaagcacaacctggacgtcgtgtctcccatacctgcaaataaggatctgagcgaagcggacctccgcatcgtgatgtgcgcgatgtgtggggaccctttctccgttgatctcattttatccccattcctggacagtcattcctgcagcgcagctcaggcaggtcagaataattcgctgatgctggacaagatcatcggcgaaaagcgacgacggattcaaatcacaatactctcctaccattccagtattggcgtgcggaaggacgagctcgtgcacgggtatatcctcgtatacagtgctaaacggaaggcatcgatgggcatgttgcgtgcatttctgagcgaggttcaagacaccatccctgtacagctcgtagcagtcacggactcccaagctgatttctttgaaaatgaggccatcaaggaattaatgacagagggagagcatatagccactgagatcactgcgaaatttacagcactatactctttatcacaataccacagacagaccgaagtgttcactctctttttctcggatgtcttagaaaaaaaaaatatgatagagaatagttacctttccgataacaccagagagtccactcaccagtctgaggatgtattcctgccgagccctagggactgttttccatacaataactatccggactccgacgacgataccgaggccccgcccccttatagccctataggggatgacgtgcagttgttgcctactcctagtgaccgttctaggtaccgccttgaccttgagggcaatgagtatccaattcacagcacccctaactgccacgaccatgaaagaaatcacaaggtgccacctcctataaaacctaagccagtcgtccctaaaacaaacgtcaagaagctggaccccaacctgttaaagacaattgaggccgggatcgggaaaaatcctcgcaaacagacatctcgagtgcccctagcccatcccgaagatatggacccctcggacaactacgcagagcctatcgacaccatcttcaaacagaagggctacagtgatgagatctacgtggtcccagacgattcccagaacaggattaagatccgcaatagtttcgtcaataatactcaaggcgacgaagaaaatgggttttccgatcggacgtccaaatcgcacggagagcgacgcccttctaagtataagtataaatctaaaactttatttagtaaggccaaatcttactatcgcagaacacattcagacgcaagcgacgatgaggcattcactacctccaagacaaaaagaaaaggaaggcataggggatccgaagaggatccactactcagccccgtcgaaacttggaaaggcggaatcgataaccctgcaatcactagcgatcaggaactggacgataaaaagatgaagaaaaaaacccacaaggttaaagaagataagaagcagaaaaagaagaccaagaacttcaacccccctacacgtcgtaattgggagtctaattattttggcatgcccctccaagatctggttacagccgaaaagcccattcctctgtttgtggagaagtgcgtggaattcatcgaagacaccggactctgcaccgaaggcttgtatcgagttagcggcaacaagaccgaccaggataatatccagaagcaatttgatcaggaccacaatatcaacctcgtgagtatggaagtgactgttaatgctgtcgcaggagccctcaaagccttttttgcagaccttcccgaccctctcattccttactctttgcaccctgaactcctggaagccgcaaagatcccagataagacggagcgcctccatgcccttaaggagatcgtcaaaaagttccaccctgtgaattacgacgtgtttcggtacgtgatcactcatctcaacagagtgtctcagcaacacaagatcaatctgatgaccgctgacaatcttagtatttgcttctggccgaccctgatgcgaccagactttgaaaatcgcgagttcctatccacaactaagatccatcaatctgtggtcgagacttttatccagcagtgtcagttcttcttttataacggcgagatcgttgaaaccacaaatattgtagcgcccccgccaccgagcaatcctggtcagctggtagaaccgatggtcccgctccagctcccgcccccactgcagccacaattaatccagccccagctgcaaactgacccgctggggatcatatag

SEQ ID NO: 203341 - DNA, 714 bp, Artificial Sequence
  Description of Artificial Sequence: Synthetic coding sequence
atgagcctgcccccccccccccccggccccctgcccctgcggcggcggagacggcggcccacccttctcggactctgtaccgaagggttgtaccgggtctcgggaaacaagacagatcaggataatattcagaagcaatttgaccaggatcacaatattaacctggtgagcatggaagtgacggtaaatgcagtcgcaggggcactgaaggccttctttgctgatctccctgaccccctgattccttacagcctgcatcctgaactcctggaggcggcgaaaattccagacaagacagagcgattgcacgcacttaaggagattgtgaagaaattccatcctgtgaattacgatgtctttagatatgtcatcacgcatttgaatagggtgtcccagcagcacaaaatcaatctcatgactgctgataatttaagtatctgtttttggcccaccctgatgcgccccgacttcgagaatagagaattcctcagcacaacaaaaatccaccagtcggttgttgagacattcattcagcaatgccagtttttcttttacaacggcgagattgttgagactaccaacatcgtagcccccccacccccatctaatccgggacagcttgtggaaccaatggtccccttgcagcttccaccacctctgcagccccagctgatccaacctcagcttcagacggatcccctgggaataatttag

SEQ ID NO: 203342 - DNA, 4506 bp, Artificial Sequence
  Description of Artificial Sequence: Synthetic coding sequence
atgatggccaagaacaaggagccccggccccccagctacaccatctccatagtcggcctgagcggtaccgaaaaagacaaaggcaattgcggcgtggggaagagctgtctgtgtaatcggttcgttagatctaaagccgacgagtattaccccgaacacacgagcgtgcttagcacaattgacttcggggggagggtggttaacaacgaccatttcctctattggggcgatatcattcagaatagcgaagacggggtcgaatgcaagatacatgttattgagcagaccgagttcattgacgaccagacctttctgccccacagaagcactaatcttcagccctatatcaagagagcggcagcgtctaagctgcagtccgctgagaagctgatgtacatttgtacggatcaacttggattggaacaggattttgaacaaaagcaaatgccagagggcaaactgaatgtcgacgggttccttctttgcattgatgtgtcccagggctgcaaccgtaagttcgacgaccagctcaagttcgtgaataacctcttcgtacagcttagcaaaagtaagaaacctgtcattattgccgccacaaaatgtgacgaatgtgtggatcattatctgcgggaggtacaagcctttgccagcaataagaaaaacttgttggttgttgagactagcgctcgttttaatgtgaacatagaaacctgcttcactgcattggtgcagatgctcgataagactagaagtaagccaaagattataccatacctggacgcttataaaacacaacggcagctggtagtgacagccactgataaatttgagaagttagtgcagacggtccgcgattaccacgccacatggaagactgtttctaataagcttaagaaccatccggattatgaggagtacataaacctggaaggcacgcgaaaggctcgtaacaccttctctaaacatatcgaacagctgaagcaagagcatattagaaaacggagagaggaatacatcaacacactccccagggcctttaataccttgctgccaaacctggaggaaatcgagcaccttaactggagtgaggcactaaagctaatggaaaagagggctgacttccagctgtgcttcgttgtgcttgagaaaactccttgggacgagacagaccatattgataagatcaatgaccggagaatccctttcgacctgctctcaaccctggaggcagaaaaagtgtaccagaaccatgtgcagcatctgataagcgaaaagaggcgcgttgaaatgaaagaaaagtttaagaagacacttgagaaaatccagttcatttctcctggacagccttgggaagaggtgatgtgctttgtaatggaagatgaggcctataaatacattacggaagcggattcgaaggaggtctacggcagacaccaaagggagattgtggagaaggccaaagaggaatttcaggagatgctgttcgaacactctgagcttttctacgatcttgatctgaatgccaccccgagctctgacaaaatgagcgaaattcatacagtgttgtccgaagagccgcgctacaaagccctacagaagttggcgcccgacagggaatcactgttgctgaagcacatcggtttcgtataccacccaactaaagagacatgccttagcggccagaactgtactgacattaaagtggagcagttgctggcttcaagcctgctccagttggatcatgggcggttgagactttaccacgacagcaccaacattgacaaagtgaatctgttcattcttgggaaggatggtttggcccaagagttagctaatgaaattcggactcaaagtaccgacgatgaatacgctctggacggtaagatttatgagctagatctacggcccgttgacgccaagagtccatactttctctcacagttgtggaccgcagcgtttaaaccacatggctgtttctgtgtatttaatagtatcgaaagcctgtctttcatcggagaattcatcggcaaaatcaggacagaagcttcacaaattcgcaaagataagtacatggccaatctaccattcaccctcattctagcgaatcaacgggattctattagcaaaaaccttcccatcctgcggcaccagggacagcagctcgcaaataagctgcagtgcccattcgttgacgtgccagctggtacgtatcctagaaaattcaacgagacccaaattaaacaggctctgagaggagtcctcgagagcgtgaaacacaacttggatgtggtttctcctatcccggctaataaagatctcagtgaagcagacttgagaatcgtgatgtgcgctatgtgcggtgaccccttcagcgtcgacttgattctgtcaccattcctggactcacactcttgctctgcagcacaggccggtcaaaataactccctaatgctggataaaatcatcggcgagaagaggcgcaggatccaaattaccatcttgtcctaccactccagcataggtgtaaggaaggatgaactcgtgcacggatacattctcgtttacagtgctaagcgcaaagcttctatgggtatgttgagagcattcctgtccgaagttcaggacacgatcccggtgcagctcgtcgctgtgacagacagccaggctgattttttcgaaaatgaagcaataaaagagctgatgacagagggggagcacatagccacagagatcaccgcgaaattcacggccctgtactcgttgtcccagtatcaccgccagactgaggttttcacactctttttcagcgacgtgttggagaaaaagaacatgatcgagaatagttacctctcggataatacacgcgagagcacccaccagtccgaagatgtgtttctgccttccccccgggactgcttcccctataacaactatcccgacagtgatgatgacacagaggcaccccccccttatagcccgataggcgatgatgtgcagttactgccgacccctagcgacaggtcacgatatcggctagaccttgagggaaacgagtatcccatccactccacacctaattgtcacgaccacgagaggaaccataaggtccctccaccaattaagcctaagccagtcgtaccaaagactaatgttaagaaactcgatccgaatctgctgaaaacaatcgaagccggaattggcaagaacccgcgcaaacagactagcagagtgccgctcgcacatccggaggatatggaccccagtgacaattacgctgaacccatcgatacgatctttaagcaaaagggctactcggatgagatatacgtggttcctgacgattcacagaatcggatcaaaattcggaattcgttcgtgaacaatactcagggagacgaggagaacggcttctccgaccgaacctcaaaatctcacggagagagacggcctagcaaatacaagtacaagtccaaaacccttttctccaaagccaagagttactaccgtcgcacacatagtgacgctagcgacgacgaggcttttaccacctctaaaacaaaacgcaaaggccgtcatcgaggtagtgaagaagacccactgctttcccccgtggaaacgtggaaaggagggatcgacaacccagccattacaagtgaccaagaactggacgacaaaaagatgaaaaagaagactcacaaagtgaaagaggataaaaaaaaaaagaaaactaagaactttaaccctcctacccgccgaaactgggagtcaaactattttgggatgccactgcaggatcttgtgaccgctgagaaacccatccctctgttcgtggaaaagtgcgtggaatttattgaagacactgggctgtgtaccgaggggctatatagagtctccggcaataagacggaccaggataacatccagaagcagtttgatcaggaccataatataaatctagtctcaatggaagtgactgttaatgcagtagcgggcgccctgaaggccttcttcgccgatttacccgacccactgataccctactcccttcatccggaactgctcgaagctgcaaagatccccgataagacagagcggctgcacgctctgaaggagattgttaagaaattccatcccgtgaattatgatgtcttccggtacgtgatcacccatctgaatcgcgttagtcagcaacataagattaatttaatgacagctgataacctttccatttgtttctggcccacactgatgagacctgactttgaaaacagagaattccttagtaccacaaagatccatcagagcgttgtcgaaaccttcatacagcagtgccagttttttttctacaacggtgagattgtggagaccacaaacatcgtcgcgcctcctccaccatccaacccaggccagttggttgagcccatggtgcccctccaattgcctcctccactgcagccccagctaattcagcctcagcttcagaccgatcctctcggcattatatag

SEQ ID NO: 203343 - DNA, 726 bp, Artificial Sequence
  Description of Artificial Sequence: Synthetic coding sequence
atgcccctgcaggacctggtgaccgccgagaagcccatccccctgttcgtggagaagtgcgttgaattcatcgaggatacaggtctgtgtaccgaggggctgtacagagtaagcggaaataaaactgaccaagacaatattcagaagcaatttgatcaggatcataacattaatctagtgtcgatggaggtcacagtgaatgcggtggccggggcgctcaaagcattctttgcagatctcccagacccactcatcccttacagtctccacccagaactgttggaggcagcgaagattcccgacaagacagaacgcctccacgctcttaaggaaatcgtgaaaaaatttcatcccgtgaactatgacgtgttccgatacgtcatcacccatcttaatcgggtgagtcagcagcataaaatcaacctaatgacagctgacaatttgtctatatgtttctggcctacgctgatgcgccccgattttgagaacagagaatttctgtcaacaaccaaaatccatcagagcgtggtagagacattcatacagcaatgccagttctttttctataacggcgagatcgtggagacgactaacattgtggccccaccccctccaagcaaccctggacagcttgttgaaccaatggtacctcttcagttgcccccccccctccagccccagctcattcaacctcagctgcaaacagatcccctgggcatcatctag

SEQ ID NO: 203344 - DNA, 4509 bp, Artificial Sequence
  Description of Artificial Sequence: Synthetic coding sequence
atgatggccaagaacaaggagccccggccccccagctacaccatcagcatcgtggggctctcgggcaccgagaaagacaaaggcaactgtggggtaggaaagagctgcttgtgtaatagattcgtacggtccaaagccgacgagtattaccctgaacatacaagcgtgctgagtacaatcgatttcggtggacgcgtcgtgaacaatgaccatttcctgtattggggagatatcattcagaactctgaagacggagtcgagtgtaaaatacatgtcattgaacagactgaattcatcgacgaccaaacattcttgccccatagatcgactaacctgcagccttacatcaaacgcgccgctgctagcaagttgcagtccgcagaaaagctaatgtatatctgtactgatcagcttggactggaacaggatttcgaacagaaacagatgccggagggcaagctgaacgtggatgggttcttgctctgcatcgacgtttcccaaggatgcaataggaaattcgacgatcagttgaagttcgtcaataatctgtttgtgcagctcagcaagtctaaaaagcccgtaatcattgcggccactaagtgtgacgagtgtgttgaccactacctgcgcgaggtccaagctttcgcaagtaacaaaaaaaacctccttgtcgtggagaccagcgcacgctttaacgtcaacattgagacatgttttacagccctggtgcagatgctggacaagacccgatccaaacccaagattattccttacttggatgcctacaagactcagcgacagctggttgttacagcaaccgacaaattcgagaagctggtccagacagtgcgcgactaccatgctacatggaaaacggtctccaacaagctgaagaaccaccctgactacgaggagtatatcaatcttgagggcacccggaaggccaggaatacattttctaaacacatcgagcagcttaaacaggaacacattcgcaaacgcagagaggaatacataaataccttgccacgcgcctttaatacacttcttcccaatcttgaagaaatagagcatctaaactggtccgaagcattgaagctgatggaaaagcgggctgactttcagctgtgcttcgtcgtgctcgagaaaaccccgtgggacgaaaccgaccacatcgacaaaattaacgaccgccgcatccctttcgacctgttatctaccctggaagctgagaaagtgtatcagaaccatgtccagcacttgataagtgagaaaagaagggtggagatgaaggaaaagttcaagaagactctcgagaaaatacagttcataagtcccggccagccttgggaagaggtgatgtgctttgtcatggaagacgaagcttacaaatacataaccgaggccgactctaaggaagtgtatgggagacaccagcgagaaatcgtggaaaaggccaaggaagaatttcaggaaatgctgttcgaacactcagaattgttctatgatctcgacttgaacgccaccccgtcctcagataagatgagtgaaattcacacggtcttgtcagaagaaccgcgctataaagcgctgcagaagctggcgccggaccgagaatctctgctcttgaagcacattggctttgtctaccatcccacgaaagagacttgcttgagcggtcagaactgtacagacattaaggtggaacagctcctggcttctagtctgcttcagctggatcatgggcggctgaggttatatcacgattcaacaaacatcgataaggtgaatctgtttattctggggaaagacggactggcacaagaactggccaacgaaatcagaacccaatcaactgatgatgaatacgctcttgacggcaagatttatgagctggacctgcggcctgtggatgctaagagcccttactttttgtctcaactctggaccgccgcattcaagccccatgggtgcttctgcgtgtttaattccatagagtctctaagctttatcggggagtttattggcaagatccggactgaagcatcccaaattagaaaggataagtacatggccaacctgccttttaccctcattttggcgaatcagcgcgacagtatctccaagaacctccccatacttcgccaccagggacaacagttagcgaataagctgcagtgtccattcgtggacgttccagctggaacgtaccccaggaaatttaacgaaacccagataaaacaagctttgaggggggttctggaatctgttaagcacaacttggatgtggtgtctcccatacctgcaaataaagatctcagcgaggcggatcttcggattgtcatgtgtgccatgtgcggagaccccttctcagtagaccttatcttaagtcccttcctcgactctcatagctgttcagctgctcaggctgggcaaaataattccctgatgttggacaagatcattggcgaaaagagaaggaggatacaaatcacaatcctgagctatcattcatccatcggtgtacgaaaagacgaacttgtccatggatacatactggtatattctgccaaaaggaaggcttccatgggtatgttgagagccttcttgtcagaagtgcaagataccattcccgtccaacttgtagctgtcactgattcacaagctgatttctttgagaacgaggcaataaaggagctgatgaccgagggcgagcacatagccaccgagatcacggccaagttcactgcattatatagtctgtctcaataccaccgccaaacggaggtcttcaccctgttcttcagtgacgtgttagagaagaagaatatgatcgagaacagctatttgtctgataatacccgggagtcgacccatcagagcgaagatgtcttcctgccaagcccaagagattgtttcccctacaacaattaccctgacagcgatgatgataccgaggctccccccccttacagtcctattggggatgacgtccagctcctgcccaccccctcggataggtcccggtataggttggatttagagggcaacgaataccctattcactccacccccaattgccacgaccacgagcgaaaccataaagtaccgccgcccatcaaacccaagcccgttgtacctaagacaaatgttaaaaagttggatcccaacttgctcaagactatcgaagccggcatcggaaaaaatcctcggaagcagaccagccgtgtgcccttggcccacccagaggacatggacccatccgataattacgccgagccaattgatacgatctttaagcagaaaggttacagcgacgagatttacgttgttccagacgatagtcagaacagaatcaaaatccggaattctttcgtaaataatacgcagggagatgaggaaaacggctttagtgatagaacgagcaagagccacggggagaggcgtccctccaaatacaaatacaagtcgaagaccttgttttcaaaggcaaaatcttattaccggagaactcacagcgatgctagtgatgacgaggccttcacaacgtcaaagacaaaacgaaaagggagacatagaggtagcgaggaagacccccttctgagtcccgttgagacctggaaaggggggatagataatcccgcaatcacctccgaccaggaactcgatgacaagaagatgaaaaaaaagactcacaaagttaaagaagataagaagcagaagaagaaaacaaagaactttaatccacctactcggcgcaattgggagtcaaactacttcgggatgcccttgcaggacctagtgacggctgagaaacctatcccattgtttgtcgaaaaatgcgtggaattcattgaggataccgggctgtgcacagaaggactgtaccgggtatcagggaataaaaccgaccaggacaatatacaaaagcagtttgaccaggaccacaatatcaatcttgtcagcatggaagttaccgtgaacgctgtggctggggctttgaaggccttctttgcagatctgcccgatccgctgatcccatacagcctgcacccggagctcctggaagccgctaaaatacctgataagacagagcgactacatgccctcaaggagattgttaaaaaattccaccccgtgaattacgacgtgttcagatatgtgatcactcatttgaatagagtgagccagcagcacaagattaacctgatgactgcagataacctgagcatctgcttctggcccaccctgatgagacccgattttgaaaaccgcgaattcttaagtacgactaagattcaccagtccgtcgtggagacatttattcagcagtgccagttcttcttctacaatggggagatcgtagagaccacaaacattgtagcccccccccctccaagcaatcccggacagctggtggagccaatggtgcctctgcagctccctcctccccttcagccacagctgatccaaccgcagcttcagactgaccctcttggaatcatctag

SEQ ID NO: 203345 - DNA, 414 bp, Artificial Sequence
  Description of Artificial Sequence: Synthetic coding sequence
atgcccctgcaggacctggtgaccgccgagaagcccatccccctgttcgtcgaaaagtgtgtggagtttattgaagacactgggctgtgcaccgaaggcctctaccgcgtgtctgggaacaagactgaccaggataatattcaaaaacagttcgaccaggaccataatatcaaccttgtctctatggaggtgacagtcaacgcggtcgcgggggcactcaaggccttcttcgccgatctgcctgatcctctgattccatactctctgcatccggagctgctggaagccgccaagattcccgacaaaacagaacggctccatgccctgaaggaaatcgtgaaaaaatttcatcccgtaaactacgatgtattccgctatgtgatcacacacctgaacagagtgtctcagcagtag

SEQ ID NO: 203346 - DNA, 114 bp, Artificial Sequence
  Description of Artificial Sequence: Synthetic coding sequence
atgatggccaagaacaaggagccccggccccccagctacaccatctcaatcgtggggttgagtggaacagaaaaagacaaggggaattgtggcgtcggaaaaagctgcttgtag

SEQ ID NO: 203347 - DNA, 423 bp, Artificial Sequence
  Description of Artificial Sequence: Synthetic coding sequence
atgatggccaagaacaaggagccccggccccccagctacaccatcagcattgtcggactctccggtaccgaaaaggacaagggaaattgtggcgtgggcaaatcatgtttgtgcaatcgttttgtgaggtcgaaagccgacgaatactatcccgagcatacctccgtgttgtctaccatcgactttgggggcagggtggtcaacaacgaccacttcctctactggggggacatcattcagaatagtgaagatggggttgagtgtaagatccacgtgatcgagcagacagagtttatcgatgaccagaccttcctcccccaccgcagtaccaatttgcagccctatataaaacgggccgctgcctctaaattacagagcgctgagaagctcatgtatatctgcacagatcagttaggactgtag

SEQ ID NO: 203348 - DNA, 4506 bp, Artificial Sequence
  Description of Artificial Sequence: Synthetic coding sequence
atgatggccaagaacaaggagccccggccccccagctacaccatcagtatcgtgggtctgagtggcacagagaaagataaaggtaactgtggggttggaaaatcctgtctatgcaatagattcgttaggagtaaagctgatgagtactaccccgagcataccagtgtgttgtccaccatcgactttggcgggagagtggtaaataacgaccattttctctactggggggatatcatccagaattccgaagatggagtcgaatgtaagatacatgtcattgaacagactgaattcatcgacgaccaaaccttcctgcctcatcgcagtaccaatctccagccgtatattaagagagcggccgctagtaagctgcagagtgccgaaaaactgatgtatatttgtaccgaccagctcggcttggagcaagactttgagcagaaacaaatgccagagggcaagctgaacgtggacgggttcctactgtgcatagacgttagtcagggctgtaacagaaagtttgacgaccagctgaagttcgtcaataaccttttcgtgcagctgtctaagtcaaagaaacctgtgattattgccgctacaaagtgcgatgaatgcgtggaccactacctacgggaagtgcaagctttcgccagcaataagaagaacctgctggtcgtggaaacttccgctaggttcaatgttaatatagaaacttgtttcacggccctcgtgcaaatgctggacaaaaccagaagcaagcctaagatcatcccgtacctcgacgcatacaagacacagcgacagctggtggtgaccgccaccgataaattcgaaaagttggtgcaaaccgtcagggactaccacgcaacgtggaagaccgtttctaacaagctcaagaaccatccggactatgaggaatacattaatctggaggggactagaaaggctaggaacacattttcgaaacacatcgagcagttaaagcaagaacacattaggaagcgcagggaggagtacattaacactttgccaagagccttcaatacccttctccctaatctcgaagagattgagcacctgaattggtcagaagccctgaaactgatggagaagagagccgactttcaactgtgttttgtggttcttgaaaaaaccccatgggacgaaacagaccatattgacaagattaatgatcggcgcatcccctttgacctcttgtcaacactagaggcagagaaagtctaccaaaatcacgttcagcacttgatctcagaaaagagacgagttgaaatgaaagaaaagtttaagaaaaccctggagaaaattcagtttatctctccaggccagccatgggaggaagtaatgtgtttcgtgatggaggatgaggcttataagtacatcacagaggcggattccaaggaagtctacggacgtcatcagagagaaatagtcgagaaagccaaagaagaattccaggaaatgttattcgaacactcggagcttttttacgatttggacctgaacgccacacccagtagtgacaaaatgtctgaaatccataccgtgctgagcgaagaaccccgatataaggccctgcagaagctcgccccagatagagagtcgttgttactaaaacatatcggattcgtctatcacccaacaaaggagacttgcctgagtggccagaattgcaccgacattaaggtggaacaattgcttgctagttctcttctccagctggatcacggccgcctaagactctaccacgactccactaatattgataaggtgaacctctttatcctcggcaaagatggcttggctcaggagctggccaacgagattaggacgcaatcgacagacgatgagtacgcactggatggcaagatctatgagctggacttgaggcctgtcgatgctaaatctccgtatttcctgagccaactatggacagctgcttttaagccgcacggatgtttctgcgtatttaattccatcgagtccttgtcattcataggcgagttcatcggaaaaatccggaccgaagcatcacaaatacggaaggataagtacatggctaacctccctttcaccctgatcttggccaaccaacgcgactccattagtaagaatcttccaatcctgcggcatcagggacagcagctggccaacaaactccaatgccccttcgtagacgtgccggccgggacttacccgagaaagtttaacgagacacagattaagcaggctctgcgaggagtgctcgagtcagtaaagcataacctggatgtcgtgtctccgatccccgccaacaaggatcttagtgaagcggacctccgcatagtcatgtgcgctatgtgtggtgaccctttctcggtggacctgatacttagtccatttttagacagccattcttgttcagctgcccaagccggccagaacaatagcctaatgcttgacaagatcatcggcgagaagcgaagaagaatacagattacaattctgagctatcactctagcatcggagtgcggaaggatgaactcgtgcacggctacatccttgtgtactcagcaaaaagaaaagcaagcatgggcatgctgagggcatttctgtcggaagtgcaggataccatccccgtccagctggtcgccgtgaccgactcccaggccgacttctttgaaaatgaggccattaaggaactgatgaccgagggggaacatatcgctacagagataacagcgaagttcacagcactatatagcctgtctcaatatcatcgtcagaccgaggtcttcaccctattttttagcgatgttcttgaaaaaaaaaacatgattgaaaactcttatctgtcagacaatacgagggagagcacccaccagtcagaggatgtatttctaccgagtccccgggattgtttcccatacaacaattaccctgatagtgacgatgataccgaagcaccccctccttatagccccattggggacgacgtgcagcttttacctaccccttcagaccggtcaagatacaggctggacttggaaggtaacgaatatccaattcacagcactcccaattgccatgaccacgagcgcaatcataaagtacctccccccatcaagcccaagcccgtggtgcccaaaaccaacgtgaagaaactggaccccaatttattaaagaccatcgaagctggcataggcaagaacccccgaaagcagacttctagagttcctctggcacatccagaggacatggatccctccgataactatgccgaacccatcgatactattttcaagcagaagggctattctgacgagatatatgtcgtgccagatgattcccaaaataggattaagattaggaattctttcgtcaacaatacacagggcgacgaagagaatggattcagcgaccgaacatcaaagtcacatggggaaaggaggcccagcaaatataaatataagtctaaaaccttattctccaaggctaaaagctattacaggcggacacacagtgatgcttccgacgatgaagcatttacaacctctaaaactaaaagaaagggccgacacaggggctccgaggaagatcccctactctcacctgttgagacctggaagggcggaatcgataacccagcaattacatctgatcaggagcttgacgacaagaagatgaagaagaagacccataaggtaaaggaagacaaaaagaaaaagaagactaagaattttaatccacctactaggcgaaattgggagtccaactatttcggcatgcctttgcaggacttggtgacagccgagaaacccattcctctgtttgtggaaaaatgtgtagaatttattgaggacactgggctatgtacggaagggctgtaccgggtgagtgggaataagacagaccaggataatattcagaaacagtttgatcaggaccataatatcaacctagtgagtatggaggtgactgtcaatgccgttgcaggcgccctgaaggcctttttcgccgacctgcccgacccattgatcccgtactctcttcacccggagctcctggaggcagccaagattcccgacaaaacggaacgactccacgccctgaaggaaatagtgaaaaaattccacccagtcaactacgatgtctttagatacgtgattacacatttgaatcgcgtttctcagcaacacaagattaacctgatgactgccgacaacctgtcaatctgtttttggcctacacttatgcgccctgactttgagaaccgcgagtttctgtccaccactaaaatccatcagagcgttgtcgaaacattcatccagcaatgccagttttttttttacaatggcgaaatcgtggagactactaatatcgtggcccctcccccaccatctaaccccggtcaattggtggagccaatggtgccccttcagctgcccccgcccttgcagcctcaattaattcagccccagcttcagacagatccacttggcatcatttag

SEQ ID NO: 203349 - DNA, 2316 bp, Artificial Sequence
  Description of Artificial Sequence: Synthetic coding sequence
atgagcggccggagcgtgcggctgcggagcgtgcccatccagagcctctcggagctggaacgagcacgcttacaggaggtggctttctaccagctgcagcaagattgcgatctctcgtgtcagattacaattccgaaagacgggcagaagcgaaaaaagtctctgagaaagaagttggatagtctgggaaaggagaagaacaaagacaaagagttcattccacaggcattcggaatgcctttgtcacaagtgattgcaaacgaccgtgcctataaattaaagcaggatcttcagcgcgatgaacaaaaagacgcttcagacttcgtggcctctctgctcccttttggcaacaagaggcaaaataaggagctgtcctcctcaaactcaagcctttcaagtacgtctgaaacaccaaacgagtctactagccctaataccccagagcccgcgcctagggctcgacgacggggcgccatgtctgtcgactccataacggacctggacgacaatcagtcccgtttgctggaggctttgcagctaagtctgccagctgaagcccagtctaagaaggaaaaggcaagggataaaaagctgtccctgaaccccatctaccgtcaggtaccacgcttggtggatagttgctgccaacatctcgaaaaacatggactgcagactgtcggcatctttcgggtgggctcgtcgaagaaacgggtgagacagttgcgggaggagtttgatcgaggaattgacgtgtcactcgaggaggagcatagcgtgcacgatgtggctgcactgctgaaggaattcctaagggatatgccggatccgctcctcacccgagaactgtatacagcttttattaacacactcttactggagcctgaggaacagttgggcacgctgcagctactgatctaccttctgccgccctgcaattgcgataccctccaccgcctcctgcaattcctatcaatcgttgcgagacatgcggacgataacatctccaaagatgggcaggaagtgactgggaacaagatgacttctctgaacctggctacaatctttgggcctaatctcttacataaacagaaatctagcgataaagagttttcggtacaaagctcagccagggctgaggagagtaccgctatcattgcggtggtccaaaaaatgatcgagaactatgaagcgttgttcatggtgccccccgatctgcaaaacgaagtgctgataagcctgttagaaacagatccagatgtagtggactatctgctgcgcagaaaagccagccaatcctccagtcccgatatgctacagagtgaagtgagcttcagtgttggagggcgtcactcctccactgacagcaataaagcaagcagcggagacatctccccgtacgacaataacagccctgtcctgagcgaaagatcgctgttagccatgcaggaagatgccgctcccggcggcagcgagaaactctaccgggtcccgggccagttcatgcttgttggacacctctcatccagcaagtctagggagtctagtccagggccgagactgggcaaagacctttcagaagagcccttcgacatttggggtacttggcattccactttgaaaagtggatctaaagatccaggtatgaccgggtcctcaggagacatcttcgagtcatcctcattacgcgccgggccgtgttccttaagtcaggggaacttgtcccctaattggccccgttggcaggggtccccagctgagctcgatagcgacacccagggggccagacggacacaggcggctgccccagctacagaaggcagagcacaccccgccgtgtcacgagcctgctccacaccacacgtgcaggtcgccggtaaagccgagcgtcccacagcacggagcgagcagtatctgactctttccggggcccatgatctgtccgaaagcgaactggatgtcgctgggcttcagagccgagccacacctcagtgtcagaggcctcatgggagcggcagagacgataagcgtcctcccccgccttatccaggcccggggaagcccgctgcagccgccgcctggatccagggccccccggaaggcgtagaaacgcccaccgatcagggggggcaggctgctgagcgcgaacagcaggtcacacagaagaaactgagttccgcaaattccttgcccgccggcgagcaggattcaccccgactcggggacgccgggtggcttgattggcagcgtgagcggtggcagatttgggagttgctttctacggacaacccagacgctttgcctgagacattggtctag

SEQ ID NO: 203350 - DNA, 2925 bp, Artificial Sequence
  Description of Artificial Sequence: Synthetic coding sequence
atgagcgcccagagcctgctgcacagcgtgttcagctgcagcagccctgctagttcatcagccgcttccgccaaaggcttttcaaaacgcaagctacgccaaactcgttctcttgaccccgccctaatcggtggctgtgggtccgatgaagccggtgcagagggatctgcaagaggtgccacagcaggcagactttactctccgtcgttgccagcagagtccctggggcccaggctcgctagcagtagtcggggcccgccgcctcgtgctactcgcctcccccctcccgggcccctgtgcagttccttctcaacccctagcacaccgcaggagaagtccccgtctggctcctttcactttgactatgaggtgcccctgggtaggggagggctgaaaaagtccatggcatgggacctgccttctgtgctggctggccctgcctcttcaagaagcgcctccagtatactctgtagctcgggcggcggccccaacggtatattcgcttcaccgcgcaggtggctgcagcagcgaaagtttcaatcccccccagatagcaggggccatccatacgtcgtgtggaagtccgagggcgatttcacatggaatagcatgagtggcagaagtgtgcgtctgagatccgtacccatccagagcctgagcgagctcgaaagggcacgattgcaagaagtggccttttaccaacttcagcaggattgtgatctgtcatgtcagattactataccaaaagacgggcagaaacgcaagaaatccctgcgcaagaagctagattccctcggaaaagagaaaaataaagacaaagaattcattccgcaggcattcggcatgcccctgagtcaagtaatagccaatgaccgggcttacaaactgaagcaagacctgcagagggatgaacaaaaggacgccagcgatttcgtcgcctcactcctcccctttggtaacaagagacagaacaaggaactgtcctcttccaatagcagtctttcttccacatccgaaactccgaacgaatccacaagcccaaataccccagagcccgcccctcgggcacgccgccgcggagccatgtctgtggactccataaccgacctcgatgataaccagagcagactgttggaggcgctgcaactgagcctgccggccgaagcacagtccaagaaagagaaagcccgggataaaaagctcagcctgaatcctatctacagacaggtgccaaggcttgtcgactcctgctgtcaacacttggaaaagcatggactccagacagtaggaatctttcgcgtgggttcatcaaaaaagagggttcgccagctgcgggaagagttcgatcggggtatcgatgtgtccctggaggaggaacactcagtacacgacgtagctgctctccttaaagagttcctcagagatatgccggacccactgctgaccagagagctttacacagccttcatcaatactctccttttagaacccgaagaacaactcgggacactgcagctgctcatttacctactgcccccgtgcaactgtgacactctgcatcgcctcttgcagtttttgtctatcgtggccagacacgcagacgataacatctctaaagatgggcaggaagtgacagggaacaagatgacttcattgaatctggccaccatcttcggccctaatctcctgcataaacagaaaagctctgacaaggaattctccgtccagtcctccgctagagccgaggaaagcactgctatcatcgctgtagtacagaaaatgatagagaactacgaggctctcttcatggtccctcccgacctccagaacgaggtgctgattagtttgcttgagacagatcccgacgtggtagactacctgctgaggaggaaggcatcacagtcgagcagtccagacatgttacagtccgaggtatccttcagcgttgggggacgccatagttcgactgactccaataaggcatcaagcggcgacatctcaccttatgataacaactccccagtactctcagaaagatctctccttgcgatgcaggaagacgccgcccctggcggttcagagaagttgtaccgggtgcccggacagttcatgttagttggtcacctttcttcctccaagtccagggaatcctcacccgggcctagactcggtaaagatctgtccgaagagccttttgatatctgggggacctggcattctaccctgaaatctggaagtaaagaccctggtatgactggatctagcggcgatatatttgagtcatcgtctttacgcgctggaccttgcagcttgtcgcaaggcaacctctcacccaattggcctaggtggcaggggagccccgctgaacttgattcagacacacaaggcgccaggcgtactcaggctgcagcgcccgcaacagagggccgagcccacccagcagtctcaagggcttgctccacgccccacgtccaggtggcggggaaagcggagagaccgacggcaaggtctgagcagtacctcacgttgtctggagctcacgacttgtcagaatctgagctcgacgtcgctggattgcagtctcgcgccacaccgcagtgccagcgcccgcacggctctggccgcgacgacaagcgccccccgcctccttatcccggacccgggaagcctgctgccgctgctgcttggattcagggccctcctgagggagttgaaactcctaccgaccagggagggcaggctgccgagcgcgagcagcaggtgacacagaagaaactgagcagcgctaactccttgcctgcgggcgagcaggacagtcccagacttggggacgctgggtggctggattggcagcgggaacggtggcagatatgggaactgctctctacagataacccagacgccttgcccgagacgcttgtgtag

SEQ ID NO: 203351 - DNA, 1806 bp, Artificial Sequence
  Description of Artificial Sequence: Synthetic coding sequence
ctggagctgtacgacctgcagatcctgggcaccaagccccccatgaacagcgatacgcacagaaacttcgaccctacagcaacactgcgtaatcagggggattttacatggaatagcatgtcgggtagatctgtgagactcaggtcagtgccaattcagtccctgtccgagctcgagcgagcaagactacaggaggtcgcgttctatcagctccagcaggactgcgacttatcgtgtcagataaccatccctaaggacggtcagaaacgaaaaaagtccctacgtaaaaagcttgacagtctgggcaaagagaaaaacaaggacaaggaattcatccctcaggctttcgggatgcccctgtcccaggtgatcgcgaatgaccgcgcctataagttgaaacaggatcttcagcgcgacgagcagaaggatgcttctgacttcgtggcatcactgttaccctttgggaacaagcggcagaacaaagagttatctagtagtaatagctctctgtctagcacttccgagacacccaatgagtcaacctcccccaatacacctgaaccagcacccagagcaagacggcggggggccatgtctgtggacagcattacagatctggacgacaaccaatcacgcctgttggaggccttgcagctgagcctgccggccgaagcccagtctaaaaaggagaaagcacgggacaagaaactatccctcaatccgatttatcgccaggtgcctcgcttggttgacagctgttgtcagcatctcgagaagcatgggctgcagacagtcggtatatttagggtgggtagttccaaaaaaagggtgcgccagctgagagaggagtttgatcgcggaatcgatgtgtccctcgaggaggagcatagtgtccacgacgtggccgccctgttaaaagagttcttgagagatatgccagaccctctccttacgagagagctctatacagctttcatcaacactctcttgctggagcctgaggaacagttgggcacactccaactcctgatatacctcctacctccttgcaattgtgacacactccacaggctgctgcaattcctcagcattgttgcacgacacgcggatgataacatctctaaagacggccaggaagtcaccggtaacaaaatgacatcgctcaacctagcgacaatattcggccccaacctgctgcacaagcagaagtcctccgacaaggaattctccgttcagtcttcggctagggccgaggaaagcacggccattattgctgtcgttcaaaagatgattgagaactatgaggccctctttatggtgccccccgacttgcaaaatgaagtgctcataagcctgctggagacagacccagatgtggtggattacctattgcgacggaaggcgagccagagcagctctcccgatatgctccagagcgaggtcagtttctccgtgggaggccgtcacagctctacagacagtaacaaagccagctccggcgatatctccccttacgacaacaacagtcccgtgttgtctgagcggagcctcctcgccatgcaggaggatgctgctcctggtgggtctgagaagttgtatagagtgccaggccagttcatgctagtggggcacttaagcagcagcaaatctcgggaatcaagccctggcccgcggttggggaaaggcaactggtccttggcaagccgacggtggcctaaacaagcaaccctcctcctgctccacgtggcttggtgcggcgctctcagaacgttttcgagcagtctcccatacctcatgttcctctag

SEQ ID NO: 203352 - DNA, 2298 bp, Artificial Sequence
  Description of Artificial Sequence: Synthetic coding sequence
atgagcgcccagagcctgctgcacagcgtgttcagctgcagcagccctgcctcatcctcagctgctagtgccaagggattctctaaaaggaagctccgccaaaccagatcccttgacccagccctcataggcggctgcggctccgatgaggccggggctgaaggatccgcccgaggcgcaacagccggacgcctttacagtcctagtctgcctgccgagagtctggggccacgcctggcatcttccagccgcgggcctcccccccgtgccaccagacttcccccccctggccccctttgctcgtccttcagcaccccttcgactccccaggagaaatccccttctggcagctttcattttgactatgaagtccctctgggaagaggcgggctcaaaaagtccatggcatgggacctgccatcagtcctggcgggcccagccagtagccgttctgcttcaagcatcctgtgttcatccggtggaggtccgaacggcattttcgcctcaccgcggaggtggctgcagcagcgcaagtttcagagcccgccagactcccgcgggcacccttatgtggtgtggaaaagcgaaggggacttcacatggaactctatgagcggcagatcagttaggctcagatccgtgcccatccagtccttgagcgaactggagagagcgaggctgcaggaggtcgctttttaccagctccaacaggactgcgacctatcttgccagattacaattccaaaggacgggcagaaaagaaaaaagagtctcagaaagaagctggactctttaggaaaggagaagaataaagataaagaattcattccccaggcatttggcatgcctctgtcgcaagtgatcgcgaatgaccgggcctacaagctcaaacaggaccttcagcgggatgagcagaaggacgccagcgactttgtagcgagtctcctgccatttgggaacaaacgccagaacaaagaactgagctcatcaaactcctctctgtcctctacctccgaaaccccgaatgagtcgacttcccccaatactccggagccagcacctcgcgcgaggcgcagaggcgctatgagcgtggatagtatcactgatctggacgacaaccagagccggctcctcgaggccttacaattatctctccccgctgaagcccagtcgaaaaaagaaaaggctagagataaaaagctctcattgaatcctatttatagacaagtgccccgtttagttgacagttgttgccaacacctcgagaagcacgggctgcagactgtgggaattttccgggtgggatcttcaaagaaacgggtgaggcaactgcgcgaagaattcgacaggggcattgatgtatcactggaagaagagcattccgtgcatgatgtcgccgccctgctgaaagaatttctcagggatatgccggatccattattgacgagagaactatacaccgcattcatcaatacacttctcctcgagcccgaggaacagcttgggacacttcagctgctgatttacctgttgcctccatgcaactgtgacactctgcaccgtctcctgcagttcctgagtattgtcgccaggcacgccgatgataacatctccaaggatggacaggaggtaacagggaacaagatgacctccctcaaccttgccactatctttggcccgaacctgttgcacaagcagaagtccagcgacaaagagttctctgtgcagtccagcgccagagccgaagaatccaccgccatcatagctgtggtgcagaagatgatagagaattacgaggcccttttcatggtccctcccgacttacaaaatgaagtgctcatttcacttctggagacagaccccgacgtggtggattatcttcttagacggaaagcttcccaatcttccagccctgacatgttgcagtccgaagtatcattctctgtggggggcagacactcatcaactgatagcaacaaggcttctagcggtgatatctcaccttacgataataacagtcctgtgttgtcagagcggagtttacttgcaatgcaggaggatgcagcacctggtggcagtgagaagctctaccgggtgccaggacaattcatgttagtgggacacctgtcatcaagcaagtctcgtgaaagctctccgggcccaaggcttggaaagggcaattggagtcttgcaagtagacgctggccgaagcaggccaccctgctgctgctgcatgttgcctggtgcggagcgttgcgcaccttctcctcatcattgccctatctgatgttcttatag

SEQ ID NO: 203353 - DNA, 2073 bp, Artificial Sequence
  Description of Artificial Sequence: Synthetic coding sequence
atgagcgcccagagcctgctgcacagcgtgttcagctgcagcagccctgcctcctcctccgccgccagcgccaaaggattctcaaagcgtaagctgcggcagacacgctccctggaccctgctcttatcggcgggtgtggctcggatgaagctggcgcagagggttcagcccgaggggctactgctggtagactatactctccgtcactgcccgcggaaagcctggggccaagacttgcttcctcttcaagaggtcccccccccagagccactcgactgccacccccgggaccgctatgctcctcattctccactccttccacaccccaagaaaagtctcctagtggatcctttcatttcgattacgaggtccccttaggaaggggaggcctgaagaagtctatggcgtgggatcttccatctgtgttagccggaccagcgagctctaggagcgccagctccatcctatgcagctccggcggaggccccaatggtattttcgcatctccccggcgctggctgcagcagaggaagtttcaatcccctcccgacagcagagggcatccttatgttgtttggaagagtgagctcgaattgtatgacctgcagatcttaggcactaagccacctatgaacagcgatactcacagaaattttgatccgactgcgacactccggaatcagggagatttcacttggaattcaatgtccggcaggtctgtcagacttcggagcgtcccaattcaaagtctcagcgagctggaaagggcccgcctccaggaagtggccttctatcaattgcagcaagactgtgacctgagttgccagatcacaatccctaaagacggtcagaaaagaaagaagtccttgcgcaaaaagctggactccctgggaaaggaaaaaaacaaagataaggagttcattccacaggctttcgggatgcctcttagccaggtcattgcgaatgatcgtgcctacaagctgaagcaggatctgcaaagggatgagcaaaaagacgcaagtgacttcgttgcgagcctcctgccatttggcaataagaggcaaaataaggagttaagcagcagtaactctagcctcagctcaaccagcgagaccccaaacgagtccaccagccctaatacacccgaacctgctcctagggcgcggaggagaggcgcgatgagtgtggattcaattaccgacctggacgacaaccagtcccggctgttggaggctttacaactttcgctccccgccgaggcccagtcaaaaaaggaaaaagcaagggataaaaaactgtctttgaaccctatctaccgccaggtgccacgactggttgactcgtgctgtcagcacttagagaagcatgggttgcagacagtaggaattttccgtgttggttcaagcaagaagcgggtcagacagcttagggaggagtttgatcgagggattgatgtgtctttggaggaagaacactctgtccacgacgtggctgcactcctgaaagaatttcttcgggatatgcctgaccccctgctgactagagaactctacacagccttcatcaatacgctgctcctggagcccgaagaacagcttggcacgctgcagttgctgatctatctgttgcctccatgcaattgcgacaccttgcatcggctgttgcaatttctctctatcgttgcccggcatgcagacgacaatatttcaaaagatggccaggaagttactggcaacaagatgacaagcctgaatctggccaccatcttcgggcccaacttgctgcacaaacaaaagtcaagtgataaggagttctctgtccagtccagtgccagagcagaggaaagtaccgccatcatagcagtagttcagaaaatgatcgaaaactacgaggccctgttcatggtcccacctgacctgcagaacgaggtccttatttcgcttcttgagactgatcctgatgttgttgactacttgcttcgccgcaaggcaagtcaatcttctacctcctccgtactccctgccgccgttcaggcctgtccccagtacccggccagtatgttcactccgtag

SEQ ID NO: 203354 - DNA, 2316 bp, Artificial Sequence
  Description of Artificial Sequence: Synthetic coding sequence
atgagcggccggagcgtgcggctgcggagcgtgcccatccagagcctgtccgagttggagcgagcccgactgcaggaagttgccttctaccagttacaacaagattgcgatctgtcatgtcagatcaccatccccaaagacgggcagaaacgaaaaaagtcactgagaaaaaaactcgactctctaggtaaagagaagaacaaggacaaggagttcattccccaggcattcggcatgcccctcagtcaggttattgccaatgatagagcatataagctcaagcaagacttgcagcgggacgagcagaaagatgcatccgattttgtggcgagcttgttgcctttcggaaacaaacgccagaacaaagaacttagttcttccaactcctctctgagctccacgagcgagacccccaatgaatctactagccccaacactcctgagcccgctcccagggcccgcagacgtggggcaatgagtgttgatagcattactgacctcgatgacaatcagtcgcgactgctggaggccctgcaactgagcctaccagcagaggcccagagcaagaaggagaaggctcgtgacaagaagctcagcttgaatccgatttatcgacaggtgccccgcctggtggattcctgttgccagcaccttgagaagcacggcctacagacggtcggcatctttagagtcgggtcgagtaagaaaagagtcagacaactccgggaggagtttgatcggggaattgatgtcagtctggaagaggagcactccgttcacgatgttgctgccttgctcaaagagttcctccgcgacatgccagacccactcctgacgagagaactatacacagccttcatcaacaccttactgttagaacctgaagagcagctgggcactctgcaactgctgatctatctgcttccaccctgcaactgtgacactctgcaccggctcctacagttcctttccatcgttgccaggcacgctgatgataatatcagtaaagacggacaggaggtgaccggcaataaaatgacttcactgaaccttgcaaccatcttcggcccaaatcttctgcataaacagaagtcctctgacaaggagttttccgttcagagctcagcccgcgcggaagaatctactgccataatagcagtggtgcagaagatgattgagaactatgaagctttattcatggtccctcctgacctgcagaacgaggtcttgatctctctgctggagactgaccccgatgtggttgactatctacttaggagaaaagcgtcgcagtccagcagcccagatatgctccagtcagaagtcagttttagcgtcggcggacgacactcctccacagattcaaataaagcttccagtggagacataagtccctacgataataactcaccagtcctctcagaaagatccttgcttgcgatgcaggaagatgccgctcccggcggaagcgagaaactgtaccgggtgccagggcagtttatgctagtgggccacctgtctagctcaaaatcccgagagtcctcacccggacccagactggggaaagacctctcggaagaacctttcgacatctggggcacatggcacagcaccctgaaatctgggagcaaagatcccggcatgaccggtagctctggtgatatctttgagtcaagctcgctccgagccggcccctgctctctgtctcaggggaacctctccccaaattggcctagatggcaggggtcccccgccgagttagactcagatacgcaaggcgcgcgacgcacacaggccgccgcaccggccaccgaggggcgagcccatcccgcggtatcgcgagcatgttctacgccacacgtgcaggtagccggaaaagctgaaagacccactgcgagaagcgagcaatatttgacattgagtggggctcacgatttgtccgagagcgagttagacgtggcagggctgcagtcgcgcgcaacaccccagtgccaacgaccgcatggatccggaagagatgataaaaggcccccacccccctatcctggccctgggaagcccgctgccgcagccgcctggatacaaggtcctcctgaaggggtggaaacaccgaccgatcaggggggacaggccgcggaacgggagcagcaagtcacccagaagaaactgtcaagcgctaactccctgcctgctggggagcaggattctccgcgcttgggtgacgccggttggcttgactggcagcgcgaaaggtggcagatatgggagttgctgtcaaccgacaatcccgacgctttacccgaaactctcgtatag

SEQ ID NO: 203355 - DNA, 1404 bp, Artificial Sequence
  Description of Artificial Sequence: Synthetic coding sequence
atgtaccggatcttcggcgacttcacctggaacagcatgagcggcagatccgtacgccttcgctccgtcccgatccagagcttgtcagagctggagagagcccggctccaggaggtggcattctaccagctgcagcaggactgtgacctgagctgccagatcaccatacctaaggatggtcaaaagaggaagaaatcactgcgcaagaagctagactctctcggcaaggaaaaaaacaaagacaaggaattcatcccacaggcttttggtatgccactgagtcaagtaatcgcgaacgatagagcctataaacttaagcaggacctgcagcgagacgaacagaaagatgcgagtgactttgtggcaagcttactcccctttggaaacaagaggcagaataaagagctttcatcttccaatagctccctcagttctacgtctgagaccccaaacgaaagcacctctcctaatacgccagagccagctccccgcgcccggcgccgcggggctatgtctgtcgacagtatcactgacttggacgacaatcaatccaggcttcttgaagccttgcagctcagtttgcccgccgaagctcagtccaagaaggaaaaagctcgcgacaagaaactgagcctgaacccaatatatcggcaggtgccccggcttgtggactcctgctgtcagcatttagagaagcatggactgcagacggtcggtatttttcgcgtcgggtcaagcaagaaaagggtgaggcaacttagagaggagtttgaccgggggatagatgtgagtcttgaggaggagcatagcgtgcatgatgttgccgcccttctcaaggagttcctgcgagatatgcctgatcccctgctgacaagagaattgtacaccgcatttataaatacactgttgttggaacctgaagaacagctcggcaccttgcagctgctaatctacctgcttccaccttgtaattgtgataccctgcataggctgctgcagtttttgagtatcgtggcgagacacgccgatgataatattagtaaggatggccaagaagtcaccggcaataagatgacaagtctgaacttggcaactatattcggccccaacttgttacacaaacagaagtcgtcggacaaggagttcagcgtgcagtcttcagcgcgggctgaagaaagcactgccatcatcgccgtcgtgcagaaaatgatcgagaactatgaggctttgtttatggtgccccctgacctccagaatgaggtgctgatatcacttcttgaaacagatccagatgtggtagactaccttctaaggagaaaggcgagccagtccagcactagttcagtcctgcctgctgcagtacaggcttgtccacagtaccccgcttccatgttcaccccatag

SEQ ID NO: 203356 - DNA, 1815 bp, Artificial Sequence
  Description of Artificial Sequence: Synthetic coding sequence
atgaagcggctgcacatcttcggccccaagatccacagcagcggcggcctgtggcaacagaaaggtgactttacctggaactccatgtctggccggtcggtacggctgagatcagttcctatccaatccctgagtgagctggaacgagcccgattacaggaagtggccttttaccaactgcagcaagactgcgatctctcctgtcagattaccatccctaaagatggccaaaaacggaagaagagcttgcgcaaaaaactggactctctgggaaaggaaaaaaacaaggataaggaatttattcctcaggctttcgggatgccactctcacaggttatagccaatgacagagcttacaagctgaaacaagatctccaacgtgatgagcagaaggacgcctctgacttcgtagcctccttgctccctttcggcaacaaacggcagaacaaagaactgtcctcttccaatagcagtctctcctccacgtctgaaactcccaatgagtcaaccagccccaatactccagagcccgccccccgggccagacgcaggggagctatgtctgtggatagtatcaccgacctggatgataatcagtctaggcttctggaggcactgcaactctcgctgcccgcagaggcacagtctaagaaagagaaagcccgggataaaaagctcagtcttaacccaatctaccggcaggtgccacggttggttgatagttgctgccaacacctggagaagcacggcctgcaaacagtgggaatctttagggtggggtcatccaagaagagagtgaggcagttacgagaggaattcgaccgcgggatcgatgtgtccctggaagaagagcattccgtccacgatgtggcagcgctccttaaggagtttctgcgcgatatgccagatcccctgctgacacgtgaactctacaccgcttttatcaatacgcttctactggagcctgaggaacagctcgggactctgcaactactgatttacctcttgcccccttgcaactgtgatactcttcaccgcctgctccagttcttgtcaatcgtggcacgacacgctgacgataacatcagcaaggatggccaagaagtgacggggaacaagatgacatcattaaacctggctactatattcgggcccaacttgttacacaagcaaaaatcctctgacaaggaattttctgtgcagtcaagtgccagggccgaagagagtaccgctatcatcgccgtcgtccagaagatgattgagaattacgaagctctcttcatggtgcctcccgacctccagaacgaagtgctcatatctttgctggaaaccgatcccgacgtggtggactacttactcagacgaaaagctagccagtcaagctcccctgacatgttgcagtctgaagtctcattctccgtcggaggccgccattcctcaacagactctaataaggctagttcgggcgatatcagtccatacgacaataacagcccagtgctgagtgaaaggtcgctcctggcaatgcaggaagacgccgcccctggtggtagtgagaagctatatcgggtgccaggacagttcatgctcgtgggccatctatcctcatcaaagtcccgggagtcgagtccgggcccccgcttaggtaaggacctgtctgaagaaccattcgacatctggggcacttggcattccactctgaaatccggatcaaaggatccgggtatgaccggtacaacgcctctcttaaatattagctctcaggaggatcaccggcagaaggaccttagacttattttcaagatatatccatag

SEQ ID NO: 203357 - DNA, 918 bp, Artificial Sequence
  Description of Artificial Sequence: Synthetic coding sequence
atggccggccaggaccccgccctgagcaccagccaccccttctacgatgtggcgcgccatggcatccttcaggtggccggggacgatcgatttggtcggcgggttgtcacattctcttgttgccgcatgcccccatctcatgagctcgatcaccaacggctgctcgaatatctgaagtatacactcgaccagtatgtcgaaaacgactacaccattgtatacttccactacggtctcaactcaagaaataagccctcactcgggtggctacagtcagcctataaggagttcgatcgaaaatacaagaaaaacctaaaagcgctgtatgttgtccatccgacctcatttatcaaggtcttgtggaatattttaaaacccctgatttctcataagttcgggaagaaagtgatatactttaattacctgagcgagttgcacgagcacctgaaatacgaccaattggtcatccctccagaagtgctgcggtacgacgagaagctgcagtcgctacatgaaggcagaaccccccctcctacaaagacacctccaccccgcccacccttgcccacccagcaatttggagtttctctgcagtacttgaaagataagaaccaaggggaactcataccacccgtgctcaggtttactgtcacatatctgagggaaaaaggcctacggacagagggcttgtttcggcgaagcgcttctgttcaaaccgtgcgtgagattcagcggctgtataaccaggggaagccagtgaacttcgacgattacggggacatccacataccagctgtcatcctgaaaaccttcctgagagagctgccccagccactactgactttccaagcgtatgaacaaatcctcggtataacatgcgtgcccggagagcatctccagcagaatgagcagttatag

SEQ ID NO: 203358 - DNA, 1302 bp, Artificial Sequence
  Description of Artificial Sequence: Synthetic coding sequence
atggccggccaggaccccgccctgagcaccagccaccccttctacgatgtggctaggcacggcattttacaggtggccggggatgatagatttgggcggagagtagtaaccttttcctgttgtagaatgccaccttcacatgaactggaccaccagaggctgttggaataccttaagtatacccttgatcagtatgttgagaacgactatactatcgtctactttcattacggacttaactcgaggaacaagcctagcctgggctggttgcagagcgcatacaaagaattcgatcggaagtacaaaaagaatcttaaagccttatacgtggtgcacccgacttccttcattaaagtcctgtggaatatcctaaagcccttaatttcacataagttcggcaagaaagtgatatacttcaactatttaagcgagctccacgagcacctgaaatacgatcaactagttattccccctgaagtactgcgatatgatgagaagctgcagagtctacacgaaggtcgcacccctccccccacgaagaccccccccccccgtccccccctgcccacccaacagttcggcgtgtctcttcagtacctgaaagacaaaaaccagggtgaactcatccctccagttctccgctttacggtcacgtacctgcgcgaaaagggcctgcggaccgaagggctgtttcgccgctcagcttcagttcagaccgtacgggaaattcaaagactatataatcaagggaagccagtcaacttcgatgactatggagacattcatattccggccgtgattctaaagacctttcttcgtgaattgccccaaccattattgaccttccaggcctatgagcagatactgggcatcacctgcgtggaatcttctctgcgagtaacggggtgtcggcagatcctgaggtcattgccagaacacaactatgtggttctgcgctacctcatgggctttctgcacgctgtttcaagggaaagcatctttaataaaatgaactccagtaatctggcttgcgtatttggtttaaaccttatatggcctagtcagggagtgtcctcactgtctgcacttgtgcctctcaacatgtttacggaactgctcatcgagtactacgagaaaatattctccactccggaagcacccggtgagcacggattggccccctgggagcagggatctagggcagctcccctacaggaggcagtccctaggactcaggccactggtttgaccaaacctactctaccaccttctccattaatggcagcccgccggaggctgtag

SEQ ID NO: 203359 - DNA, 1668 bp, Artificial Sequence
  Description of Artificial Sequence: Synthetic coding sequence
atgagcagccccagcctgagcgacctgggcaagcgggagcccgccgcggccgccgacgagcgcggcactcagcagcgaagagcttgcgccaatgctacctggaacagcatccataatggggtgatcgctgtgttccagaggaagggactaccggaccaggaactcttctctctgaatgagggggtccgacagctactgaagacagagctgggcagttttttcacagaatacttacagaaccagctacttactaaagggatggttattcttcgggacaagatacgattttatgaggagctgcaacgggacaaggccgccgctgctgcggtcctgggggcagtccgcaagcggccaagtgtggtcccaatggcaggacaggacccagccctgtctacctcccaccccttctacgatgtggcccggcatggaattttgcaagtcgcgggtgatgatcgtttcggtcgacgggtggtgacatttagctgttgcagaatgcctccatcccatgaacttgaccaccagagattgctcgagtacctcaaatacacactggaccagtacgtagaaaacgactacactatcgtatatttccactatggcctgaacagccgcaacaagccatccctgggttggttgcagtccgcctacaaagaatttgatcggaagtacaagaagaatcttaaggcattgtatgtagtacaccctactagcttcatcaaggtgctctggaatatcctgaagccactcatctcccacaagttcggaaagaaagtcatatacttcaactacctgtccgagctgcacgaacaccttaagtatgatcagcttgttatccctcccgaggtgctgcgttacgacgaaaagctgcagtctctccatgagggccgaacaccccctcctacaaagactcccccccctcgaccacccctccccacgcagcaatttggggtatcactgcagtacctgaaagacaaaaatcaaggagaactgataccccccgtcttgcggtttaccgtgacctatctacgagaaaaggggttgaggactgagggcctgttcagacgttctgctagtgtccagacggtgcgcgagattcaacggctatacaatcagggcaagcccgtcaactttgatgactacggggacatacacatcccagccgtcattctcaagacttttctgagggaactgccacagcccttgctgaccttccaggcttatgagcaaatcctaggaatcacttgcgtcgaaagttcactgagggtcacagggtgcagacagatcttgaggagcctgcccgagcacaactacgttgtactgagataccttatgggtttccttcacgccgtgtcgcgagagtctatatttaacaagatgaacagcagcaatcttgcttgtgtcttcggtctcaaccttatctggccctcccagggagtctcatctctgtcagccctggttcccctgaatatgtttacagagctgctgatagagtattacgaaaagatttttagcacgcctgaagccccgggggagcacggattggccccatgggagcaggggtccagggctgcccctctccaggaggccgtgccccgtacccaggctacagggctcactaagccaactctacccccctcccccttaatggcagccagacggaggctgtag

SEQ ID NO: 203360 - DNA, 1395 bp, Artificial Sequence
  Description of Artificial Sequence: Synthetic coding sequence
atggccggccaggaccccgccctgagcaccagccaccccttctacgacgtcgcacggcacggaatcctccaggtcgccggagatgatcgcttcggtcgccgcgtcgtcacattcagttgttgcagaatgcccccatctcacgaactggaccaccaacgcctgctcgagtacttgaaatataccctcgaccagtacgttgaaaacgattacacgatcgtgtacttccattacggccttaacagccgtaataagccatctctgggttggttgcagtctgcctacaaggagtttgatagaaaagatggcgacctgaccatgtggccccgcctggtgtcaaattccaaactaaagcgctcatctcacctcagcctgccaaagtactgggactaccgctataagaaaaatttgaaggccctctacgtcgtgcacccgacatctttcatcaaagtgctctggaacatcctgaaaccccttatctcccacaagtttggaaagaaagtgatctactttaactacttgtctgagttacacgaacatctgaaatatgaccagctcgtcattccgccggaagttttacgctacgatgagaaacttcagtcattgcatgaaggcagaactccacccccaacaaagaccccgccaccccggcctcctctccctactcagcagtttggagtctcattgcagtacctgaaggataagaaccagggagagctcattccacctgtgttgagatttactgtgacgtatctacgggagaaaggactgcgcaccgaaggactattcaggcgctcggcctctgtgcagacggttagggagatacaaaggctgtacaaccaggggaagccggtgaacttcgatgattatggcgacattcacattcccgcggtgatcctaaaaacctttttgagggaattgccacagcccctgctcacctttcaagcatacgagcagatcctgggcatcacatgcgtggaatcctccctccgggttactgggtgtaggcagatcctccgctcccttcccgagcataactacgtagtactgcgatatttaatgggcttcctgcacgccgtgagcagggagtcgatcttcaacaagatgaactcctctaatctggcttgcgtgtttggcctgaacttaatctggccaagtcaaggtgtttcgtccctgtccgccttagtgccattgaatatgttcacagaactactcatcgagtactacgaaaagatcttttctacccccgaggcccccggtgaacacggccttgccccctgggaacaaggttctagggccgcaccactccaagaggccgttcccaggacacaggctacgggcctcacaaagcctaccttaccaccttcccctttaatggctgccagaaggaggctgtag

SEQ ID NO: 203361 - DNA, 393 bp, Artificial Sequence
  Description of Artificial Sequence: Synthetic coding sequence
atggccggccaggaccccgccctgagcaccagccaccccttctacgatgttgctcgccatggcatactgcaggttgccggagacgaccggtttggaaggagagtggttacattttcttgctgccgtatgccgccatctcacgagcttgatcaccaacggctcttagaatacttaaagtacacattggaccagtatgtcgaaaatgattatactattgtgtatttccattacggcctgaattcccgtaataaaccgtcgctgggatggcttcagtctgcatataaggaattcgaccgtaaagacggagacctcactatgtggcctcgcctggtttctaacagcaagttaaaaaggtcctctcacctgtctctaccgaaatactgggactactag

SEQ ID NO: 203362 - DNA, 348 bp, Artificial Sequence
  Description of Artificial Sequence: Synthetic coding sequence
atggccggccaggaccccgccctgagcaccagccaccccttctacgacgtcgccagacacggaattctgcaagtggccggggacgatcgttttggtcggcgcgtagttacctttagctgttgccggatgccacccagccacgaacttgatcaccagagactgctcgagtacttgaaatatacccttgatcagtacgtggagaacgattatacaatcgtgtatttccactatggtttaaactcacgaaacaagccatccctgggctggcttcagtcagcctacaaggagttcgatcgaaagtacaagaaaaacctcaaagccctgtatgtagttcacccaactagctag

SEQ ID NO: 203363 - DNA, 1932 bp, Artificial Sequence
  Description of Artificial Sequence: Synthetic coding sequence
atgcggaccctgcggcggctgaagttcatgagcagccccagcctgtctgatctaggcaagcgggagcctgccgctgctgccgatgaacggggcacccagcagcgtcgagcctgcgcaaacgccacctggaacagcatccataacggtgtcattgccgtgttccagcgcaaggggctaccagatcaggaattgttttctctcaacgagggagtgcgacaactcctgaaaactgagcttggcagcttcttcaccgaataccttcagaatcagctactgacaaagggcatggtgattctgagggacaaaatccgcttctatgaaggacaaaagttgctggattcattggccgagacgtgggactttttcttctcagatgtgctgcccatgcttcaagccatcttttatccagtccagggcaaggaacctagtgtgcgacaactggcactcttgcatttcagaaacgcgatcaccctatctgtgaaactcgaagacgctctagcaagggcacacgccagagtaccccctgccattgtccagatgttgctggtgctgcagggagttcacgaaagtaggggagttactgaagactatctgaggttagagacactcgtgcaaaaagtagtcagtccatacttgggcacatacggcctgcactcttccgagggccctttcactcatagttgtattttggagctgcaacgtgataaagccgcggccgcagctgtgctaggagctgtgagaaagcggccatctgtcgtgcctatggccgggcaagaccccgctctcagcacttctcacccattttacgatgttgcaagacacggaattctgcaggtggccggtgacgaccgattcgggaggagagtggtcaccttctcctgttgcaggatgcctcccagtcacgagttggaccaccagaggctgctggaatacaaaaaaaatttgaaagctctgtacgtggtacatcccacctctttcatcaaggtcctgtggaacatccttaaaccacttataagtcacaagttcgggaaaaaagttatctatttcaattacctgagcgaactgcacgaacatttaaagtacgatcagctggtcatcccacccgaggttcttaggtatgatgaaaaacttcagagcctgcacgaggggcgcacccctcctccaaccaagacaccccctcctaggccaccccttccaactcaacaatttggcgtgagcctgcagtatctaaaggacaagaatcagggcgagttaatcccccctgttctgaggtttacggtgacttatctcagagaaaaaggcctgcggactgagggactcttcagaagaagcgcatcagtacaaacagtgagagaaattcagagactgtataatcagggtaaacctgtgaatttcgatgactatggcgatatccatattcccgcagtgattctgaagaccttcctgcgcgaactccctcagccgctcctgacatttcaggcctatgagcagatcctgggcatcacctgtgtggagtctagtttgagggtcacagggtgccgccagatcctgcgttccctgcccgagcataactacgtcgtgctgagatatctgatgggcttcctgcacgcggttagccgggagtctatatttaataaaatgaacagtagcaatctggcttgcgtctttggcttgaacctaatatggccaagccagggagtgtccagcctcagcgccctggttccactaaatatgttcactgaattgttgattgagtattatgaaaagatattctcaacccctgaagcccctggagagcatgggttggcgccctgggaacagggcagcagagcggcaccattacaggaggcagtgcccaggacacaggccactggtctgaccaagcccaccctgccgccctcaccactcatggccgctcgccgacggttgtag

SEQ ID NO: 203364 - DNA, 2322 bp, Artificial Sequence
  Description of Artificial Sequence: Synthetic coding sequence
cagacccagaccgagagcctgaccctgtgcagcggcgaggccgagcgccgggggaaagaggagtggcccgactcgcaccactacccgggccccacaccagcccctgaaagttctgacgggccacacaaagttaccgtccttgcaaccatgttaagttctcggtggtggccttcttcttggggaatcctcggcctcggaccgaggtccccaccacgggggagccagctttgtgccctgtatgcctttacttacaccggagccgatggccagcaagtgtcactcgcagagggcgatcggtttttgctgctcagaaagaccaactcagattggtggctcgccaggcgcctggaagctccgtcaacctctaggccaatctttgttcctgctgcgtacatgatcgaggaaagcatcccttctcaaagtccaaccacagtaatacctgggcaattattatggacaccgggccctaaattatttcatgggtcacttgaggagcttagtcaagctctgccctcacgagctcaggcttcttccgagcagcctcctcccctgcccagaaaaatgtgcagatccgtgtctactgataacctgagcccctccctcctaaagccgtttcaggagggcccgagcggcaggtctctctcacaagaggaccttccaagtgaggcgtcagccagcacggctggcccacagcccttgatgtcagaaccccctgtttattgtaacctcgtggatttacggaggtgccctagatctcctccgcctggccccgcatgcccgctcctacaaagactggatgcatgggagcaacatctggacccgaattctggtcgctgtttttatattaattctctgactggctgtaaatcttggaagccgcctaggcgttcccggagcgaaacaaaccctggctctatggagggaactcagaccctcaagaggaacaacgatgttttacagccgcaggcaaaagggttccggagtgatactggcactccagagccattagacccccagggatcactgtcgctttctcagcgcacgtcccagttggacccccccgctttgcaggcccccaggcctttgcctcaactcctggatgacccccacgaggttgaaaagagcggcctcctaaatatgaccaagatcgcacagggtgggagaaaactgagaaagaactggggccccagttgggttgtactcacgggcaactccctggtgttttaccgtgagccccctcccacagccccaagctcaggctggggacccgctggttcacggcccgagtcatccgtggacttgcgcggggccgctctggcccatggacgtcacctgtcaagtcgtcggaatgtgctccatattagaacaattcctggacacgagtttcttctgcagagtgaccatgagacagaattgcgtgcctggcaccgggcccttagaaccgttatagaacgcctggatcgggagaaccccctagaattgcggttgtcgggatctggaccggccgagctctccgccggtgaagatgaggaagaggagtcggaactggtgtctaagcctctgctgcggctgtccagtagaaggtcctccattcgagggcctgaaggcacagagcaaaacagagtgagaaacaagctgaaaaggctaatagcaaagagaccgcctctgcagagtttgcaagagcgagggctgctgagggaccaggtctttggctgtcaactggagtccctttgccagcgtgagggtgacactgtgccatcgtttctcagactttgcattgcagccgtggacaaaaggggactcgacgtggacggaatttaccgcgtctcgggaaacctggccgttgtgcagaagctccgcttccttgttgaccgggagcgtgccgtaacctctgacggcaggtacgtctttcctgaacagcctgggcaagaggggcggctggatctggattcaacggaatgggatgacatacatgttgtgacaggtgccctgaagttgtttctccgcgagctaccccaacctttggtccccccactgctgcttccccactttagggcagctcttgccctgtcacagatccaggaactgatcgggagtatgcccaaacccaaccacgacacgctcagatatttactcgaacatttatgtagagttatagctcacagcgacaagaataggatgactccacacaacctgggcattgtttttggacccacgctgttccgaccagaacaggaaacttccgacccagccgcccatgctttgtatcctggacagctggtgcagttgatgctgactaactttacgagcctctttccatag

SEQ ID NO: 203365 - DNA, 2253 bp, Artificial Sequence
  Description of Artificial Sequence: Synthetic coding sequence
atgctgagcagccggtggtggcccagcagctggggcatcctgggcctgggacctaggtcaccgcctagaggaagccagctttgcgccctgtatgcatttacctataccggagccgacgggcaacaagtctctctcgcagagggggaccgattcttgctgctgcgcaagaccaactcagactggtggctggccagacgcttagaagctccctcgactagtcgcccaattttcgtgccagcagcgtatatgattgaagagtccattccgtcccagtctcctacaacagtaatcccaggccagctgctgtggactccaggacctaaactattccacggctcattggaggaactgagccaggccctcccaagtcgcgcccaggcctcaagcgagcaacccccacctttaccccggaaaatgtgtcggtcagtgtccaccgacaacctgtcaccttccctcctcaagccctttcaggagggcccgtcggggaggagtctgtcccaggaagatctcccttctgaggccagtgccagtacagctgggccccagcccttgatgtcagagccgccagtgtactgcaatctggtagacttacgccgatgcccaagatctccccctccagggcctgcgtgccctcttctccagagacttgacgcatgggagcagcacctggaccctaattcgggaagatgtttctatattaacagcctgacaggatgcaagagctggaaacccccccgacgctcgcggtctgagacgaatccaggcagtatggagggcacacagaccttaaagcgcaacaacgatgttctgcaaccccaggctaagggattccgcagtgataccggaaccccagagccgctggatccacagggctctttgtctctttcccagcgcaccagtcagctcgaccctcctgccttgcaggcccccaggccactaccccagctgttggatgaccctcacgaggtcgaaaaatcgggcttgttaaacatgacaaagatcgcgcagggtggccggaagttgcgaaagaattgggggcctagctgggtggtgttaacggggaatagcttggtattctatcgcgaacccccacctaccgctccgtctagcggctgggggcctgccggctcacggcctgagtcgagcgtggatctgcgtggcgccgcactggcgcatggacggcatttgtcctcccggagaaatgtcttacatatccggactataccagggcatgaattccttctgcaatctgaccacgaaacagagctgagagcctggcatagagctttgcgcaccgttatcgaacgcctggtgcggtgggttgaggccagaagggaagcccctacagggagagaccaagggtcaggcgaccgggagaatccactggaactgcggttgtcaggcagtgggccagccgagctcagcgctggagaggacgaggaagaagagagtgagctcgtatctaaaccgctcctacggcttagtagtaggaggtctagcatccggggcccggagggaaccgaacagaaccgggtccgcaataagttgaagcgacttattgcaaagagaccaccactgcagagcctgcaggagcggggccttctacgcgatcaagtatttggttgtcagctagagtcgctctgtcagcgcgagggcgatacagtgccatccttcttgagactttgcattgccgcagtcgataaacggggcctggacgttgatgggatatacagagtctcaggaaatctggcagtagtccagaagcttcgttttctcgtcgatagagaaagagcggtgacctccgacggtcgatatgttttcccagagcagcccgggcaggagggaagactggaccttgactcaactgagtgggatgatattcatgtagtgacaggggccttaaagctcttcctgagggaactccctcaacccctggtgcccccgctgctcctgccccactttcgtgccgcgctcgcgctgtctgaatccgagcagtgtctgtcccagatccaggagctgatcggatccatgcctaaacccaatcacgacactttacggtatttgcttgagcatctatgccgggttatcgcccactccgacaagaatcgcatgactccacataatttgggcatagtcttcggccccaccctcttcagacctgaacaggagacctcagacccggccgcccacgcactataccctgggcaactcgtgcagctgatgttgaccaatttcacttcattattcccatag

SEQ ID NO: 203366 - DNA, 2196 bp, Artificial Sequence
  Description of Artificial Sequence: Synthetic coding sequence
atgctgagcagccggtggtggcccagcagctggggcatcctgggcctgggcccaaggtcccctccgcgggggtcacaactgtgcgccctttatgcgttcacttacaccggggctgatgggcagcaggtctccctggccgaaggagatcgttttctcctcctgaggaaaacaaactctgactggtggttagcgcgcagactggaggcgccttctacttccagaccaatattcgtgccagccgcgtacatgattgaagaatcaatcccttcccaatccccaaccaccgtgatccccggacagttactctggacccctggaccaaagttattccacggctcactcgaagaactgagtcaagctcttccctcacgggcccaggcttcctcagagcaacctccacctcttcccaggaaaatgtgtcgatcagtgtcaaccgataaccttagtccatccctgctgaagccttttcaggagggaccctcaggccgatccctgtcccaggaagatttgccatctgaggcttccgccagtactgccgggccccagccattgatgagcgaacctcccgtgtattgcaatcttgtggacctgcgacggtgcccacgctctccaccacccggcccggcatgccctctgctgcaacggctcgatgcctgggaacagcatcttgatccaaattctgggaggtgcttctacattaattccctgaccggctgcaagagctggaaaccaccgagacggtcccggtcagagacaaaccccggcagcatggaggggacccagacacttaaaagaaataacgacgtactccagccacaggccaaaggcttcagaagtgatactgggacacccgagcccctcgatcctcagggaagcctgtccctctctcagcgaacttctcagctagaccctccggctctgcaagctccccggccactgccacagctgctcgatgacccgcacgaggttgaaaaatccgggctattgaacatgaccaagatcgcacaaggaggccgaaagctccggaaaaattggggaccatcatgggtagtactgacaggtaattcgctagtgttctatagggagcccccacctacagccccctcctccgggtggggcccggctggctctagaccagagtcttccgtggaccttcgaggagcggccttagcccacggtcgccatttgtcatccagacgcaatgtgctgcatataagaaccattccgggtcacgaattcctgcttcagtccgatcacgaaacggaactgcgggcttggcacagagctctgcggaccgtcatcgagagactggatagggagaatccactggagcttcgactctccgggagtggacccgcagagctgtccgcaggcgaagacgaggaagaggagagtgagttggtttccaagcccctcctgcgtctgagctcgaggcgttcttccattcgcggacccgaaggaaccgaacagaatcgtgtgaggaataagctgaagagactgatagccaaacggccaccgcttcagagcttgcaggagcgtggattactccgcgaccaagtctttggttgtcagcttgaaagcctctgccaacgggagggggatacagtgccgagtttccttcgcctgtgcatcgccgctgtcgacaagagaggattagacgtggatgggatctatcgagttagtggtaatctcgcagtggtgcagaaactacggttcctcgtggaccgtgaaagagccgtgacaagcgacggccggtatgtgttccctgaacagcctggacaggagggacgcctcgatctggatagtacagagtgggacgacattcacgttgttaccggcgcccttaaactctttctccgtgaactcccccagccactggtcccacccctgttgctgccacatttcagagcggcccttgcgctctccgagagcgagcagtgcctctcccagatccaggaactcattggctcgatgcccaagcctaaccacgacacactgagataccttctggagcacctgtgtagggttatcgcgcactctgataaaaataggatgacaccccataatctcgggatcgtcttcggtccaacactgtttcggcctgagcaggagacaagcgaccccgcggcgcacgcgctatacccaggccagctggtgcagctgatgcttactaactttacatccctgttcccctag

SEQ ID NO: 203367 - DNA, 2466 bp, Artificial Sequence
  Description of Artificial Sequence: Synthetic coding sequence
atgcggcggggcagcagcgacagctgcgccagcggcagccaggtggccggtacaacagtggccggacctgcacacccagagtcgctcactctgtgttctggagaagccgagcgcagaggaaaggaggagtggcctgattcccaccactatcctggtccgacacctgcccctgaaagcagcgatggcccgcacaaggtcacagtgctagcaactatgttatcgtctcgttggtggccttcctcctggggcattttgggactagggcctaggagcccacctcggggttctcaactgtgtgctctgtacgctttcacgtacacaggcgcagacggccaacaggtgagcttggctgagggcgaccgctttctgctgctgagaaagacaaatagcgattggtggcttgcccgcaggctcgaggcccctagcacaagcaggcctatattcgtgcctgccgcttacatgatagaggaatccataccctcgcagtctccgaccaccgttatcccggggcagctcctatggactccagggccaaagctctttcatggctcactagaggaactgtcacaagccctgccgagcagagcacaggccagttccgaacaacctccgcccttacctcgcaaaatgtgccggagcgtgagtaccgataacctctctccctcattgcttaaaccatttcaggaaggtccatctgggcggtccctcagccaggaagacttgccttcggaggcctcggctagcacagcaggtccacagcctttaatgtccgaaccgcctgtatactgtaacttggtggaccttcgccggtgcccaaggtctccaccacctgggcccgcatgcccactgcttcagcggcttgatgcatgggagcagcatctcgatcccaacagtggtcgatgtttctacataaacagcctgacaggttgcaaaagttggaaaccccccaggaggagccgatctgaaacaaacccgggctccatggaaggtacacagacgcttaagcgcaacaacgacgtgctgcagcctcaggcaaagggtttccgtagtgacacaggtacccctgagcccctagatccgcaggggagcttgagtctatcacagagaactagtcagctggaccctcctgcgcttcaggcgcctagaccactgccgcaactacttgacgacccacacgaggttgagaagtccggtttacttaacatgaccaaaatagcccagggaggtaggaaactccgcaagaactggggacctagctgggttgtcctgacagggaactctttagttttttatcgcgagccgccaccaacagcgccatcctcaggatggggccccgccgggtctcgccctgagagcagtgtcgatctgagaggcgccgccctggcacacggtcgacatctaagcagtcgccgaaacgtgttgcatattcggacgattcccggccacgagttccttctccaaagtgatcacgagacggaattacgagcctggcatcgcgccctgaggactgtcatagagcgcctggtgaggtgggtggaagccagacgcgaggctcccacaggccgggatcagggtagtggcgatcgagagaatcctctcgagctgagactctcaggttcagggccagctgagttgtctgccggggaggacgaggaagaagagagcgagctcgtgtccaagccgctgctgcgactgagcagtagacgttcgagcattaggggaccagaggggaccgagcagaatagagtgcggaataaactcaagcgccttatcgctaagaggccccccctgcagtcactgcaggaacgagggctgctccgcgatcaggttttcggctgtcagctggagagtctgtgccaaagggagggtgatactgtgccctcgtttctcagattgtgcatcgccgccgtggataagagaggcctagatgtggacggaatttaccgggtatcagggaacctggcggtggttcaaaaactgagatttctggttgatagggaaagggccgtaactagtgatggccggtacgtcttccccgagcagcccggccaagagggacgcctggatctggatagtaccgagtgggacgacatacacgtcgtaactggcgcactgaaactttttttacgggagctcccccagcccctagtgcccccacttcttctgccccacttccgggccgcactcgccttgtccgagtctgagcagtgtttgagccaaatccaggagctgattggcagcatgcccaagccaaatcacgataccctcagatatttactggagcacttgtgccgggtaattgcccacagcgataagaatagaatgaccccacataatctggggattgtatttgggcccaccctgtttaggcccgagcaggagacctcagatcctgcagcccacgccttatacccaggtcaattggtacagcttatgctgactaattttacttcactgttcccttag

SEQ ID NO: 203368 - DNA, 900 bp, Artificial Sequence
  Description of Artificial Sequence: Synthetic coding sequence
atgaccaagatcgcccagggcggccggaagctgcggaagaactggggtccgtcctgggtcgtcttaacgggaaactccctcgtcttttatcgagaaccacctccgactgcacccagctccggttgggggcctgctgggtcccgacccgagtcgtccgtcgatctacggggggctgccttggcgcacggtcggcacttgtccagcagacgcaatgttctgcatatccggacaatccctggtcacgagtttctgctgcagtctgatcacgaaacagagttacgggcctggcatcgggccctccggacggtgatcgagcggctggatcgcgaaaaccccctcgaacttagactgagcgggtccggacctgccgagctgtcagccggagaagacgaggaagaggagagtgaattggtgtctaagcctctccttcggctgagctctcgccgcagcagtattcgaggacctgaaggaacagagcaaaaccgtgtgcgcaataaactcaagagactgattgctaaacggcccccactgcagagccttcaggaacggggcttacttcgcgaccaggtgttcggctgccagctggaatcactgtgccaaagagaaggggacactgtcccttctttcctgcgcctctgtattgcagcagtggacaagcgcggcctggatgtcgatgggatatatcgggtgtccgggaatctggccgtcgtgcaaaagttaagattcttggtggaccgtgagcgcgctgtcactagtgacggtcgatacgtctttccggagcagcccgggcaggcccttagtgaaagtgagcagtgcctcagccagattcaggagttaatcggcagtatgcctaagcccaaccacgatacgctgagatacctcctggaacacctatgctag

SEQ ID NO: 203369 - DNA, 1923 bp, Artificial Sequence
  Description of Artificial Sequence: Synthetic coding sequence
atgctgagcagccggtggtggcccagcagctggggcatcctgggccttggccccaggtcacctccaaggggtagccagctttgtgcgctttacgcctttacctacacgggagctgacggtcagcaggtatcccttgccgaaggagatcgctttctgctcctaagaaagaccaacagtgattggtggctggctagacgcctggaggctccatcgacttcacgacccatctttgtgcccgccgcctacatgattgaggaatctatccctagtcagtctcccactacagtgataccgggtcagctattatggacccctggccctaagcttttccacggctcattagaggagctgagtcaggccctgccatctagggcccaagctagtagtgaacagcccccccccttacctaggaaaatgtgtcgctcagttagcacagataacctgagtccctcactactgaaacctttccaggagggcccctctggtcgctctttgagtcaggaggacctccccagcgaagcaagtgcaagcacagcaggtcctcaacctttgatgtccgagcctccagtgtattgtaatctcgtcgatctgaggcgctgccctaggtctcctccccctgggccagcttgtccactcctacaaagactggatgcgtgggagcaacacttagatccgaatagtgggagatgtttctacataaatagccttacaggatgtaagagctggaagccacctcggagatctcgctcggagaccaacccgggatctatggagggaacacaaaccctgaaacggaataatgatgtccttcagccacaggctaaaggcttcagaagcgacactggcacccctgaaccgctcgacccccaaggtagtctgagcttgtcccagcgaacctctcagctggatccccctgcactccaggcaccaagaccactccctcagctgctagacgaccctcatgaagtggagaagtcgggtttactgaacatgacaaagattgcccagggaggtaggaaactgagaaagaactgggggccatcgtgggtggtcctgacggggaattcattggtcttctacagagaaccaccccccacagccccctcaagcgggtggggccctgcaggctccaggcccgagagctcggtagacctccggggcgcagccctggctcacggacggcatctgtcaagccgccgaaatgtattgcatattcggacaattcctggccatgagtttctgttgcaatccgaccatgaaacggaactccgcgcttggcaccgtgccctgagaaccgtcatagaaaggctcgatagagagaatcctctggaactgcgactgagcggcagtgggccagctgagctttccgccggagaagacgaggaggaggagtccgaactggtctctaagcctctcctccgactaagtagtaggagatcaagtatcaggggcccggagggcacggaacaaaacagggtgaggaacaaactgaagcgactgatcgccaagaggccacctctccagagcctccaggagcggggtttgctgagggatcaagttttcggctgccagctggagtccttgtgccagcgcgagggagataccgtgccctcgttccttagactgtgcatcgctgccgtggacaagcggggactagacgtggacgggatataccgggtgagtggaaacttggctgtggtgcagaagctcagatttttagtggaccgggaacgggcagtgacaagtgatggacgatacgtatttcccgagcagccaggccaggagggaagactcgacctcgattccactgaatgggatgacatccatgtagttacaggtgcccttaaactcttcctgcgtgaactcccccagcccctggtcccacctctgctcttgccacacttcagggcggcactgggatag

SEQ ID NO: 203370 - DNA, 1644 bp, Artificial Sequence
  Description of Artificial Sequence: Synthetic coding sequence
atgagcgagccccccgtgtactgcaacctggtggacctgcggcggtgcccccgctccccacctccggggccagcttgcccgttactgcagaggctggacgcttgggaacagcacctcgaccctaacagtggcaggtgcttttatattaactcacttactggatgtaaatcatggaagccgcctcggcgcagccgcagtgaaacaaatcctggatccatggaggggactcagaccctgaagcgaaacaacgacgtgctgcagccgcaggccaagggcttccgctcagacacgggaacccctgagcctctcgatccccagggctcactttccctgtcccaacgaacaagccaactggatcccccagcgttgcaggccccaaggcctcttccacagctgctcgacgatccacacgaggtagagaagtccggcctgcttaacatgaccaagattgctcagggtgggagaaaactcagaaagaactggggaccgagctgggttgtgctgaccggcaacagcctggtattctatagagaaccgcctccaacggctccatctagcggatggggcccggccggctctcggcccgagagctcagtcgatctgagaggcgcggcactagcacatgggaggcacctctcctctagaaggaacgttctccacatccgcaccatccctggccacgaattcctgcttcagtctgatcacgaaacagagcttcgcgcctggcacagggcgttaaggaccgtaatcgaaaggctggacagggagaatcccctcgagctaaggttgtcagggtctggccctgcggagcttagtgccggcgaggacgaggaagaggaaagcgagctcgtgtccaaacctttactgcggctctcttctcggaggagctctattcgaggccccgagggtaccgagcaaaaccgagtccggaacaaactcaaaagacttatcgcaaaaagacctcctttgcaatcattgcaggaacgcggattgctcagagatcaagtcttcggctgtcagctcgaatctctgtgccagcgagagggagataccgtgccaagctttctcaggctgtgtatagccgccgtggataagcggggactcgatgtcgacggaatttacagagttagtggcaatctggccgtcgtacagaagttaagattcctagtggatcgggaacgggcagtgacctccgacggacgctatgttttcccggagcaacctggtcaggaaggaagactggatttggattcaactgagtgggacgatatacacgtagtcaccggggctctaaaactgttccttcgggagctaccacaaccccttgtgccccctctactgctgccccactttcgtgccgcccttgccttgagcgagagtgagcagtgtctgagtcaaatccaggaactgattggaagcatgcctaagcctaaccacgatactctgcgctacctgcttgagcatctttgcagagttatagcacacagcgataaaaataggatgacaccccacaatctgggaatcgttttcggacccaccttatttcgacctgagcaggaaacgagcgaccctgccgctcatgcactctatcctggccaactggttcaactgatgcttacaaacttcacatctttgttcccatag

SEQ ID NO: 203371 - DNA, 894 bp, Artificial Sequence
  Description of Artificial Sequence: Synthetic coding sequence
atgagcgagccccccgtgtactgcaacctggtggacctgcggcggtgtccccgttccccaccccccggccctgcatgcccgctccttcagaggctggacgcgtgggagcagcatctagatccaaattctggccgctgcttctatataaacagtctcactggttgtaagagttggaagcctccacgcaggtcccgctctgagaccaaccccggtagcatggagggcacacagacacttaagcggaataacgatgtcttgcagcctcaggccaaggggttcagatctgatacaggaactcccgagccactagacccccagggcagcctgagcctgtcacagagaacgtcccaattggatcctcccgcactccaagctcccaggccccttccccagcttctcgatgatccacacgaggtcgagaaatcgggactgctgaatatgactaagatcgctcagggtggtcgcaaactccggaaaaattggggcccctcatgggttgttctcactggcaattctctcgtgttttaccgggagccgccacccactgcaccttccagcggatgggggcctgccggatcgcgaccggagtcctctgtcgacctcaggggtgctgccctggcgcatggcaggcatctcagtagcaggagaaatgtcctgcatatccggaccatacccggccacgaatttctgcttcagtcagaccatgagaccgagcttcgggcttggcatcgggccctgagaacagtgattgaaagactggaccgagagaatccactggagctgcggctatctgggtcaggcccagcagaactgtcagcgggggaagacgaagaagaggagagtgaactcgtcagtaaacctctcctgcgtctgtccagtagaaggtctagttag

SEQ ID NO: 203372 - DNA, 186 bp, Artificial Sequence
  Description of Artificial Sequence: Synthetic coding sequence
atgagcgagccccccgtgtactgcaacctggtggacctgcggcggtgcccccgctcccccccacctggtcccgcatgccctttattacaacgacttgacgcatgggagcagcatttagatccgaacagtggcaggtgcttttacatcaattccctcacaggctgtaagtcctggaaacccccctag

SEQ ID NO: 203373 - DNA, 471 bp, Artificial Sequence
  Description of Artificial Sequence: Synthetic coding sequence
tgagagggcgacaccgtgcccagcttcctgcggctgtgcatcgccgcagtggacaagcgggggcttgacgtagatggcatctaccgcgtgtcgggcaatctggccgtcgtgcagaaacttaggttcctggtggaccgagagcgggccgtgacgtccgatggacgttacgtgtttccggaacagccagggcaagctcttagcgagtccgagcagtgcttgtcacagattcaggagttaatcggaagcatgcctaagcctaaccacgacacccttcgctacctgttggaacatctgtgccgtgtcattgcacactctgataagaaccgtatgacaccacataaccttggcatagtctttggtccgacactgtttcggcctgagcaagaaacaagcgatccagcggctcacgcactgtaccccggtcagctggtgcaactgatgctgactaactttacttctttattcccttag

SEQ ID NO: 203374 - DNA, 396 bp, Artificial Sequence
  Description of Artificial Sequence: Synthetic coding sequence
atgagcgagccccccgtgtactgcaacctggtggacctgcggcggtgtccgcgctcacctcctccaggaccagcctgcccactgctgcagaggcttgacgcctgggaacagcatctcgatccgaactccggaaggtgtttttatatcaattctctgacaggatgtaaatcttggaaacctcctcggaggtctcgctctgagaccaaccctgggagtatggagggcactcagaccttaaaaagaaacaacgacgtgctgcagcctcaagccaagggcttccgtagcgataccggaactccagaacccctggatcctcaaggcagcttaagtctgtcccaacggacatcccagctggaccccccagctttacaggccccccggccactcccacagtag

SEQ ID NO: 203375 - DNA, 2028 bp, Artificial Sequence
  Description of Artificial Sequence: Synthetic coding sequence
gagcccggcagcggcagccgggaccccggccccggcatcgccgagccagacctgggtcgacccgccggtcacctcagagcagacacgtccccagccgagccgagagagatggaggattttgccagaggtgccgctagtcccggtccttcccgacctggtctggtgcccgtaagcataatcggggctgaggacgaagatttcgagaatgaactcgagacgaactcagaggaacaaaacagtcaattccagagtctcgagcaggtcaagagacgcccagctcacttaatggccttgttgcagcatgtagctctgcagttcgagccggggccattgctttgttgcctgcatgccgacatgctcgggtccctcgggccaaaagaggcaaaaaaggcttttctcgatttttaccactctttcttggagaaaactgccgttctcagagtgcccgtacccccaaatgtagcttttgagcttgaccggacgcgcgccgacctgatcagcgaagacgtacaacggcggttcgtccaagaagtagtgcagtctcagcaggtggctgtgggccggcaacttgaggattttcgatctaaacggctgatgggtatgactccatgggagcaggagctggcccagctcgaggcctgggtaggtcgggacagagcatcttacgaggcaagagagagacatgtggcagagcggcttttgatgcatctggaggagatgcagcatacgatctccacagatgaagagaaatctgctgctgtggtcaatgcgattgggctctatatgaggcacttaggagtccggacaaagtctggcgataagaagtccggtaggaactttttccggaagaaagtaatgggtaaccggaggtctgacgaaccggctaaaactaagaagggcctgtccagcatcttggatgctgcaagatggaacagaggagagccccaggttcccgactttcggcacctaaaagcagaggtagatgcggagaagccaggcgccactgacagaaaaggaggcgtaggaatgcctagccgcgatcggaatattggtgcacctggacaggatactccaggggttagtctgcacccactctccctcgattctccagatcgggagcctggcgcagacgctcccttggaactgggggattcctctccacagggtccaatgtccctggagtctctggcgccgcccgagtccaccgacgaaggcgccgagacggaacggtgtcctggatggggagctggtgcaggaggagtcgcttactgggctctcgtcggggggtgtcgggtcacagcggccatttgcgcctgcttgtctcaagcactagcgccccacgctcccctccttctatccgggtcagggcatagcagtccttttttctttcccttcctcatttcccttttattgccacattgtccaccttttctgctctccttcctgtttcccctcctgctccctctcctgccgttttttactaatcccagcccgcccccctttctttctaccactccttcaatctctttcattagcagccctctgttgtcacacctaccaccccctctgttcccacctcactctagtctcacctgggtattctttccccacctcccttcgcctagcgatctgccagctacattccattttttcagcccttccccctttagctttaagcctccgtgccccctcccccccactcctcgattagcacccgcctcctggtgtccttcgctgaaccccccccccctctgtagcgtgccttgggggccatgtcccccgtatagctggggagcagggtctgctagctgtccaagcctctgcagatgctttggcgacccactagttggtgcagggcgttgggtacggtttcacttgggcccccccctcactctttgtccctccctcccacgcagatggaagagatgggtgccgggaccctgggtcggcgaaggcctggcccctccacccttcctgcctgcgcccccgctctcaccgtggccactgccacctcttcattccctctag

SEQ ID NO: 203376 - DNA, 2784 bp, Artificial Sequence
  Description of Artificial Sequence: Synthetic coding sequence
atggccagcctgagcacctggagcagccccgccgagccccgggagatggaagacttcgcccgtggcgccgcttcaccaggacccagtcgcccaggcctcgtcccagtgtctatcataggcgcagaagacgaagacttcgagaatgagctagagaccaactcagaggaacagaattcacaattccaaagtctcgaacaggtcaagagacggccagcgcatcttatggctctgctccagcacgttgctcttcagttcgaacccggaccactcctgtgctgtctccatgcggacatgctgggctccttaggcccaaaagaggctaagaaggcatttctcgatttttaccactcttttctggagaaaaccgcagtgctgcgggttcccgtaccaccgaacgttgctttcgagctggacagaacccgggccgatctaatttccgaggatgtgcagagaaggtttgtgcaggaagtggtccaatcccagcaggtggcggtggggagacagctggaagatttccgctctaaaagattgatggggatgactccttgggaacaggaactggctcagctggaagcctgggtcggacgagatagagcctcctacgaagcaagagagaggcacgtcgccgagagactcctcatgcacctcgaggaaatgcagcacacaatcagtacagatgaggagaagtccgccgcagttgtcaacgcaatcggcctctacatgcggcatctcggggtccgaactaagtcaggcgacaagaagagtggcaggaatttcttccggaagaaagtgatgggaaaccgccgaagcgacgagcctgccaagaccaagaagggtcttagcagcatcctcgatgccgcgaggtggaaccggggagaaccccaggtccctgatttccgacatctgaaggccgaagtggacgccgaaaagccaggggcaacagacagaaaaggcggtgttggaatgccttcacgagacagaaacatcggggccccaggtcaggatacgccgggtgtatctctacacccgctctctctggattcacccgacagggaaccgggtgcagatgccccactggagctgggggacagcagccctcaggggcccatgtcactcgagagtctggccccccctgagagtacggatgaaggggccgagaccgaaagccccgaacccggcgatgagggagaaccaggaaggtccggtcttgagctagaacctgaagagccacccggttggcgggagcttgtgccaccggatacgttgcattctcttccaaagtcgcaggtgaagaggcaggaggtgatctctgagcttttggtcactgaagcagcccacgtaagaatgctgcgggtcctacacgacctgttctttcagccaatggctgaatgcttattcttcccacttgaggagctgcaaaatatatttccctccttggatgagctcatcgaggtccactcactctttcttgatcgcttgatgaaaagacgtcaagagtccgggtatcttatagaggagatcggagatgttcttctggcccgttttgacggagcagagggttcttggttccagaaaattagcagtagattctgcagccggcagtcttttgccttggaacagcttaaggcaaagcaaaggaaggaccccaggttctgcgctttcgtgcaagaggcggagagcagacccagatgtcgtaggctgcaactgaaggacatgatcccaacagagatgcaacggctgacaaagtaccctcttctacttcagagcataggacagaacactgaggaaccgaccgagagagagaaagtggagctggccgcggaatgttgccgtgagatcctccaccacgtgaaccaagccgtaagagacatggaggacctccttaggctcaaagactaccagcgccgtctggacctgtctcaccttagacaatcttccgaccccatgttgtctgagtttaaaaatcttgacattaccaaaaaaaaactggtccatgagggtcccctgacgtggcgtgtcaccaaagataaggccgtcgaagtgcacgtcctcctcctagacgatttgttattactcctgcaaagacaggacgagaggctccttttgaagtcccacagtcgcactctgacacccactccagatggtaaaaccatgctccgccccgtattgcgcctcacctccgcgatgacacgggaggtggcaacagaccacaaggccttctacgttctgttcacttgggaccaggaagcccagatctacgagctggtcgctcaaactgtctcagagcggaaaaactggtgcgcgcttattaccgaaacagctgggtccttgaaagtgcccgccccggcctcccgacccaaacccaggccttcgccctctagcactcgcgagccacttctctcctcttccgagaacggcaatgggggccgcgagactagccccgccgatgctaggaccgagcggattttgtccgatctgttacccttctgtcgtcctggcccagagggacagcttgctgcgacagccctcagaaaagttttgtccctgaaacagctgctgttccccgcggaagaagataatggcgccggaccacctagagacggcgacggtgtacctggcggaggcccactgagtccagcacggactcaggaaatccaggaaaacctgctgtccctcgaagagactatgaagcagctggaggaattggaggaagagttttgtcgattacggcctttactgagtcaactgggcggtaactcggtgccacagcctggatgtacttag

SEQ ID NO: 203377 - DNA, 2640 bp, Artificial Sequence
  Description of Artificial Sequence: Synthetic coding sequence
atggaggacttcgcccggggcgccgccagccccggccccagccggcccggcctagtccctgtatctatcataggggccgaagatgaggatttcgaaaatgagctggagaccaatagcgaagagcagaacagtcagtttcagtctctcgagcaggtgaagaggagacctgcccacttgatggcattgctgcagcatgtggccctccaatttgaaccaggccctctggtgttgcgcgtgcccgtgcctccaaatgtggcctttgaactggaccgcacacgcgccgaccttatcagtgaagacgtgcagcgcaggttcgttcaggaggtggtccaatcacagcaggtcgccgttggacgccaactcgaagattttcgtagtaagcgcttgatgggtatgacaccgtgggagcaggagcttgctcaactcgaggcttgggtgggacgggaccgtgcttcttatgaagccagggaaagacacgtggctgagcggctgttgatgcatctggaggagatgcagcacaccatcagtacagacgaagagaagtctgcagctgtcgtcaacgccatcgggttatacatgaggcacctgggggtacgaactaaatctggggacaagaagtcaggcagaaactttttcagaaagaaagtcatgggaaatagaaggtccgatgagcccgcaaagacaaagaaaggacttagcagcattctggacgcagcgaggtggaatagaggagagccgcaggttccagacttccgccatctcaaggccgaggtcgacgccgaaaaacccggagcaactgaccgcaaagggggtgtggggatgccttccagagatcgcaatataggtgccccgggtcaggacaccccgggcgtgtctcttcacccactttccctggacagcccggacagagagcctggagctgacgccccactggagctcggcgattctagcccccaaggccccatgtcacttgaatctctggctccacctgagagtactgatgagggcgctgagacggagtcaccggagcccggtgacgagggcgaacccgggcgtagtgggcttgaactggagccagaagaacccccgggctggagagaactagtacctccagatacccttcactccttgcccaagtctcaggtcaagagacaggaggtgatatctgaactgctcgtaacagaagcagcgcacgtgcggatgctgcgcgtgctccatgatctcttctttcaacctatggcggagtgcttattctttcctctggaggagctgcagaacatcttcccgagcctggatgaactgatcgaagtgcattccctgttccttgatcgcctcatgaaaagaaggcaggaatctgggtacttaatcgaagaaatcggcgacgtgttactcgcccgctttgatggtgccgagggttcttggttccagaaaatcagttctaggttttgttcgcgccaaagtttcgcattggagcagctgaaggccaagcagaggaaagatccaaggttttgcgcattcgtgcaggaagctgaaagccgaccacgatgtcggcgattgcagctgaaggacatgatcccgaccgaaatgcagcgacttaccaaatatcccctgttgctccaaagtatcggacaaaataccgaggagcccacagaacgagagaaggtcgagctggcagcagaatgctgcagggaaatcttacaccacgtgaaccaggcagtgcgtgacatggaggacctgctgagacttaaggactatcaaagacgccttgatctgtctcacctaagacagagctccgaccctatgttgagcgaatttaagaatttggacattactaaaaagaaactcgttcacgaaggccccctcacctggcgagtcaccaaggacaaggctgtggaagtgcatgtccttctgctggatgatttgttactgttgcttcagagacaggacgagcggctactcctcaaatcacatagcagaactttaacccccaccccagatggcaaaactatgcttcggcctgtgctccggctaacaagcgctatgacgagggaggtcgcgacagatcacaaagcattctacgtactctttacttgggatcaggaagcccaaatctacgaacttgtcgctcagacagttagcgagcgtaagaactggtgcgctttaatcaccgaaactgccggaagtctgaaagtgcctgcccccgcctcacggccaaagccgcggccatccccatcatctactcgcgagcctttgctgtctagcagcgaaaacggaaacggaggccgtgaaacgtcgcctgcagacgcccggaccgagcgtatacttagcgaccttctacccttttgccggcctggccctgaaggacagctggccgctacagctctccggaaagtcctgtctctgaagcagctgctgttcccagccgaggaggacaatggtgcaggccccccgcgggacggcgatggagtccctggtggtggccctctgtcccctgcccgcacgcaggaaattcaggaaaacctactttccctggaggaaaccatgaaacagctcgaagagctggaggaggagttttgccggctgcgccctctgctgagtcagctgggaggaaactctgtgccacaacctggatgcacctag

SEQ ID NO: 203378 - DNA, 2739 bp, Artificial Sequence
  Description of Artificial Sequence: Synthetic coding sequence
atggaggacttcgcccggggcgccgccagccccggccccagccggccgggtcttgtgccagtgagcatcatcggggctgaggacgaggacttcgagaatgagctggaaacaaactctgaggagcagaattcacaattccagagcttagagcaggtgaaacgacgtccggctcatctcatggccctcctgcagcatgtcgcgctacagtttgagccaggacctctactgtgttgcctgcacgcagatatgttgggatccctggggccgaaggaggctaagaaggcttttttggatttctatcactccttcctcgagaagacggccgtcttgagggttcccgtgccaccaaacgtagcatttgagctggataggactcgcgccgatctgatttccgaagatgttcagaggcgcttcgtgcaggaagtggtccagagccagcaggttgccgtgggccgccaacttgaggacttcaggagcaaaaggctgatggggatgactccttgggagcaagagctcgcacagctcgaggcctgggtgggccgtgatagagcttcgtacgaagcacgagaaaggcatgtggctgaacggctcttgatgcacctggaggagatgcagcacactatttcaacagacgaagaaaaaagtgcagctgtggtgaacgccattggactctatatgcgacaccttggcgtgagaactaaaagcggtgataaaaagagtggcaggaatttctttcgcaagaaggtgatgggcaacagaagaagtgatgagcccgcaaaaacgaagaagggcctgtccagcattttagacgcagcgaggtggaatagaggagagccccaggttccggatttccggcatctaaaggctgaggtggatgcggagaagcctggtgcgaccgacaggaaaggcggggtaggcatgccatctcgcgacaggaacatcggcgctcccggacaggatacgcccggagtttccctgcaccccctttctctggatagcccagacagagagcccggggccgatgcccccttagagctgggagattcctctccccagggccctatgagtctagagtctctcgcgccaccagaatcaactgatgagggggcggaaacagaaagtccagaaccgggtgatgagggcgagccaggacgatctggactggagctcgagccggaggagcccccaggatggagggagctggtgcctccagacactctgcactccctgccgaaaagccaggtcaagagacaggaagtaatttcagagctcctcgtgaccgaggccgctcacgttcggatgttgcgcgtgctccacgacctcttcttccaaccaatggctgaatgtctctttttccccttagaagagctgcagaacatttttccctctctggacgagctcatcgaagttcatagtctttttctggatcgcctgatgaaacgaaggcaggagtcaggatacttaattgaggagattggcgacgttctgctcgcccgatttgatggcgccgagggaagctggtttcagaagatcagtagcagattttgctccagacagtccttcgctctggagcaacttaaagccaaacagcggaaagaccctaggttctgtgcctttgtacaggaggctgagtccagacctcgctgtaggagactgcagctgaaagacatgatccccactgagatgcagagattgactaaatacccccttctgctgcagagcattggccaaaataccgaagagcctaccgagagggagaaggtggagttggccgccgaatgttgtagggaaatactccaccacgtaaatcaggccgtgcgcgatatggaggacctactcagactcaaagactaccagcgcaggcttgacctatcgcacctccggcagagtagtgatcctatgctgagcgaattcaagaatctggacatcactaaaaagaagctggtacacgagggccccctcacctggcgggttacgaaagacaaagcagtggaagtgcacgtgctattgctcgacgatctgctgctgttactgcagcgtcaagacgagcggctgttacttaaaagtcactcaaggacactcacgcccacccccgatggcaagaccatgcttaggccagttttgcgcttaacgtccgctatgacccgtgaagtagccaccgaccacaaggctttttacgtgttgtttacttgggaccaagaggcccaaatttatgagttagtcgcacaaaccgtgtccgaaaggaagaactggtgcgccctaatcacagaaacagctggatcactcaaggttcccgcacctgcgtctaggcctaagccaagacctagtcctagtagcactagagagccactcctcagttcttccgaaaacggcaatggagggcgggaaacaagccctgctgacgctcggaccgaaagaatactaagcgacctcctgcccttttgtcggcccggaccagaaggccagctggctgccacagctctgagaaaggtactctctttaaagcagctgcttttccctgccgaggaagataatggagctggccctcccagagacggggatggtgtaccggggggtgggccgttgagcccagctagaactcaggaaatccaggagaacctgctttcactggaggagaccatgaaacagttggaggaattggaagaagaattttgcagactccggcctctattgtctcaactcggtggtaattccgttccacaacctggatgtacctag

SEQ ID NO: 203379 - DNA, 2847 bp, Artificial Sequence
  Description of Artificial Sequence: Synthetic coding sequence
atggccagcctgagcacctggagcagccccgccgagccccgggagatggaagattttgcacgcggcgcagcaagtcctggcccatcacgcccaggtttggtgcctgttagtatcattggagccgaggacgaagacttcgaaaacgaactcgagaccaattctgaggaacagaatagtcagtttcaatctctggagcaggtcaagcggcgccccgcacatctcatggccctacttcagcacgtcgcgctgcaattcgagccgggaccactggtcctgagggtgccggtgcccccaaacgtcgcctttgagctcgataggacaagggccgacctgatctcagaggatgtccagcgcaggttcgttcaggaagtagttcagagccagcaggttgccgtggggcgacaactggaggactttcgaagcaaacggttgatgggcatgaccccctgggagcaggaactggctcagctagaggcgtgggtagggcgagaccgcgcgtcttacgaggccagggaaaggcatgtagcagagcgcttgctgatgcacctcgaagaaatgcagcatactatatctaccgacgaggaaaagtctgcggccgttgtgaacgccattggcctttacatgaggcatttgggcgtaagaaccaagagcggcgataaaaagagcggtaggaactttttccgcaagaaggtgatgggaaacagacggtcagacgagccagcgaaaacaaagaaggggctgtcgagcattctggacgccgcgagatggaacagaggcgaacctcaggttcctgatttcaggcatcttaaggctgaggtggatgctgagaaacctggcgccactgatagaaagggtggtgtgggcatgccctcgagggaccgcaacattggggcccccggccaggacacccctggtgtctccctacacccactatctctggattcacccgatagagaaccaggagctgatgctcccctcgagttgggcgactcgtcacctcagggacccatgtcactagagtctttggcaccacccgaatccaccgacgaaggggcagagacggaatccccagagcccggtgatgaaggcgagccaggcaggtccgggctagagctggaacctgaggagcctccaggctggcgggagcttgtgccccctgacactctccactcacttccaaagagccaagttaaaagacaggaggttatttctgaactgctcgttaccgaggcggcccacgtccgcatgctccgcgtgctccatgacctattctttcagccaatggcagagtgcttatttttcccacttgaggagctgcagaatattttcccttctttggatgaactgatcgaggtgcatagtctctttcttgaccggctgatgaaacgacgacaggagtccgggtatctcatcgaagaaattggggacgtattactggctcgcttcgatggggccgaaggctcctggttccagaagatatccagccgattctgttccagacagtccttcgcccttgaacagctgaaagccaagcaaaggaaggatccaaggttttgcgctttcgttcaggaggcagagagccggcccaggtgtaggagactacagttgaaggatatgattcccaccgagatgcagaggctaaccaagtacccattgctccttcagtctattggtcagaatacagaggagcccacggagagggaaaaagtcgagctcgccgccgagtgctgtagggaaatcttacatcacgttaatcaggctgtgagggacatggaggacctgctccgcctgaaagactatcaacggcgtctggatctgtcacacttgcggcagagctcagaccccatgttgtcagagttcaaaaatctggatatcacgaaaaaaaaattagtacatgagggccccctaacctggcgcgttactaaggacaaggccgtggaagtccacgtgttgctgctagatgacctgctgctgctgctgcaacgccaggacgagagactacttttgaagagtcactcgagaacgctgacccctaccccagacggtaagactatgctgcggcccgtgctgcgactgacgagcgcaatgacacgggaagttgctaccgatcataaagcattctacgttctgtttacctgggaccaggaggcgcagatctacgagttggtagctcagaccgtgtctgagagaaagaactggtgtgcccttatcacggaaaccgccggcagcctcaaagttcctgcacctgctagtaggcccaaaccacgcccatccccgagtagcactcgcgagcccctgctgtcatctagtgagaatggtaacgggggccgagaaacgtctcccgctgacgcccggacagaacgcatcttatctgacctgctgcctttctgtaggccgggacctgagggacagttagctgcaactgcattgaggaagggggtaggcggaggtatccttcctcctgagactccaccagttagtgcctggggagagctttgtcccccagcctggctacatctgaggttcccgccccggaaagctttctgcaaaaaagagcgtaatggaggtgaggatgtgcgcgaccacccacacccacacagctgtaggagcattagtcacccagaaggtcttagaaggggaagttgtgggccacgattgggtggggcacagttaggactgctggcaccgcatgaacctaggccctctctgcctcccgcactatgtcttggagactcaggcctccacagcggaggccatcatggggatccaggacacttgtccatcgcatgtggcgggcacccatccacaccgactccaaagtgtcttcgaagtgtttttattccctag

SEQ ID NO: 203380 - DNA, 4023 bp, Artificial Sequence
  Description of Artificial Sequence: Synthetic coding sequence
atgcggccccccggcttcctgagccgggcccccagcctgaaccgggctgaacgcggaatctggtcttgttcaatggaccagcgggaaccactccctccagcgcctgcggaaaatgagatgaagtacgacactaataacaacgaagaggaggagggagaacagttcgacttcgatagcggtgatgagattccggaggccgacagacaggcgccctccgctcccgaaaccggtggggctggggcgtctgaagcgcccgctcccacaggaggcgaggacggggccggagccgagaccacacctgtggctgagcctaccaagttggtgttacccatgaaagtgaatccatatagtgtgatagacattactccattccaggaggaccagccgcccacccccgttccgtcagcagaagaggagaacgtgggccttcacgtcccttgcgggtacctagtgccggtgccttgtggatacgcggtccctagcaatctgccactcttgctacccgcctactcatccccagtaattatctgcgctaccagtctggacgaagaagctgaaacacccgaggtcaccgaggatcggcagccaaactccctcagcagtgaggagccgccgacctcagaggaccaagttggcagagaggactctgctctagcacggtgggcagcagaccccgctaatactgcatggatggagaatcccgaggaggcaatctatgacgatgtccctcgggaaaattccgactcggagcctgacgaaatgatttatgatgatgttgaaaacggcgacgaaggcgggaattcttccctcgagtatggctggtcctcgtcagaatttgagtcgtacgaggaacagtccgacagtgaatgtaagaacggaattcccagatcctttttacgcagcaaccacaaaaaacaacttagtcacgatctgacgcgactaaaagagcactacgaaaaaaagatgagagacctgatggctagcacagtgggggtagtggagattcagcagctacgccagaagcacgaactcaagatgcagaagcttgttaaagccgccaaagatggtactaaagacggtctcgagagaacacgggctgcagtgaaacgtggcagatcttttatccgaaccaagtctctcatcgcccaggaccaccgtagcagtcttgaggaagaacagaacctgttcatcgatgtggactgcaagcatcccgaggcaatacttacgccaatgcctgaagggcttagtcagcagcaggtggttcggagatacatccttggatcagtcgtggactccgaaaagaattacgtcgacgccctgaagagaattttagaacagtacgagaagccactgtctgaaatggaacctaaagtgctttcagaaagaaagctgaaaactgtattctatagggtaaaggagatcttgcagtgccacagtctgttccagattgcactggccagcagggtgtcagaatgggactccgtagaaatgatcggtgacgtattcgtggccagtttttcaaaatcaatggtactggacgcctacagcgagtacgtgaacaacttcagcactgccgtggccgtgctgaagaagacctgtgctacaaaaccggcttttctggaatttctcaagcaagagcaggaggcctcgccggatcgtactacattgtattcgctcatgatgaaaccaatccagcggtttcctcagtttatcttgcttctccaggatatgttaaagaacacgtctaagggtcatcccgatcggctccctttgcagatggccctcaccgagcttgagacactggctgagaaactgaacgagaggaaacgagatgccgaccagagatgcgaagtgaaacagattgcaaaggcaataaacgagcggtatctcaacaagcttctttctagcggctcccggtacctaatcaggagtgacgacatgatcgagactgtctataacgatagaggcgaaatcgtgaaaactaaggaacgccgggtttttatgctgaatgacgttcttatgtgcgctactgtgtcttccaggccatcccatgactcccgagtgatgagttcacagcggtatctgctaaagtggtctgtcccgctgggccacgttgatgcaatcgaatatgggtcaagtgcaggcactggcgaacatagccggcatcttgcggtacacccccccgagtccttggccgtggtagccaacgcaaagccaaacaaggtttatatgggacctggccagctctatcaggatttgcaaaacctgctgcacgacttaaatgtgatcggccaaatcactcagctgattggtaaccttaagggcaactatcagaacttgaaccagtctgtggcacatgattggacatccggtctgcagcggctgattttgaaaaaggaggatgaaatccgcgctgcggactgctgtagaatacagctgcagcttccaggaaagcaggataagtcaggtcgcccaacatttttcacggctgtctttaacaccttcacgcccgccattaaggagtcatgggtgaactcactgcagatggccaaactggcccttgaggaggaaaatcacatgggctggttctgtgtggaggatgatggcaaccatatcaaaaaggaaaaacacccactccttgttgggcacatgcccgtcatggtggccaagcagcaggagttcaaaatcgggagctgtacccatcagatggggcaaatcgctatcgtttctttccagaatagtacccctaaagtgatagagtgctttaacgtcgaatctagaatcctgtgtatgctatatgtgcccgtcgaagagaagaggagggagcctggcgcccctcccgatcccgagacacccgcggttagagccagcgatgtgcccacaatttgtgtggggacagaagaggggagtatctccatctacaagtcctcccagggatcgaaaaaagtcagactgcagcacttctttacacccgagaaatccaccgtcatgagtttggcatgcacgtctcagtcgctctacgctgggctagtgaacggagcggttgcatcttatgctcgagccccagatggatcttgggactcagagccgcaaaaagttatcaaactgggagtgctcccagtgcggagtctgcttatgatggaagacacgctgtgggcagcgtcaggggggcaggtctttatcatctcagtggagacacatgcagttgagggacagctggaggctcaccaggaggagggcatggtcatcagtcacatggccgtaagcggggtcggcatctggattgcattcacctcaggttctacattgaggctgtttcacacggagaccttgaaacacctccaagatatcaacatcgccacccccgtacacaacatgctgccagggcaccaacgcctgtcggtgaccagccttctcgtgtgtcacggactcctcatggtgggaacgagcctcggagtgctcgtggccttgcctgtgcctagactccagggcattcccaaggttactggcaggggcatggtgtcctatcatgcgcataactccccagttaagtttatcgtgctggctacagctctacacgaaaaagataaggacaagtcaagagatagcttagcgcctggccccgagccacaggacgaggatcagaaagacgcactgccaagcggaggcgcggggtcttctctgagtcagggcgatccggacgcagctatatggctaggggattccttaggtagtatgactcagaagtcggacctttcgtcttcctctgggagtcttagcttgtcccatggaagctctagccttgagcataggtctgaggactctaccatctacgacctgttgaaggatccagtgtctttacgctctaaagcccgccgcgcgaaaaaggccaaggcgagcagtgcgttagttgtatgcggaggtcagggccatcgacgggtgcatcgcaaagccaggcagccccaccaggaagagctagcccctaccgttatggtgtggcagatccctctgctgaatatttag

SEQ ID NO: 203381 - DNA, 4035 bp, Artificial Sequence
  Description of Artificial Sequence: Synthetic coding sequence
atggaccagcgggagcccctgccccccgcccccgccgagaacgagatgaagtatgacactaataacaacgaagaggaggaaggtgagcagttcgatttcgacagcggcgacgagatccctgaagcggatagacaggcaccctcagcccccgagacaggcggggccggcgccagcgaggcccctgcaccaactggtggcgaagatggtgcaggcgctgaaaccacacctgtcgctgaaccgacaaaactggtgctcccgatgaaagtgaatccgtacagtgtaattgacattacccctttccaggaggaccagccgccaacaccagtgccgagcgccgaggaagagaacgttggtctccacgtgccatgcggatatctcgttccggtcccctgcggctacgctgtgccatcaaacttacctcttttactcccagcatattcttcacctgtcattatatgcgcaacctctctggatgaagaggagacaccagaagttacagaggaccgccagcccaactctctgagcagcgaggagccgcctacctccgaggatcaggtaggccgcgaggatagcgccctggctcgctgggccgccgatcccgcaaacaccgcctggatggaaaatcctgaggaagctatctatgatgacgtgcctagggaaaattccgattctgagccagacgaaatgatctacgatgacgtcgaaaacggagatgaaggagggaactcgtccttggagtacggctggtctagcagcgagttcgagagctacgaagaacagtctgatagcgagtgcaagaacggtataccaaggtcttttctgcgcagtaaccacaaaaaacaacttagtcacgatctcacccgcctgaaagagcactacgaaaaaaagatgagggacctgatggcttcaactgtgggggtggtggaaatccaacagctgcgtcagaagcacgagctgaaaatgcagaagctggtgaaggcagcaaaggatgggacaaaagacggcctcgagcgcacccgggctgcagtgaagaggggacggagtttcatccgcactaaatctctgattgcccaagatcaccgttcgtcgctggaggaggaacagaatttgttcatcgacgtggactgtaagcatccagaggctattctgactcccatgccggaagggctctcgcagcagcaggtcgtcagaaggtatattctaggctcagtggtcgactcagagaagaattatgtggatgccttgaaaaggatactagagcagtacgagaagcctctttctgagatggagcccaaagtccttagtgagcgaaagctgaagactgtcttctatagagtgaaagagattttgcagtgtcacagtctcttccaaattgcactggcaagtcgtgtttcagagtgggactctgtcgagatgatcggcgacgtgttcgtggcatccttcagcaagtctatggttctggatgcttatagtgagtatgtgaataacttctccacagccgtcgcagtgctgaagaaaacttgtgctacaaaacctgcctttctggagtttctcaagcaagagcaggaagcctctcctgatcggacaaccctgtacagtctgatgatgaaaccaattcagagatttcctcagttcatcctactgctgcaggacatgctgaaaaacacctcaaaggggcatcctgatagactgcctttgcagatggctctgactgagctagagacactggctgagaagctaaacgaacgtaagagggacgccgaccaaaggtgtgaggtcaaacagatcgcgaaggccattaacgagcggtatctcaacaaattgctgagctctggatcaagatatctgataaggagtgatgacatgatcgagactgtctataatgatcgaggcgagattgtgaaaactaaggagcggcgcgtgttcatgcttaacgatgttttgatgtgtgcgaccgtgtcatcacggccctctcacgactcacgagtaatgtcttctcagcggtatctgctcaagtggagcgttccactcggccatgtggatgccatagagtacggttccagcgcaggcacaggggaacattcccgccacctggctgtccacccgcctgaatcgttggctgtggtagctaatgcgaagccaaataaagtttacatggggcccggtcagctgtaccaggatctgcagaacttgctgcacgacttgaacgtgattggccaaattacacaattaattggtaatctaaaagggaactaccaaaatctgaatcaaagcgtagcacacgattggacatccggattgcaacggttgattttgaagaaagaagatgagattagggctgccgactgttgccggatccagctgcagctaccagggaaacaggataagtcaggacgccccacgttttttactgcagtgttcaacactttcacgcccgctatcaaggagagctgggtgaactccctccagatggcaaaactggcgctggaggaggaaaaccacatgggttggttttgcgttgaggacgatggcaaccacatcaagaaggaaaaacatccactgctagtcggacacatgcccgtcatggtggcgaagcaacaggagtttaaaatcgaatgcgctgcttacaatccagaaccctatctgaataacgagtcccaacctgacagcttttcaacagcacacgggtttctctggattgggtcctgtacacatcaaatggggcagattgcaattgtgtcgtttcagaattcaactcccaaggtaatcgaatgttttaatgtggagtccagaatcttatgcatgctgtacgttcctgtagaggaaaagcgccgggagccaggcgcaccgcccgatcctgagacacccgccgtgagggctagtgatgttccaaccatttgtgtgggcactgaagagggcagcattagcatatacaagagttctcagggcagcaagaaggtgaggctgcagcatttcttcacccccgagaaatccactgtgatgtcgctagcttgcacatcacagtctctgtatgccgggctggttaacggagccgttgccagttatgcacgggcacctgacggctcgtgggactcagagccacagaaggtgatcaaattgggggtgctccccgtcaggtccctgctgatgatggaagacaccctttgggccgcgagtggaggccaggtgttcattatttctgtggagacacatgctgtggaggggcagctcgaagcccaccaagaagaaggtatggttatttcccatatggcagtgtcaggagtgggaatctggatcgcgttcaccagtggctcaacactgaggttatttcatacagaaactttgaagcatctacaggacattaacatagccacacccgtccataacatgctccctggacaccaacgcctgtccgtaacaagcctgttagtgtgtcatgggctgcttatggtgggaaccagccttggcgtgttggtcgcgttgcccgtgccacgcttacagggcattcccaaagtgaccggacgcgggatggtctcttatcacgcccataactctccagtgaaatttatcgttctggcaacggccctgcacgaaaaggacaaagataagtctagagattccctcgctcccgggccggaaccacaagatgaagatcagaaggatgctctcccatccgggggggccggctcgagtctgagtcaaggcgatcccgatgctgccatctggctcggtgattccctgggaagtatgacgcagaagtctgatctgtcctcttcgtccggtagtctcagtctctcgcatggctcctcaagcctggagcacaggtccgaagacagtacgatctatgatcttctgaaggaccccgtctctttaagatcgaaggcaaggcgggcgaaaaaggcaaaagcctcttctgcactggtggtttgcggtggccagggtcacagacgtgtgcacaggaaggccaggcaaccacatcaggaggaactggcacctacagtgatggtgtggcaaattcctctgctgaacatttag

SEQ ID NO: 203382 - DNA, 1833 bp, Artificial Sequence
  Description of Artificial Sequence: Synthetic coding sequence
atgcggccccccggcttcctgagccgggcccccagcctgaaccgggccgagagaggtatatggagctgctcaatggaccagcgcgaaccattgccacctgccccggctgaaaacgagatgaaatatgatactaataacaatgaggaagaagagggagaacagtttgactttgattccggcgatgagattcctgaggccgatcgtcaggctccatccgcccctgaaactgggggcgccggggcgtcagaggccccggcccctacaggcggggaggatggcgctggcgcagaaaccacccccgtggccgaacctaccaaacttgtgttaccaatgaaggtgaatccatacagtgttattgatatcacaccctttcaggaggatcagccacccacacccgtgccttctgccgaagaggagaacgttggcctccacgttccctgtggctatttagtgcccgttccctgtggatacgcagtgcccagcaatttacctcttctcctgcctgcctactcatcgcccgtaattatctgtgcaacatcactggacgaggaagctgaaactcccgaggtgaccgaggatcgccagcctaacagtctcagtagtgaagagccacccacttcagaggatcaggtgggcagggaagactccgccctggctaggtgggccgctgacccggccaacacggcctggatggagaacccggaggaggctatttatgatgacgtgccccgcgagaattccgactccgagccagacgaaatgatctatgacgatgtcgaaaatggggacgaagggggcaattcatctctggagtatggctggtcctcctctgaattcgagtcttatgaggagcagtcggactcagaatgcaaaaacgggataccccggtcttttctgaggagcaatcataagaaacagatgcaaaagctggttaaggcagctaaggatggcacaaaagatggcctggaacggacacgggctgccgtgaagagagggaggtccttcatccgtacgaaatccttgatcgcccaagaccacagatccagtcttgaggaggagcagaacctgttcattgatgttgattgtaagcatcccgaggcgatcctgacaccaatgccagaaggcctgagccagcagcaggtggtccgtcgctatatcctggggagtgtcgtggattccgaaaagaactatgttgatgccctgaagcggatactggagcagtacgaaaaacctctatcagaaatggaacctaaggtgctgtctgaacgcaagttgaagacagtgttttaccgagtaaaagagatacttcaatgccattcgttgttccaaatagcactcgcctcccgggtgtcagaatgggattcagtcgaaatgatcggtgacgtgttcgttgccagcttctccaaatcgatggtccttgacgcttactccgaatatgtcaacaatttttcaacagccgtcgcagtgctgaagaaaacatgcgctacaaaacccgctttcttggagtttctgaagcaggagcaggaggcatctcctgatcgcacaaccctctacagcttgatgatgaagccaatccagcgcttccctcagtttattctgttgcttcaggatatgctcaaaaatacttctaaaggtcatccagataggctgccactgcagatggctctcaccgaactggagacactcgctgagaagctgaacgaacgaaagcgtgacgctgatcagcgatgcgaagtgaagcagattgccaaagctattaatgaacgatatctgaacaaggtcgagagggggttcctgcagttgtactctaagatcatctttgccctgtgttag

SEQ ID NO: 203383 - DNA, 4110 bp, Artificial Sequence
  Description of Artificial Sequence: Synthetic coding sequence
atgcggccccccggcttcctgagccgggcccccagcctgaaccgggcagagcgaggcatctggagttgctcaatggatcagagagagcctcttccccccgcccctgccgagaacgagatgaaatatgataccaacaacaacgaagaagaggagggcgaacagttcgatttcgatagcggggatgaaatacctgaagccgatagacaggccccgagcgcgccagagaccggaggcgctggcgcctctgaggctccagccccaaccggaggcgaagacggcgctggcgctgagactacccccgtggccgagcctacaaagttggttctgcccatgaaagtcaacccgtactctgtaattgacatcacccccttccaggaagaccaaccccctactcccgtccctagcgccgaagaggaaaacgtcggcttgcatgtcccttgcgggtacttagtgccagtcccatgtggatacgcggtgccatcgaacctgcctctgcttcttcccgcgtactcctctcctgtcattatttgcgcaacctctttagatgaagaggcagagactcccgaggtgacagaggaccgccagccaaatagcctgtcatcagaggaacctccgacttctgaagaccaggtcggtagggaggattctgcactcgcccgatgggccgcagatcctgccaataccgcctggatggagaatcctgaagaagctatttatgatgacgtacctagggagaactcagattctgaaccggacgagatgatctatgatgacgtggaaaatggcgacgaagggggcaatagtagtttggagtatggatggtcttcatctgagtttgaaagttatgaagaacagtccgattcagaatgcaagaatggtatcccccgtagctttcttcgcagcaatcataagaagcagttgtctcatgacctcactaggctgaaggaacattacgaaaaaaagatgcgggacctcatggcatccaccgtgggggttgtggagattcagcagctgagacagaagcatgagttgaagatgcagaagctggtgaaagcagctaaagacggcactaaggatggactggaacgaacacgagccgcagtgaaaagaggtcgttccttcatcagaacaaaatcccttatagctcaggatcacagatccagcctggaggaagaacaaaatctgtttattgatgtggattgcaagcacccggaagccatactgacccccatgccggaaggtctttcacagcagcaagtagttaggcgatacatcctggggtctgtcgtcgatagcgagaagaattatgtggacgctctgaagcggatcttagagcaatacgaaaagccactctctgaaatggaacccaaagtgcttagcgagaggaagctcaagaccgtcttctacagagttaaggagatactacaatgccactctctgtttcaaattgcgctggcgagtagagtttcagagtgggactccgttgagatgattggagacgtctttgtcgccagcttttcaaagagtatggttttggacgcctacagcgagtacgtgaataacttttctactgctgtcgctgtgctgaaaaagacgtgtgccaccaaacctgccttcctggagtttctgaaacaggagcaggaagccagcccggatagaaccaccctgtactcactgatgatgaagcctatccagcgattcccgcagtttatcttgttactccaagacatgttgaagaatacatcaaaggggcaccctgacagattacccctgcagatggcccttaccgagttagagacacttgcggagaagctgaacgaaagaaagcgggacgcagatcagcgttgcgaggtcaaacagattgcaaaggccattaacgagagatatttaaataagctcttgtccagtggatctcgatacctgatcaggagcgatgacatgatcgagactgtgtataatgacagaggcgagatcgtcaagacaaaggagcgacgcgtgttcatgcttaacgatgttctaatgtgcgccaccgtcagctctcggccgtcccacgactctcgtgtgatgtcaagccagcgctatctgctgaagtggagtgtgcctctgggccacgtggatgccattgaatacggatccagcgccggtacaggcgagcattctcgtcacctggctgtgcaccctcctgaatccctggccgtggtggccaacgccaagccgaacaaggtctatatgggcccggggcagctgtaccaggatctccagaatctacttcatgatctcaacgtgattggacagataacacagttgatagggaacttaaagggaaactaccagaacttgaaccagtccgttgcgcacgactggacttctggcctgcaacgtctgattctgaaaaaagaggatgagatccgggccgcagattgctgtagaatccagctgcaactgccagggaagcaagataagtcaggacggccaactttttttaccgccgtgtttaatacgttcaccccggccatcaaagagagttgggtgaatagcctgcagatggcaaaactggctctggaagaagaaaaccatatgggatggttttgtgtggaggatgatggcaatcatattaaaaaagagaagcatcctctccttgtggggcacatgccagttatggttgccaaacagcaggagtttaagattgagtgtgctgcatataaccctgaaccgtatctgaataatgagtctcagccggactcattttctactgcccatggcttcctgtggatagggtcgtgcacccaccagatgggacagatcgcaatcgtgtcattccagaacagcacccctaaagtgattgagtgttttaatgtggagtccaggatcctatgcatgttgtatgtccctgttgaggaaaagcgacgtgaaccaggcgcccctccagatcccgagacacccgccgtgcgagcgagcgacgtgcctactatctgcgtaggtaccgaggaaggaagtatctctatctacaagtcgagccagggcagcaagaaggttaggctgcagcacttttttactccagaaaagtccaccgtgatgtctctcgcctgtacttcccaatccttgtatgcaggcctcgtgaatggggctgtggcttcttacgctagggcgcccgacggatcctgggactccgaacctcagaaggtgatcaaactgggcgtgctacccgttaggtctctgctgatgatggaagataccctgtgggctgcatctggcggacaggtcttcataatatcagtggagactcacgctgtggaaggacagctggaggctcatcaggaagaaggcatggtaatcagccatatggcagtctcaggtgtgggaatttggattgcattcacgtccggttccactttacggttgttccacacagaaaccttgaaacatctgcaggatattaacatcgccacacccgtccacaacatgttgcccggccatcagcgactgtctgtgacaagtctgctcgtctgccacgggctgctgatggtggggacatccttgggcgtgctagtcgctttgcccgttcctcggctgcagggcatcccgaaagtgacaggtcggggcatggtgtcttatcacgctcacaactcaccagtgaaattcatcgtgcttgctactgccttacacgagaaggacaaagataagtcccgtgactccctggctccaggtccagaaccgcaggacgaggatcagaaagatgccctgccatctggcggcgccggctcaagcctctcgcagggcgatcctgacgctgccatatggttaggggattccctgggtagtatgacacagaagagcgatttgagcagttcatctgggtccctcagcctttcccacggttcctcctccttggagcacaggtcagaagattccacaatctacgacctcctgaaggatcccgtctctctgcggagcaaagctcgccgagcaaagaaggcgaaggccagttctgccctagtggtatgtggtgggcaggggcacagacgagtacaccgcaaagcgcggcagccacaccaggaggagctggcccctactgttatggtgtggcaaatcccgttgctcaacatttag

SEQ ID NO: 203384 - DNA, 4107 bp, Artificial Sequence
  Description of Artificial Sequence: Synthetic coding sequence
atgcggccccccggcttcctgagccgggcccccagcctgaaccgggccgaaaggggcatctggagttgctccatggatcagcgggagcccctgccacccgcccccgccgaaaatgagatgaagtatgataccaacaacaacgaggaggaagagggggaacagtttgacttcgactccggagacgagatacctgaagctgatcgccaagccccctccgctcccgagactggtggcgccggagcttcggaggctcctgctcccactggcggagaggacggcgccggcgccgagaccactcctgtggccgaacctacgaaactggttttacctatgaaagtcaatccttactccgtcattgatatcaccccctttcaagaagaccagccgcctaccccagtgcctagcgccgaggaagaaaatgtgggtctgcacgtgccctgtggttacttagtccctgtcccctgtggatacgcagtgccttcaaatttacccttgctgttaccagcgtactcatcacctgtaataatctgcgccacctctctggatgaggaggctgagactcccgaagtgacagaggaccggcagcctaattccctgagttccgaagaaccgccaacaagcgaggaccaggtgggacgagaagactccgccctggcgcggtgggccgccgatcctgccaatacagcctggatggagaaccccgaggaggcgatctacgatgatgtgccccgtgaaaactccgatagcgaacccgatgagatgatttatgacgatgtggaaaacggagatgagggtggaaattccagcctggagtatggttggtcgagctctgaattcgaaagctacgaagagcagtctgacagcgagtgtaaaaacggaatccccagatcttttctgcgatcaaatcacaaaaaacagttgtcccacgacctgacaaggctcaaggaacattatgaaaagaaaatgagagatttaatggcttccacggtgggtgtagtcgagatacagcagctaaggcagaagcatgaactgaaaatgcagaaactggtcaaagctgcaaaggacgggacaaaggatgggctggagcggactcgcgccgctgttaagagaggccgctcctttatacggactaaatccctgattgcgcaagatcaccgttccagtctcgaggaggaacagaatctattcattgatgtcgactgtaagcaccctgaagccattctgacccctatgcctgagggactgtcccaacagcaggttgtcagacgctacattctgggttccgtggtggactcagagaagaattacgttgatgcactcaagcgcatccttgagcagtacgagaagcccctcagcgagatggaaccgaaagtcctgagtgaaaggaagctgaagacagtgttctatagagtcaaggagattttacaatgccactctcttttccaaatagctctggcatcaagggtcagcgaatgggatagcgttgagatgatcggtgacgttttcgtggcatccttctcaaaatcaatggttcttgacgcttattctgagtatgttaacaactttagcaccgccgtggcggtactgaagaaaacgtgcgctacgaagccagcctttctcgaatttctgaaggagcaagaggctagtcctgacagaaccaccttgtacagcctcatgatgaaacctatccaacgatttcctcagttcatcctcttattacaggacatgctaaaaaatacgagcaaggggcacccagatcggctgcctctacagatggcgctcacagaactagagaccctggctgaaaagttgaatgagcggaagcgcgacgccgaccaacgatgcgaggtgaaacagattgccaaagccatcaatgagagatacttgaacaaactgctgtcgtccgggtccaggtacctgattcgctctgatgacatgattgaaaccgtgtacaacgacaggggcgagattgtgaagaccaaggagagaagagtattcatgctaaacgacgtgcttatgtgcgctacagtgtctagcagaccatcacatgacagcagggtgatgtcctcccaaagatatctgttaaaatggtctgtcccgttgggacatgtggatgcgatcgagtacggaagcagtgccggcacaggagaacactcccggcaccttgcagtacaccctccggaatccctggcagttgtggctaacgccaagccgaataaggtttatatgggccccggacagctctaccaggacttacagaatttgttgcatgatctgaacgtgatcggccaaatcacccagctgattggaaacctgaaagggaactatcaaaacctcaaccagagcgtcgctcacgactggacttctggccttcaacggctaattttgaagaaagaggatgaaatccgcgctgcagactgctgtaggatacaactccaactgcctggaaagcaggataagtcagggcgtcccacgttcttcactgctgttttcaatacatttactccagcaattaaggaatcgtgggtcaacagcttgcagatggctaaactcgccctggaagaagaaaatcacatggggtggttctgtgtggaggatgacggtaatcatatcaagaaagaaaagcatccgctgctagttggacacatgcctgtgatggttgcaaagcaacaggaattcaagatagagtgtgcagcatataaccccgagccatacctgaataatgagtcgcaaccagatagtttctcaacggcgcacggctttttatggataggcagctgcacacaccagatgggtcagatcgcaattgtgtcgttccaaaactcaacccctaaggttattgaatgctttaacgttgaatcaaggatcctttgcatgctctacgtccccgtggaagagaagcgccgcgaacctggagccccaccagacccagaaaccccggcggttcgggcatcagatgtacctaccatctgtgtcggcaccgaggaaggaagcatatcaatttacaaatcttcccagggttccaagaaagtgagattacaacattttttcacgcctgagaaatctaccgtgatgagtctagcatgtacttcccaatcattgtacgccggcctggttaacggggccgtcgcgagctacgccagagcaccagacgggtcctgggacagtgagcctcagaaagtgataaagctgggcgtgctgcctgtgagatccctgcttatgatggaggacacactgtgggctgcttctggggggcaagtcttcatcatttctgttgagacccatgccgtagagggtcagctggaggcacaccaggaagagggaatggtgatctctcacatggccgtgtccggggtgggaatatggattgcctttacctccggatctacgcttcgcctgtttcacacggaaacgctgaagcacttgcaagacataaacattgctacccctgtgcacaatatgctgcccgggcatcaacggctgtctgtgacatcactcctggtatgccatgggctgttgatggtgggcaccagcttgggagtgctagtcgctctgcctgtgccaagattgcaggggatccctaaggtaacaggccgtggcatggtgagttaccacgcacacaactcccccgtcaaatttattgttttggcaaccgccctgcacgaaaaggacaaggataagtccagggattccttggcgcccggaccagaacctcaggatgaagaccagaaggatgctcttcctagcgggggcgctggctcttctctgtcgcagggcgatccagacgcagcaatctggctgggagacagtcttggttccatgacacagaagtccgaccttagctcctcaagcggctctctatctctctctcatgggtcaagctcactggaacaccgatctgaggacagtaccatttacgatttgctgaaggatcctgtatccctgcggagcaaggcacgcagagcaaaaaaagccaaggcttctagtgccctggtggtgtgcggcggccagggtcacaggagggtacaccgaaaggcccggcagccccatcaggaggaactggctcctacagtgatggtgtggcagattcccctcctcaacatctag

SEQ ID NO: 203385 - DNA, 2949 bp, Artificial Sequence
  Description of Artificial Sequence: Synthetic coding sequence
atgctgcccagcagcagctggggcaagcggaagctgcggggccggctgggctgggtgcgtagcgatgcgaggggtgtcatgtgggccaggcaagaaggcctacatcaccctcatccacatgccgttatcaggtgcccgagcagcagctcttcgagcgtgtcgtgttctggagacagcgaggaggaggatatggggttgctggaggtgtcagtaagcgatattaaacctccagcccctgaattgggcccgatgccagagggcctgtcacctcagcaggtggttcgccgccacattctggggtccatagtgcagtcggagggatcctatgttgaatctttgaagcggattctgcaagactaccgaaaccctctcatggagatggagccaaaggcgctgtcagcccgtaagtgccaagtggtcttctttcgtgttaaagagatactacattgccattccatgttccagatagctctcagttccagggtggctgaatgggattccaccgaaaagattggagacctgttcgttgcgtcggacatgctgaagaacactccccgcggacatcccgaccgactgtcgttgcagctagccctcacagagctcgaaaccctggcggaaaagctcaacgaacaaaaaagactggcagatcaggttgccgagatccagcagctgaccaaatccgtttctgaccggagttccctgaacaagctgctaaccagcggccaacgacagcttctgttgtgcgagacactaacggagaccgtatacggcgatagaggccagcttataaaatcaaaggagagaagagtgttcctgctcaacgacatgctcgtttgtgcaaacattaatttcaaggggcagctggagatctcttccctcgttccactgggacccaagtacgtagtaaaatggaatacggctctgccccaggtccaagtggttgaggtcgggcaggatggagggacctacgataaggacaacgtattaattcaacactctggggccaagaaagcatccgcctccggtcaggctcagaacaaggtgtatctcggccccccgaggcttttccaggagctacaggacctgcaaaaggacctcgccgtggtcgagcagattaccctgctgattagcaccttacacgggacgtaccagaatctcaatatgacagtggcccaggactggtgtctcgccctgcagcgccttatgagggtgaaagaagaagaaatacatagcgccaataaatgtaggttgcgcttgcttctaccagggaaacctgataaatccggacgacctattagcttcatggtggtctttatcacccctaacccgttgagcaagatctcctgggtaaacagactgcatctggcaaaaatcggcctgagggaggagaatcagcccggatggctctgccctgatgaggataagaaaagtaaagcccccttctggtgtccaattctggcctgttgtattccagcctttagttctagagccctttcattacagctaggggccctagtgcacagccctgtgaactgccccctcttgggattctccgctgtgtccacgtcactcccacagggctatttatgggtcggaggcggtcaggagggagcagggggacaagtcgagattttctcactcaaccgaccaagcccccgcacagtcaaaagcttccctttagccgcccctgtgttgtgtatggagtacattcctgaactggaggaagaggccgagagtcgagacgaaagtcctacagttgccgacccctccgcgacggtacatcccactatttgcctgggcctgcaagatggtagtattcttctgtattccagtgtagacacaggcacccaatgcttagtgtcctgccggtcaccgggtctccaacctgtgctttgtctccgtcacagtcccttccatctgctggcaggtctccaagacggaacattggctgcctacccacgcacttccggcggcgtgctttgggacctggagtccccacctgtttgtctcaccgtgggcccaggacccgtacgcaccctactcagcctggaagatgctgtttgggcatcgtgtggaccctgggtcactgtactggaagcgaccactttgcagccccagcagtccttcgaggcccatcaggacgaggctgtgtccgtgactcatatggtaaaggcggggagcggagtgtggatggcttttagctctggaacttctatccggcttttccataccgaaaccctcgaacacctacaggagattaatatcgccacccgaactacatttcttctgcctggccagaagcatctttgtgtgacaagcttactcatttgtcaaggactgctctgggtaggtaccgatcagggggtcattgtcctcctgccagtaccgcggcttgagggcattcccaagatcacaggtaaggggatggtaagtcttaacggccactgcggacctgtggccttcctggctgtcgcaacaagtatactcgcgcctgatattctgcggtccgatcaggaggaagccgaaggaccaagggctgaagaggacaagcctgatggccaggcccatgaacctatgccggattcacacgtggggcgcgaactcactaggaagaaaggaatccttctgcagtatagactgcgctccactgctcatctgcccggaccccttctcagcatgcgcgagccagcacccgcagacggtgctgctcttgagcactcagaagaggacggatccatctatgaaatggccgacgatccggatatttgggtgcgctccaggccatgtgcccgcgacgcacaccgaaaggaaatctgttccgtcgcaatcatctcaggtggccaaggctaccgaaacttcggatccgcccttggctcaagcggacggcaagctccctgtggagagactgacagtacattgctgatctggcaagtacccctgatgttatag

SEQ ID NO: 203386 - DNA, 3840 bp, Artificial Sequence
  Description of Artificial Sequence: Synthetic coding sequence
atggccagcagcaacccccccccccagcccgccatcggcgaccagttagtcccaggggtgcccgggcccagctctgaggccgaggatgaccctggtgaggcttttgaattcgacgatagcgacgacgaagaggacacctcagccgccctcggggtaccttcgctggctcccgaacgggatacagatccacctctgatccatcttgactccatacctgtaacggaccccgaccccgccgctgctcctcctggcactggagtaccagcttgggtgagtaacggggatgcagctgatgctgccttcagcggggcccgacactcttcgtggaaaaggaaaagtagtcgtagaattgatcgatttaccttccccgccttggaagaagatgttatttacgacgacgtgccctgtgaatcccccgatgctcatcagcccggagctgaaagaaacctgctctacgaggatgctcaccgggctggcgctccacgccaggcggaggatctcgggtggtcttcatctgagtttgagtcgtacagtgaagattccggggaagaagcaaagccagaagtggaggttgagcctgcaaaacacagggtgagtttccaacccaagctaagtcccgacctgacaagactgaaagagcggtacgctcgcacgaaacgggatatcctggctttgcgcgtcggtggcagggacatgcaggaactcaagcataaatacgactgcaagatgacacagctaatgaaagctgctaagagtggaactaaggacggattggaaaagacacgaatggccgtgatgcgtaaagtgagcttcctgcataggaaggatgtgctgggcgactccgaggaagaggatatgggactgcttgaagtctctgtgtcagatatcaagcctccagcaccggagctgggcccaatgcctgagggactgagcccccagcaagtggttcggagacatatcctggggtctatagttcagtcagaaggtagttacgtggagtcactaaagagaatactgcaggattatcggaatcctttgatggaaatggaacctaaggctcttagtgctagaaaatgtcaagtggtatttttccgggtgaaggagatcctgcattgtcactccatgttccagattgccctttcttcaagagtggccgagtgggatagcaccgagaaaatcggggacctgttcgtcgcaagcttttcgaaatcaatggtactggacgtctacagcgactatgtgaataacttcacttccgccatgtccataatcaagaaagcctgcttgacaaaacccgccttcttagagttcctaaagcgtcgacaagtgtgtagtccagatagagtgaccctgtacggtctgatggtcaagcccatccagcggttccctcagtttattctgttgctgcaagatatgttgaagaacaccccccgtggacatccagacaggctttcactgcagttggctctcaccgagctagaaaccctcgccgagaagctgaacgaacagaagcgcctggccgatcaagttgcagagatccagcagctgacaaagtccgtctcagatcgctctagcttgaacaagctcttgacttcagggcagcgccagctgctcctttgcgaaaccttaacagaaacagtttatggcgaccgtggacagctcatcaaaagtaaagagcggcgggtgttcctgctcaacgatatgctggtgtgtgccaacatcaatttcaagccggcaaatcacagagggcagctggaaattagttccttggtgcccctcggtcccaagtacgtcgtgaaatggaatactgcccttccccaggttcaggtcgtcgaggttgggcaggacgggggcacgtacgataaggacaatgtgctgattcagcacagcggcgcaaaaaaggcctctgcctccggacaggcccaaaacaaagtttatctgggccccccccggctattccaagagctgcaggaccttcagaaggacttagctgtcgtggaacaaattactttgctgattagtaccctgcatggaacgtaccagaatctcaatatgactgtagcacaggactggtgcctggctctgcagagattgatgcgagtcaaggaagaagagatccacagcgctaataagtgccgcctgcgtctgctcctgcctggcaaaccagataaatcggggaggccaatttcattcatggtggtgttcattactcccaacccactttccaagattagttgggtgaatcggctgcacttagcaaaaatcggactgagggaggaaaatcagccgggctggctttgccccgatgaggacaagaagtccaaggctcccttttggtgcccaattctggcctgctgcattcccgccttttcgtcccgggctctgagtctccaactgggagctctggttcatagtcccgtcaactgtccgcttctcggcttcagtgcggtaagcaccagtctgccacaggggtatttgtgggtcggcgggggacaggagggtgcaggcgggcaagtggaaattttctcgctgaaccgcccttcacctcgcaccgtgaagagttttcctctcgccgccccggtcctgtgtatggagtacataccagagctggaagaagaagccgaatccagggacgagtcccctacggttgcagacccctctgccacggtccaccctacaatctgcctcggcctgcaagacggctccatcctgctttattccagcgtggacacaggtactcagtgtctggtctcctgtaggagcccagggctgcagccagtattgtgtctgcgccattctccattccacctgcttgccgggttacaggacggcaccctcgccgcttatccccgcacatcaggaggcgttctctgggacctggaaagccctcccgtgtgcttgactgtcggacctgggcctgtccgcacgctgctatccctggaggacgccgtgtgggcaagctgcggcccatgggtgaccgtacttgaagcaacaactctccagccacaacaaagctttgaagcacatcaagatgaggctgtctcggtcacacatatggtgaaagcaggcagtggtgtctggatggccttctctagcggtacatcaatccgtttatttcacaccgaaactctcgaacacctgcaagagatcaacatcgcaactcggaccaccttcctgttgcctggccagaaacacctgtgcgtgacttccctgctcatttgtcaaggcctgctctgggtgggaaccgaccagggagtgattgtgctgttaccggtgccaagactcgaaggcatccccaagataacgggtaaagggatggtttctttgaatggccactgcggccctgtggcatttctggctgtcgcaacaagcatcctggctccagatatattgaggagtgatcaggaagaggccgagggccctcgcgcggaagaggataagccagacggacaagcacatgaaccaatgcctgactcacatgtgggtagggagctgactcgtaagaaggggattctgttacaataccgcttgagaagcactgcccaccttccgggtcctctcctgtctatgagggaaccggcacccgcagacggtgcagcactcgagcattcagaagaggatggatccatctacgaaatggctgatgatcctgatatctgggtacgcagcagaccttgcgcacgtgatgcccataggaaagagatttgcagcgtcgcaataatatccggcggtcagggttaccggaatttcgggtccgctctcggaagttcaggtcgccaggctccctgtggagagactgacagtaccttgctcatatggcaagtgcctctcatgctctag

SEQ ID NO: 203387 - DNA, 3159 bp, Artificial Sequence
  Description of Artificial Sequence: Synthetic coding sequence
atgctgcccagcagcagctggggcaagcggaagctgcggggccggctgggatgggtgagatccgacgccaggggcgtgatgtgggccaggcaagagggcctgcatcatccccatcctcacgccgttattcgatgcccatccagctctagcagctcggtgtcttgtagcggcgattctgaggaggaagacatgggtttgctcgaggtgtccgtctcagacatcaaaccccctgcccctgagctcggaccgatgccggaaggccttagccctcagcaggtcgtgcgacgtcatatactcggatccatagtgcagagcgagggatcttacgtcgagagcctcaagcgaatcctacaggattaccgcaatccacttatggagatggagcctaaagctctgtcggcccgcaaatgccaggtggtctttttccgcgtcaaggagatcttgcactgtcactccatgttccagattgccctaagttctagggtggccgagtgggattctacagagaagatcggtgacctgttcgtggcctctttctccaagtcaatggtgctggacgtatacagcgactacgtcaataatttcacaagcgctatgtccatcattaagaaggcctgcttaacaaaacccgcattcttggaatttctcaaacgacggcaggtgtgcagcccagatcgcgtgaccctttacggattaatggtgaaaccaatacagaggtttccccagtttatcctcctgctccaggacatgctgaagaatacccccaggggccatccagaccgcctgagtctgcagctggcattgacggaactggaaaccctggcggagaagcttaatgaacagaagcgcctcgcggaccaggtcgccgagatccaacagctcaccaagtctgtgagcgatcggtcttctctcaacaagctgctgacttccggccagcggcagctcctattatgtgagaccctgacagaaaccgtttatggagaccgaggccagttgataaagtccaaagagaggagggtatttctgctgaacgacatgctcgtttgcgcaaatattaattttaaaggacaattggaaatctcatctctggtgccgctgggaccgaagtacgttgtcaaatggaacacagcactgccgcaggttcaagttgtagaggtaggacaagacggaggtacatacgacaaggataatgtactcattcagcactcgggggccaagaaggcttcagcctcggggcaggcacaaaacaaggtatatctggggccaccgaggctatttcaggagcttcaagatctgcagaaggatctcgctgtagtggaacaaattacattgctcatctccactctccacgggacctaccagaacctgaacatgacggtggcccaagattggtgtctggctcttcagaggctgatgcgcgtcaaggaggaagagatccatagtgcgaacaaatgccgactgagactgttgttgcctgggaagcccgataagtctggcagacccatttcttttatggtcgtgtttatcacgcccaacccacttagcaagatatcgtgggtcaacaggttgcatttagctaagatcggattacgcgaggagaaccagcccggctggctgtgtcctgacgaggacaaaaagtccaaagccccgttctggtgtcccatcttagcatgctgcattcctgctttcagctctcgcgccttaagcctgcagctgggggcactggttcactcccctgtgaactgtccactgctcggattctccgccgtgtcaacttcgctcccgcagggctatctgtgggttggcggagggcaggagggggccggagggcaagtagagatcttttcgctcaaccggcccagcccaaggactgtgaagtctttcccactggctgcacctgtgttgtgtatggagtatattcctgagttggaggaagaagcagaatctagagacgagagcccaaccgtcgccgatccctccgctacggtacatccgaccatttgtctggggcttcaagatgggtccattctgctgtattcttctgtggacacgggaacacagtgcctagtctcttgccgctccccaggtttgcagccagtgttgtgtctccgacacagcccctttcaccttctggcgggtctccaggatggaaccctggccgcctacccgcgcacctcaggcggggtgctctgggacctcgaatcacctcccgtatgtcttactgtcggtccaggtcccgtccggaccctgctatctctggaggacgccgtctgggcatcttgcggtccgtgggtgacagtccttgaagctacaacacttcagcctcagcagtcatttgaagcccatcaggatgaagccgtttccgtaacacacatggtcaaagccggatctggtgtgtggatggcattttctagtgggacatcaattagactgttccatactgagacattggagcacctccaggaaatcaacatagccacgcgtaccacctttctgctcccagggcaaaagcacttgtgcgttacaagcctcttgatttgtcagggcctgctgtgggtggggaccgaccagggggtgatcgtcctcctgcccgtaccacgactggagggcatcccaaagataactggcaagggcatggttagcctgaacggacattgcggccccgtcgcttttctcgccgttgcaacgagtattcttgctcccgatatcctgaggtcagatcaagaggaagctgaaggaccgagagcagaggaagataaacctgatgggcaggcccacgagccgatgcccgattcccatgtcgggcgagagctgacacggaagaaagggattctattacagtatcgcttaaggagcacagcgcacttgcctggccccctgctgtccatgcgcgaaccagctcctgcagatggagccgccttggagcattccgaggaggatgggagcatctatgaaatggccgacgatccagatatatgggtgcggtccagaccatgtgccagggacgcccatcggaaggagatctgttctgtggccatcatctccggcggacagggctaccgcaatttcggaagcgcccttggctcatccggtagacaggctccgtgcggggagactgatagcaccctcctaatttggcaggtgccgctcatgctatag

SEQ ID NO: 203388 - DNA, 3723 bp, Artificial Sequence
  Description of Artificial Sequence: Synthetic coding sequence
atggccagcagcaacccccccccccagcccgccatcggcgaccagctggtgcccggcgtccctggcccttcctcagaggccgaggatgatcccggggaagcattcgagtttgacgatagcgacgacgaagaagacacatctgccgccctgggcgtcccaagcctcgcaccggagcgcgatacagacccgccactgatacatttagatagcatcccagtcacggacccagaccccgccgctgcaccccctggcacgggggtccctgcttgggtgtctaatggggatgcagccgatgccgcgttttcaggagccagacatagtagttggaagagaaagagttctcggaggatcgataggttcacttttcctgctctagaggaggatgtgatctacgacgatgtaccatgcgagtctcccgacgcgcaccagccaggagcagagcggaatctcctgtatgaagatgctcaccgggctggagctcctagacaggccgaagacctcggctggtctagcagtgagttcgagagttacagcgaagattccggagaagaggcaaaaccagaggtggaggttgagcctgctaaacacagagtcagtttccaaccaaagatgactcagctcatgaaagcagctaaatcaggtaccaaggatggattggagaagacccgtatggcagttatgagaaaggtttccttcttgcacagaaaagacgtgctgggggactccgaagaagaagacatgggcctattggaagtgtcagtgtccgatatcaagcctccagcccctgagttgggccctatgccggagggtctgagccctcagcaggtcgtccgcaggcatatcctgggcagcatagtacaatctgaagggtcttatgtggaatcactaaagcgcatcctgcaagactatcgaaatcctctgatggagatggaacctaaggcactcagtgccaggaaatgccaggtcgtgtttttccgagtaaaggagatactgcattgccacagtatgtttcaaattgccctgtcttcccgagttgcagagtgggactctactgagaaaatcggggatttattcgtcgctagcttttcgaagtctatggtgctggacgtgtattcagactacgtgaataatttcacgtccgccatgtccattattaagaaggcctgtctgactaagccagccttccttgagttcctgaagcgcaggcaggtgtgtagtcccgaccgagttacgctctatggtctcatggttaaacctattcagcgcttcccccagttcatcttacttctgcaggatatgctaaaaaatactccccgaggccatccagataggctttcattacagctggccttgaccgagctggaaacactggctgagaagctaaacgaacagaagaggctcgccgaccaagtggctgaaatacagcagttgacaaagagtgtatccgataggtcatccctgaataagctccttactagtggccagaggcagcttctgctttgcgagacacttaccgaaactgtgtacggagataggggacagcttatcaagtccaaggagaggagagtgttcctgctcaacgatatgctggtgtgcgccaacattaactttaagcccgccaaccatcgggggcagctcgaaatctctagcctggtcccactgggacctaaatatgtggtgaaatggaataccgccttgccacaggtgcaagtggtggaggtcggacaggacggaggaacttatgataaggataatgtgcttatccagcatagcggcgccaagaaggcatccgcctctggccaagctcaaaacaaggtctaccttggtcctccccgtctttttcaggaactgcaggatctgcagaaggacttggcggtagtggaacaaataacgctgctcatcagcactctccacgggacatatcagaacctgaatatgacggtggctcaggattggtgtctggctctccagaggctgatgcgagtaaaagaagaggaaatacatagtgccaataaatgtagactccgtctcctgctccccggcaagcctgacaaatctggtaggcccatttccttcatggtggtgtttatcactcccaatcccctttctaaaatcagttgggtcaacaggctccatctggcaaagatagggctccgcgaggaaaaccagcctggctggctgtgtcccgacgaagacaagaagagcaaagccccattctggtgtcccatcctcgcttgctgtatccccgcgttctcctccagagctttgtctttgcaacttggcgctctcgtccacagcccagtaaactgtcccctgttagggtttagcgctgtttctacctccctgcctcagggctacctatgggtgggcggtggccaagagggggccggggggcaggtagagatctttagcctgaaccggccatcacctagaaccgtgaagagctttccactggcagcgccagtattatgcatggagtatattcccgagctggaggaagaggccgagagccgcgacgagtcccccaccgttgcagaccccagcgctaccgtgcaccctactatctgcctcgggctgcaagacggcagcatcctgttatattcaagcgttgatacagggacccagtgtctcgtcagctgtcgctcacccggactccagccagtgctgtgcctacggcattctccattccatctgctggctggcctgcaggatggcactctggctgcctacccgcgcacctctgggggagtcctttgggatttagaatcacctccggtgtgcctcaccgttggaccaggtcctgttagaacactcctatctctcgaggacgcagtctgggccagttgtgggccatgggtgaccgtcctggaagccactacactgcaaccgcaacagagttttgaagcgcatcaggatgaagctgtctccgtgactcatatggtcaaggccggcagtggcgtgtggatggccttttcatcaggtacctccatcagactgttccacaccgagacactcgagcatttacaggaaatcaatatcgctacacggactactttcctgcttcctggccagaagcacttgtgtgtcacctccttgctgatctgccaggggttgctttgggtcggtactgatcagggagtgatcgtcttacttcccgtaccccgattggaaggtatcccgaagatcactggcaaaggaatggtgagtctgaatggccattgcggcccagtagcatttctcgccgtcgccacttctattttggccccagacattttaagatctgaccaggaagaggctgaggggccacgagctgaagaggacaagcccgacggccaggcacacgaacctatgccagactcacacgtcgggagagaactgaccagaaaaaaaggcatcttgctacagtatcgtctgcggtctacagcccacctgcccggtcccctcctgagcatgcgggagcctgccccagcagacggagccgccttagaacatagtgaggaggatgggagcatttatgagatggccgacgatccagacatttgggtgcgtagtaggccctgtgctcgcgatgcacacaggaaggagatctgtagcgtcgccatcatctctggtggacagggctataggaattttggcagtgcattgggttctagcggccgccaagcaccctgcggcgagaccgactcgactctcctgatatggcaggttccactgatgttatag

SEQ ID NO: 203389 - DNA, 1467 bp, Artificial Sequence
  Description of Artificial Sequence: Synthetic coding sequence
atgacccagctgatgaaggccgccaagagcggcaccaaggacggcctcgagaaaacccgcatggcggtgatgaggaaggtgagcttcctccaccggaaggatgtcctaggagattccgaagaggaagacatgggactgctggaagtttctgtctccgatatcaagcctcccgccccagagctgggcccaatgccagaggggttatctccacaacaggtggtgaggcgccatattttgggcagcatagtgcaatccgagggaagttacgttgagtcactgaagaggattttacaagactataggaatccactgatggagatggaacctaaggctttgtcagcccgcaaatgccaggtcgtgttcttccgggtgaaggaaatactccactgtcacagcatgtttcagattgcactcagctctagagtggccgagtgggattccacagagaaaattggtgatctattcgtggccagtttctcaaaatccatggtactagacgtctatagtgattacgttaataattttacatctgccatgtcgatcatcaagaaagcatgtctgacgaagccagcatttctggaattcctcaaacgacggcaagtatgctcccctgatagagtcactctgtatgggctgatggtcaagccgattcaacgctttccccagttcattttactgctgcaagatatgctgaaaaatacgccccggggccatccggatcgcctgtccctgcagctcgccctgaccgagctggagaccctagcagagaagctcaacgaacaaaagagactcgctgatcaggtggctgaaattcagcagttgactaagtctgtctccgaccgttcaagccttaacaaactactgactagcggtcagagacaactattgttgtgcgagacgctgactgagaccgtgtacggagacagaggccagttgatcaagagcaaagaacgcagagtatttctcctcaatgacatgcttgtctgcgcgaacatcaactttaaacccgccaatcatcggggacagctcgaaattagctcactggtccccttggggcctaagtatgttgtaaagtggaataccgcccttcctcaagtccaagtggtggaggttggccaggatggcggaacgtatgacaaggacaatgttctgatccaacactcaggtgctaaaaaggccagcgcgagcggtcaggcacaaaataaagtgtatctgggcccccccagattattccaagaactgcaggacctgcagaaagatctggcagtggtcgaacagatcactctcttaattagcaccctccacgggacgtaccaaaatctaaatatgaccgtggctcaggattggtgtctggccctgcagagactgatgcgcgtcaaggaagaggagatccattctgctaataagtgccggctccggctgcttcttccaggcaagcccgacaagggaacgtggtccgacatgtag

SEQ ID NO: 203390 - DNA, 3204 bp, Artificial Sequence
  Description of Artificial Sequence: Synthetic coding sequence
atggccagcagcaacccccccccccagcccgccatcggcgaccagctagtgccaggagtgccgggaccgtccagcgaagcggaagacgaccccggggaggcatttgagtttgatgattccgacgatgaggaagacacctcagccgctctgggtgtgcctagtctggcaccggagcgcgacaccgacccacccctcattcatctggattccattccggttacagaccctgacccagcggccgcccctccagggacgggagtgccggcctgggttagtaacggagatgccgctgatgctgccttcagtggagcgcggcatagctcttggaagcgtaaaagtagcaggaggattgaccgctttactttccctgcccttgaggaggacgtgatttacgacgacgtgccctgcgaatccccagatgcccatcaaccaggcgcagaacggaatctgctctatgaggacgcccaccgcgccggggccccacgtcaagctgaagacctaggatggtcctcatctgagtttgagtcttattccgaagacagcggtgaagaggcgaagccggaagtggaagtcgagcctgcaaaacaccgtgtgtctttccagccaaaactgagtccagacctgaccagattgaaggaacggtatgcccgcactaagagagacattttggctctgcgggtgggcggtcgcgatatgcaagaacttaaacacaagtatgactgtaagatgactcaactcatgaaagccgctaaaagtggcacaaaagatggactcgaaaagacgcggatggcagtgatgagaaaggtaagctttcttcaccgcaaggatgtgctgggtgatagcgaagaggaggatatggggcttctcgaggtgtccgtgtctgatattaagccgcctgctcccgaactggggccgatgcctgagggactgtcgccacagcaggttgtcaggcgtcatatccttggctcaattgttcagtcagaaggttcatacgtggagtcacttaagcgcattttgcaggactataggaaccctcttatggagatggagccgaaggccctcagcgctcgtaaatgtcaggttgtgttcttcagagtgaaagaaatcctgcattgccacagtatgttccagatcgccctgagctccagggtcgccgagtgggattccacagagaaaattggcgacctgttcgttgcgtccttctcaaagtccatggtgctcgatgtgtattctgattacgtaaacaacttcacaagcgccatgtccataataaagaaagcttgcctgactaaaccagcttttctggagttcttgaagaggcgacaggtgtgctctccagatcgggtgaccttatacggacttatggtaaagcccattcagcgcttcccacagttcatccttctgttacaggacatgctgaaaaatactcccaggggtcaccccgatcgcttaagtctgcaactggccctgacagagctcgaaaccctggctgagaagttaaatgagcagaaacgtttggcggaccaagtcgccgagatccagcagttgaccaaatctgtttccgatcggagtagtctgaataaactactgactagcggtcagaggcagctactgctatgtgaaaccctgactgagaccgtttatggagaccgaggccagctgatcaagtccaaggagcgcagagtctttctgctcaacgacatgctggtttgtgcgaacatcaattttaagggccagctggaaatcagctctctggtccccctgggtccgaaatatgtcgttaagtggaacactgcactgcctcaggtccaggtcgtggaagttggtcaggatggtgggacatacgataaggataatgtgctgatccagcactccggcgccaagaaggcctccgcatcaggacaagcacagaacaaagtctatctgggcccccctagacttttccaagaactgcaggatctgcagaaagacctcgccgtcgtagaacagattaccctgcttatctcaacactgcacggtacataccaaaatctcaatatgacagtggcacaggactggtgcctggcactacaacgacttatgcgcgtgaaggaggaagagatccattccgctaataaatgcagactcagattgctgctcccgggtaaacccgataaaagcggaaggcccatctcttttatggtcgtattcatcacgccaaaccccttatccaaaatttcctgggtgaaccgtctgcacctggccaaaattggactcagagaggagaaccagcccggatggctctgcccagatgaggacaagaagtccaaggcacctttctggtgcccaattctggcatgttgcatcccagcattctcttctcgggctctgtcactccagttaggcgccctggtgcacagccccgtgaactgccctctcttagggttttccgccgtcagcacctctttgccccagggctacctgtgggtgggcggtggtcaggaaggagcagggggccaggtggagatatttagtcttaatcgaccctcaccgagaacagtgaaaagctttcctttggcagccccagtgctctgtatggagtacattcccgaacttgaagaagaagccgaaagtagagacgaatcacctaccgtggccgacccgtcggccacagtacacccaacgatctgcctgggtcttcaagatggatcaatactgctgtacagctccgtcgataccgggacccagtgcttagtttcgtgccggagtcccggcctgcagcccgtactctgtttgaggcattcaccttttcatctgcttgcaggattgcaggacgggacgctggccgcttacccgcgtacgagcgggggagtgctttgggacttggagagccctcccgtttgtctaacagtggggcccgggcctgttcggacgctgctgagtctcgaggatgcagtgtgggcttcctgcggtccctgggtcaccgtgcttgaggcgactaccttacaaccgcagcagtctttcgaggcccaccaggatgaggctgtctcagttacacacatggtcaaggcaggctccggcgtgtggatggctttttcatccggaactagcatccgcctgttccatactgaaacacttgagcatcttcaggagatcaacatagcaacacgcacaaccttcctgctgcccgatcggagcttgatcaaatgttctccccgtgcttag

SEQ ID NO: 203391 - DNA, 3723 bp, Artificial Sequence
  Description of Artificial Sequence: Synthetic coding sequence
atggccagcagcaacccccccccccagcccgccatcggcgaccagctggtgcctggagttcctgggccaagctccgaggctgaggatgaccccggcgaggctttcgaatttgacgactcagatgacgaggaggacacctcggcagccctgggcgtcccatccctggctcccgaacgagacacggatccccctctaatccacttggatagtattcccgtgactgatccagatccggccgcagcacccccgggaactggcgtacccgcatgggtgagcaatggtgacgcagcagatgccgcctttagcggggctcgccactcaagttggaaacgcaagtcttctcggagaatagaccgctttacattccccgctctcgaggaggacgtgatctacgacgatgtgccttgtgaaagtcccgatgcccatcagcccggggcagagcgaaatctgctgtacgaggacgcccaccgggccggggccccacgccaggcagaggacctcggctggagttccagcgagtttgaatcctacagtgaagactcaggtgaggaggcaaagcccgaggtcgaagttgagcccgcaaagcacagagtctcgttccagcctaaaatgacacagctgatgaaggctgcaaagagtgggacaaaggacggcctggaaaagaccaggatggccgtgatgcgaaaagtctcattcctgcatcggaaggatgtcttgggcgattccgaggaggaggatatgggcctgctcgaagtgtcagtgagtgatattaagccacccgcacccgaactcgggcctatgcccgaagggttgagcccccagcaggtcgtaagacgccatattctgggatctattgtgcagtccgagggatcgtatgtggaatcactcaaacgcattctgcaggattaccggaatccattgatggagatggagcccaaggctctctctgcacgcaaatgccaggtggtcttttttcgggttaaagagatccttcactgccactctatgtttcaaatcgctttatcatccagggtcgcggagtgggatagtacagaaaagatcggcgacctgttcgtcgcttccttctccaagtcaatggtgctcgacgtttatagcgactacgtgaacaacttcaccagcgcaatgtctatcattaagaaggcgtgcttgacgaagccagcattcttggagttcttaaagcggcggcaggtctgctcaccagatcgagtgactctgtatggacttatggtcaagcctattcagaggttccctcagtttatcctgctgctgcaggacatgctaaagaatacaccccgaggccatcctgacaggctgtctctccagctagcgttaactgaactcgagactcttgccgagaaactcaacgagcagaagcgcctggctgaccaggtggccgagatccagcagctgacaaagtctgtgagcgacagatcctctttgaataaattgctgacatccggacagcggcagctgcttctgtgtgagaccctgacagaaactgtgtacggagaccgggggcagttaatcaaatccaaggaaagacgcgtcttcctgctcaatgatatgctcgtgtgtgccaacatcaactttaaaccagctaaccaccgcggccagctggagattagctctctcgtacccctaggtccaaagtatgtggtgaaatggaatactgccctccctcaagtgcaggtcgttgaggtggggcaagacggcgggacttacgacaaggataatgttctgatccagcatagcggagcaaagaaggcttctgcttccggtcaggcacagaacaaagtgtacctaggaccaccacggctgtttcaggaactccaggacctgcagaaagacttagctgtcgtagaacaaattaccctgctcatcagcacactgcacggcacataccagaacctcaatatgaccgtagcccaggactggtgcctggccttacagaggttaatgcgggtgaaggaggaggaaatccacagcgcaaataaatgcaggcttcggttgctgcttcccggcaaacccgacaagtcaggcaggccaatcagttttatggtcgtgttcatcacgcccaaccccctgtccaagataagctgggtgaaccggttgcacctcgcaaaaattggcctgagagaagaaaaccagccgggatggctctgccccgacgaggataagaaaagcaaggcacctttctggtgccccattttggcatgctgcatcccggcgttcagcagccgcgctctctcgctccagcttggggcactggttcactcccccgtgaactgtccgctgctgggcttctccgcggttagtaccagcttgcctcagggctatctgtgggttggaggaggacaagagggagccgggggtcaggtggagatctttagcctcaatagaccttcccctcgcaccgtgaagtcattcccgcttgccgctcctgtattatgtatggagtatattcctgagctggaagaagaggcagaatcgagggacgaaagccctacggtggcagacccatcggccacggttcatccaaccatttgccttggtctccaggacggcagtatcctgttgtactcctctgtggacacgggtacgcaatgcctcgtttcctgccggagcccagggctccaacccgtgctgtgcctcagacattccccatttcacctcttggccgggctgcaagacggaacgctcgcagcgtatccccgaacatcagggggcgtgctgtgggacttagaatccccacccgtatgcctgaccgtcggtccaggaccggtgcgcacactgctttctctggaagacgccgtgtgggcctcctgtggcccctgggtgaccgttctcgaggccaccactctccaaccccagcagtccttcgaggcacaccaggatgaggctgtgtctgtcacccacatggttaaggccggctctggtgtatggatggcgtttagcagtggaactagtataagacttttccatactgaaactctagaacatctccaagaaattaacatcgcaacccgtacgactttcttgctgcccggccagaaacacttgtgcgtgacctcactgttgatctgtcaggggctcctgtgggttgggacagatcagggagtaatagtgctgttgcctgtcccgcgactggaaggcattccaaagattactggaaaggggatggtttcgcttaatggccactgtgggcccgtggctttcctcgccgtagccacctctattctggctcctgacatcctgagatccgaccaagaggaggctgaggggccgcgcgccgaagaggacaagcccgacggccaggcccatgagccaatgccagattcacacgtgggcagggaactcacccggaagaagggaatcctgctgcagtatcggctgagatccaccgcccatcttccaggcccgctgctgtcaatgcgggaacctgctccagccgatggggcagctctggagcactcagaagaggatggtagtatttacgagatggcagacgacccagacatatgggtcagaagccggccatgtgctagagacgcacaccgcaaagaaatttgctccgtcgccattatatcaggcgggcaagggtacagaaattttggatccgcactggggagcagcggacggcaggctccctgtggagagaccgatagcacattgctgatctggcaagttcctctgatgctctag

SEQ ID NO: 203392 - DNA, 3129 bp, Artificial Sequence
  Description of Artificial Sequence: Synthetic coding sequence
atgctgcccagcagcagctggggcaagcggaagctgcggggccggttgggttgggtgcggtctgatgcacggggagtaatgtgggcacggcaggagggcttacaccaccctcacccccacgccgttatacggtgcccctcatcctctagtagctccgtctcatgcagcggagactctgaagaggaggacatgggcctactcgaagtttctgtcagcgacattaaaccacctgctccagagcttggccctatgccagaggggctgtctccacagcaagtggtgcgccggcatatcctgggcagcatagtgcagtcagaaggaagctacgtcgaaagtttgaagaggattctccaagattaccggaaccctttgatggagatggagccaaaggctttgagcgccaggaagtgccaggtcgtgttctttcgcgttaaggaaatcctgcactgccacagtatgttccaaattgccttgtccagccgtgtggctgaatgggactccacggagaagatcggagacctctttgtcgctagcttctcgaagagcatggtcctggatgtctattctgactacgtaaataatttcaccagcgccatgtctataattaaaaaggcctgcctaacgaaaccggcgtttctagaatttctgaagcgcaggcaggtgtgctctcccgatcgtgtaaccctatatggcctgatggttaaacctatccagagatttccacaatttatactactcctgcaggacatgctaaaaaataccccgcgaggccaccccgatagactgagcctgcaactggctctgacagagctggagactctggcagagaaacttaacgagcagaaaagactcgccgaccaggtggccgagattcagcagctgaccaagtcagtgtcagaccggtccagtctcaataagctcctgacgtctggccagcgccaactactgctctgtgagacattgacagagaccgtatacggtgaccgcggtcaactaattaagtctaaagaaagaagagtgttcttactgaatgacatgctcgtgtgcgcaaacattaattttaaaggccaattggagatatcctctcttgtcccactcggcccaaaatacgtggtcaagtggaacaccgcactcccccaggtgcaggtggtcgaggttggacaagatggggggacatatgacaaggacaatgtgcttatccagcattccggcgcaaaaaaagcctctgctagtggacaggcacagaataaggtctacctggggccccccagactttttcaggagcttcaggatctgcagaaggacttagcagtcgtggaacagatcactctgctgattagcactctgcatggtacgtatcagaatctgaatatgaccgtggcccaggactggtgcttggccctccagcgtctgatgcgtgtgaaggaggaggagattcattccgccaacaagtgcaggctgcgcctgctcttgcccgggaagccagataaatctggacggcctatcagcttcatggtcgttttcattacgcctaaccccctgagcaaaatctcatgggttaacaggctccacttggcgaaaattgggctacgggaagagaaccagcccggttggctgtgcccagatgaggacaaaaagagcaaagctccattttggtgtcctatccttgcttgttgtatcccagccttttcaagtagggctctcagcctacagttgggcgcccttgtgcattccccagtgaattgtcctctcttagggttctctgcagtaagcactagtctcccacagggatatttatgggtgggcggcggccaagagggggcaggtggacaggttgagatttttagcctgaacaggccgtccccccggaccgtcaaatctttccccctggcagccccagtgttatgcatggagtacatccccgagctcgaggaggaggccgaaagcagagacgaatctcccacagtagctgacccatcagcgaccgtgcatccaactatctgcctgggattgcaggatggcagcatcctgctgtactcctccgtggacacaggaacacagtgtctcgtgagctgccggtctccgggcctgcagcccgttctgtgtcttcggcactctcctttccatctgctagctggcctgcaggacgggactttggcggcgtaccctagaactagtggaggggtcctgtgggacctggagtcgccacccgtctgcctgacagtagggccgggcccggttagaacactactcagtctggaagatgcagtctgggcctcgtgcgggccatgggttactgtgctcgaggccaccaccctgcagccgcagcaatccttcgaggctcatcaagatgaagccgtgtcagtaactcatatggtgaaagcagggtcaggagtttggatggcttttagtagcggaacaagcatccgtctgttccacactgaaacgctggaacacctacaggagataaacatcgccacacggaccacgtttcttctgccaggccagaagcacctttgcgtgacaagccttttaatctgccagggtctgctgtgggtggggacagatcagggcgtgatagtgctgctcccagtgcccaggttagaaggcatccccaaaataacaggaaaaggaatggtaagcttgaacggtcactgtggcccagtggcctttctggctgtggccacatctatcttagcccctgatatccttagatccgatcaggaggaggccgagggcccacgagcagaggaagacaagccagatggacaggctcacgaacctatgccagatagccacgtgggacgggaacttacgcgcaagaagggcattctgctgcagtaccggctcaggtctacggcccatctgcccggccccctgctgtccatgagggagcccgccccagcagacggcgccgctcttgaacatagtgaggaggacggatccatttacgagatggcattctttctgaaggccaaaaacacaaagcctcacaattgcctggctagccccgttagtctcgtttgggccctagctggactgcagggatcgcacaccccacttctcgagggatgcgtgagagtatcagtgtgtgagtgcgtaggttggtgcgtaaatatctataaatag

SEQ ID NO: 203393 - DNA, 4578 bp, Artificial Sequence
  Description of Artificial Sequence: Synthetic coding sequence
atgagcggcacccagagcaccatcaccgaccggttccccctgaagaaaccgatccgtcatggcagcatcctcaatagagagtcccccactgataagaagcaaaaagtagagcgaatcgctagccacgactttgaccccaccgggctcgtgcagcggtgcgtgatcatccaaaaggatgacaacgggttcggactgacagtctccggagataatcccgtcttcgttcagagcgtgaaggaggacggcgccgctatgcgtgcaggcgtacagactggcgatagaattattaaggttaacggcactctcgttacccatagcaaccacctggaagtggtgaagctcatcaaaagcggtagttacgtggcactgaccgttcaggggcgccccccaggctcaccgcagattccacttgctgatagcgaggtcgagccgtctgttattgggcatatgagcccaattatgacaagtccccattctcccggtgccagcggtaacatggaacggatcacaagtcccgtgctgatgggtgaagagaacaatgtcgtgcataaccagaaggtagagatccttaggaaaatgctgcagaaagagcaggagagacttcaacttcttcaggaagactataataggacaccagcccaacgcttgctgaaggagatccaagaagctaagaagcatatcccccagctgcaggagcagctgtccaaagctactggatcagcccaagatggagccgtcgtgacaccatctcgccccttgggcgatactttgaccgtatcagaagcggaaactgaccctggcgatgtgctgggtaggaccgattgtagctctggggacgctagtagacccagctccgacaatgctgactcccctaagagcggtcccaaggaaaggatttatctggaggaaaacccagagaagtctgaaacaatccaggataccgatacccagagcctggtgggaagcccaagcacgaggatcgctccacacattattggagctgaggatgatgacttcggtacagagcatgagcagatcaatggtcagtgtagttgtttccagagcatcgagcttttaaaaagtaggcctgcgcacctcgctgtgtttcttcatcacgtcgtgagccaattcgatcccgccacattgttatgctatctatacagtgatttgtataaacatacaaactcaaaggagaccaggagaatttttttggaatttcaccagttttttctggaccgcagcgcccacctcaaagtgagcgtgcccgatgagatgtcagccgacctcgagaaacgtcgccccgagttaatcccagaggacctgcaccgacactatattcagacgatgcaggaacgggttcacccggaagtgcagcggcacctggaggacttccgccagaagagaagcatgggactgacgctggcagagagtgagctcacaaaactagacgctgagcgtgacaaagacagactgaccctggagaaagaaaggacctgtgcagaacagattgtggccaagattgaggaggtgcttatgaccgctcaggccgtcgaagaggataaaagctcaactatgcaatacgtgatactgatgtatatgaagcacctaggagtaaaagtgaaagaacctagaaaccttgaacataagcggggtcgtatcgggtttctgcccaaaatcaagcagtccatgaagaaggataaagagggagaggaaaagggcaagcgcaggggcttccctagtattctgggtccgccaaggcgtccttcccgccatgacaactcagcaatcgggagggccatggagctgcagaaggctaggcaccctaaacaccttagtacgccttctagcgtaagtccagaaccgcaggacagtgcaaaactcaggcagtccggcctagctaacgaaggcaccgacgctggctacttgccagctaactcaatgagttcagtggccagcggcgcttctttcagccaagaaggaggcaaggaaaatgatactggtagtaagcaggtaggagagaccagcgcacctggagacacattggacgggacaccaaggactcttaacaccgtgttcgacttcccaccacctccactggatcaagtccaagaagaggaatgcgaggtcgagcgggtaaccgagcacggaaccccgaaaccgtttcgtaagttcgattccgtggcgtttggggagtcacagtctgaagatgaacaattcgaaaacgacctggagacagatcctcccaactggcagcagcttgtgtctcgggaagtccttctgggcctgaaaccatgcgaaatcaaaaggcaggaggtaattaacgagttgttctacaccgagcgcgcccatgtgaggacccttaaggtcttagaccaggtgttttatcagagagtctcccgcgagggaattctgtccccctccgaattacgcaaaatcttctccaacctcgaggacatcctgcagctgcacattggcctgaatgagcaaatgaaagctgtacgaaaaaggaacgaaaccagtgtcatagatcagataggtgaggacttgctgacctggttctccggcccaggcgaagaaaagctgaagcatgccgctgccactttctgcagtaatcagccctttgcgctcgagatgattaagagtaggcagaagaaagatagccggttccaaacatttgtacaggacgcagaatcaaacccactgtgtcgacgattgcagctgaaggatataatcccaactcagatgcaaagacttaccaaataccctctgctcctggataacattgcaaagtacactgaatggcccacggaaagagagaaagtcaaaaaagcagccgaccattgccggcagattctaaactacgtgaaccaggccgtgaaggaagcagagaacaaacagaggctggaggattaccagcggaggttagacacatcctcacttaaactgtctgaataccctaacgtcgaagagctgcgcaacttggacctgaccaaaaggaaaatgattcacgagggcccgctagtgtggaaggttaatagggataagacaatcgacctctacactctgctgctggaggatatacttgtcctcctacagaaacaggacgacaggttagtgctccgctgtcactcaaagatcctggctagcaccgcagactccaagcacactttttcccctgttatcaagctgagtactgtgctagtgaggcaggttgctacagacaacaaggccctcttcgtgatcagtatgagcgataatggtgctcagatttatgaactcgttgcccagaccgtgtcagaaaagactgtgtggcaagacctcatatgtagaatggccgcctccgtcaaagagcaatctacaaagcctatccctctcccgcagtccacacctggggaaggagataacgatgaagaagacccgtcgaaactcaaagaagaacagcatggcatcagcgttactggcttgcagtcaccggatagagatctcggtctggaatcaactctgatatccagcaagccccagagtcattctctaagcacatccggtaaatcagaagtgcgagacctttttgtcgccgagaggcagttcgccaaggagcaacatactgatggcaccttgaaagaggtaggcgaagactaccagatcgctattccggacagtcatttgccagtcagcgaagagcgctgggctctcgacgcccttcgcaacctgggccttctgaaacaactgctggtgcagcagctcgggctgaccgaaaaatcagtgcaagaggactggcagcacttcccgagatacagaacggcctctcagggacctcagactgattccgtgattcagaattccgagaatattaaggcctaccatagtggggagggacacatgccattccgcacaggtaccggcgacatcgctacttgctactcaccccgcactagtaccgagtctttcgctcccagggactccgtaggccttgccccacaggacagccaggcttccaacattcttgttatggaccacatgatcatgacgcctgagatgcctacaatggagccggaggggggccttgacgacagtggtgaacatttctttgatgcgcgggaagcccactccgacgagaacccctctgaaggggatggggcagttaataaggaggaaaaggacgtcaacttgaggatatcaggcaactatttaatcctggacggctacgacccagtgcaggagtcttccacggacgaagaagtagcttcgtcactaacactgcagcctatgaccgggatacccgcagtggaatctacacaccagcagcagcacagtcctcagaatacacacagcgatggcgcaatctccccatttacaccggaatttttagttcagcaacgctggggcgcgatggaatactcatgctttgagatccagagccccagtagttgcgccgattcacaatcccaaataatggaatatatccacaaaatcgaggccgatctggagcatctaaagaaagtggaggagagctatactatcctgtgtcagcgcctggccggctcagcacttaccgataagcattccgacaagtcctag

SEQ ID NO: 203394 - DNA, 4635 bp, Artificial Sequence
  Description of Artificial Sequence: Synthetic coding sequence
atgagcggcacccagagcaccatcaccgaccggttccccctgaagaagcctattaggcacggatccatccttaatagggagagcccgacggacaagaagcaaaaagtggagcggatcgctagtcatgatttcgatcctacggactcctcctcaaaaaaaactaaaagctcatcagaggaatcacggagtgagatctacggcctggtgcagcggtgcgtcattatccaaaaagacgataacggattcggactcacggtcagcggcgataacccggtattcgtccagagtgtgaaggaggatggtgctgctatgagagcaggcgtccagactggggacagaatcatcaaagtgaacggcactttagtaacccattctaatcacctggaggttgtgaagctgatcaaaagtggaagttacgtagcgctgacagttcagggcaggccaccaggcagtcctcaaattccattggcggattccgaagttgagccatcggttattgggcacatgagtcctataatgacctccccccatagtcctggagcaagtggtaacatggagcgcattaccagtccggtgcttatgggtgaagagaataacgtcgtgcacaatcagaaagtggaaattctgcgtaagatgctccagaaggagcaggagagactacagctgcttcaggaggactataacagaactcccgcccaacgactattaaaagagatacaagaggccaagaagcatatacctcagttacaggagcagctctccaaggcaaccggctcagcacaggacggggccgtcgtgacgcccagtaggccactgggggataccttaacagttagcgaagccgagacagacccgggcgacgtgctggggcgcacagactgctccagtggtgatgcctcaaggcctagctctgacaatgcagattctcccaagtctggcccgaaggaacgaatttacctggaggagaatccagaaaagtctgaaacaatccaggacaccgatacccagagtctggtaggcagcccttccaccaggatcgctccccatattatcggcgctgaagacgacgacttcggcacagagcatgagcagatcaatggccagtgtagttgctttcaatcaatcgagcttttgaaatcaagacctgcccacctagctgtgttcctgcaccatgttgtcagccagtttgacccagccactctactctgttatctttactctgacctgtataaacacactaattctaaggaaaccaggcggatcttccttgagttccaccagttcttcctcgaccgatctgcccatttgaaggtgtccgtgcccgacgagatgtccgcggatctagagaaacgcagacccgaactcattcctgaggatctccaccgccactatattcagacaatgcaggagagggtccacccagaagttcagaggcacttggaggatttcagacagaagagatcaatggggctgacattggcagaaagcgagctaaccaaattggatgcagagagagacaaggatcggcttaccttggagaaagagagaacctgcgccgaacagatcgttgctaaaattgaagaggtgttgatgacagctcaagctgttgaggaggacaaaagcagcacgatgcagtacgtgattctaatgtacatgaagcacctaggggtgaaagtcaaggaacctaggaacctggaacacaagagaggccgaatcggatttctgcctaaaattaagcagtccatgaagaaggataaagaaggggaagagaagggaaagaggaggggattcccctccatcttaggacctccccgtcgcccaagccgccacgataactctgccattggccgcgctatggaattgcagaaggcccgacaccccaaacacctgagcaccccgtcatccgtttcgccagagccccaggactcagctaagcttcgccaaagcgggctggcgaatgaaggtaccgatgccggttacctgcctgctaattctatgtcctccgtcgcatcaggcgcatccttcagccaagaaggcggcaaggagaacgacacaggaagcaaacaggtgggcgaaacatcggctccgggagataccctagacggtacaccgcggacactaaacacagtgtttgatttcccccctcctcctctggatcaggttcaagaggaggagtgcgaggtcgaacgcgtgactgaacacggcacgcctaagccattccgaaagtttgattctgtagcgttcggagagtcacagagtgaggacgaacagttcgagaacgatctcgagaccgatcctccgaattggcaacagctggtctccagagaagttctgttaggactcaagccctgcgaaatcaagcgccaggaggtgataaacgagctcttttataccgagcgtgcccatgtgcgaactctcaaggtgttagaccaggttttctaccagagagtatcacgagaaggtatcctttcaccgtccgagcttcggaagattttcagcaacctcgaagatatattacagttacatattgggctgaatgagcagatgaaggcggttcgtaagaggaacgaaacaagtgtgatcgatcaaattggagaggacctgctgacctggttttctggacccggggaagaaaagctcaagcatgcggccgctacattttgtagcaatcagcctttcgcattggagatgatcaaatctcgccaaaagaaggattctcgcttccagactttcgtccaggatgccgaatcaaacccattatgtcggagactgcagttgaaggacattattcccacacaaatgcagaggctcactaagtatcctcttctgctcgacaacatagctaagtacacggagtggcctaccgagagggagaaggtgaaaaaggcagcagaccattgtaggcagatactgaactatgtcaaccaggctgtgaaggaagcggagaacaagcagcgtctggaagactaccagcgcagattggacacaagtagcctcaaactgtccgaataccctaatgtggaggagctgcggaacctggatctcacaaagcgcaaaatgatccacgagggaccgctggtgtggaaggtgaaccgcgataagactattgatctctatacccttctgctggaggacatcctcgtgctgctgcagaaacaggatgaccggctggttctgaggtgtcattccaaaattcttgctagcaccgccgattctaagcatacctttagcccagtgatcaaattaagtaccgtgctggttcggcaggtggcaacggataataaagccctgttcgtgatctcaatgtcggataatggagcgcagatctacgaactcgtcgcgcagaccgtatccgaaaaaaccgtttggcaggacttaatatgtaggatggccgcgagtgtgaaagagcaatccaccaaaccaatacccctaccccagtccacccctggtgagggtgacaacgatgaagaggaccccagtaaactgaaggaagagcagcatggaatttccgtcaccggactgcagagccccgacagagacctcggcctggagtccacccttatatcaagcaaacctcaatcccattcactgtcgacctccggcaagagcgaggtcagggatcttttcgttgctgagcggcagttcgccaaggagcaacatacagacggtacactgaaggaggtgggagaggattatcaaatcgcaattccagatagccatcttccagtgtccgaggagagatgggctctggatgccctaaggaacttgggtctacttaaacagctgttagtacagcaactcgggctgaccgagaaaagtgtacaagaggactggcagcacttccctcgctatagaacagctagtcaggggccccagaccgactcggtgatccagaattccgaaaatatcaaggcctatcattctggggagggacatatgccttttaggacgggtactggtgacattgccacctgctattctccaagaacttccactgagtcttttgccccacgggacagtgttggactagctccccaagactctcaagcttctaacatcctggtgatggatcatatgattatgacacctgagatgcctaccatggagccagaaggagggttagacgatagtggggagcattttttcgacgccagggaggcccactcagatgaaaatcccagtgagggcgatggagcggtgaacaaggaagagaaagacgttaacctgcgcattagcgggaactacctgatcctagatggatatgaccctgtgcaagaatcgagcacagacgaggaggtggcctctagccttacactgcagccaatgactggcattcctgcggtcgagtctactcaccagcagcagcactctccccagaacacccatagcgacggcgctatctcgccattcactcctgagttcctggtccagcaaagatggggtgctatggagtacagctgcttcgagatacagagcccctcctcttgcgctgacagccagtcccagatcatggaatatattcataagattgaagccgatttagagcacctgaagaaggtggaagaatcctatactatcctgtgtcaacgcctcgctggtagcgctctgacagacaagcacagcgataagtcttag

SEQ ID NO: 203395 - DNA, 2409 bp, Artificial Sequence
  Description of Artificial Sequence: Synthetic coding sequence
atggactgcggcccccccgccaccctgcagccccacctgaccggcccgcccgggactgcccaccatcctgtggctgtctgccagcaggaatctctttcgttcgcagaattaccagccctgaagccgccgagcccggtgtgcctggacctgtttcctgtagcccctgaggaactccgtgcccctggtagccggtggagtttggggacgcccgcaccacttcaaggactgctttggccactgtcccctggtgggagcgatactgaaataacctccggcggaatgcgcccttctcgggccggaagttggccacattgtcctggcgcgcaacctcctgctctggagggcccttggtcacctaggcatactcagcctcagcgtcgcgcctcccacgggtcggaaaaaaaaagtgcctggcgaaagatgagggtatatcagagagaggaagtgccagggtgtcctgaggcccatgctgtattcctagaacccggtcaagtagtacaggagcaggcattgtcaacggaggaaccacgtgtcgaactgtccggatcaacccgtgtgtcgctggaggggccagaaaggcggaggtttagtgctagcgaactaatgacccgcttacattcatcacttcgccttggacgtaattcagccgcccgggccctgattagcgggagtgggaccggagcagctcgcgagggcaaggcttctggcatggaggcccgtagcgtcgaaatgtctggcgaccgggtgagcagacctgccccaggagactctcgcgagggagactggagcgagcccagattagatacccaggaggaacctcctttggggtctcgctctaccaatgagcgcaggcagtcgaggttccttctcaacagcgttctctaccaggagtacagtgatgtcgcgagtgccagagagctccggaggcaacagcgggaagaagaaggtcccggcgacgaagcagagggagctgaggaaggtcccgggccccctcgtgcaaacctttcaccaagctcgtcctttcgtgcacagcgttcagcccgtggttctaccttttccttgtggcaggacatccctgatgtgcggggctcaggcgtgctggctaccctgtccttgagggattgcaagcttcaagaagctaaatttgaacttatcacatcggaggcatcctatatacactcactgagcgttgctgtgggccacttcctgggctccgccgagctctcagagtgcctcggggcgcaagataagcaatggttattttccaaactccccgaagtcaaatctactagcgagcggttcctgcaggatctggaacagaggctcgaggctgatgtcctcagattcagtgtttgtgatgttgtgttggaccactgccctgccttccgtagagtataccttccctacgtaactaaccaagcataccaggagcgcacctaccagcgcctgctcctggaaaatccacgattccccgggatactcgcaaggctcgaagagtccccagtgtgccagaggctgcctctgacttcctttttaattctgccatttcagcgtataacaaggctgaaaatgctcgtcgaaaacattctgaaacgaactgcccaaggaagcgaggatgaagacatggccaccaaagcattcaacgccctgaaggaactggtacaggaatgtaacgcttctgtgcagtccatgaagagaaccgaggagcttatccatctcagcaagaaaatacacttcgaaggaaaaatttttccactcatctcccaggcaaggtggctggttcgacatggcgagctggtggaactagctcctctgccggctgcgccccccgctaagcttaagcttagtagtaaggccgtgtacttgcatctgttcaacgactgtctgctcctatcacgcaggaaagagcttggaaagtttgccgtctttgtgcatgccaagatggcagaactccaggtgcgggacttgagcctgaaactgcagggcatccctggccacgtgttccttttacaacttctgcacgggcagcacatgaagcatcagttcctgctcagagcccgaaccgagtccgaaaaacaacggtggatctcagccttgtgtccctccagtcctcaggaagataaggaggttatcagcgagggggaagattgccctcaggtccagtgtgttcgaacttacaaagccctgcacccggacgagctcactctcgagaagaccgatatactgagtgttcgcacatggacgtccgatggctggcttgaaggagtgagactggcagatggggagaaggggtgggtgccccaggcctacgtggaagaaatcagtagcctctctgccaggctgagaaacctccgggaaaacaagcgtgttacaagtgcgactagcaaactaggggaggctccggtgtag

SEQ ID NO: 203396 - DNA, 1575 bp, Artificial Sequence
  Description of Artificial Sequence: Synthetic coding sequence
atggactgcggcccccccgccaccctgcagccccacctgaccggcccaccaggcacagcacatcacccagtggcggtgtgccaacaggaatccctgagcttcgctgagcttccagccttgaagccgccttcccctgtttgcctcgacctgtttcccgtcgcaccggaagaactgcgggcaccgggctcacggtggagcctaggcacacctgcacctctgcagggattgctgtggcctttatcccccggaggatccgatactgagatcacctctggtggaatgaggccctcaagagccggcagttggcctcactgtcctggagctcagccgccagcccttgaaggaccctggtcacctcgccatactcagccgcagagacgggcctctcatgggagtgaaaaaaaatcggcctggcggaagatgcgtgtttaccagagagaggaggttccagggtgccctgaagctcatgctgtattcctggaaccaggccaggtggtgcaagaacaggctctcagtactgaggagccacgtgtcgagctcagcggctctacccgcgtgtctttggaaggtcctgaaaggcgacggttctccgcttccgaactgatgacacgactccactctagcctgcggctgggaaggaattccgctgcccgcgcgctgatcagtggctctgggaccggagccgcccgagaaggaaaggctagcgggatggaagcacggagtgttgagatgtctggggacagagtctccaggccagctcctggagactcccgagagggcgattggagcgagccccgcctcgacacgcaggaggagcctcccctggggagccggtctaccaacgagagacggcagagcaggtttctcttgaattccgtcctgtaccaggaatacagcgatgtagcctctgcacgtgaactgcgccggcagcagagagaagaagaagggccaggagatgaggccgaaggtgccgaagaggggcccgggccccctagggccaatctgtcaccttccagcagttttcgggcacaaagatccgcaagaggctcgaccttttctctatggcaggacattccagacgttcgcggatctggagtgctagcaacgctgagcctacgggactgtaagctccaggaggccaagttcgaattaatcaccagcgaagcatcatacatccattcattgagcgtggccgtgggacactttttgggaagtgcagagttaagtgaatgccttggtgcccaggataagcagtggctctttagcaagctgcccgaagtaaaatctacttccgagagattcctgcaggatctagaacaacgcctggaagccgatgtgctgagattctctgtttgcgatgtagtgctggaccactgtccagcctttagacgtgtttacctgccctacgtcacaaatcaggcataccaagagaggacatatcaaaggctgttactggagaatcctagattccccggaattctggctaggctggaggagtcgcccgtgtgccaacggctccctctgacaagtttcttgatcttgcagcccccagggggccaaggcggacaccagtag

SEQ ID NO: 203397 - DNA, 1509 bp, Artificial Sequence
  Description of Artificial Sequence: Synthetic coding sequence
atggactgcggcccccccgccaccctgcagccccacctgaccggccctccagggacagcacaccaccccgtggccgtgtgtcaacaagagtcgttgagcttcgctgaattacccgctttgaagcctccaagccctgtgtgtctggacttattccctgtggcccccgaggaactgcgtgcacccggcagccgctggtctctgggtactccggccccgctccagggtttgttgtggcccctgtccccaggaggatctgataccgagattacaagtggcggtatgagaccttcaagagccgggtcctggcctcattgtcccggcgctcagccccccgctctcgagggcccctggtcacctagacacactcagccgcagcgcagagcttcgcatggttccgaaaaaaagagcgcctggcgaaaaatgcgcgtgtaccagcgcgaagaagtgcccgggtgtccagaagcccatgctgtgttcctcgagcctggccaagttgtgcaggaacaagcattgagtaccgaagagccccgagtggaacttagcgggtctactagggtgtctctggaaggaccagaacggcgacgcttctcagcctccgagctcatgactcggctgcatagcagccttcgactaggaaggaactcagccgctagagccctcatatcagggagcggcacaggagcggctcgtgagggaaaggcttcaggaatggaggcacgtagcgttgagatgagtggtgaccgggtgtcacgcccagcccccggagatagtcgggagggcgactggtccgagcctcgcctggacacccaagaagagccacccttgggaagcagatcaacaaatgagaggaggcagagcaggttcttgcttaactcagttctctatcaagaatattcagatgtggcttcagctcgtgaactacgacgacaacagcgggaggaagagggccctggcgatgaagcggagggagctgaggagggacccggcccgcctcgagccaacctttcaccctcctccagcttccgcgctcagagaagcgctcgcggttcgacgttctccctgtggcaagacattccagatgttcgagggtcaggggtcctcgccactctgagtttgcgggactgcaaacttcaggaagccaagtttgagctgataacatccgaagcctcctatatccatagcctctctgtcgccgttggccatttcctcggatcagctgagctcagcgagtgcttgggcgcccaggataagcagtggttgttcagtaaactgccagaggtgaagtccacgtctgaaagattcctacaggatctggagcagcgtctggaagccgacgtcttgcgcttttctgtatgcgatgtggtgctggatcattgccctgccttcaggcgggtgtacctgccttacgtgaccaaccaggcttatcaggaaaggacctatcagcggctcctgcgagaaaacaagagggtgacatctgctacctctaaactcggggaggcacctgtgtag

SEQ ID NO: 203398 - DNA, 504 bp, Artificial Sequence
  Description of Artificial Sequence: Synthetic coding sequence
gagcggctggcccagttccccgccgccggccggggcagccccggccctccaggcgcaagactgggggttggacttgagaaagggagagggagagaagtgtggaggcctggagtgtggggctgtgaggcccgtgcctctgaggttaactggtcgtgcccatttgatcccgtttgcgctctcccacaggccaaatttgagctcatcacaagcgaggcatcatatattcactcactgtccgtggctgttggtcattttctgggctccgcagaactttcagaatgcctcggcgcccaggataaacagtggctcttttctaagctcccagaggtgaaatctacaagcgagaggttcttacaggatctagagcagcgcctggaagccgacgtcctccgcttttctgtctgcgatgtggtgcttgaccattgcccagctttccggcgagtatacttgccttatgtcactaaccaagcctatcaagagaggacataccaacgactgctctag

SEQ ID NO: 203399 - DNA, 924 bp, Artificial Sequence
  Description of Artificial Sequence: Synthetic coding sequence
tgacgggaccggggccaggagcggctggcccagttccccgccgccggacgtggaagccccggcccccccggggctagactcggggtgggccttgagaagggccggggacgggaggtatggcgcccaggtgtgtgggggtgtgaagcacgtgcatcagaggtgaactggagttgtcctttcgatcctgtgtgcgctttaccgcaggcgaagtttgagctaatcacatctgaagcttcctacatccacagtctgtctgtcgccgttgggcatttccttggttcagctgaattatcagaatgtctcggtgcccaggacaagcagtggctcttttccaaattacccgaggtaaagtcaacatccgagcggtttctgcaggacctcgaacagcggctggaagccgatgtactgagattctctgtctgcgatgtggtgctcgatcactgtccagcattccgacgagtgtatctgccctatgtcacaaaccaggcttatcaagaacggacctatcagagacttctacttgagaaccctcgcttcccaggtatcctcgcgcgactggaggagagcccagtgtgccagagattaccacttacctccttcctgatccttcccttccaaaggataacccggttgaaaatgctggtggagaacatcctgaagcgcactgcccagggctccgaggatgaggacatggcaaccaaagctttcaacgccttaaaggagctggtgcaggaatgcaatgcatctgtgcaaagtatgaagcggactgaggaactgatccacttatcgaaaaaaatacattttgaagggaagattttcccactcatcagtcaagctcgttggctggtgcgacatggggaactagtggagctggccccactgcctgcagctcctccagcaaaattaaagctgagctctaagtag

SEQ ID NO: 203400 - DNA, 1581 bp, Artificial Sequence
  Description of Artificial Sequence: Synthetic coding sequence
atggtggccaaggactaccccttctacctgaccgtgaagcgggccaattgtagtttggagctaccacctgcttctggacctgcaaaggacgccgaggagccttcaaacaagagggttaagccactctcaagagtcacgagcctggccaacttgatcccccctgtgaaagcaacccctctcaaaagatttagtcagacccttcaaaggagcatcagtttcagaagcgaaagtagacccgacattttggcacccagaccctggtctcgaaacgcagcaccttcatcaaccaagcgccgggatagcaagctttggtccgaaacctttgacgtttgtgtcaatcagatgttgacatcgaaggagattaaacgacaggaggccatcttcgagttgtcacaaggcgaggaggaccttattgaagatctgaagctggccaaaaaagcctatcatgaccccatgctgaaactgtcgatcatgactgagcaggagctgaatcagatctttggaaccctggatagcctaatccctctgcatgaagaacttctctcccagctgcgcgacgtgcgaaaacccgatggtagcactgagcatgtcgggcccatcctggtcggctggctaccctgtctgagctcatatgatagctactgctctaaccaggtggcagccaaggcgctgctggaccataagaagcaggatcacagggtgcaagacttcctccagagatgcctcgaaagtcccttctcacgcaaactcgacctgtggaatttcctggacatacccagaagccgcctggtgaagtatcctctgctactgagggagattctcagacatacacccaacgacaaccccgatcagcaacacctcgaggaagcgattaatatcatccaaggaatcgtagccgaaataaatactaaaacgggcgagagcgagtgccggtactataaagaacggctgctgtatttagaggaaggacagaaagattctcttattgacagctctcgcgtgctatgttgccatggcgagctcaaaaataatcgcggcgtgaaactccatgtctttctcttccaggaggtgcttgtcattactcgtgccgtgacccacaacgagcagctgtgctatcagctttaccggcagcccatccccgtgaaagatcttctcctggaagacttgcaggatggcgaggttcggctcggagggtcactccgcggggctttttcaaacaacgagaggatcaagaatttctttcgcgtgtcctttaaaaatggatctcagtctcaaactcacagtcttcaggctaacgacaccttcaacaaacaacagtggctgaactgcatacgtcaggctaaagagacggtcctctgtgctgcaggacaggcgggtgtcttagacagtgagggttcttttttaaaccctactacaggctccagagaactgcagggcgagacgaaactggagcagatggaccagtctgactccgaatctgattgttcaatggatacatcagaagtgagcctggattgcgagagaatggaacagactgatagtagctgcgggaattctcggcacggagaaagtaatgtatag

SEQ ID NO: 203401 - DNA, 1677 bp, Artificial Sequence
  Description of Artificial Sequence: Synthetic coding sequence
atggacagcagcaccgccatgaaccagtgcagctgccggggcatggaggaaaacaaggagaggcctaagcggcagcggcagaacaacttcccaatgttcccttctccgaaggcatggaacttcagagggcggaagcggaaacaatcgacccaggacgaggatgcagttagtctgtgcagcctggatatttccgagccaagcaataaaagggttaagcccctgtctcgggtcacaagtttggccaatctgatcccccccgtcaaagccacgcctctgaagcgcttttcacagactctgcaacgcagtatatcgtttcgatcagaatctaggccggatatactggcacctcgcccctggagtaggaacgccgccccgagcagtacaaagcgtcgcgattcgaagttgtggagcgagacatttgatgtctgcgttaaccagatgcttacctctaaagagataaaaagacaagaggccatttttgaactgtctcagggtgaggaagacctgatagaggacttaaaactggccaagaaggcgtatcatgacccaatgctgaagctcagcattatgaccgaacaggagctgaatcaaatctttgggaccttggacagtctgatccctctgcatgaggagcttctctctcagctacgggacgtcagaaaacccgacggatccaccgaacatgtgggaccaatactggtggggtggctgccttgcctgagtagttacgactcttactgctccaaccaggtcgcagccaaggccctgctggatcataagaaacaggatcatagagtccaggacttcctgcagcgctgtctggaaagtcctttttccagaaagctggatctatggaactttcttgacatccccaggagccgtctggtgaagtacccattgctgcttagggaaattctccggcataccccaaatgacaatccagatcagcaacatcttgaggaggccattaacatcatccaggggatcgtggcggagatcaatactaaaaccggagagtccgagtgtcgctactacaaagaaagactattgtacctggaagagggacagaaagacagcttgattgatagcagccgtgtcctgtgctgccacggtgagctgaagaataatcgtggggtcaagctgcatgtattcctcttccaggaagtcctcgtgatcacacgagctgttacacataacgagcagttgtgttatcagctgtataggcagcccataccagtaaaggacctgcttctagaggacctccaggacggagaagttagactgggcggttctcttcgaggcgccttttctaacaatgaacgtataaagaacttcttcagggtttcttttaagaacggtagtcagtctcagacgcacagtctccaggccaacgacaccttcaataaacaacaatggctgaattgcatcagacaagcaaaggagaccgtcctgtgtgccgcaggacaggctggcgtcctcgatagcgaaggatctttcctgaatccgaccacaggaagccgggagctgcaaggcgaaacaaagcttgaacaaatggaccagagtgacagtgagtcggactgctccatggacacaagtgaggttagtctggactgtgaaaggatggagcagactgattcgtcatgtggaaactctagacacggggagtctaatgtgtag

SEQ ID NO: 203402 - DNA, 1599 bp, Artificial Sequence
  Description of Artificial Sequence: Synthetic coding sequence
atgatcgaggtgtgccaccacaactggctgctgtggctgtgccccagtaaattcggtatcttcatgtgctgtctggcatccactaccggccaaatggagctgcgccgtaccagggagcccagcaataaacgcgtgaagccgctgtctcgagtgacgtctctggccaatcttataccccctgtaaaggctacccctctcaagcggttctcgcagacactgcagcggtcaatctctttccgcagcgagagtaggcctgatattctcgcccccagaccctggtcgcgcaatgcagccccaagctcgactaaaagacgcgacagcaagctgtggagcgagacctttgacgtgtgcgtgaatcagatgcttaccagtaaagagatcaaacgtcaggaggccattttcgagttgtcgcagggcgaggaagatttgatagaagacttgaagctggctaaaaaagcgtaccatgatcctatgctaaagttgtcaataatgacagagcaagagctgaaccagatttttggaactttagatagcctgattccactccatgaggagcttttgtctcaactccgtgacgtgcgcaaaccggatgggagcactgagcatgtcggacccatcctggtaggttggttgccctgtctgtcatcatacgattcatactgtagtaatcaggtagccgccaaggcattactggaccacaagaagcaggaccaccgcgtgcaagactttttgcagcggtgcctcgaaagtcccttttcacgaaaacttgatttgtggaactttctcgacatcccaagatcaaggctggtgaaataccctctgcttctgagagagatcctgagacacacacctaacgacaatcccgaccagcagcacctggaagaagcgattaatatcatccaggggattgttgctgaaatcaatactaagacgggcgagagcgagtgcaggtactataaggagcgtctcctctatctcgaggagggccaaaaagactctcttattgactcttcccgcgtactatgctgccacggcgagttgaaaaacaaccgaggcgttaagctgcacgtctttttgttccaggaggtgttggtgatcacacgcgcagttacccacaatgaacagctttgttatcagctttatcgccagcctatcccagtgaaggaccttctgctggaggatctgcaggacggtgaggttcggcttggcggtagcctgcgaggcgcattctcaaacaacgagaggatcaaaaacttctttagagtctcttttaagaacggaagccagtcccagacccattccctacaggctaatgatacctttaacaaacagcagtggcttaactgtattaggcaggctaaggagacagttctctgcgcagctggtcaggctggcgtcctcgactccgaggggtcgtttctcaatcctacaaccggctcccgggagcttcaaggtgagacaaagctcgagcagatggatcagtcagactcagagtccgactgcagcatggatacatcagaggtgtccctcgattgcgaacggatggagcagaccgacagtagctgcggaaactcaagacatggagagagcaatgtgtag

SEQ ID NO: 203403 - DNA, 2073 bp, Artificial Sequence
  Description of Artificial Sequence: Synthetic coding sequence
atgccctgggaggagcccgccggcgagaagcccagctgcagccactctcagaaggcctttcacatggaacctgcgcagaaaccctgcttcaccactgatatggtgacatgggccctgttgtgtatcagcgccgagacagtgcggggggaggcacccagtcagccccggggtattccgcatagatctccagtgagcgtggatgatttatggctcgaaaaaacgcaaaggaaaaagttgcaaaaacaggcgcatgtggagcgtcggctacatataggggcagtccataaagatggagtgaaatgctggcgtaagacgattattactagccccgaatcccttaacctcccccggcgctcccaccccctttcacaatccgctcctactggtctcaatcacatggggtggccagagcatacgcccgggacagctatgccagacggcgctcttgataccgcagtgtgtgctgatgaggtaggatccgaggaggacctctatgacgaccttcattcgtccagtcaccactattcacatccaggaggcgggggggagcagcttgctatcaatgaattgatctcagatgggtccgtagtgtgtgccgaggccctctgggatcatgtgactatggatgaccaggagctcggctttaaagcgggtgacgttatcgaagttatggatgctacaaaccgtgagtggtggtggggccgggtggcagatggtgaaggatggtttcctgcgtctttcgtccggttgcgggttaaccaggatgagccagctgatgatgatgcccccttagccggtaattcaggcgcagaagacgggggagctgaagcacaaagttccaaagatcagatgcggacaaacgtgatcaacgaaatcctctccacagagcgcgactacatcaagcacctgcgcgacatttgcgaaggttacgttaggcagtgccgcaaacgtgctgatatgttcagcgaggaacagctcagaactatctttgggaatatcgaagatatttacagatgtcagaaagctttcgtgaaagccctagaacagcgctttaatagggagcggccacatctcagtgaattgggggcttgttttcttgagcatcaggcggacttccagatctattctgaatattgcaacaaccatcccaatgcttgcgttgagctctcgcgcctaacaaaattgtccaagtacgtctatttctttgaggcctgcagactcttgcagaagatgatcgacatcagcctggacggatttttgttaacccccgtccaaaagatttgcaagtatcccttgcagcttgcagaattacttaagtacactcacccccagcatcgggactttaaagatgtggaagccgctcttcacgcgatgaaaaatgtcgctcagttgattaacgagcggaaacgcaggctggagaatattgataagatcgctcaatggcagtcctcaatcgaggactgggagggagaagacctgctggtcaggtctagcgagctgatctactcaggcgagcttacccgtgttacccagccgcaggccaagagccagcagcgaatgttttttctatttgatcaccaactcatttattgcaagaaggatctcctgaggcgcgacgtcctatattacaagggacggctggatatggatggcctggaagtggtggacctggaagatggcaaggatcgagacctgcacgttagcatcaaaaacgctttccgcctccaccggggagctaccggtgacagccacctgttgtgtacaaggaaacctgaacagaagcagcgctggcttaaggcattcgcccgcgagcgagaacaagtgcagctggaccaggagactgggtttagtattactgagctccaacgtaaacaggcaatgcttaacgctagcaaacagcaggtgaccggaaagcctaaggccgtcggaagaccgtgttatctgacgcgccagaagcaccctgcattgccctcgaatcgtccacaacaacaggttctggtgctcgctgaacctcgtcgtaaaccgtccacgttctggcattctatcagccgactcgctccattccgcaaatag

SEQ ID NO: 203404 - DNA, 1860 bp, Artificial Sequence
  Description of Artificial Sequence: Synthetic coding sequence
atgcggcccgacggccagcaggccctggacgccgtggtgcggagcttcgattgtcatagtgaggccgctctacgccaaagaaacgacgtgatctattgttccctacctcgaacagcccagggaatagtccagagagaggaccagctggaggtgctggtttccctcagggaggtttggggtagacggagagggagagacggtacttgcaccggcgcaatgcccgatggggctctcgataccgcagtctgcgccgacgaggtcggcagtgaggaggacctatacgacgatctccattcttcctctcatcactactcacaccctggtggcggaggagaacagttggccatcaatgagctaatttctgacggctcagtggtgtgcgccgaggcgttgtgggaccacgtgactatggatgatcaagagcttggttttaaggccggcgacgtaatcgaagtgatggacgctaccaacagagagtggtggtggggtagagtggctgacggggaaggatggtttcccgccagttttgtgcggctgcgcgtcaaccaagacgaaccggccgacgacgatgcccccctcgcgggcaactcaggggccgaggatggaggagctgaggcgcagagttctaaggaccagatgaggacgaacgtcattaatgagatcttatcgactgagcgtgattacataaaacacctgcgggatatttgcgaggggtacgtgagacagtgtagaaaaagagccgacatgtttagcgaggagcagctgagaactatctttgggaatatagaggatatctatcgatgtcagaaagcttttgtgaaggcactggaacagaggttcaaccgcgaacggccacacttgagcgaactcggggcgtgcttcctcgagcaccaggcggacttccaaatctacagcgaatactgcaacaaccacccaaacgcatgcgtggaattatcacggctgaccaaactttcgaagtatgtttatttcttcgaggcctgtcgcctcctccagaaaatgatcgatatttccttagatggtttcttgttaacacctgtgcaaaagatatgtaaatatcctctgcagctggccgagcttctgaaatacactcaccctcaacacagggattttaaagatgttgaggcagcccttcatgccatgaaaaacgtagcccagcttattaacgagagaaaacgcagactggagaacattgacaagatcgcgcagtggcagagcagtattgaagattgggagggggaggacctcttggttcgttcttctgagttaatctacagcggcgagctgactcgcgttacacagccccaggccaagtcccagcagagaatgttcttcctgttcgaccatcagctgatttattgcaaaaaggacctgctcaggcgggatgtcctctactacaaggggagactcgatatggacggcctggaggtggtagatctcgaagatggcaaggatcgagacctacacgtgagcattaagaatgccttccgcctccatagaggggcaaccggcgattcacacctactctgtacacgcaaacccgaacaaaagcagcgctggctaaaagcatttgctcgcgaaagggagcaagtgcagctcgaccaagaaacagggttcagcattaccgagctgcagcggaaacaggctatgctgaacgcatccaaacagcaggtaacaggaaagcccaaggcagtcggccgtccatgctacctcacaagacagaaacatccggctcttccaagtaaccgccctcagcagcaggtcctggtgcttgccgagcctagacgaaaaccgtctacgttctggcacagcatatcgcggttagctcctttccgcaaatag

SEQ ID NO: 203405 - DNA, 2013 bp, Artificial Sequence
  Description of Artificial Sequence: Synthetic coding sequence
atgccctgggaggagcccgccggcgagaagcccagctgcagccactctcagaaagccttccacatggagcccgcacaaaaaccgtgcttcacaacggacatggtgacctgggccttattatgcattagtgcagagaccgttaggggagaagctccttctcagccccgcggcatcccccaccgatcgccagtgagcgtggacgacctctggttagagaaaacacaaagaaaaaagctgcagaagcaggctcacgtggagagaaggcttcacattggcgccgtgcacaaggacggggtcaaatgttggcgaaagactattatcacttcaccagagtcacttaatttgccgagacggagtcatccattatcccagtctgctcctactggcctaaaccatatggggtggcctgagcatacccccggaaccgccatgccagatggtgcccttgataccgcagtttgcgcagatgaggtcgggagtgaggaagacctctacgatgacctccattctagctctcatcactattcccatccggggggggggggcgaacaacttgcaataaatgagctgatcagcgatggcagcgtggtttgcgccgaggcactgtgggaccacgtgacaatggatgaccaagagctggggtttaaggctggcgacgtgatagaggttatggacgcaacaaatagggaatggtggtggggaagggtagccgatggagagggttggttccccgcgagcttcgtacggctcagagtcaaccaggatgaacctgcagacgatgatgctcctctcgctggcaattccggagctgaggatggaggtgccgaggcccagagtagcaaggaccagatgcggactaatgtgattaatgaaatcctatccaccgaacgggattacataaaacatttgcgggacatttgcgaaggctacgtccgtcagtgcaggaaaagggcagacatgttctcagaggagcagttgcgtaccatttttggtaatatagaggacatatataggtgtcagaaagcctttgttaaggcgttggaacagcgtttcaacagagagagacctcatctgtccgaactgggggcatgcttcctcgaacaccaggctgactttcagatctattccgaatattgtaataatcacccaaacgcctgcgtcgaattaagccgcctgaccaaactttctaagtacgtgtactttttcgaagcctgccgtcttttgcaaaaaatgatcgatatttcgctcgatggcttcctgctaactcccgtgcaaaaaatttgcaagtaccccttacaactcgccgagcttcttaaatatactcacccacaacatagagatttcaaggatgttgaggcggccttacacgccatgaaaaacgtcgcacaactcattaacgaaagaaagagaaggttagaaaatatcgataaaatcgctcaatggcagagttcaatcgaggactgggaaggcgaggatctgctcgtccggagcagcgaacttatctattccggtgaacttactcgtgtgacgcaaccgcaggcgaagagccaacagcgcatgtttttcttgttcgaccaccagcttatatactgcaaaaaggacctgcttcgtcgggacgtcttatactataagggacgactggatatggacgggttagaggttgtagatctagaagatgggaaagatagagatctgcacgtcagtattaagaacgcattcaggttgcaccggggcgccacaggcgacagccacttgttatgtacccgaaaaccagagcagaagcagcgttggctcaaagcgttcgcaagggagcgcgaacaggtgcagctggatcaggagacaggcttttcaattaccgagctgcagcgcaaacaggctatgctgaatgcatcaaagcagcaggtcacaggcaaacctaaagggcggcgcacagcggctccgcccccccgcttgcccgggccttatccggccgacattattccttttagcgaaccgcaaagccaagcttcttag

SEQ ID NO: 203406 - DNA, 1893 bp, Artificial Sequence
  Description of Artificial Sequence: Synthetic coding sequence
atgccctgggaggagcccgccggcgagaagcccagctgcagccacagccagaaagcctttcacatggaaccggcccaaaagccctgcttcacaactgatatggttacatgggcactcctctgcatatccgctgaaactgtacgtggggaggcgccatcacagcctcgcggtattccacaccgatctccggtgagtgtcgatgacctgtggttagaaaaaacacagcgaaaaaaactccagaaacaggcccacgtggagcggaggctacacatcggagcggtccacaaggatggcgtgaaatgctggaggaagacaataatcacctcaccagagtctctcaacttgcccaggcgctcccatcctctgtctcagagcgctcctaccggactgaaccatatggggtggcccgagcataccccaggcaccgccatgccagacggggctctggatacagctgtgtgtgctgacgaggttggaagtgaggaggatctgtacgacgatcttcactcgtcttctcaccactactctcaccccggcgggggcggtgaacagctggcaatcaacgagctgatcagcgacggttctgtggtgtgtgccgaggccctctgggaccacgtcaccatggatgaccaggagcttggttttaaggccggtgacgtaatcgaagtgatggatgcaacaaaccgagaatggtggtgggggcgagtcgccgatggcgaaggatggtttccagcatcctttgtccggttaagagttaatcaggacgaaccggcagacgatgacgccccactggccggaaattctggagccgaagatgggggcgcggaggcccagtcttccaaagaccaaatgaggaccaatgtcattaacgaaatcctgtcaaccgaacgcgactacatcaagcacctgagggacatctgtgagcaggcagacttccagatctattctgagtactgcaataatcaccctaatgcatgtgtggagctgtccagactaaccaagctgtctaaatatgtctacttctttgaagcctgtagattgctgcaaaagatgatagatatctccctggacggctttctgctcacacccgtccagaaaatttgtaagtatcctctacagctggcagagctgctgaaatatacccatccgcagcatagggacttcaaagacgtagaggccgcactccatgctatgaagaacgtggcacagttgatcaatgagcgtaaaagacgtctcgagaacatcgataagatcgcacagtggcaatcctccatcgaggactgggagggggaggatctgctggtgcgatcttccgagctgatatacagcggggagctgacaagggtgacccaaccgcaggctaaatcccagcagcggatgttctttcttttcgatcatcagctgatctattgcaaaaaggatcttctacgaagagacgtgctctattacaagggacggctggacatggatggcttggaagtggttgacctggaggacgggaaagaccgcgacctacatgtttcgatcaagaatgcctttagactgcacagaggagcaactggcgactcccacctcctttgtactcgcaagcctgaacaaaagcaaaggtggctcaaagctttcgctcgggagagggaacaagtgcagctagatcaggagaccggatttagtataaccgagctgcaaagaaaacaagccatgctgaacgcttctaagcaacaggtgactggcaaaccaaaggccgtcgggaggccgtgttatcttacgcggcagaagcaccctgctttgccctcgaataggcctcagcagcaagtcctggtcctcgctgagcctaggcgcaagccttccaccttctggcatagcatttcgagattggcgccattcagaaaatag

SEQ ID NO: 203407 - DNA, 579 bp, Artificial Sequence
  Description of Artificial Sequence: Synthetic coding sequence
atgccctgggaggagcccgccggcgagaagcccagctgcagccactctcagaaggcatttcatatggaaccagcccagaaaccctgttttaccaccgacatggtgacctgggctctcctctgtatctcagcggagaccgtgaggggcgaagcccctagccagcctagaggcatcccgcaccgatctccagtgtctgttgatgatctatggttggaaaagacgcaacgaaagaagcttcagaaacaagcacacgtggagcgacggcttcatatcggcgcagtccacaaagacggagttaagtgctggcggaagacaattatcacatcaccagaaagcctgaatctgccccgtaggagccatcctctgtctcagtccgccccgacgggactcaatcacatgggttggcctgagcacactccaggcactgccgtgggacgtccttgctacctcacgaggcagaagcaccctgccctccctagtaacagaccacagcagcaggtgctggttctcgcggagccccgcaggaaaccatcaaccttctggcattctatctcacgcctcgccccctttaggaaatag

SEQ ID NO: 203408 - DNA, 2013 bp, Artificial Sequence
  Description of Artificial Sequence: Synthetic coding sequence
atgccctgggaggagcccgccggcgagaagcccagctgcagccactcacaaaaagccttccacatggagccagctcaaaagccatgtttcaccactgacatggtaacttgggccttgctttgtatttctgccgagacggtgagaggagaagccccgagccagcctagaggtataccgcaccgttcccctgtgagcgtggatgatctttggcttgagaaaacccaaaggaaaaaactgcagaagcaggcacacgtcgagagaaggctgcatatcggagccgtgcacaaggacggggttaaatgctggcggaaaactataatcacgtctcccgagagcctcaacctgcctcgccgttcacaccccttaagccagagcgcacctacggggctgaatcatatggggtggcctgaacacactcctggaactgcaatgccagatggcgctcttgatacagccgtgtgcgcagatgaagtggggagtgaagaagatctttatgatgatctgcattcctcctctcaccattattcccaccctggtggcggcggggaacagctggcaataaatgaactgatcagcgatgggagcgttgtgtgtgcggaggcactatgggaccatgtgaccatggatgatcaggagcttggttttaaggcaggagacgtgatcgaagtgatggatgccacaaatcgggaatggtggtgggggagagttgcagatggcgaggggtggtttccggcttctttcgtgagactgagggtgaatcaagatgaaccagccgacgatgacgcacccttagcgggcaactccggcgctgaagacgggggcgccgaggcccagtcatccaaagaccagatgcgtacaaacgtcatcaatgagattctttctactgaaagagattacatcaagcacttacgcgacatctgcgaaggctacgtcagacaatgtaggaaacgggcggacatgttctccgaagagcagctgaggaccattttcggaaatatcgaagatatctacagatgtcaaaaggctttcgtaaaggcactagagcagcgcttcaatagggagcgtccccacttaagcgagttaggggcctgtttcttggagcaccaagcagactttcaaatctatagtgagtactgcaacaaccacccaaacgcatgcgtcgaattgtcccggcttaccaaactgagcaaatatgtttattttttcgaagcttgtcgtctgctgcagaagatgatcgatatttcactagatggcttcctcctgacacctgtacagaagatctgcaagtacccgctccagcttgcagaactcttaaagtatacccatccccagcatcgggactttaaggatgtggaagcagctctgcacgcaatgaaaaacgtggcccagcttatcaacgagcggaagaggagactggaaaacatcgataaaatcgcccagtggcagtcgtcaattgaggattgggagggggaagacctgctggtgcggtctagtgaactcatctactctggggagctgacccgtgtcacacaaccccaggccaagtcccagcagaggatgttctttctctttgaccaccagcttatttactgcaagaaggatcttctgaggcgcgatgtgctgtattataaaggtcggttggacatggacggtctagaggttgtagacctcgaggacggtaaggatagagacctccatgtgtccataaagaacgctttcaggctgcaccgcggggcaaccggcgacagccacctactctgcactcgtaaacctgagcaaaaacagcggtggttaaaagcctttgcaagggaaagagagcaagtacagctcgatcaggagactggtttcagcattacggagctgcagaggaagcaggccatgttgaatgctagtaagcagcaggtcacaggaaagccgaaggggagacggacagctgcaccacccccccggctgcctgggccctaccctgccgatatcattcctttctccgaacctcaatcccaggctagctag

SEQ ID NO: 203409 - DNA, 4794 bp, Artificial Sequence
  Description of Artificial Sequence: Synthetic coding sequence
atggaggccgaggaggcccagcggggcgccagcccccccatcagcgcaatagaggagtttagcattattcctgaagcgcccatgcggagttcccaggtgagtgcactgggtctggaagctcaagaggatgaagatccatcttacaagtggcgtgaggagcaccggctgtctgcaacacagcaatccgaactccgcgacgtatgcgattacgccatcgagacaatgccttccttcccaaaggaagggtcagccgatgtggagccaaaccaggaatccctagttgcagaagcatgtgacactccagagcattgggaggcagtgccccagagcctggcgggcaggcaagctagaaccctggctccccctgagctttgggcctgcccaatacaatcagaacacttggatatggcgcctttttctagcgacctggggtctgaggaggaagaggtggaattttggcctggcctcacttcccttactctgggtagcggacaggcggaagaggaggaggaaacctcatcagataactccggccagacccgttattacagcccttgcgaggaacatcccgcagagacgaaccaaaatgagggatctgagagcggcaccatcaggcagggtgaagaactaccacctgaggagttgcaagagagtcaagggctgctccacccccaggaagtacaagtcttggaagagcaggggcagcaagaggccggtttcaggggggagggaacactgagagaagacgtgtgcgcggatggcctacttggagaagagcaaatgatagagcaggtgaacgacgagaaaggtgagcaaaagcagaagcaggaacaggtccaggacgtgatgctcggacggcagggtgagcgcatgggtctgacaggagagccggagggactaaacgacggggagtgggaacaagaagacatggagcgaaaggcccaagggcaaggcgggcctgagcagggagaggaacgaaagcgcgagctgcaggtgcccgaagaaaatcgagctgacagtcaggatgagaagagccagacgttcctcgggaagagcgaggaagtgaccgggaaacaggaagaccacggaattaaagagaaaggggtgcccgttagtggccaggaggctaaagagcccgagtcttgggacgggggtagattgggggctgtcgggcgagcaagatcacgggaagaggaaaatgagcatcacggcccttcaatgccagccctcattgcacccgaagactccccacactgtgacctgttcccaggagcctcttatctgatgacccagataccaggcacacagactgaatctagggcagaagagctgtcacccgcagccttatccccttccctcgagcccatcaggtgcagccaccaaccaatcagtctgcttggatctttcctgacagaagagtccccagataaggaaattgaccaaaactcacagcaggaggagtccagactgcgcaaaggcacagtttcgtctcagggcaccgaagtcgtgttcgcctcagcaagcgtgacacctccacgcactccagactccgccccaccctccccagcagaagcatatcctatcacgcccgcctcagtgagcgcacgacctcccgttgcttttccacgcagggagacctcctgcgcagcccgcgctccagagacggcttccgccccattaagcatggacgacccaagtccatgcggtacctctgaaatgtgccccgccgcactgtatggattcccttctactgggacgtcccctccccgcccccccgccaacagtaccggcaccgtgcaacacctcaggagcgatagcttcccagggtcgcataggaccgagcagactccagatctggtgggcatgttgctctcatacagccacagcgagcttcctcaacgcccgccgaagccagcaatttacagctctgtcacaccacgtcgggaccggagaagtggccgggactattccaccgtgtctgcttctcccactgcattgtctactctgaagcaggattcccaggagtccattagcaatctggaacgtccttcatctcccccttcaattcagccatgggtttctcctcataatcccgccttcgccacggaatctccagcatatggttccagtccgtcttttgtttccatggaggatgtaagaatacatgagcccttgcctccacccccgcctcagcgaagagacacccacccctcagtcgtggaaacagacggacatgctagggtggtggtgcctaccctgaaacaacactcccacccgccacctctggccttagggagcggattgcacgcaccgcataaagggcctcttccgcaggctagcgacccagcagtggcccggcagcataggccgctgccttcaacccctgatagcagccatcacgcacaggctacaccgcggtggcggtataataagccgcttccaccaaccccagacttgccacaacctcacctaccccctattagcgctcctggctcctcgcgtatctacaggcccttaccgcccttgcccatcatagaccctcccacagagcctccacccctaccccccaaatccaggggccgctctcggagcactcggggaggacacatgaactccggcggtcatgcgaaaacccgcccagcatgtcaggactggaccgtcccactgcctgcttccgctggcaggacatcatggcctcctgcgaccgcacgctctaccgagagctttacaagtaccagccgcagcaaatctgaagtcagtcccggaatggcttttagtaatatgacaaactttctctgcccctctagccctacaacaccctggacaccggagcttcagggtccaacctctaaggacgaggctggggtgagcgagcatccagaagcgcctgctagggaacccctccgacgcacaaccccgcagcagggcgcatcaggacccggacgctctcccgtcggacaggccaggcagccagagaaaccctcccacctgcacctagagaaggcatcgagctggcctcacaggagggattctggtcgcccaccaggagactcttctgggcaagcggttgctccatccgagggcgcaaataagcataagggatggtctaggcaggggttgaggagaccctccatactccccgaggggtcctctgactctagaggtccagctgtagaaaagcatcctggccctagcgatacggtagtattcagggagaaaaaacctaaagaggttatgggagggttttctcgccgctgtagcaagcttattaattccagccaacttctttaccaagagtactctgacgtcgtcctcaataaagagattcagtctcagcagaggttggaatcactaagtgagaccccagggccttcctcaccaagacagccgagaaaggcactggtgagttccgaatcttatcttcagcgactatctatggcatcgagcgggagcctctggcaggagattccggttgtgcggaattctacggtgttattatccatgacccatgaagaccagaaactgcaggaggtcaagtttgaattaattgtaagcgaagcctcttacctgaggagcctgaacatcgctgttgaccatttccagttgagcacaagtttgcgagccactctgtcgaatcaggagcaccagtggctgttttcgcgactacaggacgtgagggacgtatccgccacttttctctccgatttggaggaaaatttcgagaataatatcttctcattccaggtgtgtgacgtagtgttaaatcatgctcccgattttcgcagagtctatctaccatatgtgactaaccagacctatcaggaacggaccttccagtcacttatgaactcaaatagtaattttagggaggtcctagagaagctcgaaagcgatccagtgtgtcagcggctgtcgctcaaaagctttttaatcttgcccttccagcggataactcgtctgaaactgctcttgcagaatatcctgaaacgaactcagccgggatcctctgaagaagctgaagctaccaaggcccaccacgctctggagcaacttatccgggactgtaacaataacgttcagtccatgcgaagaactgaagagctcatttatctcagtcagaagattgaattcgagtgcaaaattttccctctcattagccaatctaggtggcttgtgaagtctggtgaattgacagcactggaattttctgctagccccggactgagaaggaagcttaatactcggccagtgcacctgcacttatttaatgattgtctgctcctcagtcgcccacgcgagggtagtcgtttcctagtcttcgatcatgcgcctttctcctccattaggggagaaaagtgcgagatgaagctacatggtccgcataagaacctgttccgcttgtttcttcggcagaacacacagggcgcgcaggccgagtttctattccggacagaaacgcagtcagagaaattaaggtggatttccgcacttgctatgcctagggaagagctggatctcctggaatgctacaactcccctcaggttcagtgcctgcgggcctacaagcctcgagagaacgacgaattggctctcgagaaggccgatgtggtaatggttacacagcagtcctccgatggctggttggaaggggtgagactgtcagacggggaacggggctggtttcccgtgcagcaggtggaattcattagtaaccccgaagtgcgggcccaaaatctcaaggaagcgcacagagtgaagacagccaaattgcagcttgtggagcagcaggcctag

SEQ ID NO: 203410 - DNA, 1197 bp, Artificial Sequence
  Description of Artificial Sequence: Synthetic coding sequence
atggccagcagcggcagcctgtggcaggagatccccgtggtgcggaactcaactgttctcttgtcaatgacccatgaagaccagaaacttcaagaagtgaaatttgagttgattgtatctgaggctagctacctgcgctccctaaatatcgccgttgatcactttcaactaagtacttctttgagggcaacactcagtaaccaggaacatcagtggttattctcacgcctgcaggatgtcagagacgtgtctgcaacctttctcagtgacctggaagaaaactttgaaaataacatattttcatttcaagtttgcgacgtcgttctgaaccatgccccagacttcaggcgagtgtacttaccctacgtgaccaatcagacataccaagaaaggaccttccagtcactcatgaattcaaactcaaacttccgcgaggtgctagagaagttagaatcagatccagtgtgccagcgcctttccctgaagagcttcctcatcttgcccttccaacgcataacacgacttaagctgcttctgcaaaacatcctgaagaggacccaacccggctcttccgaagaagcagaagcgaccaaggcccatcacgctctggagcagttaatccgggactgcaacaacaatgtgcagtccatgcgcaggacagaggaactcatatacctgtcacaaaaaattgaattcgagtgtaaaatcttccccctaatttctcaaagccgatggctggtcaaatcaggtgagttaactgccctcgaattctcggcgtcccccgggctgcgcagaaaactcaataccagaccagtacacctgcacctgttcaacgattgcctcctgctctcgcgacctcgggagtctgagaaattacgttggatttccgcgctagctatgccaagagaggaactcgacctactcgagtgctataactccccccaagtgcaatgcctgcgagcttacaaacctcgagagaacgatgaactcgccctagagaaggcagacgtggttatggtaactcagcagtcttccgatggctggttagagggggtacgcctctcagatggagagagggggtggtttcctgtgcagcaggtcgagttcattagcaacccagaggtccgggcacagaatctcaaggaggcgcaccgagtgaaaactgctaagctgcagctggtcgaacagcaggcatag

SEQ ID NO: 203411 - DNA, 1560 bp, Artificial Sequence
  Description of Artificial Sequence: Synthetic coding sequence
atgggcggcttcagccggcggtgcagcaagctgatcaacagcagccagctgctgtaccaagagtactctgacgtggtcttaaacaaagagattcagtcccagcagagactggaaagcctttccgagacacccggcccgtccagccctaggcagccacgcaaggccctggtgagctcagagtcctacctccagcgactctcaatggcctcgagtgggtccttgtggcaagaaatacccgttgttaggaactccacagtgctgctgtccatgacccatgaggaccagaaacttcaagaggtgaagttcgaattaattgtatccgaagccagctacctcagatccctgaacatcgcggtggatcatttccagttgtcaacttctttgcgggctaccttgtctaatcaggagcaccaatggctgttctcacgactgcaggacgtccgggatgtgtctgcaacctttcttagcgatctcgaggaaaactttgagaacaatattttctccttccaagtgtgcgatgtggtactaaatcacgcaccagacttcaggcgcgtctaccttccatacgttactaatcagacctaccaagagcgcacatttcagagcctgatgaatagcaacagtaacttccgcgaagtcctcgagaagttggagtccgatccagtgtgtcagaggttgagcctgaaatcctttctgatcctgccatttcaaaggatcaccagactgaagcttcttctgcagaacatactcaagcgaactcagccaggaagttccgaagaagctgaagccactaaggcccaccatgcactcgaacagctcataagagattgcaacaacaacgtccagtctatgcgacgcacagaggagctgatttatctttcccagaagattgagtttgagtgcaagatttttcccttgattagccagtccagatggctcgtcaaatcgggcgagctgaccgcattggagttctccgccagcccagggcttcgccgaaagttaaacacacggcctgtacatttgcacctgttcaacgattgcctactgctgtcaagaccgcgggaaggaagtcgatttcttgttttcgatcacgccccattctcaagcatccggggagagaagtgcgagatgaaattgcacggcccccataagaatcttttccgtctgttcctgcgtcagaatacacagggggcccaggccgagtttttgtttaggacagaaacacagagtgagaagctgagatggatttctgccctggcgatgccaagagaggagttggatctgctggaatgttacaattctccgcaagtccaatgtctcagagcgtataagcctcgggagaatgatgagctggctctagagaaagccgatgtcgtcatggtgacccaacaaagctcagatggatggctggaaggggttagactctccgacggggaacgtggctggttccccgtacaacaggtggagttcatatctaatcctgaggtcagagctcagaacttaaaagaggcacacagagtgaagactgctaagctgcagttagttgaacagcaggcttag

SEQ ID NO: 203412 - DNA, 2394 bp, Artificial Sequence
  Description of Artificial Sequence: Synthetic coding sequence
tgagtggtggtgcccaccctgaagcagcacagccaccccccccccctcgctctcgggtcaggactacatgcccctcataagggccctctaccccaggcgagtgatccggctgtcgcacgccagcaccggccattgcccagtacaccagattcaagccatcacgcccaggcaacaccccgctggagatataacaagccactgccccctacgccagatctccctcagccccatcttccacctatttctgcacccgggtccagccgcatatatagacctctcccacccctaccaatcatcgacccgcccaccgagcctcccccccttcctcccaaatctcgcggacgatccagaagcacacgggggggccatatgaattccggcgggcacgccaagacaaggcccgcctgtcaagattggaccgttccactgcctgcatcggctggaaggacttcttggccccctgctactgcccgctccactgaaagttttacttcgacatccagaagcaagtccgaggtctcccccggaatggcgttttccaatatgactaattttctgtgcccttcatcaccaaccaccccgtggacaccagagctgcaaggccccaccagcaaggacgaggccggcgtgagcgagcaccctgaagcccccgccagagagcccctgcgaaggacaacaccccagcagggagcgtccgggcctggccgctctccagtgggacaagcaaggcagcctgaaaaaccatcccacctgcacctggaaaaggcatcttcatggccacatcggcgggactccgggcgccctcccggagatagcagcgggcaggccgtcgccccgagcgagggcgctaacaagcacaagggctggagccgccagggcctaaggcgaccaagcattctcccagaagggagctctgatagtagagggccggctgtggagaagcatccgggtccaagcgacacggtagtcttcagggaaaaaaaacctaaggaagtcatgggaggcttttccaggcggtgttctaaactcatcaatagctctcagttgctctaccaggagtactcagacgtagtccttaataaggaaatacaaagccagcaaagattagaatccctttccgaaactccaggaccgagttctcccaggcagcctaggaaggcgctcgtgtccagcgaaagctatcttcagaggttgagtatggcctccagcggatctttatggcaggagatccctgtggtgcgcaatagcactgtgctgctgagtatgacgcacgaagatcaaaagctgcaggaggtgaagttcgaattaatagtttccgaggcgagttatcttcggtctctgaacatagctgtggaccattttcaactcagcacatccctgcgcgccaccctgtcaaatcaagagcatcagtggctgttttccagactccaggacgtaagagatgtgagtgcaacctttctttcagacttggaagaaaattttgagaacaatatcttcagcttccaggtctgcgacgtggtcctgaatcacgctcccgatttccgacgggtctatctgccatatgtcacaaaccagacttatcaggaacgaacatttcaatccctgatgaatagcaattcaaacttcagggaggtgctagaaaagttagagtccgatcccgtctgccagcgcctcagccttaaatcctttttaatcctgcctttccagcggataactcggttaaaattgctattgcagaatattctgaaaaggactcaaccggggagttccgaagaggccgaagctacgaaggcgcaccatgctctggagcagctgattcgggactgtaataataatgtccagtccatgaggagaactgaagaactaatttatctgagccagaagattgagtttgagtgcaaaattttcccactcattagccaaagcagatggctcgtaaagtccggagagctcactgctctggaattttccgcctccccaggccttcgacgcaaactcaatacacggccagtgcacttgcatctttttaatgactgtctcctcctgtcacgtcctagagagagcgaaaaactacggtggattagcgccctggccatgcccagggaggaattagacttgttggagtgctataattcaccacaggtccaatgtctccgtgcatacaagccacgagagaatgatgagctggccctcgagaaggctgacgtcgtgatggttacccagcagtcaagcgatgggtggctagaaggtgtcaggctgagtgacggcgagcgcggctggttccctgtccagcaagtggaattcatctcgaatcctgaagtcagggctcaaaacctgaaggaagcgcaccgggttaagactgctaagcttcagctcgtcgagcagcaggcctag

SEQ ID NO: 203413 - DNA, 2958 bp, Artificial Sequence
  Description of Artificial Sequence: Synthetic coding sequence
atgagccggatcgagagcctgacccgggcccggatcgaccggagccgcgagcttgcctcaaagaccagggagaaggaaaaaatgaaggaggctaaggacgcgcgatacaccaacggtcacctgttcacaaccatctcagtgtccgggatgacaatgtgttatgcttgtaataaaagtatcacggccaaggaggccctgatctgtcctacttgcaatgtgactattcacaaccgctgcaaagacaccctagccaactgcacaaaagtgaagcagaaacagcagaaggccgcccttctcaagaataacactgccctacagagcgtgtcacttaggagcaagaccacaattagggagaggcccagctccgctatttatcctagtgactcttttcgtcaatctctgcttgggtcacgccgggggaggagctctttgtcactcgcgaagtcagtcagcacaacgaatatcgccgggcactttaatgacgaatctcctttgggcctacgaagaattctatcccagagtaccgacagcctcaatatgcgaaaccggactctcagcgtcgagtccctgattgatgaagaagtaatctatagcgagcttatgtccgatttcgaaatggacgagaaggactttgccgcagacagctggagtctcgccgtcgactctagcttcctgcaacaacataaaaaagaggtgatgaagcagcaggatgttatctacgaactgatccagacggagcttcaccatgtccgaacactaaaaattatgactagattatttcgcaccggcatgctagaggagctgcacctcgagcccggagtggtacaagggctgttcccatgtgttgacgagctttctgacatccatacaaggttcctgtctcaactactggagcggcgccgtcaagccttgtgtcctggatcaacgcgtaattttgttatccaccgtctgggggacctattaatcagtcagttttccgggccatcggccgaacagatgtgcaagacatatagcgagttctgtagtcgacactcgaaggccctcaagctctataaagagctgtatgctcgcgataaaaggttccagcagttcattaggaaagtgacaaggcccgccgtcttgaaacggcatggcgtacaggaatgtattcttctggtaacacagaggattacgaagtatcctttgctaataagccggatcctgcagcactctcatggtattgaagaggagcgccaggatctgactaccgccctaggattggtgaaagagctgctttccaatgttgacgagggaatctaccaacttgagaaaggtgccaggctgcaagaaatttacaaccgaatggaccccagagcacagaccccagtccctgggaaaggaccattcgggagagaggagctgctacgtagaaagttaattcacgatggatgcctactctggaaaacagccaccggccgcttcaaggacgtgctggtgctcctgatgactgacgtgctagtgtttttgcaggaaaaagaccaaaaatacatcttccccactctggacaagccgtcagtggtgagtcttcaaaacttgattgtcagagatatcgctaatcaggagaagggaatgttcctaatttcagccgccccacctgaaatgtacgaagtgcataccgccagtagggacgacagaagtacttggataagggtgatccaacagtctgtgcggacatgtccctctagggaggacttccctctgattgagacagaggacgaagcatacctgcggaggatcaagatggagctgcagcaaaaagatagggctctggtggaacttttgagagaaaaggttgggttgtttgccgagatgacccatttccaggccgaggaggacggagggagtgggatggccctgccgacacttcccaggggattgttccggtcggagagcctcgaaagtcccagaggcgaaagactgctgcaagacgccatccgagaagtggagggcctaaaggatcttctggtcggtcctggcgtcgagctacttctgacccctcgggagccagcactccctctagaacctgatagtggcgggaatacttcccctggggtaacagccaatggtgaggccagaacatttaacggttctatcgagctgtgtcgcgccgattcggattcttcccagcgggacagaaacggcaaccagctgcgttcgccacaggaggaagctctccaacgactagtcaatctgtatggtcttctccatggcctgcaggcagccgtggcacagcaggacacactgatggaagcacgcttcccagagggtcctgaaaggagggagaaactatgccgggccaacagccgggatggagaggccggtagggccggagccgccccagtagctccagagaagcaggccaccgagttggcactgctccagaggcagcatgccctgctgcaggaagagttgcgcagatgtagaagactgggcgaagagagggcaactgaggcaggatccctggaagctcgactcagagaaagtgagcaggctagagcccttttggaaagggaagctgaagaggctcggaggcagctagctgccctcgggcagacggaaccactgcccgccgaagccccatgggcccgtcggcctgtggatccacgccgcaggtcactccccgccggcgatgctctgtacttaagctttaacccacctcagcctagtaggggaactgaccgcctggacctccctgtcacgacgcgcagcgttcacaggaacttcgaagaccgggaacggcaagaactgggaagtccagaagaacgactgcaagatagtagtgacccggatacggggtcagaagaagaggggagcagccggctatcgcccccgcatagcccccgagacttcacccgcatgcaagacatacccgaggagactgagtcacgcgacggagaagctgtcgccagtgaaagctag

SEQ ID NO: 203414 - DNA, 2877 bp, Artificial Sequence
  Description of Artificial Sequence: Synthetic coding sequence
atgaaggaggccaaggacgcccggtacaccaacggccacctgttcactaccatctccgtgtctgggatgacaatgtgctacgcgtgtaataagtcaatcaccgcaaaggaggccttaatatgtcccacctgtaacgtaaccatacacaatcggtgtaaagacacactagccaattgcaccaaagttaaacagaagcaacagaaagccgctcttctgaagaataacactgcgctccagtcagtctctttgaggagtaagacaacgatcagggaacgcccttcgtctgccatttatccatcggacagcttccggcaatccctcttaggatcccggcggggccgctcgtctctgtccctcgccaaatcagtgtcaactacgaatatagctggtcattttaacgacgagagccctctgggattacgaagaatcctgtctcagagtacggattctttgaatatgaggaaccgcacactcagcgtggagtctttgatcgacgaagaggtcatctactcggagctgatgagtgatttcgagatggacgaaaaggacttcgctgcggactcctggtctctcgctgtggattcctcatttctacagcagcataagaaggaggtcatgaaacagcaggacgtgatctatgagcttatccagaccgagttgcaccacgtgaggactctcaaaattatgactagactctttcgaaccggaatgttagaagaacttcatctcgagcctggagtcgtccaaggcttgtttccctgcgtggacgaactgtctgatatccatactcgcttcctctcccagctgctagagcgcaggcgtcaggctctttgccccggctctacaagaaatttcgtgatccatcgcctgggcgatttacttattagccaattctcagggccttccgccgagcagatgtgtaagacttactctgagttttgctcaagacattctaaagccttgaagctgtacaaagaactgtacgctagagacaagcgttttcagcaatttataaggaaagttacacgacctgcggtactcaaaaggcacggggttcaggaatgcattctccttgtaacacagcggatcacaaaatatccattgctgatctcgcgcattctacagcacagtcacggcattgaggaggagcgccaggacttaacaacagcccttggtctggtgaaagagctgctgtcgaatgtggacgaaggcatttatcaactggagaagggggcacggttgcaagaaatctataacaggatggacccccgggcgcagactccagttcccggcaaggggccctttggtagagaagagctgctccgccgaaagctgatacatgatggctgcctcctttggaagacggctaccgggagatttaaggatgtcttagtgctattgatgacagacgttctggtcttccttcaggaaaaagaccaaaaatatattttccccacactagacaaaccttccgttgtgtctcttcagaatctaattgtccgggacattgccaaccaggaaaaaggcatgttcctgatttcagcagccccccccgaaatgtacgaggtacataccgcctctagagacgaccgcagcacttggattcgggtaattcagcagagtgtgcggacttgccctagtagagaggactttccgctcatcgaaacagaggatgaggcctacctgagaaggataaaaatggagctgcagcagaaggaccgggccctcgtggaactgcttcgggagaaggtcggactatttgctgagatgacacacttccaggcagaagaagacgggggctcagggatggccttaccaactctcccacgggggttatttagatctgagtcactagaatccccgaggggagaacggttgttacaagatgcaatacgagaggtggaggggttgaaggacctactggtgggccctggcgtagagctcctgctgacaccaagggagccggcccttcccctggagcccgactcgggcggtaacaccagccccggagtcactgctaatggagaagcccgaacatttaacgggtctattgagttgtgtagggccgacagcgattcttcccagcgggaccggaatggaaatcagcttaggtctcctcaggaagaagccctgcagagactggtcaacctgtatggattgctccacggactgcaagccgccgttgcccaacaagacactttgatggaagcccggtttcccgagggcccagaacgacgggagaagctgtgtcgcgctaactccagagacggggaggccggcagagctggagctgctccagtagctcctgagaaacaggcaacggagctcgcccttctgcagaggcagcacgctttgctacaggaagagttgcggcgttgtcgacggctgggcgaggaacgggctaccgaggccggtagcctggaggcccggttgcgggagtctgagcaggccagggcactgctggaacgggaagccgaagaagccagacgccagctcgctgccctggggcaaacagagcctctgccagcagaggccccgtgggctcgccggcccgtggacccccgccgccgctcactgcctgcaggcgatgctttgtatctttccttcaacccaccccagccctctagagggaccgatcggcttgatcttcctgtgacaacaagatccgtacaccggaactttgaggatcgcgagaggcaggaactcggcagccctgaagagcggctacaggacagctcagatcccgatacaggatcagaggaggagggctcaagcaggctgtcccctccccattccccccgcgactttacccgtatgcaagatattccagaagagaccgagtcaagggacggggaagccgtggcctctgaaagttag

SEQ ID NO: 203415 - DNA, 2961 bp, Artificial Sequence
  Description of Artificial Sequence: Synthetic coding sequence
atgagccggatcgagagcctgacccgggcccggatcgaccggagcagagagctcgcttccaagactagagaaaaagaaaagatgaaggaagctaaggatgcccgatatacgaacggccacctctttaccactatctccgtgtctggcatgacgatgtgctacgcttgcaacaaaagtatcacagcaaaggaagctctgatctgccccacgtgcaatgttactatccacaaccgatgtaaggatactctagcaaactgcacaaaggtgaagcagaaacagcagaaagctgcgctcttgaagaataatactgcattacagagtgtctctctgcgaagtaaaacgaccattagggaacgaccttcatcagcgatttaccccagcgactcctttcggcagagcctgctgggctcgagacgaggaaggagttctttgtccctggccaaatctgtgtctaccacaaatatagcaggtcatttcaacgacgaatcgcctctaggactccggagaatcctcagtcagtctacggactcactcaacatgaggaacagaactctctcagtggaatcgctcattgacgaggccgaagtgatttacagcgaacttatgtctgattttgagatggatgagaaagatttcgccgctgatagttggtccctggcagtggactcttccttcctgcagcagcacaagaaggaggtcatgaagcagcaggacgtaatatatgagttgatccagaccgagctgcaccacgtgagaaccctcaaaatcatgactagactgttccggacaggtatgcttgaagagttacaccttgagcccggcgtagtgcagggtctgtttccatgcgtggacgaactctctgacattcacacccgattcctttctcagttactggagcggagacggcaggcgttgtgccctggatctacaagaaacttcgtgattcacagactgggggatctcctgatctcccagttctccggacctagtgccgagcaaatgtgcaagacttattcagaattttgctcccgccacagtaaggccctcaagctgtacaaagagttgtatgctcgcgacaaacgttttcagcagttcatcaggaaggtaacaagaccagccgtgttgaaacgccacggggttcaggaatgcatactgttggtgactcaaaggattaccaagtaccctctgctcattagccggatcctgcagcactcccatggtattgaggaggagcgccaagacctgacaacggcacttggcctcgtgaaggaactattgtctaacgtggacgaagggatatatcaattggagaagggggctagattacaagagatttacaatcggatggatccccgcgcacagacaccagtgccaggtaaaggaccctttggtcgtgaggaattgcttagacgcaaattaatacacgacggatgcctcctatggaaaactgcgaccggtcggttcaaggatgtcctggtgcttcttatgactgatgtgttggtctttctccaggagaaggatcagaaatacatttttccaacgcttgataagccaagcgttgttagtctgcagaacctgatagtcagagatatcgccaaccaggaaaaaggaatgttcttgatctccgccgcccctcccgaaatgtacgaggtgcacacagcgagcagagatgatcgcagcacctggattcgtgtgatccagcagagcgtgaggacgtgtccttctcgggaagactttcccttgatcgaaacggaggatgaagcttacctccgccgaatcaaaatggaactacagcagaaagaccgagctctcgtggaactgctgagagaaaaggtcggcttgttcgcggaaatgacccacttccaggcagaagaagacggaggcagcgggatggctctgccaacactgcctcggggcctgtttcgctcagagtctctagaaagtccccgcggtgagcggctgttgcaggacgcaatcagagaggttgaaggcctgaaagatctcctagtggggcccggagtggagctcctgctaactccacgcgaaccagctctccctctcgaacccgatagcgggggtaatacctctccaggagtgaccgcaaacggagaagcaagaacattcaatggttccatcgagctgtgtcgggccgactccgactcatcacaaagggatcgcaatggcaaccagctcaggtctccacaggaggaagcgctccagagactcgtaaatctgtatggtctcctgcacggtcttcaggccgcggtggcccagcaggatacccttatggaggctaggttcccggaaggtcctgaacgcagggagaagctgtgccgtgccaattcccgtgatggggaagcaggccgcgctggggctgcacctgtggcacccgagaagcaggccactgagctggctctgctacagcgtcagcacgcgctgctgcaggaggagctacggagatgtaggaggctgggggaagagcgagctaccgaagcaggttccctggaagcccgtctcagagaatccgaacaagctagagctctgctcgagcgtgaagcagaggaagcaagaaggcagttggcagccctgggccagacagaacctctacccgctgaggctccctgggctcggagaccagtcgaccctcggagacgctctctgcccgctggtgacgcactgtatctcagctttaatcctccgcagcccagccgcgggaccgatcggctagacctccctgttactacccgatctgtgcaccgtaactttgaggatcgagaacgtcaggaactaggttcccccgaggagcggctccaggatagttccgatcccgataccggctccgaggaggaaggatcatccagactctcacctccccactcacctcgggattttactcggatgcaggatatccctgaggagactgaaagccgggatggcgaagcagtcgcatctgaaagctag

SEQ ID NO: 203416 - DNA, 2964 bp, Artificial Sequence
  Description of Artificial Sequence: Synthetic coding sequence
atgtgctgctgctgcggctgctgccccctgctggcccacctggagcagggaagcctgagggaacgaaccagggaaaaggagaaaatgaaggaagctaaggatgcgcggtataccaacggacatctgtttactacgattagcgtgagtggaatgaccatgtgctatgcatgcaataaatcaattacagctaaggaagctctgatatgtcccacctgtaacgtcaccatccataatagatgtaaagacactctagctaattgcacaaaagtgaaacagaagcagcagaaagcagctctgctgaagaataataccgctctccagagcgtgagtctgcggtcaaagaccacaattagagaacggcccagcagcgccatctacccatctgattctttcaggcagtctctgctcgggagccgtcgaggtcgctcctcactgtcactcgctaaatccgtaagtacgaccaacattgccgggcattttaatgacgagtccccactgggactgcgtcgaattctatctcagagcaccgactctctgaacatgagaaaccgtacgctcagcgtagagagccttatagacgaggctgaagttatttattccgagctgatgtctgacttcgagatggatgaaaaggactttgcagccgactcctggtctctggccgttgacagcagttttctacagcagcacaaaaaagaagtaatgaagcaacaagatgtgatatacgaattgatccaaacggagctgcaccacgtgcggacactgaagattatgacccgcttattcaggactgggatgctagaagaactgcacttggaaccgggggttgttcagggcctgttcccatgtgttgacgaactctccgatatccatacacgatttctctcccagcttttagagagacgacggcaagccctgtgccctggctcgacaagaaactttgtgatccaccgcttgggcgaccttcttataagccaattttcagggcccagtgctgagcagatgtgtaaaacctactctgagttttgcagtaggcactctaaagctttaaagctgtataaagagctgtacgcccgagataagcgattccagcagttcatcagaaaagtgacaagacctgctgtgcttaagcggcatggcgtacaagagtgtattttactcgttacacagcgaattaccaaataccctctactgatttccagaattttgcagcactctcacggtatcgaggaagaaagacaggacttgactactgccctcggcctcgtgaaggagctgctatccaatgtggatgaaggaatatatcagctcgagaaaggggcccggctccaagagatctacaatcgaatggacccccgggcccagacacctgtgcctggcaagggtccctttggcagagaagaattgctccgccgtaagctcatccatgatggctgtctactatggaagacggctacagggcggttcaaggacgtgttggtgctgctgatgaccgatgtgctcgtgttccttcaagagaaggaccagaagtatattttccctactctggataaaccttcagtggtctccctgcaaaatctcattgtgcgcgatatcgcaaatcaggaaaagggaatgtttctgatctctgctgccccgcctgaaatgtatgaagtacatactgctagccgggatgatcggtcaacttggatcagagtgattcagcagagtgtcagaacgtgcccaagccgcgaagatttccccctcatcgagactgaggacgaggcctacttaaggcggatcaagatggaactgcagcaaaaagatagagctctggttgagctgctccgggaaaaggtgggcttgttcgccgagatgacacacttccaagccgaggaggacggcgggtctggcatggccctgcccacacttcctcgcggcctgttcagatccgagtccctagaaagccccagaggcgagagactactgcaggacgccatcagggaggtggagggcctaaaggatttgcttgtcgggcccggggtggagctcctcctcactccccgggagcccgccctcccattggagcccgactcaggagggaatacaagcccgggtgtgacagcgaatggggaggcaagaacattcaatggctcaattgagctctgtcgcgccgactccgactcgagccaacgggaccggaatggcaaccagctaaggtctccacaggaggaggccctccaacggttagtaaatttgtatgggctgctgcatgggttacaggccgccgttgcccagcaagacacactgatggaagcccgctttcccgaaggacccgagcgaagagagaaactctgccgagcaaattctcgggatggagaggctggacgggctggcgccgcacccgtagcccctgagaagcaggccactgagttggcactcctgcagaggcagcatgctttgttgcaggaggagctgcgcaggtgtagacgactcggagaggagcgagccacagaagcgggcagcctggaagcaaggttgcgcgaatcggaacaggcacgggcccttctcgagagagaagcagaggaggcacgaagacagctggccgcactgggccagacggagcctctgccagccgaggctccctgggcccgcaggcccgtggaccctaggcgaagatccctgcccgctggagacgccctatacctaagtttcaatccgcctcagccaagcagggggactgaccgactcgacctgccagtgaccactcggtctgtccataggaactttgaagaccgggagcgccaggaactgggcagcccagaggaacggctgcaggacagcagtgaccccgatactggctctgaggaggagggctccagtcgcctgtctcctccacacagcccccgtgattttacaagaatgcaagatattccggaagagactgaatcacgcgatggggaagcagtagcgtctgaatcatag

SEQ ID NO: 203417 - DNA, 2877 bp, Artificial Sequence
  Description of Artificial Sequence: Synthetic coding sequence
atgaaggaggccaaggacgcccggtacaccaacggccacctgttcaccaccatttcagtgagcggtatgactatgtgctatgcatgtaataaaagcataactgcaaaagaggctttgatttgtcctacttgcaatgtcaccattcataatcggtgtaaggacacgctggcaaattgtaccaaggtgaagcagaagcaacagaaggcagctcttctgaagaacaataccgccctccagtcagtgtctctccggtctaagactacgatccgcgagcgcccaagcagcgctatttatccatctgatagttttaggcagagcctattggggagtcgtagaggtagaagctccctgtccctggcgaaatcagtctctaccacaaatattgctggccactttaacgatgagtcccctctgggattacggcggattctgtcccagtctaccgactcactgaacatgcgaaaccggactctgtctgttgaatcccttattgacgaagaggttatttacagcgaactcatgtcagactttgagatggatgagaaagattttgcggctgacagctggagtctggcagtggattcttcatttctgcagcagcacaagaaggaggtaatgaagcagcaagatgtcatatacgaacttatccagaccgaactccatcatgtgcgcactttgaaaatcatgaccaggctgtttaggaccggtatgctggaggaacttcacctagagccaggggttgtacaggggttgtttccctgtgtagacgagctgtctgatattcatacaagatttctcagccagctgctcgaacggagacggcaggctctgtgccctggatccactcgaaattttgtgatacaccgtctgggtgacctgttgattagccagttttctggccctagtgctgaacagatgtgtaagacctattctgagttttgcagccgacacagtaaagctctgaaactatataaggagctttatgctcgcgataagcgcttccaacaatttatcagaaaggtgacaaggcccgccgtgttgaagagacatggggtccaagagtgcatcctcctggtgacacagaggataactaaataccccctactgatcagtcggattctgcaacactcgcatggaatcgaagaggagcgacaagacctaaccaccgcgcttggccttgtgaaagagcttctctccaatgtagatgaaggtatttaccaattggagaagggcgcgcgactccaagagatttacaaccgcatggatcctcgggcccagactccagtgcccggaaaaggcccgttcggcagagaggagctccttaggaggaagctgatacacgatggctgcttgctctggaaaactgctaccggtaggttcaaggacgtgctggtgctgctgatgacagacgtactggtgttcttgcaagagaaggaccaaaagtatattttcccaaccctggacaaaccttctgtggtctccctgcaaaatctgatcgttagagacatcgccaatcaagagaagggtatgttcttaatttctgcggcccccccagagatgtacgaggtacataccgcatcccgagatgacagaagtacatggatacgtgtgatccagcaatcagttaggacatgcccgtctagggaggattttccactgatagagactgaggacgaagcttacctgcggcgcatcaaaatggagctgcagcaaaaagacagagcactggtggaactgctgagggagaaagtcggactgtttgcagagatgacccactttcaggcagaggaagatggtggttcgggcatggctcttcctacattgcctagggggctgttccgaagcgagtcattggaaagccccagaggcgagcgcttacttcaggacgcaattagggaagtggaggggctgaaggatcttcttgtcggccccggcgttgaacttttactcacgcctagggagccagccctgccactggaaccagactcaggtggaaacacatctccgggcgtgacggccaacggtgaagccaggacctttaatggcagcatagagctatgtcgggccgacagcgactcctcccagcgggataggaatggcaatcagctccgatctcctcaggaggaggccctgcagcgtcttgttaacctgtatggcctgttgcacggactccaagccgccgtcgcccagcaggatactcttatggaagcccggttccctgaaggacccgagagaagagaaaaactttgtagagctaactcacgcgacggagaggctggacgggccggcgccgcccccgtcgcccctgagaagcaagcgactgagctggccctgttgcagcgtcaacacgcccttctccaagaggaactgcgccgctgtaggcggctcggggaggagcgggccactgaagcgggttccctggaggctaggctgagggagtcagaacaggccagggctttactggaacgcgaagcggaggaggcgaggcgacagcttgccgccctaggccagactgagcccttacccgccgaagcgccgtgggcaagacgacctgtcgacccacgccggcgaagtctgcccgccggcgatgctctgtacttgagcttcaatccacctcagccttccagaggtacagaccgcctggacttgcctgtgacaacgagaagcgtgcaccggaactttgaagaccgcgaacggcaagaactgggatccccagaagagagactgcaggatagtagcgacccagacacaggtagtgaagaagagggcagctcaagactaagtcccccgcattccccaagagacttcacccggatgcaggatatacctgaagaaactgaaagtcgcgatggtgaggctgtggcttctgagagttag

SEQ ID NO: 203418 - DNA, 1548 bp, Artificial Sequence
  Description of Artificial Sequence: Synthetic coding sequence
atgctgagcaagagcgtgcccgtgagcggcatcaactgcctgctggatcgtagcgataccgatgggaacgtgtcccagagcagcgcgatcgacttgcgcaagcggtgtagccagttagagggccactcggggacgagagtagggtcctctctgcgtcagacattttcgttcctgagcggcatgaccggcaaagccaagactcgggaaaaagagaaaatgaaggaggcaaaagacgctcgttacaccaatggccacctgttcactaccataagcgtttccggcatgacaatgtgctatgcgtgcaataaatcaatcaccgcaaaggaggctctcatttgtccaacttgtaacgttacgatccacaatcgctgcaaggacaccctggccaactgcaccaaggtgaagcagaagcaacagaaggccgcactgcttaagaacaacaccgcactgcaaagcgtatctttacgctccaagaccaccatccgggaaagaccatcctccgcgatttatccgagtgattcctttcggcagagcctgctcggttctaggagaggacgcagtagcctgtccctcgcaaaaagtgtgagcaccaccaatatcgccggacatttcaatgatgagagtcctctcggccttaggaggattctgagccagagtaccgactctctgaacatgcgcaaccggacactcagcgtagaaagcttaatcgacgaggccgaggtgatctattctgagctgatgtccgatttcgaaatggatgaaaaagacttcgcagcagactcttggtctctggctgtggatagctcttttctgcagcagcacaaaaaagaggtgatgaaacagcaagatgtaatctatgagctgatccagaccgagctgcaccacgtccgcactcttaagataatgactaggctgtttcgaaccggcatgctcgaggaactacacctggagcccggcgtcgtgcaaggattgtttccctgtgtggatgagctatccgatattcatacccgatttctgtcacaacttctggagcgacgtcgacaggctctatgtcctgggagtaccagaaactttgtgatccaccggcttggggaccttctgatcagtcagtttagtgggccatccgccgaacagatgtgcaagacttattccgagttctgctcgcggcattcgaaggccctaaaactctataaggaactctatgctagagacaaacgctttcagcaattcataaggaaagtgactcggccagcggtcttaaagcgccacggcgtacaggaatgcatcctgctcgtgacccagcgaataactaaataccctctactaatcagcaggattctgcagcacagtcacggcatcgaagaagaacgacaggacctgaccactgctctgggcttggtgaaggaactcttaagcaacgtggatgagggaatctaccagttagagaaaggtgctcgccttcaggagatttacaacctccttctcttgttttcgctgagtccgagctttatggaggcactgggggacaatctggccagctggagctag

SEQ ID NO: 203419 - DNA, 1332 bp, Artificial Sequence
  Description of Artificial Sequence: Synthetic coding sequence
atgaaggaggccaaggacgcccggtacaccaacggccacctgttcacaacgatatccgtttccgggatgaccatgtgttatgcctgcaacaaatccatcactgccaaagaagcactgatctgtcctacttgcaacgtgacgatccacaacagatgtaaggatacgctggccaattgcactaaggtgaagcagaaacagcagaaggccgctcttctgaaaaacaatactgccttgcagtcagtgagcctgcgttcgaagaccactatcagagaaagaccctcctcagccatttacccgtctgacagcttcagacagtcgctgctggggagcagaaggggtcgaagtagcctcagtcttgcaaagagcgtaagtacgaccaatatcgccggacacttcaatgacgaatcacctctgggcctgcgccgaattttgagccagagcactgacagcctgaatatgaggaacagaacattaagcgtggaaagcttgatcgacgaagccgaggtgatttactctgagctgatgagtgatttcgagatggatgaaaaggacttcgcagcagatagctggtccctggccgttgacagttcctttctgcagcaacataagaaagaagtgatgaaacaacaggatgttatatatgagttaatacaaacagaactccaccatgttcgaacgcttaaaatcatgactcgactgttccgaaccgggatgctggaggagctgcatttagaaccgggcgtggtacagggactcttcccctgtgtagacgagctctcggacatccatacacgctttttgtcgcagctcttagagagaagaaggcaggcattgtgtcctggttcaactcgaaactttgtaatccaccgcctcggcgatctgctcatcagccagttctccggcccgtccgctgagcagatgtgtaaaacatattcagaattctgctctcgtcactccaaagcactgaaactgtataaggaactgtatgcccgcgataagcgtttccaacagtttattcgcaaggtcacacggccggccgtgctcaaacgacatggagttcaggagtgcatcttgttggtgactcaacggattactaaatatcccctcctcatcagcaggatactgcagcactcacacgggattgaagaggaacgccaggacctgactacagccctgggactggtcaaagaactgctgtctaacgtcgacgaaggcatataccaattggaaaagggggctaggcttcaggagatatacaatctgctgctcctgtttagcttaagtccaagcttcatggaggctttgggagacaatctggcttcctggtcttag

SEQ ID NO: 203420 - DNA, 4167 bp, Artificial Sequence
  Description of Artificial Sequence: Synthetic coding sequence
atgagccggcccccccccaccggcaagatgcccggcgcccccgagaccgcccctggggacggagccggggcgtcccgacagaggaaactcgaggctctcattagggacccccgttcccctattaacgtggagagcttgctggacggcctgaattcactggttcttgatttagactttcccgccctgcgcaagaacaaaaatattgataacttcctgaatagatacgaaaagattgtgaagaaaattcgtgggctgcagatgaaggccgaggattacgacgtggtgaaggtaatcggccgaggtgcatttggcgaggtccaactagtgagacacaaggcgagccagaaagtctatgccatgaagcttttgtctaagtttgagatgattaaacgatcagacagcgcctttttctgggaggagcgggacataatggcgttcgccaattccccgtgggtggtgcagctgttctacgcctttcaggacgataggtacctgtatatggtgatggagtatatgccagggggcgacctggttaatctgatgagcaactacgacgtccccgagaagtgggcaaagttttacaccgccgaagtagtgcttgcacttgatgctattcactcaatgggcctcattcaccgcgatgtgaagccggataacatgctgcttgataaacacggccacctcaagctcgcagattttggtacctgtatgaaaatggacgaaacgggaatggttcactgcgatacagctgtgggcactccggactacatcagccctgaggtcctcaagagtcagggaggtgacggcttctacgggcgcgagtgcgactggtggtcggtgggcgtgtttctgtatgaaatgctggtcggggatacgccattctacgcagatagcctcgttggcacatacagcaagatcatggaccataagaacagtctgtgcttcccggaggacgctgaaatttctaaacacgccaaaaacttgatttgcgcctttctgactgaccgcgaggtccgtttaggtcggaacggagtggaagagatcagacagcaccccttcttcaagaacgatcagtggcactgggacaatattcgggaaaccgcagcacccgtggtgccagagctctctagtgacatcgactcctcaaactttgatgatatcgaggacgacaagggtgatgtggagacgtttcccattcctaaggcatttgtcggaaaccagctgccattcattggcttcacttattaccgcgagaacctgctgctatccgacagcccttcatgccgggagaccgactccatccagtcccgtaaaaacgaggagagccaagaaattcagaaaaaattgtacacactcgaggaacatttgtctaatgagatgcaggcaaaagaggaattggagcagaaatgtaagagcgtgaatactagactggagaaaacagcaaaggaattggaagaggagattacattgagaaagtcagttgaaagtgccttgcgacagctggagcgcgaaaaagccctactgcagcacaaaaacgcagagtatcaacgcaaggccgaccacgaagcagacaagaagagaaacctggagaatgatgtgaatagtttgaaggaccagctggaggacctaaaaaagcgtaatcagaactcccagattagcactgaaaaggtgaaccagctgcagcggcagttagacgaaaccaacgccttgctcaggacggagtcagacaccgccgcaagactcagaaaaacccaggcagagtccagcaaacaaatacagcagttggaatctaacaatcgcgatctccaggacaagaactgcctgctggaaaccgccaagcttaagttggagaaggagtttatcaacctacagtccgcccttgagagtgaacggagggaccgaacccacggcagcgagattatcaacgacctccagggacgcatctgcggtcttgaagaggatctgaaaaatgggaaaattctgctggccaaggtcgagctggagaagcgacaactccaggaaaggtttactgacctggagaaagagaaatcaaacatggaaatcgatatgacgtatcagctcaaagttatccaacaaagcttggagcaggaagaggccgagcacaaagctaccaaggcacgactagcagataagaataagatctatgaatctatcgaagaggctaaaagtgaagcaatgaaggagatggagaaaaaactgctagaggagagaacccttaaacagaaggtcgaaaacttactgttagaggccgagaagaggtgcagtttgctcgactgcgacttgaagcagtctcagcaaaagattaacgaactgctgaagcagaaagacgttttgaacgaagatgtgcgcaacttaactcttaaaattgagcaggagacccagaaacggtgcctgacgcagaacgatctgaagatgcagacccagcaagtgaatacattaaagatgtccgaaaagcaactaaagcaagagaataaccacctaatggaaatgaaaatgaatctcgagaaacagaatgcggagctacgtaaagaaagacaggatgcagacggccagatgaaggagttacaggatcagctggaggctgaacagtatttttctacgttgtacaagacccaggtaagagagctgaaagaagagtgtgaggaaaagacgaagctgggaaaggagttgcagcagaagaagcaggagttacaggatgagcgggattcactggccgcacagttggagattactctcacaaaggctgattctgagcagcttgcccgctcgattgccgaggaacaatattcagacctggaaaaggaaaaaattatgaaagagttagagatcaaagagatgatggcccgccataaacaagagctgactgagaaggacgccaccatcgcatccctcgaggaaacaaaccggacgctaacctccgacgtcgctaatttagcgaacgaaaaggaggaactcaacaataagctgaaagatgtccaagaacaactcagccggctgaaggacgaggaaatttctgctgctgccatcaaggcacagtttgaaaagcagcttctcacggagcgaactctcaagactcaggccgtgaataaactggccgagatcatgaaccgtaaggaacctgtaaagcgcggtaacgacactgacgtacggcgaaaggagaaggagaaccgtaaacttcacatggagcttaaaagcgagagagagaaactgacccaacagatgattaagtaccagaaagagttaaacgagatgcaggctcagatcgcggaggaatctcaaattagaattgagctgcagatgacgctagactctaaggacagcgatattgaacagctgaggtcccagctacaggcactccatatcggcctggattcgagctccattgggagcggcccaggcgatgccgaggccgatgacgggtttccagagagtagattggagggctggttatcactgccagtgagaaacaacacaaagaaattcgggtgggtcaagaagtatgtgattgtaagttcgaagaagattttgttttacgacagtgaacaagacaaagaacagtccaatccttacatggtcctggacattgacaagctgttccacgtgagaccggtgacccagaccgatgtttatagggcggacgcaaaagaaatccccaggatatttcaaatactctacgcaaatgagggtgaaagtaagaaggaacaagagtttccagttgagccagtgggtgagaagagcaactatatttgccataaagggcacgagtttatcccaacactataccacttcccaaccaactgcgaagcctgcatgaaaccattgtggcatatgtttaagcccccccctgcgctggagtgccgccgatgccacatcaagtgtcataaggaccatatggacaaaaaagaggaaataatcgcaccctgtaaggtttactacgacatctctactgccaaaaacctgttgctgttagccaacagtaccgaggaacagcagaagtgggtgagccgcctcgtgaagaagataccgaaaaaacctccagccccggacccatttgctcgctcgagtcctcgcacatctatgaagattcagcagaaccaaagtatccggaggcctagccgacaattagcgcccaacaaaccgtcatag

SEQ ID NO: 203421 - DNA, 2241 bp, Artificial Sequence
  Description of Artificial Sequence: Synthetic coding sequence
atgatctacaaggtggagtgcggcctggaggaggacctgaagaacggaaagatcctacttgccaaggtggagctcgaaaaacggcaactccaagagcggttcacagatctggagaaggaaaaatctaacatggagattgacatgacataccagctgaaagtcatccagcaatccttggagcaagaggaagctgaacataaagcaacgaaagcacggctagcagataaaaacaagatttatgagagcatcgaagaagcaaagagcgaggcaatgaaagagatggaaaagaaactcctggaggagcgtaccctgaagcagaaggtagaaaatctgctgctggaggccgagaagagatgctctttgctggattgcgacttaaagcaatcacagcagaaaatcaacgagctccttaagcagaaagacgtgctgaacgaggacgtgcgaaacttgactctgaagattgagcaggaaactcagaagcgatgcctcacacagaatgacctcaagatgcagactcaacaggtgaacacactgaaaatgtccgaaaagcagctgaagcaggagaataatcacctaatggaaatgaagatgaacttggagaaacagaacgcagagctgcgcaaagagcgacaggatgcagatggccagatgaaagaactccaggaccagctagaggcagaacagtacttttccactctttacaaaacccaggtcagggaactcaaggaggaatgcgaggagaagacaaagctgggaaaagaactccagcagaagaaacaagagctccaggatgagcgagattcgctcgccgcccaacttgagattacattgaccaaggctgacagtgaacagctcgcaagatcaatagccgaggagcagtactccgatctggaaaaggagaagattatgaaagaactggagattaaagaaatgatggccagacacaagcaggagctcaccgagaaagacgccacaatagcctcccttgaagaaactaatcggacattgacttcagatgtcgcaaatctggccaacgagaaagaggagttaaacaacaagctcaaggacgtgcaggagcagctgtctagattaaaggacgaggagatcagcgctgcggcaattaaggcacagttcgaaaagcaacttctgaccgagcgaaccctaaaaacgcaggccgtgaacaaattagccgagatcatgaatcgtaaggagcccgttaagagagggaacgacacagacgtgcgacgaaaggaaaaggaaaaccggaagctgcacatggagctgaagtcagagagggaaaagctgacccagcaaatgatcaaatatcagaaggagttaaatgaaatgcaggcccagatcgccgaagagtctcagatcaggatagaactgcagatgactctggattccaaagatagcgatattgagcaactgcggagccagttgcaggcactgcacatcggtttggattctagttctatagggagcggcccgggcgacgctgaggctgatgatggattccctgagtccagactggaggggtggctgtctttacccgtaaggaataatacaaaaaaattcggttgggtgaagaaatatgtgatcgtgagttcaaaaaaaatcctattttacgactccgaacaggacaaagaacagagtaacccgtacatggttctcgacatcgataagctatttcacgtgcgccccgtcactcagacagatgtgtatagagcagacgctaaggaaatacccaggatttttcagatcctgtacgcaaacgagggggagtcaaaaaaggaacaggagttccctgtagagcccgtgggagaaaagagtaactacatctgtcataagggccatgagttcattccgactttgtatcactttcctactaattgtgaggcatgcatgaagccgctgtggcacatgtttaaacctccacctgcgctcgaatgccgccgatgccacatcaaatgccataaagaccatatggacaaaaaagaggagatcatcgccccatgcaaagtctactatgacatctccactgccaagaacctcctgctccttgccaactctaccgaggaacagcaaaagtgggtcagccggctggtgaagaaaattccaaagaaacctccggcccctgacccgttcgctcgttcctcacctcgaacctccatgaagattcagcaaaaccaaagcatccgcaggcctagccgccagctcgccccaaataaaccttcctag

SEQ ID NO: 203422 - DNA, 3438 bp, Artificial Sequence
  Description of Artificial Sequence: Synthetic coding sequence
atggtgcactgcgacaccgccgtgggcacccccgactacatcagcccggaagtgctcaaatcccaagggggcgacggcttctatggtagggagtgcgactggtggtctgttggagtctttctgtacgagatgttggtcggagacactccattctatgcggactctcttgttggaacctatagtaagatcatggaccacaagaactccctctgctttcctgaggacgcagagatctctaaacacgctaagaacctcatttgtgccttcctgaccgaccgggaggtgcggctcggccgtaacggcgtcgaggagatccgacaacatccattctttaaaaatgaccagtggcattgggacaacatccgagaaaccgcggcccccgtggtaccggaactgagctctgatattgatagcagtaacttcgacgatattgaggatgataagggtgacgtcgagacgtttcccatacctaaggcatttgtaggcaatcagctccctttcatagggtttacctattatagagaaaacctcctgctctcggattccccaagctgccgagagaccgattccattcagtccaggaagaatgaggaatcccaggaaatccagaagaaactctataccttagaagaacatttgagcaatgaaatgcaggctaaagaggagctggaacagaagtgtaaatcagtcaatacacgtttggaaaagactgctaaggaactcgaagaagaaataacccttaggaaatcggtcgagtccgctctgcgtcagctggaacgcgagaaggctctactgcagcataaaaacgccgaatatcagcgtaaagcagaccatgaggccgacaagaagagaaacctggagaacgacgttaactcccttaaggatcagcttgaggatctcaaaaagagaaaccaaaatagtcagataagcacagagaaggtcaatcagctgcagcgacaactagatgagactaatgctttattgcgtaccgaatccgacactgcagctaggcttaggaaaactcaagctgaatcctcaaagcagatccaacaacttgaatcaaataatcgagacctgcaggataagaattgcttactggagactgccaaactcaaactagagaaggagttcattaatctacagagtgcattggaatcagagcgaagagatcgaacacacggaagcgagataatcaatgatttacaggggcggatctgcggtctggaagaggatctgaaaaacggtaagatactgctcgcgaaggtagagttggaaaaacgccagctgcaagaaagattcaccgacttggaaaaggaaaaaagtaacatggaaattgacatgacttatcaactgaaagtaatccagcagagtcttgaacaggaggaggctgagcataaagctacgaaagcccgattagcggataagaataagatctacgaatccatagaagaggctaaatctgaggcaatgaaggaaatggagaagaagcttctagaggagaggaccttgaagcagaaggttgagaatctgctgctagaagccgagaaaagatgttccctcctggattgtgacttgaagcagtctcagcagaaaatcaatgaactgctgaagcagaaagatgtgctgaatgaggatgttaggaacctaaccctgaagatcgaacaggagacccagaagcgatgtctaacacagaatgacctgaagatgcagacacaacaggtgaatacgctgaagatgagtgagaagcaactgaagcaggaaaacaatcatttaatggagatgaaaatgaatctcgagaaacaaaatgcagaactgcgtaaagagagacaggatgctgacggacagatgaaggaactgcaagaccaacttgaagctgagcagtactttagtaccttatacaaaacacaagttagagaactgaaggaagaatgtgaagaaaaaacaaaattgggaaaagagctgcagcagaagaagcaggaactacaggatgagcgggatagcctggccgcacagctggagatcaccctgacaaaggcggattccgaacagcttgcacgaagtatcgccgaggaacagtattccgatctggaaaaggagaagatcatgaaagaactggaaattaaagagatgatggctagacacaagcaagaactaacggagaaagacgctacaatcgctagtctagaggaaaccaatcgcacactgacatccgatgtagcaaacctggccaatgagaaagaagagttgaacaataagcttaaagatgtgcaggagcagttatcaaggttgaaggatgaagaaatttctgcagctgcaataaaggcacagttcgagaagcagctgctcactgaacgcaccttgaaaacacaggcagttaataagcttgctgaaattatgaaccgtaaggagccggtgaagcgcggtaacgatacagacgtgaggagaaaggaaaaggagaatcgaaaactgcacatggagttgaagagtgagcgggaaaagcttacacagcagatgatcaaataccaaaaggagttaaatgagatgcaggcccagatcgccgaggagagtcagatccgaatcgaactgcagatgactttggacagcaaggactctgacattgagcaactcaggagtcaactccaagcattgcacatagggctggacagctccagtattggcagcggaccgggtgacgcagaagctgacgacggattcccggaatccagactggagggctggctttccctgccggtccgcaataatacaaaaaaatttggctgggtcaagaaatacgtgattgtgagctccaaaaaaattcttttctacgacagcgaacaggataaggagcagtccaatccttatatggtgttggatatagacaaattgtttcatgtaaggccggtcacccagactgacgtttatcgagcggatgccaaggagatcccccgaatatttcagattctgtacgcgaacgagggggaatcaaagaaggagcaggagtttcctgtggaacccgttggagagaagagtaattatatatgccataaagggcatgagttcatccctacactgtatcacttcccaacgaactgtgaggcttgcatgaagcccttatggcatatgtttaaaccgccccctgcactggagtgcaggcggtgtcacatcaaatgtcacaaggaccacatggataaaaaggaagaaatcattgctccatgcaaggtgtattatgacatttctacagctaagaacctgctcttgctcgccaactccacggaggagcagcagaagtgggtatccaggttggtgaagaagatcccgaagaagccaccagcacccgatccattcgcccgatccagtcccagaacatcaatgaaaatccaacagaatcagagcataagaagacccagcaggcaactggctcccaacaaaccatcatag

SEQ ID NO: 203423 - DNA, 2568 bp, Artificial Sequence
  Description of Artificial Sequence: Synthetic coding sequence
atgagcgaggcccggcgggacagcaccagcagcctgcagcggaagaaacctccttggctgaagctagacatcccctctgctgtccccctgactgccgaggaaccatcttttctccagcctctgaggcgtcaggctttcctgcgcagtgtatccatgcctgctgagacagcccacatcagttctccccaccacgaactgcggcggcccgtgctgcagcgacagaccagtatcactcagaccatcaggaggggaaccgctgattggtttggcgtgtcaaaagacagcgacagtacccagaaatggcagagaaagtccatcaggcactgttctcaacggtacgggaaactgaaaccacaggtgctgagggagctggacttgccgtcccaggataatgtctcgctcacttcaacggagacacctccccctttgtatgtggggccttgccaactcggcatgcagaagattattgatcctctagcaagaggtcgcgccttcagggtcgccgacgatacagctgaggggctcagtgcgccccatacgccagttacacctggcgccgcaagcctctgttcattttctagctccagatccggtttccatcggctgccaaggcgcagaaagagagagagtgtcgctaagatgtcatttagggctgctgccgcactaatgaaaggcaggtccgtgcgagatgggacctttcggcgggctcagcgtcgatccttcactcccgcatctttcctggaggaggataccacagattttcctgatgagctcgacacctcgttcttcgctcgcgaaggaatactgcatgaagagctcagcacataccctgacgaagtgtttgagtctccttcagaagccgcattgaaagactgggaaaaagcccctgaacaggccgaccttaccggtggtgcactggatagatctgagttagagcgtagccatctgatgcttccacttgagagggggtggcgaaagcaaaaagaaggcgcagctgccccccagccaaaggtgagactaagacaggaagtggtgagtacagcagggcccaggcgtggacaaagaattgccgtaccggtgcgcaagctgttcgcaagggagaagcgaccctacggactaggcatggttgggaggctgaccaataggacttatcgcaagagaatcgactctttcgtgaagaggcaaatcgaggacatggacgaccatagaccttttttcacctactggttgacattcgttcactcgcttgtaacgattctggccgtttgcatctatggaatcgcaccagtgggcttttcgcagcatgaaacagtcgacagcgtgctgagaaaccgaggagtgtacgagaacgtgaagtatgtccaacaggaaaatttctggattggtccgagttctgaggcgctgattcatctcggggccaagttttctccctgtatgcgtcaggatccgcaggtccactcatttatcaggagcgcacgggaaagggagaaacactctgcatgctgtgtcaggaatgacagatctggctgtgtgcaaaccagtgaggaagagtgttcctcgacgttagctgtctgggtgaaatggcctatccaccccagcgccccggaacttgctggccacaaacgtcagttcggctcggtgtgccaccaggacccgcgcgtttgcgatgagccttcctccgaagatccacatgagtggcccgaggacatcacaaagtggcctatttgcacaaagaatagcgccggaaatcataccaaccacccacatatggattgcgtgatcaccggccgaccatgctgcatcggcactaaagggagatgcgagatcacctcccgtgaatattgtgatttcatgcgcggctatttccacgaggaggccaccctctgttctcaggtccattgtatggacgacgtttgtggcctgctgccctttcttaacccagaggttccggaccaattttaccgtctgtggctttcattgttcctgcatgccggaatcttgcattgccttgtcagtatctgtttccaaatgacagtactgagggaccttgagaagctggctgggtggcaccggattgccattatttatctcctgtctggtgtcaccggaaatcttgcgagcgccatttttctgccctacagggctgaagtgggtccggccggatcacagtttggcatcttggcgtgcctgtttgtagagctgtttcaatcctggcagatcctcgctaggccatggagagccttctttaaacttctggctgtggtgctgtttctattcacctttgggctcttgccatggatcgacaactttgcccatatctctggctttatttctggattatttctttctttcgctttcctgccttacatctctttcgggaaatttgacctttaccgaaagcggtgccagatcattatcttccaagtggtgttcctggggcttttagccgggttggtggttctgttttatgtttaccctgtgagatgcgagtggtgcgaattcctgacttgtatcccattcaccgacaaattttgtgagaagtatgaattggatgcacaactgcattag

SEQ ID NO: 203424 - DNA, 573 bp, Artificial Sequence
  Description of Artificial Sequence: Synthetic coding sequence
atgagcgaggcccggcgggacagcaccagcagcctgcagcggaagaagcctccctggctcaagctggatatacctagtgcagttcccctcaccgcagaggagccctcctttctgcagcccctgaggcgccaggcctttctccgatctgtctccatgccagccgaaaccgcccacatctcctcaccacaccacgagctgcgcaggccagtgttacagagacagacatctatcacacagacaatacgctcatctcgtcaggtccgcttcggtagagtgcacaccttgccactcttgggcccacgggccgcgaggagagccttcccccagcggcagagtttgagctggtctctgctgcggggaactgctgattggtttggcgtctcgaaagattcagatagtacacagaagtggcaacgcaagtccattcgtcattgctcccagaggtacggaaaactcaagccccaggtgttacgggaactggatttacccagccaggataacgtgtctcttacaagtaccgagactcctccccctttatacgtcgggccctgccagctcggtatgcaaaaatag

SEQ ID NO: 203425 - DNA, 699 bp, Artificial Sequence
  Description of Artificial Sequence: Synthetic coding sequence
tgacggccctgctgcatcggcaccaagggccggtgcgagatcacctcacgcgaatactgtgacttcatgcgcgggtatttccacgaagaggcaaccctctgttcccaggtgcactgtatggatgatgtctgcgggttgctgccttttctgaaccctgagatgaccgtgttacgcgatctggaaaagctggccggctggcacagaattgccatcatctatcttctgagtggggtgactggtaatttggcttccgcgatattcttgccctaccgtgccgaagtaggccccgctgggtcgcaattcggcatactggcctgcctgtttgtggagctgtttcagtcatggcagatcctggcacggccatggagagcattctttaagctgctggcagtggtgctgtttcttttcacattcggactgttgccgtggatcgacaattttgcccacatatctgggtttatcagcggtctgtttctctcatttgcgttcctgccctatatttcctttggcaaatttgacctctatagaaaacgctgtcagatcatcatctttcaggtagtcttcctgggactgctggctggtctcgtcgttctgttttatgtgtatccagtgaggtgtgagtggtgcgaatttctcacttgtattccctttaccgataaattctgtgaaaagtacgaactggacgctcagctgcattag

SEQ ID NO: 203426 - DNA, 492 bp, Artificial Sequence
  Description of Artificial Sequence: Synthetic coding sequence
atgagcgaggcccggcgggacagcaccagcagcctgcagcggaagaagcctccctggctgaagttggatatccccagtgccgtccccctcacagctgaggaaccttccttcctccagccactcaggcggcaggcattcctgaggtcggtctccatgccagcagaaaccgcccacattagcagcccccaccatgaactgcggagacctgtgctgcagaggcaaacgagtatcacccagaccattcgcaggggaaccgctgactggttcggtgtgtctaaggactctgacagcacacagaaatggcagcgcaagagcattagacattgctcgcaacggtacgggaagctaaagccacaagtgctgagggagctggacctgccatcccaggataacgtctctctgacttctaccgaaactccccctccactgtacgtcggcccatgtcagctcggtatgcagaaaattattgatcccctcgcccgcgggcggtag

SEQ ID NO: 203427 - DNA, 1740 bp, Artificial Sequence
  Description of Artificial Sequence: Synthetic coding sequence
atgagcgaggcccggcgggacagcaccagcagcctgcagcggaagaagcccccttggcttaaattagacataccatcagcagttcccctgacggctgaggagccgagctttctccagcctctgcgaagacaggcttttctcagaagcgtatccatgcccgcggaaacagctcacatttcatcaccacaccacgagctaagacgccctgtactgcaaagacagacgagcattacacagacgatccggcggggcaccgcagattggttcggggtgtccaaagactccgatagcacacagaagtggcagcgcaagtccatacgccactgctcgcaacggtatggaaagctgaagccacaggtcctgcgcgagctcgatttgcctagtcaagataacgtaagtctcacctccaccgagaccccgccccccttatatgttggaccctgccagctaggcatgcagaaaatcatagatccactggctcgtggaagggcctttagggtagccgatgacactgcggagggtcttagcgcccctcacacacctgtcacgcccggtgcagcaagcctgtgcagcttttccagctctagatccggcttccaccgcttacctcggcgacgcaagcgcgagagcgtcgcgaagatgagtttcagggctgccgctgctcttatgaaggggagaagcgtccgggacgggacatttaggcgggcacagaggagatctttcacccccgcttcctttctggaagaggacacgacggacttccccgatgagttggacacttctttttttgctagagagggaattctgcatgaagaactgtccacgtaccctgatgaagtcttcgagtcacccagtgaggccgccttgaaggattgggagaaagcacccgaacaggctgatctgaccggcggcgctctggatcggtccgaattagaaaggagtcatcttatgctgcctctcgaacgcggctggagaaaacagaaggaaggcgctgctgcccctcagcccaaagtgagactgaggcaagaggttgtgtccactgctggccctaggcggggtcagcgaattgcagtgcccgttagaaagttgttcgctcgcgaaaaacgaccgtacgggttaggcatggtcggaaggctcactaaccgtacttatcggaaaagaatcgattctttcgtgaaacgtcagattgaagacatggatgatcataggcccttcttcacatattggctgacctttgtccactcgctggtcaccatccttgccgtatgcatttatggcatcgctcccgtcggcttttcgcaacatgagaccgtggactccgtcctgaggaatcgcggcgtctacgagaatgtgaagtacgtgcaacaggagaatttctggatcggtcctagctcagtgaggaccggccttggagctgggccagccggggcaggtccggggggggcacgccgtgggcaggaggcgccagactgcgggcgcagtagccccagtcctgcaggtggcccccaccccccaggtcgtcaggtctttgcccttcacgcaccggggccggctggagctcagctgcactcacttggcgccagggccagagaggcactgcgccttctccgggctcagcgccaggtgggcctcagggctgacctgggcggaggggtattaggggctttccctaggccaggacttcccccgtcttctgcccggtgtagcctttttcgaccccagattgattccgccgaatag

SEQ ID NO: 203428 - DNA, 2571 bp, Artificial Sequence
  Description of Artificial Sequence: Synthetic coding sequence
atggccagcgccgacaagaacggcggcagcgtgagcagcgtgagctcttcacgactccagtcaaggaaaccaccaaatctctcaataaccatcccaccacccgagaaggaaactcaggcacctggcgaacaagactccatgttgcccgaaggatttcagaaccggcgcctaaagaaatctcagccccgtacatgggcagcccacacaacagcttgtcctcccagcttcctgccgaaaagaaaaaatcccgcctatctgaaaagcgtgtccctccaagaacctcggagcaggtggcaagagagctccgaaaaacggccaggtttccgccgacaggccagccttagtcagtccatcagaaaaggagcagctcaatggtttggtgtatccggggactgggagggacagcggcaacagtggcagagacgtagcctacaccattgctctatgcgttacgggcgcctcaaggcaagctgtcaacgagacctggaactgcccagtcaggaagcgccatccttccaagggacagaaagccccaagccttgtaagatgccaaagattgtggatcccctggctcggggacgcgcatttcgccaccctgaagagatggatcggcctcacgccccacatccgccactaacaccaggggtgctctccttgacctccttcacgtccgtgagaagcggttacagtcatctgccacgccgcaagaggatgtcggtcgctcatatgtccctgcaggccgcggcggccctgctgaaaggccgaagtgtgctggatgctaccggccagcgctgccgcgtcgtgaaacgcagctttgcctttccgtccttcctggaagaagacgtggttgacggcgctgatactttcgatagctcctttttctccaaagaagaaatgtctagtatgccagacgacgtgtttgagtcacctcctctgagcgcctcctactttcgaggcattccacattccgcttctcctgtctcccctgacggagttcagatcccgctgaaggaatacgggcgcgcccctgtgcctgggcctagaagaggcaaacgtatcgctagcaaggtgaaacattttgctttcgacagaaagaagcgtcattacgggctcggagtcgttggcaactggttgaacaggtcgtaccggagatccatttcctctactgtgcagcggcagctggagtcctttgattctcaccgtccatacttcacttattggctcactttcgttcacgtaatcattacacttctggtaatttgcacatatggtatagctcccgtgggattcgcacagcacgtgacaacccaactcgttctccgaaataagggagtgtacgaatccgtgaaatatattcaacaagagaatttctgggtgggtcccagcagtatagatctcatccatctcggggcaaagtttagtccatgtattcggaaggacggccagatcgagcagctcgtgttaagagagcgcgatctggagcgcgatagtggttgctgtgtacagaatgatcacagcgggtgcattcagactcagcgtaaggattgctcagagaccttggccaccttcgtaaagtggcaggacgacactgggccccccatggacaagtctgacctaggccagaagagaacttcaggcgccgtctgtcaccaggatccgcgtacttgcgaggaacctgccagtagcggggctcacatctggccggacgatatcaccaagtggcctatctgcaccgagcaggccaggtccaaccatacgggcttcctgcacatggactgtgagatcaaaggtcgtccctgctgtatcggaacaaagggctcttgcgagattacaacccgcgagtactgtgaatttatgcacggatattttcatgaagaagctacgctctgctcccaggtgcactgtttggacaaggtatgcgggctgctgccattcctgaatccagaggtgcccgaccaattttaccggctgtggttaagtctgttcctccacgctggtgtcgttcattgcctggtgagcgtcgtcttccaaatgactattctccgcgatctggaaaaacttgccggctggcataggattgccataatttttatcctttccggcatcactggtaacctcgcttctgccatctttctcccttatcgtgctgaggttggcccagcaggctcccagtttgggctgctcgcctgtctcttcgttgagttattccagagctggcccctgctcgaaaggccttggaaggcttttcttaacctgagcgcaatcgtattatttctgtttatctgcgggctactgccatggattgataacatcgcccacattttcggatttctatccgggctcctcttagcttttgccttcctgccttatataaccttcggaaccagcgacaagtaccggaaaagggctctaatccttgtgtccttgctggcgtttgcaggactgtttgcagccctggtgctgtggctctacatctaccctattaactggccatggatcgaacatttgacttgttttccttttacctcacgattctgcgaaaaatacgagctcgaccaggtgctgcattag

SEQ ID NO: 203429 - DNA, 2484 bp, Artificial Sequence
  Description of Artificial Sequence: Synthetic coding sequence
atggccagcgccgacaagaacggcggcagcgtgagcagcgtgagcagttcacgcctgcaaagtaggaagccgcccaacctgtccatcaccattcccccccccgaaaaagaaactcaggcccctggagaacaagatagtatgctgcctgagcggaagaatcccgcctacctaaaaagtgtttcactccaggagccacggagcaggtggcaggagtccagcgagaaaagacccggctttcgacgacaggctagcctgtcacagagtatcagaaagggagcagcacagtggtttggagtgagtggtgactgggaaggacagcgccagcagtggcagcggcggtcgctccatcattgttcgatgaggtacgggcgcctgaaagcttcctgccagcgggatctggaactcccctcacaggaggctccctccttccaggggacagagtcgccgaagccctgcaagatgccaaaaattgtggacccacttgctagagggcgcgctttcaggcaccctgaggaaatggatagaccccacgcacctcatccccctctcacccctggcgtgctgtcattaaccagctttactagcgtgaggagcggatatagccatctgccacgacgcaaacgcatgtccgtggcccatatgtccctgcaggctgctgccgctctgctcaaaggacggagtgtcctggacgccaccggtcagcggtgccgagtggttaaacgctccttcgctttccccagctttcttgaggaggatgttgttgatggtgcggatacttttgacagctctttcttttctaaggaggaaatgagctccatgccagacgatgtctttgagagtcccccattgtccgcgagttattttagagggattccccactctgcttcaccggtttcccctgatggagtccagattcccttaaaagaatatgggagagcacctgttccaggccccagaaggggcaaacggatagcttccaaggtaaagcactttgcgtttgatcgcaagaagaggcattatgggctcggcgtagtcggaaactggctgaacagatcctatcgccggtcaatatcttccactgtccagcgacagctcgagagctttgattcacacaggccatatttcacgtactggttgacattcgtccacgtaattatcacgttgctggtgatttgtacatatggaatcgctccagtgggattcgcccagcatgtgaccactcagctggtgctccgcaacaagggagtttacgagagtgtgaaatacatacagcaagagaatttctgggttggtccgagcagcatcgacctgatacacctgggtgctaaatttagcccctgtattcggaaagacggacaaatcgaacagcttgtactgagggagcgggacttagagagggactccggctgctgtgtccagaacgaccacagcggatgcatccagacacaaaggaaggattgcagcgagacactggcaaccttcgttaagtggcaggatgatacaggaccccccatggacaaatcagatctggggcagaaacggacttcaggtgcagtttgtcatcaggatcccagaacctgcgaggagcccgcatcatcgggcgcccacatttggccagacgacatcacaaaatggccaatctgtacagaacaggcgcgatcaaatcacacaggctttctgcacatggattgtgagatcaaaggtcgtccttgctgcatcgggactaaaggctcctgtgagattaccacccgcgagtattgtgagtttatgcacggatacttccatgaggaggcaacactgtgctcccaagtccattgcttggataaagtgtgtgggttgctgcctttcttgaatccagaagtacccgaccaattctatagactgtggctctctttgttccttcacgccggcgtcgtgcattgcctggtctcagtggtctttcagatgacaatcttgagggacttggagaaattggccggctggcacagaattgccataattttcattctgtccgggataacgggtaacctggcctcagcaatatttctgccttaccgggccgaagtgggccccgccgggagtcaatttggtttgctggcctgcctgtttgtggagctttttcaaagctggccactgcttgagagaccatggaaagcttttctgaatctgagtgccattgtgttgttcttatttatctgcggattgctcccttggattgataatatcgcccatatctttgggttcctatccggccttttgcttgcgttcgccttcttgccatacattacattcggcacttccgacaagtataggaaacgtgcccttattttagtgtcactgctggcatttgctggcctcttcgccgcattggtgttgtggctatacatctatcccatcaattggccctggatcgagcacctgacgtgtttccctttcaccagccgcttttgtgagaagtacgagttagatcaggtgctgcactag

SEQ ID NO: 203430 - DNA, 2151 bp, Artificial Sequence
  Description of Artificial Sequence: Synthetic coding sequence
cccggcagcagccggagccggcaccccctgctgctgctgatctggtccctggggtccagccagggccctcaccgccagattcgaccgccgcctccctgtaggcacgctggtacacatgtgccctctcccctgccccatacacaggtccatagaaggaggcaggcctatgcccatttatcattggtctgcttccgccgaggtgctgcccagtggtttggggtgtcaggagattgggagggccagcgtcagcagtggcagaggaggtctctccatcattgcagcatgaggtatgggcgcctaaaagcttcttgtcagcgggacctggaactgccatctcaggaggcaccatcctttcagggtactgaaagccccaagccatgcaagatgcctaagattgtcgatcccctggcccgcggcagggcctttagacatcccgaagaaatggatcggccgcatgctccacatccccctctgacccccggcgtgctctccctcacttcgtttactagtgttagatctggctatagccacctaccacggcgtaagcgcatgtccgttgcgcacatgagtctccaggctgccgctgctctgttgaaggggaggagcgtattagatgcaaccggccagcgctgcagggtagtaaagaggtcctttgcctttccatccttcctcgaagaggatgttgtagatggcgccgatacctttgattctagcttctttagtaaggaggagatgtcctcaatgccagacgacgtgtttgaatctccacccctgtcggcttcgtactttcgaggcattccgcattccgcttcccccgtttcacccgacggagtacagattcctctgaaggagtacggacgggctcccgtcccaggtcctaggaggggaaagcggattgccagcaaggtcaaacatttcgccttcgaccgaaagaagcgtcattacggtctgggcgtggtgggtaactggctaaatcgaagttacaggcggagcattagttcaaccgtccaacggcagcttgaatcatttgattcacataggccttatttcacctactggctgacatttgtccacgtgatcattaccctcctggtaatctgcacgtacgggatcgcgcctgtggggttcgcccagcacgtaaccactcagcttgtactacggaataagggcgtgtacgaatccgtgaaatacatccagcaggagaacttttgggtgggtccttccagtattgatctcatccacttgggggctaaattctcaccgtgcattagaaaagatggccaaatagaacaactggttctgagagaacgtgatttagagcgagactctggatgctgcgtccaaaatgatcacagcgggtgtatacagacccaaagaaaggactgcagtgaaacccttgcgaccttcgttaaatggcaggacgatacggggccgcccatggataagtcagacttaggacaaaaaagaacatccggtgccgtatgtcaccaagaccctcgcacttgcgaagagccagcctcatctggcgctcacatatggcccgacgatatcacgaagtggcctatttgcaccgagcaggctcgctccaatcacaccggctttctccatatggattgcgagatcaaagggcgcccttgttgtattggaacaaaggggtcctgcgagatcactacacgagaatactgcgagtttatgcacggctattttcacgaggaggcaacgctgtgctctcaagtgcactgcttagacaaggtttgcggcctcctaccctttctgaatcccgaagttcccgatcagttttatcgcctctggttgagtctcttccttcacgcgggagtggttcattgccttgtgagtgtcgtgtttcagatgacaatccttcgcgacctggagaagctcgccggctggcatcgtatagccataattttcatcttgtctgggataactggcaacttggcctctgccatttttctaccttaccgagctgaggtgagaatgtggaggatgggtccgctgcctcacattggtggacagccctgctgctcttatagcactcacttggggagcgcacggggcactcgctgtccctcatgtaccgggcttcacagtgggggaaccgccaacctcggagcctactggctcgtaagctag

SEQ ID NO: 203431 - DNA, 639 bp, Artificial Sequence
  Description of Artificial Sequence: Synthetic coding sequence
atggcccagaccgacaagcccacctgcatcccccccgagctgcccaaaatgttgaaagaattcgctaaggccgcaattagagtccaaccccaggatctcatacagtgggccgccgattacttcgaggcactgtcaagaggcgagacgcctcccgtgagagagcgctcagagcgagtagccctgtgtaatagagctgaactgacaccagaacttcttaagattctgcactcacaagttgcaggtcgcctgatcatcagggccgaggagctcgcacagatgtggaaagtcgttaatctgcccacagatctgttcaattccgtcatgaacgtcggaagattcacggaagaaatcgagtggctaaagtttcttgcattagcatgttccgcgctcggcgttacaataacgaaaacgcttaagatcgtttgcgaggtcctgagctgcgatcacaacggcggttccccaagaataccgttttccacctttcagtttctgtatacctacatcgctaaggtcgacggggagatctctgcctcacacgtcagtagaatgctaaactacatggaacaggaagtgattggaccggacggcattatcacagtcaacgacttcacgcagaatcctcgcgtgcagttggaatag

SEQ ID NO: 203432 - DNA, 639 bp, Artificial Sequence
  Description of Artificial Sequence: Synthetic coding sequence
atggcccagaccgacaagcccacctgcatcccccccgagctgcccaagatgcttaaggagtttgctaaagctgccatccgcgtccagccacaggatctgatacagtgggctgccgactattttgaagccttatccagaggagagacccccccggtgcgtgagaggtctgaaagggtagctttatgcaaccgtgctgaactgactcctgaactacttaaaatccttcactcccaggtggccgggaggctgattattcgcgccgaagaactagcacagatgtggaaggtggtcaatctccccactgatctcttcaacagcgtcatgaatgtcggtcggttcacagaagaaattgaatggctgaagttcctggctctggcatgttctgccttgggagtcaccatcaccaaaacactgaaaatcgtttgcgaggtgcttagctgtgatcataacggggggagtccccgcatccctttcagtacattccaattcctttatacttacattgcaaaggtggatggggaaatcagcgccagtcacgtgtcacgcatgctgaattacatggagcaggaggttatcggaccagacgggattatcacggtcaacgattttacccaaaacccccgagtgcagcttgagtag

SEQ ID NO: 203433 - DNA, 351 bp, Artificial Sequence
  Description of Artificial Sequence: Synthetic coding sequence
atggcccagaccgacaagcccacctgcatcccccccgagctgcccaaaatgctgaaggagtttgccaaggccgctatccgagtgcagccacaggacctcattcagtgggccgcggactattttgaagctctttctcgaggagaaaccccccctgtgcgtgaaaggagcgagagggtggcattatgcaacagagccgagcttacaccggagttattgaaaattctgcacagtcaagtggcgggacgcctaattattagagccgaggagctggcgcagatgtggaaggtggttaatctgccaacagacctgttcaactcagtgatgaacgtcgggcgcttcaccgaggaatag

SEQ ID NO: 203434 - DNA, 393 bp, Artificial Sequence
  Description of Artificial Sequence: Synthetic coding sequence
atggcccagaccgacaagcccacctgcatcccccccgagctgcccaagatgttaaaagagtttgccaaggccgccataagggtgcagccacaggacctgattcaatgggcagcggactacttcgaagcgctcagcaggggcgaaacacctcccgtgcgcgagcgttccgagagagtggccctgtgcaatcgagcagaactcacgccagagcttctcaagattctccactcccaagtcgccgggagattgatcataagagccgaagaactggcccaaatgtggaaggtggttaacctgccaaccgacctgtttaactccgtcatgaacgtggggcggttcaccgaggagatcgagtggctcaagttcctagcactggcatgtagcgccctctag

SEQ ID NO: 203435 - DNA, 312 bp, Artificial Sequence
  Description of Artificial Sequence: Synthetic coding sequence
atggcccagaccgacaagcccacctgcatcccccccgagctgcccaagatgttgaaagagtttgcgaaagcagctatcagggtacagccccaagaccttatccagtgggcagcagattactttgaggctctgagcaggggcgagacgcccccagtgcgggaacgctctgagcgtgtagcactttgtaacagagccgagctgacacccgagctcttgaaaatcctccactcccaagtcgcaggaagactgatcatccgggccgaagaactagcacagatgtggaaggtggttaatctaccaactgacctgtag

SEQ ID NO: 203436 - DNA, 234 bp, Artificial Sequence
  Description of Artificial Sequence: Synthetic coding sequence
atggcccagaccgacaagcccacctgcatcccccccgagctgcccaaaatgctgaaggaattcgccaaggctgccattcgggtccaacctcaggacctcatacaatgggctgcggattacttcgaagccctgtcccgaggggagaccccacccgtccgggaacggtctgagcgggtggccctgtgcaaccgcgcagagctaacaccggagttgctgaagattctccacagctag

SEQ ID NO: 203437 - DNA, 693 bp, Artificial Sequence
  Description of Artificial Sequence: Synthetic coding sequence
atgcccctgcccgacaccatgttctgcgcccagcagatccacatccctcccgagttacccgacattctgaaacagttcacaaaggcggccatcaggacacagccagcagacgtcttaagatggagtgctggctactttagcgccctgagccggggggatcccctgccggttaaagatcgcatggagatgcccaccgccactcagaagaccgacacggggttaacccagggcttgcttaaggtgctccacaagcaatgtcatcataagcgctacgtggaactgacagacctggagcaaaagtggaaaaatctttgtctacctaaggagaaatttaaagcactgctccaactggacccttgcgagaataaaattaaatggatcaactttttggcgctcggctgcagcatgctgggcggctcactcaatacggcgctgaaacacttgtgcgaaatccttacagacgacccagagggcggacctgcccgcataccattcaagacattctcatatgtgtaccggtacctagcaagactggatagcgacgtgtcacctctggaaactgagagctatctcgcaagtctgaaggagaacatcgacgcccgcaaaaacggtatgattggactgtccgacttttttttcccaaaacgaaagctcctagagtcaattgagaattctgaggacgtgggtcactag

SEQ ID NO: 203438 - DNA, 693 bp, Artificial Sequence
  Description of Artificial Sequence: Synthetic coding sequence
atgcccctgcccgacaccatgttctgcgcccagcagatccacatcccacccgagttgcctgatatcctgaagcagtttactaaggccgctattagaacgcaaccagcagatgttctgcggtggagtgcagggtatttttctgctctctcgcggggtgacccccttcccgttaaagacagaatggaaatgcccacagccacccaaaagaccgataccggcctcacacaggggcttctgaaggtgttgcataaacagtgtcatcataaacgttacgtggaattaaccgatcttgaacagaagtggaaaaacttgtgcctccccaaggaaaagtttaaggctctactgcagctggatccatgtgagaataaaatcaagtggattaacttcctggccctgggctgttccatgcttggaggcagtctgaacacggctctgaaacatttatgtgagattctaacagacgaccctgaggggggacccgcacgcatcccatttaaaactttcagctatgtctacagatacctggcccgtctcgatagcgatgtgagcccgcttgagactgagtcgtacctggcctctctgaaggagaacatcgatgctcggaagaacggcatgatcgggctgagcgattttttctttcctaagagaaagcttcttgaaagcatagagaactcagaggacgtgggccactag

SEQ ID NO: 203439 - DNA, 2091 bp, Artificial Sequence
  Description of Artificial Sequence: Synthetic coding sequence
atggacgccgacatggactacgagcggcccaacgtggagaccatcaaatgcgtggtggtgggggacaatgccgtcggcaagaccagactgatttgtgcccgggcatgtaataccaccttgacccaatatcagttattggcgacacacgtgcctactgtgtgggccattgaccagtatcgtgtgtgccaggaggtgctggaaagatcgcgagatgttgtggatgaagttagcgtgagtctccggctttgggacacctttggggaccatcataaagacagaaggttcgcgtatggcagaagtgacgttgtggtgttgtgtttctccatcgcaaaccccaatagccttaatcatgtcaagagtatgtggtaccctgagatcaaacatttctgcccacgaacacccgtcatcctggtaggttgccagctggacctgaggtacgcggatttggaggctgttaaccgcgctcgcaggcctttagctcgacctatcaagaggggggacattttgcccccggagaaaggtcgagaggtggccaaggaacttggccttccatactacgaaacttcggttttcgaccaattcggcatcaaggacgtctttgacaacgctatccgagctgctctgatatcccggcgccacctgcagttttggaagagtcacctcaaaaaggttcagaagcctctgctacaagctcccttcctgccccccaaggcccccccgcctgtcattaaaatcccagagtgcccctccatgggaaccaacgaggccgcctgtctgctggacaacccactgtgcgcggacgttctattcattctgcaggaccaggaacatattttcgcgcaccggatatatctcgctacctcctcttcaaaattctacgatttgtttttgatggaatgcgaggaaagcccaaatgggtccgaaggtgcatgcgagaaggaaaagcagtccagggacttccagggacgaatattatctgtcgacccagaggaagagagggaggaggggccacctcggatccctcaggccgaccagtggaaaagctcaaacaaatctctggtagaggcccttgggcttgaagctgagggtgctgtcccggagacacagaccctgaccgggtggtctaaaggatttataggaatgcaccgcgaaatgcaggtcaatccaatcagcaagcggatggggccaatgactgtcgtgaggatggacgcctccgtgcaaccagggccttttcggacactactgcagtttttatacactgggcagcttgacgaaaaagagaaagacctggtaggactggcccagattgcagaggtgctggaaatgtttgatctgaggatgatggtcgaaaatattatgaataaggaagcgttcatgaatcaggagatcactaaagcgttccacgtgagaaaggccaatcggatcaaagagtgcctgtctaaaggcacattcagcgacgtaacctttaaacttgatgacggggctatttcagctcataagccactgctgatttgcagttgtgagtggatggcggcaatgtttggggggagttttgtagaatcggctaacagtgaggtgtatttgccgaacatcaacaagatctcaatgcaggctgtgcttgactacttgtatacgaagcagctcagcccaaatctggatttagaccctctggagttgatagcactcgcaaatagattctgcctgccacatctggtcgccctggctgaacaacacgccgtccaggaactgacgaaggctgccactagtggggttgggatagatggcgaagtactctcctacctagaattagcgcagtttcacaatgctcatcagctggccgcatggtgcctgcatcatatttgtaccaattacaactcagtgtgcagcaaatttaggaaggaaatcaaatccaagagtgccgacaaccaagaatacttcgaaaggcatagatggccccccgtatggtacctgaaggaggaggaccattatcaaagagtcaagcgagagagggagaaggaagatatcgcattgaacaagcatcgcagtcggcgtaagtggtgcttctggaattcttcaccagctgtggcatag

SEQ ID NO: 203440 - DNA, 2091 bp, Artificial Sequence
  Description of Artificial Sequence: Synthetic coding sequence
atggacgccgacatggactacgagcggcccaacgtggagaccatcaaatgcgtggttgtcggcgacaacgccgtcggaaagactcggctgatttgcgcccgtgcttgcaacactacccttactcagtaccagttgttggcaacccatgtgcccaccgtttgggccattgaccagtatcgggtgtgccaggaggtgctggaacgctcaagggatgtcgtagacgaggtaagcgttagcttgcgactttgggacacatttggcgatcaccacaaggataggcggtttgcgtacggccggtccgacgtcgtggtactttgcttttcgattgccaatcctaacagtctgaaccacgtcaaatctatgtggtaccctgagatcaagcacttctgtcctcgcaccccagtcattctggtcggctgtcagctggatctgcgatatgctgatttagaagccgtaaaccgcgcacggcgacccctggctcgaccaatcaaaagaggggacatcctgccacccgaaaagggacgagaggtcgccaaggaactgggcctgccttattacgagacttctgtctttgatcaattcggcatcaaggatgtgtttgacaacgccataagggccgccttgatctctcgacgacatttgcagttctggaaaagccatttgaagaaggtccagaagcctcttttacaggccccttttctgcctcccaaagccccacctcccgttataaaaatccctgagtgccctagcatgggtaccaatgaagccgcttgcctcctagacaatccattgtgcgcagacgttctattcatcctccaggaccaggaacacatctttgcgcaccggatatatttggccacctccagctcaaagttttatgatttattcttgatggagtgtgaggagagcccgaatgggtccgagggtgcttgcgagaaggaaaaacagagcagggattttcagggccgaatcctgtcagtggatcccgaagaggaaagagaggaaggaccacctaggataccccaggccgaccaatggaagtcttctaataagtcactcgtggaagctttgggacttgaggcggagggagccgtgcctgagacccagacactgaccgggtggagtaaggggttcataggaatgcacagggagatgcaggtcaatcccatatcaaagaggatgggtccgatgactgtggtaagaatggatgcaagcgtacaacccggtccctttaggactctgctgcagttcctctacaccggacaactcgacgagaaggagaaagatctggtcggtcttgctcaaatcgcagaggtccttgaaatgttcgatctccgtatgatggtcgaaaacatcatgaacaaggaggccttcatgaaccaggagattacaaaggctttccatgtgcggaaggcgaacagaatcaaggaatgcctctccaaaggaactttctctgatgtgacttttaaattagacgatggagctatctctgcgcacaagccactgctcatctgctcatgtgagtggatggccgccatgtttggcggctcctttgtcgagtctgcaaattccgaagtctacctgccaaatatcaacaagatcagcatgcaggcagtcttagactacctttacactaagcagctctcacctaatctcgatctagatcctttggagttgattgcccttgccaaccgtttttgcctacctcacctagtcgccctggccgagcagcatgccgttcaggaactgacaaaggctgcaaccagcggagtgggaattgacggcgaggtcttatcataccttgagctggcgcagttccacaacgcccaccagttagcggcctggtgcctgcaccatatctgtacaaactataactcagtctgttcaaagtttcgcaaagagatcaaaagcaaatccgccgataatcaggagtacttcgaacgtcaccgttggccgccagtgtggtatctgaaggaggaggaccactatcagcgggtgaagagagagcgggaaaaggaagatattgctttgaacaagcaccgcagtcgaaggaaatggtgtttttggaactcctcccctgccgtcgcatag

SEQ ID NO: 203441 - DNA, 300 bp, Artificial Sequence
  Description of Artificial Sequence: Synthetic coding sequence
atggacgccgacatggactacgagcggcccaacgtggagaccatcaagtgcgttgtggtcggcgataacgcagtaggaaagactcgccttatatgtgcgcgggcttgcaatacaacgctgactcagtaccagctgctggctacccatgtgcctacagtgtgggccatagaccaataccgggtttgtcaggaagtccttgagcgctctcgggacgtggtagacgaggtcagtgtcagcctgcggctttgggacacctttggggaccatcacaaggaccgcagatttgcttatgggcgatag

SEQ ID NO: 203442 - DNA, 2184 bp, Artificial Sequence
  Description of Artificial Sequence: Synthetic coding sequence
atggacagcgacatggactacgagcggcccaacgtggagaccatcaagtgcgtcgttgttggagataacgccgtgggtaaaacccggctaatctgcgcccgcgcatgcaatgccacgcttactcagtaccaactgcttgcaacacacgttccaacagtgtgggccatcgaccagtatcgagtctgtcaggaagtattagagcggagccgggacgttgtcgatgacgtatcagtgtccctccgcctttgggacacttttggtgaccatcataaggacaggcgctttgcgtatggacgctccgacgtcgtggttctttgcttcagtatcgccaaccctaactctctccaccacgttaagaccatgtggtacccagaaatcaagcatttttgtccccgagctcccgtgatactggtgggatgccaattggatttgcggtacgcagatcttgaagccgtaaatagagcaaggcgtcctctagcaaggccaatcaagcccaatgaaatcttgccacccgaaaaaggtcgggaggtggccaaggagctggggatcccatactatgagacatcagtcgtggctcagttcggaattaaagacgtgtttgataacgccattcgggccgcgctaatctcccgccggcaccttcagttctggaagtcccatttacggaatgttcaacgccccctccttcaagcgccttttctgcctcctaaaccgccccctcctattatcgtagtgcctgaccctccaagtagtagcgaagagtgcccagcacatctgttggaggatccactgtgtgctgacgtcatcctggtcctgcaggagcgtgttcggatcttcgcccacaagatctacctgtccacctcctctagcaagttttacgatctgtttctcatggacctcagcgagggcgaactgggtggcccatctgagcctggcggcacacatccagaagatcaccaggggcactctgaccagcatcaccaccatcaccaccaccatcacggaagggatttcttgctccgcgcggctagttttgatgtgtgtgaatccgtcgatgaggctggaggcagcgggcctgccggtctgcgagcttctacgtccgacggtatcctcaggggcaatggcaccggatatctgcccggacgaggtcgggtcctgagtagctggtcgcgggcgtttgtatccatccaggaggaaatggccgaagatccattaacgtacaagagccgcctgatggtggttgtcaagatggacagctcaatccagccaggaccgtttagagctgtgttaaagtacctctacacaggtgagctcgatgagaatgagcgggatcttatgcacattgcacacatcgctgaattactggaggtgtttgacctgaggatgatggtggctaacattttgaataacgaggctttcatgaatcaggagattacaaaggccttccacgttcggcggacaaaccgggtgaaggagtgtctggctaagggcacatttagcgatgtcacatttattcttgacgatggcacaatcagcgcccataagcctctgttgatttcgagctgtgactggatggcagccatgttcggcggccctttcgtcgagtcttcaactcgtgaggtcgtgttcccgtatacatcaaaatcctgcatgcgtgcagtgttagagtacctctataccggcatgttcacatccagtccggacttggacgatatgaagctcattatcctcgctaatcgattgtgtctaccccatttggtcgccctaacggagcagtacactgtgacagggttgatggaggctactcagatgatggtggacattgatggcgatgtactggtcttcctcgaactggcacagtttcactgtgcctaccagctcgccgattggtgccttcaccacatctgcacaaactacaataacgtatgcaggaaatttccgagggatatgaaggccatgtcccctgaaaatcaggaatatttcgaaaagcatcgttggcctcctgtctggtacctgaaggaggaagaccattaccagagggctaggaaggaacgtgaaaaagaggattacctgcatttaaagagacagcccaagcgcaggtggctgttctggaacagtccttcgtcccccagcagctcggccgccagttcctccagtccatcaagtagctccgctgttgtttag

SEQ ID NO: 203443 - DNA, 2250 bp, Artificial Sequence
  Description of Artificial Sequence: Synthetic coding sequence
atgcaggcctggcggaagggccccgacggcccccagaagaccagctctgattcaatgtcccggcttatggattctgacatggattatgagaggcctaacgtggaaactattaagtgcgtcgtggttggcgataatgcagtgggcaaaactcggctcatctgcgccagagcttgcaatgcaacgttgacacagtaccagcttctggcaactcacgtgccaactgtatgggctatcgaccagtaccgggtctgtcaggaggtgctggaaagaagcagagacgtcgtggacgatgtcagtgtgagcttaaggctgtgggacacgtttggtgaccatcataaggatagacgcttcgcatatggtcgcagtgatgtggtggtgctgtgtttctccattgccaatcccaactcgctgcaccatgttaagaccatgtggtacccggaaatcaagcacttctgccctcgcgctccagtcatccttgtgggctgtcagctcgatctgagatacgcagatttagaggccgtgaacagagcccggcgaccgctggcacgacccattaagcctaacgaaattctgccgcccgagaaagggagggaggtggcgaaggagctgggaattccttattatgagacgtctgtggtggcccagttcggtataaaagacgttttcgacaacgccattcgcgccgctcttatttcgcgtagacatttacaattctggaaatcccatcttcgcaatgtccagcgcccgcttttgcaagcaccttttctccccccaaagccaccgccccccatcatagttgtgcccgatcccccttcgagcagtgaagaatgcccagctcatctgctggaggacccactgtgcgccgacgtgatcttagtgctgcaggaacgggtcaggatcttcgctcacaaaatctatctaagcacctcctccagcaagttctatgacttgttcctgatggacctgtcagaaggtgaattgggcggcccctcagaaccaggggggacccatccagaagaccatcagggccattccgatcaacaccaccaccatcatcatcaccatcacggccgtgactttctcctgcgcgcagcatcctttgacgtgtgcgagtcggtggacgaggccgggggcagcggacctgccggactccgcgctagcacatcggatggcatcctaagaggaaacggcacaggctatctccctggaaggggccgagtcctgagctcttggtcccgggctttcgtttccatccaagaagaaatggccgaagacccactgacatacaagtctcgtctaatggtcgtggtcaaaatggattcgagcattcagcctggcccattccgagcagttctgaaatatttgtacaccggagagttggacgagaatgaacgggacttaatgcatatcgcacacatcgccgaactgctggaggtgttcgacctgcgtatgatggtggctaatattctgaacaacgaagcattcatgaatcaggagatcaccaaagcatttcacgtccgcaggacaaaccgcgtaaaagagtgccttgccaaaggaacgtttagcgacgtgacatttatcttggatgacggtactatttctgctcacaagcctttattaatatcctcatgcgattggatggccgcaatgttcggtgggcctttcgtcgaatcgtccacaagagaagtggtgttcccctacacgtctaagtcctgtatgagagcagtgttagagtacctctacaccggaatgttcaccagctctcctgacctcgacgacatgaagctcattatactagccaaccgcctctgtctaccacatctcgtcgctctgaccgagcagtatacagtaactggactgatggaagctactcagatgatggtcgacattgacggggacgtgttagtgttcctggagctggctcagtttcactgcgcgtaccagctggctgactggtgccttcaccatatttgcactaattataacaatgtatgccggaagtttccccgtgatatgaaagcgatgtctcccgagaatcaggaatactttgagaagcatagatggccgccggtctggtacctgaaggaagaggatcactaccagcgtgcaaggaaagagcgggaaaaggaggattacctgcatttgaagcgccaacctaagagaagatggctgttctggaattccccaagtagccccagttcttccgccgcaagctcttctagtccatcaagctcttcggcagttgtgtag

SEQ ID NO: 203444 - DNA, 2205 bp, Artificial Sequence
  Description of Artificial Sequence: Synthetic coding sequence
atgaaggcccggagccggctgatggacagcgacatggactacgagcgtcctaatgttgagaccatcaaatgcgtggtcgttggagataacgctgtggggaaaacccggctgatttgcgctagggcttgcaatgcaacactcacccagtaccagctcctggcaacccacgtgcccactgtgtgggccatcgatcagtaccgggtctgccaggaggtgctggaacgctctagagacgtagttgatgatgttagcgtgtccctgcggctgtgggacacttttggtgaccatcacaaagatcgtcgcttcgcatatggacgatccgacgttgtagtactatgttttagtatcgccaacccaaactctctgcaccacgtaaagacaatgtggtacccagaaatcaaacacttttgcccaagagctcccgtcatcttggtcgggtgtcagctcgatttgcgctacgcagacttggaggccgtgaaccgcgcacgcaggccactggccagaccgattaaacccaatgagattctgccacctgagaaggggcgagaggttgccaaggaattggggatcccttattacgaaacaagcgtcgtggctcagttcgggattaaggatgtattcgacaacgctatccgggccgccctgatttcccgtcggcatctgcagttctggaagtctcatcttcggaatgtgcagcggcccctccttcaagcaccttttctgccccccaagcctccccctcccatcatcgtcgttccggaccctccgtccagttctgaggagtgcccagcacatttattagaagaccccctctgcgcggacgtgatactggtcctgcaggaaagagtacgcatctttgctcataagatttatttatccacctcctcttctaagttttatgatctctttctcatggatctgtctgagggggagctgggggggccctctgaacccggcgggacacaccctgaggaccaccagggccactccgatcagcaccatcatcaccaccatcaccaccacgggagggactttttgctgcgagcggcttccttcgacgtttgtgagagcgtggacgaagcagggggatccggcccagctggtctaagagccagcacctctgatgggatcctgcgcggtaatggcacggggtatctgcccggccgcgggcgggttctcagctcatggtcgcgtgccttcgtgagcatacaggaagaaatggcggaagacccactgacttacaagtctcgcttaatggtggtagtcaagatggacagcagcattcagcccggcccctttagggccgtactcaagtacctgtacaccggtgaactcgatgaaaatgaaagagacctgatgcatatcgcacacatcgccgaactacttgaagtgtttgacctgcggatgatggtagccaacatactgaacaatgaggcatttatgaatcaggagatcaccaaggccttccatgttcggaggaccaacagagttaaggaatgtttggccaagggtacatttagtgatgttacattcatacttgatgacgggactatctcagcacacaaaccgcttttgatctctagttgcgactggatggctgccatgttcggggggcccttcgtcgaatcctccactcgggaggtagtttttccatacacctccaagagttgtatgcgcgccgttttagagtacctgtataccggcatgttcacatcctcaccagacctggatgacatgaagctgatcattctcgccaatcggttgtgtttgcctcatctggtggccttgacagaacagtataccgttacaggactaatggaagccacccaaatgatggtcgatattgatggagacgtccttgttttcctagagctggcccagttccactgcgcctaccaactagctgattggtgtctgcatcacatatgtactaactataataatgtgtgccggaaattccccagagacatgaaagccatgtcccccgagaatcaggaatactttgagaagcacagatggccccccgtctggtatcttaaggaagaggaccattaccagagagccaggaaggagagagagaaggaagactatctgcatctcaaaagacagcccaagagaagatggctgttttggaactctccctcttcgcccagcagcagcgccgcctctagcagctcgccttcaagttcgtcagcagttgtgtag

SEQ ID NO: 203445 - DNA, 1836 bp, Artificial Sequence
  Description of Artificial Sequence: Synthetic coding sequence
atgagcatccacatcgtggccctgggcaacgagggcgacaccttccaccaggataacaggccgtccggactgattcgaacttatttgggcagatcccccctggttagtggcgacgagtctagcctgcttctgaatgccgcgagtactgttgcacgcccagtattcaccgaataccaagcttctgctttcgggaacgtgaaactcgtggtacatgattgtcccgtgtgggacatcttcgactccgattggtatacttcccgaaatctaatcggaggagccgatatcatcgttattaagtataacgtaaacgacaagttctcttttcacgaagtcaaggataattacataccagttatcaaaagggctctcaatagcgtgccagtaattatcgctgccgtggggacacggcagaacgaggagcttccttgtacttgccctctgtgtacgtcagaccggggaagttgcgtctctacaacagagggtatccagcttgcaaaggagctgggtgcgacatacctggaactgcactccctggatgacttctatatagggaaatatttcggtggtgttctggagtattttatgattcaagctcttaaccagaagacttccgagaaaatgaagaaacgtaaaatgagtaattcattccatggaatccggcccccacaattagaacaacccgaaaagatgccagtcctgaaagctgaggccagccactacaactccgacctgaacaacttgctcttctgctgccagtgcgtggatgtggttttttacaaccccaacttaaaaaaagtggtggaggctcacaagattgttttgtgtgcagtttctcatgtgttcatgctgctgttcaacgtgaaatcccccacggacatccaggattccagcattatcagaaccacgcaggacctatttgccataaatcgggacactgcttttccaggggcgtcccatgagagcagcggcaacccacctcttcgagtcatagtgaaagatgctctgttctgtagctgtctttcagatatccttcggtttatttattcaggggcattccaatgggaagagttagaagaagacattcgcaagaaactcaaggactctggcgacgtcagcaacgtcatcgaaaaggtgaagtgcatcctgaaaactcccggaaagattaactgtctgagaaactgcaagacataccaagcccgcaagcccctgtggttctataacacatccctcaagtttttccttaataagccaatgcttgccgatgttgtgtttgagatacaggggactaccgtgccggcccaccgtgccattcttgtggctcggtgtgaagtcatggccgcgatgtttaacggaaactatatggaagcaaagagtgttcttattcctgtgtacggcgtgagcaaagaaacttttctgtctttcttggaatatctgtacacagattcctgttgcccagctggcatattccaggcgatgtgcctgctcatctgcgcggagatgtatcaggtttcccgactgcagcatatttgtgaacttttcataattacccagttacaatcaatgccgtctagggagctggcttcaatgaatttagacatagtggatctgttgaagaaagcgaagtttcaccactcagattgcctgtccacatggctgctgcacttcatagccactaattacctaatcttttcgcagaagcctgagttccaggacttgtctgtggaggagaggagttttgtggagaagcacaggtggccgtcaaatatgtatctgaagcaacttgccgaataccgcaaatacattcattcgcggaagtgccggtgtcttgttatgtag

SEQ ID NO: 203446 - DNA, 354 bp, Artificial Sequence
  Description of Artificial Sequence: Synthetic coding sequence
tgagagatgtaccaggtgagccggctgcagcacatctgcgagctgttcatcattactcagttacagtcaatgccctcacgggaacttgccagcatgaatttggacatcgttgaccttcttaagaaggctaagttccatcattcagactgcctgagcacctggctgctgcatttcatcgcaaccaactatctgattttcagccagaagcccgagttccaggacctgtccgtcgaagagcgctctttcgtcgaaaaacatagatggcccagcaacatgtacctcaagcagctcgccgagtacaggaagtacatccattctcggaaatgccgctgtttggtaatcaagcgccattag

SEQ ID NO: 203447 - DNA, 1692 bp, Artificial Sequence
  Description of Artificial Sequence: Synthetic coding sequence
atgttcagccggaaccaccggagccgggtgaccgtggcccggggctccgctctggaaatggagtttaaacggggtagattccggctgagcttgttttccgacctgcccgaagatacggaactgcaacgaaagctggatcatgaaattagaatgagggaaggagcctgtaagctgctggcagcgtgcagccagagagaacaggctttagaggctacaaagtctttactggtctgtaattcccgcatcctctcttacatgggcgaactccagcggagaaaggaggcacaggttctggggaaaacttctcggcgtcccagtgatagtggtcctcctgccgaacgcagtccgtgcagggggagagtatgtataagtgacctccgcattccactgatgtggaaagatactgagtattttaagaacaagggtgacctacaccggtgggctgttttcctcttattacagctcggagaacacatacaggacactgaaatgattttggtggataggactttaaccgatatttctttccagagtaatgttctgttcgcagaagcagggccggattttgaattgcggctggagctctacggggcttgcgtggaggaagagggggcactgaccgggggacccaaacggctcgcaactaaactgtcctcctcgctgggaagatcaagcggcagaagggtccgcgcttcacttgacagcgcaggcgggtccggttcgagtcccatattactgcccactcctgtggtgggagggcctcgctatcacctgctggcacacaccacgctgacactggccgccgtgcaggatggtttcaggacccacgacttaaccttggcgagccatgaagagaatcccgcatggctgcccctgtacgggagtgtgtgctgcagattagcagctcaaccattgtgcatgacacagccgactgcctctggcaccctgcgagtgcagcaggccggggagatgcagaattgggcccaagtccacggggtcctgaaaggtaccaatctgttctgttatcgacaaccagaggacgccgatactggagaagagccgttgctcacgattgctgtaaacaaagaaacgcgggttcgagcgggtgagctggaccaagctctgggccgaccatttacactcagcatttctaatcagtacggggatgacgaggtgacacataccctgcagactgaatcccgagaggccctccaatcttggatggaggctctgtggcaactgttttttgacatgagccagtggaaacagtgctgcgatgaaatcatgaagatcgaaactccagcaccgcgcaagcctcctcaggccctagctaaacagggcagcctctaccacgaaatggccatcgagccactggatgacatcgccgccgttactgacatcctgacccagagagagggcgcccgattagaaacaccgcctccatggctcgcgatgtttacagatcaacctgctttaccgaatccatgcagcccagcctctgtggcccctgcccctgactggacccatccgcttccttggggtcggccaaggaccttctctctagatgccgtgccacccgaccacagccccagagcacgctccgtcgctccccttcctccccaacgctctcctcggaccagaggattatgcagtaagggccagccccggacctggcttcagagtccagtctag

SEQ ID NO: 203448 - DNA, 1653 bp, Artificial Sequence
  Description of Artificial Sequence: Synthetic coding sequence
atgcaggaccggctgcacatcctggaggacctgaacatgctgtacatcaggcaaatggcgctatcacttgaagataccgagctccaacggaagctggaccacgaaatccgcatgcgcgaaggcgcgtgcaagcttctcgcagcatgctcacagcgagaacaggcattggaggcaaccaaatctcttctggtgtgcaactcgcgcatactgagctacatgggagaattacagagacgaaaggaagctcaggtgctgggaaaaaccagcaggcgaccctctgacagtggccctcctgcggaaagatcaccttgccgcgggcgcgtatgtatatctgatctcaggatcccactcatgtggaaagatacagagtattttaaaaacaagggagacctgcataggtgggctgtgttcctgttgttgcagctaggggaacatatccaagacacagaaatgatcctcgttgaccgaaccctgaccgacattagctttcagtcgaacgtactattcgccgaagcgggccccgactttgagctacggcttgaactgtacggtgcatgcgtcgaggaggaaggagctctgactggtggacctaaacgactggccaccaagctgagttccagcctaggaaggagctcaggtcgaagagtgagggcctctctggacagcgctgggggctctggatcatcccccatacttttacccacgcctgtcgtgggtgggccaaggtaccatctacttgcccacacaaccctcacccttgctgccgtgcaggacggcttcagaactcacgacctgacgctggcctcccatgaagaaaacccagcttggctgcccttgtatggttctgtctgctgcagactggccgcacagcctctgtgcatgacccagcccacagcctcaggcacactgcgggttcaacaggccggagagatgcagaactgggcacaggtccatggggtcctgaaaggaaccaacctgttctgctataggcagccagaggatgctgatactggagaagaaccactcttgacgattgcggtcaacaaagagacaagggtgagggcaggcgaactggatcaggcacttgggcgtcctttcaccctgagtatcagcaatcagtacggagacgacgaggtaacccacaccctgcaaaccgaatcgcgcgaggcacttcagtcctggatggaagctctctggcagctattttttgatatgtcacagtggaagcagtgctgcgatgaaattatgaagattgagaccccagccccccgcaaacctccccaggcactggccaagcaagggtctttgtaccacgaaatggctattgagcctctggatgacatcgcagctgtgaccgatattcttacccagcgggaaggggcaagactcgagacccctcctccctggctggccatgttcaccgatcagcctgctctcccgaatccttgttctcccgcttctgttgctccagcgccagactggacacatccactcccttggggccgccctcggacctttagtctggatgctgtgccccccgatcattctcctcgcgcccgttctgtcgccccactccctccacaaaggtcccccagaactcggggtctgtgttctaaaggccagccccgaacatggctgcagtctcccgtctag

SEQ ID NO: 203449 - DNA, 4635 bp, Artificial Sequence
  Description of Artificial Sequence: Synthetic coding sequence
atggacagcggccccgtgtaccacggcgacagccggcagctgagcgcctctggcgtccccgtgaatggagccagagaacccgccggcccatctctgctcggaactgggggtccctggcgtgtcgaccaaaagcctgactgggaagccgctcctggacctgcccatactgcccgccttgaggacgctcacgacctcgtggctttcagtgcagtcgcagaagctgtgagctcctatggagctctgtcaactcgcctgtatgaaacgtttaatcgcgagatgtcgagggaggctgggaacaacagccggggcccccgccctggccctgaaggatgctctgccggtagcgaagatctagacacactacaaaccgcactggctttggccaggcacggtatgaaacctcccaattgtaactgcgacgggcccgagtgccccgattaccttgaatggttggaaggcaagattaagtctgtggtaatggaaggcggcgaggaaaggccgagactgcctgggccacttcctccaggagaggctgggttgcccgcaccatcaacacgcccgctgctctctagtgaagttccgcagatttcccctcaggagggactccctctgtctcagtccgccttgagcattgcaaaagaaaagaatattagcctgcagacagcaattgccatcgaagcgctgacgcagttatcttcagccctccctcagcccagtcatagcacccctcaggcgagctgtccattaccagaagccttgtcgccgccggcaccctttcggtctccgcagagctatcttcgggcaccatcttggcctgtggtccctcctgaagaacacagctccttcgcccctgacagctcagccttccctccagctactcccaggactgagtttccagaagcatggggcactgatacccctccagctactcctaggtcatcctggcctatgccccgacctagtccagatcccatggctgaactggagcaattacttggcagcgcctcagattacatccagtccgtattcaaaagacccgaggcgctcccaactaagcccaaagtcaaggttgaagcgccaagttcaagccccgccccagctccgtccccagtgttacagcgggaagcccccacccccagcagtgaacctgacactcaccagaaggcccagacggccctacaacagcacctccaccacaagaggagtctgttcctggagcaggtccacgatacttccttccccgcaccctcagagccttccgcccccggatggtggccacccccatcctcccctgtgccccgtttgcccgaccggccgccgaaggagaaaaaaaaaaaactgcctacacccgcagggggtccagtgggaacagaaaaagccgctccagggattaagccctccgttaggaaacccattcagatcaagaagagccggccaagggaggcccagcctctgttccccccagtccgccagattgtgctggaaggtttgaggagccccgcgtcccaagaagttcaggcgcaccctccggcccctctcccggcatcccaagggtccgcagtgccactgcctcctgagccctcactcgccctattcgctccatcgccctcccgtgattcccttctgccgccaacccaggagatgagatctccctctcctatgaccgccctccagcctggcagcactggccccctgccaccggccgatgataaactggaagaattgatcagacagtttgaggccgaattcggagactctttcggtcttccaggccctcccagcgtccctatacaggatccagagaaccagcagacatgtctgccagctccagaaagcccattcgccactcggtctccaaaacaaatcaagatagagtcatctggtgcagttaccgtcctctccacaacatgtttccattccgaggaagggggccaggaagctacgcccacaaaggctgagaaccccctcacccccacgctttcaggcttccttgagtcaccgctgaagtatctcgatacacccacaaagtccctcttagatacaccagccaagcgcgcccaggcagagtttcccacttgcgactgcgtggagcagatcgtggaaaaagacgaaggtccctactacacccaccttggttccggccctacagttgcatcgatcagggagctaatggaggagcggtacggcgagaaagggaaagcaatcagaatagagaaggtcatatataccggcaaagaggggaaaagttcccggggctgccccatcgccaaatgggtgatacgccgacacacattggaagagaagttactctgcttggtcagacatagggccggacaccactgtcaaaacgcagtaatcgtcattctcatcttggcatgggagggcattccccggtctctgggagataccttgtatcaggaactgaccgacacccttaggaaatacggaaacccaaccagtcgaaggtgcggcctgaacgatgatagaacatgcgcatgtcagggaaaggaccccaatacctgtggggcttcctttagcttcggatgcagctggagcatgtactttaacgggtgtaagtacgcacggagtaagacacctcggaagttccgtcttgcgggagacaacccgaaggaggaagaggtgctgcgtaagtcattccaggatctcgccactgaagtcgcccccttgtacaaacggctcgccccacaagcatatcaaaaccaggtcactaatgaggaaattgccattgattgtcggcttggcctcaaggaagggcgccctttcgccggcgttacagcgtgtatggatttttgcgcacacgctcataaggaccagcacaacctgtacaacggttgcacagttgtttgcacactgaccaaagaggataacaggtgcgtgggaaaaattccggaagacgaacaactgcatgtcctgcccctgtataagatggccaatactgacgaatttggaagcgaggagaatcaaaatgccaaggttggcagtggtgctatccaagttctgaccgcattcccgcgcgaagtgaggaggctcccagagccagccaagagttgtcgacaacgccagcttgaggctaggaaggccgccgcagagaaaaaaaagattcagaaggaaaagctctctactccagagaaaatcaagcaggaagctcttgagctagccggcataacatctgatccaggactgtctctcaagggaggtctgagccagcaagggctcaagcctagtctgaaggtggaacctcagaaccacttttcaagcttcaagtacagtggaaacgctgtagttgagagttattccgtcttgggcaactgtcgacccagcgacccttattctatgaattccgtctacagttatcattcctactacgcacagccttcgctgaccagtgtgaatgggtttcattcgaagtacgcgctgccgtccttcagctactatggctttccttcatccaatcctgtcttcccctcacaatttctcggaccgggagcttgggggcattccgggtcaagcggctcttttgagaagaagccagatctgcatgcactgcataattctctgtcacccgcgtacggcggggcggagtttgcagagctcccctcacaggccgttcctacggacgcgcaccaccctaccccccaccaccaacagccagcatatccaggtccgaaggagtatctcctcccaaaggcccctctgctgcactctgtgagtagggatccatcccccttcgcccaatccagtaattgttataatcggagcatcaagcaagagcctgtcgacccactgacccaggccgaacctgtacccagagacgccggtaagatgggaaagacaccactgtctgaagtgtcgcaaaacggggggcccagtcatctgtggggccagtattcaggaggaccttccatgtccccgaagcggactaatggagttggaggatcctggggagtgttttcctcgggggagtcccccgcaatcgtgcccgacaaactgagctcttttggtgcctcttgcctcgcaccaagccacttcaccgacggccagtggggcctgttcccaggtgagggccagcaggcggcatctcattctggaggccggttaaggggtaagccctggagcccatgcaagttcggaaactccaccagtgctctcgctggaccgtctcttacggaaaaaccttgggcactcggcgccggggactttaattctgcactaaaagggagcccagggttccaggacaaactgtggaaccccatgaaaggggaagagggccgaatccccgccgctggcgcctctcagttggttttctaccaacataaaaacctgaaccagccaaatcacggtctggcgctctgggaggcaaagatgaagcagcttgccgagagggcccgcgcacggcaggaggaggccgccagactgggcctcggtcaacaggaagcgaaattgtatggcaaaaaacgcaagtggggcgggaccgttgtggcagaaccgcagcagaaagaaaagaagggggtagtgcctacacgccaagccttagctgtaccaactgactccgcagtcactgtgtcatcttacgcctatacgaaggtgactggtccgtatagtcgatggatctag

SEQ ID NO: 203450 - DNA, 468 bp, Artificial Sequence
  Description of Artificial Sequence: Synthetic coding sequence
atgcggcacctgccctacttctgccggggccaggtggtgcggggctttgggcgcgggtcgaagcaactggggattcctacggcgaactttcccgagcaagttgtcgataatctgccagctgatatttccacaggcatttactacggttgggctagcgtgggaagtggagacgtacacaaaatggtagtcagtatcggatggaacccgtactacaagaatactaaaaagtctatggagacacatattatgcatacctttaaggaagatttctacggcgaaatactgaatgtcgctatcgtgggctatctccgacccgagaaaaacttcgacagcctggaatcacttatcagtgcaatccagggcgatattgaggaggccaaaaagcgcttagagcttcctgagcatctgaagataaaggaggacaatttctttcaggtgagtaaatcaaaaatcatgaatggtcactag

SEQ ID NO: 203451 - DNA, 969 bp, Artificial Sequence
  Description of Artificial Sequence: Synthetic coding sequence
atggccgccagcggcgagccccagcggcagtggcaggaggaggtggctgccgtggtggtagtcggatcttgtatgacagacctcgtctcactgacctcaaggctccctaaaactggtgagacgatccatgggcacaagtttttcataggtttcggaggaaaaggagctaaccagtgcgttcaggcagcacgcctaggagccatgacaagcatggtatgcaaagtgggcaaggattccttcggcaacgactatattgagaatctgaaacagaatgacatttctacagaatttacctatcaaacgaaagacgctgctaccgggactgctagtattatcgtgaataacgaaggtcaaaatattattgtcattgttgctggggccaaccttctcctgaatacggaggatctgcgagccgctgcaaacgtgatctcccgcgctaaggtgatggtgtgtcagctagaaattacaccagctaccagcctggaggcccttactatggcccgcagatcaggggtgaaaaccctgtttaatccggcacctgctatcgccgacttagaccctcagttctataccttgtccgacgtgttttgctgtaacgaaagcgaggctgagatccttactggactgacagtggggtcagccgcagacgccggtgaagccgcgttggttctgctgaaaagaggttgtcaggtggttatcattacactgggcgcggaggggtgcgtcgtgctgagccagacagagccagagcctaagcatattcctacagagaaggtgaaagccgttgacaccaccggtgccggcgacagcttcgtcggggccttggccttttacctcgcctactacccaaatctaagcttggaagacatgctgaaccgatccaacttcatagccgcagtgagtgtacaggcggcaggtacccagtcatcctacccatataagaaagaccttccattaacgctgttctag

SEQ ID NO: 203452 - DNA, 861 bp, Artificial Sequence
  Description of Artificial Sequence: Synthetic coding sequence
atggccgccagcggcgagccccagcggcagtggcaggaggaggtggcagctgttgtggtagttggaagttgcatgacagatctggtaagcttaacaagccgtctccctaagacaggcgagaccattcatggtcacaagttttttatcggatttggcggtaaaggagcgaaccagtgtgtgcaagctgctcggcttggggcaatgacaagtatggtgtgcaaggttggcaaggatagtttcggcaacgattatatcgagaacctaaaacaaaatgatatctctacagagtttacctatcagaccaaagacgctgcaactggaaccgccagcattattgtgaataacgaaggccagaatatcattgtcatcgtggccggagccaatctgctccttaatacagaggatttacgcgccgcagcaaatgtgattagcagggcgaaggtgatggtatgccagctggaaatcactcccgccacaagcttggaggcacttactatggcccgccggtctggggtcaagactttgtttaaccctgcccccgcgatcgctgacctggacccccagttttatactctatctgacgtgttttgttgcaacgagtccgaggcagagattctcactggcttgacagtcggaagcgccgctgacgcaggagaagctgccctcgtgctcctgaagcgagggtgtcaggtcgtcatcattacgctgggcgccgaggggtgtgtcgtacttagccagaccgagccagagccaaagcacattccaacagagaaggtcaaggccgtcgatacaacctgccggcccggtagccgaccaaaatccgaggccgcttctgtgaaaaagcagaaacattataagtag

SEQ ID NO: 203453 - DNA, 861 bp, Artificial Sequence
  Description of Artificial Sequence: Synthetic coding sequence
atgagctggctgctgttcctggcccaccgggtggccctggccgccctgccttgtcggcgcgggtcaagagggttcggtatgttctacgcagtgaggagggggagaaaaaccggcgtctttctgacatggaatgagtgcagagcacaggttgaccgctttcctgccgcccgattcaaaaagttcgctactgaagacgaagcttgggcatttgtccgcaagtcagcgtcgcctgaggtttctgaaggccacgagaaccagcatggacaggagagcgaggcgaaagcctcaaagagattacgggagccacttgacggggatggacatgaatcagccgagccctacgcaaagcacatgaagccctccgtcgaacctgcacctccggtgagcagggacacattctcttacatgggggattttgtcgttgtgtataccgacggctgctgctcttccaacggcagacgcagacctcgggccggtattggcgtgtactggggaccaggacatcccttaaatgtggggattaggctcccgggacgccagaccaaccagagggccgaaatccacgccgcttgcaaggctatcgagcaggcaaaaacacaaaacattaataagctggtgctctatacagacagcatgttcactatcaatggtatcactaattgggtccagggctggaagaagaacggatggaagaccagtgcaggaaaagaggttattaacaaggaggactttgtggcactcgagcgcctgacccagggtatggatattcaatggatgcacgtgccagggcatagtgggttcatcggcaacgaagaggcggacaggctggccagagaaggtgctaagcagagtgaggattag

SEQ ID NO: 203454 - DNA, 1683 bp, Artificial Sequence
  Description of Artificial Sequence: Synthetic coding sequence
atggagttccggcaggaggagttccggaagctggccggccgggccctcgggaagcttcatcgccttctggaaaaaagacaggagggggcagagacattggagctgagcgccgatgggagaccagttacaactcagacccgtgacccccccgtagtagattgcacatgcttcggtcttccacgccgatacataattgccataatgtccggcctgggcttctgcatcagttttggaatccgatgtaatttaggggtagcgatcgtgagcatggttaataattccacaacccatcggggcggccacgtggtagtgcaaaaggcccagttcagctgggacccagagacagtcggacttattcacggatcattcttctgggggtacatcgtgacccagatccccgggggattcatctgtcagaagttcgctgctaaccgcgtgttcggctttgccattgtcgctacatcaactcttaatatgttgattccctccgccgcccgggtgcattacgggtgtgtcatctttgtgcgtattctgcaggggcttgtggaaggcgtgacttatcccgcctgtcatggcatctggagtaagtgggctcctcccctcgagaggtctcgccttgccacgactgctttctgcggctcatacgctggcgcggtggtcgcaatgcccctcgcaggcgtgcttgttcagtattcaggatggtccagtgtgttctacgtctacggctcgttcggcatcttctggtacctcttttggctgctcgtcagctacgagtcccccgctctgcatccttcaatctcggaggaggaaaggaaatatatagaggatgcaatcggcgagtctgcgaaactaatgaatcctctgaccaaatttagtacaccctggaggcgcttctttacgagtatgccggtctacgccattattgttgcgaacttttgccgcagttggacattctatttacttctgattagccaacccgcctacttcgaggaggtgttcgggtttgaaatcagcaaggttggcctggtgagtgccctgccccacctggtaatgaccatcatagtgccgatcgggggccagattgctgattttctgaggagtaggcgaatcatgtccaccacaaatgttcgcaagctgatgaactgcggcggatttggcatggaggccacattactcctcgtggtcgggtactcgcattctaagggggtggcaattagtttcttagtgttagccgtggggttcagtggctttgctattagcggctttaacgtgaatcacctggacatcgcgccccggtacgcttccattcttatgggtatctccaacggtgtgggcactctaagcggaatggtttgccccataattgtgggagccatgaccaagcacaaaacacgggaggagtggcagtatgtatttctgattgcctccctagtgcactatggcggagtgatcttttatggggtattcgctagcggagagaaacagccctgggccgagcctgaagaaatgtcagaagagaagtgcgggtttgtgggacatgaccagctcgccgggagtgacgactcggaaatggaggatgaagccgaaccacccggcgcccccccagctccccccccctcatacggcgcgacccattcaactttccagccaccacgcccccccccccccgttagggattactag

SEQ ID NO: 203455 - DNA, 939 bp, Artificial Sequence
  Description of Artificial Sequence: Synthetic coding sequence
atggccgccggcgtggactgcggcgacggcgtgggcgcccggcagcatgtgttcctggtctccgagtacttgaaggacgctagcaagaagatgaagaacggactcatgtttgtaaaattagtaaatccttgctcgggtgaaggagcaatttacttgttcaatatgtgcctccagcagctcttcgaggtaaaggtgttcaaggaaaaacatcactcctggtttatcaatcagtcggtacaaagcggcgggctccttcactttgctacccccgtcgatccacttttcttgctcttacactacctcatcaaagccgacaaagaggggaagttccaaccactggatcaggtggtggttgataatgtgtttccgaattgcatcctgctcttgaaactacctgggctggagaaactcttacaccacgtgacagaagagaaaggaaaccctgagattgacaacaaaaaatattacaaatatagcaaggaaaagacacttaagtggctcgagaagaaagtgaatcaaaccgttgctgctctcaaaacgaacaacgtaaacgtttcttctcgggtccagtcaaccgctttttttagcggtgaccaggcaagtactgataaggaggaagactatatccggtatgcacacggtttgatttccgattacattcccaaagaattatccgacgacctgtcgaaatatttgaaactgccagagccctccgcatccctgcccaaccctccttccaagaagatcaaattaagcgatgaaccagtcgaagcgaaagaggattataccaagtttaatacaaaagatcttaagaccgagaaaaaaaactcaaagatgacagctgctcagaaggcactcgcaaaggtggacaagagcggaatgaaaagtattgacaccttctttggagtgaagaataagaagaaaatcggtaaggtgtag

SEQ ID NO: 203456 - DNA, 774 bp, Artificial Sequence
  Description of Artificial Sequence: Synthetic coding sequence
atggccgccggcgtggactgcggcgacggcgtgggcgcccggcagcacgtctttctcgtcagcgagtacctgaaagatgcgtccaagaaaatgaagaacgggctgatgttcgtgaaattggtaaatccctgcagcggcgaaggcgccatatacctgttcaacatgtgcttgcaacagcttttcgaagttaaggtgtttaaagaaaagcaccattcttggttcatcaatcagtcagttcagtctgggggtctacttcatttcgctactccggtggaccctctctttctgctccttcattacttaatcaaagcagacaaagagggcaaattccagccactggatcaggtcgttgtggacaatgtgttcccaaactgcattttgctactgaaactaccagggctagagaagctgctgcaccatgttaccgaggaaaaaggcaaccctgagattgacaataaaaagtattataagtattctaaggagaagactttaaaatggcttgagaaaaaagttaatcagacggtagcagcactcaagacgaataatgtgaatgtctcctctcgtgtgcagtctacggccttcttctccggtgaccaagctagcacagataaagaagaagactacatcagatacgcccacggtctcatctccgactacattccgaaggagctgtccgacgatctgagtaagtacctcaagctgcctgagccgtcagcaagccttcctaatccacccagcaaaatggctgctcagcgtcagaaacgggggaaatag

SEQ ID NO: 203457 - DNA, 996 bp, Artificial Sequence
  Description of Artificial Sequence: Synthetic coding sequence
atggccgccggcgtggactgcggcgacggcgtgggcgcccggcagcatgtatttcttgtgagcgagtatctgaaagacgctagcaaaaagatgaaaaacggcttaatgtttgtcaaactcgtgaatccttgctcaggggagggggcaatctatctgttcaacatgtgtctccaacagctgttcgaggtgaaggttttcaaagaaaagcaccatagctggtttattaaccagagcgtgcagagtgggggcctattgcacttcgctacaccggtggatccactgtttctgctcttgcattacctgatcaaagccgataaagagggcaagttccagccgctggatcaggttgtagtcgacaacgtattcccaaactgcatattactgctgaaattgcccgggctggaaaaactgttacatcatgtgaccgaggaaaagggtaacccagagatcgacaataagaagtactataaatactcaaaggaaaaaactttgaaatggctcgaaaagaaggtgaatcaaaccgtggccgctcttaaaactaataacgtgaacgtgtcgagcagggtacaatctacggcgtttttcagcggggaccaggccagcacagataaggaggaagactacattcggtatgcacatggcctcatctccgattatataccaaaagagttatccgatgatctcagcaagtacctgaagctacccgaaccgagcgcttctctccctaatcctcccagtaagaagataaagttgagcgatgagcctgtggaggccaaggaagactacactaaatttaacaccaaagacctgaaaactgagaagaaaaatagtaagatgaccgccgcccaaaaagccctagccaaggtggataaatccggtatgaagagtatcgacacattttttggcgtgaagaagaagctggagagattcgaaacccttaaaatcaagagctccaagaacatctgcttcctgcatgtatcagtatgcccaagttag

SEQ ID NO: 203458 - DNA, 495 bp, Artificial Sequence
  Description of Artificial Sequence: Synthetic coding sequence
atggagagcggcgacgaggccgccatcgagcggcaccgggtgcacctgcgtagtgccacgctgcgcgacgctgtccccgctactctgcatcttctcccgtgtgaggtggcagtggacgggccggccccagtggggcgatttttcacccccgctattcggcagggtcctgagggcttggaagtgtccttccggggcaggtgcctccgcggggaggaggtcgcagttcctccgggcctggtcggatatgtcatggtcaccgaggaaaaaaaggtgtctatgggcaagcccgaccccttgcgcgatagtgggaccgacgaccaggaggaggagccgctggaacgagatttcgatcgcttcatcggggccaccgctaacttctcccgatttaccttgtggggtctcgaaaccattccaggaccggacgccaaagttcgcggagcactaacgtggcccagcctagcagccgcgatccacgctcaagtaccagaggattag

SEQ ID NO: 203459 - DNA, 2226 bp, Artificial Sequence
  Description of Artificial Sequence: Synthetic coding sequence
atggagagccgggaccacaacaacccccaggagggccccaccagctcttcaggaagaagggcagcagtggaagacaatcatctgttaattaaggccgtccagaacgaggatgtcgacctggtccagcagttgctggagggcggtgccaacgtaaatttccaggaggaagagggcggctggaccccactgcataatgctgttcagatgagcagggaagatatcgtcgaattgctcttacgacacggggcggacccagtgctcaggaaaaagaacggagcaaccccctttattcttgccgctattgctggatcagtgaaattattaaaactattcctgagcaaaggtgccgatgtgaacgaatgcgatttctatggattcaccgctttcatggaggcagctgtttacggtaaggtgaaggcgctgaagttcctatacaagcggggcgcaaatgtgaacttacgtaggaaaactaaggaggatcaggaaagactgcggaaaggaggcgccaccgccctaatggacgccgcagaaaaaggccacgtcgaggtcctgaagatcttgctagatgaaatgggcgcagatgtgaatgcttgtgataacatgggccgaaatgcattgatccatgccctgctcagcagtgatgattctgacgtagaggctatcacacacctcctgctcgatcacggtgctgacgtcaacgttaggggcgagcgaggaaagacacccctgatacttgctgtggagaaaaagcatctgggactggtccagcgtttgcttgagcaagaacatattgagattaacgacaccgattccgacggcaaaacagcgttacttctggctgttgagctcaagctcaagaagatagctgaactgctgtgtaaaaggggtgcttctaccgattgcggcgatctggtcatgactgctagacgaaattatgaccattctctggtgaaggtgctgctgtctcatggtgcaaaagaggatttccaccccccggcagaagattggaaaccgcagagctctcactggggggccgccctgaaggacctccaccgaatctaccgccctatgattggcaaactgaaattttttattgacgaaaaatacaagatcgcagacacatccgagggaggcatatacctcggcttctatgagaaacaggaggttgccgtaaagacattttgtgaggggtcacctcgcgcccaaagggaggtgagctgcctccaatcttcacgggagaatagccacctggtgacattttacgggtccgagagccacagggggcacctcttcgtgtgcgtgaccttatgcgagcagaccctcgaggcgtgcctcgacgttcacaggggggaagatgtggagaacgaagaggatgaatttgctcggaacgtactctcgtctattttcaaggcagttcaggagttgcacctgtcctgcggatacacacatcaggacctgcagccccaaaatattctgatagattccaagaaggctgcccatctggccgacttcgacaagagcattaaatgggctggggatccacaggaggtaaagcgggacctggaggaccttggtcgcttagttctgtacgtcgtgaagaagggctctatcagcttcgaggacctgaaagctcagtccaacgaagaggtcgtccaactgagtcccgatgaggaaacgaaggacctcatacaccggttattccatccgggagagcacgtccgggactgcttatctgacctgctgggacacccattcttttggacatgggaaagtcgatacagaacacttaggaacgttgggaatgaaagtgatatcaaaacccgcaagagcgagagcgagattctgcgcctcctccaacccggaccatctgaacacagcaaatcctttgataagtggaccacaaagatcaatgaatgtgtgatgaaaaagatgaataaattttatgagaagagaggtaacttttaccagaacactgtcggcgacttgttgaagtttattagaaatcttggcgagcacatcgatgaggagaagcataagaaaatgaagctgaaaatcggcgacccatccttgtactttcaaaaaaccttccccgatttggtgatatacgtttacacaaaacttcagaataccgagtacagaaaacatttcccacagacacactccccaaacaaacctcagtgcgatggagctgggggcgcctcaggtctggccagtcctggatgttag

SEQ ID NO: 203460 - DNA, 2226 bp, Artificial Sequence
  Description of Artificial Sequence: Synthetic coding sequence
atggagagccgggaccacaacaacccccaggagggccccaccagctccagcggtaggagagcagccgttgaggataaccatcttctgattaaggccgttcagaacgaagacgtggatctcgtgcagcaactcctggagggcggagccaatgttaatttccaggaagaggaaggcggctggacccccttacacaatgcagtgcaaatgtccagagaggacatcgtagagctgttgctgaggcatggggccgacccagtgcttcgcaagaagaacggtgctacacccttcatactcgctgccattgcaggtagcgtgaaactgctgaaactgttcctgtctaagggcgccgatgtcaatgagtgtgatttttacggcttcacagcttttatggaggcggccgtttacggaaaagtgaaggccctgaaattcctttataagcggggtgccaacgtaaatctgcggcggaagaccaaagaggatcaagagcggcttaggaagggaggcgctaccgccctgatggatgcggcggaaaagggccacgtggaggtcctaaaaattctcctagatgaaatgggcgccgacgtgaacgcctgcgacaacatgggaagaaacgctttgatacatgccctattgagtagcgacgatagcgacgtggaagccattacgcatctcctcctcgatcacggagctgacgtgaatgtgcggggggagcggggaaaaacacccctgatcctggccgtggaaaaaaagcacctgggcctcgtccaaagactgctggagcaggagcatattgagatcaatgataccgatagcgacggaaaaacagccctgttgctggctgttgaattaaagctgaaaaaaatcgccgaactgttatgtaagcgcggagcaagcaccgactgcggtgacctcgtgatgacagccaggcggaactacgatcattccctggtgaaggtcctactgtctcatggcgctaaagaggacttccatcccccagctgaagattggaagccccagagttcgcactggggggctgccctgaaagacttgcaccggatctacagacctatgattgggaagcttaaatttttcattgacgagaagtacaaaatagccgatacatcggagggagggatctatctgggattttacgaaaagcaggaagtggctgtgaagactttctgcgaagggtctccccgggcccagagagaggtgtcttgcctacagtccagccgggaaaatagccatctggtgaccttctatggatctgagtcccatagaggccatctctttgtgtgcgtcactctctgtgagcagacactggaagcctgcctggacgtgcataggggcgaggacgtggagaatgaggaagatgagttcgcccgcaatgtgctgagcagtatatttaaagctgtgcaggagctccacttgagctgcggttatacccatcaagatctgcagcctcagaacatcctgatagacagtaagaaagcagcacatcttgcggattttgataagagtatcaaatgggcaggtgaccctcaggaagtcaaacgcgatctagaggacctaggaaggttggtattgtacgtagtgaaaaaaggaagcatttcattcgaagacttgaaggcccagagcaacgaagaagtcgtccagttaagcccagatgaagaaacaaaagaccttattcaccgactctttcaccctggtgagcacgttagggattgcctatctgacctgctgggtcacccctttttttggacgtgggaatccagatacaggacactgcggaacgtaggaaacgagtccgatatcaagactagaaaaagcgagtccgaaattctgagactgctgcaaccaggtccctccgagcatagcaagtcgttcgataagtggacaactaagataaatgagtgcgtcatgaaaaagatgaacaaattctacgagaagcggggcaacttctatcaaaatacagtcggcgacctgctcaaattcattcgcaatttaggggaacacattgacgaggagaagcacaagaaaatgaaattgaagataggagatcctagtttgtattttcagaaaacctttcccgacttggtgatctatgtgtatactaagctccagaacaccgaataccgcaaacactttccccagacacatagtccaaataaaccacaatgtgacggagccgggggcgcatctggtctggcatcccccggttgttag

SEQ ID NO: 203461 - DNA, 1959 bp, Artificial Sequence
  Description of Artificial Sequence: Synthetic coding sequence
atggagagccgggaccacaacaacccccaggagggccccaccagctcttcaggccgaagggccgccgtggaggacaaccatttgctgatcaaagccgtgcagaacgaagacgtcgatctggtccaacagctcctggagggtggggctaacgttaattttcaagaggaagaaggggggtggacacctcttcacaacgcagtgcagatgtcccgggaggacatcgttgagcttctactgaggcacggggctgaccctgtactgcgcaaaaagaacggtgcaaccccctttatactggcagccattgcaggatctgttaagctactcaagcttttcctcagtaagggcgctgacgtgaacgagtgtgacttttatggctttactgcgttcatggaggcagctgtgtacggcaaagtcaaggccctcaagtttttgtataagagaggagctaatgtaaacctgcggaggaagactaaggaagatcaggagcgactaagaaaaggcggagctaccgccctgatggacgctgcagaaaagggacatgttgaagttctgaaaatcctccttgacgagatgggagccgatgtgaatgcttgcgacaatatgggcagaaacgccctcatccacgccctcctgagtagtgacgatagcgatgtcgaagctatcacgcacttactgctggatcatggcgctgacgtgaatgtaaggggagaaagagggaaaacacccctgattctggcagtcgagaagaagcatctgggtcttgtgcagaggctgctggaacaggaacatatcgagatcaacgatacagactctgacggcaaaaccgcactactgctcgctgtagagcttaagcttaagaagattgcggagctactctgcaagaggggggccagtaccgactgtggcgacctggtcatgactgcacgtagaaattacgatcactcactcgtgaaagttctgctgtctcacggcgctaaagaggacttccatccgccagcagaagattggaaaccccagtcttcgcactggggcgcagctctcaaggatttgcaccgtatttatcggcccatgattggcaagctgaagttctttattgatgagaagtataaaattgcagatacatctgaagggggaatctatctgggattttatgagaagcaggaggttgctgtgaaaactttttgcgagggtagtccgagagctcagcgtgaagtgtcatgcctgcaatctagtcgtgagaacagccacttggtcactttttacggatctgagtcccatcgggggcatttattcgtgtgtgtgactctatgtgaacaaacactggaggcatgcctggacgtacatcggggggaagatgttgaaaacgaagaagatgagttcgctcggaacgtgttgtcttccatttttaaggctgtgcaagaactccatctctcatgtggatatacccaccaggatttacagccacagaacatccttatcgactccaaaaaagctgcgcatttggctgactttgacaaaagcattaaatgggcaggcgatccccaggaggtgaagcgggacctggaggacttaggacggctggtcttgtacgtcgtgaagaaagggagcatttcattcgaagacctgaaggcccagtctaacgaagaagttgtgcagctgtctcctgacgaggagaccaaggacctgattcatcggctctttcacccaggagagcatgttcgagattgcctgagcgatcttttggggcatccgtttttttggacctgggaaagtagataccgcactttaaggaacgtaggcaatgagtcggatatcaaaacccgtaagtcagaaagcgaaattctgcggcttcttcaacctgggccgtcagagcatagcaaaagctttgataaatggaccaccaaaatgtcaaagctcaggcatcgccagataatttttcctacaacacagaaccagtag

SEQ ID NO: 203462 - DNA, 465 bp, Artificial Sequence
  Description of Artificial Sequence: Synthetic coding sequence
atgatcggcaagctgaagttcttcatcgacgagaagtacaagatcgccgatacaagtgagggcggcatttatcttgggttctatgagaaacaggaggtcgccgttaaaaccttttgcgaaggctcacccagggcgcagagagaggtttcctgtttgcagtcgagccgagaaaactcacatttggttacattctacgggagtgaatctcacaggggccatttattcgtgtgcgtaacactctgcgaacagactttagaagcttgtttggacgtgcaccggggtgaagacgttgaaaacgaggaggatgagttcgccagaaacgtgctgagttccattttcaaggccgtacaggagttgcacctgtcttgtggatacacccaccaggatctccagcctcagaatatcctgatcggcccctggaccgctggccccctgtgtggtaaagagggaaagcacctcatctag

SEQ ID NO: 203463 - DNA, 465 bp, Artificial Sequence
  Description of Artificial Sequence: Synthetic coding sequence
atggccggccccgtgaaggaccgggaggccttccagcggctgaactttctgtaccaggccgcacactgcgtcctcgcccaagaccctgagaaccaggccctcgcccggttttattgttacacagaaaggaccatcgcaaagcgcctcgtgctccgtagagacccttcagtgaagcggacactttgcagggggtgctcatcactgctagtccccggcctgacctgcacccagcgccagcgacgatgtaggggacagcgctggacagttcagacttgccttacttgtcagcgttcccaacgattcttgaacgatcccggccaccttctgtggggagatcggcccgaggcccagctgggatctcaggcagacagtaagccattacagccactccctaatacagcccacagtatttccgatcggttgccggaagagaaaatgcaaacacagggcagcagcaatcagtag

SEQ ID NO: 203464 - DNA, 489 bp, Artificial Sequence
  Description of Artificial Sequence: Synthetic coding sequence
atggccggccccgtgaaggaccgggaggccttccagcggctgaacttcctctatcaggctgcacattgcgttctagctcaggacccagaaaaccaggccctggcgcgtttttactgttacacagagcgcactattgcaaaaaggctcgtgctccggagaccgctttctagctcagcccctcgggacccctcagtgaaacgtacactctgccggggatgtagtagtctgttagtacccggcttgacctgcacacagagacaacggcgctgcagagggcagaggtggacagtgcagacttgtttaacatgccagaggtcccagagattcttgaacgatccaggccacctcctgtggggggatcgccccgaggcacagctaggctcccaggccgactcaaagcccctgcagcccctgcctaatactgctcactccatctcagatcggttgccggaagagaagatgcagaccaagggctcatcaaatcaatag

SEQ ID NO: 203465 - DNA, 534 bp, Artificial Sequence
  Description of Artificial Sequence: Synthetic coding sequence
atggccggccccgtgaaggaccgggaggccttccagcggctgaactttttataccaggtgtctctgcgacagggaccacatggtgatggcgcccggagaccgagggtgactgcaccgctgccccaagccgctcattgtgtcctcgcacaggaccctgaaaaccaagctctcgcccgcttctactgttacacagaaagaactattgcaaaacggttagtgctccgcagagacccatcagtgaagagaacactgtgcagaggctgttcttctttgcttgtcccagggttaacttgtacacagagacagcgaagatgccgcggccagagatggacagttcagacatgtctcacctgccagcggtcccaaaggtttctgaatgatcccggccaccttctgtggggcgacagaccggaagcccaactgggctcccaagccgactcgaagccgttgcagccgctgcccaataccgcccactccatctctgatcggctccctgaggagaaaatgcagactcaggggagtagtaaccagtag

SEQ ID NO: 203466 - DNA, 489 bp, Artificial Sequence
  Description of Artificial Sequence: Synthetic coding sequence
atggccggccccgtgaaggaccgggaggccttccagcggctgaactttctctatcaggccgcccattgcgttctcgcccaagaccctgaaaatcaggctttggcacgcttctactgctatactgaaaggacaatcgccaagcgattggttttgcggagaccactgagctctagtgcccctcgggacccgtccgttaaacggaccctctgccgggggtgttcctctttgcttgttcctggactgacctgtactcaccgccagaggaggtgtcggggtcaacggtggactgttcaaacatgcttgacatgtcagagaagccagaggttcctgaatgaccccggtcacttgctatggggtgatcggccagaggctcaactgggctctcaggctgacagcaaacccctccagcccttgcctaacacagctcacagcatctccgacagattgcctgaagaaaagatgcagactcagggcagcagtaaccagtag

SEQ ID NO: 203467 - DNA, 534 bp, Artificial Sequence
  Description of Artificial Sequence: Synthetic coding sequence
atggccggccccgtgaaggaccgggaggccttccagcggctgaactttctctaccaggtgtccttgagacagggcccccacggagatggcgctcggaggcctagggtgaccgcaccactcccacaggcagcacactgtgtattggcccaggatcccgagaatcaggcactagcacgcttctactgctataccgaacgcacaatcgccaagcgactggtcctgcgccgagacccatccgtgaagagaacactatgtaggggctgttcatccctcctcgtcccaggacttacgtgcacccagaggcaacggcgctgtcggggccagcgctggacggtccaaacctgcctcacctgtcagcggtcccagcgttttctgaacgacccaggacatctgctgtggggtgatcggcccgaggcgcagttgggttcccaggctgattccaaacccctgcaaccactaccgaacacagcccattccatttccgacagactgcccgaggaaaagatgcaaaccaaaggatcaagtaaccagtag

SEQ ID NO: 203468 - DNA, 465 bp, Artificial Sequence
  Description of Artificial Sequence: Synthetic coding sequence
atggccggccccgtgaaggaccgggaggccttccagcggctgaacttcctgtatcaggctgcccactgtgtgctcgcccaggaccctgagaaccaggccctggcccgtttttattgctacaccgaaaggacaatcgcaaaaagattggtcctcaggagggaccctagcgtaaagagaactctctgcagagggtgctcttccctactggttcctggactcacttgcactcataggcagagacggtgtaggggtcagcggtggaccgtacagacttgcctgacctgccagcgatcacagcggttcttaaacgatcccggtcatcttctttggggcgaccgcccggaggctcaacttgggtcccaggctgactccaaacctcttcagcccctgccaaatacagcccactctatctctgaccgcctgcccgaggaaaagatgcaaactcagggaagttcaaatcaatag

SEQ ID NO: 203469 - DNA, 435 bp, Artificial Sequence
  Description of Artificial Sequence: Synthetic coding sequence
atggccggccccgtgaaggaccgggaggccttccagcggctgaacttcctgtatcaggccgcgcactgtgtgcttgcccaagatccggagaaccaggccttggcccggttttattgctacacggagagaactatcgccaaaagacttgttctcaggcgggacccaagcgtaaaaaggacattgtgccggggctgttccagcttattagttccagggcttacatgcacccagaggcagcgaaggtgtcggggtcaacgatggaccgtgcaaacctgcctcacgtgtcagagaagccaacgatttctcaacgatcccggccatctcctgtggggtgatcggcccgaggcccagcttggatctcaagcgggagagagattccagactactacgacactagctaagcatagcccacttcatttcagacccccttcctag

SEQ ID NO: 203470 - DNA, 465 bp, Artificial Sequence
  Description of Artificial Sequence: Synthetic coding sequence
atggccggccccgtgaaggaccgggaggccttccagcggctgaacttcttgtaccaggccgcccattgtgttctcgcccaggaccccgaaaatcaagctctggcccgtttctactgctatacagagcggactatcgccaagaggttagtactaagaagggatccttcagtgaagcgtaccctttgtcgcggatgctcaagtctgcttgtgcccggtctgacctgtacgcatcggcagcgcagatgcagaggccagaggtggacagtccagacgtgtcttacctgccagaggtctcagagatttttgaatgacccgggacacttgctgtggggagaccgtcccgaagctcagctcggcagtcaggctgacagcaaacctttacaaccgttgccaaacacagcacattcgattagcgatcgcctgccggaggaaaaaatgcagacccagggtagttctaaccagtag

SEQ ID NO: 203471 - DNA, 465 bp, Artificial Sequence
  Description of Artificial Sequence: Synthetic coding sequence
atggccggccccgtgaaggaccgggaggccttccagcggctgaacttcctgtaccaagcagcccattgcgttctggctcaggatcctgaaaaccaagcgcttgcaagattctattgttacacggaacggaccatcgccaagagactagtgcttcgccgtgacccaagcgtgaagcgtacactctgtcgcgggtgttccagtctactggtacctgggctcacgtgtacccagcggcagaggcggtgtaggggacagcggtggactgtacaaacctgcctgacttgtcagcggtcacaacggttcctgaacgaccctggacacctcttatggggagaccgacctgaggcccaactcggttcgcaagctgattccaaacccctccagccccttcctaacactgcccattccatttccgacaggttgcccgaggagaagatgcagactaaggggtcatcgaaccaatag

SEQ ID NO: 203472 - DNA, 534 bp, Artificial Sequence
  Description of Artificial Sequence: Synthetic coding sequence
atggccggccccgtgaaggaccgggaggccttccagcggctgaactttctgtaccaggtctcccttaggcagggcccccacggagatggcgcgcgcagacctcgggttacagctccgcttccccaggctgcgcattgtgtgctggcccaagatccagagaatcaggcactggcgcggttctattgctacacggagcggaccattgcaaagcggcttgtgctgcgccgcgacccctctgtgaagcgcaccctctgcagaggctgttccagtctcctggtgccaggcctgacttgcactcacagacagcgcagatgcaggggacagcggtggaccgttcaaacctgcctgacttgccagaggtctcagaggttcctcaatgatcccggacatctgttatggggagatcgacccgaagctcagcttggtagccaggccgattctaagccactgcaacccctgcctaatactgcacacagtatcagcgatagactccccgaggagaagatgcaaacgcaaggctcctccaatcagtag

SEQ ID NO: 203473 - DNA, 435 bp, Artificial Sequence
  Description of Artificial Sequence: Synthetic coding sequence
atggccggccccgtgaaggaccgggaggccttccagcggctgaacttcctgtaccaagcggcccactgtgtcctggcacaggatcctgaaaaccaggctctcgcgcgattttactgttacaccgagagaaccattgccaagcgacttgtgctgcgcagagacccatccgtaaaacgcactctttgtagaggatgttcaagcctgttagtgccggggctcacctgcacccatagacagcgccgatgcaggggtcagcgatggaccgtacagacatgtttgacctgccagaggtcgcagcggtttctgaatgatcccggacacttattgtggggcgaccggccagaagcacagcttggaagccaggcaggggaacggttccaaacaacaacaaccctcgctaaacacagcccactccactttcgtcccccctcatag

SEQ ID NO: 203474 - DNA, 465 bp, Artificial Sequence
  Description of Artificial Sequence: Synthetic coding sequence
atggccggccccgtgaaggaccgggaggccttccagcggctgaactttctgtatcaggcagctcattgcgtgcttgcacaggaccccgagaaccaggctcttgccagattctattgttatacagagcgcacaattgcaaagcggttggtcctgagaagagacccaagcgtaaagagaactctctgccgcggatgtagctcacttctggtccctggacttacatgcactcagcgccagcggcgatgtagggggcagcgctggacagtgcagacttgtctcacatgccaaagaagccaaaggtttctgaatgatcctgggcatctgctgtggggcgacaggccagaagcccaactgggatctcaagcagattctaagccactccagccattgcctaacactgcacatagtatttccgaccgactgccagaggaaaagatgcaaacccaggggtcaagcaaccaatag

SEQ ID NO: 203475 - DNA, 489 bp, Artificial Sequence
  Description of Artificial Sequence: Synthetic coding sequence
atggccggccccgtgaaggaccgggaggccttccagcggctgaacttcttatatcaggcggcgcactgcgtgcttgcacaggatcctgaaaatcaggctctggcacggttctactgttacaccgagcggacaatcgctaagcgcctggttcttagaagacccctcagctcatccgctcctagggacccaagcgtgaagcgcaccctctgcaggggttgttcaagtcttcttgtcccaggcctgacgtgtacccagcgccagcggaggtgtcgggggcagcgatggaccgtccagacctgcctaacttgccagaggtcccagcgctttctgaacgaccccggccacctcctctggggtgatagaccagaagctcagcttggatctcaggcggactccaaacctctgcaacccctacccaatacggcacatagtatctctgatcgcctgcccgaagaaaaaatgcaaacacagggaagttccaatcaatag

SEQ ID NO: 203476 - DNA, 435 bp, Artificial Sequence
  Description of Artificial Sequence: Synthetic coding sequence
atggccggccccgtgaaggaccgggaggccttccagcggctgaacttcctctatcaggccgcgcattgtgtgctcgcacaagaccctgagaatcaggccctggcaaggttctactgttataccgagcgtactatagcaaaacgcttggtgctgcgcagagacccttcagttaaacgcacactgtgtcgcggctgcagtagcctactggtgccaggattgacatgtacacacagacagaggagatgccgtggccagagatggaccgtgcaaacctgcctgacctgtcagcgaagccagagatttctgaatgaccccgggcacttactgtggggcgatcgtccggaggctcagcttggatctcaggccggcgagcgcttccagaccaccaccaccctggctaagcactcacccctacacttccgccctccttcctag

SEQ ID NO: 203477 - DNA, 534 bp, Artificial Sequence
  Description of Artificial Sequence: Synthetic coding sequence
atggccggccccgtgaaggaccgggaggccttccagcggctgaactttctgtaccaggtgagtctgaggcaggggccacatggggatggggcgcgccgtccccgcgtaacggctcctctgccccaggctgcacattgcgtcctagcccaagacccggagaatcaggctttggcacgcttttactgctacacggagagaacaatcgctaaacggctagtgctgagacgagacccgagcgttaaacgcacactgtgccgcggctgttcatctctgcttgtgcccggcctcacgtgtacccaacggcagcggcgttgcaggggccagaggtggaccgtgcagacctgcttgacttgtcaacggagccagaggttcttaaatgaccccggacatctgctgtggggcgaccggcccgaggcgcagctgggttctcaggcggacagcaagcctcttcagcccctccccaacacagcacattcaataagtgatcggcttccggaggagaaaatgcagactcaaggctcgtccaatcaatag

SEQ ID NO: 203478 - DNA, 489 bp, Artificial Sequence
  Description of Artificial Sequence: Synthetic coding sequence
atggccggccccgtgaaggaccgggaggccttccagcggctgaacttcctgtaccaggccgctcattgcgtcctcgcccaagatcctgagaatcaggcgctggccagattttattgctacaccgaacgcaccatcgccaagcggctggtgttgaggaggcccctgagctcctcagcacccagagatccgagcgtgaaacgaacactgtgccggggatgctcctccctccttgttcctggactaacatgcacacaccggcaaagaaggtgcaggggacaacgctggaccgttcagacctgtttgacctgtcagagaagccagcgctttttgaacgatcccgggcatcttctctggggtgatcgtcccgaggcgcagctggggagccaagcagattccaagcctctgcaacccctccccaatactgctcattccatttcagaccgtctcccagaagagaaaatgcagactcaaggatcctccaaccaatag

SEQ ID NO: 203479 - DNA, 534 bp, Artificial Sequence
  Description of Artificial Sequence: Synthetic coding sequence
atggccggccccgtgaaggaccgggaggccttccagcggctgaacttcctgtatcaggtttcactgcggcagggaccacacggagatggcgcccggaggccaagagtgaccgcgcctctgccccaggctgcacactgtgtcctggctcaggaccctgagaatcaggcactggctcgattttactgttataccgagcgcacgatcgcaaagcggctggttcttcgccgcgatcccagcgtcaaaagaaccctgtgtcggggatgtagcagcctgctagtcccgggactgacttgcacccagaggcagcgccgctgtcggggccagcgttggacggtacagacttgtctgacatgtcagcgctcacaacggttcctcaacgaccctgggcacctcttgtggggagatagacccgaagcgcagctgggcagccaggcggacagcaaaccactacagcccctcccaaacacggcacattctattagtgatcgcctacccgaggaaaaaatgcagacgcaggggtcaagtaatcagtag

SEQ ID NO: 203480 - DNA, 489 bp, Artificial Sequence
  Description of Artificial Sequence: Synthetic coding sequence
atggccggccccgtgaaggaccgggaggccttccagcggctgaactttctgtatcaagcggctcactgcgttttggcacaggatcctgagaatcaagctttagcccggttttactgttatacagaacggaccatcgcgaaacgattggtacttaggaggcctctgtctagctctgcaccgagggaccctagcgtgaaaaggacgttatgtcgggggtgcagcagtttgctggtccctggcctgacctgtacacaaaggcaacgacgatgtcgcggacagaggtggaccgtgcagacctgtctgacctgccagagatcccaacgatttttaaacgatcctgggcacctcctctggggtgatcggcccgaagcgcagttgggtagccaggctgattccaaaccccttcagccacttcccaataccgcacactccatctcggacaggctccccgaggaaaagatgcagactcaggggagttctaatcagtag

SEQ ID NO: 203481 - DNA, 465 bp, Artificial Sequence
  Description of Artificial Sequence: Synthetic coding sequence
atggccggccccgtgaaggaccgggaggccttccagcggctgaactttctttaccaggccgcccactgtgtacttgctcaggacccagagaatcaggccctagctcgattctactgctacaccgagaggacaatagccaaaagacttgttctgagacgggacccgagcgtcaagagaacgctctgtaggggatgctcttctctgctcgtgcccggtctcacttgcactcatcgccaaagacgctgccgcggacagcggtggactgttcagacctgtctaacatgccaacggtctcagcggtttttaaacgatcctgggcacctgttgtggggtgatcggcctgaggctcagttggggtcacaggccgactccaaacctttacagcccctccccaacacggcccatagtatctctgatcgcctccccgaagagaaaatgcaaactcagggttcctccaaccagtag

SEQ ID NO: 203482 - DNA, 435 bp, Artificial Sequence
  Description of Artificial Sequence: Synthetic coding sequence
atggccggccccgtgaaggaccgggaggccttccagcggctgaactttctataccaggccgcccattgtgtgctggcacaggatccagagaaccaagcattggccagattttattgttacacagagagaacaattgctaaaagactggtcctgcgaagagacccttccgtgaaacgaacactgtgccgaggatgttcatctcttctcgtcccgggcctgacttgcacacagagacagagacggtgccggggtcagagatggacagttcagacctgtttgacgtgtcaaaggtcccagagattcctcaatgatcccggccacttactgtggggcgaccgaccagaagcccagcttggatcccaagccggggaaaggtttcaaactacaaccactctggccaaacactccccactgcactttagacccccctcatag

SEQ ID NO: 203483 - DNA, 435 bp, Artificial Sequence
  Description of Artificial Sequence: Synthetic coding sequence
atggccggccccgtgaaggaccgggaggccttccagcggctgaacttcctgtatcaggccgcccattgcgtgttagctcaagatcctgaaaatcaggccctggccagattttactgttataccgaacggaccattgcgaagagacttgtcctgagacgagacccaagtgtcaaacgtacactgtgcagaggatgttcatctctgttggtgccaggtctcacctgcacccagaggcaaagacggtgtaggggacagcgttggactgttcagacctgcctgacgtgccagcgcagtcagaggttcttaaatgaccccggtcacctgttgtggggcgatcgccctgaagctcagctgggaagtcaagccggcgagcgtttccagaccacaacaaccttagcaaagcattccccgctccatttccggcctccctcttag

SEQ ID NO: 203484 - DNA, 435 bp, Artificial Sequence
  Description of Artificial Sequence: Synthetic coding sequence
atggccggccccgtgaaggaccgggaggccttccagcggctgaactttctctatcaggctgcccactgcgtactcgcccaggatcctgagaaccaggcgctcgcccggttttattgctacactgagcgtactatagctaagcgccttgtgctgagaagggacccatcagttaaacgtaccctttgtcgtggctgcagttcccttctggttccaggtctcacatgtacccaacgccagaggaggtgtaggggtcaaagatggacagtgcagacgtgtctgacatgtcagcggtctcagagattcctgaacgaccccggacatctgttgtggggcgatcgccctgaggctcagctggggtcccaagccggggagcgatttcaaactaccaccactctcgccaagcactcccctctgcattttcggcccccttcctag

SEQ ID NO: 203485 - DNA, 534 bp, Artificial Sequence
  Description of Artificial Sequence: Synthetic coding sequence
atggccggccccgtgaaggaccgggaggccttccagcggctgaactttctctaccaggtgtccctgcgccaggggcctcatggcgacggcgctaggaggcccagggtcactgctccactcccccaagcagcccactgcgtcttggcccaggatcctgagaaccaggccctggccagattttactgctacacagagaggacgattgcgaagcgactggttctgcgcagagaccctagcgtgaagagaacactatgtcggggatgctcctccctgctggtgcctggacttacgtgtactcatagacagcggcgctgccggggacagcgttggactgtccaaacctgtcttacctgccagaggtctcagaggtttttgaatgatcccggccacctgctctggggagaccgcccagaagcccaactgggaagccaagcggacagcaagcccttgcagcctctcccgaacacagctcactcgattagcgaccggctcccggaggagaagatgcagacccaggggagctctaatcagtag

SEQ ID NO: 203486 - DNA, 435 bp, Artificial Sequence
  Description of Artificial Sequence: Synthetic coding sequence
atggccggccccgtgaaggaccgggaggccttccagcggctgaacttcttgtaccaggcggctcactgtgtgctcgcgcaggatccagagaaccaggctctggccagattctattgttacactgaacggactatcgctaagcgcctggtgctgcggcgagacccctcagtgaagcggaccctgtgccggggctgcagctcattgttggtaccaggattgacctgcacacataggcagaggcggtgtagagggcaaaggtggaccgtacaaacctgtctcacctgccagcgatcccagaggttcctaaacgaccccggccatctactctggggagataggccagaggcacagctcggttcccaggcgggagaacggttccaaaccacaaccacattagccaagcactctcctctccactttagacccccttcatag

SEQ ID NO: 203487 - DNA, 465 bp, Artificial Sequence
  Description of Artificial Sequence: Synthetic coding sequence
atggccggccccgtgaaggaccgggaggccttccagcggctgaactttctctaccaagccgcccactgtgtgttggcccaggatcctgaaaaccaagctctggccagattctactgttataccgaacgaaccattgccaagcgcctggtcttgcgtagagatcccagtgtaaagcggacactctgtcggggatgctccagcctgctggtgcctggtctcacttgcacccagaggcagcggcgatgtagaggccagagatggaccgtgcagacatgtcttacttgtcagaggagccagcggttcttgaacgaccctgggcatctgctctggggagacaggcccgaggctcagctggggtctcaggccgatagcaaacccctgcagccattaccaaataccgcacactcgatatctgacaggcttcctgaagagaagatgcagactcagggatcatcgaaccagtag

SEQ ID NO: 203488 - DNA, 534 bp, Artificial Sequence
  Description of Artificial Sequence: Synthetic coding sequence
atggccggccccgtgaaggaccgggaggccttccagcggctgaacttcctctatcaggtgtctctgcgacaagggccacacggggacggtgctaggcgaccccgggttaccgctcccctgccacaggctgcacactgtgtgcttgcccaggatcctgaaaaccaggccctggcccggttttattgctacacagagaggactattgcgaagcggctggttctgagaagagatccttccgtgaagcgaaccttgtgtcggggctgtagcagcctcttagtgcctggcctaacctgtacccaccgccagcggcggtgtagaggccagagatggacagtccagacatgtctgacatgtcagaggtcccagaggttcttgaacgatccaggccatcttttatggggcgaccggcctgaagctcagctggggagccaggcagattccaaacccttgcaacctctgccaaatacagcacacagcatatctgacaggctccccgaagagaaaatgcagacccaggggagttcgaatcagtag

SEQ ID NO: 203489 - DNA, 489 bp, Artificial Sequence
  Description of Artificial Sequence: Synthetic coding sequence
atggccggccccgtgaaggaccgggaggccttccagcggctgaactttctataccaagcagcccattgtgtcctcgcacaggatcctgaaaatcaggccttagctaggttctactgttatactgaacgtacaatcgccaaaagactcgtcctgcgccgccccctgtcttccagtgccccacgagatccaagcgtgaaaagaactctttgccgcggttgttcctccctcctggtgcctggcctgacttgtacacagcggcagcggagatgcagaggacagcgatggacggtacaaacctgtcttacatgtcagaggtctcagcgctttctgaacgaccccggtcacctgctgtggggcgataggcccgaagctcagctgggctcacaggccgacagtaagccactgcaacctctgccaaatactgcacacagtatctctgatcgactgcctgaagagaagatgcagactcaggggtcctccaatcagtag

SEQ ID NO: 203490 - DNA, 489 bp, Artificial Sequence
  Description of Artificial Sequence: Synthetic coding sequence
atggccggccccgtgaaggaccgggaggccttccagcggctgaactttctctaccaggccgcccattgcgtattggcccaggacccggagaatcaagctctggcaaggttttactgttataccgagcgaaccattgccaagagactggtcttacgccgccccctctccagttcagctcctcgcgacccctccgtcaagagaacgctatgtcgaggctgctcaagcctgcttgtgcctggcctcacttgtacgcatcgacagcgccggtgcaggggtcagcggtggactgtgcagacttgcttaacatgccaaagaagccagaggttcttaaacgatccagggcacctgctgtggggagacagacccgaagcccagcttggctcccaggcagatagcaaacctttgcagccgctgcccaacactgcccacagcatttctgatcgtttgcctgaggaaaagatgcagactcagggatcttccaaccagtag

SEQ ID NO: 203491 - DNA, 765 bp, Artificial Sequence
  Description of Artificial Sequence: Synthetic coding sequence
atggccgtgttcgccgacctggacctgcgggccggcagcgacctgaaagcccttcgcggacttgtggagaccgccgctcaccgtgaattgccacgcttgagggcctggccaacctcttgtcatccagaccacagggcgaccctgcgtattggctattctgtggtggctatcaaccacattgtcgactttaaggagaagaagcaggagatcgagaagcctgttgccgtgtctgagctgttcacaactcttcccatagttcaaggcaaatcccggccaattaagattctcacccggctcacgatcatcgtttcagacccgagtcattgtaatgtcttacgcgccacaagttctcgtgccaggctttacgacgtggtcgccgtcttcccaaaaacagagaaactcttccacattgcttgcacccaccttgatgtggacctggtgtgcatcactgttactgagaagctgccgttctacttcaaacgtcctccaattaacgtagcaatcgacagaggactggccttcgaattagtgtactcccctgcaatcaaggattcaaccatgaggcgttatactatctcttccgcactgaacttaatgcagatttgtaaagggaagaacgttatcatctcctcagccgccgagagacccttagaaattcggggcccttatgacgtggcaaatctgggacttctttttggcctgtccgaatccgacgccaaagccgctgtttcaacaaactgccgcgcggccctgctgcatggctag

SEQ ID NO: 203492 - DNA, 807 bp, Artificial Sequence
  Description of Artificial Sequence: Synthetic coding sequence
atggccgtgttcgccgacctggacctgcgggccggcagcgacctgaaggctctgcgcggactcgtagagactgctgcacatttgggctactccgtggtggcaatcaatcatattgtggacttcaaagaaaagaagcaagagattgagaaacctgtggcagtgtctgaactcttcaccactctgcccatagtacagggcaaaagccggcccatcaaaatcttaacacgcctcactatcattgtttccgaccccagccattgcaatgtgctacgggcaacgagctcgagagcccgcctctacgatgtagtcgccgtgttccctaagacagaaaagctgtttcacatcgcatgcacccatctcgatgtcgatcttgtttgcataacagtcacagagaaactgcccttttattttaaacgacccccaatcaatgtggccatcgacaggggactcgcttttgagttggtgtacagtcccgccattaaggatagtacgatgaggaggtacaccatctctagcgctctgaacttaatgcagatttgtaagggcaagaatgtgattatcagctcagctgccgaacggccgttggagatccgggggccatacgatgtcgcaaacttgggccttctcttcggccttagcgaatctgacgcaaaggccgctgtcagcacaaactgcagggccgccctgctgcacggtgagacaaggaagacagcctttggaattatttcaacagtaaagaaacctcgaccctccgaaggcgatgaggattgtctacccgcatccaagaaagcaaaatgtgagggctag

SEQ ID NO: 203493 - DNA, 768 bp, Artificial Sequence
  Description of Artificial Sequence: Synthetic coding sequence
atggccgtgttcgccgacctggacctgcgggccggcagcgacctgaaagctctgcgaggccttgtggagactgcggctcatcttggctattccgtggtcgccataaaccacatagtggacttcaaagagaagaaacaggaaattgagaagcctgtggccgtgtccgaattatttacaaccctacccattgtgcagggcaagagccggccaatcaagattttgaccaggctcaccatcatcgtgtcggatccctctcactgtaatgtattacgcgccacatcttctagagcacgattgtacgatgtggtggccgtcttccctaaaactgagaaactgtttcacatcgcgtgtacacacctcgatgttgacctcgtctgcattacagtgacggagaagttacccttctactttaagcgaccacctattaacgtggccatagatagaggcctagccttcgaactcgtctactctccagccatcaaggattcaaccatgagacgctacaccatatccagcgccctcaatctgatgcagatttgtaagggtaaacctctggagatcagaggaccctatgatgtcgccaacctgggtctgttattcggcctgagcgaaagcgacgcaaaagccgctgtcagcactaactgccgcgcagcgttactccacggagagactagaaagacggcctttgggataatttccacagtgaaaaagccacgaccaagtgagggggatgaggattgtctgcccgctagtaagaaagccaaatag

SEQ ID NO: 203494 - DNA, 969 bp, Artificial Sequence
  Description of Artificial Sequence: Synthetic coding sequence
atggccgtgttcgccgacctggacctgcgggccggcagcgacctgaaggctttgcgcgggctggtggagaccgccgctcacttagggtattcagtagtagctatcaatcacatcgtcgactttaaagaaaagaaacaggaaatcgaaaaacctgtggcagtgtccgagctgttcaccactctcccaatagttcagggtaagtctcgccctattaaaattctaactaggctcactatcatcgtttccgacccttctcactgcaatgtacttcgcgcaacctctagcagggccaggctttacgacgtggtagcggttttccctaagacagaaaaactcttccatatagcatgcacacaccttgacgtggatctggtatgtataacagttacagagaaactgccattttactttaagcgcccccctattaatgtcgcaattgaccgcgggctggcattcgagctggtgtacagtcccgcaatcaaggacagtaccatgaggcgctacactatcagcagcgctttgaatctgatgcagatatgtaaaggcaaaaatgtgattatttcaagcgctgctgaacgtcccctcgagattagggggccatatgatgtggccaatctcggattgttattcgggctcagtgaaagtgacgcgaaagccgcggtgtctactaattgcagagcggccctgctccatggcgaaaccaggaaaaccgccttcggcataattagtactgttaagaagccccggccttctgagggagatgaagactgccttccagcgtccaagaaggctaagtggtcccacagcgtgacccaggccggcgtgcagtggcacaatctaggctccctgcagcctttgccactaggcctgaagcccagctcccatctcagcctgcccagaacccgaatccaacagagacaactcctcattagccaccagagggatcatacacccaaaaatcgattgtag

SEQ ID NO: 203495 - DNA, 639 bp, Artificial Sequence
  Description of Artificial Sequence: Synthetic coding sequence
gagatcgagaagcccgtggccgtgagcgagctgttcaccaccctgcccatcgttcagggtaagtcacgaccaattaaaatcctcacgagactgaccatcatcgtgtccgacccttcccattgcaacgtcttgagagccacaagttctcgggctcgtttgtacgacgtggtggcggtattccctaagacagagaagctcttccacatcgcctgtacgcatctggatgtggacttggtctgcatcaccgttacagaaaaacttccattctactttaagagacccccgattaacgtggcgatagaccgtggtctagcctttgagttggtctatagtccagccattaaagactctacaatgaggcggtataccatatcctctgctcttaatctcatgcagatttgtaaaggtaagccactggaaatcaggggcccatacgacgtggcgaacctagggcttctctttggcctcagcgaaagcgacgctaaggctgcggtgtccaccaattgtagagcagcactgcttcatggggaaacccgtaaaaccgccttcggcattatctccacagtgaaaaaaccacggccctccgagggagacgaagactgtctgcccgcgtctaaaaaggctaaatgtgagggctag

SEQ ID NO: 203496 - DNA, 852 bp, Artificial Sequence
  Description of Artificial Sequence: Synthetic coding sequence
atggccgccgccccccaggcccccggccggggcagcctgcggaagaccaggccactggtggtgaaaacctcccttaacaacccttatatcatccgatggagtgcgctggagtccgaggatatgcatttcatcctgcagaccctggaggatcggttgaaggcaatcgggttgcaaaagatcgaggacaaaaagaaaaagaacaaaacccccttcctcaaaaaggaatccagagaaaaatgctcaattgccgtggatattagcgaaaatctgaaggagaagaagacagatgccaaacagcaggtgtcaggttggactcctgcccacgtccgcaagcagctcgctatcggggtgaacgaggtaacgcgggctctggagcgccgcgaactgttgctagtcctggtgtgcaagtcggtaaaaccagcaatgattacgagtcacttgatacagctgagtttgagccgctccgtgcctgcttgtcaggtgccacgactgagcgaacgcattgctccagtgatagggctcaaatgtgtgctcgccctcgcttttaaaaaaaatactactgacttcgtagacgaagtgagagctatcatcccacgggtgcctagcctgagcgtgccctggttacaggaccgaattgaggacagcggcgaaaacctggaaacggagccattggagagtcaagatagggagctcctcgatacctcctttgaggatctgtctaaacccaaaagaaagctcgctgacggtagacaagcatccgtgaccctacaaccccttaagatcaaaaagctgattcccaatcctaataagattcgaaagcccccaaaatcaaagaaagcgacacctaaatag

SEQ ID NO: 203497 - DNA, 504 bp, Artificial Sequence
  Description of Artificial Sequence: Synthetic coding sequence
atggccgccgccccccaggcccccggccggggcagcctgcggaagaccaggcctctggtggttaaaacttctttaaacaatccctatatcattcgatggtcagctcttgagagtgaggacatgcatttcatactccagaccttggaagatcgcctcaaagcaataggactccagaaaattgaggataagaagaagaaaaataaaactccctttctcaagaaggagagtagagagaagtgtagcatcgctgtggatattagcgagaatctgaaggagaagaagacagacgcaaagcagcaagtgagcgggtggacgccagcccatgtcaggaagcagttggccattggcgttaacgaggttacccgcgcactcgaacggcgtgagttgctcctggtcctggtgctgactcttctgcctcgtttagagtgctcaggggtgatccccgcccactgcaatccggcttcatgggttcaggccatcttactgccccagccccctgaatag

SEQ ID NO: 203498 - DNA, 852 bp, Artificial Sequence
  Description of Artificial Sequence: Synthetic coding sequence
atggccgccgccccccaggcccccggccggggcagcctgcggaagacccggcctctggtcgtgaagacaagtttgaacaatccttatattatacgctggtcagccctggagtcagaggatatgcactttatccttcagacactcgaggatcggttgaaggccattgggctccagaaaatcgaagataagaagaagaaaaacaagactcccttccttaagaaagaatctagagagaagtgcagcattgctgttgatatatctgagaatcttaaagaaaaaaaaaccgacgctaagcagcaggtctcaggctggacaccggcacacgttcgtaagcagctggccatcggcgttaatgaagttacacgtgctcttgagcgtagagagctgctgctggtgctcgtctgcaagtcagtgaagcctgctatgattacttcccatcttattcagctctctctgagtcgctctgttccggcatgccaagttccgcgattgagtgaaagaatcgctccggtgatcggcctgaagtgtgttttggctttagctttcaagaagaatacgactgacttcgtcgatgaagtccgcgccattatccccagggtcccttccctttctgtaccgtggctgcaggaccgaatcgaggattctggagagaatctggaaacagagccgctggagtcacaggacagggagcttctggacacaagctttgaggacctcagcaagccaaagcggaaactcgccgacggccgacaggctagtgtgaccctgcagccactcaaaatcaagaaattgattccaaaccctaataagattcgcaagcccccgaagtctaagaaagccaccccaaaatag

SEQ ID NO: 203499 - DNA, 852 bp, Artificial Sequence
  Description of Artificial Sequence: Synthetic coding sequence
atggccgccgccccccaggcccccggccggggcagcctgcggaagacgcggccattggttgttaaaacctccctgaataacccctatattatcaggtggagtgccctggagagtgaagatatgcacttcatcttacagactctggaagaccggttgaaagcgataggcctgcagaagatagaagataaaaaaaagaaaaataaaacacccttccttaaaaaggagagccgcgagaaatgtagcatcgctgttgatatctccgagaacctcaaggaaaagaaaactgatgcaaaacagcaggtaagcggctggacaccagcccatgtgagaaagcagctggccatcggagtcaatgaagtgacaagggccctcgaacgcagagagcttttacttgtgctagtgtgcaagtccgtcaagcccgcaatgattacatcacatttgatccagctgagcctgagtcggagcgtgcccgcctgtcaggtaccacgcttgtcagagcgtatcgcgccagtgattggcctgaaatgcgtgctcgctttggcttttaaaaaaaacaccaccgactttgtcgacgaggtcagggctattatccctcgggtgcccagcctctctgttccttggctacaggaccggatcgaggactcgggcgagaaccttgagactgagcctttggagtcccaggacagagagttgctcgatacttcattcgaggacctgagtaaacctaagcgcaaactggccgatgggcgtcaggctagcgtcaccctgcaacctttgaagattaaaaaactgatcccaaacccaaataaaattcggaaaccccccaaatcgaagaaggcaacccctaagtag

SEQ ID NO: 203500 - DNA, 510 bp, Artificial Sequence
  Description of Artificial Sequence: Synthetic coding sequence
atggccgccgccccccaggcccccggccggggcagcctgcggaagacccggcccttggtcgtgaagacaagccttaataacccttacatcatccgctggtccgctcttgaaagcgaggacatgcattttattctgcagaccctggaagatcgtcttaaggcaattggattgcagaagatcgaagacaaaaaaaagaaaaacaagaccccattcctgaaaaaggaatcccgcgaaaagtgctccattgccgtagatatttcagagaatctgaaggaaaaaaagaccgatgcgaagcagcaggtcagtggatggactccggctcatgtacgcaaacagctagctataggcgtcaacgaagtcacgcgcgcactggagcgcagggaactgctccttgtactggtatgcaagtcagtaaagccagcaatgatcaccagtcatttgatccaactgtccttgtcccgctcagttcccgcttgccaagttccacggctgtctgagagaattgcctag

SEQ ID NO: 203501 - DNA, 1092 bp, Artificial Sequence
  Description of Artificial Sequence: Synthetic coding sequence
atggccaccctgcggcggctgcgggaggccccccggcacctgctggtgtgtgagaaatcgaacttcggcaaccacaagtcacgccatcgccacctggtccaaacacattactacaactatagggtctctttcctcattcctgaatgcggaatcttgtccgaagaactcaaaaacctggtgatgaacacgggtccttactatttcgtcaaaaatctaccgcttcatgaactcataactccggagttcatttctaccttcattaagaaaggatcctgttatgcgttgacctacaacacgcacattgacgaagacaataccgttgcgttgctccctaacggcaagctcatactgtctttagacaaagatacgtatgaggaaactggcctgcagggccacccaagccagtttagcggtcgaaagattatgaaattcatagtttccattgatctgatggagctgagtctgaacctcgacagtaagaaatacgaacgaatctcatggtcttttaaggagaagaaaccgctgaagttcgatttcctgctggcttggcataagaccgggtctgaagaatccacgatgatgagctactttagcaagtaccagatccaggagcaccagccaaaggtagccctttctaccttacgggatctccagtgcccggtgttacaatcctctgagttggagggtactcccgaggtcagttgccgagccctggaattgttcgattggctgggggctgtgtttagtaatgttgacctgaataatgaaccgaataattttatctccacatattgttgccctgaaccatctaccgttgtagcgaaggcctacttgtgtaccattactggtttcatcctcccggagaagatctgccttctgctcgaacacctgtgtcattattttgacgagccaaaactcgccccctgggtgactctcagcgtccaaggctttgccgatagcccagtgtcctgggaaaagaatgagcacggattcagaaaaggaggggagcatctctacaattttgtgatcttcaataaccaggattactggcttcagatggcagttggagccaatgaccattgtcctccgtag

SEQ ID NO: 203502 - DNA, 912 bp, Artificial Sequence
  Description of Artificial Sequence: Synthetic coding sequence
atgaacaccggcccctactacttcgtgaagaacctgcccctgcacgaactgatcactccagaatttatctcaacatttataaaaaagggcagctgttacgcgctgacttataatacccatatcgacgaggataacacagttgcgctgctgcctaatggaaaactgatactgtccctggataaggatacctacgaggagaccggcttgcagggacatcctagtcagtttagcggccgcaagattatgaagttcatagttagtattgacctgatggagctaagtttaaacctcgatagcaagaaatacgagagaattagctggagctttaaggagaaaaaacccctgaaatttgacttcctgctggcatggcataaaaccgggagcgaggagagtacgatgatgagctactttagcaagtatcagatccaggaacatcagcctaaggttgctttatctacattgagagacttgcagtgtcccgtcctacagagtagcgaactggaaggcactccagaagtttcttgcagagctcttgaactgtttgattggctgggagctgtgttcagcaatgtcgacctcaataatgagcccaacaatttcatttctacctactgttgtccggagccctcgaccgtcgtggccaaggcatacttgtgcactatcactggattcattttacccgaaaagatttgcttgctcctcgagcacctgtgtcattactttgacgagcctaagctggctccgtgggtgaccttgagtgttcagggattcgccgactcccccgtcagctgggagaaaaatgagcatggatttaggaagggaggagagcatctctacaacttcgtaatttttaacaaccaggactactggctgcagatggctgtcggagccaatgaccactgtccgccttag

SEQ ID NO: 203503 - DNA, 717 bp, Artificial Sequence
  Description of Artificial Sequence: Synthetic coding sequence
atgcggcccgccgccctgcggggcgccctgctgggctgcctgtgcctggccctcctgtgcctgggtggcgccgacaaacgattgcgcgacaaccatgagtggaagaagctgatcatggtacaacactggccagagactgtatgcgagaagattcaaaatgattgtagggaccctcctgattactggaccattcacggactatggcctgacaagtctgaaggatgcaatcgtagctggcccttcaaccttgaggagatcaagaagaattggatggagatcaccgacagctccctgccctccccctctatgggacctgcaccacccaggtggatgcgctctactccccgacgctcaacgctcgccgaggcttggaattcaactggctcctggacatcaacaggaggatgcgctttaccacctgcagctctcccctctggcgatctttgttgccgcccatcattaactgccggatcacgaggagtcggagtggatctcacagcgctgcaacaattacttcacgttcactatagtgccacagggattatcccagaggaatgctcagagcctaccaaaccattccagattatcctacaccatgatcacacggaatgggtgcaaagtattggcatgcccatttggacaatttccagtagtgagtctgctatcggaaaaacacgaacccagcctgcttgtgctgtcttgtcgcatgattcttag

SEQ ID NO: 203504 - DNA, 624 bp, Artificial Sequence
  Description of Artificial Sequence: Synthetic coding sequence
atgcggcccgccgccctgcggggcgccctgctgggctgcctgtgccttgcactcctatgcctagggggcgctgataaaagacttagagacaaccatgagtggaagaaactgatcatggtgcagcactggcccgaaactgtgtgtgagaagatacagaacgattgtagggatccaccagattactggaccatccacggactctggcccgacaagtctgaagggtgtaatcggagctggccgtttaacctggaggaaatcaagaaaaactggatggagataacggattcttcgctgccatccccctccacagacctcctgccagaaatgcgggcatactggccagatgtcattcacagttttccaaatcgaagcagattctgtggaacatgtgccgctcaagtagacgccttgaatagtcagaaaaaatattttgggcgatcactggagctttacagagaattggacctcaaccgctgggtgcggccaagtcctgggtgtaccagtcagtgggggtccctgctgagccctaagcctgatagctggattcagggaagtggctgtcgacctcactgccccccagccgccagcgcttgtgctctcttcggatactgggaccatagctag

SEQ ID NO: 203505 - DNA, 921 bp, Artificial Sequence
  Description of Artificial Sequence: Synthetic coding sequence
atgcggcccgccgccctgcggggcgccctgctgggctgcctgtgcctggccctgctctgcctggggggtgctgataaacggttgcgcgacaaccatgagtggaaaaaactgattatggtccagcactggcctgaaacagtgtgcgagaagattcagaatgattgccgtgatccgccagactactggacaattcacggcctctggcaagttagccatacctcccggcgaggtctcttattccttttcaaaaatatcttctctctgagctctcgcaattttagcttctattcgctgcagacaagtatgaaaaaacctccacagccctctttgatcttcctgatttttagcttcaagcccgataaatctgaaggttgcaatagaagttggccttttaaccttgaagagatcaaggatctcttgcctgaaatgagggcatactggcctgacgtcatacactccttcccaaatcgatctcgtttctggaaacacgagtgggagaagcatggcacgtgcgctgcccaggttgatgccctcaacagtcagaagaaatacttcgggcgttcactggagctgtatcgagagctggacctgaattccgtgctactgaagctggggattaaaccaagtattaactactaccaagtggccgactttaaagatgcacttgcccgtgtgtacggcgtgatcccaaaaatccaatgtctgcctccatctcaggacgaggaggtgcaaacaatcggccaaatcgaactgtgcctgaccaaacaggatcagcagcttcaaaattgtacggagcccggcgagcaacccagtccgaagcaggaagtttggttggcaaacggagctgctgaaagtcgagggctgcgagtgtgcgaggacgggccggtgttctacccacccccgaaaaagacaaaacactag

SEQ ID NO: 203506 - DNA, 771 bp, Artificial Sequence
  Description of Artificial Sequence: Synthetic coding sequence
atgcggcccgccgccctgcggggcgccctgctgggctgcctgtgcttggccttgctgtgtcttgggggtgctgataaaagactgcgcgacaatcacgaatggaaaaagttaatcatggtccagcactggcccgaaacggtgtgtgagaagatccaaaacgattgtagggatccccccgattactggactatacacggattgtggccggacaagtccgaaggctgtaacaggtcctggccgtttaacctcgaggagatcaaagatctcttgccagaaatgagagcatactggcccgatgtgatccattcatttcctaacagaagtcgtttctggaaacacgagtgggaaaagcatgggacctgcgcagcccaggttgatgctctcaatagtcaaaaaaagtactttggccgaagcctagagctttatagggaactggaccttaactcggtgctgctgaagcttggaatcaagccctccataaattactaccaggtcgccgactttaaggacgccctggctcgtgtgtacggagttatccccaagatccagtgcctccccccttcccaggatgaagaggtccagaccataggacaaatcgagctttgtcttacaaaacaggaccaacagctgcagaactgcactgagcctggagagcagccgtccccaaaacaggaagtgtggctggccaatggtgccgcagaatctaggggacttagagtgtgtgaagatggacccgtgttctatcctccaccgaagaagacaaagcattag

SEQ ID NO: 203507 - DNA, 765 bp, Artificial Sequence
  Description of Artificial Sequence: Synthetic coding sequence
atgcggcccgccgccctgcggggcgccctgctgggctgcctgtgcctggctctgttgtgtctcggaggcgccgataagcggcttcgtgataatcacgaatggaagaagctaattatggttcagcattggccggagaccgtgtgcgagaaaattcaaaacgattgtagagatccccctgactactggactatccacgggctttggcccgataaatccgaaggttgtaacaggtcatggccgtttaacctggaagaaataaaagacctgttaccagagatgagagcttattggccagacgttattcattcttttcccaaccgatcgcgcttctggaaacatgagtgggagaaacacggcacatgcgcggctcaggttgatgccctaaatagccagaaaaagtacttcggccgtagcctggagctgtatcgggagcttgacctaaactcagtgctcctcaagctgggtatcaaacccagcatcaattactatcaggtcgccgactttaaggatgccctagccagggtctacggcgtgatcccaaagatccagtgtctgccgccttcccaggatgaggaagttcagacgatcggacagattgaactgtgcctgacaaaacaagaccaacaactgcagaattgtacagagccgggcgaacagccatcccctaagcaagaggtgtggttggcaaacggggcagcagagtcccgggggctgagagtgtgcgaggacgggcccgttttctaccctcctcccaagaagacttag

SEQ ID NO: 203508 - DNA, 771 bp, Artificial Sequence
  Description of Artificial Sequence: Synthetic coding sequence
atgcggcccgccgccctgcggggcgccctgctgggctgcctgtgccttgctctgctttgtctgggtggggcagacaaaaggttgcgcgataaccacgaatggaaaaaactaataatggtacagcactggccagagactgtctgcgaaaagatccagaacgactgtcgtgatcctcctgattactggaccatccacggtctgtggcccgataagtctgagggctgtaaccgttcttggccctttaacctggaggagattaaggacctcttgccagaaatgagagcctattggccggatgttattcactcattccccaatagaagcagattttggaagcatgaatgggagaaacacggtacgtgcgcggctcaggtcgatgcattaaactcccaaaagaaatacttcggccgttcactcgagttgtaccgggagttagacttaaattctgtcctgctgaagctcggcattaaacccagcattaattactatcaggtggctgattttaaggacgcattagcacgggtctacggggtgatccctaagattcaatgcctaccgccctctcaggatgaagaagttcagaccatcggtcagatcgagctttgcttgaccaaacaagatcagcagcttcagaattgcacagagccgggcgaacaaccgagccccaagcaagaggtctggttggcaaatggagccgctgagtcccgcggattgagggtgtgcgaggacggccccgtgttttacccccccccaaagaaaacaaagcactag

SEQ ID NO: 203509 - DNA, 471 bp, Artificial Sequence
  Description of Artificial Sequence: Synthetic coding sequence
atggccctggagaagagcctggtgcggctgctgctgctggtgctgatcctgctggtcctcggctgggtccagccctcactggggaaggaaagtcgggccaagaagtttcaacgccagcatatggactctgacagcagtcccagcagttcttcgacgtactgtaaccaaatgatgcggagaaggaatatgacacaaggccggtgtaaaccagttaacacgttcgtccatgagcctctggtggacgtccagaacgtttgtttccaggaaaaagtcacttgtaaaaacggacagggcaactgctacaagtccaacagttccatgcatatcaccgactgtcgactaacaaatggttctagataccctaattgcgcttacagaacctcacccaaggaacgccacatcatcgtagcctgcgaagggtccccttatgtgccggtccacttcgacgcttccgtcgaagattccacttag

SEQ ID NO: 203510 - DNA, 471 bp, Artificial Sequence
  Description of Artificial Sequence: Synthetic coding sequence
atggccctggagaagagcctggtgcggctgctgctgctggtgctgatcctgctggtcttggggtgggtacaaccatctctgggtaaagagagccgcgccaagaaatttcagcgccagcacatggacagcgatagtagtcctagttcctcgagtacgtactgcaaccagatgatgcggcgcaggaatatgactcaagggcggtgtaagcccgtgaacacctttgtccatgagcctcttgtggacgtccaaaacgtttgctttcaagaaaaggttacttgcaaaaacggccagggcaactgttacaagtctaactcatcaatgcacattacagattgtcgcctgacgaatggaagcagatacccaaactgtgcatacagaactagtcctaaggagcgtcacatcatagtggcgtgcgagggctccccatacgtgccggtccacttcgatgcctccgttgaagattccacctag

SEQ ID NO: 203511 - DNA, 471 bp, Artificial Sequence
  Description of Artificial Sequence: Synthetic coding sequence
atggccctggagaagagcctggtgcggctgctgctgctggtgctgattttactggtgctgggctgggtgcagccaagtctgggcaaagaatctagggctaaaaaattccagaggcagcatatggattccgatagctctccctcctctagcagcacatactgcaatcagatgatgcggaggcgaaacatgactcaggggcgctgcaagcccgtgaacacgttcgtgcatgaacccctggtcgatgtgcaaaacgtctgtttccaggagaaggtgacttgcaaaaacggccagggtaactgttataagagtaactcttccatgcacattaccgactgtcggctgacaaatggctcccggtatccgaactgcgcttaccggactagccccaaagagcggcacatcatcgttgcctgcgaaggctccccgtacgtgcctgtgcacttcgatgcttccgtggaagactctacttag

SEQ ID NO: 203512 - DNA, 471 bp, Artificial Sequence
  Description of Artificial Sequence: Synthetic coding sequence
atggccctggagaagagcctggtgcggctgctgctgctggtgctgatccttcttgtgctggggtgggtgcagccaagcctgggcaaagagtctcgagcgaagaagtttcagcgccaacatatggatagcgactcttcaccctcttcttcttctacatactgtaaccaaatgatgcggcggagaaacatgacacagggaagatgcaaaccagttaacacattcgtgcatgagcccctggtcgacgttcagaatgtttgtttccaggagaaggtgacgtgcaaaaacggacagggcaattgttacaaaagtaacagctcaatgcacataaccgactgtagactgaccaacggatccaggtacccaaactgcgcttataggacgagccccaaagagcggcacatcatcgtcgcgtgcgaaggaagcccttatgtacccgtgcacttcgacgcttccgttgaggactcaacatag

SEQ ID NO: 203513 - DNA, 486 bp, Artificial Sequence
  Description of Artificial Sequence: Synthetic coding sequence
atggtgcccaagctgttcaccagccagatctgcctgctgctgctgctggggctgctcgccgtggaagggagcctacacgttaagcctccccagttcacttgggctcaatggttcgaaactcaacacataaatatgacttcccaacagtgtaccaatgccatgcaggtgattaacaattaccaacgcagatgtaaaaatcaaaatacattcctgctgacaacctttgccaacgtggtaaatgtgtgtgggaatccaaacatgacatgtccatctaataagacacggaaaaattgccaccattcaggaagccaggtcccactaatacactgtaacctgactacaccttcaccccagaacatatctaattgccgttacgctcagacacccgcaaacatgttttacattgtggcttgtgacaacagggatcagaggagagaccccccccaataccccgtggtgcccgtgcatctcgatcggatcatttag

SEQ ID NO: 203514 - DNA, 483 bp, Artificial Sequence
  Description of Artificial Sequence: Synthetic coding sequence
atggtgcccaagctgttcaccagccagatctgcctgctgctgctgctgggactgatgggggtagaaggcagtctccatgcacgccccccacagtttacaagagcacaatggttcgcaattcagcatatcagcctgaaccctccgcgatgcactattgccatgagggccatcaataattacaggtggaggtgcaagaatcagaacacattcttgcgcaccactttcgccaatgtggtcaacgtctgtggaaaccagagcatcaggtgccctcacaatcggacactgaacaactgccatcggagcagattcagggttcctttgctacattgtgacctgatcaatccgggggctcaaaatatctcaaactgcacttatgcagataggcctggaaggcgattttacgtcgttgcttgtgataacagagatcctcgtgacagccctcgctatcccgtggttcctgtacaccttgacaccacaatttag

SEQ ID NO: 203515 - DNA, 444 bp, Artificial Sequence
  Description of Artificial Sequence: Synthetic coding sequence
atggccctgcagcggacccacagcctgctgctgctgctgctgctgaccctgctaggtctaggcttggtacagcctagctacgggcaggacggcatgtaccagagatttttaagacagcacgtgcaccccgaagagacaggcggctcggacagatattgcaacttaatgatgcagcgccgcaaaatgacactgtatcactgtaagcggtttaacacatttatacacgaagacatctggaacatacgcagcatttgcagtaccaccaacattcaatgtaaaaatggcaagatgaattgccacgagggtgttgtcaaggtgaccgattgccgggatacgggctccagcagggcacctaactgccgataccgggccattgccagcacccgccgggtggtgatagcctgtgaaggaaacccacaggtgcctgtccatttcgacggttag

SEQ ID NO: 203516 - DNA, 444 bp, Artificial Sequence
  Description of Artificial Sequence: Synthetic coding sequence
atggccctgcagcggacccacagcctgctgctgctgctgctgctgacattgttggggctgggcctcgtgcagccgtcatatggtcaggacgggatgtatcaaagatttcttaggcaacacgtacaccctgaagaaaccggcggaagtgaccgttattgcaacctcatgatgcagcgcaggaagatgaccctgtatcactgcaagagatttaatacgttcattcacgaggatatttggaatatccgctcaatttgctctacaaccaatatccagtgcaagaatgggaagatgaattgtcatgagggggtggtcaaggtcacagattgccgagatacagggtcttcccgcgctcccaattgccggtaccgtgccattgcaagcacccgacgggtggttattgcatgtgagggcaaccctcaagtgccagtgcattttgacggctag

SEQ ID NO: 203517 - DNA, 444 bp, Artificial Sequence
  Description of Artificial Sequence: Synthetic coding sequence
atggccctgcagcggacccacagcctgctgctgctgctgctgctgacattgctgggtctgggcttggtgcagcctagctatggacaggacggcatgtatcagagattcctcaggcaacatgtgcatcccgaggaaactggaggcagtgatcgatattgtaacctcatgatgcagcgccgaaagatgacgctctaccactgcaaacggtttaatactttcatccacgaagatatctggaatattagatccatctgttctacaaccaacatccaatgcaaaaacgggaaaatgaactgtcatgagggtgtcgttaaggtcacagattgccgtgacacaggttcctcccgcgcccccaactgccgatatcgggctatcgcaagcaccagacgcgttgtaattgcatgtgagggcaacccccaggtgcctgtacacttcgacggatag

SEQ ID NO: 203518 - DNA, 465 bp, Artificial Sequence
  Description of Artificial Sequence: Synthetic coding sequence
atggcccccgcccgggccggctgctgccccctgctgctgctgctgcttggcctgtgggttgccgaggtgctcgttcgagcaaagcctaaagacatgacatcttctcaatggttcaaaacacagcatgtgcagcccagtccccaggcttgtaactcagcgatgtctatcataaacaaatatacggagagatgcaaagacttgaacacgtttcttcacgagcccttcagttcggtggctatcacttgtcagacaccaaacatcgcctgcaaaaactcctgtaagaattgtcaccaaagccatgggccaatgagcctaaccatgggtgaacttactagcgggaagtatcctaactgccgctataaggagaagcacctgaatacaccctacattgtggcatgcgacccaccacagcagggagacccagggtacccactggtccctgtacacttggacaaggtagtgtag

SEQ ID NO: 203519 - DNA, 453 bp, Artificial Sequence
  Description of Artificial Sequence: Synthetic coding sequence
atggtgctgtgcttccccctgctgctgctgctgctggtgctgtggggacccgtgtgccccctgcacgcatggcccaagaggctgactaaggcacactggtttgaaatccaacacatccaacccagtccccttcagtgtaaccgcgcaatgtccgggattaacaactacacccaacactgtaaacaccagaacacttttttgcacgatagtttccagaatgtggcagcagtgtgcgatctgctgtcgatcgtgtgcaaaaatcggcgacacaactgccatcagtcctccaagcctgtcaatatgacagactgcagactgacttctgggaagtatcctcagtgcaggtattctgctgcagcccagtacaaattttttattgtggcgtgcgaccccccccaaaaatcggatcccccatacaagctggtcccggtccaccttgacagcatcctgtag

SEQ ID NO: 203520 - DNA, 2271 bp, Artificial Sequence
  Description of Artificial Sequence: Synthetic coding sequence
atgcccctgcggcccggcagcctggtgcccgagggcgccggcttccccaagatggcagccgatgtatcagtcacccacaggccaccactgtcccccaagtcaggcgcagaggtagaagcaggagacgccgccgagagacgagcccccgaagaagaattgcctccactggacccagaggagataagaaaaagactagagcacacggagaggcagtttcgaaaccgaagaaagattctgatccgtggattgccgggggatgtgacaaatcaggaggtgcatgacctcctttccgactatgaactcaagtactgtttcgtggacaagtacaagggtaccgccttcgtcaccctgttgaatggagaacaggctgaggcagccatcaatgccttccatcaatcccgcctgcgcgagagggaactctctgtgcagctgcaacccacggatgcccttctctgtgtcgccaatctgccccctagcctaactcaacaacagtttgaagagttggtccgcccctttggctcccttgagaggtgctttcttgtgtacagtgagaggaccggccagtccaagggttacggcttcgctgagtatatgaagaaggatagcgccgctagagcaaaatccgatttactcgggaaaccactcggccctcggacgctgtatgtgcactggaccgatgccggccagttgacccccgccctgctgcattcaagatgcctttgcgtagatcggctgccgccagggtttaacgacgttgatgccctatgccgagctctcagtgcagtacacagcccaaccttttgtcagctggcctgtggtcaggacggacagctgaagggttttgccgtactggaatacgaaaccgcggaaatggcagaagaggcccaacagcaggcagatggcttgtccctggggggtagccacctgagggtgtccttctgcgccccagggcctccgggccggagcatgctagcggccctgatagcggcgcaggccacggctttgaacaggggtaagggactccttccggaacctaacattctccagctgcttaataacttgggaccctccgcgtctttgcagttactgctaaatcccctgctgcacggctctgccggcgggaagcagggccttcttggggccccacccgctatgccactgctgaacggccccgctttgagcaccgcgcttctccagctggccttgcagacacaagggcaaaagaagcctggcatactgggcgatagccctctgggcgccttacaacctggggcacagcccgccaacccactgctgggggaattgccagcgggaggcggtctgcctcctgagctaccccctcgacgggggaagcctccacctctgctgccttcagtgctcggcccggcggggggcgaccgcgaggcacttggcttgggaccccctgccgcacagttgactcctccaccggcccctgtaggcctgcggggctccggactccgcggactgcagaaagatagcggcccgcttcctacacccccaggggtgtctctgttaggagagccccccaaggactatagaatccctcttaatccatatctgaaccttcactccctgctccccgccagtaacctcgctggtaaggaagcgcgcgggtggggcggggccggaaggagccgaagacccgccgagggccctccaactaaccctccagcccccgggggcgggtcctcatctagcaaggcctttcagctaaagtctaggctactttctcctttgtccagcgcaagactcccccccgaacccggcctgtccgattcctatagcttcgactaccccagtgacatgggacctagacgcctcttcagtcaccctcgagaaccggccctgggtccacacggccctagccggcacaaaatgagcccccctccaagtggcttcggcgagcgtagctctggcggatcgggaggcgggcctctgtcgcacttctatagcggaagccccacctcctactttacgagtggtttacaagccgggctgaagcagagtcacctgagcaaagctataggctcttcacccttgggctctggggaaggactcctgggcctgagcccaggtcctaatgggcatagccacctgttaaagacgccactggggggccagaaacgttcatttgctcatcttctgccatctcctgaacctagccctgagggatcctacgttggtcaacactcccaggggctgggcggccactatgcagatagctatctcaagcgcaagagaattttctag

SEQ ID NO: 203521 - DNA, 1821 bp, Artificial Sequence
  Description of Artificial Sequence: Synthetic coding sequence
atggccgccgacgtgagcgtgacccaccggccccccctgagccccaagtcgggagctgaggtcgaggctggggatgctgctgagcggagagctccagaggaggagttgccccctcttgatccagaagaaatccggaagagactggaacataccgaaagacaatttcgcaacagaagaaaaattctcatacgaggactaccgggagatgtcactaatcaagaggtgcacgatctgctgtctgactatgaattgaaatactgttttgtagataaatacaaggggactgcctttgttactctcctgaacggggaacaagctgaagccgccatcaatgcgtttcaccaatctagactgcgggagagagagttgagcgtgcagctacagcccaccgatgctctcctctgtgtagcgaatctgcctccctcactgactcaacagcaattcgaggagctggttcggcccttcggatccctggaaagatgctttttagtttacagtgagaggactggccaatccaaggggtatggttttgccgagtatatgaaaaaggattctgcggccagggctaagtccgacctgcttggcaagcctctgggcccaagaaccctctatgtccactggactgatgctggccaactgacacctgctttgctccattctagatgcttatgtgtggaccgactcccacccggtttcaacgacgtggatgcgctctgcagagctttaagtgctgtgcacagcccaacgttttgccagctcgcttgtggtcaagacggccagctgaaaggttttgccgtcctagaatatgagacagcggagatggctgaggaggcgcagcagcaggccgacggactctcactgggcggcagccatctgagggtttcattctgcgcaccaggcccaccagggaggagtatgctagcggcgctgattgctgcccaggccaccgctctgaataggggcaaagggcttttacccgagcctaacattctgcaactgctgaacaacttagggccgtcagcctcactgcagcttctcttaaatccgctcctgcacggaagcgccggcgggaaacaagggctgctgggtgcacccccagccatgccacttctgaacggcccggcgttgtctacagcactacttcagctggcactgcaaacgcagggccaaaaaaagcctggtatcctgggcgattctccgttgggggcattgcagcccggcgcgcagccagccaaccccctgctgggcgagctgcccgcggggggtggcctgcctcctgagttgcctccccgccgcgggaagcccccacccctgcttccatctgtccttggccctgctggcggcgatcgcgaggcactgggcctaggaccgcctgccgcccaattgaccccgcctccagcccccgtgggtttgaggggtagtgggcttcgcggtcctttgagtcacttctacagcggaagcccaacctcatactttaccagtggactgcaggccggcctgaagcagtctcacctgtctaaagctataggctcaagtcccctgggctctggagagggcctgctgggcttgtctccaggccccaacggacactctcacctgttaaaggtgagagcagggggcggcgacatgcagggatgggaggctccagctccccagcgaccgctgacgcgacccgcattaccgtccgtgagcaggcctcattgggccgcaaggaacgctgcgctgcctacctgttgcccacgcccatcccctgcccagaaagccgcaatgtgggcatcgacccctcgtgctagcgccgctactacacgcacacctacttag

SEQ ID NO: 203522 - DNA, 2076 bp, Artificial Sequence
  Description of Artificial Sequence: Synthetic coding sequence
atggccgccgccgccggcgacggcggcggcgagggcggcgccggcctaggctcagctgccggtctgggacccggacctggtttaagggggcagggcccttcagccgaagcccacgaaggggcccccgatccaatgcctgctgctctgcatcccgaggaagtcgccgcccggctacaaagaatgcagagagaactgtctaatcgcagaaagatcttagtgaagaacctacctcaggacagtaactgccaggaggttcatgatctgcttaaagattacgacctgaagtactgttacgtcgaccgaaataaaagaacagcttttgtgactttgttgaacggggagcaggctcagaacgcgatccagatgtttcaccaatacagctttagaggaaaagatctcatagtgcagcttcagcccacggatgctctcctgtgtatcaccaacgtgccaatttcatttacaagtgaggagttcgaagagttggtacgagcttacggtaacattgagagatgttttcttgtgtattcagaggtgaccgggcactccaaggggtatgggttcgttgagtacatgaaaaaggattttgcagccaaagccagactggaactcctggggcgtcagcttggggccagcgcactcttcgcacaatggatggatgtgaacctgctggcttctgaattaatacactctaagtgcctgtgtatagacaaactgcccagcgactaccgtgattctgaagagctcctacagatcttcagcagcgtgcacaagcccgtgttttgccagctcgctcaggatgaaggctcctatgtgggtggttttgcagtagtcgagtactctacagccgagcaggcggaggaagtccaacaagccgctgacggaatgaccattaaaggttcgaaagtgcaggtgagtttctgtgcacccggggcccccgggcgctctacgctcgccgcactcatcgctgctcagcgggtcatgcacagcaaccagaaggggctgctgccagagcctaaccctgtacagataatgaagagcctcaataatccagccatgcttcaagtactgctgcagcctcagctgtgtggtagagccgttaagccagccgtgttgggcacccctcattccttgcctcacctcatgaatcctagtatttctcctgcatttctgcaccttaataaagcccatcagtcatcagtgatgggcaacacttctaaccttttcctacagaacctctcccatattcctctcgctcaacagcagctgatgaagtttgagaacattcatacgaacaataagccggggctgctgggtgagcctccagcggtggtactccagactgccctaggaatagggtcggtgcttccattaaagaaagagctggggcaccaccatggcgaagcccataagacaagctccctcattccaactcagaccacaatcaccgctggcatgggcatgttaccatttttcccaaaccagcacattgctggccaggccggtcccggtcactcaaatactcaggaaaagcagcctgctactgtgggaatggccgaagggaatttctctgggtctcagccttatctccagagcttccccaatctcgcagccggttctctgctggtcggtcaccataaacagcagcagtctcagcccaagggaaccgagatctcatccggcgccgcatcaaaaaaccagaccagcctcctgggcgaaccccccaaagagatccgcctgtcaaagaacccttatctaaacctggccagtgtgctcccgagtgtgtgcctaagctctccagctagtaagaccactctgcataaaaccggaattgcatcctctattctggacgccatttcccagggttcagaaagccagcacgccttggaaaagtgcattgcctattcgccaccattcggagactacgctcaggtctcttcactccgcaacgagaagagaggctcgagctacctcatatccgccccagaaggcggcagcgtggaatgtgtggaccaacactcacaaggcactggggcctactacatggaaacatatctgaaaaagaagcgtgtttactag

SEQ ID NO: 203523 - DNA, 2037 bp, Artificial Sequence
  Description of Artificial Sequence: Synthetic coding sequence
atggccgccgccgccggcgacggcggcggcgagggcggcgccggcctgggatccgccgctgggctcggccctggtccaggattgagaggacaaggtccatccgcagaagcacatgagggggctcctgatcccatgcctgctgcacttcacccagaagaagtggccgctcggctgcagcggatgcagcgcgaactaagtaataggcgtaaaatattggtgaagaatttgccccaagactcaaactgtcaagaggtgcacgatctcctcaaagattacgacctgaagtactgttatgtagaccgaaacaaaaggactgcattcgtgacactgctcaacggggagcaggcacaaaacgccatccaaatgttccatcaatattcatttcgtggcaaggatctcatagtgcagctgcagccaacagatgccttgctctgcattacgaacgtgccaattagttttacaagcgaggaattcgaggagcttgtgcgagcctacggcaacatagaacgatgtttcctggtgtacagcgaagtgactggccatagcaagggatacggcttcgttgagtacatgaaaaaggatttcgccgccaaagcacgactcgaactgctcggcaggcagcttggggcttctgcactctttgcccaatggatggacgtgaatctgttagcttccgagctgattcattccaaatgtctctgtatcgacaagttgcctagcgactacagagattcggaggagttactgcagattttctcaagcgtgcataagccagtgttttgtcagctggcacaggacgagggttcttatgttggcggcttcgctgttgtagagtattcaacagctgaacaagccgaggaggtccaacaagcagcagacggtatgactattaaaggttccaaggtgcaggtaagcttttgcgcaccaggcgcacccggacgaagtacgctcgcggcgctgattgccgcccagagggtcatgcattcgaaccagaaggggctgttgcccgaacccaatcccgtccagattatgaagagtcttaataaccctgccatgctccaggtcctattacaaccccaactgtgtggaagggcagtgaagcctgccgtcctggggaccccacatagtctgcctcacctaatgaaccctagtatcagcccagcgtttctgcacttaaacaaggcccatcagaacttgtcacacatccccctggcacagcagcagcttatgaaatttgagaatatccatacaaataataagcctgggctgcttggcgagccacctgcggttgttctgcagactgctctgggaattgggagtgttctacctcttaagaaggagctggggcaccatcacggcgaggcacataagacctcctccttaatacccacacagactaccatcaccgcagggatgggcatgctgccgttcttcccaaaccagcatatcgccggccaggctgggcctggtcactcaaacactcaggagaaacagcccgccaccgtcggcatggctgaggggaacttcagtgggtctcagccctacctgcagtcatttcctaacctggcagcaggctctctgctcgtcggacaccacaagcaacagcagagccagcccaaagggacagagatttcttctggagctgcatctaagaaccagaccagtctgctgggggaaccccccaaggaaatccgcctgagcaagaatccttacctcaatctcgcgtcagtgctaccctcagtgtgtctttcatcccctgcaagcaaaaccacacttcataagactggaattgcctcaagtattcttgacgccatttctcagggatccgagagccagcacgcattggagaaatgcatagcttattcgcccccgtttggggactatgctcaggtgagttcgctgcggaatgaaaagagagggagcagctacctgatcagcgcaccggaaggtggttctgtggagtgcgtcgatcagcatagccagggtacaggggcatattacatggagacctacctgaagaagaagagggtgtactag

SEQ ID NO: 203524 - DNA, 693 bp, Artificial Sequence
  Description of Artificial Sequence: Synthetic coding sequence
atgaccatcaagggcagcaaggtgcaggtgagcttctgcgcccccggagctcctggcagatcaactcttgctgcccttatagctgcacagagagtgatgcacagcaaccagaaagggctgctgcctgagcctaatccagtccagattatgaaaagccttaacaacccagcaatgctacaggtgctccttcagccccagctttgtggaagggccgtcaagcccgccgtgctggggactccccacagccttccccacctgatgaacccctccatctcccccgcctttttgcatctgaacaaagcacatcagaaccagaccagcttattaggtgagccacccaaagagataaggctttcaaaaaacccatacctgaatttggcaagcgtgctgcctagcgtgtgcttgagctcacccgcatccaagacaacgctgcacaagactggtattgcaagttcgatactcgatgccatttctcagggatccgagtcccagcatgcgttggaaaaatgcatcgcttatagtcctccatttggtgactatgctcaagttagctctttgcggaacgaaaagcgcggctcttcctacctgataagtgctccagagggcgggtcggtcgagtgtgtggatcaacactctcagggtactggggcatactatatggagacctatctcaagaagaagagggtctactag

SEQ ID NO: 203525 - DNA, 2379 bp, Artificial Sequence
  Description of Artificial Sequence: Synthetic coding sequence
atgcacgtgatcaagcgggacggccggcaggagcgggtgatgttcgacaaaattacgagtcgtatccagaaactatgctacggcctcaacatggatttcgttgaccctgcccagattaccatgaaggtaatacagggcctgtatagcggggtgacgactgtggagctggacacacttgccgcagagacagccgccaccctgaccaccaagcatccggattatgctatcctggccgcaaggattgccgtgtccaatcttcacaaagagacaaaaaaagttttttccgacgtcatggaagacctgtacaattatatcaaccctcacaacggaaagcacagtccaatggtggccaagtcaacccttgacatagtactggccaacaaagaccgtctgaacagtgctataatatatgaccgggatttctcctacaactatttcgggttcaagaccctcgaacggagttatttgctgaagatcaacgggaaagtagcagagagaccccagcatatgctcatgagagtcagtgtggggatacacaaggaggacatagacgctgccattgagacgtataatttattgtccgaacgatggtttacacatgcctcaccaacgttgtttaacgccggtactaatagaccccagcttagtagctgcttcttactttcgatgaaagatgactctattgagggcatctacgatactttaaagcaatgcgcactgatctcaaaaagcgccggcggcattggcgttgccgtgtcttgcattcgagcaacagggtcttacattgctggcaccaacggaaattctaatgggttggtaccgatgttgagggtatataacaataccgcgcgctatgttgaccagggcgggaacaaacgacctggagctttcgcgatttatcttgaaccctggcatctcgatatatttgagtttttagacctcaaaaagaatactggcaaagaagaacaacgcgctcgagacctgtttttcgcactctggattcccgatttattcatgaaaagggtggaaactaaccaggattggtcactgatgtgccctaatgagtgtccaggcttggacgaggtctggggcgaggagttcgaaaaattgtacgcatcatacgagaagcaagggcgcgtgcggaaagtcgttaaagcccagcagttgtggtatgcaattatcgagagccagaccgagacgggtaccccgtacatgctgtacaaggatagttgcaataggaagtcaaatcagcaaaatttggggaccatcaagtgctctaacctttgtacagagattgtggagtacacttctaaggacgaagttgctgtctgcaacctggcctccttggctctgaacatgtacgttacgagcgaacacacttatgactttaaaaaactggccgaggtgaccaaggtcgtggtgagaaatctcaacaagatcattgacatcaactattaccctgtgcccgaagcttgtctgtccaataaaaggcaccgtccaattggtatcggtgtccagggcttggccgatgctttcatcctgatgagatacccctttgagtccgccgaggcccagctactgaataagcagatcttcgagacaatctactacggggctcttgaggccagttgtgacttagccaaagaacaggggccatacgagacttatgagggaagccccgtttctaaaggcattctccagtacgatatgtggaacgtcaccccaacggacctgtgggattggaaggtgctgaaggagaagattgctaaatatggcatacgaaattcactgttgatcgccccaatgccaacggctagcacagctcaaatactagggaataatgagagcattgaaccttatacttctaacatttacacaaggcgcgtgctctcgggcgaattccagattgttaatccacacctgctgaaggacctgacagagaggggactgtggcacgaagagatgaagaaccagattatagcctgcaatggatctatccagtccatacctgagattcccgacgacctcaaacagttgtacaagactgtctgggaaatttcccagaaaaccgttctgaagatggccgccgagaggggtgccttcatcgatcagtcccagtcgctgaatattcacatagctgagccgaactacggaaaattgaccagcatgcatttctatggttggaaacagggccttaaaactgggatgtactatttgaggacgcgaccagcggccaatcccattcagttcactctcaataaggagaagttgaaggacaaggagaaggtgagcaaagaggaggaggaaaaggagaggaacaccgcagccatggtttgctccctggagaaccgggacgaatgcctaatgtgtgggtcctag

SEQ ID NO: 203526 - DNA, 2088 bp, Artificial Sequence
  Description of Artificial Sequence: Synthetic coding sequence
atggaggacctgtacaactacatcaacccccacaacggcaagcactcccccatggtagcgaaatccactctggacatagtgcttgctaacaaggatagactcaacagcgcaatcatctacgacagggatttttcttacaattattttggtttcaagaccctggaacgtagctatctcctgaagattaacggtaaggtagcagaacgcccacagcatatgctaatgcgcgtgtccgtcggaatccataaagaagacatcgacgcagcgatcgaaacctataatttactctcagaaagatggttcactcacgcttcccctactctttttaacgccggcaccaacaggccccagctctctagctgtttcctgctttctatgaaagacgactctattgaaggtatttacgatacccttaagcaatgtgccctgattagcaagtccgccggcggcattggggtagccgtgtcctgcattcgtgcaacagggtcatacatcgctggcaccaacggcaattcaaatggcctagtcccgatgctgagagtttataacaacactgctaggtacgtcgaccagggcggcaacaagcggcctggcgcgtttgctatttatctggagccctggcatttggatatcttcgaattcttagatctcaaaaaaaacaccggcaaagaagaacagagagcccgggatttgttctttgccctgtggatccctgacctatttatgaagcgcgttgagacaaaccaggattggagcctaatgtgcccaaacgaatgccctggcctcgatgaggtgtggggtgaagagtttgagaaactgtacgcaagttacgagaaacagggaagagtgaggaaggtcgtgaaggcccagcagttgtggtatgcaattatagagtctcagaccgagaccgggacaccatacatgttgtataaggactcctgcaaccgtaagtccaatcagcaaaatcttgggaccatcaagtgtagtaacctctgtacagagatcgtggagtacacctcaaaggatgaagtcgccgtgtgtaatctggcatccctggctctgaatatgtatgtcacaagcgaacacacctatgattttaaaaagctcgccgaggttaccaaagtggtagtccggaacttgaacaagattatcgatattaactattaccccgtgcccgaggcttgcctgtccaataagcgacataggccgatcggcatcggagtgcagggtctcgctgatgcatttattctcatgagatacccctttgaaagcgccgaagcccagctgttgaacaagcagatattcgagaccatctactacggggccttagaggctagttgcgacctggccaaagagcagggcccatacgagacatacgaagggagccctgtttcaaagggcattctgcaatacgacatgtggaacgtaactcccacagacttgtgggactggaaagtgctgaaggagaaaattgcaaagtacggtatacggaatagccttctcatcgccccgatgccaaccgcatctacagcgcaaatcctgggtaacaacgagtcaatcgagccctacacatcaaatatctacactagaagggtgctgagcggggaatttcagatagtaaatccccatctgctgaaggatctcactgaaaggggcttgtggcacgaggaaatgaaaaatcaaattattgcgtgcaatggctcaatacagtccatacctgaaatcccagatgacctgaagcagttgtataaaactgtctgggaaatctctcagaaaacggtgcttaagatggcggctgagaggggcgcctttattgatcagtcgcagtcgctaaacatccacatcgcagaacccaactatgggaagctaacctcaatgcacttctacggttggaaacagggactgaagactggtatgtactacctcaggacccggcccgcggccaatcccatccagtttacactaaataaagaaaaattgaaagataaagagaaggtgtccaaagaagaagaggaaaaagaaagaaacacagcagcgatggtgtgctctctggagaatcgggatgagtgtctgatgtgcgggtcgtag

SEQ ID NO: 203527 - DNA, 2118 bp, Artificial Sequence
  Description of Artificial Sequence: Synthetic coding sequence
gacggccggcaggagcgggtgatgttcgacaagatcaccagccggatccaaaaactctgctatggcctcaatatggactttgtggacccagcgcagataacgatgaaagtaattcagggactctattcaggcgtaacaactgtggaactcgacacattagcagctgaaacggccgccacactgaagacactcgaaaggtcctatctactgaagattaacggtaaagttgctgaacgcccgcaacatatgctcatgagagtcagcgtgggaatccacaaagaagatatcgatgccgctatcgagacctataatctactgtctgagcggtggttcacgcatgcctccccaaccctattcaatgcgggaactaaccgcccccaactctctagctgcttccttctctctatgaaagacgactccatcgaaggcatatatgacacgctaaagcagtgtgccctgatctctaagagcgcaggtgggatcggggtggcagtttcttgtatccgcgccactggctcatatattgccggaactaacggcaatagtaatggcctggtgcctatgctcagggtgtataataacaccgcccgctacgtggatcagggtgggaacaagcgtccaggggctttcgctatctacctggagccatggcacctcgatatttttgagttcttggacctcaagaaaaatactgggaaggaggagcagagggcccgcgacctttttttcgccctctggatccccgacctcttcatgaagagagtggaaaccaaccaggactggtcattaatgtgtcccaacgaatgtcccggtctggacgaagtctggggggaagaattcgagaaactgtacgcctcttatgaaaagcaggggagagtacgcaaagttgttaaagcccagcaattgtggtacgcaatcattgaatctcagacggaaacagggacaccctatatgttatacaaagattcttgcaaccgtaaatcgaaccagcagaatcttggtaccattaaatgttcaaacctgtgcacagagattgtggaatacacaagcaaggatgaagtggctgtttgcaatctggccagtctggccctgaacatgtatgtcacttccgagcacacatacgacttcaagaagctggccgaagtaaccaaagtggtcgtcaggaacctgaacaaaataatcgatatcaattattaccctgtgcccgaggcttgcttgtcaaacaagcgacatcggcccataggtattggggtccaaggactagccgacgccttcattctcatgaggtatccgttcgaatccgcagaagctcaattgctgaataagcagattttcgagacaatctattatggtgcactagaagcctcatgtgatctggccaaggagcagggaccctatgagacatatgagggctcacccgtgagcaaaggaatcctgcaatacgacatgtggaatgtgacgccaactgacctgtgggactggaaagtgctcaaagaaaagatcgccaagtacggaataagaaactccttactgatagctcctatgccaactgcctccaccgcccagattttgggaaataacgagtcgattgaaccatacacaagcaatatttacactcgccgggtcctgtcaggggagtttcagatagtgaacccgcatctgctaaaggacctcacggaacgagggctttggcacgaagagatgaaaaatcagattatcgcttgtaacggctccatccagagcattccagagatccccgatgatctgaagcaactctataagacggtgtgggagatctcccagaagacagtgctgaagatggcggcggaacggggagctttcatagatcaatcacagtccctgaatattcacattgcagaacctaattacgggaagttgacttctatgcacttttacggctggaagcagggcctgaagactggaatgtactacctccgaactcggcctgccgccaacccaatccagtttaccctgaataaggagaaactcaaggacaaagagaaagttagcaaggaagaggaggagaaggaaaggaataccgctgccatggtctgctctttggaaaacagggacgaatgcctcatgtgcgggagttag

SEQ ID NO: 203528 - DNA, 1365 bp, Artificial Sequence
  Description of Artificial Sequence: Synthetic coding sequence
atgaagcgggtggagaccaaccaggactggagcctgatgtgccccaatgaatgccccggcctggatgaagtgtggggtgaagagttcgaaaagctttacgcatcatatgagaagcaagggagggtccgcaaagtagttaaagcacagcaattgtggtatgccattattgagagtcagacagagacaggcactccctacatgctatacaaggattcctgcaacaggaaaagcaaccagcaaaatctaggtaccataaaatgtagtaacctgtgcactgagatcgtcgagtatactagcaaggatgaagttgccgtgtgcaacttggccagcctggctctgaatatgtatgttacatccgaacacacctatgatttcaagaagctggcagaggttacgaaagtggtagtcagaaatctgaacaagataattgatatcaactattaccctgtgcctgaggcctgtctctccaataagcgtcacagacccattgggattggagttcagggcttggctgacgccttcatcttgatgagataccctttcgagagtgctgaagcccagctcctgaataagcagattttcgagactatctactatggtgctttggaggccagctgcgatcttgcaaaagaacagggaccatatgagacctacgagggaagccccgtttccaaaggcattcttcagtacgatatgtggaatgtcacaccaactgacctttgggattggaaagttctgaaggagaaaatcgccaagtatggcatccggaacagcctccttatcgcccccatgcccaccgcgagcaccgcccagatcctcggcaacaacgagagcatagagccctatacctcgaatatttatacccgcagagtgctgagcggcgagtttcagatagtaaacccccatctgttaaaggatctcaccgagagaggactctggcacgaagagatgaagaaccagattattgcctgtaacggctcaattcaatccattcccgagattcccgatgatttgaagcagctgtacaaaaccgtctgggaaatatcccagaaaaccgtactaaagatggccgctgagcgcggcgccttcatcgatcagtcgcaatcattgaacatccatattgccgaaccaaattacgggaaactgacgtcaatgcatttctatgggtggaagcagggactgaagaccggaatgtattacctgaggacaaggcccgcagcaaacccaatacagtttaccttgaacaaggaaaagttaaaggataaagaaaaagtgagtaaggaagaagaagagaaagagcgcaatactgcggccatggtgtgttccctggagaacagagacgagtgtctcatgtgtggttcgtag

SEQ ID NO: 203529 - DNA, 1170 bp, Artificial Sequence
  Description of Artificial Sequence: Synthetic coding sequence
atgctgagcctgcgggtgcccctggcccccatcaccgacccccagcagcttcagctgagccccctgaaagggttgtcactggtggataaagaaaacactccaccggctctttcagggacacgagttctggcgtccaagaccgctcggcgcattttccaggagcctaccgagcccaagactaaagctgctgctccaggagttgaagatgaacctctacttcgcgaaaacccgagacgattcgtgatttttcctatcgaataccatgatatctggcagatgtataaaaaagctgaagcctccttctggaccgctgaggaggtggatttgtccaaggacatacaacactgggagagcctcaagcccgaggagaggtactttattagtcacgttttggcatttttcgcagcctcggacgggatagtgaatgaaaatctggttgagcgcttctcccaggaagtccaaatcaccgaagcacggtgcttttacgggtttcagattgccatggagaatattcatagcgaaatgtatagtctactcattgacacatatatcaaagatccaaaagaaagggaattcctgtttaacgcgatagagacaatgccctgcgtgaaaaaaaaggctgactgggcgttacgctggattggagataaagaggccacctacggggagagggtcgttgccttcgccgccgttgagggaatattttttagcggctcattcgccagtattttttggcttaaaaagcgcggcctgatgcctgggctgaccttttcaaacgaactgatatcccgggacgaagggctgcactgcgatttcgcctgccttatgttcaaacacctggtgcacaagccgagcgaagaacgcgtgcgggaaattatcattaacgccgttagaattgaacaagaatttcttacagaagcactccccgtgaagctgataggtatgaactgcactctgatgaaacagtatatcgagttcgtcgctgataggctgatgcttgagcttgggttttcaaaggtattccgcgtcgaaaaccccttcgattttatggagaatataagcctggaaggcaagacaaattttttcgagaaaagggtaggtgagtatcagaggatgggtgttatgtcctcgcccaccgaaaactcctttaccctggacgctgatttttag

SEQ ID NO: 203530 - DNA, 1350 bp, Artificial Sequence
  Description of Artificial Sequence: Synthetic coding sequence
atgggccgggtgggcggcatggcccagcccatgggccgggccggcgccccaaaaccaatgggtagggcaggatccgcacggcgaggtagattcaagggatgttggagtgaaggaagtccagtacatccagtgcctgccgtgctctcgtggctgctggctttgctccggtgtgcatccaccatgctgagtctgcgggtgccactggcacctatcacggacccgcagcagttgcagttgtcccctttgaagggtttgagcttagtggataaagagaacaccccccctgccctgagcggcacgagggtgttggctagcaagactgcacggaggatctttcaggagcccaccgaaccaaagaccaaagctgccgcacccggggttgaggacgagcctctgttgcgagaaaatccacggcggttcgtaatctttcctattgagtaccatgacatatggcagatgtacaaaaaggcagaggcttcattttggaccgcggaggaggttgacctctctaaagacatacagcactgggagtctttgaagcccgaagagagatacttcatcagtcatgttcttgcctttttcgccgccagcgacgggatcgtgaatgagaacctcgtggagagattcagtcaggaagtgcagattactgaagccaggtgcttttacgggttccaaatcgccatggagaatatccatagcgagatgtactctttacttattgacacctacattaaggatccaaaggaacgggagttcctgttcaatgccatcgagactatgccttgcgttaagaaaaaggctgattgggctctgaggtggattggagacaaggaggcaacctacggagagagagtggtggcattcgcagctgttgaagggattttcttttcgggcagtttcgcatcgatcttctggttgaagaagcgggggcttatgcctggactgacctttagtaacgaattaatctctcgcgacgaaggccttcactgcgatttcgcatgcctgatgttcaagcacctggtgcacaaaccatctgaggagcgcgtgcgggagattatcataaacgccgttcggatcgagcaggagttcttgacagaggctctcccagttaagcttattggcatgaactgcacattaatgaagcagtatatcgaatttgtagccgaccgtctgatgctggagctgggtttctctaaggtcttcagagtggagaacccatttgatttcatggaaaacatttctttagaagggaagaccaacttttttgagaaaagggtgggtgaatatcagcgtatgggggtgatgtcctcaccgacagaaaacagctttaccttggacgcagatttctag

SEQ ID NO: 203531 - DNA, 1056 bp, Artificial Sequence
  Description of Artificial Sequence: Synthetic coding sequence
atgggcgaccccgagcggcccgaggccgccggcctggaccaggacgagcgcagtagctcagatacgaatgagtcagagatcaaaagcaatgaagagccactacttaggaagagctcacggcgcttcgttatttttccaattcagtacccagacatttggaaaatgtataaacaggcccaggctagcttctggacagctgaggaagtggacttgagtaaagatctcccacattggaataaactcaaggctgatgagaaatatttcataagccacatcctagctttctttgccgcaagtgatggtattgtcaacgagaatctggttgaacggttttcccaggaagttcaggttccggaagccagatgcttttacggatttcagatccttatagagaatgtccactcagagatgtattccctgcttatcgacacttatatcagggatccaaagaagcgcgagttccttttcaatgctattgagacgatgccatatgtgaaaaaaaaagctgactgggccctccgttggattgcggatagaaaatccacctttggtgagagagtcgtggccttcgcggctgtggagggcgtgtttttttctgggagttttgccgcaattttctggctgaagaaacggggattaatgccaggtctcacattcagtaacgaactgatttcgcgggacgagggactgcattgtgacttcgcctgcttgatgttccagtacctggttaacaaaccctctgaggagagggtgagggagatcatcgtagatgcagttaaaattgagcaagagtttctaacagaagccttgcccgtaggactcattggaatgaactgtattttgatgaagcagtacatcgagttcgttgctgatcgtttactggtcgagctcggtttttctaaagttttccaagctgagaatccatttgacttcatggagaacatatctctggagggaaagaccaacttttttgaaaaaagagtgtccgagtaccaaaggtttgcggttatggccgagaccaccgacaacgtgtttactttagacgcggacttctag

SEQ ID NO: 203532 - DNA, 900 bp, Artificial Sequence
  Description of Artificial Sequence: Synthetic coding sequence
atgggcgaccccgagcggcccgaggccgccggcctggaccaggacgaggttgacctctcaaaggacctgcctcactggaacaagctcaaggctgacgaaaagtattttattagtcatatactcgcctttttcgcagcctctgacggtattgtgaatgaaaacctcgttgaacgcttttctcaggaagtgcaggtgccagaggcaaggtgtttttacggctttcaaatcctgatcgaaaacgtgcactccgaaatgtattcgcttctgatcgacacatacatcagggatccaaaaaagagggagttcctgttcaatgccattgagacgatgccctacgtcaaaaagaaggccgattgggccctacgctggatcgccgatcggaaaagtacctttggtgaaagagtagtggcctttgcagctgttgagggtgtgttcttctccgggtccttcgctgcgatcttctggcttaagaaaagaggtttaatgcccgggctgacatttagcaatgaactgatcagccgcgatgagggcctccactgcgacttcgcatgcctgatgtttcagtatctggtaaataagcctagtgaggagagggtgcgggagatcatcgttgatgcagtcaaaatcgaacaggagttccttaccgaggcgttacctgtcggactgattggtatgaactgcattctgatgaagcagtacatcgaatttgtagccgatcggctgttggtcgagctcggattcagtaaggtgtttcaggcggaaaacccctttgattttatggagaatatttcactggagggaaagaccaactttttcgagaaacgagtcagtgagtatcagcgtttcgcagtcatggctgaaaccaccgacaacgtcttcacgctggacgctgacttttag

SEQ ID NO: 203533 - DNA, 420 bp, Artificial Sequence
  Description of Artificial Sequence: Synthetic coding sequence
atgggcgaccccgagcggcccgaggccgccggcctggaccaggacgagggcctccactgtgattttgcctgtttgatgtttcagtatctggtgaacaagcccagcgaggaacgcgtgcgggagatcatcgtggacgccgtcaagatagaacaggagttcctgacagaggctctgcctgtcgggcttatcggaatgaactgcattctgatgaagcaatacatcgagttcgtggcagatcgcctgcttgtggaactcggcttcagtaaagtgtttcaggccgagaatccatttgatttcatggaaaacatcagcctggaagggaaaaccaatttctttgagaaaagggtgtcagagtatcagcggtttgcagttatggcagaaacaactgataacgttttcacattggatgcagacttctag

SEQ ID NO: 203534 - DNA, 201 bp, Artificial Sequence
  Description of Artificial Sequence: Synthetic coding sequence
atgggcgaccccgagcggcccgaggccgccggcctggaccaggacgaggtgtttcaggccgaaaatccgttcgattttatggagaacatttctctggagggtaagaccaatttctttgagaaaagagtaagtgagtatcagaggttcgctgttatggccgagacaaccgacaacgtgtttaccctggacgctgatttctag

SEQ ID NO: 203535 - DNA, 132 bp, Artificial Sequence
  Description of Artificial Sequence: Synthetic coding sequence
atgggcgaccccgagcggcccgaggccgccggcctggaccaggacgaacgcagcagctctgacacaaacgaatccgagataaagagcaatgaagagcctctgctccgaaagtccagccggcggagcttctag

SEQ ID NO: 203536 - DNA, 894 bp, Artificial Sequence
  Description of Artificial Sequence: Synthetic coding sequence
atgtacaagcaggcccaggccagcttctggaccgccgaggaggtggacctcagcaaagatctgccccattggaataaattgaaagctgacgagaagtacttcatttcccacatcctagcttttttcgcggcgtcggatggaatagtcaatgagaaccttgtagaacgatttagtcaggaagttcaagttcccgaggccaggtgcttttatggctttcagattctgattgagaacgtccactctgagatgtacagtctgttgattgacacttatatcagagatcctaagaaaagagaattcctcttcaacgcaattgaaacaatgccgtatgtgaagaaaaaggccgactgggccctcaggtggatcgccgaccgcaagtccacattcggcgagcgagtcgtggcattcgcagctgtcgagggggtattcttcagtggcagctttgccgctattttctggctgaagaagcgcgggctcatgcccggactcaccttcagcaatgagctgatctcacgtgatgaagggttgcattgcgattttgcatgtctgatgtttcaatatctagtgaacaagccctctgaggaaagggtacgggagattatagtggatgccgtcaagatcgaacaggagtttctgacagaagctcttcccgtggggttgattggcatgaactgtatactcatgaagcagtacattgaattcgtggccgataggctcctggttgagttagggttcagtaaggtcttccaggccgagaaccccttcgattttatggaaaatatttcactggagggaaaaaccaacttttttgaaaaaagggtgagcgaataccagcgcttcgcagtgatggcagagacgaccgataatgtgttcaccttggatgcggacttttag

SEQ ID NO: 203537 - DNA, 1824 bp, Artificial Sequence
  Description of Artificial Sequence: Synthetic coding sequence
atggaggcccccgccgccggcctgttcctgctgctgctgctgggcacgtgggcaccggcccctggctcggcctcttccgaagcgccacccctgataaacgaggacgtcaagagaaccgtagatcttagtagccatctggccaaagttacagcagaggttgtgctggcacaccttggaggtggatcgacatctagggctactagttttctacttgccctggagcctgaactggaggctcgcctcgcccacctaggggtgcaggtcaagggcgaggacgaagaggagaacaatctggaagttagggaaacgaagatcaaaggaaagtccgggcggttcttcactgtgaaactcccggtggccctggacccaggggctaaaataagtgtaatcgttgagactgtctatacacacgtcctccacccttatccgacgcaaataactcaaagcgaaaagcaattcgtggtctttgaaggaaaccactacttctacagtccatacccaacaaagacacagactatgagagtgaaactggcgtcccgcaacgtggagagttacacaaaactaggcaatccaacccgaagcgaggatttgctggactatgggccgttcagagatgtgccggcctattcccaagatacgtttaaggtgcactatgaaaataattctcccttcttaacaatcacctccatgacccgggtgattgaggtgtctcattggggaaatattgcagtcgaagaaaatgtggatctgaagcataccggcgcagtgcttaaggggcccttctctagatatgactaccagaggcagcccgattccgggatctcttccatccgcagctttaagaccattctccctgccgcggcacaggacgtttactacagagacgagatcggaaacgtctctacaagccacctccttatcctagatgactccgtagagatggagatccggccgcggtttcctctgttcgggggttggaaaacccactatattgttgggtacaacctgccctcttatgagtatctgtacaacctcggtgaccaatatgctttaaaaatgcggttcgtggatcatgtcttcgacgaacaggtcatagactccctcacagtgaaaattatcctccctgaaggagcgaagaacattgagattgacagtccctacgaaatttcgcgtgctcccgacgaactgcactacacctatctcgatacatttggccggccagtcatcgtcgcctacaaaaaaaacctggttgaacaacatatccaggatatcgtggtgcactacacgttcaacaaggtcttgatgctgcaggaacctctgctcgttgtggctgccttctacatactatttttcaccgtcataatctatgtcagacttgatttcagcattaccaaagacccggccgcggaggcccggatgaaggtggcatgtattacagagcaggtgcttacactcgtaaataagaggatcggcctgtatcgtcacttcgatgagaccgttaaccgatataagcagagccgcgatatcagcacacttaatagcggcaagaagagcctggaaaccgagcacaaggcattgactagcgagatcgccctgctgcaaagtcgccttaagactgaggggagcgacctgtgtgatagagtttccgagatgcagaagcttgacgcccaggtgaaagaacttgtcttaaagagcgctgtggaagcagagcgcctcgtggcaggcaaactgaagaaggatacatatattgaaaacgagaagcttatttccggaaaacgccaggaattggtaacgaagatcgatcacatcctggatgcattgtag

SEQ ID NO: 203538 - DNA, 1308 bp, Artificial Sequence
  Description of Artificial Sequence: Synthetic coding sequence
atgcgggtgaagctggccagccggaacgtggagagctacaccaagctgggtaacccaacacgaagcgaagaccttttggactatggaccattcagagacgtgcccgcttatagtcaggatacttttaaagtgcactatgagaataactctcccttcttgacaattacttccatgacaagagtgatcgaagtttcgcactggggtaacattgccgttgaggaaaacgtggacttaaaacacacgggcgcagtgctgaaggggccatttagccgatacgactatcagcgacaacccgactctggtataagtagcatcaggtctttcaagacaattctacccgcagccgctcaagacgtgtattatcgggacgaaataggaaacgtgtcgacgtcccacctactgatacttgatgactctgtggaaatggagattagacctcggttcccactctttggcgggtggaaaactcactatattgtggggtacaatctgccctcctacgagtatctctacaacctcggagaccagtacgctctgaaaatgagatttgttgatcacgtattcgatgagcaggtgatagactccctgactgtaaagattatcttgcccgaaggggccaaaaatatagagatcgactcaccctacgaaatatcccgtgcaccggatgaactacactacacatacctagatacttttggtagacccgtcatcgtcgcgtataagaaaaatctagtggaacaacacatccaggatatcgtggttcactacaccttcaacaaggtcttgatgttgcaggaacctcttttggtggtagccgctttttatatacttttttttaccgtaattatttatgttcgactcgacttttcaattacgaaggatccagccgccgaggcacgcatgaaagtcgcctgcattactgaacaggtgctcaccttggtaaataaacgaatagggctgtacaggcacttcgacgaaacagttaataggtacaaacagagccgcgacatcagtaccctgaactcaggcaagaagagcctcgaaaccgaacacaaagccctgaccagcgaaatcgcactactgcagagtcgattgaaaactgagggttccgacttatgtgaccgcgtcagtgagatgcagaagctcgatgctcaagtaaaagagctagtgctcaagtcagctgttgaggccgaaaggctcgtggccggcaaacttaaaaaggatacttacatagagaacgaaaagctcattagcggaaaacggcaggagctcgtcacgaaaatagaccacatcttggatgccttgtag

SEQ ID NO: 203539 - DNA, 1137 bp, Artificial Sequence
  Description of Artificial Sequence: Synthetic coding sequence
atgacccgggtgatcgaggtgagccactggggcaacatcgccgtggaggagaacgtggacctcaagcatacaggggcagtactaaaaggaccattctcaaggtacgactaccagcgccagcccgattccgggatttcaagcattaggtcgttcaaaaccattctgccggctgcagcacaggatgtgtactacagagacgagattggcaatgtgtcaacctcgcacttgctaattctggatgactcagtggagatggagattcgtcctcgatttcccttgtttggcggatggaaaacccactacatcgtgggctacaacctgccctcttatgaatacctgtacaatttgggtgatcaatatgcgctgaagatgagattcgttgatcacgtttttgatgaacaggtaatcgacagcttgacggtcaaaattatactccccgaaggggctaaaaatatcgaaatagacagcccctatgaaatttccagggcaccagatgaactgcactatacatacttagacacgttcggaaggccagttatcgtagcctacaaaaagaacctcgtggaacagcatattcaggatatcgtcgtacactacaccttcaataaagtcttaatgctgcaggagcctttacttgttgtagcagcgttttatattctattcttcactgtgataatttacgtacgacttgactttagcatcacaaaggatcccgcagctgaggcccgaatgaaagtcgcctgcattaccgaacaagttctcactcttgtcaacaagaggatcgggctctaccgacacttcgatgagactgtgaatcgctataagcagtcccgggacatttcaacccttaattccggcaagaagtccctggagacggagcacaaggccctaaccagcgagatcgccctcctgcagtcgcgcctgaaaacagaaggatccgatctctgcgacagagtgtctgaaatgcaaaagctggatgcccaagtgaaggaacttgtgttaaagtctgctgtggaagctgagcgcctggtggccggcaaactgaaaaaagacacctacatcgagaatgaaaagttaatctcaggcaaacgtcaagaattagtgaccaaaatagatcatatcctcgatgccttatag

SEQ ID NO: 203540 - DNA, 1746 bp, Artificial Sequence
  Description of Artificial Sequence: Synthetic coding sequence
atggaggcccccgccgccggcctgttcctgctgctgctgctgggcacctgggcgcctgcaccaggaagtgctagtagcgaagctccgcctttgataaatgaagacgttaagcgtacggttgacttgagtagtcaccttgcaaaggtgacggccgaggtggtgcttgcccacctaggcgtgcaggttaaaggtgaagacgaagaggagaacaatctcgaggttcgcgagaccaaaatcaagggtaagagtggacggttcttcaccgtgaaactacccgtagctttggaccccggagccaaaatttccgtgatagtcgagacagtatacacacacgttcttcatccttaccccactcagattacccagagtgaaaagcaattcgtggtcttcgaaggaaaccactatttctacagtccttatccgaccaaaacccagactatgagagtgaagctcgcaagccgcaatgttgagtcttacaccaaacttggcaatcccacaagaagcgaggatcttctcgactatggtccttttagggacgtgcctgcatattcccaggatacttttaaagtccattacgagaacaacagcccctttctgacaatcacaagcatgacacgcgtcattgaagtctcccactggggaaatatcgcggtagaagaaaacgtggatcttaaacacactggagccgtgctcaaggggccattcagccgatatgattaccagcgccaacccgattctggaatttctagcataaggagtttcaagaccattttgcccgcagccgctcaggacgtttactaccgggacgagataggaaacgtatctacatcccacttactgatcctggacgatagtgtggaaatggagattcggccgaggtttccgctttttgggggatggaaaacccattatatcgtggggtacaatctaccatcatacgaatatctgtacaacctgggggaccagtacgcactgaagatgagatttgtcgatcatgtcttcgacgagcaggtcatcgatagcctgacagtaaagatcattctccctgagggggccaaaaatatcgaaatcgatagtccatacgagatttcacgggccccggatgaactgcattacacctatttggacacctttgggagaccagttatagtagcttacaagaagaatttagtggaacagcacatacaggacatcgtcgtccattacacttttaacaaagtccttatgctgcaagagcctctgctggtagtggcagcattttacatcctgttctttacagtgatcatttacgtgaggctggatttctcgataaccaaggaccctgccgcagaggctcgcatgaaggttgcctgtatcaccgagcaggtgcttaccctggtgaataagaggattggcctgtacagacacttcgacgaaacggtgaaccggtacaagcagagcagagatatctccactctgaacagtggaaagaaaagtttagagactgagcataaggcgctgaccagtgaaatcgccttgttgcaatctaggctgaagacggagggcagtgacctatgtgatcgggtctcagaaatgcagaagctggacgctcaagtaaaagagctggtgctgaagtccgccgtagaggcagagagactggtcgccgggaagctgaagaaagatacctacatagagaacgagaagcttatttccggaaagaggcaggaactcgtaacaaaaatcgaccacattctggatgctctgtag

SEQ ID NO: 203541 - DNA, 1896 bp, Artificial Sequence
  Description of Artificial Sequence: Synthetic coding sequence
atggccccccccggcagcagcaccgtgttcctgctggccctgaccatcattgccagcacgtgggctctaactccaacacactacttgaccaagcatgacgtggaacgcctcaaagcatccctggataggccttttactaaccttgaaagtgctttttactccattgtaggcttatcttctctaggcgctcaggtgcctgacgcaaagaaggcctgcacttacatccgctccaacctggatccttctaacgtggatagcttgttttacgctgcccaagctagccaggccctgagcgggtgcgaaattagtatatccaacgagaccaaggacttgctattggccgctgtgtccgaagatagttcagtaactcagatctatcacgccgtggccgctctgtcagggtttggactccctctggcttcccaggaagccttatccgctctgaccgcgagactctcaaaagaagagacagtgttggctactgtccaggcactacagactgctagccacctctcgcaacaggccgaccttcggtctatcgtggaggagatcgaagacctcgtggcccgcctggacgaacttggaggggtgtatctgcagtttgaggaggggctggaaactacagctttgtttgtcgcagctacctataaactaatggatcatgtggggaccgagccttccatcaaggaggatcaggtcatccaactgatgaatgccattttcagtaaaaagaacttcgaatctctgtccgaggccttttctgtcgcctcagccgctgccgtcctgtctcataataggtaccacgtgcccgttgttgtcgtgcccgaaggtagcgcctcagatactcacgaacaggctatcctgcggctgcaggttactaatgtgttatcccaacccctcacccaggcaactgtgaaacttgaacatgccaaatccgtcgcgtcacgagccactgtcctgcagaagacatcattcacccctgtcggtgatgtgttcgagctcaattttatgaacgtgaagttttcatctggctactacgacttcctggtcgaagtggagggggataacaggtacatagccaacacagtggagctccgggttaaaatctctaccgaagtgggcataacaaatgtagacctctctacggtggataaagatcagagcatcgccccaaaaactacccgagtaacttacccagccaaagccaagggtaccttcatcgcagactctcaccaaaattttgccctctttttccaactggtagatgttaacaccggggcggagctgacgccccatcagaccttcgtccgtttgcacaatcaaaagaccggtcaagaggtggtttttgtagctgaacctgataacaagaacgtctataagttcgagctggacacgtccgaacggaaaatcgagtttgatagcgcatcgggcacatacaccctgtacctgattataggcgatgcaacactgaagaatccaattctgtggaatgtggccgatgtggtgattaaatttcccgaagaggaagcaccctctacagttctcagccaaaacctctttacccctaagcaagagattcaacatctcttccgggagccagagaaacggccaccaactgtggtgagcaacactttcacggcccttatattgtcccctctcctgctgctttttgccttatggattcgaatcggtgctaacgtcagtaatttcacgttcgcaccctcgaccattatctttcacctgggccacgcagccatgcttggcctgatgtatgtgtactggacccagctaaacatgtttcagactctgaagtacctcgcaatcttgggcagcgttacttttctggctggcaaccggatgctggcgcaacaggcagtgaagcgcacagcccactag

SEQ ID NO: 203542 - DNA, 1038 bp, Artificial Sequence
  Description of Artificial Sequence: Synthetic coding sequence
gtgagcccccagggcagcagcaccgtgttcctgctggccctgaccattattgcctctacttgggctctgacgccaacacattacctgacaaaacacgatgtcgaaagactgaaagccagtcttgacagaccatttaccaacctcgaatctgctttttactcaatcgtaggattgtcttctctgggcgcgcaggtgcctgatgccaagaaagcctgcacctatatccgatccaaccttgacccttcaaacgttgattcactgttttatgccgctcaggccagccaggcactttcaggatgcgaaatttcaatttccaatgaaactaaagatctgctgctggcagctgtgtccgaagacagctccgttacgcagatctaccacgcagtggccgctctgtctgggttcggtctacccctggcctcccaagaggctctcagcgccctgactgctcgcctgtcaaaggaggaaaccgttctcgcccgagtctggtcaactgtgctagaaagccggtctttgttctctaagagaactgttcaggccctgcagaccgccagccatctttcccaacaggctgatttgagatcaatcgtagaggagatcgaggacttggtggccagactcgatgagctgggaggggtgtacctgcagttcgaggaggggctcgaaaccacggccctgttcgttgctgcaacttacaagttaatggaccatgtggggacggagccatcgatcaaggaggatcaagtgatccagctgatgaatgcaatttttagcaagaagaactttgagagcttgtccgaagccttttcagttgcctctgcagcggcggtgctttcccacaatagataccacgtcccggtggtagtagtacctgaagggtctgcaagcgatacacacgaacaggcaatcttgcgcctgcaagtgactaatgtgttgagccaacctctgacccaggctacagtgaagctggagcacgctaagtccgtcgcaagtagggctactgtgctgcagaaaaccagtttcacaccggtcggatag

SEQ ID NO: 203543 - DNA, 1848 bp, Artificial Sequence
  Description of Artificial Sequence: Synthetic coding sequence
atggccccccccggcagcagcaccgtgttcctgctggccctgaccataatcgccagcacctgggccctaaccccgactcactatttgactaagcacgacgtcgagagactcaaggccagtcttgaccgtccctttaccaatctggagtccgctttctacagtattgtggggctatcctctttgggtgcacaggtcccagacgcaaagatatctattagcaacgagacaaaagatctacttttggcagctgtgtccgaggactctagtgtgactcaaatttaccatgccgtagcagcactctccgggtttggcctcccactcgcatcccaagaagctttaagtgcacttactgcacgtctgtccaaagaagaaaccgtgctggccaccgttcaggccttgcaaaccgctagccacttgagccagcaggcagatcttagaagcatcgtcgaggagatcgaggatctggtggctagattagacgagcttggaggagtatatctccagttcgaggagggcctggagacaacagctttgttcgtcgccgcaacttacaaactcatggaccatgtgggcactgagcccagcataaaggaagaccaagtgattcaattgatgaacgcgattttctcgaaaaaaaacttcgaatccttatccgaggccttttccgtggccagcgccgcagccgtcttgtcccacaacagataccacgtacctgttgtggtggtcccggaaggttcggcaagtgatactcatgaacaggcaatccttagactccaggtgactaacgtgctatcacagccgctgactcaggccacggtaaagctggagcatgccaagtccgtggcctctcgggccactgttcttcagaaaacatcgttcacacccgttggcgatgtgtttgaactcaatttcatgaacgtaaagttctcctctggctattacgactttcttgtcgaggtcgaaggtgataaccgatacattgcaaacaccgttgaactcagggttaagatctccactgaagtcggcatcacgaatgttgatctgtcaacagtcgataaagatcaatcaatcgctcctaagaccacccgcgttacctatcccgcaaaggctaaggggacgtttatcgcagattcccaccaaaacttcgccttgttcttccagctcgttgatgtcaatacaggggccgagttgacaccccatcaaactttcgtgagacttcacaaccagaaaactgggcaggaagtggtgtttgtcgccgagcccgacaacaagaacgtgtataaatttgaactcgacacgagcgagcggaagatcgagttcgattctgcctcgggcacatatacgctttatcttatcattggggacgctacccttaagaaccccatactgtggaatgtggccgacgtggtgataaaatttcctgaggaggaggcaccaagtacagtgctgagccagaacttatttacacctaagcaggagatacagcacctctttcgcgagccggagaagcggcccccaaccgtggtgtctaacaccttcactgcactcattctttctcccctcctgctgctcttcgcgttgtggattagaataggcgccaacgtaagcaattttacgttcgccccctcgacaatcattttccacctaggccacgctgctatgctgggtctgatgtacgtctattggacacaacttaacatgttccaaactctgaagtatctggccatactggggtcagtgactttcctcgccggcaatcgcatgctcgctcaacaggcagtgaagaggatagcggccgagcaaagctccagactagctaagtatcgtacgcttagaactgctcattag

SEQ ID NO: 203544 - DNA, 441 bp, Artificial Sequence
  Description of Artificial Sequence: Synthetic coding sequence
ggcacctacaccctgtacctgatcatcggcgacgccaccctgaagaatcccattctctggaacgtggctgacgtcgtcattaagtttcctgaagaagaggctcccagtacagtattatcgcagaatttgttcacaccgaagcaggaaatccagcacctattccgtgaacctgagaaaagacctccaacagtcgtcagtaacacctttactgctctcatcctatcaccgcttctcctattatttgccctatggatcaggattggcgccaatgtgagcaatttcactttcgccccatccacgatcatattccacctggggcacgccgaacagcacatctccagccgtcgtaagatggaaattctcaagaccgaatgtcaggaaaaggagtcacggactatacattccatgcgaaggaaaatggaaaaaaagaattttatctag

SEQ ID NO: 203545 - DNA, 1038 bp, Artificial Sequence
  Description of Artificial Sequence: Synthetic coding sequence
atggccccccccggcagcagcaccgtgttcctgctggccctgaccatcatcgcctccacatgggctctgacaccaacccactatttaaccaaacacgatgtagagcgactgaaggcatcactggatagaccctttaccaatctggagagcgccttctattccattgtggggttgtccagtcttggggctcaggtccctgacgcaaagaaggcatgtacatatatccgctctaatctggatcccagtaacgtggatagtctgttttacgctgcccaagcctcacaggcactctccggatgcgagatcagcatttcaaacgaaaccaaggacctcctgctcgctgccgtatcagaagattcctctgtcacccaaatctaccacgctgttgcagcgctaagcggcttcggcctgccccttgcaagccaggaagccctgtctgccctaaccgcaaggctctccaaagaagagacagttctcgcccgcgtttggtccaccgtcttagagagcagaagtctgttcagtaagagaactgtgcaggcccttcaaacagcttcccacctgtcccaacaggccgatctccgttccattgtcgaggagatcgaggatcttgtggcgcgactagatgagctcggcggggtgtacctgcaatttgaagaggggctagaaactacggcgctttttgtggccgctacctacaaattgatggatcacgttggtaccgagcccagcatcaaggaagaccaggtgattcagctgatgaatgctatattcagcaagaagaactttgagagcctgtccgaggccttttccgtggctagcgctgccgccgtcctatcgcacaataggtaccatgtgcccgtcgtggttgtgcctgaaggctctgccagtgatacacacgagcaggctattttgcgcttgcaagtaacaaacgtcctctctcagccactaactcaggctacagttaaattggagcacgccaaatctgtcgcttcccgcgctaccgtcctacagaagacaagctttacccccgtaggatag

SEQ ID NO: 203546 - DNA, 417 bp, Artificial Sequence
  Description of Artificial Sequence: Synthetic coding sequence
gagctggacaccagcgagcggaagatcgagttcgacagcgccagcgggacctacactttgtatctgataataggagacgcaacgctgaaaaatccgattttgtggaacgtcgccgacgttgtgatcaagtttcccgaggaggaggctccttcaactgttctctcgcaaaatttattcacaccaaaacaggaaatccagtggatccggattggggccaatgtaagtaactttacgtttgcaccttcaacgatcattttccacctgggtcacgcagctatgctgggcctgatgtacgtgtactggacccagcttaacatgttccaaaccctgaaatatctggccatcctgggcagtgttacatttttagccgggaaccgaatgctagcccagcaggcagtaaaacgaacagccgaatag

SEQ ID NO: 203547 - DNA, 417 bp, Artificial Sequence
  Description of Artificial Sequence: Synthetic coding sequence
gagctggacaccagcgagcggaagatcgagttcgacagcgccagcggcacgtacactctgtatctgataattggagatgccactttaaagaatccaatcctttggaatgtggcggatgtggttattaagtttccagaagaggaagccccctcaactgttctttctcagaatttgttcacacccaagcaggaaatacagtggattagaatcggcgcgaatgtaagtaacttcacattcgcgccttctactattatctttcacctaggccacgcagcgatgctggggttgatgtacgtttactggactcaattaaatatgttccagactctgaagtatctcgctattctcgggagcgtgacatttctggcaggtaatagaatgcttgcgcagcaagctgtaaagcggactgcccattag

SEQ ID NO: 203548 - DNA, 504 bp, Artificial Sequence
  Description of Artificial Sequence: Synthetic coding sequence
atgcagcggaccgtgcaggccctgcagaccgccagccacctgagccagcaggccgatcttcgctctattgtcgaggaaatagaagaccttgtcgcccgccttgatgaactcggaggagtgtaccttcagttcgaggagggcctagagacaaccgccctctttgtggctgccacgtacaagctgatggaccacgttgggactgaacccagcattaaagaagaccaggttatccagcttatgaacgccatattcagcaagaaaaatttcgagtccctttccgaggcttttagcgtggctagcgccgcggctgttttatcccataatcggtaccatgtgccagtggtggtcgttccggaaggctcggctagcgacactcatgaacaagcaatcctgcgactgcaagtgactaacgtacttagtcaaccacttacccaggccacagtcaagctcgagcatgcaaaatcagtggcctcacgtgccaccgttctacagaagacttcctag

SEQ ID NO: 203549 - DNA, 444 bp, Artificial Sequence
  Description of Artificial Sequence: Synthetic coding sequence
tgaggcacctacaccctgtacctgatcatcggcgacgccaccctgaagaaccccatcctctggaacgtggccgatgtcgttatcaagtttccagaagaggaggcgccttctactgtgctgagtcagaacctattcactcccaagcaggagatccagcacctctttcgtgagcctgagaagcggccaccaaccgtggtatctaacaccttcacagcccttatcctgtccccgctcctgctgctgtttgccctgtggatccggatcggcgccaatgtgagcaactttaccttcgcacccagcactatcatcttccacctaggtcatgccgagcagcacattagttcaaggagaaagatggaaattctcaaaaccgagtgtcaggagaaagagtcaaggacaatccactccatgcgaaggaagatggagaagaagaactttatctag

SEQ ID NO: 203550 - DNA, 936 bp, Artificial Sequence
  Description of Artificial Sequence: Synthetic coding sequence
atgcagcggcccggccccttcagcaccctgtacggccgggtgctggcacctctgccaggaagagcgggaggtgcggcttcagggggtggaggaaattcttgggacctccctgggtctcatgtgaggttgccgggaagggctcagtcgggtacacgcggcggggctggaaatacctctacatcttgcggtgatagtaactcgatctgtcccgcccctagcaccatgagtaaggctgaggaagcaaaaaagctggcggggagagctgcagtggaaaatcatgtccgtaataatcaagtgctgggaataggaagtgggtctactattgtccatgcggttcagcggatagctgagagggtcaaacaggagaacttaaatctagtgtgcatcccaacctccttccaggcaaggcagttaatccttcagtatggtttgacactgagtgatctcgatagacatcctgagatcgatctggctattgatggagccgacgaggtagatgctgatctgaatttgatcaagggggggggagggtgcctgacccaagaaaagatcgtggctggctatgcatctaggttcattgtgattgccgatttcaggaaggactcaaagaatcttggtgaccagtggcacaaaggcatccccatagaggtgatcccaatggcttacgtcccagtgtctcgcgctgtcagccaaaaattcgggggagtggtggagctgcgcatggccgttaacaaggcagggcctgtggttaccgacaacggaaattttattctcgactggaagtttgatcgggtgcacaaatggagtgaagtgaacactgccattaagatgataccaggcgtcgtggacaccggtctgttcataaacatggctgaaagagtatatttcgggatgcaagacgggtcagtgaacatgcgggaaaaaccattctgttag

SEQ ID NO: 203551 - DNA, 534 bp, Artificial Sequence
  Description of Artificial Sequence: Synthetic coding sequence
gcccggcagctgatcctgcagtacggcctgaccctgagcgacctggaccggcaccccgagattgatctggcaatcgacggcgctgacgaagttgacgcagaccttaatttaattaaaggcgggggagggtgcctgacacaagaaaaaatcgtcgctgggtatgcctcccgctttatcgtcatcgccgactttaggaaggatagcaagaatctgggggatcagtggcataaaggtattccaatcgaagttattcctatggcctacgtcccagtgtcacgggcggtgtcacagaaatttgggggggtggtggaactgcgtatggctgtgaataaagctggccctgtggtgactgataatggtaacttcattctcgattggaagttcgaccgcgtccataagtggtctgaggttaacactgcaatcaaaatgattccaggggtagtggatactgggttattcattaacatggcggagagggtttactttggaatgcaggacggttcggtgaacatgcgggaaaagcctttctgctag

SEQ ID NO: 203552 - DNA, 492 bp, Artificial Sequence
  Description of Artificial Sequence: Synthetic coding sequence
atgcggatcgagaagtgctacttctgcagcggccccatctaccccgggcatggaatgatgttcgtccgaaacgactgcaaggtattccgattctgtaagtctaagtgtcataaaaactttaaaaaaaagaggaacccgagaaaggtcagatggacaaaggcatttcgaaaagctgccggtaaagaacttacggtggacaactcttttgaattcgagaaaaggagaaacgagcctataaaatatcagagggaactatggaacaagaccatcgacgctatgaagcgcgtagaggaaattaagcagaagcgtcaggcaaaattcatcatgaatcgtctgaaaaaaaacaaagaactgcagaaggtccaagacattaaggaggtgaagcagaacattcatctaatcagagcccctctagctgggaagggcaaacagctcgaagagaagatggtacaacagctgcaggaagatgtggatatggaggacgcaccttag

SEQ ID NO: 203553 - DNA, 1161 bp, Artificial Sequence
  Description of Artificial Sequence: Synthetic coding sequence
atgtgcagcagcgtggccgccaagctgtggttcctgaccgaccggcgcatcagggaagattacccacaaaaggaaatcctccgtgctctgaaggccaaatgctgcgaggaggagctggacttccgggctgttgtgatggatgaggttgtgctgacaattgagcagggaaacttaggactccgtattaacggcgagctcattactgcctatcctcaggtggtggttgtcagggtccccacaccttgggtccagtcagacagcgacatcactgttctccgacatctcgagaagatgggatgccggctgatgaacaggccacaagccattctgaattgcgtaaacaagttctggacttttcaagagctcgctggccacggcgtccctcttccagatacattttcctacggcgggcacgagaactttgccaaaatgattgatgaggcagaagtgctggagttccccatggtggtcaaaaacacgagagggcacagagggaaggcagtgttcttagcgcgcgacaagcatcacctggccgacttgtcccatttaattcgccacgaagccccctacctgttccagaaatatgttaaggaatctcatggcagggatgtgcgcgttattgttgtcggcgggcgagttgtcgggaccatgctgcgatgcagcacggatgggcggatgcagtccaattgtagcctcggtggtgtggggatgatgtgttccctgagcgaacagggcaagcagctcgcaatccaggtttcaaacattttaggcatggatgtctgcgggattgacctgttgatgaaagatgacgggtcattttgtgtgtgcgaagcaaacgcgaacgtggggttcatagcttttgataaggcctgcaatttggatgtcgcaggcataatcgccgattatgccgcgagcctgttaccctctggccgacttacaaggaggatgtctttgctaagtgttgtgagcaccgcaagcgaaacgagcgagccagaattgggcccacctgcgagcacagctgtcgacaatatgagcgccagctcttctagtgttgatagcgaccccgagagcactgagcgggaactcctaactaagctcccaggcggcctatttaacatgaaccagctgctggccaacgagataaaattgctggtcgattag

SEQ ID NO: 203554 - DNA, 1161 bp, Artificial Sequence
  Description of Artificial Sequence: Synthetic coding sequence
atgtgcagcagcgtggccgccaagctgtggttcctgaccgaccggcggatcagggaagattatccacagaaggagatcctgagggctcttaaagccaagtgttgcgaggaagaactggatttcagagcagttgttatggacgaggtggtccttacaattgaacagggtaacctagggctgaggatcaatggcgagctgattactgcatatccccaggtggtcgtggttagagtacctactccttgggtacaatcggacagcgatatcaccgtcctgcggcacctggaaaaaatgggctgccggctgatgaaccgcccacaagccatattaaactgtgttaataaattttggaccttccaggagctggcaggccacggggtgcccctgccagacacgttcagctacggcggacatgagaatttcgccaagatgatagatgaggccgaggtcctggaattcccgatggtcgtcaagaacacacgaggtcatagagggaaggcggttttcctagcccgggacaagcaccacctcgccgacctgtcccatcttattcgacacgaggcaccgtatttgtttcaaaagtatgtcaaggagtcccacggtagagacgtcagggtgatcgttgtggggggcagagtggtcggaacaatgctgagatgttctaccgacggtagaatgcagtccaattgttctttgggtggtgtcggaatgatgtgctcactaagtgagcagggcaagcagctggctatccaagtgagtaacatcctggggatggatgtgtgtgggatagatttgctgatgaaagacgacggatcgttttgtgtttgcgaggcaaatgccaacgtcggcttcatcgcctttgacaaggcctgcaatttggacgttgccggaataatcgccgattacgctgcctctctgctgccgagcggaagactaactcggcggatgtcccttctctctgtggtgagtaccgcctccgagaccagcgagccagaactcggtcctcccgcaagtaccgctgttgacaacatgagtgcttcatcatcctcggtggattctgaccccgagtctaccgaacgcgaattactgaccaagctgccaggaggactctttaatatgaaccaattgctggccaacgaaatcaaattactggttgactag

SEQ ID NO: 203555 - DNA, 1161 bp, Artificial Sequence
  Description of Artificial Sequence: Synthetic coding sequence
atgtgcagcagcgtggccgccaagctgtggttcctgaccgaccggcgcattcgagaggattatccccagaaggagatcctgagggcactgaaagcaaagtgttgtgaggaagagctcgactttcgggcagtggtgatggacgaagttgttttaacaattgagcaggggaacctggggctcaggataaacggcgagttgataacggcttatccccaggtggtcgtggttagagtccctaccccatgggtgcagtcagacagcgacatcaccgtactgcgtcatttagaaaagatgggatgtcggctgatgaatcgcccacaggccattcttaactgtgtgaacaaattttggacttttcaagagttggccggccatggggtccccttacctgatacctttagttacggcggacacgagaactttgctaagatgatcgatgaggccgaggtgcttgaattcccaatggtggtaaagaacacccggggccaccgcggtaaagccgttttcctcgcgcgcgacaaacaccacctcgccgatctgagtcacctcattcggcacgaggccccttatcttttccagaaatacgtgaaggagtcacacggccgggacgtgcgcgttatcgttgtgggcggccgtgtggtgggaaccatgctgcggtgctcaaccgatggcaggatgcaatctaactgctctttagggggtgtcgggatgatgtgctccctaagtgaacaggggaagcagctcgccattcaggtgtccaacattctgggaatggacgtgtgcggaatcgatctcctgatgaaggatgatggctcattttgtgtgtgcgaagctaacgccaacgtgggtttcattgcatttgataaggcatgcaacctggacgtcgccggaattatagccgactatgccgctagccttctgcctagcgggaggctgacacggcgcatgagtctcctgtccgttgtgtccactgccagcgagacctccgagcctgaactgggcccgcctgcctctaccgctgtggataatatgagtgctagttcctcatctgtagatagcgacccagaatcaaccgaacgcgagctgttaactaaactgccaggcgggctgtttaatatgaatcaactccttgccaatgagattaaacttctagtggactag

SEQ ID NO: 203556 - DNA, 288 bp, Artificial Sequence
  Description of Artificial Sequence: Synthetic coding sequence
atgtgcagcagcgtggccgccaagctgtggttcctgaccgaccggaggatccgcgaagattatccacagaaggagattctgagggcacttaaggcaaagtgttgcgaagaggaactggacttccgagccgttgtcatggacgaggtcgtcctgacgattgaacagggtaacctcggccttagaattaacggcgagctgatcaccgcctacccacaggtcgtagtagtgagggtgccaaccccttgggttcaatccgattctgacataactgtgcttagacacctgtag

SEQ ID NO: 203557 - DNA, 345 bp, Artificial Sequence
  Description of Artificial Sequence: Synthetic coding sequence
atgtgcagcagcgtggccgccaagctgtggttcctgaccgaccggaggataagagaggactacccgcagaaagagatcctgcgggcccttaaggccaaatgttgtgaagaggaactggatttccgcgccgtggtcatggatgaggtagtgttaacaattgaacagggcaatcttggcttaagaatcaacggagaacttataacggcttatccacaagtggttgtggtgcgagtccccaccccttgggtgcagagtgattctgatatcacagtgctacgccatctggaaaagatggggtgcagactgatgaatcggccccaggccatcctcaactgcgttaactag

SEQ ID NO: 203558 - DNA, 645 bp, Artificial Sequence
  Description of Artificial Sequence: Synthetic coding sequence
atgggccggcggcccgcccggtgctaccggtactgcaagaacaagccctatccgaagagcaggttctgtcgtggcgtgcctgacgcgaagatcagaatcttcgatctcggacgtaaaaaagctaaggttgatgaattccctctgtgcggacacatggtaagcgatgaatacgagcaactctcctcagaggctctcgaggccgctaggatttgcgccaacaagtacatggttaagtcatgcggaaaggacggattccatatacgggtgcgcctgcatccttttcatgtgatcaggataaataaaatgctttcttgcgccggggccgaccgcctgcagacagggatgaggggagcttttggaaaacctcaagggacagtggcccgagtccatatcggtcaagtgattatgtccatcaggaccaagcttcagaacaaggagcacgtaatcgaagccctgcgtcgtgccaagttcaagttccctggccgtcaaaaaatccacataagcaagaagtggggttttacaaaatttaatgccgacgagttcgaggatatggtggccgagaaacgcctgattcccgatggctgcggagtgaaatatataccaaataggggccccctggacaaatggcgtgctctgcactcctag

SEQ ID NO: 203559 - DNA, 645 bp, Artificial Sequence
  Description of Artificial Sequence: Synthetic coding sequence
atgggccggcggcccgcccggtgctaccggtactgcaagaacaagccctatcctaaatctaggttctgtagaggagtcccggatgcaaagattcgtatctttgatctgggcagaaagaaggcgaaggtggatgagtttccactctgtggccatatggtaagcgatgaatacgaacagctgagctctgaagctctggaggcagctaggatttgtgccaataagtacatggtcaaaagctgtgggaaagacgggtttcacatccgcgtacggctgcacccgttccacgttatcaggattaataaaatgctttcatgcgctggcgccgatcgcttgcagacaggaatgaggggcgccttcgggaaaccccaaggtaccgtggcgagggttcatatcgggcaggtgatcatgtcaatccggaccaagctacagaacaaggagcacgttattgaagccctgcgacgcgctaagtttaagttccctggacggcagaagatacacatctctaaaaagtggggattcactaagttcaatgccgacgagtttgaagatatggtggcagagaaaaggctcattcccgatggttgtggtgtgaagtatattccaaatcgtggccccctcgataaatggcgcgccctgcacagttag

SEQ ID NO: 203560 - DNA, 645 bp, Artificial Sequence
  Description of Artificial Sequence: Synthetic coding sequence
atgggccggcggcccgcccggtgctaccggtactgcaagaacaagccttaccccaagtctaggttctgccgaggagttccagacgcaaagatccgaatttttgatctgggccgcaagaaggcaaaggtcgacgagttcccattgtgcggccacatggtgtcagacgaatatgaacagctgagcagcgaggcactggaggcagctcgaatttgcgcgaacaagtacatggttaaaagctgtggaaaggacgggtttcacatccgggttagactccatccttttcatgtgattaggattaataaaatgctatcatgcgccggcgcagacagattacagaccggtatgagaggtgcctttggaaagcctcaggggacggtggccagggtacacattggacaggttattatgagtatcagaactaagctgcagaataaggagcatgtgattgaagcgctgaggcgggctaaatttaagttccccggacggcagaaaattcacatcagcaaaaaatggggattcactaagttcaacgccgacgaattcgaagatatggtcgcggagaagcggctgatccctgatggctgcggcgttaaatatatccctaatcgcgggcctctagataaatggcgcgctttgcatagctag

SEQ ID NO: 203561 - DNA, 606 bp, Artificial Sequence
  Description of Artificial Sequence: Synthetic coding sequence
atgggccggcggcccgcccggtgctaccggtactgcaagaacaagccatatcctaagagccgtttctgtaggggggtgcccgacgcgaagatcagaatcttcgaccttgggcggaaaaaggccaaagtagacgagttccctctgtgcggccacatggtgagcgatgagtacgagcaactgtcatccgaggctctcgaggcggctcggatctgcgctaacaagtacatggttaagtcctgcggcaaggacggcttccacataagagtcagactgcacccatttcatgtgatccgaatcaacaaaatgctgtcctgtgcaggagcagaccggttacagactgggatgcggggcgcattcgggaagccacagggaactgtagcacgagttcatatcggacaggttatcatgtccattagaacaaagctccagaataaggagcacgtgatagaagcgctgcgccgggcaaagttcaaattccctggccggcaaaaaatccatataagtaaaaaatggggatttaccaaatttaacgcggatgagtttgaggacatggtcgccgagaagagactgatcccagacggctgcggtgttaagtatattccctag

SEQ ID NO: 203562 - DNA, 327 bp, Artificial Sequence
  Description of Artificial Sequence: Synthetic coding sequence
cccaagagccggttctgccggggcgtgcccgacgccaagatccggatttttgatcttggaaggaaaaaagccaaggtcgacgaatttcctctttgtggacatatggtgtcagacgaatacgagcaattatcgagcgaagcactggaggcagcaaggatctgcgcgaataagtatatggttaaaagctgtggaaaagatggatttcatatccgggtaagactgcatcctttccacgttatccgaataaacaagatgttgtcctgtgccggcgcggatcgacccaccctgctctgtcagtgctgggagacatcccgcaatacttcttag

SEQ ID NO: 203563 - DNA, 546 bp, Artificial Sequence
  Description of Artificial Sequence: Synthetic coding sequence
atgggccggcggcccgcccggtgctaccggtactgcaagaacaagccgtaccctaagagtcgattctgccggggagtccccgacgctaagattaggatttttgatctgggtcgaaagaaggcaaaggtggacgaattccccctctgcgggcacatggtctcggatgagtacgaacagctgtcatccgaagctctggaggctgccagaatttgtgcaaataagtatatggtcaagagttgcggcaaggatggattccatattagggtgcgtttgcacccattccatgtgatcaggatcaacaagatgctgagttgcgccggggctgatagaagcacttcacaaagatctggtgccagccctagttccatgttaatgaatttgaagacatggtggctgaagtcaggatcctcgcaaatggccgttggcagtagcaccagccctattgtggcgctgtggacctccggagggccatgtacacacgagggatttcagtgcgccgccccattgctgattctgaccaacaagttttactttcttagcacgtag

SEQ ID NO: 203564 - DNA, 537 bp, Artificial Sequence
  Description of Artificial Sequence: Synthetic coding sequence
atggcccaggaccagggcgagaaggagaaccccatgcgggagctgcggattcggaaattgtgcctgaatatctgtgtaggggagtcgggagatcgattaacaagagccgccaaagtgcttgaacagctcacagggcagactcctgttttcagtaaggctagatacactgtgaggtcgttcggcatacgtagaaacgagaaaatcgccgtgcactgcacggtgcggggcgccaaggctgaagagatactggaaaagggacttaaagtgcgggaatacgagctgcggaaaaacaacttttccgacaccggcaacttcggatttggaattcaggagcatatagacctggggattaagtatgacccatccatcggcatctacggcttagatttctacgtggtccttggcaggccaggcttttcaatcgccgacaagaaaagacgtactggttgtatcggggctaagcatcgcatcagcaaagaggaagcaatgaggtggttccagcagaagtacgacgggatcatcctgcccggcaagtag

SEQ ID NO: 203565 - DNA, 396 bp, Artificial Sequence
  Description of Artificial Sequence: Synthetic coding sequence
caggaccagggcgagaaggagaaccccatgcgggagctgcggatccgaaagctatgtctgaacatatgcgttggtgagtccggcgacagattaactcgggccgctaaggttctggaacagttgactggtcagaccccggtctttagtaaagccagatacacggtccgctcattcggcattaggcgtaacgagaaaattgccgtgcattgcacagtgcggggggccaaggctgaggagatactggagaaggggctgaaagtgcgagagtacgagcttagaaagaacaacttcagtgacactggaaactttggattcgggatacaagagcacatcgatctcggtattaaatatgacccatctattggtatctacggtttggacttttacgtcgtgtag

SEQ ID NO: 203566 - DNA, 525 bp, Artificial Sequence
  Description of Artificial Sequence: Synthetic coding sequence
caggaccagggcgagaaggagaaccccatgcgggagctgcggatcagaaagttgtgtttgaatatttgtgtgggagaatctggggatagactgactcgtgccgccaaggtacttgagcaactcacaggtcagaccccggtgttttcaaaggccaggtataccgtcaggtccttcggaattagaagaaatgaaaagattgctgtgcactgcaccgttcgcggggccaaggcagaggagatcttagaaaagggcctgaaggtgcgggaatacgaactgcgaaaaaataacttttccgacaccggtaactttggattcggtatacaggagcacattgacctggggataaaatatgacccttctattggcatttatgggctcgacttttatgtcgtgctcggccgacccggcttcagcatagcggataagaagagaagaacaggatgcattggcgcaaaacacagaatcagcaaagaggaggctatgcggtggtttcagcagaaagtgaaattgatttacctcaaatag

SEQ ID NO: 203567 - DNA, 498 bp, Artificial Sequence
  Description of Artificial Sequence: Synthetic coding sequence
atgccccccaagttcgaccccaacgagatcaaggtggtgtacctgagatgcacgggtggggaagtaggtgcgacatcagctctcgctcccaagattggaccccttggtctcagcccaaagaaggtcggcgacgatatcgctaaagccaccggcgactggaagggtctgcgaatcactgtgaaattaaccattcagaaccggcaagcacagatcgaggtggtaccaagtgccagcgcgttaataatcaaagctctgaaggaacccccccgggaccgcaagaaacaaaaaaatatcaagcattctggaaacatcacatttgatgagatcgtcaatatcgcgagacagatgcgccaccgatctcttgccagggagctgtccggtacaataaaagagattctaggtacagctcagtctgttgggtgtaacgtggatggtaggcaccctcacgatataatagacgacataaatagcggggctgtggagtgtccagcctcttag

SEQ ID NO: 203568 - DNA, 399 bp, Artificial Sequence
  Description of Artificial Sequence: Synthetic coding sequence
atgccccccaagttcgaccccaacgagatcaaggtggtgtacctgaggtgcaccggcggggaagtcggggcgacatcagctttggccccaaaaattggacccctcggcctgattgaggtggtccccagcgccagcgctctgattatcaaggctttgaaagagcctcctcgcgacaggaagaaacagaaaaatattaagcactccggaaatatcacatttgacgagattgtcaacatcgccagacaaatgagacaccgcagccttgcacgggaattgtctggtaccatcaaagagatcctgggcaccgcccagtcggtcggctgcaacgtcgatggccgccatccccacgatatcatcgacgacatcaattccggagctgtggagtgccccgcctcatag

SEQ ID NO: 203569 - DNA, 636 bp, Artificial Sequence
  Description of Artificial Sequence: Synthetic coding sequence
atggcccccagccggaacggcatggtgctgaagccccacttccacaaggattggcagaggcgtgtggctacgtggttcaatcaaccggcccggaaaattcggcgtcggaaggccaggcaagccaaagccagaagaatcgcaccgcgaccggccagcggacccatcagaccgatcgtaagatgtcctaccgttcggtatcacacgaaagtgcgtgccggacgtgggttcagtctcgaggaactgcgagtggcaggcatccataagaaggtggcccgaacgattgggataagcgtagatccgcggagaaggaataaatctacggagtctctgcaagctaacgttcagaggctgaaagaatatcggtcaaagctgatcttgtttcccaggaaaccctctgctcctaaaaaaggagatagctcggctgaggaactcaaattagctactcagctcactggcccagttatgccagtgaggaatgtctataaaaaagagaaagctcgtgtcattacagaagaggaaaagaatttcaaggccttcgcttccctgaggatggcgcgtgccaatgcccgtctgttcggtattcgcgctaaaagagcgaaagaggcagctgaacaggacgtagaaaaaaagaaatag

SEQ ID NO: 203570 - DNA, 636 bp, Artificial Sequence
  Description of Artificial Sequence: Synthetic coding sequence
atggcccccagccggaacggcatggtgctgaagccccacttccacaaagactggcagcgacgggtggccacatggtttaatcagccagccaggaaaatccgccgccgcaaagccagacaggcaaaagcccgacgcatagctccccgccctgctagtggacctataaggcctatcgtgcgctgtccaactgtgcgatatcacacgaaggtgcgtgctgggcgcggattttctctagaggaactgcgagtggctggaatccataaaaaagtcgccagaaccattggcatttctgtggatccacggagacgcaacaaaagcaccgagtcattacaggctaacgtgcagcgcctcaaagaatacagaagcaaactcattctgtttccccgtaagccctcagcccccaagaaaggtgacagcagtgccgaagaactcaagttggccacgcagctgactgggccagttatgccagtccgtaacgtatataagaaagagaaagcacgcgtgattacagaagaagaaaaaaactttaaggcgttcgcctctctccgcatggcgcgggctaatgcgcgtctcttcggtattcgcgccaagagggccaaggaggccgcggaacaggacgtcgaaaaaaagaaatag

SEQ ID NO: 203571 - DNA, 495 bp, Artificial Sequence
  Description of Artificial Sequence: Synthetic coding sequence
atggcccccagccggaacggcatggtgctgaagccccacttccacaaagattggcagcgtagggttgccacgtggttcaatcagcctgcaaggaagattaggaggcgtaaagcgcgacaggccaaggcccgtcggatcgccccccggccagcctctggcccaatccgtcccattgttcgctgtcccaccgtccggtaccatactaaagtccgcgccggaagaggattctccttggaagagttaagggtggccggcattcacaagaagggtgattccagcgcggaagagttaaaattggcgacacagctcaccggccctgtgatgccagttcgtaatgtgtacaaaaaagagaaggcccgagtaatcactgaggaggaaaaaaattttaaggcattcgcatcactgcgcatggcacgagctaacgcgagactgtttgggattagggctaaaagggccaaagaggccgccgaacaggatgtcgagaagaagaagtag

SEQ ID NO: 203572 - DNA, 615 bp, Artificial Sequence
  Description of Artificial Sequence: Synthetic coding sequence
atgggcgcctacaagtacatccaggagctgtggcggaagaagcagagtgacgtgatgcgtttcctcctcagagtcagatgttggcagtatcgacagctaagtgctctgcatagagcgcctagacctactagacctgacaaggccagaagattgggctacaaagcaaagcaagggtatgtaatctataggatccgggtccggagggggggccgcaagcgaccggtaccgaaaggtgcaacttatggtaaacccgtgcaccacggcgtgaaccagctgaaattcgctcggtcccttcaatccgttgctgaggaaagagcaggcaggcattgtggagccctgagggtgctaaatagttactgggtgggcgaggacagcacctacaagttctttgaagtcatccttattgatcctttccacaaagccatacgtcgcaatccggacacccagtggatcaccaaaccggtgcacaaacaccgcgagatgcgtgggctgacaagcgccggcaggaaaagccggggattaggtaaaggacataaatttcaccacacaatcggaggatcacggcgtgctgcctggaggcgtcgcaatacgcttcagctacataggtacagatag

SEQ ID NO: 203573 - DNA, 615 bp, Artificial Sequence
  Description of Artificial Sequence: Synthetic coding sequence
atgggcgcctacaagtacatccaggagctgtggcggaagaagcagtctgatgtgatgaggttcctactgcgggttagatgttggcagtacaggcagctgtctgccctacatcgggcccctcgtcctactcggccggacaaggccaggcgacttggctacaaggctaaacagggatacgtcatttataggattagagtgagaagagggggcaggaaacgacctgtccccaaaggcgccacctacggtaaaccagtgcatcacggtgtaaaccagctgaagttcgcaagaagcctgcagtccgtggccgaagaacgcgctgggaggcactgcggcgctctccgcgtgttaaactcgtactgggtgggagaagactccacatataaattcttcgaggtgattctcatcgacccttttcacaaggcaatcagacggaatccggatacacagtggatcaccaaacctgttcacaagcaccgcgaaatgagaggactgaccagcgccggtagaaaaagtcgtggactgggtaagggacacaagttccaccacacaattggggggagccggcgcgcggcctggaggcggaggaacactctgcagctgcacagataccgatag

SEQ ID NO: 203574 - DNA, 528 bp, Artificial Sequence
  Description of Artificial Sequence: Synthetic coding sequence
atgggcgcctacaagtacatccaggagctgtggcggaagaagcagtccgatgtgatgaggtttctcttgagagtgcgatgttggcagtaccgccagctttctgccctccaccgggctcccagacctacgaggcccgacaaagccaggagacttggatacaaagcaaaacaaggctacgttatctatcgcatcagggtgagaaggggcgggaggaaacgccccgtgccaaaaggggctacatacgggaaaccggtgcaccatggagtgaaccagttaaagttcgcacgcagcctccagtccgttgctgaagttaatgctggacgccactgtggggcactgagggttctcaacagctattgggtgggcgaggactctacgtacaagttcttcgaggtcattctgatcgacccgttccataaggccatccgccgaaatcccgatacccagtggattaccaagccagtgcataagcatcgggaaatgcgcgggcttacttccgcgggcaggaagtctcgtggcctcgggtag

SEQ ID NO: 203575 - DNA, 615 bp, Artificial Sequence
  Description of Artificial Sequence: Synthetic coding sequence
atgggcgcctacaagtacatccaggagctgtggcggaagaagcagagcgatgtcatgcgctttcttttacgtgtaagatgctggcagtaccggcagctgagcgcactccatcgcgctccccgtcccactcgaccagacaaagcgcgccgcctgggctataaggccaagcagggatatgtgatataccggatccgtgtcagaaggggcggccggaagcggccagtgcccaaaggcgcaacatatggaaagcccgtccatcacggtgtgaaccagctaaaattcgcaaggagcctccagtccgttgctgaagagagggcgggtagacactgtggagccctgagggtgctcaactcctactgggtcggcgaagattccacctataaattcttcgaggtgattctgattgatccgtttcacaaggcgattagacgcaacccagatactcagtggataaccaaacccgttcataagcacagggagatgaggggacttacttctgctgggcggaaatctcggggactgggaaagggccataaatttcatcataccattgggggatcgcgccgagcagcctggaggagacgcaacacccttcagctacataggtaccgttag

SEQ ID NO: 203576 - DNA, 615 bp, Artificial Sequence
  Description of Artificial Sequence: Synthetic coding sequence
atgggcgcctacaagtacatccaggagctgtggcggaagaagcagagcgacgttatgagattcttgctcagggttcgatgctggcagtaccggcaattgtcagcactccacagagcccctagaccgacaagaccagacaaagcccggcggttaggctataaggcaaagcaagggtatgtcatctatcgcatccgagtgcgcaggggggggaggaaaagaccagtgcccaagggcgctacctacggcaaacccgtgcatcatggagtaaaccagctgaaatttgcaaggtccctgcaaagcgtagccgaagaaagagcaggtcggcattgtggggccctaagggtgctgaattcttactgggtgggagaggacagcacgtataaattcttcgaagtcatcttaattgatccattccataaagccattaggcgtaacccggatacccagtggattaccaagcctgtccataaacatcgagaaatgagagggttgactagtgccggccgtaaaagtaggggactaggcaaggggcacaaattccatcacacaataggaggctcacgcagggcggcttggaggcgcagaaatacccttcagctccacagataccgctag

SEQ ID NO: 203577 - DNA, 402 bp, Artificial Sequence
  Description of Artificial Sequence: Synthetic coding sequence
atgggcgcctacaagtacatccaggagctgtggcggaagaagcagtccgacgtcatgaggtttctcttaagggtgaggtgttggcagtataggcagttgtccgccctccatcgggccccgcgcccgacgcgcccggacaaagcccggcgcctgggatacaaagccaaacaaggctacgtaatctatcgcatcagggttagacgaggcggtcgcaagcggccggtgcccaagggagcaacctacggcaagcccgtccatcatggagtgaatcagctgaagttcgcgcggtcattgcagagcgtcgccgaggaacgcgcaggtcggcactgtggagctctgcgtgtgctgaattcctactgggtgggcgaggactccacctataagtttttcgaagtgatttag

SEQ ID NO: 203578 - DNA, 525 bp, Artificial Sequence
  Description of Artificial Sequence: Synthetic coding sequence
atgggcgcctacaagtacatccaggagctgtggcggaagaagcagtctgatgtaatgaggttcttgctgcgcgtgaggtgttggcagtaccggcagctatccgcccttcatcgggcgccacgcccaaccaggccagataaggcacgtaggctggggtacaaagccaagcaggggtacgtgatatataggatcagagttagaagaggcggcagaaagaggcccgtccctaagggggccacttacggcaaaccagtacaccacggagtaaatcagcttaaattcgccagatccttacaatccgtcgccgaagaaagggccgggaggcactgtggagcccttagagtgcttaactcctactgggtgggagaagactccacttataagttctttgaggtcatcctcattgacccttttcacaaggctatccggcgcaatcccgacacacagtggatcactaagcctgttcataagcacagggagatgagggggctgacctctgccggacggaagagccgcgggctgtag

SEQ ID NO: 203579 - DNA, 615 bp, Artificial Sequence
  Description of Artificial Sequence: Synthetic coding sequence
atgggcgcctacaagtacatccaggagctgtggcggaagaagcagtcagatgtaatgaggtttctattgagggttcgatgctggcagtatcgccagctgagtgcactccatcgtgcaccacgcccaacacggccagacaaggcacgcaggttgggctataaagctaaacaagggtatgtgatttacaggatcagggtgaggcggggtggcagaaaacggcctgtgccaaagggagccacatatgggaaacccgttcatcacggtgtaaaccagctgaagtttgcccggtctctgcagtctgtcgcggaggaacgcgccgggcgccactgcggagctctgcgcgtcctcaactcctactgggtcggagaggacagcacatataaatttttcgaagtgattctgatagaccctttccataaggctattcgccgcaaccccgatacacagtggattacaaagcctgtacataaacatcgtgagatgagggggctcaccagtgctggaagaaaatccaggggactggggaaaggacacaaatttcaccacacaattggcggcagccgccgcgccgcttggcgcagaaggaatacactacagctccaccgctaccggtag

SEQ ID NO: 203580 - DNA, 180 bp, Artificial Sequence
  Description of Artificial Sequence: Synthetic coding sequence
atgggcgcctacaagtacatccaggagctgtggcggaagaagcagtccgatgtgatgcgcttcctcctgagggtgcgctgctggcagtatagacagctttcagctctgcaccgcgctccccgcccaactagacccgacaaagcacgcagactgggttacaaagcgaagcagggcacatag

SEQ ID NO: 203581 - DNA, 438 bp, Artificial Sequence
  Description of Artificial Sequence: Synthetic coding sequence
atgggcgcctacaagtacatccaggagctgtggcggaagaagcagagcgacgtgatgcggttccttctacgggtgagatgttggcagtacagacagctgagcgcactccacagggcaccccgacccacccgtcctgacaaggccaggagactggggtacaaagcaaagcaggggtacgttatatatcgcatacgggtgaggcgtggggggcgaaaacgcccagtccccaagggcgcaacctatgggaagcccgtgcatcacggtgtgaatcagctgaagtttgccagatcgttgcaatcagttgcagaggagcgagctgggcggcactgtggcgccctacgagtcctgaattcctactggatggaaagccattcacacagcggaggttccgcggttggacagtccagactgaccgctacctccgtaagcagggtttag

SEQ ID NO: 203582 - DNA, 495 bp, Artificial Sequence
  Description of Artificial Sequence: Synthetic coding sequence
atgggcgcctacaagtacatccaggagctgtggcggaagaagcagtccgacgttatgcgtttcttattgagggttcgctgctggcagtaccggcagctttctgctcttcacagggcaccaagaccaacacgtccggacaaagcccgaaggctcggctacaaggccaagcagggatatgtgatatatagaatacgcgtgcgacgcggggggcggaaacgccctgtaccaaaaggggctacatacggtaagccggtgcatcatggagttaatcagctcaaattcgcccgttctcttcaatccgtggcagaagaacgggccgggcggcattgtggagccttacgagtgcacaagcatagagaaatgagagggctcacaagtgcagggagaaaaagccgcggcctcggaaagggacacaagttccaccacactattggcgggtcccgtcgagctgcctggcgccgaagaaatacattacagcttcatcgctatagatag

SEQ ID NO: 203583 - DNA, 441 bp, Artificial Sequence
  Description of Artificial Sequence: Synthetic coding sequence
atgcacatccggaaggccaccaagtacctgaaggacgtgaccctgcagaaacagtgtgtacctttcaggcggtacaatggtggcgtggggagatgtgctcaggcaaaacagtggggctggacacaggggagatggcccaaaaaatctgccgagttcttgctgcatatgctgaagaatgctgaatctaacgcagagctgaaaggattagatgtggactccctcgtaattgaacatatacaggtgaacaaggcccccaaaatgaggaggcggacctatcgcgcgcacggtcgcataaatccctatatgagctcaccatgtcatatcgaaatgattctcacagagaaggagcagattgtccccaaacccgaggaggaagtcgcccaaaaaaagaagatcagccagaaaaagttaaagaagcaaaaactgatggccagggagtag

SEQ ID NO: 203584 - DNA, 555 bp, Artificial Sequence
  Description of Artificial Sequence: Synthetic coding sequence
atggtgcggtacagcctggaccccgagaaccccaccaagagctgcaagtccaggggctctaatctccgggtccacttcaagaacaccagagagactgcacaggccatcaaaggaatgcacatccgcaaggcaaccaaatatctgaaagatgtgactcttcaaaagcaatgcgtaccattccggagatacaatggcggagtagggagatgcgcccaggccaagcaatggggatggacccagggcagatggccaaaaaagtcagcggagttcctgctgcacatgttgaaaaacgccgaatccaacgcggagctgaagggattggacgtcgacagccttgtgatcgaacacattcaggttaataaggcaccaaagatgagaaggagaacctatcgtgcacatggtcggatcaatccctatatgagcagtccatgccacattgaaatgatattaacggagaaggagcagattgtcccaaaacccgaggaagaagtggcccaaaaaaaaaaaatctcccagaaaaaactaaaaaaacaaaagctaatggctagggaatag

SEQ ID NO: 203585 - DNA, 555 bp, Artificial Sequence
  Description of Artificial Sequence: Synthetic coding sequence
atggtgcggtacagcctggaccccgagaaccccaccaagagctgcaaatcccggggctccaatcttcgcgtccactttaagaatactcgggagacggctcaagccattaaggggatgcacatcaggaaggccacgaagtacctgaaggacgtgaccctgcagaaacagtgcgtgccctttcgtcgatataatggcggggtcggtagatgtgctcaggcgaagcagtggggctggacacagggaaggtggcctaagaaatcggccgagtttctcctccacatgctaaagaatgcagagtcaaatgccgagttgaaggggttggatgtggacagtctcgtaatcgagcatatccaggtgaacaaggctcccaaaatgagacgcaggacataccgtgctcatggccgcattaatccatatatgagcagcccctgccacattgaaatgatcttgaccgagaaggagcagatcgtcccgaaacctgaggaagaggtggcccagaaaaaaaagattagtcagaagaaactcaagaagcagaaactcatggcaagggaatag

SEQ ID NO: 203586 - DNA, 573 bp, Artificial Sequence
  Description of Artificial Sequence: Synthetic coding sequence
tgaccccagggcgtggacatccggcacaacaaggaccggaaggtgaggaggaaggagcctaagtctcaggacatttacctgcgcctgctcgtaaagctctatcgcttcctggcccgccgcacgaatagcactttcaatcaggtcgtgttgaagcgtctgttcatgtctcgcactaaccgcccaccgctttctctgtcacggatgattcgcaagatgaagctgccgggccgggagaataagacggccgttgtggttggaaccatcacggacgacgtgcgcgtccaagaagtgccaaagctgaaggtctgtgcattgagagtgacaagtcgtgcaagatccagaatcctccgggctggtggaaaaatcttaacgttcgatcagctggctcttgattctccgaaagggtgcggcacggttcttctgtcaggcccccgtaaaggccgggaggtgtaccgacactttggcaaggcacccggcacaccgcattctcacacgaagccctatgttagaagcaagggccggaagttcgaacgggcaagaggcaggcgcgcttctagagggtacaaaaactag

SEQ ID NO: 203587 - DNA, 408 bp, Artificial Sequence
  Description of Artificial Sequence: Synthetic coding sequence
atgggcgtggacatccggcacaacaaggaccggaaggtgcggcggaaagaacctaagtctcaggatatttacctacgactgcttgttaagctctacagatttttggcacggcgaacgaactccacattcaatcaggtagtgctgaagcgtttatttatgtccagaacaaatagaccccccctgtcactgtcaagaatgattcgcaaaatgaaacttccagggcgggaaaataagactgctgtcgttgtcggaaccattactgacgatgtgcgcgtgcaggaggtgcctaagttgaaagtgtcatggcgaggtctgggccgtcctatcagacccctgctgtactgtgcggtgttgtgctgtgcagtcctgtgctgtctcgtgcatcctcaatcatgccaccgctggtag

SEQ ID NO: 203588 - DNA, 567 bp, Artificial Sequence
  Description of Artificial Sequence: Synthetic coding sequence
atgggcgtggacatccggcacaacaaggaccggaaggtgcggcggaaagagccaaaatcccaggacatctacttaaggttgctggtgaaattgtatagattcctggctcgaaggaccaatagcacttttaaccaggtcgtgttgaagagactctttatgtcccgaaccaaccgcccacccttgtctctgtcaaggatgattcgaaagatgaaactgcccggcagagagaataaaacggcagttgttgtaggaaccatcactgatgacgtgcgtgtgcaggaagtgccaaagctcaaagtatgcgccctgagagttacgtccagggccaggtccaggattctgcgtgctgggggtaagattctcacttttgatcagctggctctggacagccctaaaggctgtgggacagtccttttgtcaggaccccgcaaaggcagagaagtatatagacacttcggaaaagctcccggaacaccacatagccatacaaaaccctatgtaagatctaaaggtagaaaattcgagcgcgctaggggccgcagggccagcagagggtacaagaattag

SEQ ID NO: 203589 - DNA, 480 bp, Artificial Sequence
  Description of Artificial Sequence: Synthetic coding sequence
atgctgtaccggttcctggcccggcggaccaacagcaccttcaaccaggtggtgttaaagcggctgttcatgtcccgcaccaacaggcctcctctcagtttgtcaagaatgattcgaaagatgaaactgccaggcagagagaacaagacagctgtggtagtcggtaccattacagatgacgtgcgggttcaagaggtgcccaagctcaaggtgtgtgcgctgagggtgacctctcgggcccgctcccggatcctgcgagccggaggcaagatcctaacattcgatcagctcgccttggacagccctaaaggttgcggtacagtgctgttaagtggacctcgaaaagggcgagaggtataccgtcatttcgggaaagcacccggcactccgcacagccacacaaaaccgtatgtgcgtagcaagggaaggaaatttgaaagagcgcgcggccgacgcgcatctcgaggatataaaaactag

SEQ ID NO: 203590 - DNA, 795 bp, Artificial Sequence
  Description of Artificial Sequence: Synthetic coding sequence
atgaacatcctgcccaagaagagctggcacgtgcggaacaaggacaacgtggctcgagttcgcagagacgaggcccaggcccgcgaggaggaaaaagaaagggaacgaagagtcctgctagcccaacaggaagcccgtacagagttcctgcgaaagaaggctaggcaccagaatagccttccggagctagaggcagccgaggctggcgcccccggcagcggacctgtcgacttattcagagagttgctcgaagaggggaaaggcgtcattcgcgggaataaggaatacgaggaagaaaagaggcaagagaaagagagacaggagaaggctcttggcatattaacatatcttgggcaaagtgcagcagaggctcagacccagcccccctggtatcagttgcccccaggaaggggaggccccccaccaggcccagctccagatgaaaaaataaagtcacgactcgacccattgcgggaaatgcaaaagcatcttggaaagaagcgccagcacggcggcgatgaaggttcacgcagcagaaaagagaaggaaggcagcgaaaaacaacggccaaaggagcccccgtcactggatcagctgagggccgagagattgcggagagaggccgccgagagatctagagccgaagctctgctggcaagggtacagggccgcgcgctgcaggagggccagcctgaagaagacgagaccgacgaccgccgtcggagatacaatagccagttcaacccacagttagctagaagacctcgacagcaggacccacatctgacccactag

SEQ ID NO: 203591 - DNA, 465 bp, Artificial Sequence
  Description of Artificial Sequence: Synthetic coding sequence
atgaaggccagcggcaccctgcgggagtacaaggtggtgggccggtgcctgccaacccccaagtgtcacaccccccctctgtatcggatgcggatatttgcacctaatcacgtagttgcaaagagcaggttttggtatttcgtctcccaattaaagaaaatgaaaaaatcctccggcgaaatcgtatactgtggacaggtattcgagaaatcccccctgagagtgaagaatttcggaatttggctcaggtacgattctcggtctggaacccacaatatgtatcgcgagtacagggatctcacaacagcgggagcagtgacacaatgctatagagatatgggagcgaggcatagagcacgagctcacagtatacaaatcatgaaggtggaggagatagcggcttcaaagtgccgcagacagcacaagccaaggtttacaacaaagcggcctaacacattcttctag

SEQ ID NO: 203592 - DNA, 1278 bp, Artificial Sequence
  Description of Artificial Sequence: Synthetic coding sequence
atgggcggcggcgacctgaacctgaagaagagctggcacccccagacgttaagaaatgtggagaaggtctggaaggccgagcaaaaacacgaagctgagaggaagaaaattgaagagctacaacgtgagcttagggaggagagagcacgagaggaaatgcagcgttacgcggaagatgtcggagccgtgaagaaaaaggaggagaaactggactggatgtatcagggaccaggtggtatggtgaaccgggacgaatacctgctgggcaggccgattgataagtatgtgttcgagaaaatggaggagaaggaggcgggatgcagcagcgaaacaggcttgcttcccggcagcatcttcgcccccagcggagcaaatagtttgctcgacatggctagtaagatcagggaagatccactgttcataattcggaaaaaagaggaggaaaaaaagagagaggtgttaaacaacccggtgaagatgaagaaaattaaggagctgctgcagatgtcactcgagaagaaggaaaagaagaagaagaaggaaaagaaaaaaaagcacaaaaagcataaacatcgttcaagctcatccgaccggtcgagctctgaagacgagcacagcgccggtcgctctcagaaaaagatggctaacagctctcccgtgctgtcaaaagtgcccgggtacgggctccaggttcgaaacagcgaccggaatcagggcctgcaaggcccattgacagctgagcaaaagaggggccatggcatgaaaaatcatagcaggagccgttcttcttcacattcccccccacgccatgcatctaaaaaatctacccgggaggccggcagtagagaccggagatcacgatcgcttggacgacggtctcgctcaccacggccttccaagctccacaattccaaggttaaccgccgcgaaactggtcagacccggagtcctagcccaaagaaggaagtgtaccagagacgacatgcccctggatacacacgtaaactcagtgcagaagagttggagcgcaaaagacaagagatgatggagaatgctaagtggagggaagaagagaggctgaacattctcaagaggcacgctaaagacgaggaaagagagcagcgccttgagaagttagattctagggatggaaaattcattcatagaatgaaactagaaagtgccagcacatcttcactcgaagacagggtcaagagaaacatttatagtctgcagagaacctcagtggcacttgagaagaatttcatgaaacgctag

SEQ ID NO: 203593 - DNA, 483 bp, Artificial Sequence
  Description of Artificial Sequence: Synthetic coding sequence
atgaccaacaccaagggcaagcggcggggcacccggtacatgttcagtcgcccttttaggaagcacggcgtggtaccactagccacttacatgcgtatctataaaaagggggatatagtagacataaagggaatgggcacggtgcagaaagggatgcctcataaatgttaccacgggaagacaggcagagtttataatgtgactcagcacgctgtggggatcgtggtgaacaagcaggtgaagggtaagattctggcaaagaggattaatgtcagaattgaacatattaaacatagtaagtcccgcgactcctttcttaagcgtgtcaaggagaacgatcagaagaaaaaagaagccaaagaaaaggggacttgggtccaactcaagagacagcctgccccaccccgagaggcgcacttcgtgagaactaacgggaaggagcctgagctgctggaaccaattccctatgagttcatggcatag

SEQ ID NO: 203594 - DNA, 483 bp, Artificial Sequence
  Description of Artificial Sequence: Synthetic coding sequence
atgaccaacaccaagggcaagcggcggggcacccggtacatgttcagtagacccttcaggaaacacggtgtcgtgcccctcgcaacctatatgcggatctataagaaaggcgacatcgtggatatcaagggaatgggtacagtgcagaagggaatgcctcacaaatgctaccacggaaagacaggtagagtgtataacgtgacccagcatgcagtagggattgtagtgaacaaacaggtaaagggaaagatccttgctaaaaggatcaatgtgcgcattgaacacatcaagcactccaaatctcgagatagcttcctcaaaagagtcaaggaaaatgaccagaagaagaaagaggccaaggaaaaaggcacgtgggtacagctaaaaaggcaacctgctcccccgagggaggctcatttcgtaaggactaacggcaaggagcctgagctcctggaacccatcccctatgagttcatggcgtag

SEQ ID NO: 203595 - DNA, 483 bp, Artificial Sequence
  Description of Artificial Sequence: Synthetic coding sequence
atgaccaacaccaagggcaagcggcggggcacccggtacatgttcagcagaccgttcaggaagcacggggtagtgccactcgctacatacatgcgcatctacaagaagggagacattgtcgatataaaggggatgggaactgtgcaaaaaggaatgccccacaagtgttaccacggaaaaacggggcgcgtttacaacgtgactcaacacgcagtcgggatcgttgtaaacaagcaggtgaaggggaaaatcctggccaagagaataaacgtacggatcgagcatataaagcactccaagagcagagactcttttctgaaaagagttaaagagaatgaccaaaagaagaaggaggcaaaggaaaaaggcacatgggttcagttaaaacgccagcccgcacctccgagggaggctcacttcgttaggaccaacgggaaggaaccggagcttcttgaaccaatcccctatgagtttatggcgtag

SEQ ID NO: 203596 - DNA, 483 bp, Artificial Sequence
  Description of Artificial Sequence: Synthetic coding sequence
atgaccaacaccaagggcaagcggcggggcacccggtacatgttctcaagaccttttagaaagcatggcgtggtcccactggcaacctatatgcgcatctacaagaaaggtgacattgtggacattaaaggcatgggcactgtccagaagggcatgcctcacaagtgctatcacggcaagacagggcgagtgtataacgtcacacagcacgccgtcggaatcgtggtgaacaagcaggtaaaaggtaagattctggcaaagcgaattaacgttagaatcgagcacatcaagcactccaaatcccgagacagcttcctgaaacgagtcaaggaaaatgaccagaagaagaaagaagccaaggaaaagggcacatgggtgcagctcaaaagacagccagccccacccagggaagcccactttgtcaggacaaatgggaaggagccagaactccttgaacccattccctatgaattcatggcctag

SEQ ID NO: 203597 - DNA, 972 bp, Artificial Sequence
  Description of Artificial Sequence: Synthetic coding sequence
atggccgcccccaagggcagcctgtgggtgcggacccagctgggcctgccgcccctgctgcttctgacaatggccttagccggcggaagtggcactgcaagcgcagaagcattcgattcggttctcggcgacacagcaagctgccacagggcttgtcaactgacttatcccctgcacacctaccccaaggaggaagaactgtatgcctgccaaaggggttgtagattattttcaatctgtcagttcgtcgacgacggcatcgacttgaatcgtactaagctggaatgtgagagcgcttgcacggaggcgtacagccagagtgacgagcagtacgcctgccacctgggctgtcagaatcagctgccctttgctgaacttcggcaggaacaactgatgagtctcatgcctaagatgcacttgctatttcccctcaccctggtgcgaagtttttggagcgatatgatggacagtgctcagtcattcattacatccagttggacattttatttgcaggcagatgatggcaagattgtgatttttcagtcaaaaccagaaatccagtacgcccctcacctggagcaggaaccgactaatttgcgggaaagttcgctgagtaaaatgagttatctgcagatgaggaactctcaagcccaccgcaatttcctggaggatggagaatccgatggctttctcaggtgcctttctttgaattccgggtggatcctcaccaccacactggtgctgtccgtgatggtgctcctgtggatttgttgtgcaactgtggccaccgccgtggagcaatatgtgccatccgaaaaattatccatctacggcgacctggaattcatgaatgaacagaagctgaataggtacccagcgtctagcctcgtggttgtgcgctccaaaacagaggaccacgaggaggccgggcccctgcccacaaaggtgaacctcgctcactctgagatctag

SEQ ID NO: 203598 - DNA, 276 bp, Artificial Sequence
  Description of Artificial Sequence: Synthetic coding sequence
atggccggcagccggcgggagtgccggcggggcggcagcagcggcgccaagtttaggatctctcttgggctgccagtgggagccgtgatcaactgcgctgacaacaccggcgcgaagaacctctatataatctcggtgaaaggtattaaaggtcgcctgaacaggctcccggctgccggggtgggggacatggtgatggccaccgtgaaaaaaggtaaaccagaactcagaaaaaaagtccaccccgccgtcgtgatcagacaaaggaaaagctag

SEQ ID NO: 203599 - DNA, 423 bp, Artificial Sequence
  Description of Artificial Sequence: Synthetic coding sequence
atgagcaagcggggccggggcggcagcagcggcgccaagttccggataagcttgggactcccggtgggggccgttatcaactgcgcagataatactggcgccaagaatctgtatattattagtgttaaaggtatcaaaggaaggctgaataggctgcctgctgccggggtcggagacatggtcatggctacagtgaagaagggcaagccagagttgcgaaagaaagtccacccggcagtagtgataagacagcggaagtcctacaggcgcaaggacggggtgtttctgtatttcgaagacaatgccggggtgatcgtcaacaacaagggtgagatgaaagggagcgccatcaccggccccgtggcaaaagaatgcgccgatctgtggccccggattgcgagcaacgctggctcaatcgcctag

SEQ ID NO: 203600 - DNA, 345 bp, Artificial Sequence
  Description of Artificial Sequence: Synthetic coding sequence
atgagcaagcggggccggggcggcagcagcggcgccaagttccggattagcctgggcctgcctgtgggggccgtcattaactgcgcagacaatactggcgcgaagaatctgtacatcatcagcgtgaagggcatcaagggccggttgaataggctaccagccgccggcgtgggggacatggtaatggcaactgtgaagaaagggaagcccgagctccggaagaaggttttgttgtgccatacagggtggtcggcagtgactccactgaagctcaccgtgactttgaactgctggacttggaatcctccagcagtcgcgtttaaaggactgcagttacaggtgtag

SEQ ID NO: 203601 - DNA, 423 bp, Artificial Sequence
  Description of Artificial Sequence: Synthetic coding sequence
atgagcaagcggggccggggcggcagcagcggcgccaagttccggatcagcctgggactgcctgttggggctgtgattaactgtgcagataataccggagccaagaatttgtatatcatcagtgtgaaggggatcaaaggtaggttaaatcggctcccagcggccggggtgggcgatatggtaatggctacagtgaagaaaggcaaaccagagttacggaaaaaagtgcatcctgctgtggttatcaggcagagaaagtcataccgtcgcaaagacggcgttttcttgtactttgaagacaacgctggtgtcatcgtaaataataaaggggagatgaaaggcagtgcaattacaggacccgtcgctaaggaatgtgcggacctgtggcctcgcatcgcctcaaacgctgggtccatagcgtag

SEQ ID NO: 203602 - DNA, 477 bp, Artificial Sequence
  Description of Artificial Sequence: Synthetic coding sequence
tgactggtgggcgccccctgcccccgggccagccccgccccccccaaagcggaggccaaggccaaagcccttaaggctaagaaagccgtgctgaagggagtgcatagtcacaaaaaaaaaaagatccggactagcccaactttccgacgccctaagaccctacggctgaggcggcagcctaagtacccacgtaaaagcgcccctcgccgaaataagctggatcactacgctatcatcaaatttccgcttaccactgaatccgcaatgaagaagatcgaggataataacacactggtgtttattgtggacgtgaaagccaacaaacatcaaataaaacaggcagtgaagaagttatacgatatcgacgtggctaaggtgaatacgctgatacgccccgatggcgagaagaaggcgtacgttagactggccccagattatgatgccctggatgtggcaaacaagatcgggatcatttag

SEQ ID NO: 203603 - DNA, 477 bp, Artificial Sequence
  Description of Artificial Sequence: Synthetic coding sequence
atgagccccggcctggtggtgctgcggtgggcccccgccccccccaaggcagaagctaaagccaaggccctgaaggccaagaaggccgttctcaaaggtgtgcactcacacaagaagaagaaaattcgcactagccctaccttcaggcgacctaagaccttgcggctgaggaggcagccaaaatacccacggaagtcggcaccacggcggaacaaattggatcattacgccattatcaaattccccctgacgactgaatcggccatgaagaagatcgaggacaacaatactctggtttttattgtggacgtaaaggcaaacaaacaccagatcaagcaagctgtaaagaagctttacgatatcgacgtggccaaagtgaacacgctgatcagaccggatggcgaaaagaaagcttatgtgcgcctggcccctgactatgacgccctggacgttgctaacaagataggtattatttag

SEQ ID NO: 203604 - DNA, 585 bp, Artificial Sequence
  Description of Artificial Sequence: Synthetic coding sequence
atgcaccccctggtgggcgccccctgcccccgggcctgcaaggagcttgttcccagcgcgctgactattttccttctggtgcatgtacagcccgggtatattacgcgcccaagcctgcgctctgtcgtcctccggtgggcccccgccccaccgaaagccgaggccaaagccaaagcactcaaagcaaagaaagcggtgctgaagggagtgcattcacataaaaaaaaaaagattcgcacatcccccacattcaggcggcccaagactctgcgcctcaggcgccagcctaagtacccacggaagagcgctcccagacgcaataagctagatcattacgccatcataaaattccctctgactaccgaatccgctatgaagaagatagaagacaacaacacccttgtgttcattgtggacgtcaaagcaaataagcaccagataaagcaggccgtcaagaaattgtatgacatcgatgtcgccaaggttaatacactgatccgaccagacggggaaaagaaggcctacgtgagactggcccctgactacgacgcactcgatgtcgccaacaaaatcggcattatttag

SEQ ID NO: 203605 - DNA, 471 bp, Artificial Sequence
  Description of Artificial Sequence: Synthetic coding sequence
atggcccccaaggccaagaaggaggcccccgccccccccaaggccgaggcaaaagctaaagcactcaaggcaaaaaaggccgtgctaaaaggcgttcactctcacaaaaaaaaaaagattaggaccagccccacattccgccgccccaagactctgcgactgaggaggcagccaaaatacccccgcaagtcagcaccaagacggaacaagctggatcactacgccatcatcaaatttccgctaactactgagtcagccatgaaaaagatcgaggacaacaacaccttagtgtttattgtggacgtcaaggctaacaagcaccagatcaagcaggccgtcaagaaactgtacgatattgatgttgccaaagtcaataccctgattcgccctgatggagagaaaaaggcctacgttcgattggcaccggattacgatgcccttgacgtggcaaataagatcgggataatctag

SEQ ID NO: 203606 - DNA, 474 bp, Artificial Sequence
  Description of Artificial Sequence: Synthetic coding sequence
atgaaggtggagctgtgcagcttcagcggctacaagatctaccccggccacggacgccgttacgcccgcactgacgggaaagtgttccagttcctgaacgccaagtgcgagtccgcgttcctttcgaagcgcaatccgagacaaatcaattggacggtactgtatagacgaaaacacaaaaaggggcagagcgaagaaatccagaagaagaggactcgccgcgcagttaagtttcagagagccatcactggcgcttccttggccgatatcatggccaaaaggaatcagaaaccagaagtgaggaaggcacaaagagagcaggctataagagctgctaaggaggctaagaaagccaagcaggcaagcaagaagaccgctatggcggcggcgaaggctcctactaaggccgctcccaagcagaaaatcgttaaacccgtcaaggtctcagcacctcgcgttggcgggaagaggtag

SEQ ID NO: 203607 - DNA, 453 bp, Artificial Sequence
  Description of Artificial Sequence: Synthetic coding sequence
atgaaggtggagctgtgcagcttcagcggctacaagatctaccccggtcacggtcggcgctacgctcggacagacgggaaggtcttccagttcctcaatgccaagtgcgaaagcgcgttcctgtccaagcggaacccccggcagatcaattggaccgtgctctaccgaaggaaacacaaaaaggggcagagcgaagagatccaaaagaagcggacacgcagggcagttaagtttcaaagagctatcacgggagcctctctcgcagacattatggccaagcgaaatcagaagcctgaggtgaggaaagcccagagggaacaggcaatccgggctgccaaggaggccaaaaaagctaagcaagcgtctaagaaaaccgcaatggcggcggccaaagtaataatgggtttcctgtacttcctcgaacagtataatagaaaaatcttttttttttag

SEQ ID NO: 203608 - DNA, 438 bp, Artificial Sequence
  Description of Artificial Sequence: Synthetic coding sequence
atgaagttcaaccccttcgtgaccagcgaccggagcaagaaccggaagcgacatttcaacgcccccagccacattagacgtaagattatgagctctccactgtccaaagaactccgacagaaatataatgtgcggagtatgcccatcaggaaagacgacgaagttcaagtcgttcgtgggcattataaggggcagcagatcgggaaggtcgtgcaagtctatagaaaaaaatacgttatctacatcgagagagtacaaagggagaaagctaacggtacaactgtgcatgtaggcattcatccctcaaaggtggtcatcaccagacttaaactcgacaaggaccggaaaaagatcctcgagaggaaggccaagtctcggcaagttggaaaagaaaaaggtaagtataaggaagaaaccatagaaaagatgcaggagtag

SEQ ID NO: 203609 - DNA, 411 bp, Artificial Sequence
  Description of Artificial Sequence: Synthetic coding sequence
atgggcaagttcatgaagcccggcaaggtggtgctggtgctggccgggcggtattcaggtaggaaagcagtcatcgtaaagaatatagacgatggcaccagcgacaggccttattcacacgctctagtcgcgggaattgatagatacccacggaaggtcacagcagcaatgggcaaaaagaagatcgcaaagcgctcgaagatcaagagtttcgtgaaagtgtacaactataatcacctgatgcccacgcggtatagcgtggatatccctttggacaaaacagtggtcaacaaggacgtttttcgggatcctgccctcaagcggaaggccaggcgggaggccaaagtgaagtttgaggagcgctacaagactggtaagaacaaatggttctttcagaaactccggttttag

SEQ ID NO: 203610 - DNA, 447 bp, Artificial Sequence
  Description of Artificial Sequence: Synthetic coding sequence
atgcccagccggctgcggaagacccggaagctgcggggccacgtgagtcacggccatggcaggattgggaagcaccgaaagcaccctggcggaaggggaaacgctggcggcttgcatcatcatcgaattaacttcgataaatatcaccctggttattttggcaaagtggggatgaagcactaccatctcaagcgaaaccagagcttctgccccacagtgaatctggacaaactgtggacgctcgtcagcgaacagaccagggtcaatgcagcaaaaaataagacgggggcggccccaatcatcgacgttgtaaggagtggttactataaagtcctgggcaaaggcaagctgccaaagcagccagtgattgtaaaggctaagtttttttcccgcagagccgaggagaagattaagtcagtggggggcgcctgcgtactggttgcctag

SEQ ID NO: 203611 - DNA, 327 bp, Artificial Sequence
  Description of Artificial Sequence: Synthetic coding sequence
atgcccagccggctgcggaagacccggaagctgcggggccacgtgtctcatgggcatgggcgcattgggaaacaccgaaaacatcccgggggcaggggtaacgcaggggggctgcaccaccatagaatcaatttcgataagtatcatcccggctactttggtaaggtgggaatgaaacattaccacctaaaacggaatcagtccttttgcccaacagtgaatctggataagctgtggactcttgtctcagagcagacgagagtgaatgccgcaaagaataagacaggcgcagctccaataatcgacgtggtgcgatcagtctcctag

SEQ ID NO: 203612 - DNA, 414 bp, Artificial Sequence
  Description of Artificial Sequence: Synthetic coding sequence
atgagcgcccacctgcagtggatggtggtgcggaactgcagcagctttctcattaaacggaacaagcagacctatagtaccgaacccaataatctgaaagcacgcaattccttcaggtacaacggcctgattcacaggaaaaccgtaggagtggagcctgctgcagacggaaagggggtcgtagtcgtaattaagagacgctccggccagcgcaagcctgctacaagttatgtgcggacaaccataaataagaacgccagagccaccctttcatccatccgtcatatgattcggaaaaacaagtatcgacccgatcttcgaatggccgcgatcagaagagctagtgcgatcctacgttcacaaaagccggtgatggtgaaacgcaagagaacccggcctaccaaatcaagctag

SEQ ID NO: 203613 - DNA, 210 bp, Artificial Sequence
  Description of Artificial Sequence: Synthetic coding sequence
atgagcgcccacctgcagtggatggtggtgcggaactgcagcagcttcctcatcaaacgaaataagcagacttactcaaccgagccgaacaacctcaaggctcgcaattcttttcggtacaatgggttgatccataggaagaccgtgggcgtggaacctgctgcagacgggaagggggtcgtcgtggtcatcaaacgacgcagcgagtag

SEQ ID NO: 203614 - DNA, 264 bp, Artificial Sequence
  Description of Artificial Sequence: Synthetic coding sequence
atgagcgcccacctgcagtggatggtggtgcggaactgcagcagctttctgatcaagagaaacaagcagacatactccaccgagcctaataatctaaaggcccgtaattcattccgctataatgggctgatacacaggaaaaccgtgggggtagaaccggccgctgacggtaaaggcgttgttgttgtgataaagcgccgtagcggggagttctgccttgtctgggcccgggagaggcccctgtccagggtgtgggaactgtag

SEQ ID NO: 203615 - DNA, 510 bp, Artificial Sequence
  Description of Artificial Sequence: Synthetic coding sequence
atgagcgcccacctgcagtggatggtggtgcggaactgcagcagctttctgatcaaaagaaacaagcaaacctacagcacagagccaaacaacctgaaggcccgtaatagttttcggtataacggcctcatacatcggaaaacagtgggggtcgagcctgcggccgacggaaagggtgtcgtagtcgttattaaacggcgatcaggtcagaggaaaccagctacctcatatgtccgtacaactattaataagaacgccagggcgaccctcagcagtatacggcatatgatccgcaaaaacaagtatcggcctgatttgagaatggatatgcttgccagcactggttcaggcctctgttgttcggtcgccgtccagccttgggcatcctcatcaaccagtctgtgtttacgtacactgatatgtaatatgcgggtggacagaccttactacagcgggctgatgcggcggctgaacgtgcaaaacctgctcgactgtgcccacaaaagctag

SEQ ID NO: 203616 - DNA, 510 bp, Artificial Sequence
  Description of Artificial Sequence: Synthetic coding sequence
atgagcgcccacctgcagtggatggtggtgcggaactgcagcagcttcctaatcaaaaggaacaagcagacttattccacggaacctaacaatttgaaggcgcggaatagtttccgatacaacggactcatacaccgtaagactgtgggagtcgagcccgcggctgacggtaagggagtggtggtggtcattaagcgaaggagcggacaacggaagcctgcaactagttatgttagaactaccattaacaaaaatgcccgagctactctctcctcaatacggcatatgattcgcaaaaataaataccgacccgacctccggatggatatgcttgccagtaccgggtctggactttgctgtagcgtggcagtgcaaccgtgggcttcaagtagcacaagtttatgtttacgcactctgatctgtaacatgagggtcgaccggccatactatagtggacttatgaggcggcttaacgtgcaaaacctactggactgtgctcataaaagctag

SEQ ID NO: 203617 - DNA, 414 bp, Artificial Sequence
  Description of Artificial Sequence: Synthetic coding sequence
atgagcgcccacctgcagtggatggtggtgcggaactgcagcagctttctcatcaagaggaacaaacaaacatattccaccgagccaaataacctgaaggcgaggaactccttcaggtacaatggacttattcatcgcaagactgtcggtgtggagcctgccgcagacggcaagggggtggtggtggtgataaaaagaagatcaggtcagaggaagcccgctacttcatacgtgcgtaccactataaacaagaacgctagggcaaccctgtcttccatacggcatatgattcggaagaacaagtacagacccgacctgcggatggctgccattcgacgcgctagtgctatccttcgaagccagaagccggtgatggtgaagcggaagcggactcggcctaccaagtctagttag

SEQ ID NO: 203618 - DNA, 492 bp, Artificial Sequence
  Description of Artificial Sequence: Synthetic coding sequence
atgagcgcccacctgcagtggatggtggtgcggaactgcagcagctttctcatcaagcggaataagcagacttactcgacagagcctaataacctgaaagccagaaacagtttcaggtacaacggcctgattcatcgcaagaccgtcggcgtggagccagctgcagacggtaagggtgtcgtcgtggtgatcaagcggaggagtggccagaggaagccagcaacatcctacgtgcgcacgaccataaataagaacgcccgtgctactctttcctccatcaggcacatgattcggaagaacaagtacaggcccgatctcagaatggtctcttggggtttagggattcgcctcggcgagaccggacagtgctgcggcgagggacccccgaccacaggctgcaacatgggatggcgcggcatggactcttgctttcaaccgactccgcacacacagcactggcccagaggcagacttgtggagtgtatgggttag

SEQ ID NO: 203619 - DNA, 480 bp, Artificial Sequence
  Description of Artificial Sequence: Synthetic coding sequence
atggccaagagcaagaaccacaccacccacaaccagagccggaagtggcaccgaaatgggatcaagaagcccaggagccaaagatacgagagtttaaagggggtcgaccctaagttccttagaaacatgagattcgctaagaagcacaacaagaaaggcttgaaaaagatgcaagccaacaatgcaaaggcaatgagcgctcgtgcagaggctataaaagccctcgttaagcctaaggaggttaaaccaaaaatcccgaaaggagtatcaagaaagcttgataggctagcctacatcgcacatcctaaacttggaaaaagggctcgggcacggatcgcgaaagggctacgactgtgccgcccaaaggccaaggccaaggcaaaggccaaagaccagaccaaggctcaggccgccgctccagcgtcagtgccagctcaggcaccaaagaggacccaagccccaacgaaggcctctgagtag

SEQ ID NO: 203620 - DNA, 480 bp, Artificial Sequence
  Description of Artificial Sequence: Synthetic coding sequence
atggccaagagcaagaaccacaccacccacaaccagagccggaagtggcaccggaacggcataaaaaagccccggtctcagagatatgagtctctcaagggagtggatcccaagtttcttagaaacatgcgctttgcaaaaaaacacaacaagaaaggattgaagaaaatgcaggctaataatgccaaggccatgagcgcgcgggcagaggcaattaaggccctggtcaaacccaaagaagtgaagccaaagatcccgaagggagtgtctcgtaagctggatcgcctggcttatatagcacaccccaagttaggcaagagggcacgcgcccggatcgccaaaggcctgaggctgtgccggccaaaggcgaaagctaaggctaaagccaaggaccagacaaaggcgcaagccgccgctccggcttctgttccggctcaagcgcccaaaaggacgcaggctccaacaaaggccagtgagtag

SEQ ID NO: 203621 - DNA, 480 bp, Artificial Sequence
  Description of Artificial Sequence: Synthetic coding sequence
atggccaagagcaagaaccacaccacccacaaccagagccggaagtggcacaggaacggaataaagaaaccaaggtcacagagatacgagagtctgaagggggtcgaccctaaatttctaagaaatatgaggtttgcaaaaaaacataataaaaaagggttaaaaaagatgcaggcaaacaacgccaaagcgatgtccgctcgcgcggaagcaattaaggcactcgtgaagccaaaggaagtgaaaccaaagatccccaagggcgtgagccgaaagctcgacagactcgcatacatcgcccaccccaagctggggaaacgagcccgggcccgtattgcaaaaggtctccgtctgtgcagacccaaggccaaggccaaagccaaggcgaaggatcaaacaaaagcgcaggccgccgcaccagcatcggtgcccgcgcaggcccctaaacgaactcaggcccctactaaagcctcggagtag

SEQ ID NO: 203622 - DNA, 480 bp, Artificial Sequence
  Description of Artificial Sequence: Synthetic coding sequence
atggccaagagcaagaaccacaccacccacaaccagagccggaagtggcacaggaacggcatcaagaaacctaggtctcagcggtacgagagcctcaagggcgtggaccccaagttcttaaggaacatgaggtttgcaaaaaaacataacaagaagggactcaaaaagatgcaggccaataacgctaaggccatgagcgccagagcggaagctattaaagcactggtgaagcccaaggaggtgaaacctaaaattccaaaaggcgtgagccgcaaattggacagactcgcctatatcgcgcaccccaaactcggaaaacgagcacgtgcgcggatcgccaagggcttgcgtctatgccgcccgaaggcaaaagcaaaggccaaggccaaagatcagactaaggcgcaagcagccgccccagcaagcgttccagcccaagccccaaaacgcacacaggctccaacgaaggcgagcgagtag

SEQ ID NO: 203623 - DNA, 480 bp, Artificial Sequence
  Description of Artificial Sequence: Synthetic coding sequence
atggccaagagcaagaaccacaccacccacaaccagagccggaagtggcacagaaatggcattaaaaagcccaggagccagcggtatgagtccttgaaaggtgtcgacccaaagttcctgcgcaatatgagattcgcgaaaaagcacaataaaaagggcctgaagaaaatgcaggccaacaacgccaaggctatgagcgcacgcgccgaagctattaaggccttggtaaaacctaaggaggttaaacccaaaatccctaaaggagtatcccgcaaacttgataggctggcctacattgcccaccccaaactgggaaagagagctcgcgctcggatcgcaaagggactgcggctttgcaggccaaaggccaaagcaaaagccaaggcaaaagaccagactaaggctcaggccgctgccccagcctccgttccagcgcaggctcccaaacgcacacaagcgcctaccaaggccagtgaatag

SEQ ID NO: 203624 - DNA, 480 bp, Artificial Sequence
  Description of Artificial Sequence: Synthetic coding sequence
atggccaagagcaagaaccacaccacccacaaccagagccggaagtggcacagaaatggtattaagaaacctagaagtcaaagatacgagtccctgaaaggagtcgaccccaaattcttgcgcaatatgaggttcgctaagaagcacaacaagaagggcttaaagaagatgcaagcaaataatgcaaaggcgatgagcgcaagagctgaggctattaaagcactcgtgaaaccaaaagaggttaagcccaagatcccaaagggcgtgagcagaaaattggacagactggcctacatcgctcaccccaagctggggaaacgagcacgagctagaatcgctaagggactaaggctatgccgacctaaggccaaagctaaagcaaaggctaaagaccaaacaaaagctcaagctgccgctcctgcaagtgttcctgcccaggctcctaagagaactcaggctcccacaaaagcctccgaatag

SEQ ID NO: 203625 - DNA, 648 bp, Artificial Sequence
  Description of Artificial Sequence: Synthetic coding sequence
atgcccttccaccccgtgaccgccgccctgatgtaccggggcatctatacggtgcccaatctcttatctgagcagagacctgttgatataccagaggacgagctcgaagaaattagggaagcatttaaagtgtttgaccgggacgggaatggattcatttcaaaacaggagctgggtacggcaatgcgctctcttggctacatgcccaacgaagtggagctggaagtgattatccagcgactggacatggatggggatggccaggtcgatttcgaagaatttgtgacactgcttggcccaaaacttagcacaagcggtattcccgagaaattccacggtacggacttcgataccgtgttttggaaatgcgacatgcagaagctgacggtcgacgaactgaagcgtctcttatacgataccttctgcgaacatctgtcaatgaaagacatagagaatatcataatgactgaggaggagtcacatctgggaaccgctgaggagtgccctgttgacgtggagacgtgctccaatcaacaaataagacaaacctgcgtgcggaagtctttgatctgtgcgttcgcgatcgcatttataatcagcgtgatgttgatcgctgcaaaccaggtgctaaggagcggaatgaagtag

SEQ ID NO: 203626 - DNA, 1056 bp, Artificial Sequence
  Description of Artificial Sequence: Synthetic coding sequence
atgacccacatcgtgcgggaggtggaccggcccggcagcaaggtgaacaaaaaggaagtggtggaggcagtgaccatcgttgagacgcctccaatggtagtggttggaatcgtgggatacgttgagacgcctagaggcctgagaacctttaaaacagtgttcgctgaacacataagcgatgagtgcaaacgacgcttttataagaactggcacaaatcgaagaaaaaagcctttaccaaatactgtaaaaagtggcaggatgaagatggaaagaagcaacttgaaaaggatttcagtagcatgaagaagtattgtcaggtcatccgggtcatagctcacacacaaatgcggttgctcccgctgagacaaaagaaggcacatctaatggagattcaggtgaacggtgggacagtggctgaaaagttagattgggcacgagagagattggagcaacaggtgcccgtcaaccaggtttttggacaggacgagatgattgatgtgatcggcgtcacgaaggggaagggctataagggagtgacttcccgttggcacaccaagaagcttcctagaaagacgcatcgaggtttacgaaaagtagcgtgtattggggcctggcaccccgctcgtgtcgcttttagcgtggcccgggccggccagaagggatatcaccacagaaccgaaatcaacaagaagatttataagattggccagggatacctcatcaaggacggcaaactaattaaaaacaatgcatccacagactatgatttgtcagacaaaagcatcaaccctttaggcggcttcgtgcattacggagaagtcaccaatgacttcgtgatgttaaagggatgtgtggtgggaacaaagaagagggttctcactctgcggaagtccctgctggtgcagaccaaaagaagagccctggagaaaatcgatttaaagtttatagacaccacgagtaagtttggacacggaaggttccagaccatggaggagaaaaaagccttcatgggccctctgaaaaaggacagaatagctaaagaggagggagcttag

SEQ ID NO: 203627 - DNA, 348 bp, Artificial Sequence
  Description of Artificial Sequence: Synthetic coding sequence
atggtggccgccaagaagaccaagaagagcctggagagcatcaactctcggttacagctggtcatgaagtcagggaaatacgtgctcggatataaacaaacccttaagatgatacgacagggaaaagccaagctcgtgattctggccaacaattgccccgccctcagaaagagcgagatagagtactacgcgatgctggccaagaccggggtgcaccattatagcggcaacaatatcgagctaggcaccgcctgtggcaaatactaccgcgtttgcaccctggccataattgatccaggggactccgacattatacgctccatgccggagcagacaggggaaaagtag

SEQ ID NO: 203628 - DNA, 348 bp, Artificial Sequence
  Description of Artificial Sequence: Synthetic coding sequence
atggtggccgccaagaagaccaagaagagcctggagagcatcaacagtaggctgcagctggtgatgaagagcggtaaatacgtgctaggctataaacagaccttgaagatgatccgacagggcaaagccaagctggtcatcctggctaacaattgccccgccctgagaaagtccgaaatcgagtactatgccatgctggctaaaactggagtgcaccactattcaggtaacaatatcgagctggggacagcctgcggaaagtactatcgcgtgtgtacattggccatcatcgatcccggcgacagcgacataattcgctctatgccggaacagactggcgagaaatag

SEQ ID NO: 203629 - DNA, 345 bp, Artificial Sequence
  Description of Artificial Sequence: Synthetic coding sequence
atggtggccgccaagaagaccaagaagagcctggagagcatcaacagccgactgcagctggtcatgaagtccgggaaatatgtcctgggttacaaacaaacacttaagatgatccggcagggcaaagccaagctcgtgatcctagccaataactgtcctgcccttcggaagagtgagattgagtactatgctatgctcgctaagacaggagtgcaccactattctggtaacaatattgaattagggacggcttgcggtaaatactatagggtgtgtacactggccatcattgatcctggtgactctgacattatcaggtctatgcccgaacagacaggggaatag

SEQ ID NO: 203630 - DNA, 285 bp, Artificial Sequence
  Description of Artificial Sequence: Synthetic coding sequence
atgagcggccggctgtggagcaaggccatcttcgccggctacaagcgcggcctccggaaccagcgggaacatacagcattgctaaaaattgaaggggtgtacgcaagagacgaaaccgagttctaccttggtaagaggtgcgcttacgtgtacaaagccaaaaataataccgtcacaccaggtggcaaacccaacaagacgcgggtaatctggggtaaagtgactagagctcacggcaactcaggcatggtgagggccaagttccggtccaatctgcccgcatag

SEQ ID NO: 203631 - DNA, 333 bp, Artificial Sequence
  Description of Artificial Sequence: Synthetic coding sequence
atgagcggccggctgtggagcaaggccatcttcgccggctacaagcgcggactcaggaaccagagagaacatacggctctgcttaagattgaaggagtttatgcccgcgacgagacagaattttacctggggaagcgctgtgcctatgtgtacaaagctaagaataacacggtgacaccgggcggcaagcccaacaaaaccagagtcatttggggtaaagtcaccagggcccacggcaactccggaatggtgcgggcaaaattcaggtcgaacttgcctgcaaaagcaatcggccaccgcataagagtcatgttatatccgagcagaatctag

SEQ ID NO: 203632 - DNA, 333 bp, Artificial Sequence
  Description of Artificial Sequence: Synthetic coding sequence
atgagcggccggctgtggagcaaggccatcttcgccggctacaagagagggttgcgaaatcagcgcgaacacaccgctttgctgaagatcgagggagtgtatgctagagacgagactgaattctacctcggcaaacgttgcgcttacgtttacaaggccaagaacaataccgtgacccccggtggaaaacctaacaaaacaagggtgatttggggcaaagtgacacgcgcgcacggaaactctggcatggtacgcgccaagtttcggtctaatctccctgcaaaggctataggccatagaatccgggttatgctctacccaagcaggatatag

SEQ ID NO: 203633 - DNA, 396 bp, Artificial Sequence
  Description of Artificial Sequence: Synthetic coding sequence
tgactgcccttcgccagccggttcctgagcttccgggccgacagcgcacacgcttcgatggtgaacgtacccaagacacggagaactttttgtaagaagtgcggtaagcaccagccgcataaggtgactcagtataagaaaggtaaggacagcctttatgcccagggcaaaaggcgatacgaccgcaagcaaagcggctacgggggccagaccaaacccatcttccggaaaaaggctaaaaccaccaagaaaattgtgctgaggcttgaatgcgtggagccaaattgccgtagcaagaggatgctcgcgattaaaaggtgcaagcatttcgaactgggtggagataagaaacgcaaggtgtataattacggctggaaggtgcagagctttagctag

SEQ ID NO: 203634 - DNA, 429 bp, Artificial Sequence
  Description of Artificial Sequence: Synthetic coding sequence
atgatcgcccccaccgacagccacgaggaggtgcggagcggcacctcctacatactgccattcgcgtcacgcttcctttcgttccgagccgattcggctcacgcaagtatggttaacgtccctaagactcgtcggacattttgcaagaagtgcggtaagcatcagccccacaaggtcacacagtacaagaaagggaaagactcgctgtatgcccagggaaaaaggcggtatgacaggaaacagtcagggtatggcgggcagacaaaacccattttccgtaaaaaagctaaaaccaccaaaaaaatagtgctcaggctagagtgcgtcgaaccgaactgcagatccaagcgcatgcttgcaataaagagatgcaaacacttcgagctcggtggagacaagaaacgcaaagggcaggtcatccagttctag

SEQ ID NO: 203635 - DNA, 321 bp, Artificial Sequence
  Description of Artificial Sequence: Synthetic coding sequence
atggtgaacgtgcccaagacccggcggaccttctgcaagaagtgcgggaaacatcagcctcacaaggtcacacagtataaaaaagggaaggactctttatacgcacaggggaagaggcggtacgaccgcaagcagagcggctatggcggccagacgaagcctatctttaggaagaaagctaaaaccaccaaaaagatcgtgttgcggcttgagtgcgtggaaccaaactgccgaagcaaacgtatgcttgccatcaagagatgcaaacacttcgagctaggaggagacaaaaaaagaaaaggccaagtgattcagttctag

SEQ ID NO: 203636 - DNA, 321 bp, Artificial Sequence
  Description of Artificial Sequence: Synthetic coding sequence
atggtgaacgtgcccaagacccggcggaccttctgcaagaagtgcgggaagcatcagccacataaggtgacccaatacaaaaaaggaaaagattcactttatgcacaaggccggagacgatacgaccgcaagcaaagtgggtacggaggccagaccaaacctatctttcggaagaaagctaagacaactaagaagattgtgttgagattggagtgcgtcgagccaaactgtagatccaaacggatgctggctattaaacgctgcaaacacttcgagctggggggggataagaaaaggaagggccaggtgatccaattttag

SEQ ID NO: 203637 - DNA, 294 bp, Artificial Sequence
  Description of Artificial Sequence: Synthetic coding sequence
atgaccaagggcaccagcagcttcggcaagcggcggaacaagacccacacactctgcaggcgatgtggctctaaagcctaccatttacaaaaatctacctgtggaaaatgcggttaccctgccaaaagaaagaggaagtataattggtccgccaaggccaagcggagaaacactaccggaaccggacgcatgagacatctgaagatcgtgtatcgaagattccgtcacggattccgcgagggcacgacccccaagcccaaacgagccgccgttgctgcaagcagttcttcctag

SEQ ID NO: 203638 - DNA, 207 bp, Artificial Sequence
  Description of Artificial Sequence: Synthetic coding sequence
atggtgaagaagatcgagatcagccagcacgccaagtacacctgctctttttgtggaaaaacgaaaatgaaacggagagctgtgggaatatggcactgcggttcctgtatgaagaccgtggcaggcggggcttggacctataatacaacatctgcagtgactgtaaagtctgctatccggcggctcaaggagttgaaggaccaatag

SEQ ID NO: 203639 - DNA, 279 bp, Artificial Sequence
  Description of Artificial Sequence: Synthetic coding sequence
atggccaagcggaccaagaaggtgggcatcgtgggcaagtacggcacacggtatggggccagcctaaggaaaatggtcaagaaaatcgagatttctcagcacgccaagtacacatgctccttctgtggtaagacaaagatgaagaggagagctgtaggtatctggcattgcggctcctgtatgaagacagttgctggaggcgcttggacctacaataccacatccgctgtgaccgttaaatcagctatcagaaggttaaaagagcttaaagatcaatag

SEQ ID NO: 203640 - DNA, 213 bp, Artificial Sequence
  Description of Artificial Sequence: Synthetic coding sequence
atgccccggaagatcgaggagatcaaggacttcctgctgaccgccaggaggaaagatgccaaaagcgtgaaaataaagaagaataaggataatgttaaattcaaggtgcgatgtagccggtatttgtatactctggttataaccgataaagagaaagccgagaaactgaaacagtcactaccaccaggtttggcggtgaaggaactcaagtag

SEQ ID NO: 203641 - DNA, 213 bp, Artificial Sequence
  Description of Artificial Sequence: Synthetic coding sequence
atgccccggaagatcgaggagatcaaggacttcctgctgaccgccagaaggaaggatgctaagtcagtaaagattaaaaagaacaaagataacgtgaaattcaaagtgcgttgttcaagatacctatacacccttgtgatcaccgataaggagaaggctgagaagctgaagcagagtctgccaccaggcctggctgttaaggaactgaaatag

SEQ ID NO: 203642 - DNA, 213 bp, Artificial Sequence
  Description of Artificial Sequence: Synthetic coding sequence
atgccccggaagatcgaggagatcaaggacttcctgctgaccgccaggcggaaagatgctaaatctgtcaagatcaaaaagaataaggataacgtcaaatttaaagtccgctgcagccgctatttgtatacactcgtaatcacggataaggagaaggccgaaaagctaaagcagagcctccctccaggcctggcggtgaaggaactgaaatag

SEQ ID NO: 203643 - DNA, 156 bp, Artificial Sequence
  Description of Artificial Sequence: Synthetic coding sequence
atgagcagccacaagaccttcaccatcaagcggttcctggccaagaagcagaaacaaaatcgccctatcccacaatggatccaaatgaagccagggagtaagataaggtacaatagcaaacggagacattggaggcgcaccaaactgggcttatag

SEQ ID NO: 203644 - DNA, 156 bp, Artificial Sequence
  Description of Artificial Sequence: Synthetic coding sequence
atgagcagccacaagaccttcaccatcaagcggttcctggccaagaaacagaagcagaacagaccgataccgcagtggatccagatgaaacctgggtccaagatccgctataattccaagagacgacactggcgacgcaccaaactgggcctttag

SEQ ID NO: 203645 - DNA, 156 bp, Artificial Sequence
  Description of Artificial Sequence: Synthetic coding sequence
atgagcagccacaagaccttcaccatcaagcggttcctggccaagaagcagaagcagaatagaccaatcccacagtggatccagatgaaaccaggcagcaagatccgctataactccaaacggagacactggaggcggacaaaactgggtctgtag

SEQ ID NO: 203646 - DNA, 1284 bp, Artificial Sequence
  Description of Artificial Sequence: Synthetic coding sequence
atggcctgcgcccggcccctgatcagcgtgtacagcgagaagggcgaatcgtccgggaaaaatgtcaccctgccagcagtattcaaggcccctatacgccctgacattgtgaacttcgtgcataccaatctgaggaagaataatcggcagccgtacgctgtttctgagctggcaggccaccagactagcgctgaaagttggggcaccggccgagctgtggccaggatacctcgcgtcagaggcggaggtacgcaccgcagcggacagggggcattcgggaacatgtgtcgcgggggaagaatgtttgcccccacaaagacctggagacgttggcaccgccgcgtcaatacaacacagaagagatatgctatttgtagtgcactggcagcttctgcccttccagccctagtcatgagcaaagggcataggatcgaggaggtgcccgagctccccctggtcgttgaggataaggtagaagggtataagaaaacgaaggaggcggtgcttcttctgaagaaattaaaagcatggaatgacatcaagaaagtctatgcctcacagcggatgcgggcagggaaggggaaaatgagaaaccgcaggcgcatccagaggaggggcccatgcatcatctataatgaggataacggaataatcaaggcgttccgcaatatcccggggatcaccctcctcaacgtgagcaaattaaatattctaaagctggctccaggggggcacgttggacgcttttgcatttggacagagagcgcctttagaaaacttgatgaactgtatggaacttggcgcaaagcggcctctttgaaatccaactataacttaccaatgcacaagatgataaacaccgacctctcccgaatccttaagtcacccgagatccagcgggcactgcgggcccccaggaagaaaattcaccgtcgagtgctgaaaaaaaaccctctcaaaaatttgaggattatgctaaaactgaatccttacgctaaaacaatgaggcgcaacaccatcctgcggcaggctagaaatcacaagcttagagtcgacaaagccgccgccgcggccgccgccctccaggccaaatccgacgaaaaggcggccgtggccgggaaaaagcccgttgtcggaaagaaaggaaagaaagcagcagttggcgtcaagaagcagaaaaaaccgctggtggggaagaaggcggctgccactaaaaagcctgcccctgagaaaaagcctgctgaaaagaagcctacaaccgaggagaagaagcccgccgcctag

SEQ ID NO: 203647 - DNA, 1221 bp, Artificial Sequence
  Description of Artificial Sequence: Synthetic coding sequence
atggcctgcgcccggcccctgatcagcgtgtacagcgagaagggcgagtcaagtggcaagaacgtgacactgccagccgtgtttaaggctcccattcgccctgatattgtgaattttgttcatactaacctaaggaagaataatcgccagccttatgctgtgagcgaactcgctgggcatcagacctctgctgagtcttggggtactggacgggccgtggccaggattccccgggttcgcggagggggcacccacaggagcgggcaaggggcctttggcaacatgtgcagagggggccgcatgtttgccccaaccaaaacttggaggcggtggcaccggagagtgaacaccacgcagaaacgatacgccatctgttcggctctggcggcatccgctctccctgctctcgtgatgtcaaagggacaccgaatagaggaggtaccagagctcccactggtggtcgaggacaaggtggaaggatataagaagactaaagaggcagtgctgctcctcaagaagctcaaagcatggaacgatatcaagaaagtgtatgcctcccagcgcatgcgggccggcaaggggaaaatgagaaatcgccgacgcatccagcgccggggcccctgcattatctataacgaggacaacggaataataaaagcattccgaaacatccccggaattaccctcctgaacgtgagtaaacttaacatactgaaattggcccctggcggacacgtgggccgcttttgtatttggacagagagcgctttccgaaagttagacgagctctatggcacgtggcgcaaggccgcaagcctgaaaagtaattacaaccttcctatgcacaagatgattaacaccgacctgtctcggatcctgaagtctcccgagatccaaagggccctgcgggctccccgaaaaaaaattcatcggcgagttcttaaaaagaaccctttaaaaaatttgcgaatcatgctgaagctgaatccatacgcgaagaccatgcggcgcaatactatcctgcgtcaggctcgcaaccacaaactgcgggtggacaaagcagcagcagccgccgccgcgctgcaagcaaagagcgacgaaaaggcagcagtggccgggaagaaacccgtagttgggaagaaggggaagaaggccgccgtcggtgagaagaagcctgcggaaaaaaaacctacaaccgaggagaaaaagcctgccgcctag

SEQ ID NO: 203648 - DNA, 456 bp, Artificial Sequence
  Description of Artificial Sequence: Synthetic coding sequence
atggcctgcgcccggcccctgatcagcgtgtacagcgagaagggcgagtcttccgggaagaatgtcactctcccagcagtattcaaggccccgatccgtccagatattgtgaattttgtgcatactaacctcaggaaaaacaacaggcaaccatatgccgtgtctgagcttgctggtcaccaaacaagcgccgagtcttgggggacaggcagggcagtggcaaggattccaagagttcgcggaggggggacacatcggagcggacagggcgcattcgggaatatgtgtagagggggtcgcatgtttgccccaaccaaaacttggaggaggtggcaccgccgagtgaacaccacacagaaactagagaatcatgtagaggccaaacctatatgcaaggatcacgcccctgaacatcatagtagccctggacaggaatcccaagcacccggtggctag

SEQ ID NO: 203649 - DNA, 78 bp, Artificial Sequence
  Description of Artificial Sequence: Synthetic coding sequence
atgcgggccaagtggcggaagaagcggatgcggcggctgaagcggaagagaaggaaaatgaggcagcggtcgaagtag

SEQ ID NO: 203650 - DNA, 78 bp, Artificial Sequence
  Description of Artificial Sequence: Synthetic coding sequence
atgcgggccaagtggcggaagaagcggatgcggcggctgaagcggaaacgacgcaaaatgcgccagagatctaagtag

SEQ ID NO: 203651 - DNA, 381 bp, Artificial Sequence
  Description of Artificial Sequence: Synthetic coding sequence
atgatcgtgcgggtgaccaaccgggacatcatctgccagatcgcctacgccaggatcgaaggcgacatgatcgtgtgcgctgcgtatgcccatgaactgcctaagtacggcgtaaaggtgggcctcactaattatgccgcagcatattgtacaggtctccttctcgctcgaagacttcttaaccgcttcggaatggacaagatatacgaaggccaggttgaggttactggcgatgaatataatgttgagagtatagatggacaacccggcgctttcacttgctatttggacgctggtttggcacggacaacgaccggaaataaagtttttggtgccctcaagggggcggtcgacggtggattatcaattccgcaccgttag

SEQ ID NO: 203652 - DNA, 894 bp, Artificial Sequence
  Description of Artificial Sequence: Synthetic coding sequence
atgggcttcgtgaaggtggtgaagaacaaggcctacttcaagcggtatcaggtgaaatttaggcggcgtagggaaggaaagacagactattacgcccgaaaaaggcttgttatccaggacaaaaataaatacaatacccccaaatatcgcatgatcgtgcgcgttaccaatcgagacatcatttgccaaattgcctatgcccgcattgagggtgacatgatcgtctgcgctgcgtatgcacacgaactgccaaagtacggcgttaaggtgggattaactaactatgcagccgcctactgtactggacttctgctagctaggcgcctattgaacaggtttggtatggacaaaatctacgaaggtcaggtagaagtgactggcgatgaatataatgtggagagtatcgacggacagcccggggcctttacgtgctacttagacgcagggcttgcgaggaccaccacgggcaacaaggtgtttggggccctgaaaggggcggtggatggtggcttgagcataccacacagtaccaagaggttcccaggatacgatagcgagtccaaggaattcaatgccgaggtgcaccgcaaacatataatgggtcagaacgtggcagactatatgagataccttatggaggaagacgaagacgcatataagaagcagttctcccagtatatcaaaaattcagtcaccccagatatgatggaagaaatgtataaaaaggcccacgcagccatacgggaaaatcctgtgtacgagaaaaagcccaagaaggaagtcaaaaagaagaggtggaacagaccgaaaatgtccctcgctcagaaaaaagacagagtcgcacagaaaaaggcgtcattcctccgagcccaggaacgcgcagccgagagctag

SEQ ID NO: 203653 - DNA, 744 bp, Artificial Sequence
  Description of Artificial Sequence: Synthetic coding sequence
atgatcgtgcgggtgaccaaccgggacatcatctgccagatcgcctatgcccgcattgaaggcgatatgatcgtgtgtgccgcttatgcccacgagctgcccaagtacggggtcaaagtgggactcaccaactacgcagccgcgtactgtactgggctccttcttgcaaggagattgcttaatcgcttcggtatggataaaatctacgaaggccaggtggaagtaactggggacgaatataatgtggaatcaatagacggtcagcccggagccttcacctgttacttggatgctggattggctagaactacaacgggtaataaagtgttcggcgctctgaagggggccgttgacggaggcttgtctatacctcattcaaccaaacgctttcctggatatgactcagaatccaaggaattcaatgccgaggtgcaccggaagcatatcatgggacagaacgtcgccgattacatgagataccttatggaagaagacgaagacgcatacaagaagcagttcagccagtatatcaagaactctgtcactccagacatgatggaagagatgtataaaaaggcccacgccgctatccgagaaaaccctgtttatgagaagaaacctaagaaagaggtgaagaaaaagagatggaacaggccgaagatgagtctggctcagaagaaagacagagtagctcaaaagaaggcctctttccttagagctcaggaaagagccgcagagtcgtag

SEQ ID NO: 203654 - DNA, 867 bp, Artificial Sequence
  Description of Artificial Sequence: Synthetic coding sequence
atggccggcgagaaggtggagaagcccgacaccaaggagaagaagcccgaggcaaaaaaggtggatgccggcggcaaggttaagaagggaaacctgaaggccaaaaagccgaagaagggcaagccacattgttcgagaaacccagtgctggtccgggggattgggcggtatagcagaagcgcgatgtattccagaaaagctatgtataaaagaaaatattctgctgcaaaatcaaaagtggaaaagaagaagaaagaaaaagtcctggccacggtgaccaagcccgttggcggggataaaaacggtggcactcgtgtcgtgaagctgcgaaagatgccacggtactacccaaccgaagacgtccctaggaagctcctgtctcatggtaaaaagcccttctctcagcatgtccgaaaacttagggccagtattactccaggtacgatcttgataatccttactggacgccaccggggcaaacgggtcgtctttctcaagcagttggccagcgggctactcctcgtgaccggaccattggtgctgaaccgcgtgcccttacgtcggactcatcagaagtttgtgatcgcgacctctaccaaaatcgacatcagcaacgtgaagatcccgaaacacttgacagacgcgtactttaagaaaaaaaaactgagaaagcctagacaccaggagggtgaaatcttcgataccgagaaagagaaatacgaaattacagagcagcgcaagattgatcagaaggctgtggatagccagattctgcccaagatcaaagcaatccctcagttacaggggtatctgcgttctgtttttgcactcactaatgggatctatccgcacaaactagtcttctag

SEQ ID NO: 203655 - DNA, 867 bp, Artificial Sequence
  Description of Artificial Sequence: Synthetic coding sequence
atggccggcgagaaggtggagaagcccgacaccaaggagaagaagccagaggctaaaaaggtagacgccggcggaaaagtgaaaaaggggaacctcaaggccaaaaagccaaaaaaaggcaagccacattgttcaaggaacccagtactcgttcgaggcatcggccgatactcccggtctgccatgtattccaggaaggcaatgtacaagagaaaatactctgcagcaaagagcaaagttgagaagaagaaaaaagagaaggtgctggcaacggtgacgaagcccgtaggaggagataagaacggaggcacccgcgttgtcaaactccggaagatgcctagatattaccctaccgaagatgtcccaaggaagctgctcagccacgggaagaagccatttagccagcacgttcgaaagctccgggcatcaatcacacccggtactattttaataatccttacaggccgtcaccgcggcaaacgtgtggtgtttctgaaacaactggcctcaggcttgctcctcgtcacaggtcctttggtgctaaaccgggtgccattaagaaggacacaccagaagttcgtcatcgcaacaagcactaaaattgatatttctaacgtgaagattcctaagcatctgaccgacgcttactttaagaagaaaaaactgcgtaagcctcgtcaccaagagggtgagatcttcgatacagagaaggagaaatatgagattacggagcagcggaagattgatcaaaaggccgtagattcccaaattctgcctaaaatcaaagccatcccacagttacagggatatctcaggtcggtgttcgccctaaccaacggtatatatccacacaagctggtcttttag

SEQ ID NO: 203656 - DNA, 318 bp, Artificial Sequence
  Description of Artificial Sequence: Synthetic coding sequence
atggccggcgagaaggtggagaagcccgacaccaaggagaagaagcccgaagccaaaaaagtggatgctggagggaaagtgaaaaagggaaacctcaaggcaaaaaaacccaagaaagggaagcctcactgcagccgcaacccggttcttgtgcggggcatagggaggtactctcgttcagcaatgtattccaggaaggccatgtacaagcggaagtatagcgcggctaagtcaaaggtggaaaagaagaagaaagagaaagtgttggccacagtgactaaacccgtgggcggtgacaagaatggcggaacccgctag

SEQ ID NO: 203657 - DNA, 219 bp, Artificial Sequence
  Description of Artificial Sequence: Synthetic coding sequence
atggccggcgagaaggtggagaagcccgacaccaaggagaagaagccagaggcgaaaaaagtggacgccggggggaaagttaagaaaggcaacctaaaagctaaaaagccaaagaaaggcaaaccacattgctctcgaaaccctgtactagtgcggggaatcggccgctactcacgctcagctatgtattctcgcaaagccatgtacaaaagaaaatag

SEQ ID NO: 203658 - DNA, 480 bp, Artificial Sequence
  Description of Artificial Sequence: Synthetic coding sequence
atggccggcgagaaggtggagaagcccgacaccaaggagaagaagcctgaagcaaagaaggtggatgcaggaggcaaagttaagaagggaaatttgaaggcgaagaaacccaagaagggcaaaccccattgcagccggaatccggtactcgtcagaggtataggacgctactctcgttcagcgatgtactcccggaaggccatgtacaagagaaaatatagcgctgcaaaaagcaaggttgagaagaagaaaaaagaaaaggtgcttgcgactgtgacaaagccggtggggggcgacaaaaatggcggaacaagagttgtgaagctgagaaaaatgccccgctattaccctaccgaagacgtcccaaggaaacttttatcgcatgggaagaagccgttcagccagcatgtccggaagctcagggccagcatcacgcccgggacgatcttgatcattctcacagggcgacaccgcggctag

SEQ ID NO: 203659 - DNA, 345 bp, Artificial Sequence
  Description of Artificial Sequence: Synthetic coding sequence
atggccggcgagaaggtggagaagcccgacaccaaggagaagaagccagaggcgaagaaagttgacgcgggtggaaaggtgaaaaagggcaacctcaaagcgaagaagccaaagaaagggaaaccgcattgctcacggaacccagtcttggttcggggaattgggagatatagtagaagcgctatgtattctcggaaggccatgtacaaaaggaaatattccgccgcaaaatccaaagtggagaagaagaaaaaagagaaggtcctggcaacagttactaaaccagtcgggggagataagaatgggggcactcgtgtggtaaagcttcgcaaaatggtacggtag

SEQ ID NO: 203660 - DNA, 345 bp, Artificial Sequence
  Description of Artificial Sequence: Synthetic coding sequence
atggccggcgagaaggtggagaagcccgacaccaaggagaagaagcccgaagctaagaaggtcgatgccggcggcaaggtaaaaaagggtaaccttaaagctaagaaacccaagaagggcaagcctcattgctcccggaatcccgtgctcgttcgcggaatcgggcggtatagccgctccgccatgtattctcggaaggccatgtataagcgcaagtattccgcagccaagtccaaggtcgagaagaagaagaaggagaaggtgctcgcaacagttactaagcctgtgggtggtgataagaatgggggaacaagagtcgtgaagctgcggaaaatggtgcgctag

SEQ ID NO: 203661 - DNA, 747 bp, Artificial Sequence
  Description of Artificial Sequence: Synthetic coding sequence
atggagggcgtggaggagaagaagaaggaggtgcccgccgtgcccgaaaccctgaagaaaaaacgccgaaactttgccgagttgaaaattaaacgcctcagaaagaaatttgctcagaagatgttgcgtaaggctcggcgtaagctgatttacgagaaagcgaagcattaccacaaagagtatagacagatgtatcgcacggagatacgtatggcgcggatggcccggaaagccggcaatttctatgttcccgccgaacccaaattggctttcgtcatcaggatacggggcattaatggggtatccccgaaggtcaggaaggtccttcagctgctaagactgcgccagatcttcaatggtacattcgtgaaactgaataaagcatcaattaacatgctgaggattgtggaaccttatattgcttggggctaccctaacctcaagagtgtcaatgagttaatttataaaagagggtatggaaaaatcaacaaaaagagaatagctctcactgataatgcgctcattgcaaggtccctcggcaagtatggcatcatttgcatggaggatctgattcacgaaatttatacggtggggaagcggttcaaagaagctaacaatttcttatggccttttaagctgagcagccctcggggagggatgaagaagaagaccacccatttcgtcgagggcggagatgcaggcaacagagaagatcagatcaaccgcctgatccggcggatgaactag

SEQ ID NO: 203662 - DNA, 456 bp, Artificial Sequence
  Description of Artificial Sequence: Synthetic coding sequence
atggcccccctgtaccaggccgccggcaagggcgacgtgcccaccaaaagacctccggtgcttagagcaggcgtcaacacagttacaaccctggtggagaacaaaaaagcccaattggtcgtgattgcgcacgatgtggatcccattgagctggtcgtattcctgcccgctctgtgccgaaaaatgggcgtaccctactgcataatcaaaggaaaggccaggctcggacgcctcgttcacagaaaaacgtgcaccactgttgccttcacccaggtcaacagtgaagacaagggcgctttggccaaactcgtagaagccatcaggaccaactacaatgaccgctacgacgaaattcgtaggcactggggcggcaatgtgctcgggcccaaatctgtggcccgaatcgcaaagcttgagaaagcaaaagctaaagagctagctactaagttggggtag

SEQ ID NO: 203663 - DNA, 801 bp, Artificial Sequence
  Description of Artificial Sequence: Synthetic coding sequence
atgcccaagggcaagaaggccaagggcaagaaggtggcccccgcccccgctgtggttaaaaaacaggaggccaagaaagtggtgaacccgctgttcgagaaaagacccaaaaatttcggtattggtcaggacatacagccaaagcgggacctgacccgttttgttaaatggccacggtatatccgcctgcagaggcagcgggctattctgtacaaacgtctaaaagtgccccctgctatcaaccaatttactcaggccctggatcgccagaccgcaacgcagctgctcaagctcgctcacaagtatcggcccgagactaagcaggaaaagaaacaacggttactggcccgcgccgaaaaaaaagccgctggcaagggagacgtgcccaccaagcgcccacctgttctgcgggcgggggtaaataccgttaccacacttgtcgaaaataagaaagcgcagttggtggtgattgcgcatgacgtagaccccattgagcttgtcgtctttttgcccgcattatgcaggaagatgggggtcccgtactgtatcatcaagggaaaggcccgcctggggagattggttcacagaaaaacatgtacaactgttgcatttacccaagtgaactctgaggataagggtgctctggctaagctcgtagaggcgatcagaaccaactacaatgacagatacgatgagattcgccgacactggggtggaaatgtcctcggtcccaagtccgtggccaggatagccaagcttgagaaagcaaaggccaaagaattagctacgaagctgggatag

SEQ ID NO: 203664 - DNA, 576 bp, Artificial Sequence
  Description of Artificial Sequence: Synthetic coding sequence
atgctggtgcggctgaacgtgcggtgcagctgccggggcgtggtgctgggcggctgtcgaaagctgttggcctccctggtgcagcctaaaggcaagaaagcaaaagggaagaaggtggctcccgcacccgcggtggtgaagaagcaggaggccaagaaggtggttaatccgctcttcgagaagcggccaaaaaattttggcatcggacaggacatccagccaaaacgagatttaacgaggtttgtgaagtggcctcggtacatccgcctccaaagacaaagggcaatcctttataaaagattaaaagtgcctcccgcaatcaaccaatttacacaagctcttgacagacagaccgctactcaactgctgaagttagcgcacaaataccggcccgaaaccaagcaagaaaagaaacaaaggttactggccagggcagaaaagaaggcggctggtaaaggcgatgtcccaactaaacgtccacctgtcttaagggctggcgtcaatactgtgactactttagtcgagaacaagaaagcccagctggttgtgattgctcatgacgtggatccaatatag

SEQ ID NO: 203665 - DNA, 774 bp, Artificial Sequence
  Description of Artificial Sequence: Synthetic coding sequence
atgggccgggtgatccggggccagcggaagggcgccggcagcgtgttcagggcccacgtgaagcacagaaaaggggcagctcgccttcgagctgtggactttgccgaacggcacgggtatatcaaaggaattgtgaaagatatcatccacgatcctggccggggggctccattggccaaagtggtgtttagagacccctatcgattcaaaaagcgaacggagctcttcattgccgctgaggggattcatacagggcaattcgtgtattgcggaaagaaagctcagcttaacataggcaatgttctccccgtcgggactatgcctgaaggcactattgtgtgttgtctcgaagagaaaccaggggatcggggcaagctcgcacgggcgtccgggaactacgcaacagtgatctcccacaatccagagaccaaaaagacccgggtcaaactgcccagcggttcaaagaaagtcatatcatctgccaaccgggctgtagtgggtgtggtcgctggcggaggcagaattgacaagcctatcctcaaagcagggagagcctaccacaaatacaaggcaaagcggaactgttggccccgcgttcggggtgtggcaatgaatcctgtggagcacccctttggaggaggtaaccaccagcacatcggcaaaccaagtaccattcgcagggatgcaccagcagggagaaaggtggggctcatcgctgccaggaggacaggaaggctgaggggaacaaagacagttcaggaaaaggagaattag

SEQ ID NO: 203666 - DNA, 774 bp, Artificial Sequence
  Description of Artificial Sequence: Synthetic coding sequence
atgggccgggtgatccggggccagcggaagggcgccggcagcgtgttcagagcccatgtgaaacaccggaagggagcagcccgactcagggcagtggattttgctgagcggcacggatacataaaaggtattgtgaaggacattatccatgatcccggccgcggcgcccccctagcaaaagtcgtgttcagggacccctacagatttaagaagaggaccgaactatttattgcggccgagggtattcacacggggcagtttgtgtactgcggtaagaaggcccagctcaatattggtaatgtgcttcctgtggggacaatgccggaaggcaccatcgtctgctgtttggaggaaaaacctggagatcgggggaaattggctcgagcctcaggcaattatgctaccgtgatcagtcataatcctgagacgaagaaaacccgcgtgaagctcccctccgggtctaagaaagtgatcagcagcgctaaccgcgcagtagtgggcgtggtggccggtggaggtagaatagacaaacccattctcaaagcaggaagagcctaccacaagtacaaggccaagcgcaactgttggccgcgggtccggggggtggccatgaacccggtggagcacccctttggaggcggcaaccaccagcacattggcaagccatccaccatccgtagggacgcacccgctgggagaaaggtcggcctcatcgcagcccgacgaaccggacggctcaggggtaccaagacagtgcaagaaaaagagaactag

SEQ ID NO: 203667 - DNA, 579 bp, Artificial Sequence
  Description of Artificial Sequence: Synthetic coding sequence
atgaagaccatcctgagcaaccagaccgtggacatccccgagaacgtggatatcactctgaaaggccgcaccgtgatcgtaaagggaccacggggcaccctccgtagggacttcaaccacattaacgtggagttgtctctgctgggcaagaagaaaaagcgcctgcgagtggataagtggtggggaaataggaaggagctcgccaccgtccgcacaatttgttctcatgtacagaatatgatcaaaggcgtgaccctcggctttcgatataaaatgaggtccgtgtacgcccatttccccataaatgtcgtaattcaggagaatgggtccctcgtagaaattagaaatttcctaggcgaaaaatacattcggcgggtcaggatgcggcccggcgttgcatgttcagttagccaagcacaaaaagacgagctgatcctggagggaaacgacatagagttagtcagtaattcggccgccctgatacagcaggctacaaccgtgaagaacaaagatattagaaagtttctcgatggcatctatgtatccgagaaaggaacggtgcagcaagccgatgaatag

SEQ ID NO: 203668 - DNA, 444 bp, Artificial Sequence
  Description of Artificial Sequence: Synthetic coding sequence
atgaagaccatcctgagcaaccagaccgtggacatccccgagaacgttgatatcaccctgaaaggaaggacagtgatcgtaaaagggccccggggcacattaagacgagactttaaccacatcaatgtcgagcttagcctgctgggtaaaaagaagaagcgattgcgtgttgataaatggtggggcaataggaaagaactggctaccgtgaggaccatctgtagccacgttcagaacatgatcaagggcgtgacgctgggttttaggtacaagatgcgcagtgtctacgcccacttccccattaatgtggtgattcaggaaaacggttcattagtcgagatcagaaacttcttaggggagaaatacattagaagggtcagaatgagacccggggtggcatgcttcaagttctctggatttgattctgcctctcataatagctag

SEQ ID NO: 203669 - DNA, 579 bp, Artificial Sequence
  Description of Artificial Sequence: Synthetic coding sequence
atgaagaccatcctgagcaaccagaccgtggacatccccgagaacgtcgacatcaccctgaagggtcggaccgtaatcgtcaagggccccaggggaaccctgagacgggattttaatcatatcaatgtggagctgagtcttctgggcaagaagaagaagaggctgcgcgtggacaaatggtggggaaaccgaaaagaactggcaacggtgcggacaatttgttctcacgttcagaatatgataaagggtgtgactttgggtttcagatataaaatgcggagcgtgtacgcacactttcccatcaacgtggtaatccaggagaatggtagcttggtggaaatacgaaactttctgggggaaaagtatattcgaagagttcgtatgcggcctggcgtggcatgtagtgtctctcaggcgcaaaaggatgagctgattctggaaggtaatgatatcgagctggtatcgaactctgccgctctcattcagcaggctaccaccgtcaaaaacaaagatatccgaaagttcctggatggaatctacgtgagcgagaagggaaccgtccagcaggccgacgagtag

SEQ ID NO: 203670 - DNA, 501 bp, Artificial Sequence
  Description of Artificial Sequence: Synthetic coding sequence
atgaagaccatcctgagcaaccagaccgtggacatccccgagaacgttgacatcacgttgaaaggtcgcacagtcattgttaaaggtcccagggggacactgcgtcgagattttaaccacattaacgtagaattgtcattactggggaagaaaaagaagagacttagggtcgacaagtggtggggaaaccggaaggagctagcaaccgtgagaactatatgctcacacgtgcaaaatatgattaagggtgttacacttgggttccgctataagatgcggagcgtctacgcgcattttcccattaacgtcgtgatacaagagaacgggagcctggtggaaattcgaaacttcctgggcgagaagtacatcagacgagtcagaatgcgccctggggttgcctgctccgtctctcaggcccagaaggacgaactgatcctcgaagggaacgacattgagctggtctccaactcagcagcattaatccaacaggctaccacgtag

SEQ ID NO: 203671 - DNA, 498 bp, Artificial Sequence
  Description of Artificial Sequence: Synthetic coding sequence
atgctgatgcccaagaagaaccggatcgccatctacgagctgctgtttaaggagggggtcatggtagccaagaaggatgtacacatgccgaagcatccagaactcgccgacaaaaacgttccaaacttgcacgtcatgaaggccatgcagagtctgaagtcacgcggctacgtcaaggaacagtttgcatggaggcacttctactggtacctcaccaacgaaggcattcagtacctgcgagattacctgcacctacccccagaaatcgtgcccgcaaccttacgcagatctagaccagagaccggccgtccccggcctaagggacttgagggcgaaaggcctgccagactgacaaggggggaggcggatcgagacacctacagacggtccgctgtccctcctggggctgataagaaagcggaagcgggggccgggagcgctacagagtttcagttccgcggcggtttcggccggggacgtggacagcccccgcagtag

SEQ ID NO: 203672 - DNA, 477 bp, Artificial Sequence
  Description of Artificial Sequence: Synthetic coding sequence
atggccgacatccagaccgagcgggcctaccagaagcagcccaccatttttcagaataaaaaacgggtgctgctaggcgagacaggaaaggagaaacttcccagatactacaagaacattggcctgggctttaaaaccccaaaagaggcgatcgaaggcacttacatagataaaaaatgtcctttcacgggcaatgttagtatccgcggtcggatcctgagcggtgtagtcacgaaaatgaaaatgcaaagaaccattgttatccgcagggactacctccactacattcgtaagtacaataggttcgagaagaggcacaaaaacatgtctgtgcacctatccccctgcttccgtgacgtgcagattggagatattgtgacggtgggcgagtgccgacctttgagcaagaccgtcaggttcaatgtcttgaaggtgacaaaggctgccgggaccaagaagcagtttcaaaaattttag

SEQ ID NO: 203673 - DNA, 423 bp, Artificial Sequence
  Description of Artificial Sequence: Synthetic coding sequence
atgaccagcatgacccagagcctgcgggaggtgatcaaggccatgaccaaggcacgcaacttcgagcgcgtgctggggaagatcactctggtgtccgctgcccctgggaaggtgatatgcgaaatgaaagtcgaagaagaacataccaacgctattggtaccctgcacggaggccttaccgctaccttggtagacaacatctccaccatggcgttactctgcacggaacgaggtgcgccaggcgtttccgtagatatgaatatcacgtatatgtcccctgcgaagctcggcgaggacatagtgatcaccgcccacgttctgaagcagggaaaaacactggcctttacaagcgtggacttaaccaataaagctacaggtaagttgatcgcccaaggtcgtcatactaaacatctgggaaactag

SEQ ID NO: 203674 - DNA, 456 bp, Artificial Sequence
  Description of Artificial Sequence: Synthetic coding sequence
atgggccggatgcacgcccccggcaagggcctgagccagagcgcccttccctaccgtcgctctgttcctacgtggcttaaactgacctccgacgatgtgaaggaacagatttacaaactagccaaaaagggccttacgccaagccagatcggagttatactccgggactcacatggagtggcccaggtgcggttcgtgacaggtaacaagattttaagaattctgaaaagtaaaggcttggcccccgatttgccagaagacctttaccatctgatcaagaaagccgttgctgtgcgcaagcacctggagcgcaaccggaaagataaagatgcaaagtttcgcttgatcctgatcgaatccaggattcaccggttggcccgctattataaaacaaagcgggtcctcccacccaactggaaatatgagagctccaccgcctccgcccttgtggcatag

SEQ ID NO: 203675 - DNA, 456 bp, Artificial Sequence
  Description of Artificial Sequence: Synthetic coding sequence
atggccccccggaagggcaaggagaagaaggaggagcaggtgatcagcttaggtccccaggtggctgaaggggaaaatgtattcggcgtttgtcatattttcgctagctttaacgacacatttgtacatgtgaccgacctttctggtaaggaaaccatttgcagggtaactggcggcatgaaagttaaggcggaccgcgacgaatccagcccttacgcagccatgctggccgctcaggatgtggcacagaggtgcaaagaacttgggattaccgcactgcatattaagttgcgcgctaccggcggaaaccgcaccaagacgcccggaccgggtgcgcaatctgccctccgagccctggcaagaagtgggatgaagatcggacgtatcgaagacgttacgcctataccttctgacagcacccggcgaaagggcggcagaagaggcagacgcctgtag

SEQ ID NO: 203676 - DNA, 456 bp, Artificial Sequence
  Description of Artificial Sequence: Synthetic coding sequence
atggccccccggaagggcaaggagaagaaggaggagcaggtgatcagcttggggcctcaggtggcagagggcgaaaatgtctttggggtatgccatatctttgcaagcttcaatgatacctttgtgcacgtcacagacttgtctggaaaagagaccatctgtcgcgttacaggagggatgaaggtgaaggctgatcgcgacgaaagctcaccatatgctgccatgctcgcagcgcaggatgtggcacaacgctgcaaggagctgggcatcactgccttgcatataaaattgcgggctaccggaggcaaccggacaaaaactccaggacctggtgcccagagcgccctgcgggcactggcccgctcagggatgaaaataggcaggatcgaagacgtgacccccattccgagtgattccacccgacggaaaggaggccggcgggggcggcggctgtag

SEQ ID NO: 203677 - DNA, 456 bp, Artificial Sequence
  Description of Artificial Sequence: Synthetic coding sequence
atggccccccggaagggcaaggagaagaaggaggagcaggtgatcagcctagggccccaggtggccgaaggcgagaacgtctttggcgtttgccacatctttgctagcttcaatgatacgtttgtgcatgtcaccgatctttccggtaaggagaccatctgtagggtcactggcggaatgaaggtgaaggctgaccgtgatgagtcgtctccgtatgccgcaatgctcgcagcacaggatgtcgcccagagatgcaaggaacttggaattacggccctgcacatcaaactgcgagccacaggagggaatagaacaaaaacaccgggccctggggcacaatccgctctgcgcgctcttgcccgatccgggatgaagatcggccgaattgaggatgtgacccctatcccttccgatagcacacggcgaaagggagggaggcgagggagacgtctttag

SEQ ID NO: 203678 - DNA, 456 bp, Artificial Sequence
  Description of Artificial Sequence: Synthetic coding sequence
atggccccccggaagggcaaggagaagaaggaggagcaggtgatcagcctgggtcctcaggtagctgagggcgagaacgtgttcggggtgtgccatatttttgcatcttttaatgacaccttcgtacacgtgactgacctctccgggaaagaaactatttgtcgtgtgaccggaggcatgaaagtcaaggccgatagggatgagagctctccttacgcagccatgcttgctgcccaggatgtggcccagcgatgcaaagaattagggattaccgccttacacatcaaattaagggccaccggcggaaacagaacaaaaacccccggccctggcgcccagtcagccctgagagctttggcccggtcgggcatgaaaattgggcggatcgaagatgtgacaccaattcctagcgactccacaaggcgaaaaggaggacggagagggcgcagactgtag

SEQ ID NO: 203679 - DNA, 6912 bp, Artificial Sequence
  Description of Artificial Sequence: Synthetic coding sequence
atggccagcagcgtggccccctacgagcagctggtgcggcaggtggaggccctgaaagccgagaacagccatctcagacaggaacttcgcgacaacagcagccatttaagtaaactagaaacagaaacaagtggaatgaaggaagtgctcaaacatcttcagggaaagcttgaacaggaggctcgagtgctcgtcagttccgggcagacggaggtcctggagcagctcaaagcactgcagatggatatcacatccctgtataacctgaagtttcagccccctacactggggccagaacccgcggctaggacaccagagggctcccctgtgcacggatctggcccaagcaaagacagtttcggcgagttatccagggctacgattcgactgctggaagaattggatcgcgaacgctgtttcttgctgaacgagattgaaaaagaggagaaggaaaagctctggtattattcccagctgcaggggctgagcaaaagattggatgagttgccccacgtggaaacacaattctccatgcagatggacctcatccggcagcaactggagttcgaggcacaacatattcgctcacttatggaagagcgttttggcacaagcgatgaaatggtccaaagagcccagatccgagcgtccaggctcgaacagattgataaagagctgctggaggctcaggaccgggttcaacagaccgagcctcaagccctgttggcagtcaagagtgtgccggtggacgaggatccggagacggaggttccaacacacccggaggacggcacaccacagccgggcaattctaaagtagaagttgtgttttggctgctttccatgctcgccaccagagaccaggaagacactgcgaggactctcttggctatgtcgtcctctccagaatcatgtgttgctatgaggcggagcggctgcctacccctgctattacaaattttacacggaacggaggccgccgccggcgggagagcaggagccccaggcgcccccggcgccaaagatgctcgtatgcgtgccaatgccgcactgcataacatagttttctcccagcccgaccaagggctggctaggaaagagatgcgcgtactgcacgttctcgaacagatccgagcctattgtgagacctgctgggactggctgcaggcacgggacggtgggcctgagggagggggcgctggatcggcaccgattccaatagaaccccagatttgccaagcgacttgtgctgtgatgaagctgagctttgacgaagaataccgcagggcaatgaacgagctaggagggcttcaggctgtggctgagctcctccaggtagactatgagatgcataagatgactcgtgaccctttgaatttagccttgcggcgctacgccggaatgacgctgaccaatctgacctttggggatgtggccaataaagctacactgtgcgctaggaggggttgcatggaagccattgtcgcccagctggcatcagacagcgaagagctgcatcaggtggtgtccagcatcttgagaaacctttcatggagggcagacatcaacagcaaaaaagtgctgcgagaggcaggcagtgtcacggctcttgtgcagtgcgtccttagagcgaccaaggagtctactcttaagtcagtgttatctgcgctctggaatctgtctgctcactctactgaaaataaggcagctatttgccaagtggatggggctttagggttcctcgtctctacccttacctataagtgccagagcaattccctagcaataattgagtctggaggcggaatattacggaatgtcagcagtctggttgccactagggaagattaccgacaggttctgcgggatcataactgcctccaaaccctgctgcagcacctaaccagtcatagcctgacaatcgtgagtaatgcatgtggaactctgtggaaccttagcgcacggtctgcccgggatcaagagctactgtgggatctgggcgccgtgggcatgctacggaacttggtacattctaagcacaagatgatagccatgggaagcgcggccgccctcagaaacctccttgcccaccggcccgcaaaacatcaggccgccgcaactgccgtgtcccctggttcctgcgtgccatctctgtatgtgagaaagcagagagctctggaagctgagctggatgcaagacatcttgctcaagccttagaacacctggaaaaacagggtcctcccgcggccgaggccgcgactaaaaaacccctgcctcctctgaggcacttggatggtctagcgcaggactacgcttcagattccgggtgttttgacgatgacgatgctccatcaagtttagccgctgccgccgcaaccggcgagccagccagccccgcagccttaagtttattcctgggcagtccgttcctccaagggcaagcgctcgctcggaccccacctacacggagaggaggcaaagaggcggaaaaggatactagcggagaggccgccgtggcggctaaagctaaggctaaactggcgctggccgttgcccgaattgatcaattggtggaagacatctctgcacttcacacctccagtgacgatagcttcagtctatcttcgggcgacccagggcaggaggccccccgtgaggggcgagcccagtcttgtagtccatgtagaggccctgagggaggccggagggaggcaggctcacgggcacaccccctgctcaggctgaaggctgcccacgcgtctttatccaacgatagtctcaacagtggttctgccagcgatggttattgtcctagggagcatatgctcccctgccccctcgccgccctggcctctagaagagaggacccccgctgtgggcagcctaggccttctaggctggatctggatctccctgggtgtcaggccgaaccacctgcacgcgaggctacttcggctgacgcaagagtgagaactataaagctgagtcctacataccagcacgtgccattgctggagggcgccagcagggccggcgccgaacctttggccggtccaggcatcagtcccggcgcaagaaaacaggcctggctgcctgctgaccatttgtctaaagtccccgagaaactcgccgccgcccctctgtcagttgcctccaaggcccttcaaaagttggctgcccaagaaggaccattaagtctgtcccggtgcagcagtctgagttcactgagctctgccggccggccagggccaagcgaaggcggagatcttgacgacagtgatagctccctagagggcctagaagaggccggccccagcgaagccgaactggatagcacgtggcgagccccaggcgctacaagcctgccagttgcaatcccggcacctcgtagaaacagaggtagaggtctaggagtagaagatgcaaccccgagttcctcgagtgaaaactacgtccaagagactcccctggtgctgagccgatgctcgtcagtctcaagtttggggtcatttgagtccccatcgatcgctagctctattccctctgagccctgtagcggacagggctctgggacaatttccccttcagagctccctgacagtcccggtcagacgatgcccccgtcacggtccaagaccccacctcttgccccagccccgcagggacctccagaggctacacagttctctttgcaatgggagtcatatgtcaagcggtttctcgacattgctgactgccgagagcgttgccgtttgcccagtgaattggatgcgggctccgtaaggttcactgtggagaagccggacgaaaatttttcctgtgcaagctccctttccgcacttgccctgcacgagcattacgtccagcaggatgtggagctgcgcctgctcccttctgcctgccccgagcgaggtggcggagctggaggtgctgggctccacttcgctggacacaggcgcagagaggaaggacccgctcccacgggctctaggccccgcggcgcggccgaccaggaactcgagcttctccgggaatgcctgggggcggctgttcccgcaagattgagaaaggtcgcttcagcactggtcccgggccgccgtgccctccctgtgcctgtgtacatgctggtccctgctccagcacctgcgcaggaagacgacagctgcacagattcagctgaaggcacccccgttaacttttcctctgctgccagcctttccgatgagactctgcagggaccccctagagatcagccaggtgggcctgcagggaggcagcggcccactggcagaccaaccagcgcccggcaagccatgggtcatcgccataaagcaggaggcgcaggacggtctgccgaacagagccggggggccggtaagaatagggccgggctcgagctgcctctggggcggcccccaagcgcacccgctgacaaagacggaagtaaaccagggcgtacacgtggcgacggcgccctacagtctttgtgcttaactactcctacggaggaggccgtttactgtttttacggcaacgactcagatgaggaaccgcccgctgcagcacccacccccacccaccgccgcacgagcgcgatcccgcgggctttcactcgcgagcgcccacagggacgtaaagaggcccctgcgccaagtaaggctgcgcccgcagcaccacctcccgcccggactcaaccatcccttatcgccgatgaaacacccccttgttactcactgagttcctccgcatcttcactgagcgaacccgagccaagcgagcccccagccgtgcacccgaggggccgagaaccagccgtcacaaaggatcctggtcccggcgggggccgtgactcatccccatcccctagggcagctgaggagctcttgcaacgctgcataagctccgcacttccaagacggcggcccccagtgagtggtctgcgaagacgtaaaccgcgcgcaaccaggctggacgagagaccggcagaagggagtagggaacgtggggaggaggccgctggctctgacagagcatccgatctggattctgtagagtggagggctattcaagagggcgctaactcaattgtgacctggctgcaccaggccgcagccgctactcgggaagcctccagcgagtccgattccatactgtctttcgtctcaggtctaagtgtcgggtccaccctgcagcctcctaagcataggaagggaagacaggctgagggtgagatggggtcagcgaggcgacctgaaaagcgcggcgccgcgtcagtgaaaacaagcggtagtcctcgctctcccgctgggcccgaaaaacctcgaggtactcagaaaacaacaccaggtgtacccgcagtgctgcgcggcagaacagtcatctacgttcccagtccagcccctcgtgcccagcctaagggaacccctggaccccgcgccacacctaggaaggtggccccaccttgtctagcccaaccggctgcacctgccaaagtgccaagccctggacagcagcgctctcgctcccttcacaggccagccaaaacttctgaactggctactctgtctcagcctccccgatcagccacccctcctgcccgcttggccaaaactcccagctcatcctcctctcagacctcaccagcaagccaaccactgccgcggaagaggcccccagtgacgcaggccgccggcgcccttccagggccaggcgccagtcccgtgcctaagacccctgcaaggaccctgctggccaagcagcacaaaacccagaggagccctgtgcgaattccctttatgcagagaccagcaagacgtgggcccccccctctcgcgcgagctgtacctgagccagggccacgcggaagagcaggaacagaggcaggcccaggtgctcgggggggtagactcggcctggttagggtggcctccgctctctcttcaggaagtgaatcctccgacaggtccgggttccgaagacagcttaccttcataaaagagagcccaggattgcgacgcagaagatcagagctgagcagtgcagagagcgcagctagcgctcctcagggggcctcaccacggaggggtcgtcccgctctccctgctgtgttcctatgctcaagccgatgtgaagagctgcgcgccgcgccaaggcagggacccgctccagctagacaacggccaccagcggcgaggccctcaccaggcgagagacctgcccggaggaccaccagtgagtcccccagtagactgccagttagagccccggccgcccggcctgagactgtcaagcggtacgcctctctgcctcatatcagtgtagctcgaagacctgatggcgccgtaccagctgcccccgcgtcagctgacgctgcccgccgtagtagcgacggggaaccacgccctctgccacgagtcgctgcccctgggacaacttggaggcgcattagggatgaggacgtgcctcacatcttgcggtctactcttcctgccactgcactgccacttcgagggtcaaccccagaggatgcacctgcaggccccccccctcggaaaacttcagacgccgtagtgcagacggaggaagttgccgctcccaagaccaatagtagcacatccccatccctggaaacacgggagcctcccggagcccccgccgggggccagctgtcgctcctggggagcgacgtcgacggacctagcctggctaaggccccaatttctgctccattcgtccacgagggcttgggcgtggcagtaggaggctttcccgcctctcggcacgggtcaccatccaggtctgctcgggtcccgccgtttaattacgtgccctctcctatggtcgtggccgctacaacagactctgccgctgagaaggcacctgctacagcaagcgcaactctgctggagtag

SEQ ID NO: 203680 - DNA, 438 bp, Artificial Sequence
  Description of Artificial Sequence: Synthetic coding sequence
atggccgaggtggagcagaagaagaagcggaccttccggaagttcacttacagaggagttgatcttgaccaattactggacatgagctacgagcagcttatgcagctatatagtgcccggcagcggcggcggctcaaccgagggctgcgcaggaagcagcactcgcttctgaaacgtctgcgaaaggcgaaaaaagaagctcctcctatggagaaacccgaggtggtcaagacccaccttcgagatatgattatcttgccggagatggtgggtagcatggtcggggtgtataacggtaaaacctttaaccaggtagagattaaaccagaaatgattggccattacctcggagaattttcaattacgtataaacccgtgaagcacggcagaccaggaatcggggcgacccacagctcaaggttcattcctctcaaatag

SEQ ID NO: 203681 - DNA, 393 bp, Artificial Sequence
  Description of Artificial Sequence: Synthetic coding sequence
atggtgcggatgaacgtgctggccgacgccctgaagagcatcaacaacgccgaaaaacgcgggaaacgtcaggtgttgattagaccttgctcaaaggtcatcgtgaggtttttgactgtgatgatgaagcacggctacattggcgaattcgagatcattgacgaccatagagcgggcaagattgtcgtcaatttgacgggtagactgaacaagtgcggcgtaatcagtcccaggtttgatgtccagctgaaggacctcgagaagtggcagaacaatctcctaccaagccggcagtttgggtttatcgtgttgaccacttctgctggaataatggatcacgaggaagccaggcggaagcacactggcgggaagattctgggctttttcttttag

SEQ ID NO: 203682 - DNA, 393 bp, Artificial Sequence
  Description of Artificial Sequence: Synthetic coding sequence
atggtgcggatgaacgtgctggccgacgccctgaagagcatcaacaatgccgaaaaacgcggcaagcgtcaagttctcatccgaccatgttcaaaggtgatcgttaggttcctgacggtcatgatgaagcacggatacatcggcgaatttgaaatcatagacgaccatagggcagggaaaattgtcgttaatctcacaggaaggctgaataaatgcggcgttatcagcccccgcttcgacgtccagcttaaagaccttgagaaatggcagaacaacttgttacccagccgccaattcggctttatcgtgctgacaacgtccgctggcattatggatcatgaggaggcccggcggaagcatactgggggtaaaatcctgggattctttttttag

SEQ ID NO: 203683 - DNA, 441 bp, Artificial Sequence
  Description of Artificial Sequence: Synthetic coding sequence
atgcccagcaagggccccctgcagagcgtgcaggtgttcggccggaaaaagactgctaccgcagtcgcccactgtaagagaggaaatggcctcatcaaagtgaatgggagaccattagagatgatcgagccccggaccctacagtacaagctgctcgagccggtgctgctactgggaaaagagagatttgcaggcgtggacatcagagttagggttaagggtggaggtcatgtagctcagatctacgctatcaggcaaagtatatctaaggcccttgtggcatactaccaaaaatatgttgacgaggcctctaagaaagaaatcaaagacatactcatccagtacgataggacattgctggtcgccgatcccagaagatgtgagagtaagaaatttggcggccctggtgcacgcgcaagataccagaagtcctacagatag

SEQ ID NO: 203684 - DNA, 459 bp, Artificial Sequence
  Description of Artificial Sequence: Synthetic coding sequence
atgcccagcaagggccccctgcagagcgtgcaggtgttcggccggaaaaaaacagcaactgcggtcgctcattgcaaacgagggaacgggctgatcaaagtgaacggtcggccactcgaaatgatagagccccggactttgcagtataaactcctcgaacccgtcctgttgctgggaaaagaacggttcgccggcgtggacattagagtccgagtgaagggagggggacacgtggcccaaatctacggagaaagtcaggagctcggcgcctggcgaagatggctgtgggagggtgggctgcacagcgcccctgtacctttcaattgcgtgtcttttagccagctctctgtctctccatctccgaagccttggtggcccatcactagaaatatgtggatgcgcttaccccggagacggtctaagacctcatcatctagtatgacaggcccctgttggtag

SEQ ID NO: 203685 - DNA, 408 bp, Artificial Sequence
  Description of Artificial Sequence: Synthetic coding sequence
atgggccgggtgcggaccaagaccgtgaagaaggccgcccgggtgataatcgaaaagtactacacacgattgggcaatgattttcacactaataaaagagtgtgcgaagagatagccataatcccatctaagaaattaaggaataaaatagccggatacgtaacccacctgatgaagcgtatccaacgtggccctgtgcgggggatctccattaaactccaggaggaagaacgagagaggagggataattacgtgcctgaggtttccgccctggatcaggaaattattgaagttgaccccgatactaaggaaatgctgaagctgctggactttggatcgcttagtaaccttcaggttacccagcccacagtgggaatgaactttaagacacccagagggcctgtttag

SEQ ID NO: 203686 - DNA, 300 bp, Artificial Sequence
  Description of Artificial Sequence: Synthetic coding sequence
atggacctgatcggcttcggctacgccgccctggtgaccttcggcagtatttttggatacaagcgaaggggcggcgtgcccagcttgatcgccgggttgtttgtgggctgccttgccggctacggagcctatagagtcagcaatgacaaacgggacgtcaaagttagcctctttacagcattttttctggctactataatgggagttagatttaaaaggtctaaaaagatcatgccggctgggctcgtcgccggcctgtcacttatgatgattcttagactagtcctcctgttattatag

SEQ ID NO: 203687 - DNA, 459 bp, Artificial Sequence
  Description of Artificial Sequence: Synthetic coding sequence
atgagcctggtgatccccgagaagttccagcacatcctgcgggtgttgaacacaaacatcgacgggcgtcgcaagatagcctttgccatcacagccatcaaaggcgtagggcgacggtacgcccatgtggtcctacgtaaggcagacattgacctaacgaaacgggcaggggaactaaccgaggacgaagttgagagagtcattacgatcatgcagaatccccgccagtacaagattcccgattggttcctcaaccgacagaaggacgtcaaagacggcaaatacagtcaggttctcgccaatgggttagataataaattgcgcgaagacctggagagacttaagaagattcgggcacaccggggcctgcgccatttctggggtttacgggtgaggggacagcataccaaaactaccggccggcgtggccgcacggtgggcgtgtcaaaaaagaaatag

SEQ ID NO: 203688 - DNA, 459 bp, Artificial Sequence
  Description of Artificial Sequence: Synthetic coding sequence
atgagcctggtgatccccgagaagttccagcacatcctgcgggtgctgaacaccaatatcgacggtaggcgtaaaatcgctttcgctatcactgccataaaaggcgtcggacgtcgttacgcccacgtggtcttgcggaaggcagatattgatctgacgaaaagagccggcgagctgactgaggacgaagtggagagagtgatcaccataatgcaaaacccgcgccagtacaaaatccctgattggttcctcaatcggcagaaggacgtgaaagatggaaagtactcccaggttttggctaatggactggacaataaattaagagaggatttggagagactcaagaagattcgcgcacaccgagggctgcggcacttttggggcctgcgggtgcgggggcagcataccaaaacaaccggacggcgcggccgaaccgtcggcgtttctaagaagaaatag

SEQ ID NO: 203689 - DNA, 105 bp, Artificial Sequence
  Description of Artificial Sequence: Synthetic coding sequence
atgagcctggtgatccccgagaagttccagcacatcctgcgggtgctcaataccaatatcgacggcagaaggaagatagcatttgctattaccgccataaaatag

SEQ ID NO: 203690 - DNA, 459 bp, Artificial Sequence
  Description of Artificial Sequence: Synthetic coding sequence
atgagcctggtgatccccgagaagttccagcacatcctgcgggtgctgaacacaaatatcgacggccgtcgtaaaatcgccttcgccatcacggctattaagggagtggggcgcaggtacgctcacgtcgttctgcgaaaagctgacatcgacttaacgaagagagcaggcgagctgactgaagacgaggttgaacgcgttataacaatcatgcagaatcctcgccagtacaagatccctgactggtttttaaatcgccagaaagacgtcaaggatggcaaatactcacaggtcctcgcaaacgggctagacaataagctccgtgaagacttggagagattgaaaaagatccgggctcacaggggattgagacacttctggggtctgagagtgcgtggccagcataccaaaacaacaggccgccggggtcggaccgtgggcgtgtccaaaaaaaaatag

SEQ ID NO: 203691 - DNA, 459 bp, Artificial Sequence
  Description of Artificial Sequence: Synthetic coding sequence
atgagcctggtgatccccgagaagttccagcacatcctgcgggtgctgaatactaacattgacggaagaaggaaaatcgcctttgccatcactgccatcaagggcgtcggaaggaggtatgctcatgtcgtcctgcgaaaggccgatatcgacttgacaaagagggctggcgaactgacggaagatgaggtggagagagtgataaccataatgcagaacccacggcagtataagattccagactggttcctgaacaggcaaaaagatgtgaaagacggcaagtactcccaagttctcgcaaatgggctcgacaacaagcttagagaggacttggagaggcttaagaagataagggcccacagggggcttcgtcatttttggggcttaagagtgagaggccaacacacaaagacaaccggaagaagagggcgcaccgtgggtgtatctaaaaagaagtag

SEQ ID NO: 203692 - DNA, 249 bp, Artificial Sequence
  Description of Artificial Sequence: Synthetic coding sequence
atgcagaacccccggcagtacaagatccccgactggttcctgaacagacaaaaggatgtaaaagacggaaaatattcacaggtcctcgctaacggactggataacaaattacgagaggacctggagcggttgaagaaaatccgggctcatcggggattgagacatttctgggggttgcgggtgcggggacagcacaccaagacaaccggaagaagaggaagaactgtgggcgtgtctaaaaagaaatag

SEQ ID NO: 203693 - DNA, 249 bp, Artificial Sequence
  Description of Artificial Sequence: Synthetic coding sequence
atgcagaacccccggcagtacaagatccccgactggttcctgaacagacagaaggatgtaaaggatggcaaatatagccaagttttggccaacgggttggataataagttgagagaagatttagagcgattgaagaagataagagcacaccgcggcctgagacatttctgggggctacgggtaagaggtcagcacactaaaacgaccggccgtcgaggtcgcacagtgggagtgtccaagaagaaatag

SEQ ID NO: 203694 - DNA, 249 bp, Artificial Sequence
  Description of Artificial Sequence: Synthetic coding sequence
atgcagaacccccggcagtacaagatccccgactggttcctgaacagacagaaagatgtcaaggacgggaaatactcacaggttctggccaatggattggataacaaacttcgtgaggatctagaacgactgaaaaagatcagggcgcatagggggttaagacacttctgggggctccgggtgcgggggcagcatacaaaaaccaccggccgccggggaaggaccgttggggttagcaagaagaaatag

SEQ ID NO: 203695 - DNA, 249 bp, Artificial Sequence
  Description of Artificial Sequence: Synthetic coding sequence
atgcagaacccccggcagtacaagatccccgactggttcctgaacaggcagaaagatgtgaaggatgggaaatatagccaggtgctagctaatggactcgataacaagctgcgcgaggacctcgaaaggctaaagaagattcgggctcacagaggtctccgccatttctggggacttagagtgcgaggacagcacactaaaactactggccgtcggggtagaaccgtgggcgtgagtaaaaagaagtag

SEQ ID NO: 203696 - DNA, 249 bp, Artificial Sequence
  Description of Artificial Sequence: Synthetic coding sequence
atgcagaacccccggcagtacaagatccccgactggttcctgaaccgtcaaaaggacgtgaaagatggtaagtattcacaggtgttagccaacggactcgataacaagctgagggaagacttagaacgactgaagaagatacgggcacatcgcggtctcagacatttttggggtttgcgagtgcgcgggcaacatactaagactacaggcagacgcggaaggactgtgggggtcagcaagaagaagtag

SEQ ID NO: 203697 - DNA, 648 bp, Artificial Sequence
  Description of Artificial Sequence: Synthetic coding sequence
atgtacagcttcatgggcggcggcctgttctgcgcctgggtgggcaccattctgttagtggtggcgatggccactgatcattggatgcaataccgactgtccggtagcttcgctcaccaaggactgtggcgctattgcctgggcaataagtgttacctgcagaccgactcgatcggcgaaccgcctggacaggggccaggacgcgcatggggaaagagtcgggctgatctgggagcacagggacacttgtactcccgatggagaacgctacggctcaaagaaggaaaaggcgcgactcaggcctactggaacgctaccagggcatttatgattctgtccgcactgtgtgccatttccggcattatcatgggtatcatggccttcgcccatcaacccactttctctaggatatccagaccattcagcgccggcattatgttttttagctcaactctgttcgtggttctggccctggctatatacaccggagtgactgttagctttttgggcaggagattcggggattggagattcagttggagctacattctgggatgggtggctgtgctgatgaccttctttgctgggatcttctatatgtgcgcgtaccgcgtgcacgagtgccggcgtttgtccacccctcgctag

SEQ ID NO: 203698 - DNA, 438 bp, Artificial Sequence
  Description of Artificial Sequence: Synthetic coding sequence
atgcccggcgtgaccgtgaaggacgtgaaccagcaggagttcgtgcgggcactcgccgcatttctgaagaagtccggaaagctcaaggttccagagtgggtggacactgtgaaactagctaaacataaggaactggctccatacgacgagaactggttttacacccgagccgcctcaaccgcccgccacctctacctccgcgggggcgccggagtcggaagcatgacgaagatttatggagggcgccaacggaacggagtaatgccctctcatttttctaggggaagcaagtcagtcgcgcgacgagtgttgcaggccctagaaggtctgaagatggttgaaaaagaccaggatggtggtaggaaacttaccccccagggtcaaagagacctggacaggatcgccggtcaggtagcagcagccaataaaaagcattag

SEQ ID NO: 203699 - DNA, 411 bp, Artificial Sequence
  Description of Artificial Sequence: Synthetic coding sequence
atgagcgccgccctgctgcggcggggcctggagctgctggccgcctccgaagcaccacgcgatccacctggccaggccaaaccgagaggggctcctgtcaaacggcctcgaaaaacgaaagccattcaggctcagaagcttagaaactccgctaaaggcaaagtgccaaaatctgccctggatgagtatcgaaagagggagtgccgcgatcatctgcgggtcaaccttaaattcttgacccgaacccggtcaacagtagctgaatccgtttcacagcaaatcctcaggcagaatcgagggcgaaaagcatgcgacagacccgtggccaaaacaaaaaagaagaaggctgaaggaacagtgttcacggaggaagatttccagaaatttcagcaggagtacttcgggagctag

SEQ ID NO: 203700 - DNA, 882 bp, Artificial Sequence
  Description of Artificial Sequence: Synthetic coding sequence
atggccgacgacgccggcgccgccggcggccccggcggccccggcgggcccggaatgggaaatcgtgggggatttcggggtggtttcggcagcggcattagggggaggggacgcggacgggggagggggcgggggagggggcgtggagcaagaggtggaaaggccgaagataaggaatggatgcccgtcaccaagttaggtcgactggttaaggatatgaaaatcaagagcctcgaagaaatctatcttttcagtttgccgattaaggagagcgaaatcatcgacttttttctgggagccagcctcaaagacgaagtgctcaaaatcatgcccgtacaaaagcagaccagagcagggcaacgaacacgctttaaggctttcgtggcaattggcgactataatggccacgtggggctcggagtcaagtgctctaaggaggttgcaaccgccattaggggggctataatcctggctaagctcagtatcgtgccagtgagacgagggtactggggcaacaagattggtaagcctcataccgtaccctgtaaagtaaccgggcggtgtgggtccgtgttggttcgcctgatcccagcaccacgtgggacaggcattgtgtcagcacccgtgccaaaaaaattgttgatgatggcaggtatagatgactgctatacctccgctaggggctgcacagctacgctaggcaattttgccaaggctacattcgacgcaatcagcaagacctattcctacctgactccagatctttggaaagaaacagtgttcaccaaaagcccttaccaggagttcaccgaccacctcgtgaagacccacacacgagtgagtgtacagagaacccaggctcctgccgtggcaacgacatag

SEQ ID NO: 203701 - DNA, 708 bp, Artificial Sequence
  Description of Artificial Sequence: Synthetic coding sequence
atggccgacgacgccggcgccgccggcggccccggcggccccggcggccctggcatggggaatagagggggctttaggggaggattcggaagcggtatcaggggtaggggcagaggtcgtgggcgtggccgaggcagaggtcggggggcccggggggggaaagccgaggataaggaatggatgcccgttacaaagctgggtcgcctcgtgaaggacatgaaaattaagagcctcgaagaaatttatctgttcagtttgcctatcaaggagagcgagataattgatttttttctgggcgcctctctgaaagatgaggtcctcaaaatcatgcccgtccaaaagcagacgagagctggacagagaactcgcttcaaagtgactggacgctgtggcagtgtattggtccgattaatcccggcacctcgcggcactggaatagtttcggcgcctgtgcctaaaaaattgttgatgatggctggaattgacgactgttatacgtcggcgagaggttgtactgcaacactgggaaacttcgcaaaagccacatttgacgccatttccaagacatacagttacttaaccccggatttgtggaaagagactgtgttcactaaatctccctaccaagagtttacagaccacttagtgaagacgcatactagagtatctgtgcaacggactcaggcccccgcggttgccactacatag

SEQ ID NO: 203702 - DNA, 537 bp, Artificial Sequence
  Description of Artificial Sequence: Synthetic coding sequence
atggccgacgacgccggcgccgccggcggccccggcggccccggcggaccaggtatgggaaaccgcggtggcttcaggggcggatttggctctggaattagagggcgtggccgcggacgtggtcggggccgaggaaggggacgcggagcccggggcggaaaggctgaagataaagagtggatgccagtcacgaaactgggaagacttgttaaggatatgaaaatcaagtccctggaagaaatctatctgttctccttgccaattaaggaatccgaaattatagacttttttctcggagcttccctgaaagacgaagtgttgaagattatgccggtccaaaagcagaccagggctgggcagcgcacgaggttcaaagtgcccggctgtcccgggggaggatgtgctgggttagccgggactcttagcgccttgcactcgtgcacatggttgcacccatgtgacttccggaacggcgagcgcgagaagaggtctcctcaagaccttggctgggcacttctgtggcctctgtttccctag

SEQ ID NO: 203703 - DNA, 588 bp, Artificial Sequence
  Description of Artificial Sequence: Synthetic coding sequence
gtgaccaagctgggccggctggtgaaggacatgaagatcaagagcctcgaggagatctacctctttagcctgcctattaaggctttcgtggccattggcgattataacgggcacgtgggcttgggcgtgaagtgtagtaaggaagttgctaccgccataagaggggcaatcatcttggcaaagctatccattgtccctgtgcgacgcggttactggggaaacaagataggaaagccccacacggtcccctgtaaggtgaccggcagatgtggcagcgtgctggtcaggctaatacccgccccccgagggaccggtattgtgagtgccccggtgccaaaaaagctcctcatgatggctggcatcgacgactgctacacatccgcaagaggctgtacggctaccctggggaactttgctaaggctacattcgacgcgatttcaaagacatactcctacctcactcccgatctctggaaagagactgtgttcactaagtctccctaccaggaattcactgaccatctggtgaaaacacatacacgcgtctctgtacagaggacccaggcccctgccgtggccacgacgtag

SEQ ID NO: 203704 - DNA, 360 bp, Artificial Sequence
  Description of Artificial Sequence: Synthetic coding sequence
atggccttcaaggacaccggcaagacccccgtggagcccgaggtggccatacaccggataagaattactctgactagccgcaacgtgaaatcactcgagaaggtgtgcgctgatctgatccggggagctaaggagaagaacctgaaagtgaaagggcccgtaagaatgcccacaaaaactctccggattaccacacggaagactccttgtggagagggcagtaaaacctgggacagatttcaaatgcggattcataagcgtctgatagatctgcatagtccttcagagatcgtcaagcagatcacgagcatctccatagagcccggcgtggaggtggaagttaccatcgctgacgcgtag

SEQ ID NO: 203705 - DNA, 429 bp, Artificial Sequence
  Description of Artificial Sequence: Synthetic coding sequence
atggccttcaaggacaccggcaagacccccgtggagcccgaggtggcaatccataggatccgtattacacttaccagtcgcaacgtgaagtctctggagaaagtttgcgccgacttgatcaggggcgctaaagaaaagaacctgaaggtcaaaggacctgtgagaatgccaaccaaaactctgaggattaccaccaggaaaaccccatgtggggagggatctaaaacttgggatcgatttcagatgagaatccataaacgccttatcgacttacatagtcctagcgagatcgttaagcaaataacctcaatctccatcgaacctggcgttgaactcatcgaaagtactgacgcagagcctatggacactgaagggcaacagtacaccctgcggtctgtgttcgagagtccaggtacttgtcctttctag

SEQ ID NO: 203706 - DNA, 360 bp, Artificial Sequence
  Description of Artificial Sequence: Synthetic coding sequence
atggccttcaaggacaccggcaagacccccgtggagcccgaggtggccatccataggattagaataacccttactagtcgcaacgtgaaatcactcgagaaggtatgtgctgatttgattcggggggcaaaggaaaagaacctcaaggttaaaggtcccgtaaggatgcccacaaagacactgaggattactaccaggaaaacaccgtgcggggaggggtctaagacctgggaccggtttcagatgcgcatccataagaggctaatcgatctgcattcccccagcgaaattgtgaagcagatcacatccatttcaatcgagcccggtgtggaagtcgaggtgacaatcgccgatgcatag

SEQ ID NO: 203707 - DNA, 252 bp, Artificial Sequence
  Description of Artificial Sequence: Synthetic coding sequence
atgcagaacgacgccggcgagttcgtggacctgtacgtgccccggaaatgttccgcctctaacagaattatcggcgcaaaggatcacgcttccatccagatgaacgttgcagaagtggacaaggtcacgggcagatttaacggtcaattcaagacttatgctatctgtggggcgatacggcggatgggggagtcagatgacagcattctccgtcttgcaaaggccgacggaattgtgtccaagaacttctag

SEQ ID NO: 203708 - DNA, 294 bp, Artificial Sequence
  Description of Artificial Sequence: Synthetic coding sequence
atgcagaacgacgccggcgagttcgtggacctgtacgtgccccggaagtgttctgcctcaaaccgcattatcggggcaaaggaccacgctagcatccagatgaatgttgccagactcacacgctcacaagctgggcttatggcgtctctgaagctcatgctgagtgctgggccctttgtcggatgggtaagccaaatgatccctttttcagactggccgcggcggtggcacaggctaaaagaactcctgaccggcgaaaatcaccgatgtggcattttcgtcattaataaatag

SEQ ID NO: 203709 - DNA, 252 bp, Artificial Sequence
  Description of Artificial Sequence: Synthetic coding sequence
atgcagaacgacgccggcgagttcgtggacctgtacgtgccccggaagtgcagtgcctccaatcgaatcattggagcaaaggatcacgcctctatccagatgaatgtggcggaagtggataaggtcactggacgcttcaatggacagtttaaaacttatgctatctgtggagctatccgccggatgggcgaatcagatgacagtatcctgcgcctcgcaaaagcggatgggatcgtttccaagaatttttag

SEQ ID NO: 203710 - DNA, 201 bp, Artificial Sequence
  Description of Artificial Sequence: Synthetic coding sequence
atgcagaacgacgccggcgagttcgtggacctgtacgtgccccggaagtgctctgcgtccaaccgcatcattggcgcaaaagatcatgcaagtatccagatgaacgtggctgaagtctcttgggagccaggaaggagagaaggatgtgatatctgtgcagggaaggccgggtgtcctattgtagaggagcccctcgggtag

SEQ ID NO: 203711 - DNA, 273 bp, Artificial Sequence
  Description of Artificial Sequence: Synthetic coding sequence
atgcagaacgacgccggcgagttcgtggacctgtacgtgccccggaagtgcagtgcgtccaatcgcataattggtgctaaagaccacgcgagtatccagatgaacgtggctgaggtggacaaggtgacaggccgattcaatggacagttcaaaacatatgccatttgcggagccatccgcagaatggtgtccgtgagcctgggcttcgcccaccatttcggtaccagctggaccttgccatgcgccctcgaatgtgtaatggtccccgagtag

SEQ ID NO: 203712 - DNA, 246 bp, Artificial Sequence
  Description of Artificial Sequence: Synthetic coding sequence
atgcagaacgacgccggcgagttcgtggacctgtacgtgccccggaagtgttcagccagcaataggattataggggcaaaagatcacgcaagcattcagatgaacgtagccgaggttgacaaggttacaggccgattcaacggccaattcaagacctatgctatatgtggtgctatacgacgaatgggggaatcagacgatagtatcctcagactggccaaagctgacggaatcgtatcaaagtag

SEQ ID NO: 203713 - DNA, 432 bp, Artificial Sequence
  Description of Artificial Sequence: Synthetic coding sequence
atgggcaagtgccggggcctgcggaccgcccggaagctgcggagccatcggcgtgaccagaagtggcacgacaagcaatataagaaagcccacctaggaacagccctcaaggccaatccattcgggggcgccagccatgccaagggtattgtcctggagaaagtaggagttgaagctaaacagcccaactccgccattagaaagtgcgtgcgcgtgcagttaataaagaacgggaagaaaatcaccgcctttgtgccaaatgacggctgtcttaattttattgaagagaacgatgaggtactcgtcgccggattcgggaggaagggacatgcagtcggcgacattccaggggtgcggttcaaggtggttaaagtggcgaatgtaagcctgctggcgctgtacaagggcaagaaggaacgccctaggtcctag

SEQ ID NO: 203714 - DNA, 393 bp, Artificial Sequence
  Description of Artificial Sequence: Synthetic coding sequence
atgaacgacaccgtgaccatccggacccggaagttcatgaccaaccgcctcctccaacgcaagcagatggtgatcgatgtgcttcaccctgggaaggccaccgtcccaaagaccgagatacgtgagaagctggccaagatgtacaaaacaacaccagacgtgatattcgtctttgggttcagaactcactttggcggcggcaaaaccactggcttcggcatgatatacgactcattggactacgccaaaaagaatgaaccaaagcatcgcttagcgaggcacgggctgtacgaaaaaaaaaagacaagccgcaagcaacgcaaagaaaggaaaaacagaatgaaaaaagtcagggggactgctaaggctaacgtgggggccgggaagaaatag

SEQ ID NO: 203715 - DNA, 402 bp, Artificial Sequence
  Description of Artificial Sequence: Synthetic coding sequence
atgaacgacaccgtgaccatccggacccggaagttcatgaccaaccgactgcttcagagaaagcagatggtgattgatgtccttcatcctggaaaagcaacggtccccaaaaccgaaatccgcgaaaagctagccaagatgtacaagacaaccccggacgtgatctttgtgttcggattcaggacacattttggaggcggaaaaacgacaggattcggcatgatatacgacagtcttgactatgccaaaaaaaatgaaccaaagcatcggctcgcacggcacggtctttatgagaagaagaagacttccagaaaacagaggaaagaaagaaaaaaccggatgaaaaaagtgagaggcaccgccaaagccaacgttggggcgggtaagaagcctaaggagtag

SEQ ID NO: 203716 - DNA, 399 bp, Artificial Sequence
  Description of Artificial Sequence: Synthetic coding sequence
atgaacgacaccgtgaccatccggacccggaagttcatgaccaaccggttactgcagcggaagcagatggttattgacgtgctgcaccctggcaaggcaaccgtacccaagaccgagattcgggagaagctggcaaaaatgtacaagactacccctgatgtgatcttcgtatttggcttccgcactcacttcggaggtgggaaaacgaccgggttcgggatgatctacgacagcctagactacgcaaagaaaaacgagcccaagcatcggctggcacgtcacggactgtacgaaaaaaagaagacgagtcgaaagcagcgtaaagaaaggaaaaacaggatgaagaaggttaggggcaccgcaaaagccaatgttggtgccggaaagaaacagaagtag

SEQ ID NO: 203717 - DNA, 396 bp, Artificial Sequence
  Description of Artificial Sequence: Synthetic coding sequence
atgaacgacaccgtgaccatccggacccggaagttcatgaccaaccgcctgttgcagcgaaagcaaatggtcatagatgtgctccatcctggcaaggctacagtgccgaaaacagaaattagggagaagctggccaaaatgtataaaactacgcccgacgtgatttttgtttttggtttccgcacccactttggcggaggaaaaacaactggatttggtatgatctatgattcattggactatgccaaaaagaacgagcccaagcatcggctggctcgacacgggctgtacgagaagaagaagacttcacggaagcaaagaaaggaacggaagaacagaatgaagaaggtaaggggtaccgccaaggccaacgtcggcgccggcaaaaagcagtag

SEQ ID NO: 203718 - DNA, 870 bp, Artificial Sequence
  Description of Artificial Sequence: Synthetic coding sequence
atgaacgacaccgtgaccatccggacccggaagttcatgaccaaccggctgctccaaagaaaacagatggtgatagacgtcctgcacccaggaaaggccaccgtacccaaaactgaaatccgagagaaactggcgaaaatgtacaagacgacaccagatgtgatattcgtattcgggtttaggacacatttcgggggtgggaagactaccgggtttggaatgatctatgactctcttgactatgcgaaaaagaacgaaccaaaacatcgtttggctaggcacggattgtacgagaaaaaaaaaacgtcaaggaaacagcgtaaggagagaaaaaatcgcatgaaaaaagtgcgcggcacagcaaaagcaaatgtcggcgctgggaagaagatgcgggagctggggctcggcgttcaagcgctgggacggatttcccaagaggagaggtgtactgatgtgaaaaacagcaaggcccgagaatccaggggagttgtttggcaagtagaggttcccggcccatggtccgtttggacatgtggtcgactaagaagagggtgtggaaaatatctccaggtcgccgtaacctggagaaaaacggaaaatcgtgaacagtgttgccaggcttgtctcctcgaaagggctctggttcgcaacggagctttcatgagtcctgcctctccagcccccgcgggtagcccgcatcctgttgatggagacctagtgctacacctacccgaggctctatctgcaacattaaccctgtcaccacatatacaagcaatcaacaagtcctttggcccctttttcgagatccatcaggagagtagttgcttctctccgccaagctgcttgagcgggctgggccattag

SEQ ID NO: 203719 - DNA, 378 bp, Artificial Sequence
  Description of Artificial Sequence: Synthetic coding sequence
atgccccccaaggacgacaagaagaagaaggacgccggcaagagcgctaagaaggataaggatcccgtgaacaagtcaggcggtaaggcaaagaagaaaaagtggtcgaaaggcaaggtacgcgacaagctgaacaatttagtgttgttcgacaaggcaacctacgataagctgtgcaaagaggtccccaactacaagttaattacccctgcggtcgtttcagagcgcctcaaaatccggggcagtctcgcacgggcagcccttcaggaactgttgagtaagggccttattaaactggtctctaagcatagggctcaggtaatctacactcggaataccaaagggggagatgctcccgcggctggtgaggatgcctag

SEQ ID NO: 203720 - DNA, 348 bp, Artificial Sequence
  Description of Artificial Sequence: Synthetic coding sequence
atgaccaagaagcggcggaacaacggccgggccaagaagggccggggtcatgtccagcctattagatgcacaaactgtgccagatgcgttccaaaggataaagctattaagaaattcgtcatcaggaacatcgttgaggctgccgccgtgcgcgacatatcggaggcaagcgtattcgacgcgtacgtattgcccaaactttacgtgaagctgcactactgtgtatcatgtgcaattcacagcaaagtcgtgcgtaatcgctcacgggaggcccggaaagataggactccaccccctagattccggccggccggcgctgcgccaagacctcctcccaagccaatgtag

SEQ ID NO: 203721 - DNA, 348 bp, Artificial Sequence
  Description of Artificial Sequence: Synthetic coding sequence
atgaccaagaagcggcggaacaacggccgggccaagaagggccggggccatgtccagcccattagatgcactaattgcgccagatgcgtccctaaggacaaagcaataaaaaaatttgtgatccggaacattgtggaggctgctgcagtgcgagacatttctgaagcgagcgtgttcgacgcgtacgtcctcccaaagctttacgtgaagttacattattgtgtgagctgcgctatccatagtaaggtggtgcgcaatcgtagcagagaggctagaaaagaccgtacaccacctcccaggttccggcctgccggagccgccccccggcccccccccaaacccatgtag

SEQ ID NO: 203722 - DNA, 255 bp, Artificial Sequence
  Description of Artificial Sequence: Synthetic coding sequence
atgcccctggccaaggacctgctgcaccccagccccgaggaggagaagaggaaacataaaaagaaaaggttggtgcagagcccaaatagctacttcatggacgtgaagtgtcccgggtgttacaagattaccaccgtgttctctcacgcacaaactgtggtgctgtgcgtcggctgctccaccgttttatgccagcctacaggaggtaaagcgaggctcacagaaggatgctcgttcaggagaaagcagcactag

SEQ ID NO: 203723 - DNA, 201 bp, Artificial Sequence
  Description of Artificial Sequence: Synthetic coding sequence
atgcccctggccaaggacctgctgcaccccagccccgaggaggagaagcggaaacacaagaaaaagcgcctggtgcagagccccaattcctacttcatggacgtgaagtgccccggcgaagaaactgcatgctgctctggggagagcaccggaccccagcagctggagaatgtggtagtgcttgccgtgagttacccgtag

SEQ ID NO: 203724 - DNA, 255 bp, Artificial Sequence
  Description of Artificial Sequence: Synthetic coding sequence
atgcccctggcccgggacctgctgcaccccagcctggaggaggagaaaaagaagcacaagaagaaacgcctggtccagtcaccaaatagctattttatggatgttaagtgcccaggatgttacaaaattacaactgtcttttcgcatgcccaaactgtggtgctatgcgtcggttgttctacagtgctttgccaacctacaggcggtaaggcccggcttaccgaggggtgttcattcaggcggaagcagcattag

SEQ ID NO: 203725 - DNA, 159 bp, Artificial Sequence
  Description of Artificial Sequence: Synthetic coding sequence
atggacgtgaagtgccccggctgctacaagatcaccaccgtgttctctcacgctcagacagtagtgctctgtgtgggctgttctacagtgctgtgccagcccacagggggaaaggctcgactaacagagggatgttccttccgccggaagcagcattag

SEQ ID NO: 203726 - DNA, 159 bp, Artificial Sequence
  Description of Artificial Sequence: Synthetic coding sequence
atggacgtgaagtgccccggctgctacaagatcaccaccgtgttctcacatgcacagaccgttgtgctctgcgtggggtgctcaactgtcctctgccagcctactgggggcaaggctcgcctgacagagggatgcagttttaggcgcaaacagcactag

SEQ ID NO: 203727 - DNA, 303 bp, Artificial Sequence
  Description of Artificial Sequence: Synthetic coding sequence
atgtgccagcggtgcggcctgaagctgatcgtgatcatctgcttcttcgtccagctagcaagggatttgcttcacccttctttggaggaggagaagaaaaagcacaagaagaaaagattggtgcagagtcctaacagctacttcatggatgtgaagtgtcccggttgctacaagatcaccactgtattttcgcatgctcagacggttgttctctgtgtgggatgttcaacggtgttgtgtcagccaaccgggggtaaggcccgcctcactgaggggtgttctttcaggcgaaagcaacattag

SEQ ID NO: 203728 - DNA, 210 bp, Artificial Sequence
  Description of Artificial Sequence: Synthetic coding sequence
atggacaccagccgggtgcagcccatcaagctggcccgggtgaccaaggtactgggtcggaccggttcgcaaggccaatgcacccaggtccgggtcgaatttatggatgacaccagcaggtcaataatccggaatgtcaagggtccggtacgcgagggcgacgtgctgaccctattggaatccgaacgcgaagcccggaggctcaggtag

SEQ ID NO: 203729 - DNA, 366 bp, Artificial Sequence
  Description of Artificial Sequence: Synthetic coding sequence
atggtgcccttcaacgacctgtacagcggccccgacaccttcagcgagttcatctcagcctcacactccgccgtgccattccgggggccacccctgctcctaccccctcttcgttggggacccgtgggagcaaggggtatacacggacgccacgagccaatccaccatccacaatgtaaacgtccccgtgcgcgcggccgtagggcccacccctttggcgtgcgggccaggagcccagaggtggcgctttcgctggcggctcgatgggtcttggacgttggcttcgatcacttggctgacgggaacgggctgtcccagagcgcaccttttttctgtccaccacatgttaccgagatgcttctttag

SEQ ID NO: 203730 - DNA, 210 bp, Artificial Sequence
  Description of Artificial Sequence: Synthetic coding sequence
atggacaccagccgggtgcagcccatcaagctggcccgggtgaccaaggtcctaggacggactggaagtcaaggacagtgcacacaagtgagagtggagttcatggacgacaccagccgatccattataaggaatgtgaagggcccagtccgggagggggacgtgctcacgctcctggagagcgaacgcgaggcgcgtcggctccggtag

SEQ ID NO: 203731 - DNA, 171 bp, Artificial Sequence
  Description of Artificial Sequence: Synthetic coding sequence
atgggccaccagcagctgtactggagccacccccggaagttcggccaggggagtcggagctgtcgagtgtgttcaaatagacacggtttgataaggaaatacgggctgaatatgtgcagacaatgcttcaggcagtatgctaaagacatcggatttataaaacttgactag

SEQ ID NO: 203732 - DNA, 204 bp, Artificial Sequence
  Description of Artificial Sequence: Synthetic coding sequence
atgggccaccagcagctgtactggagccacccccggaagttcggccagggatcccggtcgtgccgagtctgttcaaataggcacggtctgataaggaaatacggactcaatatgtgtaggcagtgttttcgtcagtacgcaaaggatattgggtttatcaaaaaggacctgtcctgcctgccatggcactgcctgtggcgttag

SEQ ID NO: 203733 - DNA, 780 bp, Artificial Sequence
  Description of Artificial Sequence: Synthetic coding sequence
atggccgtgcagatcagcaagaagcggaagttcgtggccgacggcatcttcaaagctgaacttaatgagtttctcaccagggagctggccgaagatggatactcaggcgtagaggtacgagtgacaccaacaagaacggagatcatcatactcgcaactagaacacaaaatgtgttgggtgaaaaagggagacgcataagggagctgacggctgttgtacagaaaaggtttgggttcccggaaggatccgtcgagttgaaaattatggtaatggtgacaggctaccctcttctgcccctgaaactgtatgccgagaaggtggcaacccgcggcctgtgcgccattgcgcaggctgagagcctccgttacaagttactcggagggctggcagtccgcagggcctgttatggagtcctgaggttcattatggagtccggagcaaagggctgcgaggttgtcgtgagcgggaagctgcgcggacaacgggctaagtcgatgaagtttgtcgacggcttaatgatccatagcggggatccagtcaattattatgtggatactgcagttcggcatgtgctcctaaggcaaggagtcctggggatcaaggtcaagattatgctaccctgggatccaaccgggaaaatcggcccgaaaaaaccactacctgatcacgttagtatcgtggaacccaaagacgagatactgccgaccaccccgatcagcgaacagaaaggggggaagccagaacctccggccatgccacagcctgttccaacagcgtag

SEQ ID NO: 203734 - DNA, 732 bp, Artificial Sequence
  Description of Artificial Sequence: Synthetic coding sequence
atggccgtgcagatcagcaagaagcggaagttcgtggccgacggcatctttaaagccgaacttaacgaatttctcaccagggagctggccgaggatgggtactccggcgtagaagtgcgggtgactcccactagaacggagataatcattctagcgacccggacacagaacgtgctaggtgagaaaggtcgtagaatccgggaactgacggctgtagtgcaaaaaaggttcggttttcccgaaggttctgtggaactctacgcggagaaagtggccaccagggggctgtgcgcaatcgcccaggcggaaagcctacggtataaattgttaggtggactggctgtgcgccgcgcctgttacggcgtacttcgctttatcatggagtccggagctaagggctgcgaagtggtagtgtctggaaagctacgaggacaacgggctaagtccatgaagtttgtggacggtctcatgatacatagcggcgatcccgtgaattactacgtagataccgccgtgaggcacgtgcttctgcgccagggggtgctgggaataaaagtgaaaataatgctgccatgggatcctaccggaaaaataggcccaaagaaacccctacccgaccatgtctctatcgttgaacccaaggatgagattctgccaaccaccccaatctctgaacagaaaggcggcaaacctgaacccccagctatgcctcaacccgtcccgaccgcgtag

SEQ ID NO: 203735 - DNA, 732 bp, Artificial Sequence
  Description of Artificial Sequence: Synthetic coding sequence
atggccgtgcagatcagcaagaagcggaagttcgtggccgacggcatcttcaaggctgaactaaacgagttcctgactagagagctggcagaggatggttactccggcgtggaggtacgcgtgaccccaacaagaactgagattatcatcctcgccacacggacgcagaacgtattaggggagaagggacgcagaatcagggaactcactgccgtggtccaaaagaggttcgggtttcctgagggctccgtcgagctgtatgccgagaaagtcgccacccgcgggctgtgcgcaattgcccaagccgagagtttgcggtataagctactgggcgggctggcagtgaggagagcatgttacggcgttctgcggttcatcatggagtccggggccaagggctgtgaggtggttgtgtccggcaaactgagggggcagagggcaaaaagcatgaagttcgtcgacgggttaatgatccattcaggcgacccagtaaactactatgtcgataccgccgtgaggcacgtgctcctcagacagggcgtcttaggaatcaaggttaaaattatgttgccatgggatccgacgggtaaaattggcccgaaaaagccgttgcccgatcacgtcagtatcgtcgagccaaaagatgaaattctaccaaccaccccgatttccgagcagaaaggtggcaaaccagagccaccagcaatgcctcagccagtgcccacggcttag

SEQ ID NO: 203736 - DNA, 732 bp, Artificial Sequence
  Description of Artificial Sequence: Synthetic coding sequence
atggccgtgcagatcagcaagaagcggaagttcgtggccgacggcatctttaaggcagagctaaacgagtttctcacaagggaactggcggaggacggatattctggcgttgaggtcagagtcacccccacaaggacagagatcatcatcctggctactcggacccagaatgtgctcggcgagaaggggcgtagaatacgggagttaactgccgtcgtgcagaaacggttcggattcccagaaggcagtgtagagctgtacgctgaaaaggtcgcaacaagggggctctgtgccattgcgcaagctgaaagcctcaggtataagcttttaggcggcctggccgtgaggagagcgtgttacggcgtgttgagattcatcatggagtccggggcaaagggatgtgaagtggtcgtctcaggaaagctgaggggtcagcgcgctaagagcatgaagtttgtggatggcttgatgatccacagtggtgatccggttaattattacgtcgacactgccgtgaggcacgtactgttaagacagggagtgctgggtataaaggtgaaaattatgctgccctgggacccaaccggaaagataggccccaaaaaacccttgcccgaccacgtgtccatcgtggagcccaaagatgaaatactccccaccacacctatttccgaacagaaggggggcaagcctgagcccccagcaatgccgcagcccgttcctacggcctag

SEQ ID NO: 203737 - DNA, 795 bp, Artificial Sequence
  Description of Artificial Sequence: Synthetic coding sequence
atggccgtgggcaagaacaagcggctgaccaagggcggcaagaagggcgcaaagaagaaggtggtggacccctttagtaagaaagactggtatgacgtcaaggctccggctatgttcaatattcgtaatatcggcaagacactggtgactcgcacacagggaacaaaaattgcaagcgacggactcaaagggcgcgtttttgaggtctctctggcggacttgcagaacgatgaggtggccttcagaaagtttaagctcattacagaagatgtgcagggcaaaaattgtctgacaaattttcatggaatggacctgaccagggacaagatgtgcagtatggtcaaaaagtggcaaaccatgatcgaggcccacgtggatgtgaagacaacagacggctatttgttgaggctgttttgtgtaggtttcacaaagaaacggaataaccagatccggaagacaagttacgctcaacatcaacaggtccgacagattcggaaaaaaatgatggaaatcatgactcgcgaggtccagaccaacgacttgaaggaggtggtgaacaagttgatcccggactctattgggaaggatatcgaaaaagcttgccagagtatatatccccttcatgatgtcttcgtgaggaaggtgaagatgctaaaaaagccaaagtttgaactgggaaaactcatggagttacacggggagggaagcagtagcggcaaagctaccggggacgagacgggcgccaaggtggagcgcgccgacggctacgagcctcccgtccaggagtcagtttag

SEQ ID NO: 203738 - DNA, 528 bp, Artificial Sequence
  Description of Artificial Sequence: Synthetic coding sequence
atggccgtggccaagaagaaggtggtggaccccttcagcaagaaggactggtatgatgtcaaagcaccagcaatgttcaatatacggaacatcggtaaaacactggtgactagaacacaaggaaccaagatcgcatcggacgggttgaagggtcgcgtctttgaggtatccctcgccgaccttcagaacgacgaggtagcattccggaagttcaagttgatcacagaggatgtccaggggaagaattgcttgaccaacttccatggcatggatctgacaagagataaaatgtgctccatggtgaaaaagtggcagacgatgatagaggcacacgttgatgtgaaaacaaccgacggttatcttctgcgtctcttttgtgtaggatttaccaagaaacggaataaccagattagaaaaacctcctatgcccaacaccagcaagtccggcagatccgtaaaaagatgatggaaattatgacccgcgaagttcagaccaacgaccttaaggaagtagttaacaagctgtag

SEQ ID NO: 203739 - DNA, 684 bp, Artificial Sequence
  Description of Artificial Sequence: Synthetic coding sequence
atgttcaacatccggaacatcggcaagaccctggtgacccggacccagggcaccaaaatcgcttctgacggtcttaagggacgggtgttcgaagtgagccttgctgacctacaaaatgacgaggtcgcatttcgcaagtttaaattgattacggaggatgttcagggaaaaaattgccttactaacttccacggcatggacctaacacgtgacaagatgtgctctatggtgaaaaagtggcagactatgatcgaagcccatgtggatgtgaagaccacagacggttacctacttaggctgttctgcgtgggtttcactaaaaagcgtaataaccagatcaggaaaacgtcatatgcccagcatcagcaagttaggcagatacggaagaaaatgatggagatcatgacgcgagaggtgcagacaaatgacctgaaagaggttgtgaacaaactgattcctgatagtatcggcaaagacattgaaaaggcttgccagagtatctaccccctacatgacgtcttcgtgcgtaaggttaaaatgctcaaaaagcccaagttcgagcttggcaaactcatggaactgcacggggagggcagctctagtgggaaggccactggcgatgaaacaggagccaaagtagagcgagcagacggctacgaaccgccggttcaggagtccgtgtag

SEQ ID NO: 203740 - DNA, 438 bp, Artificial Sequence
  Description of Artificial Sequence: Synthetic coding sequence
atgatcgaggcccacgtggacgtgaagaccaccgacggctacctgttgcgtctgttctgcgtgggattcaccaagaagcgcaacaaccagatcagaaagactagctacgcccaacaccagcaggtccgccagatcaggaaaaagatgatggaaattatgactcgggaagtgcaaacaaacgatttaaaagaggtcgtgaacaagttgatccccgacagcataggcaaagacatcgagaaagcctgtcagtcaatttaccctctacatgacgtgtttgtcaggaaagttaagatgttgaaaaagccaaagtttgagctcgggaaactgatggaactccacggagaggggtccagctctgggaaagccaccggcgacgagacgggcgccaaggttgagcgtgccgatggatacgagccccctgttcaggagtccgtgtag

SEQ ID NO: 203741 - DNA, 684 bp, Artificial Sequence
  Description of Artificial Sequence: Synthetic coding sequence
atgttcaacatccggaacatcggcaagaccctggtgacccggacccaaggcaccaaaattgccagtgatggcttaaaaggaagggtcttcgaggtctcactcgccgatttgcagaatgatgaggtggcctttcgaaaattcaaactgataaccgaggacgtgcagggaaaaaattgcttgaccaacttccacggcatggaccttactagggataaaatgtgcagcatggtcaagaagtggcagaccatgatcgaggcacacgtggatgtgaaaacaaccgatggatacctcctgcggttattttgtgttggatttacaaaaaaaaggaataaccaaatacgtaaaaccagctatgcgcagcaccagcaggtcaggcagattagaaaaaaaatgatggagattatgacacgagaagtgcagacaaatgatcttaaggaagttgtcaacaagctgatccctgactccataggtaaagacatcgaaaaagcctgccagagcatttacccccttcacgacgtcttcgtaagaaaggtaaagatgttgaagaagcccaaatttgagttgggcaaattgatggagctgcacggtgaagggagcagttccggcaaagctactggagacgagacaggagctaaagtcgaacgcgccgacgggtatgagccaccagtgcaagagagcgtttag

SEQ ID NO: 203742 - DNA, 627 bp, Artificial Sequence
  Description of Artificial Sequence: Synthetic coding sequence
aagcggctgaccaagggcggcaagaagggcgccaagaagaaggtggtggaccccttctcaaagaaagactggtacgacgtcaaagcccctgctatgtttaacatccggaacattggcaagactctcgtgaccagaacacagggcacgaaaatcgcttctgatggcctgaaagggagggtgttcgagaccatgattgaagcacacgtcgacgtgaagacaaccgatggttacctgctgagattgttttgcgtcggctttaccaagaaacggaataaccagatccggaaaaccagttacgcacaacaccaacaagtcaggcagatccgcaagaaaatgatggagatcatgaccagagaggttcagacgaacgaccttaaggaggttgtaaataagctcatccccgactcaattgggaaggatattgagaaagcgtgtcagagcatttacccgctccacgatgtctttgtccgaaaggttaagatgctgaagaagcccaaattcgagctaggcaaactgatggagttacatggtgagggttcaagcagcggcaaggcgactggggacgagactggcgcaaaggttgagcgtgccgatggatacgagccgccagtgcaggaaagcgtatag

SEQ ID NO: 203743 - DNA, 792 bp, Artificial Sequence
  Description of Artificial Sequence: Synthetic coding sequence
atggcccggggccccaagaagcacctgaagcgggtggccgcccccaaacattggatgttggacaaactgactggcgtcttcgcacccagaccttcaacaggaccacacaaactaagagaatgcctccctctaatcatattcttgcggaataggctaaagtatgcactgactggagacgaggtgaaaaaaatttgcatgcagcggttcatcaagattgatgggaaggtgcgaaccgacatcacctacccggctggcttcatggacgtaattagcatagacaaaacaggtgagaatttcaggttaatatacgacactaaggggagatttgccgtgcatcggattacccccgaagaggctaagtataaactgtgtaaagtgcgaaaaatttttgtgggtacaaaggggatcccgcatctggttactcacgacgccagaaccatccgctatccagatcctcttatcaaagtgaatgacaccatccaaattgatttggaaacaggaaagataacagactttattaaattcgacacaggtaatttatgtatggttactggcggggccaatttgggccgcatcggagtgattacaaaccgcgaaagacaccccggtagctttgatgtcgtccacgtaaaggacgccaatggaaattctttcgccaccagactatccaatatttttgttattggtaaaggaaataaaccttggatatcgctccccagaggtaagggaatcaggctgacaatcgctgaagagagagacaagaggctcgcggccaagcaaagtagcggatag

SEQ ID NO: 203744 - DNA, 369 bp, Artificial Sequence
  Description of Artificial Sequence: Synthetic coding sequence
atggcccggggccccaagaagcacctgaagcgggtggccgcccccaagcattggatgctggacaaactgaccggagtgttcgcgccacgcccctctacagggccccacaagcttcgggagtgcctacccctcattatcttccttcgcaaccgactgaaatacgccttaacaggggacgaggtcaaaaaaatttgtatgcaacgcttcataaaaattgacggtaaggttcgtactgacataacataccccgctggctttatggacgtgattagcatcgataagacaggagaaaacttccggctgatctacgataccaagggtcggtttgccgtccaccggattacccctgaggaggctaaaccctgctag

SEQ ID NO: 203745 - DNA, 792 bp, Artificial Sequence
  Description of Artificial Sequence: Synthetic coding sequence
atggcccggggccccaagaagcacctgaagcgggtggccgcccccaagcattggatgctagataaattaacaggagtctttgcgccccgacctagcacaggcccgcacaagctgcgtgagtgtctgcccctgatagtttttctgcgcaaccgccttaaatatgcgctaaccggggacgaggtcaagaaaatatgtatgcagcggttcattaaaatagatgggaaagtgcgggttgacgttacttacccggccggatttatggacgtgatctccatagaaaagactggtgaacatttccgcctcgtgtatgataccaaaggtcgttttgccgtacatcgaattaccgtggaggaggccaagtacaaactctgtaaggtaagaaaaattacagtgggggtgaagggcatcccacacctcgtgacacacgacgcacgcaccattagatacccagatcctgtaatcaaagtgaacgacacggtccagatcgatctgggtacaggtaaaattattaattttattaagttcgacacaggaaacctgtgcatggtcataggaggggccaacctggggagagtcggtgtgataactaatcgcgagaggcaccctgggtcctttgatgtggtgcatgttaaagacgctaatggaaattcatttgctacccggctgagtaatatcttcgtcattggcaacggcaataaaccttggatctcgctcccccgtggcaaggggatcaggctgactgtggcagaggaacgggacaaacgtttagcgacgaagcagagttctgggtag

SEQ ID NO: 203746 - DNA, 789 bp, Artificial Sequence
  Description of Artificial Sequence: Synthetic coding sequence
atgctgggccggcccgccaagttcagcaaggcccggggccccaagaagcatttgaagcgggttgctgctcctaagcactggatgttagacaaactgacgggagtgtttgcaccacggccaagtacgggcccacataaattacgggaatgtttgccgcttatcgtgtttctgagaaaccgtttgaaatacgccctcactggcgacgaagttaagaagatctgtatgcagcgctttataaagatagatggtaaggtcagagtcgatgtgacataccccgccggctttatggacgtgatttccatcgagaaaaccggggagcactttagactcgtctacgataccaaaggaagattcgctgttcacagaattactgtggaggaagcaaagtacaaattgtgtaaagtcagaaaaattaccgttggggtgaagggcataccacatctagtcacgcacgacgcgcgcacaattcgctaccccgacccagtcattaaggttaacgataccgtgcaaatcgaccttgggaccggaaaaattatcaattttataaaattcgatacaggcaatctctgtatggttattgggggggctaacctgggccgtgtcggcgtcatcacaaatcgcgagaggcatcctggttcgtttgacgtggtccacgtgaaggatgccaacgggaacagcttcgcaacaagactgagtaatattttcgtgatcggaaatggtaataaaccctggattagcctgcctaggggcaagggaataaggttgacagtggcggaggagagggactag

SEQ ID NO: 203747 - DNA, 792 bp, Artificial Sequence
  Description of Artificial Sequence: Synthetic coding sequence
atggcccggggccccaagaagcacctgaagcgggtggccgcccccaagcattggatgctggataagctgactggggtgttcgcgccaagaccttctactgggcctcacaagctcagagaatgcctacccctgattgtgttcttaagaaataggctgaagtacgcgttaacaggcgatgaagttaaaaagatatgcatgcagcactttctgaagatcgacggcaaggtcagggtagatatcacctacccagcagggtttatcgatgtgatcagcattgaaaaaaccggggagcactttcgcctcgtgtacaataccaaggggtgctttgccgtgcaccgtattactgtggaagaggctaagtataaactgtgcaaggtgcgcaaaattaccgttggaacgaagggcataccgcacctcgtgactcatgacgctagaaccatacgatatcctgatcctctcatcaaagtcaatgacacagtacagattgatttaggaactggaaagattaccagcttcatcaaattcgataccggaaacgtctgtatggtcattgctggcgccaacctgggaagagtgggcgtcattaccaaccgagagagacaccctggatcttgcgacgtggttcatgtcaaggacgcaaatgggaatagctttgcgacaaggatcagcaatattttcgttattggcaatgggaacaagccctggatctcattgcctcgggggaaaggaataagattgaccatcgctgaagagagggacaagcggttggccgctaagcagtcttcagggtag

SEQ ID NO: 203748 - DNA, 615 bp, Artificial Sequence
  Description of Artificial Sequence: Synthetic coding sequence
atgaccgagtgggagaccgccgcccccgccgtggccgagacccccgatattaaactgttcggcaagtggagtaccgatgacgtgcagatcaacgacatcagtttgcaagattacatcgccgtgaaagagaaatatgcaaagtacctcccacacagcgccggccggtatgctgccaagcgcttccgcaaagcgcaatgccctatcgtcgaaaggctcactaatagcatgatgatgcacggcaggaataacggaaagaagctcatgaccgtacgcatcgtcaagcatgccttcgaaatcatacatctgttgactggagagaacccattgcaggtgctggtgaacgcaatcatcaactcaggccctcgggaagactcaacaaggataggccgtgctggtaccgttcgacggcaagctgtggacgtcagtcccctacgaagagttaaccaggcgatctggctcttatgcacaggcgctcgagaggccgctttccgcaatattaagaccattgctgagtgtctggccgacgagctaattaacgcggccaagggttcatctaactcatacgccattaagaagaaagatgagttagagcgggtcgccaagtcgaaccgctag

SEQ ID NO: 203749 - DNA, 615 bp, Artificial Sequence
  Description of Artificial Sequence: Synthetic coding sequence
atgaccgagtgggagaccgccgcccccgccgtggccgagacccccgatatcaaacttttcggaaagtggtcaaccgatgacgtccagataaacgacatatcactacaggattacatagcagtaaaggagaagtatgctaagtacctacctcacagcgccgggcggtatgccgcaaagaggttcaggaaggctcagtgtccgatcgtcgagcgcttgactaactcaatgatgatgcacggcaggaacaacggtaagaaactaatgacagtgaggatagtcaaacacgcatttgagataattcaccttctcaccggcgaaaatccgctccaggtcctcgtcaatgctatcatcaactctggcccccgcgaagatagtactcggatcggccgagctggtaccgttcggcgccaggccgtggacgtatcccccctccgccgagtaaatcaggctatttggttactctgcacgggcgctcgcgaggccgcctttcggaacattaagaccattgctgagtgcctggccgacgaactcattaacgccgctaaaggctcttccaacagctatgccattaagaagaaagacgagctggaaagagtagctaagagcaacaggtag

SEQ ID NO: 203750 - DNA, 657 bp, Artificial Sequence
  Description of Artificial Sequence: Synthetic coding sequence
atggccaccgaggtggccgccgacgccctgggcgaggagtggaagggctacgttgtgcgtatatccggcggcaacgataagcagggattccctatgaagcagggtgttctgactcacggaagagtgcgacttttactgtctaagggccatagctgttacagacccaggaggacgggagagaggaagcggaagtccgtgagagggtgcattgtggacgcaaacctgtcagtgctgaatctggtgattgtgaagaagggtgaaaaggatatccccggactcaccgacaccaccgtgcccaggcgactgggaccgaagcgggcgagccggatacggaaactgttcaacctcagcaaggaggacgacgtgcgccagtatgtcgtccgcaaaccgcttaataaggaagggaaaaaaccccggacaaaggctcctaagattcagcgtctcgtgacccccagggtgctccagcataagcgccgccggatcgctctcaaaaagcaacgaactaagaaaaacaaggaagaggcagctgaatatgcaaagctcctcgccaagcgtatgaaggaggccaaggaaaagagacaggagcagattgcaaaaaggaggagattatcaagtttaagggcttcaacctcaaagagtgagagttcgcagaagtag

SEQ ID NO: 203751 - DNA, 276 bp, Artificial Sequence
  Description of Artificial Sequence: Synthetic coding sequence
atgaagctgaacatcagcttccccgccaccggctgccagaagctgatcgaggtggatgacgagaggaagctgcgcacattttacgagaagcgtatggccacggaggtcgcggcggatgcactgggcgaagaatggaaagtgaaagtcgacaaactgttgcaagtcttcaagtccgaaaccgtcaacgccatcggcaactggtacttggagtggggttccgattccggtttctggttgcttacatttggcaaactgctccctaatgctaccctctag

SEQ ID NO: 203752 - DNA, 657 bp, Artificial Sequence
  Description of Artificial Sequence: Synthetic coding sequence
atggccaccgaggtggccgccgacgccctgggcgaggagtggaagggatatgtggtgcgcatatccggtggtaacgataagcaggggtttccgatgaaacagggcgttctgacccacggacgcgtgagactgctcttgagcaagggccattcttgttatcgaccgcgcaggaccggagagcggaagcggaagtccgtgcgcggctgtatagttgacgctaatctgagcgtcttgaacctagtaatcgttaaaaaaggagagaaggatatccccgggctgaccgacacaaccgtaccacgtcggctggggccgaaacgtgcctcacgcattcgaaagttgttcaatctgagcaaggaggacgatgtgcggcagtatgtcgtgaggaagcccctgaacaaagaagggaaaaagccaagaacaaaggcaccgaagattcagcgtctggttacccccagagtgttgcaacacaagcggcgccggattgctctgaagaaacagagaaccaaaaagaataaggaggaggccgctgagtacgccaaacttcttgcaaaaaggatgaaggaagccaaggaaaagaggcaggagcagattgccaagaggaggcgactctcctcgctcagggcttcgacaagcaaatcagagagcagccagaaatag

SEQ ID NO: 203753 - DNA, 750 bp, Artificial Sequence
  Description of Artificial Sequence: Synthetic coding sequence
atgaagctgaacatcagcttccccgccaccggctgccagaagctgattgaggtggatgacgaacgcaaactgaggaccttctatgagaaacgcatggccaccgaggtcgcagctgacgccctgggtgaagagtggaaaggctatgtggtacgaatttctggcggcaatgacaaacaaggtttccctatgaagcagggggtcttgacacacggcagagtccggcttctgctgagcaagggccacagttgctaccggccacggcggactggcgagcggaagagaaagagtgtccgcgggtgtatcgtggacgccaacctgtctgtgctcaatttagtcatcgtaaaaaaaggggagaaggacatacctggattgaccgacactaccgtgccaagaagacttggacccaaacgcgcctcccggatacgcaagctgtttaatctgagtaaggaggatgatgtaaggcagtacgtggtgagaaaacccctgaacaaagaggggaaaaaacccaggaccaaagcccctaagatccagagacttgttacgcctcgggttcttcagcacaagagacgaaggattgccctgaagaagcagcgtaccaagaagaacaaagaggaagccgccgagtacgccaagcttctcgccaagcggatgaaagaggccaaagaaaaaaggcaggagcagattgctaagcgacgcaggctgtctagtctgagggctagcaccagcaagtcagaaagcagtcaaaagtag

SEQ ID NO: 203754 - DNA, 585 bp, Artificial Sequence
  Description of Artificial Sequence: Synthetic coding sequence
atgttcagcagcagcgccaagatcgtgaagcccaacggcgagaagccagatgaattcgaaagcggcatctcacaggccctgctagagttggagatgaatagtgacctgaaggcccagttgagggaactgaacatcactgcagcaaaggagattgaggtgggcggcgggcgtaaagctattataattttcgttcctgtgcctcagctgaagtcctttcagaaaattcaagtgcggctggttcgggagctcgaaaaaaaattctcgggtaaacacgtggtgttcatcgctcagcgcaggatactgcccaagccaacacggaagagtcgaaccaagaacaaacagaaaaggccccggagccggacactaacggctgtccatgatgccatcctcgaggatctcgtcttccctagtgagattgtggggaaaaggatccgtgttaagcttgacggcagcaggttgatcaaagtccatctggataaagcacagcagaataacgtggagcataaggttgagactttcagcggcgtgtacaaaaagctaactggtaaagacgttaatttcgagtttccagagttccagctctag

SEQ ID NO: 203755 - DNA, 585 bp, Artificial Sequence
  Description of Artificial Sequence: Synthetic coding sequence
atgttcagcagcagcgccaagatcgtgaagcccaacggcgagaagcccgatgagtttgagagtggcattagtcaggctttgctggaactcgagatgaactcggaccttaaggctcagctgcgcgagttaaatataaccgctgccaaggaaattgaggtgggaggaggaaggaaggctatcatcattttcgttcccgtgccacagctgaaatcatttcagaaaattcaggtgagactcgtgcgggagttggagaaaaaattttcaggaaaacatgtcgtgtttatcgcccagcgaaggatcctgcccaagcccaccagaaaatccagaactaagaacaaacagaaaagacctaggagtcgcaccctcactgccgtacacgatgcgatccttgaggacttggtgttccctagcgaaattgtagggaagcgcatcagagtcaaattggacggcagtagacttatcaaagtgcacctggacaaggcacagcagaataacgtggagcataaggtggagacattctcgggggtgtataaaaagttaaccgggaaagacgttaactttgagtttccagagttccagctgtag

SEQ ID NO: 203756 - DNA, 585 bp, Artificial Sequence
  Description of Artificial Sequence: Synthetic coding sequence
atgttcagcagcagcgccaagatcgtgaagcccaacggcgagaagcctgatgaatttgaatctggcatttcacaggccctgctcgagttggaaatgaactccgatttaaaggcccaactgagggagcttaacatcaccgctgcgaaggaaatcgaagtgggaggcggccggaaagccattatcatcttcgtgccggtgccacagttgaaatcttttcagaaaatacaggtgcgtctggtgagggaattagagaaaaaattttcaggaaagcacgtcgtttttatcgcccagcggcggattctcccgaagcctacaagaaaaagccgtaccaagaacaagcagaaaagacctaggagtcggaccctgactgccgttcatgacgccattcttgaagatctggtgttcccaagtgagatcgttggaaagaggatcagagtgaagctggatgggtctaggctgatcaaagtgcatcttgataaggcacagcagaacaacgtggaacacaaggttgaaactttttctggggtgtataagaagcttactggaaaggacgttaacttcgagttccctgaattccagctttag

SEQ ID NO: 203757 - DNA, 567 bp, Artificial Sequence
  Description of Artificial Sequence: Synthetic coding sequence
atgggcatcagccgggacaactggcacaagcggcggaagaccggcggaaagagaaagccataccacaagaagcgcaagtacgagttgggaaggcccgctgctaacactaagataggtcctaggcgaatacataccgtgcgtgtacggggagggtgcacaagaaagacacggattatcgacgttgtctacaacgcctccaataacgaattggtcaggaccaagactcttgtcaagaattgtatcgtgctcattgacagcactccctaccgacagtggtatgagagtcactatgccctgccacttgggagaaaaaagggtgcaaagcttacaccggaggaggaagaaattctcaacaagaagcgcagcaagaagatccagaagaaatacgacgaacgcaagaagaacgctaagatcagctccttgctagaagagcagtttcaacagggtaaactgctggcgtgcattgcctctcgccctggacagtgcgggagggccgacggttatgtgctagaaggaaaggagctggagttttatctgcgcaagatcaaagcacggaaggggaaatag

SEQ ID NO: 203758 - DNA, 627 bp, Artificial Sequence
  Description of Artificial Sequence: Synthetic coding sequence
atgggcatcagccgggacaactggcacaagcggcggaagaccggcggcaaacgcaagccctatcacaagaagagaaagtacgaactgggccggccagccgcaaataccaagattggcccaagacgtatccatactgtgagggttagaggcggcaacaaaaaatatcgcgcattgcgcctggatgtgggaaatttctcttggggcagcgagtgctgcacccgcaagacacggataatcgacgttgtttacaatgcttcgaacaatgaattagtgcggaccaaaacattggtgaagaactgcattgtgctgatcgacagcacgccttatcggcagtggtatgagtcccattatgccctccctctgggccgaaaaaaaggcgcaaagctcaccccagaagaggaggagattctcaataagaagagaagcaagaaaattcagaagaaatatgatgagagaaagaaaaatgcaaaaattagcagtctgctggaggagcagttccagcagggaaagctgttagcatgcatagccagccgccccgggcagtgcggccgagccgatggatacgtgctcgagggcaaggagctcgagttttacctcaggaagatcaaagcccgtaagggaaagtag

SEQ ID NO: 203759 - DNA, 585 bp, Artificial Sequence
  Description of Artificial Sequence: Synthetic coding sequence
atgcccgtggcccggagctgggtgtgccggaagacctacgtgaccccacgccggccttttgagaagtccagactggaccaggaattaaagctcattggggaatatggactcaggaataaaagggaggtgtggcgggtgaagtttactcttgccaagattcggaaggcagcgcgggagctgctgactctagacgaaaaagaccctcgcaggctattcgagggtaatgcgctcctccgcaggctggtccgtatcggagtattagatgagggcaagatgaaactcgattatatattgggactcaaaatcgaggatttcctagagcgccgcctgcaaacacaggtgttcaaactcggactggccaagtccattcaccacgctagggtactcatccgtcagcgacatatcagggtgaggaaacaggtggtgaacatcccttcattcatagtccggcttgactcacagaagcacatcgatttttcgctccggtccccgtatgggggtggcaggcctggtagggtgaagcgaaaaaatgccaagaaaggacagggaggcgccggggctggagatgatgaggaggaagactag

SEQ ID NO: 203760 - DNA, 585 bp, Artificial Sequence
  Description of Artificial Sequence: Synthetic coding sequence
atgcccgtggcccggagctgggtgtgccggaagacctacgtgaccccacgacggccctttgagaagtcccgactggatcaggaattgaaactcataggtgagtatggcctgagaaacaagagggaggtctggagagtcaaattcacattggctaaaattcgcaaagcagcccgcgagttactgaccctggacgagaaagatcctcggcgcctgttcgagggaaatgcactcctgcgcagactggtgcggatcggagttctagatgaaggcaagatgaagctcgattacatcctcggcctcaagatcgaggactttttagagcggcgtctccaaacccaggtcttcaagctcggacttgctaaaagcatccatcatgcaagggtgctgatacgtcagagacacatcagagtgcgcaagcaagtcgtaaacatacccagtttcatagtccgcctcgactcgcagaagcatatcgattttagcttgaggtccccctacggaggaggcagaccgggaagagtcaagcggaaaaatgcgaagaagggtcagggaggagcaggcgccggtgatgacgaagaggaagactag

SEQ ID NO: 203761 - DNA, 585 bp, Artificial Sequence
  Description of Artificial Sequence: Synthetic coding sequence
atgcccgtggcccggagctgggtgtgccggaagacctacgtgaccccaagacgaccctttgaaaaatcacgcctggatcaggagcttaaactcatcggggaatacggtctccggaataagagggaagtttggagggtgaaattcacacttgctaaaatcagaaaagctgccagggaactactgaccctggatgagaaggatccccgccggctcttcgagggaaacgcactgttgagacgccttgtgcgaattggcgtcctggacgagggaaagatgaaacttgactacatcctaggcttgaagattgaggatttccttgaacggcgcctccagacccaggtattcaagctaggccttgcaaaatccattcatcatgctagagtcctgatacgccagcgacacataagagtacggaagcaggttgtcaacataccctcctttatcgtcagactggacagccagaagcacattgacttttctctccgctcaccctacggcgggggcagacctggtagggtgaagagaaaaaacgccaagaagggacaaggcggtgcaggggccggagacgacgaggaggaggattag

SEQ ID NO: 203762 - DNA, 420 bp, Artificial Sequence
  Description of Artificial Sequence: Synthetic coding sequence
atgcccgtggcccggagctgggtgtgccggaagacctacgtgacccctagacgaccctttgaaaagtctagactcgaccaggaactcaagctcattggggagtacgggctgaggaataagagagaggtttggcgcgttaaatttaccctggccaaaatcaggaaagccgctagggaacttctaacgttagacgagaaagatccacggcggctatttgaagggaatgccctcctgaggcgtcttgtgcggattggcgtccttgacgaggggaaaatgaaactggattacatactaggtctcaaaattgaagatttcctggaacggaggctgcagacacaggtgtttaagcttggtctggcaaagtccatacaccacgctagagttctcatccggcagcgacatattagccctcggagatag

SEQ ID NO: 203763 - DNA, 420 bp, Artificial Sequence
  Description of Artificial Sequence: Synthetic coding sequence
atgcccgtggcccggagctgggtgtgccggaagacctacgtgaccccacgtcgcccgttcgagaagtctagattggatcaggagctgaaactgatcggtgagtacgggttgagaaacaagagagaggtgtggcgcgtgaagtttaccctggcaaaaatcaggaaggctgccagggaattgctcacattagatgagaaggatccgaggaggctatttgaaggtaatgcactgctgaggagactcgttagaatcggagtgttagacgaaggcaagatgaaacttgactatattctggggcttaagatagaggattttcttgagcgacggttgcagacgcaagttttcaaactgggattggccaagtccatacaccatgctcgcgttttgatacgccagcgacacatctcccctcgtcggtag

SEQ ID NO: 203764 - DNA, 471 bp, Artificial Sequence
  Description of Artificial Sequence: Synthetic coding sequence
atgcccgtggcccggagctgggtgtgccggaagacctacgtgaccccccggaggccattcgagaagagcaggctagaccaggagctcaagttaatcggcgagtacgggttgcggaacaagcgtgaggtctggcgagtgaaattcaccctggccaagattaggaaggccgccagggaattactgaccctggatgagaaggaccctcgcaggttatttgagggtaacgccctcctgcgtagacttgtgaggatcggagtgctagatgagggtaaaatgaaattagactatattctcggcctgaagattgaggacttccttgagcgccgcctccagacgcaagtcttcaaactcggtctcgctaagagcatccaccatgccagggttctgatcagacagcgtcacattcggtaccacctcggttgggctccagaatccagtagcacatgcccaagtgatgggtgcccacactag

SEQ ID NO: 203765 - DNA, 420 bp, Artificial Sequence
  Description of Artificial Sequence: Synthetic coding sequence
atgcccgtggcccggagctgggtgtgccggaagacctacgtgaccccccggcgaccttttgagaaatcaaggctggatcaggagttgaagttgatcggtgagtatggcctcagaaacaaacgcgaggtttggcgtgtcaaatttacgctcgccaagataaggaaagccgcacgagaactgctcacattggatgaaaaggatccacggcgcctgttcgaggggaatgccttgctgcggcggctggtgcggatcggcgtgttagatgagggcaaaatgaagctggactatatactcggtctcaaaatagaagatttcctggagcgacgcctgcagacccaggtgttcaagctgggcttggcaaagtcaatccaccatgcacgcgttctgattcgccagcgccacatttccccacggaggtag

SEQ ID NO: 203766 - DNA, 2844 bp, Artificial Sequence
  Description of Artificial Sequence: Synthetic coding sequence
atggccacccgggtgcggaccgccagcatctgggtgccccccctgcaggagaggaactcctcgtgggataggattaggaagttacaaggacaggagagcatcctgggtcagggcacgccaggcctgcaacctctccccggaacacccaggcaaaagcagaaatctcggaggatcgagaaggtactggagtggctatttattagtcaggagcagccgaaaattacaaaatcctggggccctctgtcatttatggacgtcttcgtggactttacctgggaagagtggcaactgctggatccagcacagaagtgtctgtatcgttcggttatgctcgagaactactctaacttggtgtcactaggttaccagcacacaaagcccgacataatctttaaactggaacaaggagaggagctatgtatggtgcaggcccaggtgccgaaccagacatgtccaaacactgtgtggaagatcgatgacctaatggactggcatcaggaaaacaaagacaagctggggagtactgctaaatctttcgagtgtacaaccttcgggaaactctgcctcctgagcaccaaatacctctctcgtcagaagccccacaagtgcggaacccatggcaaaagtctcaaatacatagatttcacttccgattacgccagaaataacccgaatggctttcaggtccacggaaaatctttttttcacagtaagcacgagcaaaccgtgattggcatcaaatactgcgagtcaatcgaaagcgggaagaccgtgaacaagaagtcacagcttatgtgtcagcagatgtatatgggagaaaaaccctttggctgttcatgttgcgaaaaagcatttagttccaagagctacttgctcgttcaccagcagacacacgccgaggagaaaccttacggctgtaatgagtgtggcaaagacttctctagtaaaagttatttgatcgttcatcaaaggattcacactggagagaagctccatgagtgctctgagtgccgcaaaactttcagctttcattcgcagctagtgatacaccagagaatccacacaggggaaaacccctacgagtgttgtgaatgtggtaaagtttttagccggaaagaccagttggtgtcccaccaaaaaacccacagcgggcagaagccctacgtgtgtaacgagtgtggaaaggccttcggcctaaagagtcagctgataattcatgagaggatacacactggggagaaaccttatgagtgcaacgagtgtcaaaaagcgtttaataccaagtctaacctgatggtgcaccagcgcacccatacaggcgaaaagccctacgtctgtagcgattgcggcaaggcttttacttttaagtctcagttgatcgtccatcaggggatacacaccggcgtgaagccgtatggctgcatccagtgtggaaaaggttttagcctcaagtctcaattaatcgtccaccagagatcacatacagggatgaaaccatacgtatgcaacgagtgtggcaaggcctttcggagtaagagctacttgatcatccatacccggacgcacactggcgagaaactgcacgaatgtaacaactgcgggaaggcatttagctttaaatctcagttaattatacaccagcgaatccataccggagagaatccgtacgagtgtcacgagtgcgggaaggccttctctaggaaatatcagttaatcagccatcagcgtactcacgcaggcgaaaagccttacgagtgtactgactgcggaaaggcttttggcttgaaaagtcagttgattatccaccagcgcacccataccggcgagaagcctttcgaatgtagcgaatgccaaaaggcttttaacacgaaaagtaacctcattgtccatcagcgtacacacactggcgaaaagccttactcgtgcaacgagtgtggcaaggctttcacattcaaaagccaactcatcgttcacaaaggggtgcacaccggtgttaaaccatacggatgcagccagtgtgccaaaactttctcacttaaatcacaactgattgtacaccaacgaagccatactggggtcaaaccctatggctgcagtgaatgtggcaaggcttttcgctctaaatcttacctgatcattcacatgcgcacacacacgggagaaaagccccatgagtgtcgggagtgcggtaagtcctttagcttcaattcgcaactgatcgtccatcaacgcattcacacgggcgaaaacccatacgaatgctccgagtgcggcaaggcgtttaaccgcaaagatcagctcatctcacatcagaggactcacgccggagagaaaccctacggctgctctgagtgcggcaaagcctttagctcaaagagctatctgatcattcatatgagaacccatagcggagagaaaccctatgagtgcaatgaatgtggcaaagcctttatttggaagtccctgctgattgtccacgagcgcacccacgccggagtaaatccctataagtgttcccagtgcgagaaatcattctcaggaaagctaaggctgctggtgcatcagaggatgcatacacgcgagaaaccgtatgaatgcagtgaatgcggcaaagctttcatccgaaattcccaactgatcgtccaccagcgtacacactcaggggaaaaaccttacggctgtaacgagtgcggaaagactttctcacaaaaaagtatactttcagcgcaccaacgcacacatacgggggagaagccctgtaagtgtactgaatgcggaaaggccttctgctggaagagccagttaattatgcaccaaagaacacacgtggatgacaaacattag

SEQ ID NO: 203767 - DNA, 768 bp, Artificial Sequence
  Description of Artificial Sequence: Synthetic coding sequence
atgccccgggaggaccgggccacctggaagagcaactacttcctgaagataatacagcttctggatgactaccctaagtgcttcatcgtcggcgcagacaatgtaggctcaaaacagatgcagcagattcgaatgagcttgagaggaaaggccgtagttttgatggggaaaaacacaatgatgcgcaaagccatacgcggacacctagagaacaaccccgcactcgagaaactgctgccacacatccggggtaatgtgggctttgtgtttacaaaggaggatctgaccgagatccgggacatgctgctcgctaataaggtgcctgctgccgctagagctggggccatcgcgccctgcgaggtcaccgtgccagcccaaaacactggcctgggccctgagaagacatcatttttccaggcgttgggcattaccactaagatctccaggggcaccatcgaaattttgggcgtgcgcaacgtggctagtgtatgcctccagatcgggtacccgacagtggcctcagtcccgcatagtatcatcaacggctataagcgggttttggctttgtccgtggaaacagactatacattcccacttgcagagaaggtcaaggcctttttagctgaccccagcgctttcgttgcagctgctcccgtcgctgctgcaactactgcagcacccgcggcagctgcagcaccagccaaagtggaagccaaggaggagtctgaggaatcagacgaagatatggggttcggcttgttcgactag

SEQ ID NO: 203768 - DNA, 954 bp, Artificial Sequence
  Description of Artificial Sequence: Synthetic coding sequence
atgccccgggaggaccgggccacctggaagagcaactacttcctgaagatcatccagctgttggacgattaccctaagtgcttcatcgtcggcgcggacaatgtggggtcaaagcagatgcaacagatcaggatgtctttacgtggcaaagccgtggtgttgatgggtaagaacaccatgatgaggaaagctattagagggcatctcgagaataacccggcgctggaaaagctgctccctcacattcgtggtaacgtaggctttgtcttcacgaaggaagacctaaccgagatccgggacatgctgttggcgaataaggtacctgcagccgctagggcgggcgcaatcgccccctgcgaggtgacggtgccagcacagaacactgggctcggaccggagaagacatcctttttccaggccttggggatcacaaccaaaatttcccgtggaaccatcgaaatcctcagcgatgtacagttgatcaaaaccggcgacaaagtgggggcttcagaggcaacacttttgaacatgctgaacatctctcccttttcgttcggcctcgttatccaacaggtattcgataacggcagtatttataaccctgaggtgctagatatcacagaggagacactgcactcaaggttcctggagggcgtcagaaatgttgcctctgtgtgcctgcagattggctaccccaccgtggcctcagtgcctcactcgatcattaatggttacaaaagagtgctcgctttatcagtcgaaacggactacacctttcccctggccgagaaagtgaaggctttccttgcagatccttccgcttttgtagctgccgcgccggtagccgccgccacaactgctgctccagccgctgccgctgcccctgcgaaggtagaagctaaggaggaatctgaagagtccgatgaggacatgggattcggcctctttgattag

SEQ ID NO: 203769 - DNA, 954 bp, Artificial Sequence
  Description of Artificial Sequence: Synthetic coding sequence
atgccccgggaggaccgggccacctggaagagcaactacttcctgaagatcattcaactactggacgactatccaaagtgttttatcgtgggggccgacaatgtagggtccaagcagatgcaacaaatccgaatgagcttgcgtggcaaggctgtggtcctgatgggaaaaaacaccatgatgcggaaggcgatccgaggccaccttgaaaataatccagcactggaaaaactgctgcctcatatccgagggaatgtcggcttcgtctttacaaaggaggatttgacggagatccgggacatgcttctggcgaacaaagtgcccgccgctgctcgggctggggccattgcaccctgtgaagttactgtgcccgcccagaatacgggacttggccccgaaaaaacgagtttctttcaagcccttgggataactacaaaaattagcagggggaccatcgagattctgtccgatgtacagcttatcaagaccggcgataaggtcggcgcttctgaagctacactgttgaatatgctgaacattagtcccttctctttcgggcttgttatccaacaggtttttgataacggttctatatataatcccgaagtactggatattaccgaggagacacttcactccagattcctggaaggcgtgaggaatgtggccagcgtctgtctacagatcggataccctacagtagctagtgtgccccattctattataaacggctacaagcgtgtcctagccttatccgtggagaccgattatacctttcctctcgcagaaaaggtcaaggctttccttgccgacccctcggccttcgtggcggctgccccagttgccgcagccactactgccgcccccgcagccgctgcagctcccgcgaaggttgaggccaaagaggaaagcgaagagtccgatgaggacatggggttcggtctgttcgactag

SEQ ID NO: 203770 - DNA, 345 bp, Artificial Sequence
  Description of Artificial Sequence: Synthetic coding sequence
atggccagcgtgagcgagctggcctgcatctacagcgccctgatcctccacgacgatgaggttactgtgactgaagataagatcaacgctttgataaaagccgcaggggttaatgttgaaccattttggccaggcctgttcgccaaggccttggcaaatgtgaatataggcagtctgatttgcaacgtcggcgctggcggaccagctcctgccgctggtgcagcgcccgcaggggggcccgcaccatccacagccgcggcaccagcagaggagaaaaaagtcgaagcaaagaaggaggagagcgaagagtctgacgacgatatgggttttgggctcttcgattag

SEQ ID NO: 203771 - DNA, 270 bp, Artificial Sequence
  Description of Artificial Sequence: Synthetic coding sequence
atggccagcgtgagcgagctggcctgcatctacagcgccctgatccttcacgacgacgaggtcacggtgaccgctttggccaatgttaatatcggttccttgatatgcaacgtcggcgcaggaggtccggccccggctgctggagccgctccagctgggggacccgctcctagcacggccgcggcaccggccgaagaaaaaaaagtggaagctaagaaagaagagtccgaggagagcgacgatgatatggggttcgggttattcgactag

SEQ ID NO: 203772 - DNA, 2277 bp, Artificial Sequence
  Description of Artificial Sequence: Synthetic coding sequence
atggcccccgccatgcagcccgccgagatccagttcgcccagcggctggccagctcagagaagggcatacgagaccgagcggttaagaagctgcgacagtacatcagcgtgaagacacaacgcgagactggaggcttctcccaggaagaactcctgaagatctggaagggtctgttctactgtatgtgggtacaagacgaacccctgctccaagaagaactggccaatacgatcgcccaactggtgcatgccgtgaacaattctgcagctcagcacctgttcatacagaccttttggcagaccatgaatcgtgagtggaagggcatcgaccggctgcgcttggataaatactatatgctgatcaggctggtgcttagacagtcatttgaggtgctgaaacgcaatggctgggaggaaagccgtatcaaggtctttctggacgttctgatgaaggaggtgctctgccccgaatcgcagagccccaatggggttcggttccactttattgacatataccttgatgagttgtcaaaggttggcggtaaggaactgctggccgaccagaacttaaaatttattgatccattttgtaagatagctgccaaaacaaaagaccacactcttgtacagacgattgcccgcggtgtgttcgaggccatcgtggatcagtcccccttcgtgcccgaggagactatggaagagcagaagaccaaggtgggcgatggtgatctgtctgcagaggaaattccagagaatgaggtgagccttcgaagggcggtctccaagaaaaaaacagctttaggcaagaatcactcgcgtaaagacggtctgagcgatgaacgggggagagacgactgcggtacattcgaggatactgggcctctactgcagtttgattacaaggctgtggccgaccggctgctcgagatgacttcaagaaagaacaccccgcacttcaatcgcaagcggctgagcaaactgatcaagaagttccaagacctgtctgagggatcctccatttctcagcttagcttcgcagaagacatttccgcggatgaagatgaccagatcctttcccaaggtaaacacaagaagaaggggaacaagcttctcgaaaagacgaatttagaaaaggagaaggggagccgcgtcttttgtgtggaagaggaagattcagagtcaagcctgcagaaacgacggaggaagaagaaaaagaaacatcaccttcaaccggaaaaccctggaccaggaggcgccgctccgtctttggaacagaaccggggaagagagccagaggcctccggactcaaggccttaaaggcccgtgttgcagaacccggcgccgaagcgacctcctccaccggggaggagtccggatctgaacatccccccgcggtacctatgcacaataaacggaagagacctaggaaaaagagtccacgcgcacaccgggaaatgctggagtccgctgtcctgccaccggaagatatgagtcaatccggtccttccggttcacaccctcagggtcctaggggaagtcccactgggggcgcgcagctgctgaagcgcaaaaggaagctcggggtagtgcctgtgaacggatcaggccttagcacccctgcatggcctcctcttcagcaggaaggcccccctacaggaccagctgaaggggcgaattcccacacaacactcccccaaagacggcggctgcagaaaaaaaaagctgggcctggaagcctggagctgtgcggcctgccttcccagaagacagctagtttgaagaagagaaagaagatgcgggttatgagcaacctagtggaacacaatggcgtgctagagagcgaggccggtcaaccccaggccctgggcagttccggtacgtgcagcagcttaaagaagcagaagctgcgagccgagtccgattttgtcaaatttgacactccattccttcccaagcccctgttctttcgacgcgccaaatcaagcaccgctacacatcccccaggtcctgcagtgcagctgaataagaccccaagctcgagcaagaaggtcacgttcggactcaatagaaatatgaccgccgagttcaaaaaaacggacaaatccatcttggtttccccgacgggaccatcaagggtggcattcgacccagagcagaagcccctgcatggggttctcaagacacccacttcatcccccgcctcgtcgccccttgttgccaaaaaacctctcacaacaactccaaggcgccggcccagggccatggactttttttag

SEQ ID NO: 203773 - DNA, 780 bp, Artificial Sequence
  Description of Artificial Sequence: Synthetic coding sequence
atgcccggcgccaactaccgggccggcgccggcgccggcgccggcgcccggcgaccacgcggagcgcgcgatagagaagaggacggaggtggcctggaacctgcagccgttgctcgcgatctgttaaggggcacatccaacatgtcattcgaggaactgctcgagctgcagtctcaggtaggtactaagacctacaaacagcttgtggcaggcaactcaccaaaaaagcaggcttctagacctccgatccagaatgcctgcgtcgccgacaagcatagaccgttggaaatgtcagccaagatcagggtccctttcttacgccaagtcgttcccatttcaaaaaaggtggcaagggatccacggttcgatgatctcagtggggaatacaaccctgaggtgtttgataaaacctatcagtttctgaatgacatccgtgcaaaagaaaaggaactggtcaaaaagcagctgaaaaagcacctgtcaggcgaggaacatgaaaagttacagcagttgctgcagcggatggagcagcaagagatggcacagcaagagcggaaacagcagcaggagctacatttagctttgaaacaagagcgacgcgcccaggcccagcagggccatagaccttacttccttaaaaaatcagagcagcgccagctagctctggcagagaaatttaaagagttaaaaagatcaaagaagctggaaaattttctgagtagaaagcgtcggcgcaacgctggaaaagatcggcggcatctgcccctgagcaaagaatag

SEQ ID NO: 203774 - DNA, 4233 bp, Artificial Sequence
  Description of Artificial Sequence: Synthetic coding sequence
atggacatctacgacacccagaccctgggcgtggtggtgttcggcggattcatggtcgtgtccgccataggcattttcctcgtgagcactttctccatgaaggagacgtcttatgaagaggccctcgccaatcagcgtaaggaaatggcaaagacacatcaccagaaggtagagaaaaagaaaaaagaaaagactgtcgagaagaagggtaaaactaaaaagaaagaagaaaaacctaatggaaaaatacctgatcacgacccagcccctaatgtaacggtattgctgagggagccagtgcgagctcctgcagtggccgtagccccgacccccgttcaaccccctattatcgtggcaccggtggccaccgtacctgcaatgcctcaggagaaactggctagctctcctaaagacaagaaaaaaaaagagaagaaggttgccaaggtagaaccggctgtgtcgtcagtagtaaattctatccaagtgctgacttccaaggccgccattttagaaactgcccctaaggaagtcccaatggtagtggtgccccccgtgggagccaagggaaatactcctgctacaggaactactcagggaaaaaaggccgagggaactcagaaccagtcgaagaaagccgagggcgctccaaatcagggtagaaaggctgagggcacccccaatcagggcaagaagacggaaggaacacctaaccaaggcaagaaagccgagggcaccccgaaccagggaaagaaagctgagggaaccccgaaccagggcaagaaggcggagggcgcccagaatcagggaaagaaggttgacaccactccaaatcagggtaagaaagtggaaggggcacctacacagggcagaaaagcagaaggcgcccagaatcaggccaagaaagttgagggcgcccagaatcaagggaaaaaggccgagggcgcacagaaccaaggaaaaaaaggcgagggtgcccagaatcagggtaaaaaggctgagggcgcccagaaccaagggaagaaggcggagggcgcccagaaccagggtaaaaaagccgaaggcgcccagaatcaaggcaagaaagccgagggtgcacagaaccagggcaaaaaggccgaaggcgctcaaaaccaaggcaagaaaagcgaaggcgcacagaaccagggtaagaaagtggagggagcccagaaccagggtaaaaaagccgaaggagcccaaaatcagggtaagaaagctgaaggcgctcagaatcagggcaaaaaagccgagggggcccagaatcaggggaaaaaagctgaaggggcgcaaaatcagggaaaaaaagccgagggcgcccagaaccagggaaagaaggcagagggtgcacagaatcagggcaagaaggctgaaggagcacagaaccagggtaagaaagtggaaggagctcagaaccaggggaagaaagccgaaggggcacagaaccaaggaaagaaagccgaaggggcccaaaaccagggaaagaaggccgagggtgcgcagaaccagggccagaagggcgagggtgcccagaaccagggtaaaaagaccgagggcgctcagggaaagaaggccgaacgttcccccaaccaaggcaagaaaggggaaggtgcccctattcaggggaaaaaggccgattcggttgcgaatcaaggtacaaaagtcgagggaatcaccaatcaggggaagaaggcggagggatcgccaagcgaaggcaaaaaggccgagggctctccaaatcaggggaagaaagcagacgctgcggctaaccagggaaaaaaaacagaatctgcttcggtccaaggtagaaatacggacgttgcccagagccccgaggcccccaagcaggaggctcctgctaagaaaaagtctggatctaaaaagaaaggcgaaccggggccgcccgatgccgacggtccactctaccttccatacaagacgttggtgtccaccgtgggaagcatggtgtttaatgaaggagaagcccagcgcctcatcgaaatactgtctgagaaagcaggcatcatacaagacacttggcacaaggccacccagaagggtgaccctgtagccatcctgaagcggcagttagaggagaaagagaagcttctggcgacggagcaggaagatgcagctgtggctaagtctaaactccgcgaactgaacaaggaaatggcagccgaaaaagccaaggctgccgcaggcgaagcaaaagttaagaaacagctcgtggctagggagcaggagataactgccgtgcaggcccggatgcaggcctcctatcgagagcatgtcaaggaggtgcagcaactgcagggtaagattaggactcttcaggaacaactggagaatggacccaatacccagctggcccgactccaacaggaaaattctattcttcgggacgccttgaatcaggcaacatctcaggtcgaatccaagcagaatgcagaactagccaagctccgtcaggagttatctaaggtatcgaaggaactggttgaaaagtccgaggcggtccggcaggacgagcagcaaaggaaagcgctcgaggctaaggccgccgctttcgaaaagcaagttctacagctgcaggcttcacaccgagaatccgaagaggccctgcagaaacgtctggacgaagtgagcagggaactctgtcatactcagtcatcacatgccagcctccgggctgacgccgaaaaggcccaggaacagcagcagcaaatggcggagctgcactccaaactgcagtctagtgaagctgaagtcagatctaaatgcgaggagctttcagggctccatggtcagctgcaggaggcccgggccgagaactctcagcttacagagcgcatccgcagtatcgaagcactcctggaggccggccaggcccgggacgcccaggacgtacaagccagtcaagcagaagcagatcagcagcagacccgactgaaagaactggaatcccaagtaagcggcctagagaaggaagccattgaactgcgcgaggctgtggagcagcagaaagtcaagaataatgatcttcgggagaagaactggaaggcgatggaggcattggctactgctgaacaggcttgtaaggaaaagctcctgagcctcacacaggctaaggaggagtccgaaaagcaactctgcttgatcgaggcacaaactatggaggccctgctggctcttctgccagagctttccgtcttggcccagcagaattacacagaatggctacaggatttaaaggaaaagggacccactcttctcaagcatcctcctgctcccgctgagccgtcatctgatttagcctccaaactgcgagaagccgaggagacccagtctacactgcaggccgagtgcgaccagtataggagcattctggccgagactgaggggatgctgagggacctccagaagtcagtggaagaggaagagcaggtttggagagctaaggtgggtgccgctgaggaggagctacagaagagtcgggtgaccgttaaacatcttgaggagatcgtggagaagctgaaaggggagctggaaagttctgatcaggtcagggagcacacatcacacttggaagcagaacttgagaagcacatggccgctgcttctgcagaatgccagaactacgcaaaagaagttgctgggctgagacagcttctcttggaatcccagagtcagctcgacgcggccaaaagcgaagcccagaagcagtccgacgaactagctctggtgcgtcagcagctgtcagagatgaagtcccacgtggaggacggtgatatagcgggcgctccggcctcttcccccgaagctcctcctgccgaacaggaccctgtgcaactcaagactcagctggaatggacggaagcaattttggaagatgagcaaacccagagacagaaacttacggcggagttcgaggaggcacagactagcgcctgccggcttcaggaagagctggagaagctccgcactgctggacctttagaaagctccgaaacagaggaggcctcccaactgaaggagcgtctggagaaagagaaaaagctcacatctgatctcgggagagccgccacacgcctgcaggagcttcttaagaccactcaagagcagttagctcgagagaaagatacagtgaagaagttacaggaacagcttgagaaggctgaggatggatcttcttccaaggaagggacttctgtttag

SEQ ID NO: 203775 - DNA, 2934 bp, Artificial Sequence
  Description of Artificial Sequence: Synthetic coding sequence
atggacatctacgacacccagaccctgggcgtggtggtgttcggcggcttcatggttgtaagcgcaatcgggatctttctggtttccaccttcagcatgaaggagaccagctacgaggaggcactggccaaccagcggaaagagatggctaagacccaccatcaaaaggtcgagaagaaaaagaaagagaagaccgttgagaagaagggaaaaacgaagaaaaaagaggaaaaaccaaacgggaagatacccgatcacgacccggcgccgaatgtgactgtgctgctccgcgaacccgtgcgcgccccagccgtcgccgtggctccaactccagttcaaccccccatcatagtcgcccccgtggccacagtgccggcgatgcctcaggaaaaactcgcatctagcccaaaggacaaaaagaaaaaagaaaaaaaggtggccaaggtagagcctgctgtctctagcgtggtaaatagcattcaggtcctcacctcgaaagccgccatcctggagactgccccaaaggagggaaggaatacagacgtggcgcaatcacctgaagcgccaaagcaagaggctcccgctaaaaaaaagtcgggcagtaagaaaaaagggccacctgatgctgacgggccattgtatcttccttataagactctggtttctacagtggggtctatggtcttcaacgagggcgaggcgcagagactgatcgaaatcttgagtgagaaggcaggtataattcaggatacatggcacaaggcaacccagaagggggatcccgtggcaatcttaaaacgccagcttgaggagaaggagaagctcctggctacagagcaagaggatgccgccgttgctaagtccaaacttagggaattaaacaaggagatggcagctgaaaaagctaaggcagccgccggtgaagcgaaggtgaagaaacaactggttgcccgcgagcaagagatcaccgctgtccaggccaggatgcaggccagctacagggagcatgtaaaagaggtgcagcagttgcaaggaaagattagaacactccaagaacagctggagaacgggcccaacacacagctggcgcggttgcagcaagaaaacagcattctgcgcgatgcattgaaccaggctaccagccaggtggagtctaaacagaacgccgagcttgcaaaactcagacaggagttatctaaagtaagcaaagaactggtcgagaaatccgaagctgttcggcaggatgagcagcagcggaaagctctcgaggccaaggccgctgccttcgaaaaacaggtcctgcagctacaggcttcacaccgagagagcgaggaggcactacagaagcgcctcgacgaggtgagcagagagctgtgccatacgcagagctcccatgccagcctcagggccgatgcagagaaggcacaagaacaacagcagcagatggcagaattgcacagtaaactgcagtcctctgaggcagaggtccgctctaagtgcgaagaattgagtggactgcacggccagcttcaggaagcacgcgcagaaaattctcaacttactgaaagaattaggagcattgaggcgctgctcgaagcaggacaggcccgcgacgctcaggacgtccaggcctctcaggccgaggcagaccagcagcagacaagattaaaagagttagaatcccaggtttccgggctggagaaggaagctattgagctgcgggaggctgtggaacaacaaaaggtgaaaaacaacgatttaagagagaaaaattggaaggctatggaggcattagctacagccgaacaggcctgcaaagaaaaactcctaagcctgacacaggccaaagaggagagcgaaaagcaactgtgtctgatcgaggctcagaccatggaagccttactagcactccttcctgaactctccgttcttgctcagcagaactacactgagtggctccaggatctgaaagagaaggggccaacgctattgaagcaccccccagcacctgccgaacctagtagcgaccttgccagcaaactccgtgaagctgaagagacccagtcgactcttcaggcggagtgtgaccagtatcggtctatactcgcagagactgagggaatgctccgtgaccttcagaaatcggtggaagaagaagaacaggtttggcgggcgaaagtcggagcagctgaggaagagctgcagaaatcgagagtaaccgtgaagcacctggaagagattgtggagaagctgaagggcgaattggaaagtagtgaccaggtgcgcgagcacacctcccatttggaggccgagttggagaagcacatggctgctgcttccgctgagtgccaaaactatgccaaagaggtcgccgggctccgacaactgctgctggagagccagtcccaactggacgctgccaaatctgaggcccagaagcagtcagacgaattggccctggtgcgacagcaactgagtgagatgaagtcccatgtcgaggatggcgatatcgccggggctccagcctccagccctgaagcccctccagccgagcaggatccagtacaactgaaaacccagttagagtggaccgaagcaatcttggaggatgagcaaacccagaggcagaagttgacggcagaatttgaagaagcccagacttccgcttgccgtttgcaagaagaactggagaagctgcgcacggccggtcccttagagtcgtccgagactgaggaagcgtctcagcttaaggagagactggaaaaagagaagaaactgacaagcgaccttggtcgcgccgctacaagattgcaggaactgctgaaaacgacccaggaacagctggctcgggaaaaagacaccgtgaagaagctgcaggagcaactggagaaagcagaagacggcagctcttcaaaagaaggcaccagcgtatag

SEQ ID NO: 203776 - DNA, 2934 bp, Artificial Sequence
  Description of Artificial Sequence: Synthetic coding sequence
atggacatctacgacacccagaccctgggcgtggtggtgttcggcggctttatggtggtgtctgccatcggaatctttctcgtgagcactttctctatgaaggagacgagctacgaagaggccttagccaaccagagaaaggagatggccaaaacgcatcaccagaaggtcgaaaagaaaaaaaaggaaaagacggtggagaagaagggcaagactaagaaaaaggaggagaagcctaatggtaaaatccctgatcatgatcccgctcccaacgtgactgtgctccttcgtgagcccgtgcgcgctcctgcagtggccgtagcccctacaccagtccagccgccaattatcgtggcaccagttgccactgtacctgccatgccacaggagaagctcgccagtagcccgaaagataagaaaaagaaggagaagaaggtcgcaaaggttgaacctgccgtctctagtgtcgtgaacagcattcaagtcttgacttcgaaagctgcaatactggaaaccgcgcccaaagaaggtcgcaacacggacgtcgcccagagtcccgaggcccctaagcaggaagcccctgccaaaaagaaatctggtagtaagaaaaagggtcccccagacgcggacggaccactgtacttgccctacaagacgctagtgagcactgtgggatctatggtgttcaacgagggagaggctcagagattaatcgaaatcctttctgagaaggccgggatcatacaggacacgtggcacaaagcaacccaaaaaggtgatccagtcgccatcttaaagcgccaactggaggagaaagagaagcttctggccactgagcaggaggacgccgcagtggctaaaagcaagctaagagagttaaataaagaaatggctgctgaaaaggccaaagcagcagcaggtgaagctaaggtgaagaaacagctggtcgcaagggaacaagagatcaccgctgttcaggcccgcatgcaggccagctaccgcgaacatgtgaaagaagtccagcagctgcagggaaaaatccgaactctgcaggaacagctcgaaaatggtcccaacactcaactggccagactgcagcaggaaaactctatcctccgtgacgcgctcaatcaggccacttctcaggtcgagtccaagcagaatgccgagctggcaaaactgcgccaggaattgagcaaggtgtctaaggagctggtcgagaagtcagaagctgtgcgccaagacgagcaacaaaggaaggccctcgaggccaaggcagcagcattcgagaagcaggtcttacagcttcaggcctcacaccgggaatcagaggaagccctgcagaaacgtttggatgaggtttccagagagctgtgccatacccagtcaagccacgcttcgttgcgggctgacgcagagaaagcccaggaacagcagcagcagatggcagaactacatagcaagttgcagagctccgaagcagaagtcaggagcaaatgtgaagaactgtccggtcttcatggtcaactgcaggaagcccgagcagagaattcacaactgaccgaacggatcaggtcaattgaggcgcttttggaggccggccaggcgagggatgcgcaggatgtgcaggccagtcaggcagaggctgatcagcagcagacccgtctgaaagaacttgagtcacaggtctccggtctggagaaagaagccattgagctgagagaggctgtggaacaacaaaaggtgaaaaataatgacttgcgggagaagaactggaaggcgatggaagcacttgccaccgccgagcaggcctgcaaagagaagttgctgtccctcacacaggcaaaggaagaaagcgaaaagcagctatgcctgatcgaggcccagacaatggaagctctactcgctctcctgcccgagctcagcgtgttggcccagcagaattataccgagtggctccaggatctgaaagagaaaggaccaactctgctcaaacacccgccggcgccagcagaaccatcgagcgacctcgcatccaagctgcgggaggcggaggagactcagtccacactgcaggctgagtgtgatcagtaccgatccatattagccgagaccgagggaatgctcagggacctgcagaagtcagtcgaggaagaggagcaagtttggcgcgccaaagtgggagccgccgaggaggaactacagaaatccagggtcaccgtgaaacatttggaagagatcgtcgaaaaactaaagggagagttggagtcatcagaccaagtcagagagcacaccagccacctcgaagccgagctcgagaaacacatggccgcagccagcgccgagtgtcagaactacgccaaagaggtcgccggattgcgacagttacttctggaaagccagtcacagttggacgccgctaagagcgaggcccaaaaacagtcagatgagttagctctcgtcagacagcagctgtccgaaatgaaaagtcacgtcgaggacggcgacatcgctggcgcgccagcctcttccccggaagcccctccagccgaacaggatccagtccagctgaaaacgcaactggagtggacagaagccatcctcgaagacgagcaaacccagcgccagaagctgaccgccgagtttgaggaagctcagacatctgcctgcaggttgcaagaggaactcgaaaagttacgcacggcagggccgctcgagtcatcagaaactgaagaagcctcccagttgaaggaacgcctcgaaaaagaaaaaaagctgaccagcgacctgggtcgcgccgcaacgcgactccaagaactgctgaagactacccaggagcaactggcacgagaaaaggataccgtcaaaaagttgcaggaacagctggagaaggcggaggatggaagcagcagtaaagaaggcacgagcgtgtag

SEQ ID NO: 203777 - DNA, 4233 bp, Artificial Sequence
  Description of Artificial Sequence: Synthetic coding sequence
atggacatctacgacacccagaccctgggcgtggtggtgttcggcggctttatggtggtgtcagcaatagggatctttctggtcagcacttttagtatgaaggaaacaagctacgaggaagccctcgccaaccagaggaaagagatggctaagacgcatcaccagaaggtcgagaaaaagaaaaaggaaaagacggtcgaaaagaagggcaagacaaaaaaaaaggaggagaaacccaacggaaagatcccggaccatgacccagcccccaacgtgaccgtgctgctgcgagaaccagtgagagcgcccgctgtggccgtggctccaactcccgtccagccacccatcatcgttgctccagttgccaccgtaccggcaatgccccaggagaagttggcctctagccctaaggacaagaaaaagaaagaaaagaaagtggccaaggtggaacctgccgtttcttctgtggtgaacagcatacaggtgctaacctccaaagccgccattcttgagacggcacctaaagaagtgcccatggtggttgtcccacccgtcggtgccaaaggcaatacccctgcgactggcactacccagggcaagaaagcagaagggactcagaatcagtccaagaaagccgaaggggcgccaaatcaggggaggaaggcagagggtactccaaatcagggaaagaaaacagaggggactccaaaccaaggaaagaaggccgagggcacacctaaccagggaaaaaaagccgaaggtacccctaaccaaggtaagaaggctgagggtgcacagaaccaaggaaaaaaggtcgatacaacgcccaatcagggcaaaaaagtcgaaggagcccccacccaggggcgcaaggctgagggggcacaaaatcaggccaagaaggtcgaaggcgctcagaatcagggcaaaaaagctgagggcgctcaaaaccaaggcaaaaaaggagagggcgcgcagaatcaggggaagaaggccgagggcgcgcagaatcagggcaaaaaggccgaaggggcacaaaatcaggggaagaaagcggagggtgcacagaaccagggcaagaaggcggagggggcccagaaccaaggaaagaaagccgagggcgctcaaaaccagggcaagaaaagcgaaggggcacagaatcaagggaaaaaagtcgaaggagcccagaaccagggcaagaaagccgagggggcacagaaccaggggaagaaggcagagggggctcagaaccagggtaaaaaggctgagggcgcccagaaccaggggaagaaggccgagggggcacagaatcagggaaagaaggccgaaggagcccaaaatcaaggtaagaaggccgaaggcgcccagaatcaaggcaaaaaggctgagggcgctcaaaatcagggtaaaaaggtagaaggagcgcagaaccagggaaagaaagccgagggcgcacagaaccaaggcaagaaagcagaaggagctcaaaaccaggggaagaaggcagagggtgcgcaaaaccaaggccagaagggtgaaggggcccaaaaccagggaaagaagacggagggtgctcagggcaagaaagctgagcgtagccctaaccagggtaagaaaggtgagggtgctcccatccagggaaagaaagctgactctgtggccaatcaaggtaccaaggtggagggaatcacaaatcaggggaaaaaggccgaaggatccccaagtgaggggaagaaagcggagggctcgcccaatcagggcaaaaaagcagatgcggctgcaaatcaggggaagaagactgagagcgcctcagttcagggcaggaatacagatgtggcgcagtcgcctgaggcccctaagcaagaagcccctgccaaaaagaagtctggcagcaagaagaaaggggaacctgggccccccgacgcagacggcccactctacctcccatacaagacactggtatctaccgtcggtagcatggtgttcaatgaaggcgaggcacagcgcctcatcgaaatcttgagtgagaaagccggaatcatccaagacacatggcacaaggccactcagaagggggacccagtggccatcttaaaaaggcagttagaagagaaggagaaactgctcgccacggagcaggaggacgctgccgtggcaaaatcgaagctgcgcgagcttaataaagaaatggccgcggaaaaggctaaggcggcggcaggcgaagctaaggtaaagaaacagctggtggcccgtgaacaggaaattacggccgtccaagcccgcatgcaggcttcctatagagagcatgtgaaggaggtgcagcagttgcagggcaagatccggactctgcaagagcagctggagaacgggcccaacacacagctggctcggttgcaacaagagaattctatactgcgcgacgccctgaaccaggccacctcccaggtggaatcaaagcagaacgcggaacttgccaaacttagacaggagctgtcgaaggtgtcgaaagaactcgtcgaaaaatccgaggctgttaggcaggatgagcagcagaggaaagccctcgaggcaaaagcggcggccttcgaaaaacaggtgcttcaactccaggcatcccaccgtgagagcgaggaagccttgcagaagcgcttggatgaggttagccgagagctctgtcatacacaatcaagtcacgcgtctttacgcgccgacgccgaaaaggcacaagaacagcaacagcagatggccgaactccactccaagctgcagtcttccgaggccgaagtgagatcaaaatgtgaagaactgtcggggctgcacgggcagctgcaagaggcgagagccgagaactctcagctgaccgagcgaatccgctcaatcgaggccctgttggaagcagggcaagctcgggatgcgcaggatgttcaggctagtcaagcggaggctgatcaacagcagactagactcaaagaactggagtcccaggtttctggactagaaaaggaggcgatcgagctcagggaggccgttgagcaacagaaggtgaaaaacaacgatcttagggaaaaaaattggaaagccatggaggcgttagctacagctgaacaggcatgtaaagagaagcttctgagtctcacccaggctaaggaagaaagcgaaaagcagctgtgcttgatagaggcccaaacgatggaggctctgctggcgctgcttcccgaactctcggtgctcgcccaacaaaactacacagagtggctgcaggatttgaaagaaaagggacctactctcctcaaacacccaccagctccggctgagccttcttcagatttggcctctaaattaagggaagctgaggaaacgcagtctacgctgcaggccgaatgcgatcagtacagaagtatcctcgccgagacggagggaatgcttcgggacctgcagaagagtgttgaggaagaggaacaagtgtggcgtgccaaggtgggagccgctgaggaagagctgcagaagtcacgggtgactgtgaagcatctggaggagatcgtggaaaaactgaagggcgagttggagagctcagaccaggtcagggagcatacctctcacctcgaggctgagctggaaaagcatatggccgctgcaagcgcagagtgtcagaattatgcaaaagaggtggctgggcttagacagctcctgctagaaagccagagtcaattggatgcagccaagtcagaagctcagaaacaaagtgacgagctggctctcgttagacagcaactgtccgaaatgaaatcacatgttgaagacggggacatcgccggggcacctgctagcagccccgaggctcccccagccgagcaggacccagttcaactgaagactcagctagaatggaccgaagctattttggaagatgagcagacacagagacagaagcttacagcggagtttgaagaagctcagacaagcgcatgccgattacaagaagaacttgaaaagttgcggactgcgggccctctggaaagcagcgagacggaagaagcctcgcaactgaaagagaggctcgaaaaagaaaaaaagctgacctcagacctgggccgggccgccacacgtctccaagagctgctgaaaactacacaagaacagcttgcacgggagaaggacaccgtaaagaagctgcaggaacaactggagaaggccgaagatggttcctcctcgaaagagggaactagcgtgtag

SEQ ID NO: 203778 - DNA, 903 bp, Artificial Sequence
  Description of Artificial Sequence: Synthetic coding sequence
atggacatctacgacacccagaccctgggcgtggtggtgttcggcggattcatggtggtttccgccataggcatctttttggtgtcaaccttttcaatgaaggagacttcttatgaggaggcccttgccaatcagaggaaagagatggctaaaacacatcatcaaaaggtagagaaaaaaaagaaagagaaaactgtcgaaaaaaaaggcaagacgaagaagaaggaggaaaagcctaacgggaagattcccgaccacgacccggcaccaaatgttacagttctcctccgcgagccagtgcgggctcctgccgtggctgtcgccccaacaccggtacaacctcctatcatagtggcccctgtagccaccgtccctgccatgccccaagaaaagttggctagttctcccaaagataagaaaaagaaggaaaagaaagtggccaaggtcgaaccagctgttagcagtgtcgtgaacagtatccaggtcctgaccagtaaagccgcaattctggaaactgcgcccaaggaagtcccgatggtggtggtgccccccgtgggagccaagggcaatactcctgccaccggaacaacccaggggaagaaggccgaggggacacaaaaccagagcaagaaagccgaaggggcacctaaccagggtagaaaagctgaaggcactcctaaccaggggaagaaaaccgaaggcactccaaaccaagggaagaaggcggaaggcacaccgaatcagggcaaaaaggcagaaggcacgccaaaccagggcaaaaaggctgaaggcgctcagaaccaaggaaagaaggtggacactaccccgaatcagggcaaaaaagtggaaggcgctcctacccagggacgcaaagcggagggcgctcaaaatcaggccaagtag

SEQ ID NO: 203779 - DNA, 2256 bp, Artificial Sequence
  Description of Artificial Sequence: Synthetic coding sequence
atggtgttcaacgagggcgaggcccagcggctgatcgagatcctgtctgagaaggcgggaattattcaggatacttggcataaggcaactcagaaaggcgatcctgttgccatactgaagagacaactggaagagaaggagaagctattagccacagagcaagaagatgccgctgtagcaaagagtaaacttagagaactcaacaaggaaatggctgccgagaaagccaaggcagctgcgggggaagctaaggtgaaaaagcagctagtggccagagagcaagaaataaccgctgtacaggcgaggatgcaggcatcctaccgcgaacatgttaaggaggtacagcagttacagggcaagatccgcacactccaggaacagctagagaatggccccaacacgcagctggccaggctgcaacaggagaatagcatcctgagagatgccctaaatcaggcaacctctcaggtggagtccaaacagaatgcagagctggccaaactgaggcaggagctttcaaaagttagcaaagagctggtcgaaaagagcgaagccgtgcgccaggatgagcagcagaggaaggctttggaggcgaaagcagcggcctttgagaaacaagttctccagctccaggcaagccacagagagtcagaagaagccctgcaaaagcggttagatgaagtctcacgcgagctttgtcacacccagtccagtcatgcatccctccgcgcagacgccgagaaagcccaggaacagcagcagcaaatggccgaactccattcaaagctccagagctcagaagccgaagtgcgctccaagtgtgaggaattgagcgggctgcatggacagctgcaggaagcgcgggccgagaactcacagttgacagagcggattcgttctatcgaggctttgctggaggcaggccaagctagagatgcgcaggacgtgcaggcctctcaggccgaagccgatcagcagcagactaggctgaaggagctggaatcgcaagtgtcgggtctggagaaagaagcgattgagctcagagaggccgtcgaacaacagaaggtcaagaacaacgacttgagggagaagaactggaaagctatggaagctctcgctacggctgagcaggcctgcaaggagaagctgctgagtctaacccaagctaaagaagaaagtgagaagcaactttgcctgattgaagctcagactatggaagctctactggcactactgcctgagctgagcgttttggcccaacagaattataccgagtggctgcaggacctaaaagagaagggtcccaccctgcttaagcatccacctgcgcctgcggaaccgtcgagtgacctggccagtaagctaagagaggccgaggagactcagtctacacttcaggccgagtgcgatcaatacagatcaatactggccgagaccgaagggatgctccgcgacctgcagaaatccgtggaagaggaagagcaggtttggcgtgccaaggtgggagccgcagaagaggaactacaaaagtccagagtgacggtgaaacacctcgaagagatcgtggaaaaacttaaaggtgaactggaatctagcgaccaggtgagggaacataccagtcatctagaagccgagttggaaaagcatatggccgcagccagcgccgagtgccagaactacgctaaggaagtggcaggcctccggcagctgctattggagagtcagagccagcttgacgctgctaagagcgaggctcagaagcaatctgacgaactggctctggtgaggcagcaacttagcgagatgaagtcccacgtcgaggacggagacatcgcgggggccccagcctcaagccctgaagcaccacccgcagagcaggatcctgttcaactgaagactcagctggaatggacagaagctatcctggaagatgagcagacacaacgccagaagctgactgccgagttcgaggaggcacagacatctgcctgccggttacaggaagagctggaaaagcttcgtaccgcaggaccccttgaaagctctgagacggaagaggcaagccagctgaaggagcggctcgaaaaggagaagaagttgacctccgaccttgggagagccgcaacaaggctccaggaactgttaaagacaactcaagagcagttagctagggagaaagatacagtgaagaagctgcaggagcagctggaaaaggccgaagacgggtccagttctaaggagggaacatcagtttag

SEQ ID NO: 203780 - DNA, 663 bp, Artificial Sequence
  Description of Artificial Sequence: Synthetic coding sequence
atggccagcggctgcaagatcggccccagcatcctgaacagcgacttagccaacctgggcgcagagtgtctgcgaatgctcgattccggagctgactatctacatctcgacgttatggatggatacatgcacatgatggtctctaagcccgaacaatgggtgaaaccaatggccgttgcaggggccaatcagtacacattccacttggaggcaacagagaacccaggagccctgattaaagatattcgcgaaaatgggatgaagtcctgcagcgttactcaggctgaggtacaatggcactcccagggacccctgcaagtcggtctcgccatcaaacctggaactagcgtggaatacctagccccctgggctaatcagatagacatggcgctagttatgactgtagagcctggattcggaggccagaaatttatggaagacatgatgcccaaggtacactggctgcgcactcaatttcccagcctcgatattgaggtcgacggcggggtggggcccgacaccgtgcataagtgcgctgaagccggagccaacatgatcgtgagcgggagcgccatcatgcgatctgaggaccctaggtccgttatcaacttgttacgaaatgtctgtagcgaagcagcccagaaaaggtctctcgaccggtag

SEQ ID NO: 203781 - DNA, 687 bp, Artificial Sequence
  Description of Artificial Sequence: Synthetic coding sequence
atggccagcggctgcaagatcggccccagcatcctgaacagcgacctggccaacttaggtgcagagtgcctccgcatgcttgactcaggggccgactaccttcacctcgacgtcatggatggccatttcgttcccaatatcaccttcggccaccccgtcgtcgagtctttacggaaacagttgggccaagatccattctttgatatgcacatgatggtgagtaagcctgagcagtgggtgaaaccaatggccgtcgcgggggccaaccagtacacatttcacctcgaggccactgagaatcctggcgccctcattaaagacatcagggagaacggcatgaaagttggattagccatcaaaccggggacttctgtcgagtacctcgcaccctgggcgaatcagatagatatggccctggtgatgacggttgagcctggctttgggggccagaagttcatggaagacatgatgcctaaggtgcactggctgaggactcagttcccatctttggacatagaggtcgacggtggggtgggcccagatacagtgcataaatgtgccgaggccggcgctaatatgatagtcagcggcagtgctatcatgcggtcagaagaccccagaagcgtgatcaacctcctaaggaacgtgtgctctgaagccgcccaaaagcggtcccttgatcgatag

SEQ ID NO: 203782 - DNA, 537 bp, Artificial Sequence
  Description of Artificial Sequence: Synthetic coding sequence
atgcacatgatggtgagcaagcccgagcagtgggtgaagcccatggcagtcgcaggagcaaaccagtatacgtttcatctggaagccacagaaaatcccggcgctctgatcaaggacatccgcgagaacggcatgaaatcttgcagtgtgactcaggccgaagtccagtggcacagtcaaggccccctgcaggtgggactggccatcaagcccggtacctctgtagaatacctagcaccctgggctaaccagatcgatatggcgctggtgatgaccgtcgagcctgggttcggtggccagaaattcatggaagatatgatgcctaaagttcattggttaagaacacagtttccatctctagacatcgaggttgacggaggcgtggggcctgacacagtgcacaagtgtgctgaagcgggagcgaatatgatcgtgagcgggagcgccatcatgaggagcgaagatccccggtccgttattaacctgcttcgaaacgtctgttcagaagctgctcagaaacggtccttagataggtag

SEQ ID NO: 203783 - DNA, 537 bp, Artificial Sequence
  Description of Artificial Sequence: Synthetic coding sequence
atgcacatgatggtgagcaagcccgagcagtgggtgaagcccatggccgtcgcaggcgcaaatcaatatacctttcacctggaggccacagaaaatcctggtgcactaatcaaggacatccgagaaaatggtatgaagtcctgcagtgtcacgcaagctgaagtgcagtggcactcccagggtcctcttcaggttggactcgcaataaaacctggaacctcggtggaatatttggcgccatgggccaaccagatcgacatggctttagttatgactgttgagccaggtttcggaggtcagaagtttatggaagatatgatgcctaaagttcactggctgaggacacagttcccttcactagatatcgaggtagatgggggagtcggccctgatactgtgcacaagtgcgctgaggctggggccaatatgatagtgtccgggagtgctatcatgagaagcgaggaccctaggtccgtgatcaacctgttgcgcaatgtatgttccgaggcggcacagaaacggtctttggaccgatag

SEQ ID NO: 203784 - DNA, 285 bp, Artificial Sequence
  Description of Artificial Sequence: Synthetic coding sequence
atgcacatgatggtgagcaagcccgagcagtgggtgaagcccatggcggtggccggggctaaccagtatacctttcacttggaagccaccgaaaaccctggcgctttgattaaagacataagggaaaatgggatgaagtcatgttctgttactcaggcagaagtgcagtggcacagtcagggacctcttcaggtaggactggccatcaaaccaggcaccagtgtggagtacctcgctccttgggcgaaccagattgatatggcccttgttatgactgttgagtag

SEQ ID NO: 203785 - DNA, 537 bp, Artificial Sequence
  Description of Artificial Sequence: Synthetic coding sequence
atgcacatgatggtgagcaagcccgagcagtgggtgaagcccatggcggtggctggtgcgaaccaatataccttccatctcgaagctaccgagaaccccggagcactgattaaggacattagagaaaacggaatgaagtcctgctccgtgactcaggcagaggttcaatggcactcccaaggacctctgcaggtcggcctggcaattaagcccggaacgtctgttgagtaccttgctccctgggctaaccagattgacatggcactggtaatgactgttgaaccaggctttggcggccaaaagtttatggaggacatgatgccgaaagtccactggttgaggactcagttcccatctctggacatcgaagttgatgggggggtcggccccgacaccgtccataagtgtgcagaggccggagctaatatgattgtgtcgggtagtgcaattatgagatcagaggatccccgcagtgtgatcaatttgctgcgcaatgtctgctcagaagcagcacagaaaaggtccctcgatcgctag

SEQ ID NO: 203786 - DNA, 600 bp, Artificial Sequence
  Description of Artificial Sequence: Synthetic coding sequence
atggccagcggctgcaagatcggccccagcatcctgaacagcgacctggccaacctgggggccgaatgcttaaggatgctcgactcaggagccgactacctccatctggatgtgatggatggtcactttgtccctaatatcactttcggtcatcccgtagttgagtctctgcgcaagcagttgggacaggacccctttttcgacatgcacatgatggtttctaagccagagcaatgggtaaaaccgatggccgtagcaggtgcaaatcagtataccttccacctggaggcaaccgagaaccccggtgcccttattaaagatattagagagaacggcatgaaagtggggctcgccatcaagcctggtaccagcgtggaatacctggctccatgggcaaaccagattgacatggctctggtgatgactgtcgaacctggatttggcggccagaagtttatggaagatatgatgcctaaggctggggctaatatgatagtctccggatcagcgatcatgcggtctgaagaccctagaagtgtgatcaatcttctgcgaaacgtctgttcggaggctgcccaaaagagatccctggatcgttag

SEQ ID NO: 203787 - DNA, 3159 bp, Artificial Sequence
  Description of Artificial Sequence: Synthetic coding sequence
atgcgggaggccgccgagcggcggcagcagctgcagctggagcacgaccaggcccttgccgtgctctcagcaaagcagcaagagatcgatcttctgcaaaagtctaaagtgcgggagctggaggaaaagtgtcgtacccagtcagagcagtttaatttgctgtccagagacctcgaaaaattcagacaacatgccggaaagatagacctactgggaggcagtgccgtggcccccttggatatttctacagctccatctaaacccttcccacagttcatgaatggattagccacaagccttggcaaaggacaggagtccgccattggtggctctagcgctatcggagagtatatccgacccctgccccagccaggggaccggcctgagccgctttccgccaagcccacttttctgtcaagatcaggctctgctcgatgccggtcagagagcgatatggaaaacgaaaggaactcgaatacatcaaaacagagatattccggaaaggtgcatttgtgtgtggctcgctacagttacaacccgttcgatggtcctaatgagaaccccgaagccgaactgccactgactgctggaaagtatttgtacgtttacggggacatggacgaagatggcttttatgagggggagcttctggacggtcaacgcggactagtgccctctaacttcgtggattttgtgcaggataacgaatctagactggcgagtactcttggcaacgaacaggaccaaaatttcattaatcactccggcattggacttgagggggagcacatacttgacctgcattcaccaacacacatagacgccggtattaccgataactctgccgggacgctggatgtcaatatcgatgacataggagaggacattgtgccatatccacggaagatcacactgatcaagcagttagccaagtcagttattgtgggctgggagcctcccgccgttccaccaggttggggcaccgtgtcctcctacaatgtgttagtggataaagagactcggatgaatctaaccctcggtagccgcaccaaagctctgatagagaagctcaacatggccgcttgcacatatagaatttcggttcaatgcgtgacctctcggggctcgagtgacgagctccagtgcacactgcttgttggcaaggacgtcgtggtggcaccgtcccatctccgggtggacaatatcactcaaatttcagctcaactgtcatggctgccaactaattccaactattcccacgtaatttttttaaacgaagaagagttcgacatcgtgaaggccgcacgttacaagtaccagttctttaatctgcgacctaatatggcctacaaggtcaaagttcttgcaaagccacaccagatgccatggcagctaccgttagagcagcgggagaagaaagaagcattcgttgaattctccacactccctgcagggccacccgcccctccccaggacgtaacagtccaggccggggttactccagccacaatcagagtgtcctggcggcctcccgtcttgacccctaccggactgagtaacggcgctaatgttacagggtacggcgtctacgccaaaggccaacgggtggccgaagtgattttcccaactgccgactcaactgccgtcgagttggttcggctacgaagtctcgaagccaagggtgtgaccgtcaggacccttagtgctcagggggaaagcgttgattcagccgtggcagccgttcccccagagctgttagtaccccccactccacacccccggccggcgccccagtctaagccactggcaagcagcggagtgcccgaaaccaaagacgaacacctaggaccccatgccaggatggacgaggcatgggagcaatcaagggctcccggacctgtgcatgggcatatgctcgagccaccagtcggtcctggtcgtcggagccccagtcccagcaggattctgccccagccgcagggcactccagtcagcactacagtcgcaaaagccatggccagggaggccgcacagagggtcgctgagtccagtagactggagaagcggagcgtgttcttggaaaggtcgagcgccgggcagtacgccgcctcagacgaggaggatgcctacgattccccagattttaaacggcgcggggcaagtgtggacgattttctcaagggatccgaattagggaaacagccacactgttgtcatggagacgaataccataccgaaagcagcaggggctctgacttgtccgacatcatggaagaggacgaggaagagctgtattccgaaatgcaactggaagacggaggcaggcgaaggcccagtgggacatcccacaatgctctgaagatcctcggcaaccccgcctcggctgggcgggtggatcacatgggaagaagattccctagaggctccgctggaccacaacgttcacggcctgtgactgtaccatccatcgacgactacggcagagaccggctctcccccgacttctacgaagagtccgagacagaccccggagccgaggagctccctgcgcgcatctttgtagccttatttgactatgacccgcttacgatgagccccaacccggacgccgcagaagaagaattgccttttaaagaggggcagatcattaaggtgtatggcgacaaggacgctgacggcttctacagaggagagacatgcgcgcgccttgggctgattccgtgcaatatggtcagcgaaattcaggccgacgacgaagaaatgatggatcagctgttgaggcaaggttttctgccgctgaacactcccgtggagaaaatcgagagaagcagaaggagcggcagacgccactctgtctcaactagacgaatggtcgcgctctacgactatgacccacgcgagagctctcccaacgttgatgtggaagctgaactcactttctgcaccggcgatatcatcactgttttcggcgagatcgacgaggatggcttttattacggcgaactgaacggccagaaaggcctcgttcctagcaacttcctggaagaggtgcctgatgacgtagaggtctatcttagcgatgcccccagccactatagtcaagatacccccatgagatctaaggcgaagcggaaaaaatcagtccatttcaccccgtag

SEQ ID NO: 203788 - DNA, 1938 bp, Artificial Sequence
  Description of Artificial Sequence: Synthetic coding sequence
atgaacggcctggccaccagcctgggcaagggccaggagagcgccatcgggggaagctctgccatcggggaatacatcagacctctcccgcagccaggtgacagaccggaacctctgagtgccaagcccacattcctttcccggagcgggtcagcaagatgtcggtccgagagtgatatggaaaacgaaagaaattcaaacaccagcaaacagcgatacagtgggaaagtgcacctgtgtgtcgcccgctattcctacaacccatttgacggacctaatgagaaccccgaggcagaactgcccttgactgccggcaaatatctgtacgtttacggtgacatggatgaagacggcttctacgagggggaacttttggacggacagcgaggactcgttccttccaacttcgtcgactttgtgcaagataatgagagtcgattggcttccacactgggcaacgagcaggaccagaatttcattaatcactctggcatcggcttagagggagagcacattctcgacttgcatagtcccacgcacatcgatgccggcataactgataactcggccgggacgctggatgtgaacatcgacgacatcggcgaagatattgtcccttatcctcggaaaatcactctgattaaacagctagccaagtccgtgattgtgggctgggagccgcccgcagtgcctcccggttgggggaccgttagtagctacaatgtactggtggataaagagacaaggatgaacttgactttggggtcacggaccaaagcgttaattgagaagcttaatatggccgcgtgtacgtacagaatctccgtgcagtgtgtcacgtcgcgaggttcaagtgatgagctgcaatgcacccttttagtaggaaaggacgtggtggtcgccccctcccatctgagggtggacaacattacccagattagcgcacagctgtcctggttgccgacaaacagcaattattctcacgtcatcttcctgaacgaagaagagttcgatatcgtgaaagccgcacgttacaaatatcagttctttaatctgcggccaaatatggcatacaaagttaaggttttggctaaacctcaccaaatgccatggcagctgccccttgaacaacgcgagaagaaggaggcattcgttgagttttcgacactcccggccggaccgcctgcaccaccccaagacgtcaccgtccaggctggcgtgaccccagcgacaattcgggtgtcctggaggcctcccgtgctaactcctacggggctaagcaatggagccaatgtgactggctatggcgtctacgctaaaggacagagggtcgccgaagtgattttccctacggccgactctactgccgttgagttggtcaggttacggagtctcgaagccaagggtgttacggtacggacactgagtgcccagggtgagtccgtggattccgcagtcgctgctgtgcctccggagctgctcgtcccacctactccccacccacggcccgcaccccagtctaagccactggcctcctccggcgtgccagagactaaggacgagcacctgggccctcacgctcggatggatgaggcctgggaacagtcaagggctcctggaccagtccacggccacatgctggagccccccgttgggccaggtcgacgttccccatctcctagtcggattctccctcagccacagggtacaccagtttctacgactgtcgccaaagctatggctagagaggctgcacagcgcgtcgcggagagcagccgcctggagaaaagatctgtgttcctcgagcggagcagtgctggacagtacgcagcttccgatgaggaagatgcatacgattcccccgacttcaagcgacgcggcgcttctgtggacgatttcctcaaggggtccgaacttggaaagcagatggcttcatag

SEQ ID NO: 203789 - DNA, 1938 bp, Artificial Sequence
  Description of Artificial Sequence: Synthetic coding sequence
atgaacggcctggccaccagcctgggcaagggccaggagagcgccatcgggggctcaagcgcaatcggtgagtatatcagaccattaccccagccaggagaccgacctgaacctttgtctgccaagccaactttcctgagcaggagcggctcagctcggtgtcgctcagagagcgacatggaaaacgaaaggaacagcaacacaagcaagcaacgctactcaggaaaagttcatctttgtgtggcaagatattcttataatcctttcgatggtcctaatgaaaaccctgaggctgagctcccattgaccgcaggaaaatatttgtatgtgtacggagatatggacgaagacggattctatgaaggagagctgctggatggccagcgtggattggtaccaagtaattttgtcgattttgtacaggataacgaatccagactggcctccactctgggcaatgaacaggaccagaacttcatcaaccactcagggatcggcctggaaggtgagcacatactggacttgcattctccaacacatattgatgcaggtatcactgataattcagccggcactctcgatgtaaacatcgacgacatcggcgaagacatcgttccataccctagaaagatcacactgatcaaacagctcgccaaatctgttatagtgggctgggagccacctgccgtccctccagggtggggcaccgtgtcctcatacaacgtgctggtagataaggagacaaggatgaacttgactcttgggagtcgaactaaggccctgatcgagaaactgaatatggcagcttgtacttatcggatatctgtgcagtgcgtcacttccagaggctcaagcgacgagttgcaatgtaccttgttagtcggaaaagatgttgtagtggctccctcgcacctcagggtcgacaacattacgcaaatcagcgcccagctgtcttggctccccacgaacagcaattatagtcatgtaatttttctgaatgaggaggaatttgatattgttaaggcagctcggtacaagtatcagttctttaatctacgcccgaacatggcatacaaagtgaaggtgctcgcaaagcctcaccaaatgccctggcagcttcccctggagcagagagaaaagaaggaggcattcgttgaattctccacactgcctgccggccctccagcccctccacaggatgtgacggttcaggcgggtgtcactccagctacaatccgcgtgtcatggcgacccccggtcctaactcctactggattgtcgaatggcgccaatgtgaccggctacggtgtctatgcaaagggccagagggttgccgaggtgatatttcctacagccgactcgaccgcagtagagctggtgcggttgaggtccctggaggcaaagggcgtgacagtcaggaccttgtccgcgcaaggcgaatccgtcgacagcgcagtagccgctgtgccaccggaactcctagtgccaccaacaccacatcctcgccctgcgccacagtccaagccactggcaagttccggcgttcccgagaccaaagacgagcatctgggtccacacgctaggatggatgaagcctgggagcagagccgtgccccaggtccagtgcacgggcacatgctcgagccacctgtcgggcctggaaggcgctccccttcccctagccggattctgccacagccacaggggacgcccgtaagtaccactgtggccaaggctatggcccgagaggcggcacagcgggtggcagagagcagtcgactggaaaagcgttccgttttcctcgagaggtcctccgcaggccaatatgctgcctccgatgaagaggacgcatacgactcacccgatttcaaacgtaggggcgccagcgtagatgacttcctgaagggatctgaacttgggaagcagatggtgtcctag

SEQ ID NO: 203790 - DNA, 4638 bp, Artificial Sequence
  Description of Artificial Sequence: Synthetic coding sequence
atgcagcgggagcgggaggccgagatccggcagctgctgcggtggaaagaggctgagcagcgtcagcttcaacagctgttgcatagagaacgcgatggcgtcgttagacaggcgagggagctacaaaggcaattggctgaggaacttgtgaaccggggtcattgttctaggccgggagcctccgaggtgagtgctgctcagtgtcgctgccggctgcaggaagtcttggcccagttgcggtggcagactgacggtgagcaagctgcacgcatcagatacttacaggccgcccttgaagtggaacgccagctcttcctcaagtatatcttggcacactttcggggccatcccgccctatctggatctcctgacccacaagccgttcattccttggaagaaccgctgccacagacttctagcggctcatgtcacgctccgaaaccagcgtgccagctcggctctctcgattctctctccgccgaggttggcgtgcgatccaggtcattagggttggtgtcatcagcttgctcatccagtccagatggccttttatctacccatgcctctagtctggactgcttcgccccggcctgtagcagatccttagactccacccgatccctacctaaggcaagtaaatcagaggaaagaccctcatccccggacacctctacccccggatctcgacggctgtcgccgcccccctctcccctaccaccacccccacccccttcagctcatcgcaagctgagcaacccaagagggggggaagggtctgagtcacagccatgcgaagtactgactccatctccgccaggcctagggcaccacgagctcattaagttaaactggctgctggcgaaggccctgtgggtactggcacgccgctgctataccctgcaagccgagaataaacaattgcgtcgggccggttgtccttatcaggcagatgaaaaggtgaagcgattgaaggtaaagcgagctgaactaaccggcttggctcgccggctcgctgatagggcacgaaagctgcaagagacaaaccttcgagcggtatccgcccccatcccgggagaatcttgcgcaggccttgagctgtgtcaggttttcgccaggcagagggctcgtgacctatccgagcaggcctccgcgcctttggcaaaggacaagcagatcgaagaacttcggcaggaatgtcacttacttcaggccagggtggcttcaggcccatgttctgatcttcatacaggccgggggggcccttgtacgcagtggctgaacgtacgagatctggacagacttcagagggagtctcagcgcgaggtgctgcggcttcagaggcaactgatgctgcagcagggcaatgggggtgcgtggcctgaggctggtggtcaatccgctacttgtgaggaagtgcgtcggcagatgttggctctagaacgagagttggaccaaaggagaagagaatgtcaggagctgggcgcacaggctgcgcccgcgcgtagaaggggggaagaggccgagacccagctgcaggctgccctactgaagaatgcgtggttggccgaagagaatgggcggcttcaagctaaaactgattgggtgcggaaggttgaggctgaaaactccgaggtgcgggggcatttggggcgcgcgtgccaagaacgggatgcaagtggactaattgcggaacagctgctccagcaggccgcccggggacaagacaggcaacaacagttacagagagatccgcagaaggcgttatgtgacttgcaccccagttggaaagagatccaggcactgcagtgtaggcctggccaccccccagagcagccctgggagacctcacagatgccagagagccaggtaaaaggcagtaggaggcctaaatttcatgccagacctgaagattacgccgtgtctcagccaaatcgggatatccaagagaagagggaagcttctttggaggaatcgcccgtggcacttggggagagtgctagtgtgccacaggtctccgaaaccgtgcccgcctcgcagcctcttagtaagaaaacctctagtcagtcaaactcatcgtctgaaggcagcatgtgggcgaccgtgccctcatctcctactctggacagagatacagcatccgaagtggacgacctggagcctgactctgtgagtctggccctcgagatgggggggagcgcggcaccagccgccccaaaactcaagatttttatggctcagtacaactacaatccctttgagggcccaaatgaccatcctgaaggagagctccccctgacggcaggcgactacatatatatcttcggggacatggatgaagacggattttatgagggggagctggaggacggacggcggggattagtaccctccaatttcgtcgagcaaattcccgacagctatattccagggtgcctgccggcgaagtcacccgacctcgggccaagccagctccctgctggtcaagacgaggcactggaagaggatagtttactcagcggaaaagcacagggcgtggtggacagagggctctgtcagatggtcagagtgggaagcaaaaccgaagtggctaccgagatcttggataccaagactgaggcatgccagctggggctactacagtctatgggcaaacaaggcctcagccgtccacttctgggtacaaagggagtcctcaggatggctcccatgcaactacatctgcagaatgtcacagccacaagcgctaatatcacatgggtctattcaagccatcgtcatccccacgttgtttatctagatgaccgggagcatgctctgacacccgcaggtgtttcctgttacactttccagggactctgcccgggaacccactaccgtgcacgtgtggaggtgcgcttacctcgtgatttattgcaagtgtactggggcacaatgtcgtcaacagtcacctttgacacactgttggccggacccccctacccccctctcgacgtgctggtggaaagacacgctagcccaggcgtgctggtggtctcatggctgcccgttacaattgactctgctggatcttcaaacggagttcaggttactgggtacgccgtgtacgccgatgggctcaaagtctgtgaagtggcggatgctaccgcaggatcaaccttgctggaattctcgcaactccaggtacctctcacttggcagaaggtgtctgtgcgcacaatgagcctatgtggggagagcctggacagcgtacctgcacagatcccagaggacttttttatgtgccacagatggcctgagacccctcccttcagctatacttgtggcgacccgtccacttaccgggtaacattccctgtgtgcccacagaagctgagcttggcccccccctcagctaaagcatctccccacaacccaggaagctgtggcgaacctcaggcaaagttcctcgaggcgttctttgaggagcctccccgcaggcagtcccccgtctccaacctgggtagcgagggagagtgcccaagcagcggagcgggcagccaggctcaagaactggcggaggcatgggagggttgtaggaaagacctgctcttccagaagtcccctcagaaccaccgccctccgtccgtcagcgatcagcctggtgagaaggagaactgttcacagcacatgggtaccagcaagagcccggccccaggcttcattcatctgcgcactgagtgcggtccgagaaaagagccctgccaagaaaaggccgctttagaacgggtcttgcggcaaaagcaagatgcgcagggattcaccccaccgcagctcggggcctctcagcagtatgccagtgactttcacaacgtgcttaaagaagagcaggaggcattatgcctcgacttgtggggcacagagaggcgagaagagcgcagagaacccgaacctcattcacggcagggtcaggccttgggtgtcaaacggggatgtcagctacacgagcctagtagcgccctgtgtccagctccaagcgctaaggtaattaaaatgcccagagggggccctcaacaactcggaaccggcgcaaatactccagctcgcgtttttgtggcattgtcagactacaacccgctggtgatgagcgcaaacctgaaggccgcggaggaggaactggtgttccaaaaaagacagctgttgagggtctggggatctcaagacacgcacgatttttacctttccgagtgcaaccgacaggtcggaaacattcccggtcggttggtggctgaaatggaggtcggcaccgagcagacagatagacggtggagatcccccgctcagggcaatctgccatccgtggctcaccttgaggactttcagggtctgaccattccacagggctcttctcttgtactgcagggcaactcaaagaggctgcccctttggaccccaaaaataatgatcgcggctctggattacgatcccggggacggccagatggggggccagggcaagggacggctggccctccgcgcgggcgacgtcgtgatggtttacggccctatggacgatcagggcttttattacggtgagctagggggccatcgcgggctggtgccagctcacttgctggaccacatgtctctacatggacactag

SEQ ID NO: 203791 - DNA, 4920 bp, Artificial Sequence
  Description of Artificial Sequence: Synthetic coding sequence
atggccaaggacagccccagccccctgggcgccagccccaagaagccaggatgcagcagccctgccgctgctgtgcttgagaaccagcggagggagctggagaagctccgggctgagctggaggctgagagggctggctggagagccgagaggcggaggtttgccgccagagaacggcagctacgggaagaggccgagcgcgagagacgtcagcttgcagatcggctcagaagtaagtgggaggctcagcgctcaagggagctcagacagctgcaagaggagatgcagagggaacgggaagccgagataaggcagctgctcaggtggaaggaagcagagcagagacaactgcagcagctgctccatagggagcgcgatggcgtagttcggcaagcccgggaattgcaacgccagcttgccgaggaattggttaataggggccattgctcacggccgggggcgtccgaggtgtctgcagcgcagtgcaggtgtagactccaagaggtgttggcccaattgcgctggcaaactgacggcgagcaagccgcaaggatcaggtacctccaagcggccctggaggtggaacgacagttattcttgaagtacatattggcacactttaggggacaccctgcgctctctggtagccccgatccgcaggctgtgcactcactggaggagcctttgcctcaaacttctagcggaagctgtcacgcacccaaacctgcttgccagctaggcagtctggattccctgtcagcggaggtcggagtgaggagccgctcactgggcctagtgagtagcgcctgttcatcgagccccgacggcctcctctcgacccatgcttcctcactggattgtttcgctccagcttgctctagaagcctggacagtacaagaagtcttccgaaagctagtaagagtgaggagcggcccagtagccccgacacctcaacacccggctccagacgtctgagcccgcccccaagcccacttcctcctccaccccccccttcagcccaccggaagctatctaacccacgcggtggtgaaggaagcgagagtcagccgtgtgaggtgctgacaccctccccgcccgggctgggtcaccacgaacttatcaagctgaattggttgctggctaaggctttgtgggtcctggccaggcgatgttatacactgcaggctgagaataaacaactcagacgtgcaggctgcccctatcaagccgacgagaaggtcaaacggctcaaggtgaaaagggccgagctgaccggtctcgctcggcgattggctgatcgggctcggaaattacaagagactaacctccgcgccgtgtccgctcccatacccggagagagttgcgcaggactggagctttgtcaggtgttcgcgagacagagagcccgggatctcagcgagcaggccagcgccccgctggccaaggacaaacaaatcgaagagttaagacaggagtgtcatttgttacaggcccgagtcgcttccgggccttgttccgacctgcacaccggcagaggaggcccatgcactcagtggttgaacgtgcgagacctggaccggcttcagcgtgaatctcaaagggaggttctcagacttcagaggcaactaatgctgcagcagggcaatgggggggcatggcctgaagctggcgggcagagtgcaacatgcgaggaggtaaggagacagatgctggctcttgagcgtgagctggatcagcgcagaagagaatgccaggaactgggagcacaggccgcacccgcacgccgtcgaggcgaggaggcagagactcagctgcaagctgctctgctgaagaacgcctggttagctgaagaaaatggtcgcttgcaggcgaagacagactgggtacgcaaggtggaagcggagaactccgaggtccgcggtcacctgggtcgagcttgtcaggagagggacgcatccggactgatcgccgagcagcttctccagcaggcagcaagaggacaggatagacaacaacagctccagcgcgacccccagaaagcactgtgtgacttgcacccctcatggaaagagatccaggcgttgcaatgcagacctgggcaccctcccgagcagccatgggaaaccagccaaatgcctgaatcccaggtgaaagggtctaggcgtcccaagttccatgcaaggccagaggactacgcagtgtcacaacccaacagagacatccaggagaagagagaggcatctctggaagagagtcccgtggcgcttggagagtctgcgtccgtgccccaggtcagcgagacagttccagcatcccagccactgtcaaaaaaaacaagtagtcagagtaactcctcaagtgaaggatctatgtgggcaacagtcccctcatcacctaccctcgacagggataccgctagcgaggtcgatgatctggagccagactctgtgtctctcgcactggaaatgggtgggagcgctgcacctgccgcaccaaagctaaagatctttatggctcagtataattacaatcccttcgagggcccaaacgatcatcccgagggcgaactccctctgactgcaggagactacatctatatttttggggacatggacgaggatggcttttacgagggggagcttgaagatggtcgccgcgggctcgtgcccagtaattttgtggagcagatcccagacagctacatacctgggtgcctgcccgccaagtcaccagatctgggaccgtcccagctgccagcaggacaggacgaagccctggaggaggatagcttactctcaggaaaagcccaaggagtggtcgacagaggtctgtgccagatggtgagagtcggatccaaaactgaagtggccactgagatactggacacgaaaaccgaggcgtgccagctggggcttctgcagagcatgggaaaacagggtctctcgagaccactgctcggcaccaaaggcgtcctgcggatggcccccatgcagttgcacctgcagaacgtcaccgccacctctgctaacataacttgggtttattctagtcaccggcacccacacgtcgtgtacttggatgacagagaacacgccctgactcctgcgggagtgtcctgttacacctttcaaggtctttgtcccggaacacattacagggctagagtcgaggtgcgtttgcctcgcgacctgctgcaggtgtattggggcactatgagctctaccgtgaccttcgataccctgctggctggacccccataccctcctctggatgtgctcgtcgagaggcatgcctctccgggggtgctcgtagtgtcctggctgcctgtaactatagacagtgctggctcttcaaacggagtgcaggtcactgggtacgccgtctatgccgatggcctgaaggtgtgtgaggtagcagacgcaaccgcaggttctaccttgctagaattctcccagcttcaggtgcccctgacctggcagaaagtgtccgtgcgtaccatgtccctgtgtggagaatccttagattcagttcccgctcagatacctgaggatttcttcatgtgtcacaggtggccggagactcctccattttcatacacctgcggggatccctctacatatagagttacctttcccgtatgtcctcagaagctatcgcttgccccaccttccgctaaagcttctccccacaaccctggttcttgcggcgagccacaagccaaatttttggaagcgttctttgaagagcctccccgccgacagtcaccagtaagcaatcttgggagcgagggcgaatgcccctcaagtggggccgggagtcaagcccaggaactggccgaagcctgggagggatgtcgcaaggatctcctgttccagaaatcaccccagaaccatcggcccccctctgtgtccgaccaaccaggagagaaagagaactgttcgcagcacatgggcaccagcaagagcccagcccccgggtttattcacctcagaactgagtgtgggccacgcaaggaaccttgtcaagaaaaggctgctctggagcgagtcctgaggcagaagcaggatgcccaaggcttcacccctcctcaattaggcgcaagccaacagtatgcctctgacttccataatgtactgaaggaagagcaggaggccctttgtcttgacctgtggggcaccgagagaagagaagagcgccgggagcctgaaccccattcccgtcagggccaggccctcggtgtcaaacggggttgtcagctgcatgaaccctcctcagcactgtgtcccgcccctagtgccaaggtgatcaagatgccccgaggcggcccccagcagttggggacaggcgcaaataccccagctcgggtatttgtggctcttagcgactacaaccccctggttatgtccgcaaacctcaaggctgctgaggaggagctcgtgttccaaaagcggcagctgttacgcgtctggggcagtcaggatacacacgacttttatttgtccgagtgtaatcgacaggtggggaacatccctggccgactggtagctgaaatggaggtcggcactgaacagactgaccggcgttggagatctccagcgcagggaaacctgccgagtgtcgcgcatctcgaggattttcaaggattaaccatccctcaagggtcctcactggtacttcaaggaaattcaaaacggctaccattgtggactccaaaaatcatgattgccgcccttgattatgacccaggggatggacagatgggtggacagggcaagggcagacttgcgctgcgtgcgggggacgtagtcatggtgtatggtcccatggatgaccagggattctactatggcgagctcggcggtcataggggcctcgtgccagcacatctgctcgatcatatgagtctgcacgggcattag

SEQ ID NO: 203792 - DNA, 4638 bp, Artificial Sequence
  Description of Artificial Sequence: Synthetic coding sequence
atgcagcgggagcgggaggccgagatccggcagctgctgcggtggaaggaagctgaacagcggcagttacagcagctactgcaccgcgagcgagacggtgtagttagacaggcacgcgaattacaaagacagcttgctgaggagttggtcaatcgtggacactgctcgcgccctggcgcttctgaagtttccgccgctcagtgtagatgtcggctccaggaggtgctggcccaactgcgatggcaaactgacggagagcaggccgcaagaattaggtatctgcaggcggccctggaggtggagagacagctgttccttaaatatatcctggcccacttccggggccatccggcactctccggctccccagaccctcaggcggtccactccctcgaggagcctttacctcagaccagttccggaagttgtcacgcccccaagcccgcatgccagctgggaagcctcgattctctgagcgccgaagtcggcgtccgcagtagatctcttggcctggtgtccagtgcttgctctagcagtccagatgggttgctgtcaacgcatgcttcttctctcgactgtttcgcccccgcttgctcacggtccctggactctactcgatctctgcccaaggcttctaaatcggaagaacgaccttccagccccgacactagcacaccagggtcccggcgtctttctcccccacctagccctttgcctccacccccacctccttcagcacatagaaaattaagcaaccctcgaggaggagaaggatcagaatcacagccatgtgaagtgctgaccccgagccctcctgggttgggacatcatgagctcatcaagctgaattggttgctagctaaggcattgtgggttctcgcaagaaggtgttacacgctgcaagaggagaataagcagcttcggagagcaggatgcccatatcaggcagacgagaaggtcaagagattgaaagtcaagcgagcagaactcactgggctcgcacggcgattggctgaccgggcccgagaactgcaggagacgaatcttcgtgccgtatccgctccaatccccggagaaagctgtgcgggcctcgagctttgccaggttttcgcacgccaacgggcccgggacctgagtgaacaagcctctgctccgcttgccaaggataagcagatcgaagagctaaggcaggaatgtcatctcctgcaggcccgagtggcctccggaccatgtagcgatcttcataccggacgcggtggcccgtgcacccagtggttgaatgtgagagacctcgatagactacaaagagaaagccagcgcgaagtgctgagactgcagcgccagctgatgctgcaacagggcaatgggggagcatggccggaagcaggcggtcagtcagcaacctgcgaggaagtgaggaggcagatgctggcgctggagcgggagctcgaccaaagaagaagggagtgccaagagctaggcactcaggctgctccagcccgtaggagaggagaagaggctgagacacaactccaggccgcccttttaaagaacgcctggctcgcggaagagaacggtcggttgcaggcaaaaacagattgggtgcgtaaagtggaagcggaaaattctgaagtaaggggccacttaggtagagcctgccaagaacgtgatgccagcggcctgatagccgaacagctgttacagcaggccgctcgcggtcaggatagacagcagcagttacagagggatccccagaaagcactttgcgacctccatccttcctggaaggagatccaagcgctgcaatgtcggccaggacacccgcccgaacaaccttgggagacatcacagatgccggagtcccaagtcaaggggtccagacgccctaaatttcatgcaagacctgaagattatgcagtgtctcagccaaaccgcgatatacaggagaagagagaggcaagtctggaagagagtcccgtagccctcggtgagagtgcttccgtgccccaagtgagtgaaacagttcctgcttcccaacctctaagcaagaagacgagctcgcagagtaatagttcatccgagggctctatgtgggcaacagtgccgagtagcccaaccctggatcgggacacagccagcgaagtggatgacttagaacccgacagcgtgagcctggccctcgagatgggcggaagcgccgcccccgcggcgcccaagttaaaaattttcatggcacagtataactacaatccatttgagggacctaatgaccatcctgagggagagctgccactaacggccggcgattatatatatattttcggcgacatggacgaagatggcttctacgaaggcgaactagacgatgggaggagggggctggtgccttctaacttcgttgagcagatcccagacagttacattcctggctgtctgcctgccaaatcccccgacctcgggcctagccagctacctgccggtcaagatgaggctctcgaagaagattctctgctgtccggaaaggctcaggggatggtggacagaggtctgtgccagatggtccgagtgggcagtaaaactgaggtggctactgagattcttgacactaagacagaagcttgccagctgggactgttgcagtccatgggtaaacaggggctctcccgtcccctcctcggaaccaagggcgtgcttagaatggcccctatgcagttgcatttgcagaatgtaaccgccacctccgcaaatatcacttgggtgtacagcagtcaccgccatccacacgtcgtttacctggacgatagggagcacgccctcactccagccggagtctcttgctacacgttccaagggctctgtcccggcacccattatcgcgtgcgagtagaggtgcgattgccctgggacctgttgcaagtctattggggaacaatgtcgagcacagtcacgtttgatactctgctcgctggccctccgtatccacctttggaagtgctcgtggagagacatgcctcaccaggcgtgttggtggtgagctggttaccagtgactatagactccgccggctctagcaacggggtgcaggttactggatatgccgtgtatgccgacggcctgaaagtgtgcgaagtcgccgatgcaacagctggctcaacagttctggagtttagccagctccaggtgcccctgacatggcagaaagtgagcgtacgaactatgtctctgtgtggagagagcctggactccgttccagcacagattcctgaggacttcttcatgtgccatcggtggcccgagaccccacctttttcttatacttgcggggaccccagcacttatcgggttacattcccagtgtgtccgcaaaagttgtcgctggcccccccgtccgccaaagccagcccacacaaccccgggtcttgcggggagccccaagccaagtttctcgaggccttcttcgaagagcctcccagacggcaaagtccagtatccaacttgggatccgagggagagtgccctagcagcggtgcaggctctcaagcccaggagcttgctgaagcatgggaaggatgtagaaaagaccttctgtttcagaagtcaccacaaaatcaccgccctccatctgtgagcgaccagcccggggagaaggaaaattgttaccagcatatgggaactagcaaatctcccgcacctgggttcatccacttgaggaccgagtgtggtccacggaaagagccctgtcaggaaaaggccgctctggaacgggtcctgcggcagaagcaagatgctcagggctttacacctcctcagcttggggcctcccaacagtacgcatccgactttcacaatgttctgaaagaggaacaagaagccctgtgcctcgatctccgcggtacagaaagaagagaggagaggagggagcctgagccacattcccggcagggccaggcattgggtgtgaagcgaggatgccagttgcacgaaccctcctctgctctatgccctgccccttcggctaaagttatcaagatgcctcgcggaggcccacagcagctgggcaccggagccaacacgcccgcccgcgtgtttgtcgctctgagtgactacaacccactagttatgtccgccaacctgaaagctgccgaggaggagctggtgtttcaaaaaaggcaattgttgcgggtttggggaagccaggacacccatgacttttacctgagcgaatgcaatcgacaagtgggcaatatcccggggcgcttggttgcagaaatggaagtcggcacagaacagaccgacagacgctggcgcagccccgcccagggacacctgcctagcgtagcccatctcgaagactttcaggggctgaccataccgcagggatctagtctagttctccagggaaacagcaaaagactgcccttgtggacacccaagattatgattgccgccttggactacgatcctggtgacggacaaatgggtggtcaaggaaagggcaggctcgccctgagggcgggcgatgtggtcatggtctacggccctatggacgatcaaggcttttactacggcgaactcggcggccatcgaggcttggtgcccgcccacctgctggaccacatgtcacttcacggccattag

SEQ ID NO: 203793 - DNA, 4920 bp, Artificial Sequence
  Description of Artificial Sequence: Synthetic coding sequence
atggccaaggacagccccagccccctgggcgccagccccaagaagcctgggtgttcctcccctgctgccgccgtcctggagaaccagcgccgcgagctggagaagctccgggccgagcttgaggccgaacgcgctggatggcgcgccgagcgccggaggtttgctgcgagagagagacaactgcgggaggaggcggaacgagagcgcagacagttggcagacagactaagatccaagtgggaagcgcaacgcagtagggaactgagacagttacaggaggagatgcagcgtgaaagagaggcggaaattcgtcaacttctgcgttggaaagaggcggaacagcgacagcttcaacagctcctgcaccgtgagagggacggtgtggtaaggcaggctagggaattgcagcgtcagttggctgaggagctggtgaacagaggccactgctcaagacctggagccagtgaggtcagtgccgcacagtgcaggtgtagactccaggaagtgttggcacaacttaggtggcagactgatggcgaacaggctgcccgcatccgctacttgcaggccgccctcgaggtggaaagacagctatttctcaagtatattttggctcacttcagggggcatccagccctgagcgggagtcccgacccgcaggcagtccattccctggaagaaccattacctcagacctccagtgggagctgtcacgcccccaagcccgcatgtcagcttggctccctcgactccctttctgccgaggtcggggtgcgctctcggtcccttggtttagtctcgtcagcttgcagctcttctccagacggtttgttaagcactcatgcatcgtcactggactgttttgcccctgcatgttccaggtctctggacagcacacgaagccttccgaaagctagtaagagtgaggagaggcctagcagccctgacacctcaactcccgggagccggaggctgtcgcccccaccaagcccattacctccacctcctccgcccagtgcccatagaaaattatcaaatccgcgtggaggagagggctcagagtcacaaccttgcgaggttcttacgccaagtcctccaggattaggacaccacgaactgatcaagctcaactggttgctcgccaaagctctctgggtgctagctcggaggtgctacacacttcaggaggaaaacaaacagttaaggcgtgctgggtgcccttatcaggccgatgagaaggtgaagcgcttaaaagtgaaacgggcggaactgacaggcctagcccgcaggctggcagaccgggcccgggagctgcaggaaaccaacctgcgggctgtatcagcccccatacctggagaaagttgtgcaggactcgagctttgccaagtcttcgcccggcagcgagctcgagacctttctgagcaggcctctgctccactcgcgaaagacaagcagatcgaagaactgaggcaagaatgccatcttctccaagcaagggtagctagcgggccatgttccgacctgcacacggggaggggagggccatgcacccagtggctaaatgtgagagatctagacaggctgcagcgggagtctcagagagaggtcttgaggctgcagcgacagctgatgttacagcaagggaatggaggggcatggcccgaagccgggggccagtccgcgacttgtgaggaggtccgacggcaaatgctggctttggaacgggagctggatcagcgccgccgcgaatgccaggaactcggtacccaggcagcaccagccaggagaaggggggaggaagccgagacacagttgcaggcggccctgttaaagaatgcctggctggccgaggaaaacggacgtcttcaggccaagaccgattgggtcagaaaggtggaggctgaaaactcagaggtgcgagggcatctcgggcgcgcctgccaggagcgggatgcctcggggcttatcgcagagcaactgctccaacaggcggcacggggccaagacaggcagcagcaactgcagagagacccacaaaaggctctgtgtgatcttcacccatcctggaaagagattcaggcactccagtgccgaccgggacatcccccagaacagccttgggaaacaagtcagatgcctgaatcgcaggtgaaggggtctcggagaccaaagtttcacgcgcgtcccgaggattacgctgtaagccagcccaatcgtgatatccaggaaaagcgagaagcaagtctggaggagagcccagttgcacttggcgaaagcgcctcggttccccaggtgtcagaaactgtacccgcctcgcagcctctgagcaagaagacctcttcccagagcaacagctcatcagagggctccatgtgggccacggtgccatcatccccgactttggaccgtgacaccgccagtgaggtcgatgatctggagccagattccgtgtcgctggccctggagatggggggctcagctgctcccgctgcccccaagctcaaaatatttatggcccaatacaactataaccctttcgagggcccgaacgaccatcccgagggggaacttcccctgaccgcgggagactacatttacatatttggtgacatggacgaagacggcttctacgagggggagttagatgacgggaggagggggcttgtgccttcaaacttcgtggaacaaattcccgactcttatatccccggatgtctgccggctaaaagtcctgatctgggcccaagccaactgcctgccggccaggacgaggccctggaagaggactctcttctttccggtaaggcacaaggcatggtggaccgcggcctgtgccagatggtccgtgtcgggagcaagaccgaggtggcgactgagattctggacaccaagactgaggcctgtcagctgggcctcctgcagagcatgggaaagcaagggctatctcggcccctgctcgggactaagggagtgctgaggatggcccccatgcagctgcaccttcagaatgttaccgccactagcgccaatattacctgggtgtattcttcacatcgacacccacacgtggtgtaccttgatgatagagaacacgcactgactccagctggcgtttcctgctacacctttcaggggctgtgccccgggactcattatcgggttcgggtggaagttcgtctgccctgggaccttctacaggtgtactggggtactatgagctctaccgtgacctttgacacattgttagcaggccctccatacccacctcttgaggtgctagtagaacgacacgccagccccggcgtgcttgttgtctcatggctgcctgtgaccatagattctgcaggaagcagcaacggcgttcaggtaaccgggtatgccgtgtacgccgatgggctgaaggtgtgtgaagtcgctgacgctaccgccgggtccactgtgctggaattcagtcagctgcaggtccctttaacctggcaaaaagttagcgtgcgcaccatgtccctgtgcggagagtctcttgactccgtgcctgcgcagatcccagaagacttctttatgtgccacaggtggccagaaactccgcctttctcatacacctgcggcgacccgtcaacgtacagggtgacatttccggtgtgtcctcagaaactttcgctcgctcccccatccgctaaagcctcaccgcataatccgggctcttgcggcgaaccacaggcaaagttcttagaggccttctttgaggagccacccagaagacagtctccagtgtccaatttggggtcggagggggaatgcccctcaagcggagcaggtagtcaggcgcaggagttggccgaggcctgggaggggtgccgaaaggatctcctattccagaagagtccacagaatcatcgccctccgtctgtgtccgaccaacctggggaaaaagagaactgctatcagcacatgggaactagcaagagccccgcacctggctttattcatttgcgtacagagtgcgggcctagaaaggaaccttgccaggagaaagctgcactggaacgggtgctccgccagaagcaagacgcccagggtttcactccaccccagctcggggctagccagcagtacgcctcagactttcacaacgtactgaaagaagaacaggaggcactgtgcctggatcttaggggcactgagaggcgagaggaaaggcgagaaccagagcctcatagccgccaaggtcaagcgctgggtgtgaagaggggatgtcagctgcacgagcctagctctgcgttgtgccctgccccaagcgcaaaggtgattaagatgcccagagggggcccgcagcagctcggtaccggggctaacacacccgcacgggtgttcgtcgccctgagcgactacaacccgttggtcatgtctgccaatcttaaggcggccgaggaagaactggtattccagaagcgacagctcctacgcgtctggggtagccaggacactcacgatttctatctctccgaatgtaataggcaggtcggaaacatcccaggcaggctggtcgctgagatggaggtgggcactgagcagacagatagaagatggcgcagtccagcacagggacatttacctagcgtggcccatctagaggatttccagggtttaactattccccagggctccagcttagtacttcaagggaacagcaaaaggctgcctctgtggacccccaagattatgatcgcggccctcgactacgacccaggagatggccaaatgggcggccagggcaaaggccgtttggccctacgcgccggtgatgtcgtcatggtctatgggccaatggacgatcagggtttttattacggggagctgggtgggcaccgcgggctggtacctgcccacttactggaccacatgtcattgcatgggcattag

SEQ ID NO: 203794 - DNA, 4638 bp, Artificial Sequence
  Description of Artificial Sequence: Synthetic coding sequence
atgcagcgggagcgggaggccgagatccggcagctgctgcggtggaaagaggctgagcagcgacagctgcagcagctactgcatcgcgaacgcgatggagtggtgcgtcaggcccgcgagttacagcgacagctggctgaagaactggttaaccgtgggcactgcagtcgccccggcgcttctgaagtatcagccgcacaatgccgctgcaggctgcaggaggtgcttgctcagttgaggtggcagaccgatggggagcaagctgcaagaattcgctatctgcaggctgcattggaggtggaacgccagctgttcctgaagtacatcctcgcacacttcaggggacaccccgcgttaagcggatctcctgatccacaggccgtacacagcctcgaggaaccactgccccagacaagctccggctcctgccacgctcctaaacccgcttgccagctcggctccctagactccttgtcagctgaggtcggggttcgatcccgttctctcgggctggtctctagcgcttgcagtagctcccctgacgggctcttgtcaacacatgcctccagcctcgattgcttcgcccctgcgtgctcaagatccctagatagcacccgatccctccccaaggcttctaagtctgaggaacgaccctcatctcctgacactagcacccctggcagtcggaggctgagccccccgccctctcctttgccacctccaccgccgccatctgcgcaccggaagctttccaatccccgcggaggtgaaggcagcgagtctcagccttgcgaggtgcttacgccttcaccgccaggactgggtcaccacgagcttataaaactgaattggttgctggcgaaggctctgtgggtgctagctcggcgctgctacactctgcaggaggaaaacaaacagctgcgcagagcgggctgtccttaccaggcggacgagaaagtgaaaagactaaaagtgaaacgtgccgagctcaccggcctggccaggcggcttgcagatcgggctcgcgagctgcaggagaccaaccttagggcagtgtctgctccaatacccggggagagttgcgccgggctcgaattgtgccaagtttttgcccgacagcgcgcccgggatctatccgagcaagcctcagctcccttggcaaaagataaacaaatcgaagagctgcggcaggagtgccatctgcttcaggctagggtggcttcagggccatgctctgatctgcacaccggcagaggaggaccctgtacccagtggctgaacgtgcgggacctcgacaggctccaaagggagagccagagagaggtattacgtctgcagcggcaactaatgctgcaacagggtaacggtggcgcctggcctgaggccggaggtcaatccgctacctgtgaagaggttcgtcgacagatgctcgcactggagagggaacttgaccagagaagaagagaatgccaggaactgggcacccaagccgcgcccgcgaggagaaggggcgaggaggctgagacccagctgcaggcagcattgctgaagaacgcttggctcgcagaagaaaatggaaggctgcaggctaaaaccgactgggttcggaaagttgaagccgaaaattccgaggtgcgaggccacctaggtcgtgcatgtcaggaacgagatgcctcagggctgattgcggagcagcttctgcagcaggcagcacgaggacaggatcggcagcagcaactgcagagagacccacagaaagccctttgcgacctacacccctcctggaaggagattcaggctctgcagtgcaggccaggccacccccccgaacagccatgggaaacctcacagatgcctgagtcccaggtgaaggggtcacggagacctaaatttcacgctagaccagaagactacgccgtttctcagcccaacagggatatccaggaaaagcgggaggcgagtctggaggagagtcctgtggccctgggtgagtctgcaagcgtgccccaggtttcggaaaccgttcccgcatcccagcctttgagcaagaagacctccagccagagcaattctagtagtgagggatccatgtgggccactgtcccctcaagtcccacactagatcgtgatactgcgagcgaagtggatgacctagaacctgactccgtctcgctagccctggaaatgggaggcagcgctgcgcccgccgcgcctaaattaaagatcttcatggcacagtataactacaatccattcgaaggtcccaacgaccatcccgagggggaacttcctctgacagcgggagattacatttacatcttcggagatatggacgaggacgggttttacgaaggcgagctcgatgacggcagacgaggccttgtgccctccaacttcgttgagcagattcctgattcatatatcccaggatgtcttccagcgaaaagccccgatctgggtcctagccagttgcctgccggtcaggacgaggccctggaggaagacagcttattatccggaaaggcccagggcatggtggaccgagggctttgccagatggttagagtcggcagtaagaccgaggttgcaactgagatcctggacacaaagaccgaggcgtgtcagctggggctgcttcagtcgatgggcaagcaaggactgtcccggccattactgggcaccaaaggggtcctcaggatggcgcctatgcagctgcacctgcagaatgtgacagcgaccagcgccaacataacctgggtttactcctcccaccgtcatcctcatgtggtttacctagatgacagagagcacgcactaacgccagcaggggtgtcatgctacactttccaaggcctttgccccggcactcattacagagtgcgtgtggaggtaagactgccttgggatctgcttcaagtatattgggggacaatgtcgtccacggtgacctttgatacgctgctcgccggtccgccatatcctcctctggacgtgctcgtcgaacgtcatgcctcccccggagtgttagttgtctcgtggctgcctgttaccattgacagcgcaggctcctcaaatggcgtgcaagtcacaggatacgctgtatatgcagatggccttaaggtctgtgaagtagctgatgctaccgccggaagtaccgtactggagttttcccagctccaggtacctttgacctggcagaaagtgtctgtcagaacaatgtccctttgcggagagagcctggactccgtgccagctcagattccagaggatttctttatgtgccaccgttggcctgagactccgcccttcagctatacctgtggcgatccaagcacttaccgagtaacctttccagtttgcccccagaaactgagcctggctccaccttccgccaaagcctccccccataatcccggctcttgcggtgagccacaggccaagttcctggaggcgttttttgaggaacctccccggagacagtctcctgtgagtaatttgggcagtgaaggagaatgtccatcgtcgggtgcaggctctcaggcccaggagctcgccgaggcttgggaagggtgtaggaaagatcttctgttccagaaatccccacagaatcataggcctccctcagtgagcgaccagcctggcgagaaggaaaattgttatcagcatatgggcacttcaaagagccccgctccaggatttatccacttacggacagaatgtggccctcggaaagaaccctgtcaggaaaaagctgcacttgaacgcgtgcttcgtcaaaagcaagacgctcagggcttcacccctccacagttaggtgcctctcagcagtatgcttccgacttccataacgtactgaaggaggaacaagaggctctttgcctcgatctgcgcggcaccgaacgccgcgaagagcgaagagaacctgagccccactctcgtcaggggcaagctcttggcgtcaagagaggatgtcagctgcatgagccatcgagtgcactttgccctgcacctagcgctaaggttatcaagatgccaagaggcgggccgcagcaactggggacaggcgccaatactcccgcacgcgtattcgtcgccctgagtgactacaatccactggtaatgagcgcaaacctgaaagcagcagaggaggaactcgtgttccagaaaaggcagctactgcgcgtgtggggctcacaggacacccacgatttctacctgagcgagtgtaacagacaggtgggaaacattccaggtagacttgtggctgagatggaggtggggacggaacagactgaccgtcgttggcggagcccggcccaaggccatctgccttctgtggcccacctcgaggacttccagggcctaattataccccaggggtcttcactagtgttacaaggcaacagtaagcggctcccactgtggaccccaaagattatgatcgccgccctggactatgatcctggagacggccagatgggaggtcaaggaaaaggaagactggctctccgggctggcgatgtcgtaatggtatacggtccaatggacgaccagggcttctactatggggaactgggtgggcatcgaggtctcgtgccggcgcaccttttggaccatatgagcctccatggccattag

SEQ ID NO: 203795 - DNA, 4920 bp, Artificial Sequence
  Description of Artificial Sequence: Synthetic coding sequence
atggccaaggacagccccagccccctgggcgccagccccaagaagcctggttgctcctctcccgcagctgccgtgctggagaatcagcggcgtgaactcgagaaattacgcgcagagctggaggcagaaagggcaggctggagggcagaacgccgccgctttgcggcacgggagcgccagctcagagaggaggccgagcgcgagagacgccagctggctgacagactaaggagtaaatgggaagctcaaaggtctagagagcttagacaactgcaggaggagatgcagcgagagagagaggccgagattagacagctgctccggtggaaagaggccgaacaacgtcagctgcagcagctgctacacagggagcgcgacggggttgtcagacaggcccgtgaattacagcgccagctcgccgaggagctggtcaacagaggccactgttcccgacctggagccagcgaggtatcagcagcacaatgccgatgtagattacaagaggtactcgcccaactacggtggcagaccgacggcgaacaggccgcaagaattcgctacctgcaggcagctctcgaggtggagcgtcaacttttcctgaagtacatcctcgctcactttaggggacaccctgccctgtcagggtctcccgacccacaggcagtccactcattagaagagcccttgcctcagacttcatctggcagctgtcatgctcccaagccagcttgtcagctcggaagtctcgattccctgagcgctgaggttggagtacgcagccgctcactgggccttgtcagcagcgcatgctctagtagtcccgacgggctcctctccacccacgcctcttctctcgactgttttgcaccggcctgcagccggagtctagattccactaggtctctccctaaggcctctaaatctgaggagcgtccatccagtcctgatacttcaactcccggatctaggcgcctgtctccacctcccagccctctgcctcccccaccgcctccaagtgcacatcgaaaactctccaatcctcgaggtggggaaggcagcgagagtcagccttgcgaggtgttaacaccatcaccccccggtctggggcatcatgaactgataaaactgaattggctcctggcgaaagctctatgggtgctagcccgtcgatgctatacactccaagaggaaaacaaacagctgagaagggcaggctgcccttatcaagccgacgaaaaagtgaaaagacttaaggtgaagagagcggagttgacaggcctggctcggcgtctggccgatagagcccgcgagttgcaggagactaacctgagagccgtgagtgctccgattccaggtgagtcatgtgctggccttgaactgtgtcaggtttttgcgagacaacgagcccgtgatctctccgagcaggccagcgcccctttagcgaaggacaagcaaattgaggagctgcgccaggaatgtcacttactgcaggctcgcgtggcctccggcccttgcagcgacttgcacaccggccgaggcgggccttgtacacaatggctgaacgtgagggacctggacagactgcaacgtgagtcccagagggaagtgctgcgcttgcagcggcagctcatgctgcagcaggggaacggcggggcttggccagaggccggaggccagtccgccacatgcgaagaagtcagacgccaaatgctcgctctggaaagagaactggatcagagacggcgggagtgccaagaactcggcacccaagccgctcctgcacgtcggcgcggggaagaagcagagacacaattgcaggctgccctgctgaagaatgcctggctggccgaggaaaacggcaggcttcaggcgaaaactgattgggtgcggaaagttgaggctgagaactcggaagtccgggggcacctcggacgcgcctgccaggagcgcgacgcatccggcctgatcgcagagcagttgctacaacaagccgccaggggccaggatcggcagcaacaattgcagagagatccccagaaggctctgtgtgatctccatcccagctggaaagagatacaggccctccaatgtcgtcctggacatcctcctgaacagccttgggaaacttcccagatgccagaatcccaagtcaaaggctccaggcggccaaaatttcacgcgcggcccgaagattatgcagtgtcccaacctaaccgggatatccaggaaaagagggaagcgtctctagaagagtctccagtcgcgctgggtgaatctgcttccgtgccacaggtgagcgagaccgttcccgctagccagcccctcagcaaaaagacatctagtcaatctaactcatcttcagaaggcagcatgtgggctacagtgccttccagtccaaccctggacagggacactgcatccgaagtggatgatcttgaacctgactccgtaagcctggccctcgagatgggaggaagcgccgctccagccgctcccaagctaaaaatttttatggcgcagtacaattataacccgttcgagggcccaaatgaccaccctgaaggtgagcttccactcactgctggtgattatatctacattttcggcgacatggacgaagatggattttatgaaggggagctcgacgacggcaggcggggactagtccccagcaacttcgtcgagcagatccctgattcctatattcctggctgcctgcccgcgaagtcacccgaccttggtccgtcacagttgcctgccggacaagacgaggcgttggaggaagacagcctgttatctggaaaggcacaggggatggtggacagaggattgtgccagatggtccgggtcgggagcaagacagaggtggccaccgagatcctggacactaaaaccgaagcgtgtcagctaggcttactgcagtccatggggaaacaaggacttagcagaccacttcttggcactaaaggcgtcttaaggatggcccccatgcagttacacctccagaatgttacagccactagcgctaatattacatgggtctattccagtcaccggcacccccacgttgtgtatctggatgaccgtgagcacgctttaacccctgccggagtgtcatgctacacctttcagggactctgtcccgggacgcactaccgtgtccgtgttgaagtccgattaccatgggatctcctccaagtgtactggggcacaatgtccagtacagttacattcgacaccctgcttgccgggcctccgtatccccctctggacgttctcgtggagaggcacgccagtccaggagtgcttgtggtttcctggttacccgtcaccatagacagtgctgggagtagtaatggcgtgcaggtcacgggctatgcagtctatgccgatggactgaaagtctgtgaggtagcggatgctaccgccgggtcaactgtcttagaattttctcagctgcaagtcccattgacgtggcagaaagtgtccgtgcggaccatgtcgttgtgtggcgagtctctcgactccgttcctgctcagatcccagaagactttttcatgtgtcacaggtggccagagaccccacccttctcttatacgtgcggtgaccccagtacctacagagtgacatttcccgtttgtccccagaagctcagcctggcccccccctccgccaaagcctccccccacaatcctggtagttgcggggagccccaggctaaatttcttgaagccttctttgaagaacctccacggcgccagtctcctgtgtcaaacctgggatccgagggtgaatgccctagctctggggccgggtcccaagcccaagagcttgccgaagcctgggaagggtgtcggaaagatttactctttcaaaaatctcctcaaaatcacaggcccccatcagtctccgaccagcctggggaaaaagaaaactgctatcagcatatggggactagcaaatcccctgctcctgggtttatccacctgcgcactgagtgcggtcctcgaaaggagccatgtcaggagaaggccgcactcgagagggtcctgaggcaaaaacaggatgcccagggattcactccaccacaactgggagcgtcccagcaatatgcctctgacttccacaacgtgctaaaagaggagcaggaggcgctttgtcttgatctcagaggcacggagcgacgggaagagagacgcgagccagagccccattcaagacagggccaagccctgggcgtgaaaagaggctgtcaactccacgagccatcgtccgcactgtgtcctgcaccgtctgccaaggtcataaagatgccacgcggcggaccacaacagctgggaaccggcgccaataccccagcgagggttttcgtggccctgagcgactacaatcctcttgttatgagcgccaacctgaaggctgctgaagaagaactggtattccagaaaaggcagctgctccgggtctggggctcccaggatacccacgacttctatctttctgaatgcaatcggcaagtgggcaacattcctggccgccttgttgctgaaatggaagtgggcacagaacagactgatagaagatggagatcccccgcccaggggcacttaccgtccgtggcccacttggaggatttccagggcctcatcatcccgcagggcagtagcctagtgcttcaagggaattccaagaggttgccattgtggacacccaaaattatgatcgcggctctggattacgacccaggtgatggccagatgggtggccaaggcaagggccggctggccctaagagcaggcgatgtggtgatggtctacggtcccatggacgaccaaggattctactacggagaactgggaggccacagaggcctggtgcctgcgcatcttttggatcacatgtcgctccacggccattag

SEQ ID NO: 203796 - DNA, 3402 bp, Artificial Sequence
  Description of Artificial Sequence: Synthetic coding sequence
atgcccgtgcaggccccccagtggaccgacttcctgagctgccccatctgtacacagacttttgatgagacaattcgcaagcctatctccctaggatgcggccacaccgtgtgtaagatgtgtctgaacaagctccaccggaaagcttgcccattcgatcagaccactatcaataccgacattgaacttctcccggtgaatagcgctctccttcaactggtaggcgcccaggtccccgagcagcaacccatcactctatgctccggtgtcgaagacactaagcattatgaagaggctaaaaaatgtgtggaagagctcgctttgtacctcaagccactatcctctgcccgcggagtgggccttaattcaaccactcagagcgtactgtcacgcccaatgcagaggaagcttgtgaccctggtccactgccagctggtagaggaagagggcagaatccgcgcgatgagagctgctcggtccttgggcgaaagaactgtgacggagctcattctgcagcatcagaacccgcagcagctctctagtaacctctgggccgcggtcagagcccgaggctgccaatttctcgggccggccatgcaggaggaagcgctgaagctggtgcttctcgcactggaagacggatcagccctgtctcgcaaagtcctggttctctttgttgtgcagcgactggagccccggttcccacaagcctctaagacatcaatcggccacgtggttcagctgctgtaccgcgcaagctgttttaaggtaaccaaaagggacgaggattccagtctgatgcagctcaaggaagaattccggacctacgaagctctgagaagagagcacgactcccaaattgttcagatcgccatggaggcaggcctgaggatcgccccagatcaatggagttctttgctatatggggatcaaagtcacaaatcacatatgcagtccattatcgacaagttgcaaacacccgcaagtttcgcgcagagcgttcaggaactgaccatagcgctccaacgcaccggtgatcctgctaatttaaataggctccggccacacctggagctgctagctaacatcgatccaagcccagacgccccacccccaacttgggaacagctggaaaacggtttagtggcagtgaggactgtggtgcatggtctggtggactatatccagaatcatagcaagaagggcgccgatcaacagcagccaccgcagcactcaaagtacaagacctacatgtgcagagatatgaagcagaggggtggatgcccacggggagcttcgtgtaccttcgctcattcccaggaggagttggagaagttcagaaaaatgaataagcgactcgtcccaagacgacctcttagtgcaagcttagggcagttaaacgaggtggggctgccctctgcagccatcctaccagatgagggagctgtcgacctccccagtcgcaaacctccagcactgcccaacggaatcgtaagtaccggaaacacagttactcagctgatcccccgtggaactgatccctcatacgactcctctttgaaacccggtaagatcgatcatctgagctcatctgctcccggaagtccccccgatctcttggaatccgtgcccaaatccatctccgccctgccagtgaatccacattcaattccgccacgagggccagcagacctgccccctatgcctgttacaaaacccctgcagatggtgcctaggggcagtcagttgtacccagctcagcagactgacgtttactaccaggaccctaggggcgctgcaccgcctttcgaacctgccccctatcaacaaggtatgtattatacgccaccacctcaatgtgtgtcccggttcgtgcggcctccacctagcgctcccgagcccgctcccccctatctggatcactatcctccttacttgcaagagagagtagtgaattcccagtacggtacacaaccccagcagtatcctcctatctaccctagccactatgacgggagacgggtctatccagctcccagctatacccgcgaagagatctttagggaaagccctatccccatagaaattccgcctgccgcggttccaagttatgtacccgaaagcagagagcggtaccagcagatcgaaagctactatcctgtggcgcctcacccaactcaaattcggccctcctatctgcgggaacccccctactcaagacttccccctccgccacagccacatccctcactggatgaattgcaccgcaggcggaaagaaattatggcccaacttgaagaaaggaaggtaatctctccaccaccttttgccccatcgcccactcttcctcccacctttcacccggaagaatttttagatgaggaccttaaagtggcgggcaagtataagggcaatgattacagtcagtacagtccttggtcctgtgataccatcggcagttacatcggaactaaagacgcaaagcccaaagacgtggtggctgccggctcagtagaaatgatgaacgtggagtccaagggaatgagggatcaacgcctggacttgcagaggcgggccgcggaaacgtctgacgacgacctcatccctttcggggatagacccaccgtgtcccgcttcggagctatatcacggacatcaaaaaccatttaccagggggccggacccatgcaagccatggcccctcagggcgcacccactaagagcatcaatatcagcgattacagtccatacggcacccatggaggctggggcgctagcccgtacagcccacaccagaacattccctctcaggggcattttagtgagagggagcgcatctcaatgtcagaagtggccagtcacggcaaacctttgccgtctgcggagagagaacagctgaggttagagctccagcaacttaaccaccaaatttcgcagcagacgcagctgcggggactggaggcagtgtctaatcgcctggtgcttcagcgcgaagctaacacattggctggacaaagccaaccacctccacctccaccaccaaagtggccgggcatgatttccagcgagcagctgtcactggagctccaccaggtcgagcgggagattggaaaacgcactcgagaattgtccatggaaaaccagtgttctttggatatgaaatccaaattaaacacttcaaaacaagcggagaacggtcagcccgaacctcagaacaaggtacctgccgaggacttgacactgacatttagcgatgttcctaatggatccgcccttacacaggaaaacatctcacttttatcaaacaaaacttcatcattaaacctgtccgaggaccccgaaggtggcggtgacaacaatgactcacaacggtccggcgtgaccccatcaagtgcgccttag

SEQ ID NO: 203797 - DNA, 3378 bp, Artificial Sequence
  Description of Artificial Sequence: Synthetic coding sequence
atgcccgtgcaggccccccagtggaccgacttcctgagctgccccatctgtacccagaccttcgacgaaacaattaggaagccaatctcattggggtgtggacatacagtgtgcaagatgtgtctcaacaaacttcaccgcaaagcatgtccatttgaccagactaccatcaacacagacattgagctcctccctgtaaactcagccctcttgcagttagtgggagctcaggtccctgagcagcaacctattactctctgctccggggttgaggatacgaaacactacgaggaagctaaaaaatgcgtggaggagctggccctctatttaaagccactttcctccgccagaggcgttgggttaaattccacgacacagagtgttctttcacgcccgatgcaaagaaagctggttactttagttcactgccaactggtggaagaagaaggtaggatccgcgcaatgcgcgcggcaagaagcctgggtgagaggactgttacagagcttatacttcagcaccaaaacccccagcagcttagcagtaacctatgggccgcggtgcgagctcgagggtgccagttcctggggcctgccatgcaggaggaggcactgaagctagtgttgctggccttggaggacgggagcgcactctctagaaaggtactggtgctctttgttgtccaaagactcgaaccccgattcccccaagctagcaagactagcatcggacatgtggtccaacttttatacagagcatcctgtttcaaggtgactaaaagggacgaagacagctccctgatgcagcttaaggaagaattcaggacatacgaggccttgaggcgggaacatgatagtcagattgttcaaatcgccatggaagccggcttgcggattgctccagaccagtggtccagcctgttatacggagatcagtcccacaagagtcatatgcagtctataatcgataagctgcagactcccgctagctttgcccaaagcgtgcaggagctcacaatcgcacttcagcgcactggggatccagcaaacctgaaccggctgcggcctcacctcgagcttctggccaatatcgacccctctcctgacgcccccccacctacctgggaacagctggagaacggtctcgtcgcagtgcggactgtagtccacggcctggttgactatattcagaaccacagtaagaaaggcgccgaccagcagcagccaccccagcacagtaaatataaaacatatatgtgccgggacatgaagcagaggggggggtgcccacgcggggcgtcctgtactttcgcccacagccaggaagagctcgagaaattccggaagatgaataaacggctcgtaccgcggcggcccctgtccgccagtttggggcaattgaatgaggtcggactgccaagtgctgccattttgccggacgagggagccgttgacctcccgtccaggaagcccccggccctgccaaatggtatcgtgagcaccggcaacacagttacacagttgataccccggggaacagacccctcctacgattcatcgctcaaaccaggaaaaatcgatcatttatcaagctcagccccaggctcccctcctgatctgcttgagtccgtccccaagtccatttccgcactacccgtcaatccccacagcatcccccctcgagggccggctgacctcccacccatgcctgtcacgaaaccactacagatggtacccaggggcagccagctctaccctgcccagcaaacggacgtgtattaccaggatccgcggggcgccgccccacccttcgagccagcaccataccagcaagggatgtactacactccaccacctcagtgtgtgagtcgcttcgttcgccccccgccctcagcaccagagcctgctccaccatacctcgatcattatcccccctatctccaggagcgagtcgttaactcccagtacggtactcagcctcagcagtacccaccaatataccccagccactatgatggccggagagtgtacccagccccaagctacacacgcgaagaaattttccgagagagtcctataccgatcgagattccgcctgcagctgtgccatcttacgtcccagagagcagggagcgatatcagcaaatcgaaagctactatcccgttgctcctcatcctacgcagattcgcccatcatatttgagggaaccgccatactctcgacttcccccgcccccccagccccatccctctctggatgagctacatagaagacgtaaggaaatcatggcacagctcgaagagcggaaggtgatatcacctcctccttttgccccatcccccaccctcccccctacgtttcaccccgaggaattcctcgatgaggacctcaaggttgccggtaagtataaggggaacgactacagccagtactccccctggtcatgcgatactattgggagttacatcggtacaaaggatgcaaagcccaaagatgtggttgcggctggcagcgtggagatgatgaacgtagagagcaagggcatgagggatcagaggctggaccttcaacggcgtgccgccgagaccagcgacgatgatctgatcccatttggggacagaccaacagtgagccggtttggtgccatctctaggaccagcaaaactatatatcagggagctgggcctatgcaagccatggccccccagggagcgccgaccaagagcatcaatatttccgactatagcccctatgggactcacggcggctggggcgcctccccttactcgcctcaccagaatattccctcccagggtcatttctctgagcgggaaaggatctcaatgtctgaagtagcctcgcacggcaagccgctcccctctgctgagcgcgagcaattgagattagaactgcagcaactgaatcaccaaatctcacagcagacccagctgcgtggactcgaaagggaagctaataccttagcaggacagtcccagccccctccccccccccccccgaagtggcctggcatgatcagttcagaacagctctctctcgaactgcatcaggtggagagggaaataggaaagagaacccgggaattgtctatggagaaccagtgctcactggacatgaaatctaagctcaacactagtaagcaagcagaaaacggccagcctgagccccagaacaaagtgcctgcagaagacctgacccttactttttcgtccgacgtgcctaacggaagcgcacttacccaggaaaacatatccctgctgtctaataagaccagctccctcaatctgtcggaggatcctgaaggaggcggagacaataatgactctcagcgaagtggcgtgacaccaagtagcgcaccatag

SEQ ID NO: 203798 - DNA, 3402 bp, Artificial Sequence
  Description of Artificial Sequence: Synthetic coding sequence
atgcccgtgcaggccccccagtggaccgacttcctgagctgccccatctgcacgcaaaccttcgatgagactatcaggaagccaataagcctaggatgtgggcacactgtgtgtaagatgtgtctgaataaactgcaccgaaaggcttgtcccttcgaccagacgacgatcaacacagatattgagctgttgccagtgaacagcgccctgctgcagttagtgggagcacaggtcccagaacagcagccaatcacactctgtagtggagtcgaggataccaaacactatgaagaggcaaaaaaatgtgtcgaagagctggctttatacctcaaaccactaagctccgctagaggcgttggtctgaacagcactactcagtctgtcttaagtcgtccgatgcagcggaagctggttacgctggtacactgtcaacttgtcgaggaggagggccggatccgcgccatgcgcgcagcccgctcattaggcgagagaaccgttaccgagcttatccttcagcatcagaatcctcagcagttgagttcaaacctgtgggccgctgtacgagcacgtggctgccagttcctaggcccggctatgcaagaagaagcgttgaaattggtcttgctcgcactcgaggatggctccgcactctctagaaaagttctggtcctttttgtagtacagcggctcgagccaagatttcctcaggcctccaagacatcaatcgggcatgtcgtccagttgctgtaccgtgcctcgtgcttcaaggtaacaaaaagggacgaagactccagcctcatgcagctgaaggaagagtttaggacatacgaggctcttcggcgggagcacgacagccagattgtccagattgccatggaggcaggcctgcggatcgcccccgaccaatggtcttcccttctgtacggcgaccagtctcacaagtcccacatgcagagtatcattgacaagttgcagactccagcctccttcgcccaaagtgtgcaagaactaactattgctttacaacgaacaggtgatcctgcgaatctgaatcgcctacgaccccatctggagctgctggcgaacattgacccttctcctgacgcacctccaccaacgtgggagcagcttgaaaacggcctggttgccgtcaggaccgtggtgcatggcctggttgattacatccagaatcactcaaagaagggcgcggaccagcagcagcccccacagcactctaagtataaaacatatatgtgtcgcgatatgaagcagcgcgggggctgtccccggggggcctcctgcaccttcgcccactcacaggaggagctggaaaagttcaggaagatgaacaagcggttagtgccccgccgcccactgtccgcctctcttgggcagctcaacgaggtgggcctcccgtcagccgcaatcctacctgacgagggtgctgtggacttaccctcccgaaagcccccagcgctcccaaacgggattgtaagtactggaaacacagtgactcagcttattccaagaggtacagacccaagctatgacagctccctcaaaccagggaaaatcgatcacctgagttccagtgctccgggcagcccacccgacctgctagaaagcgtgcccaaaagcattagtgcccttccagtaaacccacactcaataccccctaggggccctgccgatcttcctcctatgcctgtaacaaagcccttgcaaatggtgccccggggatcccagctttaccccgcccaacagactgatgtgtattaccaggacccccggggcgcagcaccgcccttcgagccagcgccttaccagcagggcatgtactatactccccctccccagtgcgtgtcgcgattcgttagaccccccccttcagcacctgagccagcacctccatatctagatcactacccgccttacctgcaggaacgagtcgtcaattcacagtacggaacgcagcctcagcagtacccaccaatctacccaagtcattacgatgggcgaagggtgtatcccgctcccagttacacgcgtgaggagatttttagagaatcccccatcccaatcgagattccccccgcagccgtgccttcctatgttccagaatcaagagagcgttaccagcaaatcgagagctactacccagtcgcgccacaccccacgcagatccgaccctcctatctgagagagcctccctattccagacttcctcctcctccccagccgcatccgagcctcgatgaactgcaccgcaggcggaaagagatcatggctcagctggaggaacgcaaagtgatcagcccacccccatttgccccatctcctactttgcctcctacatttcaccctgaggagtttctggacgaagatctgaaggtggctggtaagtacaagggcaacgactactctcagtactcgccctggagctgcgacacaattggttcctacatcggtactaaggacgccaaaccaaaagacgtggttgccgccggctcagtcgaaatgatgaacgtagaaagcaaaggaatgagggaccagagactggatctccagagacgagctgcagaaacctctgatgacgatctgattcctttcggggatagaccaacagtgtctcggtttggggctatctctcgaacatcaaagacaatctatcagggcgccgggccaatgcaggccatggcaccgcagggcgctcccacaaagagtatcaatatcagtgattacagtccgtacggcacacacggaggctggggggcgagtccctattcgccgcaccaaaatataccctctcagggacacttctctgagcgtgagcgcatctctatgtctgaagtcgccagccacggaaaaccgctcccgagcgccgagagagagcagctcaggctagagcttcaacagttgaaccaccaaatttctcagcaaacacaactgcggggtctggaagcagtcagcaataggttggtcctccagagggaagccaacacgctggccggccagagtcagcctcccccacccccgcctcctaaatggcctgggatgattagtagtgagcagttaagtttggagctgcaccaggttgagagggaaattggtaagcggactcgagagctctcaatggagaaccagtgtagcctggacatgaagtccaagctaaatacttcaaagcaggccgagaacggccagccggaaccccagaacaaggtgccagcagaggatctcactctgacatttagcgatgttcctaatgggtccgctctcacacaggagaatatctcacttctttccaacaaaacatcatcccttaacctatccgaagatcctgaaggaggcggcgacaataatgattctcaaagaagcggcgtgacgccatcctccgctccatag

SEQ ID NO: 203799 - DNA, 984 bp, Artificial Sequence
  Description of Artificial Sequence: Synthetic coding sequence
atgtgggccacctgctgcaactggttctgcctggacggccagcccgaagaggtacctcccccacaaggagctagaatgcaggcctattccaatccgggttatagtagttttccctctccaactggtctcgaaccgagctgtaaatcttgcggggcacacttcgccaataccgctaggaagcagacttgcctggactgcaagaagaatttctgtatgacctgtagttctcaggtgggaaatggaccccggttgtgtctcctgtgtcaaagattccgggccacagcctttcagcgcgaggagctcatgaaaatgaaggttaaagatctccgcgactacctgtctttgcacgacattagtaccgagatgtgtagggaaaaggaggaattggtgcttctcgtgctgggccagcagcctgtgatttcgcaagaagatagaacccgggctagcactctgtctcctgatttccccgaacagcaagcgtttctgacccagcctcactcatccatggtccctccaacgagtcccaacctgccgtcaagtagcgcccaagctacttccgtgccccctgcccaggtgcaggaaaatcagcagagtatcgatagtgaagactccttcgtacccgggaggcgggcatctctgtccgacctgactgacctggaagatattgaagggttaaccgtccgtcagctgaaggaaatcctggccaggaactttgtcaattataagggttgttgtgaaaagtgggagctgatggaacgggtgacacgactgtacaaggaccagaagggcctgcagcatctagggggggcggttccaagcgggctggaagagaacctctgcaagatatgcatggactcacccattgattgtgtcctgctggagtgtgggcacatggtcacatgtactaaatgtgggaagcgcatgaatgaatgcccaatttgtaggcagtacgtcattcgggccgtacacgtgttcaggtcttag

SEQ ID NO: 203800 - DNA, 1092 bp, Artificial Sequence
  Description of Artificial Sequence: Synthetic coding sequence
atgtgggccacctgctgcaactggttctgcctggacggccagcccgaggaggtgcccccgccccagggggcgcgaatgcaggcctattccaatccagggtattcatccttcccatcacccacggggttagaacccagctgcaagtcttgcggtgctcacttcgcaaacactgctagaaaacagacctgcctggattgcaagaaaaacttctgtatgacctgttcttcgcaggtgggcaatggaccgcgactgtgtctgttatgtcaaaggtttcgcgccaccgccttccagagagaggagcttatgaagatgaaggtgaaagacctcagggactacctctcattgcacgatatctcgactgagatgtgtcgcgagaaagaggagctcgttctgcttgtgctggggcagcagccggtcatcagtcaggaggataggactcgtgcttccaccctaagcccagacttccccgagcagcaggcattcctgacccagcctcattcttccatggtgccacctacttcgccaaacctgccatcttcaagcgctcaggcaacttccgtgccgccggcccaagtgcaagagaaccagcaagctaatggacacgtaagccaggatcaagaggagcctgtttatctggaatcagttgctcgggtgccagctgaggacgaaacacagagcattgactccgaagattcgtttgtccccggccgtcgggcatcattgtcagacctgacagatcttgaggatattgagggtttgacagttcggcaacttaaggagattctcgcacgtaactttgtaaactacaaaggctgttgtgaaaagtgggagcttatggagcgagtgacgcgcctgtacaaagatcagaagggccttcagcacctggtgtctggagccgaagaccagaatggcggagcagtgccaagtggtctagaggagaatctgtgcaagatctgcatggacagccccattgactgtgtgttactggagtgtgggcatatggtgacatgtaccaagtgtggaaagcgcatgaatgagtgtccaatatgcaggcagtacgtgatcagggctgtccacgtcttccgatcctag

SEQ ID NO: 203801 - DNA, 1068 bp, Artificial Sequence
  Description of Artificial Sequence: Synthetic coding sequence
atgtgggccacctgctgcaactggttctgcctggacggccagcccgaagaagttcctccacctcagggggcacgaatgcaggcttattctaacccaggctattcaagtttcccttcgccaactggccttgagccgtcatgcaagtcttgtggggctcattttgcgaatactgcacggaaacaaacatgtttggattgcaagaaaaatttttgtatgacgtgctccagtcaggtgggtaatggccctcgcttgtgtttactctgtcaaagatttagggccacagctttccaaagagaggaactgatgaagatgaaagtcaaagacctacgtgactatctgtccctccacgatatcagcacggagatgtgtagagagaaagaagaactggtcctgctcgtactcggtcagcagccagtaattagccaggaagacaggaccagagcgagcacgctctccccggacttccctgagcaacaggcgttcctcacgcagccccattcgagtatggtgccaccaacttcccccaacctcccgagttcatctgctcaggctacttcagtgccgcccgcgcaggttcaagagaatcagcaggcaaatggccatgtctcccaagatcaagaggaacccgtatatctggagagtgtagcacgagttcccgccgaggacgaaacacaaagcatagattctgaagacagttttgtgccaggtcgacgagccagcctgagcgacctcaccgatttggaagatatcgaaggactgactgtgaggcagcttaaagagattctcgcacgcaactttgtcaactacaaagggtgctgcgaaaagtgggagctgatggaaagagtaactcgcctgtacaaagaccagaagggtctccagcatttaggcggagctgtcccaagcggccttgaggaaaatttatgcaaaatctgtatggactccccaatagactgcgtgttgttggaatgcgggcatatggtgacatgcaccaagtgcggaaagcgcatgaacgaatgtccgatctgcagacaatacgtgatccgtgccgtgcacgttttccggtcctag

SEQ ID NO: 203802 - DNA, 1092 bp, Artificial Sequence
  Description of Artificial Sequence: Synthetic coding sequence
atgtgggccacctgctgcaactggttctgcctggacggccagcccgaggaagtccccccgccacagggcgctcggatgcaggcctactccaacccaggatattcttcattcccaagtcccacaggcttagagcccagttgtaagagttgcggggcacacttcgctaatacagcaagaaaacaaacctgtctcgactgtaagaagaacttttgcatgacctgttcctctcaagtgggaaacggtccccggctttgtctgttatgtcagcggtttagagccacggcatttcagagggaggagcttatgaaaatgaaagttaaggatctgcgggattatctctctctgcatgatatttctactgagatgtgccgtgaaaaagaggaacttgtgctgctggtgttgggccagcagcccgtgatatctcaggaggatagaacgcgggcctcgacgctgtctcctgatttccctgagcagcaggcattcctcacccagcctcattcctccatggtcccacccacctctccaaatctgccaagcagttccgctcaggccacgagtgtgcctcctgcccaggtccaggagaaccagcaggccaacggtcacgtcagtcaggaccaggaggaacctgtgtatttagagtcagtggctcgtgttccagctgaggacgagactcagtcgattgatagcgaagactcattcgtgccaggcaggcgcgcgtccctgtccgatcttactgacctggaagatattgagggccttactgtgaggcagcttaaagaaatcttggctcggaactttgtgaattacaaggggtgctgcgagaaatgggagttgatggagcgcgtgacgaggctatataaggaccagaaggggctacaacacttagtgagtggggctgaagatcagaatggcggggctgttccctcgggactggaagagaatctttgtaaaatatgtatggacagcccaattgattgcgttcttctcgagtgcggtcacatggtgacttgcaccaaatgcggcaaacgcatgaacgaatgtcccatctgtaggcagtatgtcatcagggccgtgcacgtgtttagaagttag

SEQ ID NO: 203803 - DNA, 816 bp, Artificial Sequence
  Description of Artificial Sequence: Synthetic coding sequence
atgtgggccacctgctgcaactggttctgcctggacggccagcccgaagaggtcccaccaccccagggggcgaggatgcaagcttactccaaccctggctatagcagtttcccgtctcctaccgggttggagccttcctgtaagtcatgcggtgcgcacttcgccaacaccgcccggaaacagacctgcttggactgtaaaaagaatttctgtatgacctgttcctcccaggttggaaatggacccaggctctgccttttgtgtcagaggttcagggcaacagccttccagagagaggaacttatgaagatgaaggtaaaggatctgcgggattacctttctttacatgacatctcgacagagatgtgccgcgaaaaggaggagttagtgctgcttgtcctgggacagcaacctgttattagtcaagaggacagaactagggccagcacgctttccccagatttcccggagcagcaggccttcctgacccagccgcattccagtatggtgccccccacctccccaaacctgccctctagcagcgcgcaggcaacctccgtgcctccagctcaggtacaggagaaccagcaagcgaatggccatgtcagccaggaccaggaggagccagtctacctggaaagtgtggcccgcgtgcccgccgaagatgaaacgcagagtatcgatagcgaagacagtttcgtgcctggccgcagggccagtctgagcgaccttactgatttggaggatatcgagggcctaacagttagacagctgaaggaaatccttgcccgaaattttgttaattacaaagggtag

SEQ ID NO: 203804 - DNA, 402 bp, Artificial Sequence
  Description of Artificial Sequence: Synthetic coding sequence
atgtgggccacctgctgcaactggttctgcctggacggccagcccgaggaagtgccccccccccagggggcacggatgcaggcttactctaatccaggctactcttcatttccctctcccaccggcctggaaccatcttgtaagagttgtggcgcacatttcgccaatacagcgagaaaacagacctgtttagactgtaagaaaaacttctgtatgacctgctccagccaggtgggtaacggccctagattgtgtcttctgtgtcagagatttcgcgctactgcgttccagcgcgaggagctcatgaaaatgaaggtgaaagatctgcgcgactatctgtcactacatgacatttctacggaaatgtgtagagaaaaggaagagctcgttctccttgtctag

SEQ ID NO: 203805 - DNA, 570 bp, Artificial Sequence
  Description of Artificial Sequence: Synthetic coding sequence
atgtgggccacctgctgcaactggttctgcctggacggccagcccgaggaagtgccaccccctcagggcgctcgtatgcaggcctatagcaaccccggctattcttcattcccatctccaacaggactggagccttcctgcaagagctgtggggcccatttcgcgaacacagctagaaaacagacgtgtctcgactgtaaaaagaatttctgtatgacatgcagctctcaggttggcaacggacctaggctttgcctcctctgtcagcgctttcgggctacagctttccagagagaggagctgatgaagatgaaagttaaggatttgagagactacctctctctgcacgacatcagcactgaaatgtgtcgagagaaagaagaactggtgttactggtgttaggccagcaacctgtgatctcgcaggaggacagaacccgagcctctaccttgtcccccgactttcctgagcagcaggctttcttaacacagccccacagtagcatggtgccccctaccagtcccaaccttcctagtagcagcgcacaagctacttccgtgcccccatag

SEQ ID NO: 203806 - DNA, 138 bp, Artificial Sequence
  Description of Artificial Sequence: Synthetic coding sequence
atgtgggccacctgctgcaactggttctgcctggacggccagcccgaggaagtgccgcccccccagggcgcgagaatgcaagcctattccaaccccggatactctagtttccccagtcccacaggcttagagccatag

SEQ ID NO: 203807 - DNA, 2124 bp, Artificial Sequence
  Description of Artificial Sequence: Synthetic coding sequence
atgagcggcagccggcaggccggcagcggcagcgccggcaccagcccagggtcctctgccgcctccagcgtgacctctgcgagtagttcattgagttcctcaccaagcccaccaagcgtcgctgtgtccgccgcagctcttgtgtccggtggcgtggcccaagctgctggctccgggggtctgggggggccagtgcgtccagtgctggtcgcccctgccgtttccgggagcggcggaggtgccgtgagcactggcctatccagacacagctgcgcagccaggccttccgccggtgtcgggggttcttcatcatcactgggctccggatcacgtaaacgacctcttctggcacccctgtgtaacggcctgattaacagctacgaggataagagtaacgattttgtgtgtcctatctgcttcgatatgatcgaggaagcatacatgacgaaatgcggccattctttctgctacaagtgcatccatcaatccctggaagacaacaatcgctgtcccaagtgtaattatgtagtcgataacatcgaccacctgtatccaaactttctggtgaacgaattaattctgaaacagaagcagagatttgaggagaaacgctttaaacttgaccatagcaacggccaccgttggcagatttttcaggattggctgggtacagatcaggacaatctggacctcgctaacgtcaacctcatgttggaactccttgtccaaaaaaagaagcagctcgaagccgagagccatgcagctcagctgcagatcctgatggaatttctcaaggtggcccgccgtaacaagcgggaggagatgtcggggctgtattcacccgttagcgaagatagtaccgtgccccaatttgaggcaccttccccatctcactcaagtatcattgactctacagagtacagccagccacctggattctccggaagcagtcaaacaaaaaagcaaccgtggtacaactccacccttgcttcacggcggaagagactgacagcacactttgaagacctggagcagtgctatttcagtacgcgcatgtcacgtatcagcgatgactcacgcaccgccagtcaattagacgagtttcaggagtgtctatctaagttcacacgctataactccgtccggccgttggctaccctcagttatgcctctgacctgtacaatggctcttccatagtgagcagtattgagttcgaccgtgactgtgactattttgcaattgcgggtgtaacgaagaaaatcaaagtgtacgagtatgataccgtgattcaggacgccgtcgacatacattatcccgagaacgaaatgacttgcaattcaaagatcagctgcatctcgtggagcagttaccacaaaaacctgctcgcctccagcgattacgagggcactgtgattctttgggacggctttactgggcagcggagcaaggtctatcaggaacatgagaaacgctgttggtctgttgactttaacctcatggatcccaaactgctcgcgtctggcagcgacgatgcaaaagtgaagctgtggtctacaaacttagataactctgtcgcgtccattgaggcaaaagctaatgtgtgttgcgtgaaattcagtccatcttctagataccacctcgcattcggttgcgcggatcactgtgtacactattatgacttgaggaacaccaaacagcctatcatggtgtttaagggccataggaaggcagtcagttatgccaaattcgtaagcggagaggagatcgtctctgcgtctaccgattctcagcttaaattgtggaacgtgggcaagccatattgcttgagaagtttcaagggtcatatcaatgagaaaaatttcgtgggactggctagtaatggtgactacattgcatgcgggtctgaaaataattccctatatctgtattacaagggcttaagcaagactctgttaacctttaaattcgatacggtcaaatctgtgcttgacaaagaccgaaaggaggacgacaccaacgaattcgtctcggcagtgtgttggagggcgcttccagatggggagagtaatgtactgattgcggccaattcccaaggcaccattaaggtgctcgagctcgtctag

SEQ ID NO: 203808 - DNA, 1521 bp, Artificial Sequence
  Description of Artificial Sequence: Synthetic coding sequence
atggagttcctgaaggtggcccggcggaacaagcgggagcagctggaacagatacagaaggagctctccgtccttgaggaggatatcaagcgggttgaagagatgtccggcctatattcccctgtgtccgaagactctacggttccacaatttgaggccccttctccatcccattcctctatcatcgactcaaccgagtattctcagccccctgggtttagcgggtcgtcccaagccggtgttcagtggcgctacctcgggtcactgcagcccccgccgccccgctacaagcgtttcagttgcctgacactgccaagctcctgggattacagaagactacccccccatttgaccaaaaagcaaccgtggtataattctaccctggcttcccgccgcaagaggctgactgctcacttcgaagatctcgagcaatgttatttttcaacacgcatgagccggatctctgatgacagtagaacggctagccaacttgatgaatttcaagagtgtctctcaaagtttactcggtacaacagtgtgagacccctcgccactctgtcatacgcaagtgatctttataatggaagctctatcgtttcaagtatcgaattcgacagagactgtgactattttgccatagctggcgtgaccaagaaaattaaagtgtacgagtacgatactgtgattcaggatgcggtggacatacattacccggaaaacgagatgacatgtaactcgaagatttcttgcattagctggagttcataccacaaaaatctcctggccagcagtgactatgaaggcaccgtgatcctttgggacggcttcaccgggcagcggtccaaggtgtatcaggagcacgagaagcgctgctggtctgttgacttcaatctgatggaccccaagcttctggcatcagggagtgacgatgctaaggtgaagctatggagcactaaccttgataattctgtcgccagcatagaggcaaaagctaacgtgtgctgtgtcaagtttagtcctagtagtagatatcacctggcctttgggtgtgccgatcactgcgttcactattacgatcttcggaacaccaagcagcccatcatggtgttcaagggccacaggaaggctgtgtcctatgctaaatttgtatccggagaggaaatagtttcagcaagtaccgattcccagcttaaactgtggaacgtgggtaaaccgtactgtttacgcagtttcaaaggacatattaacgagaagaacttcgtcggattggccagcaatggcgactacatcgcttgcggcagcgaaaacaattcattgtacctgtattacaaagggctgagcaagaccctgttgacgtttaaattcgatactgtgaagtcagtgcttgataaggaccgaaaggaggacgataccaatgagttcgtatctgccgtctgctggagggctttaccagatggagagtccaatgtgttgattgctgcaaactcccaaggtactattaaagttctggctcttttatag

SEQ ID NO: 203809 - DNA, 2196 bp, Artificial Sequence
  Description of Artificial Sequence: Synthetic coding sequence
atgagcggcagccggcaggccggcagcggcagcgccggcaccagcccaggctcaagtgccgcttccagtgtcacctctgcttctagtagcctttcctcatcccccagcccgccctcagtggccgtctcagctgcagcactcgtatccggtggagtggcacaggccgccgggtccggcgggctgggcggacctgtccgcccagtgctcgtggctccagccgtgtcagggtccggtggcggcgcagtgtccaccggcctcagccggcacagttgcgcagctaggccttcagccggcgtgggtggctcttcctcttcactgggctcagggagccgcaaacgcccacttctggcccccctctgtaacggacttattaacagttatgaagacaagagtaacgacttcgtctgtccaatttgtttcgacatgatcgaggaagcttacatgaccaaatgcgggcattctttctgttacaagtgtattcaccagtctctggaggacaacaataggtgtccgaagtgtaactacgtggtggacaatatcgatcatctgtaccccaactttcttgtcaacgagctgatcctcaaacaaaagcagagattcgaggaaaagcggtttaagttggatcattcagtgtcgagcaccaatggccataggtggcagatctttcaggattggctgggtactgatcaggacaatcttgatctggcgaacgtcaatctgatgctggagctgctggttcagaaaaagaagcaactggaagcagaaagtcacgccgctcaacttcagatcctgatggaatttctcaaagtcgcgagacgaaataagcgggaacagttagagcaaatccagaaagagttgtccgttctggaggaagacattaagagggtcgaagaaatgagtggattgtatagtccggtatctgaggattccacggttccccagttcgaagccccctctccatctcatagctccatcattgattcgacagagtatagtcagccacccggcttcagtggttcctctcagactaaaaagcagccttggtacaattccaccctggcatcccggagaaagcggctcacagctcacttcgaggacctggagcagtgctacttctcgactcgaatgagcaggatctctgacgatagtcgcaccgctagccagctggatgagttccaggaatgcctcagcaagttcactagatacaattctgtacgacctctggccactctctcgtatgcatctgacttatacaacggcagctccattgtcagtagtattgagtttgaccgcgactgcgattactttgctatcgcgggggtgacgaaaaagatcaaagtttatgagtatgatacggtgatacaggacgcagtggacatccactatccggaaaatgaaatgacttgcaactctaaaatctcctgtatttcctggtcttcatatcataagaacctcttagcctccagtgattatgaaggcaccgttatcctgtgggatggctttaccgggcagaggtccaaggtataccaggaacacgaaaagagatgttggtccgtggactttaatctgatggacccaaaactgctggccagtggtagtgacgacgccaaagtaaaactttggagcacaaatctcgacaattctgtggcctccatcgaggccaaggcaaatgtgtgctgcgttaagttctccccttcttcaagatatcacctcgcatttggatgcgctgaccactgcgtacattattatgatttgcgtaatacaaaacaacccatcatggtctttaaagggcatcggaaggctgtatcctatgctaagttcgtttccggtgaggagattgtgtctgcttcgacagactctcagctcaaactgtggaatgtgggaaaaccttactgtctgaggagttttaaagggcatatcaacgaaaaaaattttgtcggactggcctctaacggggactacattgcctgtggctccgagaataattcactgtacctgtattataagggcttaagtaagaccctgctgacctttaagtttgatacggttaagtccgtgctcgacaaagaccgtaaagaggacgacactaacgaattcgtgagcgcagtatgctggcgggctctgccggacggcgaaagcaatgttttaattgccgccaattcccagggcaccattaaagtgctcgagttggtatag

SEQ ID NO: 203810 - DNA, 774 bp, Artificial Sequence
  Description of Artificial Sequence: Synthetic coding sequence
atgagcggcagccggcaggccggcagcggcagcgccggcaccagcccgggaagttcagcagccagctcagtgacctccgcgagttcatctttgtccagctcaccctccccgcctagcgtggcggtgagtgcggcggctctggtgtccgggggcgtggctcaggctgctggatcaggcggacttggtgggcctgtccgtccggttcttgtggcccctgctgttagtgggtccggcggcggtgccgtgtcaaccggcctcagcaggcactcctgcgccgccaggcctagtgcaggggtaggaggcagttccagcagtctcggaagcggatcaagaaagagacccctattggccccactgtgcaacggtctcataaattcttacgaggacaaatcaaacgactttgtgtgtcccatttgttttgatatgattgaagaggcttacatgacaaagtgcggtcacagcttctgctacaaatgcatccaccagagtctggaagataacaatcggtgtcctaaatgtaactatgtagtggataatatcgatcacctgtatcccaactttcttgtcaatgagctgatcctgaagcagaagcagagattcgaggagaaacggtttaagttggaccacagcgtttcttctactaacggtcaccggtggcagatctttcaggactggctcggaaccgatcaggataaccttgacttggccaacgttaatctcatgctcgagctgctggtccagaaaaacaagaaaaagaagaaaaaaaagaagtag

SEQ ID NO: 203811 - DNA, 2325 bp, Artificial Sequence
  Description of Artificial Sequence: Synthetic coding sequence
atggcccacgaggccatggagtacgacgtgcaggtgcagctgaaccacgccgagcagcagccggcgcctgcagggatggcttcatcgcagggaggtcccgctctccttcaacctgtccccgctgacgttgtatcaagccagggagttcctagtattcttcagccagcacccgccgaggtgatctctagccaggctacgccccccctgctgcaacctgctcctcagctgtccgttgacctgaccgaagtggaagtgttgggcgaagacacagtggaaaacatcaacccaaggacgtccgaacagcaccgtcaaggatcagacggtaatcacaccatccccgccagctctctgcactccatgacgaacttcatctctggactgcagcgcctacatggtatgttagagttcctgagaccctcctctagcaatcatagtgtcggccccatgcgcacaagacgcagagtgtccgcttcccgtcgagctagagccggggggtcacagagaaccgactccgcccgactgcgagctcctctagacgcctactttcaggtatctaggactcaaccagatctgcccgctaccacctacgacagtgagacgaggaacccggtgtcagaagagttacaggtatcgtccagcagcgatagtgacagcgactcctctgcagagtacggcggcgtggtggaccaggctgaggagtctggggcagtcatcttagaagagcagttagctggagtttctgccgagcaggaagtcacttgtatcgacggtggtaagaccctgcccaagcaaccctcaccccaaaaatccgagccactgctgccatctgcctcaatggacgaggaagagggcgacacctgcacaatatgcctggagcaatggaccaacgctggggaccaccggctgtccgcgttgaggtgcggccacttgtttggctatcgttgcataagcacttggctaaaggggcaagtgaggaaatgcccgcagtgtaacaaaaaggcaaggcatagcgatatcgtagtcctgtatgcccgaactctgcgcgccttagacaccagcgaacaagaacgcatgaagagctctctgctaaaagaacagatgttgcggaaacaggctgagctcgaatcagctcaatgccggcttcaacttcaggtgctaactgataagtgtacacgattgcagaggcgcgtgcaagatctccagaagttaacatctcaccagagtcagaacttgcaacagcctcgggggtctcaggcttgggtgctcagttgctcaccctcttctcaggggcagcacaaacacaagtaccattttcaaaaaactttcaccgtttcacaagcaggaaattgcaggatcatggcctattgtgacgccctctcctgcctggtcatctcacagccaagcccacaggcttcttttctccctgggttcggggtcaagatgctgtcaaccgccaatatgaagtccagtcagtacatcccaatgcatggaaagcagattcgcgggctcgcatttagctcctacctgcggggacttcttctctctgctagcctggataacactatcaaactgacctccctcgagaccaacacagtagtgcagacatataacgcagggcgacccgtatggagctgctgctggtgcttagatgaggctaattacatctatgcaggtctggctaacggcagtattctcgtgtatgatgtgagaaatacttccagtcacgtgcaggagctcgtggcccagaaggcgcgctgtccactggtgagcctgagctacatgccgcgcgctgccagcgcggcttttccctacggaggagtgcttgcaggtactctcgaggacgcctctttctgggaacagaagatggatttctctcactggccccacgtcctccctctcgagcctggaggctgcatcgactttcaaacagaaaacagcagccgacattgtctggtaacttacagacctgataagaaccatacaaccattcgcagcgtgctaatggagatgtcatatagactggatgatactgggaatcccatatgcagctgtcagcctgtccataccttcttcgggggtccgacttgcaaactgctgaccaaaaatgccatctttcagtctccggaaaatgacggaaacattctggtctgtaccggagacgaggccgcaaactccgccctgctctgggacgcggccagcggttctctactgcaggacctccagacggatcagccagtcctagacatttgtcccttcgaggtaaatcggaattcctacctggccacattaactgagaaaatggttcacatttacaagtgggagtag

SEQ ID NO: 203812 - DNA, 792 bp, Artificial Sequence
  Description of Artificial Sequence: Synthetic coding sequence
atggcccacgaggccatggagtacgacgtgcaggtgcagctgaaccacgcagagcaacagcccgcacccgcggggatggcgagttctcaggggggacccgctctgctgcagcccgtgcctgccgatgtcgtcagctcacagggagtcccaagcattctgcagcctgcccccgctgaggtaatctcttcacaggcgacccctccccttctgcagcccgccccccagctctccgtcgatctcaccgaggtggaagtgctgggcgaggacacagtcgagaatattaatcctcggaccagtgagcaacaccgccaaggaagtgatggtaatcacacaataccagcgtccagcctgcactcaatgcccctcgaaccaggggggtgcatagattttcagactgagaattcctcacgccattgcctcgtaacctaccgccccgataagaaccacaccacaatccgttccgttttaatggagatgtcataccgcctggacgacaccggaaaccccatctgctcctgtcagcctgtgcatactttcttcggcggcccaacatgcaaacttctgaccaaaaatgccatcttccagtcacctgagaacgacggaaatattttggtttgtacaggcgacgaagccgcgaactcagccctcctctgggacgcggctagcgggtctcttctgcaggatttgcaaaccgatcagcctgtgctggacatctgccccttcgaggtgaatcgtaacagctatctcgctacacttaccgaaaagatggtacacatctacaaatgggaatag

SEQ ID NO: 203813 - DNA, 2058 bp, Artificial Sequence
  Description of Artificial Sequence: Synthetic coding sequence
atgaaccagagccggagccggagcgacggcggcagcgaggagaccttaccccaggatcataaccatcacgaaaacgagagacgatggcagcaggaacgcctgcaccgcgaggaggcctattatcagtttattaatgaacttaatgacgaggactatcggttgatgagagaccacaacttattggggactcccggcgagataactagtgaggagctgcaacagaggttggacggcgtgaaggagcaactcgcatcccagcccgacctgcgagatggcacaaactatcgagactcggaggtaccaagagaatcatcacatgaagacagtctgttggaatggctgaacactttccgacgcaccgggaatgccacaaggagtggccagaacggcaaccagacatggagggcagtaagtcgaaccaatcccaataatggtgaattcaggttctccctagagatacatgtgaaccatgagaaccgtggattcgaaatccacggggaggattataccgacattcctttatctgactctaatagagaccacacagcaaatcgccagcaacgctcgacgtcccccgttgcccggcgcacccgcagccagactagcgtgaatttcaatgggtcaagctctaacatccctagaacacgtctggcttctcgaggtcagaaccctgccgagggctccttttccaccctcggaaggctgcgcaacggcatcggaggggctgccggcattccccgcgctaatgcctctcggaccaatttcagctctcacaccaatcagtctggtggttctgaactgaggcagcgggagggccagcgttttggcgcagcccacgtgtgggagaacggggcccggtcaaatgtgaccgtccggaacacaaatcagaggctcgagcccatccgattgagaagtacttcgaactctcggagtcgctcccctatccagcggcaaagcggaaccgtgtatcacaatagccagcgtgaatcaagacccgtgcagcagaccaccagacggtcggtgaggcggcgggggcgtacacgtgtcttcttagaacaagatcgagaacgcgaacgtagaggtacagcctacaccccattctctaatagcagactggtgtcccgcatcaccgtggaggagggggaagagtccagccgatcaagcaccgcggtgagaaggcaccccaccataaccctggatcttcaggtacgcaggattcgtcccggcgagaacagagatcgtgacagtatagccaatcgcactagatcaagagtgggtctcgcagaaaatacagttaccattgagagtaactctggcggatttcgaagaacaatttcaaggttagagagatctggcattagaacatatgtgtcgactatcactgtgcccctgaggagaatttctgagaacgagctagtggaaccttcgtccgtagcattgcgctctattttgcgccaaatcatgactggatttggtgagttgtcctcattgatggaggcagattcagagtctgaactgcaacggaatggccaacacttacccgacatgcactcagagctctcaaaccttgggactgataacaatagatcacagcatcgcgaaggctcgtcacaggaccgacaggcacagggagatagtaccgagatgcatggagagaatgagacgacccagccacacacccgtaattcagacagtagaggcggcagacagttgcggaatccgaacaatctggttgaaacggggaccctgccaattctccgactggcccacttctttctcctaaatgagtcagacgacgacgacaggattcggggcctgacaaaagagcaaatcgacaatctttccacgcgccactatgaacataattccattgactctgaactaggcaaaatttgctcggtgtgcattagtgactacgtaaccggaaataaactaagacagcttccctgcatgcacgagtttcatatccactgcattgatagatggttgtcggaaaactgcacatgccccatatgtaggcagcccgtgttgggcagcaacattgctaataatggctag

SEQ ID NO: 203814 - DNA, 2058 bp, Artificial Sequence
  Description of Artificial Sequence: Synthetic coding sequence
atgaaccagagccggagccggagcgacggcggcagcgaggagaccctaccccaggaccacaatcaccacgaaaatgagcgccgatggcagcaggaacggctgcacagggaagaggcatactaccagttcattaatgagctgaacgatgaagattatcgcctaatgagggaccataatctgctgggaacacccggggaaatcacctccgaagagctacagcagcgcctcgatggcgttaaagaacagctggctagccagcccgatctacgtgatggaacaaattatcgggactctgaggtgccgcgcgagtcctctcacgaagactccctgctggagtggttaaatacctttcggcgtacaggtaacgccactaggtcaggtcagaatggcaatcagacgtggcgcgccgtcagcagaacaaacccaaacaacggcgagttcaggttctcacttgagattcacgtgaaccatgaaaatagaggcttcgaaattcacggcgaagactatactgatatacctctgtcagactccaatcgcgatcacaccgccaatcgtcagcagagaagcacttctcccgtggccaggcgtaccagaagtcagaccagtgtgaacttcaacgggtcttcatcaaacatcccccgcacccgactggcttctaggggccagaatccagccgaaggcagcttttctaccttagggagactccggaatggaatcggcggcgctgcgggaattcccagagcaaacgcaagccggacgaacttttcatcacacacgaaccagtccggaggctctgagctgcgacaaagagagggacaacgcttcggagcggcccacgtgtgggaaaacggagcaaggtcaaacgttaccgttcggaacaccaaccagagactggaacctatccgtttacgcagcacatctaactcccggagtaggtctcctatccagcggcagagcggaaccgtgtaccataacagtcaaagggagtcgaggccggttcaacagaccacccgacgttccgttcggcgcagaggcagaacaagagtgttcctagaacaggatagagagcgggagcggcgtggtacagcttacacgcctttcagcaatagtcgtctcgtgtcccgaatcacggtagaggaaggagaagagtcatcaagaagttcaactgccgtacgtcgccacccaactataacacttgatctgcaggtgaggcggattcgacccggtgagaatcgggatcgcgactcaattgccaatcgcacacgaagccgggtagggcttgccgagaacaccgtaacgatcgaaagcaattctggagggtttaggagaactattagccgcctcgagagaagcggaatacggacttacgtttctaccatcacggttcccctacgccggatctcagagaacgagttggtagaaccctctagcgtcgccctcaggtctatcctacgacagatcatgacagggtttggggagttatccagcttgatggaggctgactcagaaagtgaactccaacgcaacggtcagcatctccccgatatgcactcagaattatccaatctgggaacagataacaatcgtagtcagcatcgcgaaggctcatcccaagataggcaggcccagggcgactccaccgagatgcacggagagaacgaaaccactcagccacatacccgtaactcagattcgcgaggcggcaggcagttgagaaatccgaacaacctggtggagactggaacgctaccaattttgagactggcccatttttttctcttaaacgagagcgacgacgatgaccgaattcggggcctaaccaaggagcaaatcgataatctgtccacccgacattacgaacataactcgattgatagcgaacttggtaaaatatgcagcgtgtgcatttcggactatgtcactgggaataagttgagacaattaccctgtatgcatgagtttcacattcactgcatcgaccgatggctcagcgagaattgtacatgtcctatctgcaggcagcctgtgctgggctctaatatcgcaaacaacggctag

SEQ ID NO: 203815 - DNA, 2058 bp, Artificial Sequence
  Description of Artificial Sequence: Synthetic coding sequence
atgaaccagagccggagccggagcgacggcggcagcgaggagaccctaccccaggatcataatcatcacgagaacgagaggcgatggcagcaggaaaggctgcaccgcgaggaagcatactaccagtttataaatgaactgaatgacgaagactatagacttatgcgggaccacaacctgctgggcacccccggagagatcacttcggaagagttgcagcagcggctggatggggtcaaagagcagttggcatcacagccagatctgcgggatgggacaaactacagggatagtgaggtaccgagggagagctctcatgaggattcgttactggagtggctgaacactttccgcaggacaggcaatgctactcgcagcgggcagaatggaaaccagacttggcgcgcagtgtcccgaacgaatccaaataacggcgagttccggttcagtctggaaatacacgtgaaccatgagaatcggggatttgagatccatggtgaggactacacagatatccctctgagcgacagtaatcgggaccataccgccaatagacagcagcgaagtacctcacctgtggctaggcggacacgtagtcaaacgtcggtaaacttcaatggaagctcgtccaatattccccgaacacgccttgcttctcgtggacagaatccggccgagggaagcttttctacccttggcaggcttaggaatggaattggcggagccgcagggattccccgcgccaacgcgagcagaacaaacttctcatcccacactaatcaatccggcgggtctgaactcaggcaacgcgagggtcagaggtttggtgctgcccatgtgtgggaaaatggcgctcggtctaatgtgacagtccgtaacacaaatcagaggctggagccgatccgcctccgaagcacgtccaattcgcgatcgcgcagccccatacaacggcaatcaggcactgtatatcacaactcacagagggagtctcggcctgtgcagcagaccacacgaagaagtgtacggcggaggggtcgcacccgcgtctttttggagcaggatcgggaacgagaaagaagaggaactgcttacacaccattctccaacagtcgcctggtgagcagaatcacagtggaggaaggggaggagagcagccgctcgagcaccgccgttcgacgccacccaactatcactctcgatctccaagtcaggaggattagaccaggtgagaatagagaccgggactccatagcaaacagaacccgctcacgggtgggcctcgcagaaaacacggttacgatagagtcgaattcaggaggattccgtagaacaatctccaggctggaacggtcagggattcgcacatacgtgtctaccattacagtcccattacggaggatttccgagaatgagcttgttgagccttcatccgtggccctgcgatccattctgagacagattatgactggcttcggtgagctgagcagcctgatggaggcagactcagaaagcgagcttcagaggaatggacagcacctgcctgatatgcacagcgagctgagtaatctcggcactgacaacaataggtcgcagcatcgggaggggagttcccaggataggcaggcccagggcgacagcaccgagatgcatggcgagaacgaaaccacccagccacatactcgtaattccgacagccgcgggggccggcagctgcgcaatcctaacaacctggtcgagaccggcacacttccgatactgcggcttgctcatttcttcttgcttaatgagagcgatgatgatgaccggattaggggcttgaccaaagagcagatagataacctcagcaccagacactatgagcacaattctattgatagtgagttaggaaagatttgctctgtttgcatttcggactatgtgactggcaacaagctgcgacagctcccgtgtatgcacgagtttcacatacactgcatagaccggtggctctccgagaattgtacatgtcccatttgtcgccagcccgtgctggggtccaatattgccaacaatggctag

SEQ ID NO: 203816 - DNA, 990 bp, Artificial Sequence
  Description of Artificial Sequence: Synthetic coding sequence
atgcagctggaggtggacaagatgggcaccaagctgggcgagctgttagtgagcagaattacggtcgaagagggcgaagaatcttctaggtcatccaccgccgtgagaagacacccaaccattacgcttgacctacaggtccggcgcatccgcccaggcgaaaaccgagaccgcgactcaattgctaatagaaccagatcacgggtcgggctcgccgagaacacggtcactatcgaaagcaatagtggcggattccgacggaccatctcgagactcgagcgcagcggcatcagaacgtatgtcagcactattaccgtaccactgagaaggatttcagagaacgaactcgtcgagcctagctccgtcgcactccgaagtatcctgaggcaaattatgaccggattcggagaattgtcatctcttatggaagccgactctgaatccgagctgcagagaaacggtcagcacctgccagacatgcattctgagttatctaaccttggcaccgataataatcgctcacaacacagagaagggtcttcacaagaccgccaggctcaaggcgacagcacggaaatgcacggagaaaatgagaccacccagccccataccagaaattctgattcccgtgggggtcgtcagctccgaaatcccaacaatttagtggagacaggcacgctccccatcctgcgcctcgcccacttcttcctgctgaatgaaagcgacgatgatgataggattaggggcctcactaaggaacagatcgataacttaagcacgcgccactatgaacataattcaatcgatagcgaactgggcaaaatatgcagcgtctgtatctcagactatgttacaggcaataagttgaggcagctaccatgcatgcatgagttccatatccattgtatcgatcggtggctgtcggagaattgcacttgtcctatctgcagacagcccgtgctcggtagtaatatcgctaacaacggctag

SEQ ID NO: 203817 - DNA, 1221 bp, Artificial Sequence
  Description of Artificial Sequence: Synthetic coding sequence
atgaccacccccgccaacgcccagaacgccagcaagacctgggagttatctttgtacgaactccacagaaccccacaagaggcaattatggatggcacggagattgcagtgtcacctcggtctctgcactccgaactcatgtgccctatttgcttggacatgttgaaaaataccatgacaacaaaagagtgcttacatcgattctgttctgactgcatagtgaccgcacttaggagcggtaataaggaatgtccaacctgcaggaagaagctagtaagcaaacggtctttacgtcctgacccaaacttcgacgccctgattagcaaaatttacccctctcgcgaagaatacgaggcacaccaggatcgtgttttgatccggcttagtcgactgcacaatcagcaggctctatcctccagtattgaagagggcctcagaatgcaggccatgcatagggcacagcgggtgcggaggcctatcccaggaagcgaccagactaccaccatgtcagggggtgagggtgagcccggagagggagaaggagacggagaggatgtgtcgtcagattccgctccagattccgcccccggtccagcgccaaagcggccccgcggtgggggagcagggggtagcagcgtggggactgggggaggtggcactgggggtgtgggcggaggagctggaagcgaggattcaggggaccgcggagggaccctgggtggcgggaccctcggccctccaagtcctcctggtgccccttcgccgcctgaacccggtggggagatcgagctggtctttagaccacacccgctgctcgtagaaaagggtgagtactgccaaacccggtacgtcaagacaacaggaaacgcgactgtggaccatctctcaaagtacctcgctctaagaattgcgctggagcgcaggcagcaacaggaagcaggggagccaggcggccctggaggcggtgcgagtgataccggcggtccagacggttgcggcggcgaaggtggtggcgccggtggtggagacggtcctgaggagcccgccttacccagcctggagggtgtgtcagaaaaacagtataccatttacattgcccccggggggggagcattcacgactctgaacggtagcctgactctcgaactggtgaatgagaaattttggaaggtctctcggccgctggaactgtgctacgcccctactaaggatccaaagtag

SEQ ID NO: 203818 - DNA, 1221 bp, Artificial Sequence
  Description of Artificial Sequence: Synthetic coding sequence
atgaccacccccgccaacgcccagaacgccagcaagacctgggagctcagtctgtacgagctgcataggacaccccaagaagctatcatggatggcaccgaaatagctgtgtccccacgttctctgcattccgagcttatgtgtccgatttgccttgatatgctaaaaaacacaatgactactaaggaatgtctgcatcgcttctgcagcgactgtattgtcacagccttgagaagcgggaacaaggagtgtcccacatgccgcaaaaagctggtgagcaaacggagcctaagaccagatcccaactttgacgccctcatctccaaaatttatccatcaagagaagaatacgaggcccaccaggatagggtcctcattagacttagtagactgcataatcagcaggccttgagctctagcatagaagaaggccttcgcatgcaggccatgcaccgggcccagcgcgtccgccggccaattccgggtagtgaccaaaccaccaccatgagtgggggcgaaggggaaccaggggagggagaaggagatggggaagacgtgtcaagtgatagcgcccccgactccgccccaggccctgcccccaagcgcccgcggggcggaggggcaggaggatccagcgtcggtactggaggtggcgggaccggaggagtggggggcggcgccggctcagaagacagtggggacagaggggggactctgggggggggcactctgggcccaccatctccccccggtgccccttcgccgcctgaacccggcggtgaaattgagctggtttttagaccacatcccttgctcgttgagaaaggcgagtactgtcagacaaggtatgtgaagacaacaggtaatgctaccgtggaccacctgtctaagtatcttgctctgcgcatcgctctggagcgcaggcagcagcaggaagccggggagcccggcggccctggtgggggagcttctgacaccggtggccccgacggatgtggtggagagggaggcggagccggcggtggggatggaccagaggagcccgctctgcctagcttggagggagtgtcagaaaagcaatacaccatatacatcgctcccggagggggggcattcaccacactgaatggatcactgacgttagagctcgtgaatgagaagttctggaaggtgtcccgtccgcttgagttgtgctacgcaccaactaaagaccccaaatag

SEQ ID NO: 203819 - DNA, 1221 bp, Artificial Sequence
  Description of Artificial Sequence: Synthetic coding sequence
atgaccacccccgccaacgcccagaacgccagcaagacctgggagcttagcctttatgaattacataggactccgcaggaggccatcatggacggaaccgaaatcgcagtaagcccccgatctctccattctgaactgatgtgcccaatttgtctggatatgttgaagaacactatgaccaccaaggagtgccttcaccggttttgcagcgactgcattgttacagcgttgaggtctggcaacaaagagtgtcccacgtgcagaaaaaagctggtatcgaaaaggagcttgaggcccgaccctaactttgatgccctgatcagcaagatttatccttctagggaggagtacgaagctcaccaggatcgagtactgatcagactgagccggctgcacaatcagcaagcgctttcgtcaagtatcgaggagggtcttaggatgcaggcaatgcaccgcgcacaacgcgtgaggcggcccatcccgggctccgatcagaccactacgatgtctggtggggagggggaaccgggcgagggtgagggcgacggtgaagacgtgagcagtgatagtgcccccgatagcgcccccgggcccgctccgaagcggcctagaggcggaggagcaggaggcagttcagtagggacagggggcggaggaaccgggggggttgggggaggcgctgggtctgaggattcaggcgatagaggcgggaccctcggaggtggcaccttgggccctccatccccaccaggggccccttcacccccagagccaggcggagagatcgagctggtcttcaggcctcatcctctgctggtcgaaaagggagaatactgccagactagatacgtgaaaacaactggaaatgcaaccgtggatcacctatccaaatatctcgccctgagaatcgctctggagcggcggcagcagcaggaagctggggaacctggggggccaggaggcggcgccagcgacaccgggggccccgatggatgcggtggggaagggggaggagccgggggcggggatgggccggaagagccagcattgccctcactggaaggggtgtctgagaaacagtacacaatctatatcgctccaggcgggggagcctttactactttgaacggctccctaaccctcgaactggtgaacgagaagttctggaaggtgagtagaccgctggaactgtgctacgctccaacaaaggatcccaaatag

SEQ ID NO: 203820 - DNA, 1221 bp, Artificial Sequence
  Description of Artificial Sequence: Synthetic coding sequence
atgaccacccccgccaacgcccagaacgccagcaagacctgggagttaagtctttacgagctgcatcgcactccccaggaggccataatggatggaacagaaatcgctgtgagccccaggtctctgcattccgaattaatgtgcccaatatgtctggacatgctgaaaaacaccatgaccacgaaggaatgcctccatcgattctgctcggactgcattgtcaccgctctcagaagtgggaacaaagaatgccctacctgccggaaaaagctcgtgagcaagcgtagtttaaggcccgatcctaactttgatgccctaatctctaaaatttatcctagccgagaagagtatgaggcccatcaggaccgagtgcttattagattgtcacgtctacataatcagcaggctctaagtagcagtatcgaggaaggcctccggatgcaagcgatgcacagagcacagagagttaggcgcccgattcctggcagtgatcagacaacgactatgtccgggggtgaaggggagcccggtgaaggtgagggggatggcgaggacgttagctcagattcagccccagactccgccccagggccagcgcctaagcgtcctaggggaggaggggccggaggaagcagtgtcgggacaggaggcggtgggacagggggagtcggggggggggccgggtccgaggatagtggcgataggggaggcacactggggggcggtaccctggggcctccgtctccccctggcgcccccagccctccggaacccggaggtgaaatcgaactggttttcagaccacatcccctgttggtggagaagggcgaatactgtcaaacccgatatgtcaaaacaaccgggaatgctaccgtagaccatttgtccaagtatctggcgctccggattgcccttgaacgaaggcagcagcaggaggccggcgaacccggcggccccgggggcggtgcctcagacacagggggacccgacggatgtggaggcgaaggtggtggggccggaggcggagacggtcccgaggagcccgccctccctagtctcgagggagtcagcgagaagcagtacaccatttatattgccccgggtggcggcgctttcaccactcttaatggctcacttacactcgagctcgtgaacgagaagttctggaaagtgtctagacctctcgagctgtgttatgcgccaacaaaagatcccaagtag

SEQ ID NO: 203821 - DNA, 1221 bp, Artificial Sequence
  Description of Artificial Sequence: Synthetic coding sequence
atgaccacccccgccaacgcccagaacgccagcaagacctgggagctgagtttgtatgaactccaccgtacaccccaggaggcaataatggacggcacggaaatagctgtgtcccctaggtctctgcattccgaactgatgtgtccaatatgcttggacatgttaaaaaatacaatgaccaccaaggagtgtctgcacaggttttgtagtgactgtatcgtgaccgctctaaggagtggaaacaaggaatgtccgacatgtcgcaagaaacttgtttcaaagcgcagcttacggccagacccgaacttcgacgcactaatttcaaagatctatcccagccgcgaggagtacgaggctcatcaggaccgcgtccttattagattaagcagactccataaccaacaagctctctcgtccagcatcgaagagggtctgaggatgcaagccatgcaccgagcccagagagtgagacgaccaattccgggcagcgatcagacaaccacaatgagcgggggcgaaggcgaacccggcgaaggggagggggacggggaggatgtcagttcagacagtgccccggattctgcccctgggcctgctccaaagcgtccaagaggcgggggagctggcggttcttcagtaggtaccggaggcgggggtacggggggggtaggggggggagctggtagcgaagacagtggggacagaggcggaaccctggggggggggaccttgggcccaccgtcacctcctggggctccttcacctcctgagcctggaggcgagatcgagcttgtcttccgtccacatccgctgcttgtcgaaaagggggagtactgccagactaggtatgtaaagaccactggcaacgccaccgtggaccacctctcaaaataccttgcgttaagaatcgccctggagaggcgtcagcaacaggaagccggtgagccgggcggtcccgggggcggcgcttccgacacgggtggtcctgacggctgtgggggggagggtggtggagcaggaggcggggatggcccagaagagcccgccctgccctccctggagggagtctccgagaaacaatacacaatctatatcgcgccaggcggcggggccttcaccaccctcaatggctcactgacactggaattggtcaatgagaaattctggaaggtgtctcggcctctggaactgtgttacgctcccactaaagacccaaaatag

SEQ ID NO: 203822 - DNA, 1221 bp, Artificial Sequence
  Description of Artificial Sequence: Synthetic coding sequence
atgaccacccccgccaacgcccagaacgccagcaagacctgggagttatcactctacgagctccaccggacacctcaggaggcaataatggacggcacggagattgccgtgtccccgcgaagtcttcacagtgaactgatgtgccctatctgtctagatatgctgaaaaacacgatgaccaccaaagagtgcctgcacagattctgctctgattgcatcgtgaccgccctccgaagtggaaacaaggagtgcccgacttgtaggaaaaagctggtctccaagcggtcactccgtccagacccaaatttcgacgccttgatctcaaagatttatcccagcagggaggaatacgaagcacaccaagaccgcgtcctgattcggttaagcaggttgcacaatcagcaggctctgagtagcagtattgaggaaggattacgaatgcaggctatgcatagagctcagcgggtgcgccggcccatccccgggtccgaccagacaactaccatgtctggtggcgagggagaacccggcgagggcgagggcgacggggaggacgtatcttcagatagcgcccctgacagcgcccctggcccagccccgaagcgaccccgaggcggaggagcgggaggcagcagtgtcgggacaggtggtggcggcactggcggcgtaggcggaggggccggtagcgaggattctggcgataggggcggcactctgggcggcgggaccctgggccccccctcaccacccggtgccccctcaccgcctgaaccagggggggagatcgaactagtatttcgcccgcaccctctcttggtggagaagggggaatactgccagacacggtatgtgaaaaccactggaaatgccactgtcgaccatctctctaagtatctggccctgcgcattgccctcgaaaggcgacaacaacaggaggccggagaacctggagggccaggcgggggcgcctccgataccggaggacctgatggttgcggcggcgagggtgggggagcaggaggaggggacggtcctgaggagcctgcccttcctagtctcgagggcgtgtctgagaagcagtatacaatttatatagccccaggcggcggcgcctttaccaccctgaatggctccctcacgcttgagcttgtaaacgagaagttctggaaagttagccggccactggaactgtgttacgctcctaccaaagatccgaagtag

SEQ ID NO: 203823 - DNA, 465 bp, Artificial Sequence
  Description of Artificial Sequence: Synthetic coding sequence
atgggcaactgcctgaagagccccaccagcgacgacatcagcctgctccatgaatcccagtctgacagagccagcttcggcgagggtaccgagcccgaccaagaaccgccccccccatatcaggagcaggtgccggtccctgtgtaccatcccaccccgtcacagactcggctggccacccagcttactgaggaagagcagatccggatcgcacagaggatcggcttgatccaacatctgcccaagggcgtatatgacccggggcgagacggaagcgagaaaaaaatccgcgagtgtgtcatctgcatgatggatttcgtgtatggagaccccatccggttccttccatgcatgcacatctaccatctggattgcatcgacgattggttaatgagatcttttacctgcccctcctgcatggagccggttgatgccgccctcctgagctcttatgaaactaactag

SEQ ID NO: 203824 - DNA, 1896 bp, Artificial Sequence
  Description of Artificial Sequence: Synthetic coding sequence
atgccccggcccgccctgagcgtgaccagcttctgccaccggctgggcaaaagagaacggaagcaatcttttatggggaatagcgggaacagttggtcccacaccccttttcctaaacttgaacttgggctcggcccccagcctatggccccgcgggagctcccaacatgttccatttgccttgaaagacttagggatcctatctctctcgattgtggccatgatttctgcatccggtgtttttctacccatcgactgccaggatgcgagcccccatgttgtcctgagtgccgcaagatctgcaagcaaaaaaggggactacggagccttggagagaaaatgaagttgctgccgcaacgaccgctgccacccgctcttcaggaaacttgtcccgtccgggcggaaccgttgctcctcgttcgtatcaatgcttctggcggactcattttgcggatgggggcaatcaaccggtgtctcaagcacccgctggccagagacacccccgtctgtctcctcgcggtccttggcgagcagcatagtggcaaatctttcctcctaaaccacttacttcaaggattaccagggctagagtccggagaaggagggcggccccgcggtggagaggctagtcttcaaggatgcaggtggggagcgaacggattggccaggggtatttggatgtggtctcaccctttccttctggggaaggagggaaagaaagtcgctgtattccttgtcgataccggagatgccatgagcccagagttatccagagagacaagaatcaagctttgtgccttgacaactatgttatcctcctatcaaattctgagcaccagccaggagctgaaggacaccgatctcgattacctggagatgtttgtccacgtggccgaagtgatggggaaacactacggaatggtcccaatccaacacttagatctcctcgtgagggattcaagtcatcccaacaaagccggccagggccatgtcgggaatatctttcagaggctgagcggcagatatccaaaagtccaagaacttcttcaagggaagcgggcaagatgctgcctgttgccagctcccggtcgacgacgaatgaatcagggtcacgcttcccctggagacactgatgacgatttccgccatctgttaggcgcttacgtgtctgatgtactgtccgcagcaccccaacacgctaagtcacgctgtcagggatactggaatgaaggccgtgcagtcgcacgcggcgaccggagactcctgaccgggcaacagctggcccaagaaattaagaatttgtctggatggatggggagaacaggcccggggtttacctctccagacgaaatggcagctcagcttcatgaccttagaaaggtggaggctgccaagcgggagtttgaggagtacgtgaggcagcaggacgtggccactaagagaatattcagcgccctgcgggttttacccgacacgatgaggaacctgctgtcgacccagaaggacgccatcttagccaggcatggggtggcactgctgtgcaaaggccgggaccagactttggaagccttagaggcggaacttcaggccaccgctaaggcctttatggatagttacaccatgagattctgcgggcatttagctgccgtcggaggcgccgtaggggcaggcctgatgggactagctgggggcgtagtgggcgcaggtatggcagctgcggctctggcagctgaggcaggcatggtggctgccggcgctgctgtcggcgcgaccggtgcggccgtcgtgggtgggggagtgggtgccggtctggctgccacagttgggtgtatggagaaggaggaagatgagcgattgttggagggggaccgcgagccattattacaagaagaatag

SEQ ID NO: 203825 - DNA, 687 bp, Artificial Sequence
  Description of Artificial Sequence: Synthetic coding sequence
atggccgcccagcagcgggactgcggcggcgccgcccagctggccgggcctgccgctgaggcagaccccctcggaagattcacttgtccagtttgtctggaggtctatgagaaacctgtgcaggtcccctgtggacatgtgttctgtagcgcctgtctgcaagaatgcctcaagcccaaaaagcccgtgtgtggcgtctgtcggagcgcacttgcccccggggttagagctgtagagctggagaggcaaatcgaatccaccgaaacaagctgtcacgggtgccgaaagaatttcttcctaagcaaaattcggtcacatgtggccacgtgcagcaaatatcagaattatataatggagggcgtgaaggcgacgattaaggacgcctcactccaacccaggaacgtgcccaatcgttacaccttcccctgtccatattgccccgagaagaactttgaccaggagggcttagtcgagcactgcaaactgttccatagtacagacaccaagtccgtagtgtgcccgatttgtgcttctatgccatggggagatcccaattaccgcagcgccaatttccgcgagcatattcagcggcgacaccggttcagttatgataccttcgtcgattatgatgttgatgaggaggacatgatgaaccaggtgctccagagatcaatcatcgaccagtag

SEQ ID NO: 203826 - DNA, 576 bp, Artificial Sequence
  Description of Artificial Sequence: Synthetic coding sequence
atggccgcccagcagcgggactgcggcggcgccgcccagctggccggacctgcagctgaagcggatccactgggtagattcacctgccctgtgtgcctcgaggtctacgaaaagcccgtacaggtgccttgcggccatgtgttctgctccgcctgcttgcaagagtgcctgaagcctaaaaagccagtgtgtggcgtgtgcagaagcgctctcgctcccggggttcgcgctgtcgaactcgagagacagatagagtccacggaaaccagctgtcacggatgcagaaagaacttttttttgagtaaaatcaggtcgcacgtcgccacatgctcaaagtatcagaactatataatggagggtgtgaaggctaccattaaagacgcctcattgcagccaaggaacgtgcccaacaggtacaccttcccatgtccatactgtcctgaaaaaaacttcgaccaggagggcttggttgaacactgcaaactgttccattcaactgatacaaagtcagtgaccagtgagcagtcaccatgtctgctgagcgtctcctgttaccgcgcgtcaatcacatactag

SEQ ID NO: 203827 - DNA, 1287 bp, Artificial Sequence
  Description of Artificial Sequence: Synthetic coding sequence
atgggccccccccccggcgccggcgtgagctgccggggcggctgcgggttcagcagactgcttgcctggtgttttctgcttgcgttaagcccacaggcacccgggagtcggggcgccgaggctgtgtggaccgcctacctgaatgtgtcttggcgcgtgccccatacgggggtaaacagaaccgtctgggagttgagtgaagagggcgtgtacggacaagacagccccttggaacctgtggccggggtattagtgcctcctgatgggccgggcgccctaaacgcctgtaatccccacactaactttaccgtgccgactgtgtggggcagcacagtgcaagtttcgtggttggctctaatccagaggggaggcggctgcaccttcgccgataagattcatcttgcgtacgagcggggggcctctggcgcagtgatctttaatttccctggcacaaggaatgaggtgatccctatgtcacatccaggagctgtggatatcgtcgccatcatgatcggcaatctgaaggggacgaaaattctgcagtctatccagcgcggtattcaggtgacaatggtcatagaagtcggaaagaagcatggaccctgggtgaatcactactccatttttttcgtaagcgtttcctttttcatcattacggccgccactgtggggtacttcattttctatagcgccaggcgattacggaatgcgcgggcacagtcgaggaagcaacggcagttgaaagccgacgcgaagaaagcaataggacgtctacagctgcgtaccctgaagcagggcgataaggaaataggaccagatggcgacagctgcgctgtctgcattgagctttacaaacctaacgatctggtaagaatcctgacctgcaatcatatttttcataaaacctgcgtggatccttggctgctcgaacaccgaacgtgtcccatgtgcaaatgtgacattctgaaagccctgggcatcgaggttgatgtggaggatggctccgttagtctccaagtgccagttagtaatgagatcagcaacagtgcctctagccatgaagaggacaaccgctctgaaaccgcctcatcagggtacgcctccgtgcagggaaccgatgagcctccgctggaggagcatgtgcaaagcaccaatgagtctttgcagctggttaaccatgaagcgaacagtgtagccgtggacgtcattcctcatgtggataatcctacgtttgaagaggatgaaacgccaaaccaagaaacagctgtgcgtgaaattaaatcctag

SEQ ID NO: 203828 - DNA, 1209 bp, Artificial Sequence
  Description of Artificial Sequence: Synthetic coding sequence
atgaaccaggagaaccggagcagcttcttctggctgctggtgatcttcactttcctcctgaagataacggcatcattttccatgtctgcatacgtgactgtgacctattacaacgagacgtcaaactatacggccatcgaaacatgcgagtgcggggtctacggcctggcatctccagttgcgaatgctatgggggtggtgggaatacccaaaaacaataattaccaagcttgtgatcacaataccgagttttcaaacacaaagaagccatggattgctttgatagagcggggaaactgcacattcagtgagaaaattcagaccgccggacgcaggaacgcggatgccgtggtaatttataacgctcctgagaccgggaatcaaacaatccaaatggcgaacttcggggccgtggacattgtggccatcatgatcgggaaccttaaggggaccaaaattctgcagtcgattcagcgcggtattcaggtgaccatggtgattgaagtcggtaagaagcatggaccatgggtcaatcactactccatctttttcgtgtctgtgtctttcttcattattacagccgctactgtgggatatttcatcttctatagcgcaagacgactcaggaacgcccgggcccagtctcgcaagcagagacaactaaaggcagatgccaagaaagccatcggtagattgcagttgcggactctcaaacagggggacaaagaaataggtcccgatggcgacagctgcgcagtgtgcatcgaactctataaaccgaatgaccttgtaaggatccttacatgtaaccacatcttccataaaacttgtgtcgacccatggctgctggaacacaggacctgcccgatgtgtaaatgcgacatcctaaaagctctgggaatcgaggttgacgtggaggatggatctgtcagcctgcaggttccagtgtccaacgagatatcaaattccgccagtagccacgaggaggacaatcgcagtgagaccgcatctagcggttatgccagcgtgcagggaaccgacgagcctcctcttgaggaacatgtccagagcactaatgagtccctacagctggtcaaccacgaggccaactcggtcgcggtggacgtcatcccccatgtggacaaccccacattcgaggaggatgagactcccaatcaggaaaccgccgtgagagaaatcaagagctag

SEQ ID NO: 203829 - DNA, 750 bp, Artificial Sequence
  Description of Artificial Sequence: Synthetic coding sequence
atgagcgcctacgtgaccgtgacctactacaacgagaccagcaactacacggctatcgagacttgtgaatgcggggtatacgggcttgcttcccccgttgctaatgccatgggagttgttgggatccctaagaacaataattatcaggcatgcgatcacaatactgagttctctaataccaaaaagccttggattgctctcatcgaaaggggaaactgtactttctcggaaaaaatccagacagcaggccgccgaaatgcagatgccgtggtgatctataacgctccggagaccggcaaccaaaccatccagatggctaacttcggcgccgttgacattgttgcgattatgatcgggaatctgaaaggcaccaagatactgcagagcattcaacggggcatccaggtcactatggttatagaggtcggtaagaaacatggtccctgggttaatcactacagtattttttttgtgtctgtctccttcttcattatcaccgccgcaaccgtggggtacttcatattctactccgcccgacgcctacgtaatgctcgggctcaatctaggaagcaacggcagctgaaggctgacgccaagaaagctattgggaggctgcagctgcgtaccctaaaacaaggagataaggaaattggtcccgacggcgattcctgcgctgtttgtattgagctttataagcctaacgatttggtgcgcattctgacgtgtaatcatatcttccacaagacctag

SEQ ID NO: 203830 - DNA, 633 bp, Artificial Sequence
  Description of Artificial Sequence: Synthetic coding sequence
atggccggcctgggcctgggcagcgccgtgcccgtgtggctggccgaagatgaccttggctgtatcatttgccaaggattgctagactggccagccacattaccctgtggacacagcttctgtaggcattgcctggaggctctgtggggagcgcgcgatgcgagacgctgggcctgccctacttgccgccagggagctgcccaacagccccatctgcgcaagaacacgctactacaggacctggccgataagtatcggagggccgctagggaaatccaggccgggtccgacccagcccactgcccatgcccaggcagtagctccctctcgtctgcggctgctcggccccgacggcggcctgagttacaacgggtagccgtagagaaaagtataaccgaggtcgctcaagagttgaccgagctagtggaacaccttgtagatattgtaagatccctgcaaaaccaaagaccactcagcgagtcaggacctgataacgagttgtccatcctgggcaaggagaattcatggaaaccgcgactgcccccccacgcgcactgtctgacacgagctactctgcatagtggagagttactcggactcctgagcgggcctagcatccagccattaacttag

SEQ ID NO: 203831 - DNA, 1299 bp, Artificial Sequence
  Description of Artificial Sequence: Synthetic coding sequence
atggccggcctgggcctgggcagcgccgtgcccgtgtggctggccgaggatgacctgggatgtatcatctgccagggactcctggattggcccgccaccttgccgtgtggccattctttctgccgtcactgcctggaagcactgtggggagcaagagacgcaagacgatgggcatgtcccacttgcagacagggtgccgctcagcaaccacatctccgaaaaaatacattattgcaggacctagcggataaataccggagagctgccagagagatccaggccggctcagatcccgcacactgtccctgccctggctcctccagtctctcctcagccgctgctaggccccgccgtcgccctgaacttcaaagagttgccgtggaaaagtccatcacagaagttgcgcaggagcttacggagcttgtcgaacatctggtagatattgtcagaagcctccagaaccagaggccgttgagcgaaagcgggccggacaacgaactttcaattctcggcaaggccttcagcagcggcgttgacttatctatggcttcaccgaaactggtgacttccgacacagctgctggtaaaatcagagatatcctgcatgacctggaagagatccaggaaaagcttcaggaaagcgtgacctggaaggaagccccggaagctcaaatgcagggagagcttctcgaggccccgtcctcttcctcttgccctctcccagatcagtctcatcctgccctgaggagggcttcccgtttcgcgcagtgggccatccacccgacttttaatcttaagtctctgtcttgctcccttgaggtgagtaaggactcacgtaccgtgactgtatcccaccgcccccagccttatcgttggagctgtgaacggttctctacctcccaggtcttgtgctcacaggcactgtcaagcggcaaacattattgggaggtagacacaaggaactgctcccattgggcagttggtgtggccagttgggagatgtctcgagatcaggtcttgggaagaaccatggactcctgttgcgtggagtggaagggaacaagtcaactcagcgcctggcacatggttaaagagactgtcttagggtccgacagacctggagtcgtcggcatctggctgaatctggaagagggcaagttggccttctacagcgtggacaatcaggagaagctgctgtatgaatgcacaattagcgcatcatcacccttataccctgccttctggttatacggacttcatccaggtaattatctcataatcaaacaggtgaaggtctag

SEQ ID NO: 203832 - DNA, 255 bp, Artificial Sequence
  Description of Artificial Sequence: Synthetic coding sequence
tgaaaggaggcccccgaggcccagatgcagggcagcctgctgcccagactggaatgttcgggtacaataaccgccgcctccatcagtcaggctcaggagaatagctggaaaccccggctgccccctcacgcgcactgcctgaccagggcgactcttcattctggcgagctgctgggcctattgtctgtgcctcccaggggcgaacttatcgctaaggccaaacaagtggagacactagaccctagagctctgtag

SEQ ID NO: 203833 - DNA, 291 bp, Artificial Sequence
  Description of Artificial Sequence: Synthetic coding sequence
gcccagcagccccacctgcggaagaacaccctgctgcaggacctggccgataagtaccgacgtgctgcgcgagaaattcaggccggatctgacccagcgcattgtccttgcccagggtcaagctccctgtcaagcgctgctgctagaccacgcaggcgacccgaactgcagcgagaaaattcgtggaagcctcgactcccccctcatgcccactgcctaacccgggccacactccactccggcgagttgctcggtctcttgtctggcccatcaatccagccactcacatag

SEQ ID NO: 203834 - DNA, 861 bp, Artificial Sequence
  Description of Artificial Sequence: Synthetic coding sequence
atggccggcctgggcctgggcagcgccgtgcccgtgtggctggccgaggatgatttgggatgcatcatatgtcagggactcctggattggccggctactctgccctgcggccattcattctgccggcactgcctggaggcgttgtggggcgcccgcgatgcccgcaggtgggcctgccccacatgccgacagggggctgctcaacagccccacctgcggaagaataccctgctacaggacctcgctgataagtaccggcgcgcagcacgagagatccaagccgggagcgacccagcccactgcccctgtccaggctcatcctcattatcttccgccgctgcacggcctcgcagaaggccagaactgcagcgggtggccgtggagaagagcattacagaggtggcccaggagttaacggaactggttgagcatctggtagacatcgtgcgatctctgcagaatcagcgaccactaagcgaatctggaccagacaacgaactgtccattctggggaaggcattttcttccggtgtcgacctttcaatggcttcacccaaattggttacctccgataccgctgcaggaaaaatccgggacatcctccacgacttggaagagatccaggagaagctgcaggaatccgtcacctggaaagaggcgcctgaggctcaaatgcaagggagcctgctgcctcgtctcgaatgtagcggaacgattaccgcggcttctataagccaggctcaggagaattcctggaaaccacgactcccccctcatgctcactgtcttacccgggccactctacacagcggcgagttattggggctactttctggcccctcaatccagcctctgacatag

SEQ ID NO: 203835 - DNA, 756 bp, Artificial Sequence
  Description of Artificial Sequence: Synthetic coding sequence
atggccagccccaagctggtgaccagcgacaccgccgccggcaagatccgcgatatcctgcatgatctggaggagatccaggagaaactgcaggagtccgtgacctggaaagaagcccccgaggcccagatgcagggcgagctcctcgaagccccgtcttcgtcatcatgccctctgcccgaccagagccatcccgccctgagacgagcaagccgcttcgctcaatgggcaattcacccaacttttaaccttaagtcactcagctgctctcttgaggtttccaaagactcccgcacagtcactgtaagtcatcggcctcagccttacaggtggtcctgtgagcgctttagcacatcgcaggtgctgtgctcccaggcactgagtagcggtaagcattattgggaagtggatacccgcaattgcagccattgggccgtcggagtggcctcctgggagatgagtcgcgaccaagtacttgggcgcacaatggacagctgttgcgtcgagtggaaaggcacatcacagctgagcgcatggcatatggtgaaagagacggtcctgggttccgacaggcccggggtagtgggcatttggctcaatctcgaggaggggaagctcgctttttacagtgtggacaaccaggagaaactgttatatgaatgcacaattagtgcctccagccccttgtatcccgctttttggctgtacggcctgcatccaggcaactacctcatcattaaacaggtgaaggtttag

SEQ ID NO: 203836 - DNA, 1995 bp, Artificial Sequence
  Description of Artificial Sequence: Synthetic coding sequence
atggccgccgtgggccccccccagcagcaggtgcggatggcccaccagcaagtctgggcagcgctggaagttgcactccgggtcccctgcctgtatattatcgatgcaatttttaactcctaccctgactcatcacagtccaggttctgcattgtgttacaaatattcctgagactctttggtgtatttgcctcttcaattgtgctgatcttgagccagagatctctttttaaattctacacatacagtagcgcattcctgttagcagcgacaagcgttttggttaactattatgcatccctgcacatagatttttatggggcctataacacttcagccttcggcattgagcttttgccccgcaagggacctagcctttggatggcactgatcgtgctccaactcactttcggcataggatacgtaacactccttcaaatccacagcatatacagccagctaatcatcctggatctgcttgtcccagtaattggtctcatcaccgagttacctctgcacatcagagaaacactcctattcacgtcgtcgctgatcctgacacttaatacggtgtttgtcttggccgtgaagctgaaatggttctactattcaacccggtatgtctatctcctggttcgccatatgtaccgaatctatgggctccagctgctgatggaagacacatggaagcggatccgcttccctgatatactgcgggtcttttggctcaccagagttacagctcaggcaaccgtactgatgtatattcttagaatggcaaatgagaccgattccttctttattagctgggacgacttttgggatcttatttgcaatttgatcatttccgggtgcgactccactctgactgtactggggatgtctgccgtgatcagttcagttgcccactatttggggctaggcatcctcgccttcatcggatctacagaagaggacgatcgacgcttggggttcgtggccccagttctgtttttcatcttggccctgcagaccggactgtcaggcctgaggcctgaggagagacttatccggctgtctaggaacatgtgcctgctcctgacagccgttctacattttattcatggcatgacggatccggtgctcatgtctctgtcggcctcacatgtgagctcctttagacggcactttccggtgctatttgtttcagcgtgcttgtttatcttgcccgtgttgctttcttacgttttgtggcatcattacgccctgaatacctggttattcgcagtgacagcgttttgtgtagaattgtgcctgaaggtaattgtgtccctgacggtctacacactgtttatgattgacggatattataatgtcttgtgggagaagcttgatgattacgtatattatgtccgctccacaggctccattatcgaatttatctttggggttgtaatgtttggtaatggggcatatactatgatgtttgaatccggatctaaaattagggccttcatgatgtgcctccatgcctatttcaatatctacttacaggcaaagaacggctggaaaacgttcatgaatagacgaacagcagtcaagaagatcaactccctgccagagatcaaaggttcgcggcttcaggagataaacgacgtctgcgccatctgttatcacgagttcaccacttccgcgcgaatcacaccctgtaaccactacttccatgctctctgtctccgtaaatggctgtacatccaagatacatgccctatgtgtcaccaaaaagtgtatattgaggacgatattaaggacaactccaacgttagcaacaacaatggtttcattccccctaatgagacccccgaagaggcagttagagaagccgccgccgaaagtgatagggaattgaatgaggatgattctacggactgcgacgatgacgtgcagagagagcggaatggagtaatccagcatacaggagccgccgcagaggagtttaacgatgataccgattag

SEQ ID NO: 203837 - DNA, 1425 bp, Artificial Sequence
  Description of Artificial Sequence: Synthetic coding sequence
atgagcagcgaggaccgggaggcccaggaggacgagctgctggccctagcgtccatctatgatggagatgaattccgtaaggctgagtcggtgcaggggggggagacccggatttacctggacttgccacaaaacttcaaaatcttcgtgtctggtaactcgaatgaatgcttgcaaaatagcgggttcgagtatactatctgctttctgccccctttagtactgaactttgagttaccaccggactacccatcctcatccccgccttctttcacactttccgggaagtggctgtctcctacacagctttccgccttgtgcaaacatttagacaatctatgggaggagcatcgcggcagcgtcgtgctgtttgcttggatgcagttcctgaaggaagagaccttagcgtacctaaacattgtgtcaccgtttgagctcaagattggctcacaaaaaaaggtgcagcgaaggactgcccaggccagcccaaacaccgagctggatttcggtggcgctgcaggctctgacgttgaccaagaagagattgtcgacgagcgagccgtgcaggacgtggagagtcttagcaacctgatccaagagatccttgattttgatcaagcacagcagattaagtgttttaattcaaagctgtttctatgttctatttgcttttgtgaaaaattgggcagcgaatgcatgtattttttggaatgccgacatgtctactgtaaggcttgcctgaaagattattttgagattcagattagagatggccaggttcagtgcctgaactgcccagagcccaagtgcccttctgtggctacccctggtcaagtcaaagaactcgtggaagccgagctgtttgccaggtacgataggcttcttctgcaatcctccctggacttaatggccgacgtggtctattgtcccagaccctgctgccagctgccggtgatgcaagaaccggggtgtactatgggaatttgtagttcttgcaactttgcattttgcacactgtgcagactcacataccacggtgtctctccttgtaaggtgactgctgaaaaattgatggatctcaggaatgagtatttacaggctgacgaggctaacaagagactcctggatcagaggtacggcaaacgcgtgatccaaaaggccttagaggagatggaaagtaaggagtggctagaaaagaatagcaaaagctgtccctgttgcggcactcccattgagaaactggacggctgcaacaagatgacgtgcactggttgtatgcagtatttttgttggatttgtatgggaagcctttctcgggcaaatccttacaaacactttaatgaccccggatcaccttgcttcaaccggttgttctacgcagtggacgtagacgacgacatatgggaggatgaggtcgaggactag

SEQ ID NO: 203838 - DNA, 1425 bp, Artificial Sequence
  Description of Artificial Sequence: Synthetic coding sequence
atgagcagcgaggaccgggaggcccaggaggacgagctgctggccctggcctccatttatgacggcgatgaattcagaaaagctgaatccgtgcaaggcggggagactaggatttacctcgaccttccccagaatttcaagattttcgtctctggtaatagtaacgagtgtctgcaaaatagtggctttgagtacacaatttgctttctgccacccctcgtcttaaactttgaattgcctcccgactacccatcgagttccccacctagctttaccttgtctggcaagtggcttagtcctacccagctcagtgcactgtgcaagcatctggataacctgtgggaagaacacaggggaagcgtcgtgctgtttgcctggatgcagttcctgaaagaggagacccttgcgtatctgaatattgttagcccctttgagctgaagattggttcacagaagaaagtccagagaaggaccgcacaagcttcacctaataccgagctcgacttcggaggcgccgcaggtagtgacgttgatcaggaagagattgtcgatgagagagcagttcaggatgtggaaagcctgagcaacctcatccaagagatactggacttcgaccaggcacagcagatcaaatgttttaacagcaaactcttcctgtgcagcatctgcttctgcgagaagctcgggagcgaatgtatgtacttcctcgaatgcagacatgtttactgtaaggcctgcctcaaagattattttgaaattcagatccgggatggccaggtgcagtgcctaaattgtccagaaccaaagtgcccttcagtggcaacaccgggccaggtaaaggaactggtggaagctgagctgttcgcccggtacgatcggcttctgcttcagtccagcctcgacttgatggccgatgtcgtgtactgtccacgtccttgttgtcagctaccagtgatgcaggaaccagggtgcacaatgggcatttgctcgtcgtgtaacttcgctttttgtactctttgtcgcctcacctaccatggggtctccccctgtaaggtgactgccgaaaaactgatggatctacgtaacgagtacttacaagcggacgaggccaacaagagactgttggaccagcggtacgggaagagagtgatacagaaggccctggaggagatggagtcaaaggaatggcttgagaaaaattccaagtcttgcccttgctgcggtactcctattgaaaaactcgatgggtgcaataagatgacatgtactgggtgcatgcagtacttttgctggatctgcatgggttcgctttcccgcgccaacccctacaaacacttcaacgatccaggcagcccatgctttaacagactgttctacgctgtggacgtagacgacgacatttgggaagatgaggtcgaggactag

SEQ ID NO: 203839 - DNA, 1047 bp, Artificial Sequence
  Description of Artificial Sequence: Synthetic coding sequence
atgcagttcctgaaggaggagaccctggcctacctgaacatcgtgtcaccttttgaattaaagatcggcagccagaagaaagtgcagagacggacggcccaggctagtccaaacacagaattggacttcggaggcgcagcaggctctgacgtcgaccaggaggaaatcgtggatgaaagggctgtgcaggatgtagaaagtttgagtaacctcattcaggagatcctcgacttcgaccaggcccagcagatcaagtgttttaactctaagctattcctttgttctatttgcttctgcgaaaagctggggtccgaatgtatgtacttcttggaatgccgtcatgtgtactgcaaggcatgtctcaaagattacttcgagattcagatcagagacggtcaagtgcagtgcttaaactgccccgagccaaagtgcccatcggtggcaacgccgggccaagtgaaagaattggttgaggcagagctgttcgcacgctacgatcgcctcctgctccagtctagccttgatctaatggccgatgttgtgtactgtcctcgaccctgctgccagctgcctgtcatgcaagagcccgggtgcactatgggtatttgtagctcttgtaatttcgcgttttgcaccctgtgccgactgacctatcatggcgtttcgccatgcaaggtgacagcagagaagctcatggacctaagaaacgagtaccttcaggccgatgaagctaataagaggctgctcgatcaaagatatgggaagcgggttattcagaaagctttggaagaaatggaaagcaaagagtggctggagaagaattcaaagagctgcccatgctgcggcacaccaatcgagaaattggatggatgcaacaagatgacctgcactggctgtatgcagtatttctgttggatttgtatgggcagcctgagcagggctaacccatataagcacttcaacgaccctggcagcccctgttttaaccgattgttttacgccgtcgacgtggatgatgacatatgggaagacgaggttgaagactag

SEQ ID NO: 203840 - DNA, 897 bp, Artificial Sequence
  Description of Artificial Sequence: Synthetic coding sequence
atgagcagcgaggaccgggaggcccaggaggacgagctgctggccttagcttcaatttatgatggtgatgaattccggaaggcagagtctgtgcaaggaggggagaccaggatctaccttgacctgccacagaacttcaagatcttcgtctcaggaaattccaacgaatgcttacagaacagtggatttgaatacaccatctgctttctgccaccacttgtgcttaatttcgaattgcctcctgactatcccagctccagtcccccctctttcactctcagcggaaagtggctgagcccgacccaggtgaaggagctggtcgaagccgaactgttcgccagatatgatcgactgctgctccagagttccttggacctcatggcggatgtagtgtactgtcctagaccatgttgccagttgccagtgatgcaagagcctggctgcacaatgggcatttgttcatcttgcaattttgctttttgtacactctgccgtctgacctaccacggggtgagcccatgcaaggtgaccgcagaaaagttaatggacttacgaaatgagtacctgcaggctgacgaggccaacaaaaggttgctggatcagaggtacggcaaacgggtgattcagaaggcgctggaggagatggaatctaaagaatggcttgaaaagaactctaagtcttgtccatgctgcgggacaccgatcgagaagctcgacggatgtaacaaaatgacctgtactggatgtatgcagtatttctgctggatctgcatggggtccctgagccgcgctaacccctacaagcacttcaatgatccaggatcaccttgttttaatcggcttttttatgcggtcgacgtggatgacgacatatgggaagatgaggtggaggattag

SEQ ID NO: 203841 - DNA, 1425 bp, Artificial Sequence
  Description of Artificial Sequence: Synthetic coding sequence
atgagcagcgaggaccgggaggcccaggaggacgagctgctggccctagcttccatatacgacggcgacgagttcaggaaagcagaaagcgtacaaggcggggagacccgcatatacctggaccttccccaaaactttaaaatatttgtttccggcaactccaacgaatgtctgcagaattccggctttgagtacacgatttgctttctgcctccactggtgctgaattttgaacttcctcccgactacccatcctcctcacccccctccttcactttatccgggaagtggctcagccctacacagctctctgccctgtgtaaacacctagacaacctgtgggaagagcatagagggtctgtggtgctgtttgcctggatgcagtttctaaaggaagaaacgctcgcttatttgaatatcgtgtcccccttcgagcttaaaattggaagccagaagaaagtgcaaagaaggaccgcccaggcgagtccgaatactgagttagactttggaggggcagctggttctgacgtcgaccaggaagagatcgtggacgaacgcgcggtgcaggacgtggagtctctcagtaacttaatccaggaaatcctagacttcgatcaggctcagcagatcaaatgctttaattcaaagttgtttttgtgttccatttgtttctgcgaaaagctcggatccgagtgcatgtactttctggaatgtaggcacgtttactgcaaagcttgcctgaaggattatttcgagatccagatccgcgatggacaagtgcagtgtctgaactgtcccgagcctaagtgtccttccgtcgcgaccccagggcaggttaaagaattagtggaagcagaactgtttgctcgttacgaccggctccttttgcagtcctcattggacttaatggctgacgtcgtgtattgtccacgaccctgctgccagctgcctgtgatgcaggaaccgggctgcacgatgggcatctgttcctcgtgcaattttgccttctgtactttatgtcggctcacttaccatggtgtctctccatgcaaggtgacagccgagaagcttatggatctgcggaatgaatatctgcaggctgacgaagctaataaacgattgctagatcaacgatacggaaagcgggtgatccagaaggctctagaggagatggaaagcaaggagtggttggaaaagaacagcaagtcctgtccctgctgcggcactcctatcgaaaagctggacggctgtaataaaatgacgtgcacaggctgtatgcagtacttctgctggatctgcatgggctcactctcaagggcaaatccatataaacattttaatgatcctgggagtccctgctttaaccgcctcttttacgccgtggacgtagacgacgatatatgggaggacgaagtggaagactag

SEQ ID NO: 203842 - DNA, 1425 bp, Artificial Sequence
  Description of Artificial Sequence: Synthetic coding sequence
atgagcagcgaggaccgggaggcccaggaggacgagctgctggccctcgcctctatctacgacggggacgagttcaggaaggctgaaagcgtgcagggcggcgaaacaagaatttacctggatctgcctcagaatttcaagatcttcgtgagtggcaattccaacgaatgtctccagaattctgggttcgagtacactatttgttttctgccaccattagtgctaaatttcgagctgccaccagattatcctagctcttcccccccaagctttaccctctccgggaagtggctttctcccacccaactttcggctctgtgcaagcacctggacaacctctgggaagagcaccgcggttcagtcgtcttgtttgcctggatgcagttcctcaaagaggagacactagcctacctgaacatcgtttcgccatttgagctcaaaataggttcccagaagaaggtgcagcggaggactgctcaggcctcccccaacaccgaactggattttggaggcgctgcaggctccgatgtcgatcaggaggaaatcgtcgacgagcgcgccgtccaggatgttgaaagtctctccaacctgatccaggagattcttgattttgaccaagcacagcagatcaagtgtttcaactctaaactgttcctgtgcagcatctgcttctgtgaaaagctcgggtctgaatgtatgtatttcctggagtgccgacatgtttattgcaaggcgtgcctgaaggattacttcgagattcagattcgagatggccaggtgcaatgcttgaattgcccagagcctaagtgtccgtcagtggccactcctggacaagtgaaggaactggtggaggctgaactatttgcccgctatgacagactcctgttgcagtccagcctcgacctcatggctgacgttgtctactgccccaggccttgttgtcagctcccagtaatgcaagagcccggttgcacgatggggatttgttccagctgcaattttgcattctgcaccctctgccgcctcacttatcacggcgtatcgccctgtaaggtgacagcagagaagttgatggatctccgcaacgaatatctgcaggccgacgaagccaataagagactgctggatcagagatatgggaaaagggtgatccaaaaagcgctcgaggaaatggaatccaaagagtggctcgagaaaaactccaagtcttgtccatgttgtggcacgccaatcgagaaattggatggttgtaataagatgacatgcaccggctgcatgcagtacttttgctggatttgtatggggtccctctccagagcaaacccgtataagcactttaacgatcccggatctccttgctttaatcgtctgttttacgctgtagatgtggacgacgatatctgggaggatgaggtggaggactag

SEQ ID NO: 203843 - DNA, 48 bp, Artificial Sequence
  Description of Artificial Sequence: Synthetic coding sequence
atgagcagcgaggaccgggaggcccaggaggacgagctgctggcctag

SEQ ID NO: 203844 - DNA, 399 bp, Artificial Sequence
  Description of Artificial Sequence: Synthetic coding sequence
atgagcagcgaggaccgggaggcccaggaggacgagctgctggccctcgcaagcatctacgacggtgacgagttcaggaaagccgagagcgtacagggaggagagacccgcatctatttggacttgcctcagaacttcaaaatttttgtctctggaaacagtaatgagtgtttacaaaacagcggctttgagtatacgatttgttttctgccacccctcgtgttgaatttcgagctgcctcctgattacccatcatcatcccccccctcctttactctttctggaaaatggctatctcctactcaattgtcagccctgtgcaagcatcttgacaacctgtgggaggagcaccgtgggtcggttgtgttatttgcatggatgcagttcctgaaggaatag

SEQ ID NO: 203845 - DNA, 516 bp, Artificial Sequence
  Description of Artificial Sequence: Synthetic coding sequence
atgagcagcgaggaccgggaggcccaggaggacgagctgctggcccttgcctcaatctatgatggcgacgagttcagaaaggctgagagtgttcagggcggtgagactagaatttatctcgacttacctcaaaatttcaaaattttcgttagcggtaacagtaacgagtgcctacagaatagcgggttcgaatataccatctgcttcttacctccactggtgttaaattttgaacttccacccgactatccttccagctcacccccctccttcacattaagcggaaagtggctgtcaccaacgcagctatctgcgctctgcaaacatctggataacttgtgggaagagcatcgaggctccgttgtgctctttgcatggatgcagttcctgaaggaggagactttggcttatctcaatatcgtgtcacccttcgagttaaagatcgggagccagaagaaagttcagcggcggactgcgcaggcatctcccaataccgagcttgactttggcggctag

SEQ ID NO: 203846 - DNA, 558 bp, Artificial Sequence
  Description of Artificial Sequence: Synthetic coding sequence
atgagcagcgaggaccgggaggcccaggaggacgagctgctggccttagctagcatctatgacggtgacgagtttaggaaggctgagtccgtgcagggaggggagacccggatctatctggatctgcctcagaattttaagatctttgtgtctggaaattccaatgagtgtcttcagaactctgggttcgaatatactatctgcttcctcccccctctggttctgaattttgagctcccccctgattacccttcatcttccccaccgtcctttaccttgtcagggaaatggttgagcccgacacaactctccgccctttgtaagcatttagacaacctctgggaagaacacaggggatctgtcgtgctttttgcttggatgcagtttctcaaagaagagactctggcctaccttaacatcgtgtctccattcgaactgaaaatcggatcgcagaagaaggttcagcggcgcaccgcacaagcctccccgaacacggaactggattttggcggtgcagcggggtccgacgtcgaccaggaggaaatagttgatgaatag

SEQ ID NO: 203847 - DNA, 186 bp, Artificial Sequence
  Description of Artificial Sequence: Synthetic coding sequence
atgagcagcgaggaccgggaggcccaggaggacgagctgctggccctggcgtctatatacgatggggacgagttcaggaaagccgaatcggtccagggcggagaaactagaatctatctggacttgccccagaactttaagattttcgtgtcaggcaactcaaacgagtgtcttcagaactcctag

SEQ ID NO: 203848 - DNA, 837 bp, Artificial Sequence
  Description of Artificial Sequence: Synthetic coding sequence
atgagcagcgaggaccgggaggcccaggaggacgagctgctggccttagcctctatctatgacggcgatgagtttaggaaagccgaaagtgtacagggaggagaaactaggatctaccttgatttaccgcagaacttcaaaatttttgtgtccggcaattcaaatgaatgtctgcaaaacagtggcttcgagtacactatctgtttcctccctccactagtcctaaactttgagttgccacccgactatccatcatcttcacctccaagctttaccctttccgggaaatggctctctcctacccaactgtccgcactctgtaaacacctggataacctgtgggaggagcatagaggatcagttgtgctgttcgcttggatgcaatttctgaaagaagaaacactggcgtacttgaatatcgtttccccattcgagttgaaaatcggctcccaaaagaaggtgcagagacgtacagcgcaggcttcacccaatactgagcttgactttgggggtgcggcagggagcgacgtggaccaggaggaaattgtcgatgagcgggcggtgcaggacgttgaaagcttatccaatttaatccaggaaattctcgactttgatcaggcacagcaaataaaatgcttcaattctaagttgtttctgtgtagtatttgtttctgcgaaaaacttggatccgaatgtatgtattttctcgaatgtcgtcacgtgtactgcaaagcatgtctgaaagattactttgaaattcaaattcgggatgggcaggtgcagtgtctcaattgtcctgaacccaagtgcccttctgttgcaactccaggccagtag

SEQ ID NO: 203849 - DNA, 300 bp, Artificial Sequence
  Description of Artificial Sequence: Synthetic coding sequence
atgagcagcgaggaccgggaggcccaggaggacgagctgctggccttggcctcaatctatgacggagacgaatttcgcaaggctgaaagtgtacagggcggcgagacccggatttatctggatttgccgcagaactttaagatcttcgtgtctgggaacagcaacgaatgccttcagaattcaggattcgaatataccatatgtttcttgcccccactggtcctgaattttgagctgcccccagactacccgtcttcatccccaccttccttcacactgtccgggaaatggctctcttag

SEQ ID NO: 203850 - DNA, 516 bp, Artificial Sequence
  Description of Artificial Sequence: Synthetic coding sequence
atgagcagcgaggaccgggaggcccaggaggacgagctgctggccctcgctagcatatacgatggcgacgaattccgaaaagcagagagcgtccagggcggagaaacaagaatctatctggacctgcctcagaattttaagatcttcgtgtctgagaagctcatggacctgcggaacgagtatctgcaggctgatgaagctaacaagcggctcctggaccagcgctacgggaagcgcgtcatccagaaggcactggaggaaatggaatctaaggagtggctcgagaagaattctaaaagctgtccctgttgcgggacccctatcgagaaactcgacggatgcaataagatgacttgcactgggtgcatgcaatacttttgctggatttgtatggggtctctgtctcgcgcaaacccatataagcacttcaatgaccctggcagcccctgtttcaatagactgttctatgccgtggatgtggacgacgacatatgggaagatgaggttgaagactag

SEQ ID NO: 203851 - DNA, 1077 bp, Artificial Sequence
  Description of Artificial Sequence: Synthetic coding sequence
atggccggctgcggcgagatcgaccacagcatcaacatgctgcccaccaaccggaaggccaatgagtcctgttccaacaccgcaccttcactgacagtaccagagtgcgccatttgtctccagacttgcgtgcatccggtgtctctcccatgtaagcatgttttttgttacctgtgcgtcaagggggctagttggttggggaaacgttgcgccctgtgccggcaggaaatacccgaggacttcctcgataaaccaaccttgttgagtcccgaagaactgaaggccgcctccaggggcaacggcgaatatgcgtggtactacgaaggccggaatggttggtggcaatatgacgagcgcacaagtagagagctagaagatgcattttctaagggaaagaaaaatacggagatgctcatagccggatttctctacgtggccgatttagaaaatatggtgcagtatcgaaggaacgagcatggaagaagacgcaaaattaagcgggatatcatagatatcccaaagaagggcgttgctggtctgcgcctcgattgtgatgcaaataccgtaaaccttgctcgcgagtcctctgccgacggggccgacagcgttagcgcacagtctggcgcctctgtgcaaccccttgtgtcaagtgtacgacctcttacctcggtcgatggtcaactgaccagtccagccacaccctctcccgatgcttcgacatctctggaggattcatttgctcatctgcagctgtccggggacaatacggccgaacgttctcaccgcggtgaaggagaggaggatcacgagtcaccttccagtggaagagttccagcacctgacacaagcatcgaggaaacggaatccgacgcaagtagcgatagtgaagacgtgtctgccgtcgtggcacagcatagcctcacacagcaacgactcctcgtctcgaacgcgaaccagaccgtccccgataggtctgatcggagtggtaccgaccgcagtgttgccggggggggcacagtaagcgtctccgtgagatctcgtcgccctgacgggcagtgtaccgtgactgaggtgtag

SEQ ID NO: 203852 - DNA, 1077 bp, Artificial Sequence
  Description of Artificial Sequence: Synthetic coding sequence
atggccggctgcggcgagatcgaccacagcatcaacatgctgcccactaacagaaaggcaaatgagtcctgcagtaacactgcacccagtctgactgtgcctgaatgcgccatttgtctccagacttgcgtacacccagtgagcctcccatgcaaacacgtgttctgctacctctgcgtgaagggcgcttcctggttgggcaagcggtgcgctttgtgtcgccaagaaatccccgaagatttcctcgataagcctacactgctttccccagaggagctgaaggccgctagcaggggaaatggggaatacgcttggtattacgagggccggaatgggtggtggcagtatgacgagcgaacatcacgcgagttggaagacgctttctctaaggggaagaagaataccgaaatgttaatcgccggctttctgtacgtggctgacttggagaatatggtgcaataccgcagaaatgagcacgggcgccgacgtaaaattaaacgggatattattgatattcctaagaaaggggtggcaggcctcaggctggattgtgatgccaacaccgtgaacctggctcgggaatcttcagccgacggtgccgactctgtcagcgcccagtctggggcgtcagtacagcctcttgtgtcgtcagtccgcccactgacctccgtggacggacaattaacctcgcctgctaccccttcccccgacgccagcacctccctggaagatagcttcgcccacctgcagctgagtggggacaataccgcagaacgctcacatcgcggcgaaggggaggaagatcatgagagcccctcatctgggagagttccagcacctgacactagcatcgaggaaaccgagagcgacgcgtcttctgacagcgaggatgtttccgcagtggtggcacaacactctttaactcagcagcgcctgctagtctcaaatgcaaatcagaccgtgcccgacaggtcggatagatccggtactgatagaagtgtggcaggtggaggcaccgtgagtgtctctgttagatcccgccgtcccgacggccagtgtaccgtgacagaggtgtag

SEQ ID NO: 203853 - DNA, 1080 bp, Artificial Sequence
  Description of Artificial Sequence: Synthetic coding sequence
atgatggccggctgcggcgagatcgaccacagcatcaacatgctgcctaccaaccgcaaggccaacgaaagctgctccaatacggccccaagtttgaccgtgcccgaatgtgctatttgccttcaaacttgtgtccatcctgtgtctctcccctgcaaacacgttttctgttatctttgtgtaaaaggtgccagctggctcggaaagcgctgcgccctctgcaggcaggagattcccgaggacttcctggacaaacctacactgctctctcccgaagaactgaaagccgcttcacggggcaatggggaatatgcatggtattacgagggccgaaatggttggtggcagtacgatgaaaggacttcgcgcgaactggaagacgcattctccaagggtaaaaagaatacggagatgctgatcgctggatttttatatgtcgccgatctcgagaacatggtccagtaccggagaaacgaacatgggcgaagacggaagattaaacgtgatataatcgacatccctaaaaagggggtggcaggcctcagacttgactgcgacgccaataccgtgaacttggcccgggagagctcagccgacggcgccgattccgtctccgcccagtctggggcatccgttcagccattggtgtccagcgtgcggccacttacctctgtggatggacagctgacctcgcccgccactccctctccagatgcatccaccagcctggaggactcttttgcccaccttcagctgagtggcgacaatacagccgaaagatcacaccggggcgagggggaagaggatcatgaaagcccttcatccggaagagtcccagcccccgacactagcatcgaggagactgagagcgacgccagctccgactccgaggatgtttcagccgtcgtagcgcagcactccttaacacagcagagactcctggtatccaatgctaatcagacggtgcctgaccggtctgaccgcagcggcaccgatcgcagcgtcgcaggcggtggaaccgttagtgtttcagtccggtcccggaggccggatgggcagtgcaccgtaactgaggtctag

SEQ ID NO: 203854 - DNA, 1716 bp, Artificial Sequence
  Description of Artificial Sequence: Synthetic coding sequence
atggccctgcccaaggacgccatccccagcctgagcgagtgccagtgtggcatttgcatggagattttggtggaacctgtcactcttccatgtaatcacaccctatgcaagccctgcttccaatccacggtggagaaggcgtcactgtgttgcccattttgtagacgccgcgttagtagctggacaagatatcacacgcgaagaaattctctggtcaacgtggagctgtggacaattattcaaaaacattatccccgagagtgcaaactgagagcgtccgggcaagagtccgaagaagtcgcagacgactatcagccggtcagattgctgtccaagcctggtgagctgcggagggagtatgaggaggagatctccaaggtagctgctgagagaagggcctccgaagaggaggagaacaaagccagtgaggagtacatccaaaggctgctcgcggaagaggaggaggaagaaaagagacaggcagagaagaggcgtagggctatggaagaacagctgaaaagcgacgaagagcttgcacgaaaactctcaatagatatcaataacttttgcgagggcagcataagtgcaagtcccctcaatagtaggaagagtgacccagtgactccaaaatccgagaagaaatctaaaaacaagcagagaaataccggagacattcagaagtatttgacacccaaaagccaatttgggtctgcttcacacagcgaggctgtacaagaagtgcggaaggattctgtcagcaaagatattgactcttctgataggaagtctcctaccgggcaggacaccgaaatcgaagacatgcccacattgtcaccccaaatctcgttgggcgtaggagagcagggggccgattcctctattgagtcacctatgccctggctgtgcgcatgcggcgcagagtggtatcacgaggggaatgtaaaaacaagaccatccaatcacggaaaagaattatgcgtgctcagccacgagcgacctaagactcgggtaccatactctaaggaaaccgccgtcatgccatgtggcagaacagagagtggctgtgcgccaacttcaggagtgacccagaccaacggcaacaataccggggaaaccgagaacgaggagagctgcttgttaatctctaaggaaatctccaagcgaaaaaaccaggagagtagcttcgaagctgtgaaagacccctgcttcagtgccaaaaggcggaaagttagccccgagagcagtcctgaccaggaggagacagaaataaatttcactcaaaagctcatcgatttagagcatttactctttgagagacataagcaggaggagcaagaccggctgctggctctgcaacttcagaaagaggtcgacaaagagcagatggttcctaatcggcagaagggtagccccgatgagtatcacctacgggctactagcagcccccccgacaaggtgctaaatgggcagcgcaaaaatcctaaagatgggaatttcaaaaggcagacacacacgaaacacccgaccccagagcgcggatcacgtgataagaaccggcaggtatccctgaagatgcaactgaaacaatcagtgaataggaggaaaatgccgaactccactcgcgaccactgcaaggtctccaagagtgctcatagtttgcagcctagcatctcccaaaaaagtgtgttccagatgtttcaacggtgcaccaagtag

SEQ ID NO: 203855 - DNA, 1716 bp, Artificial Sequence
  Description of Artificial Sequence: Synthetic coding sequence
atggccctgcccaaggacgccatccccagcctgagcgagtgccagtgtgggatatgtatggagattctggtcgagcccgtgactctgccgtgtaaccacaccctgtgcaaaccttgttttcagtcgacagtggaaaaggccagcctgtgctgccctttttgcagacgccgggtctcttcttggacgcgttatcacacgcggcgtaactccctggtaaatgtggagctctggacaattatccagaaacattacccgcgagagtgcaagctacgcgccagtggccaagagtccgaggaagtggccgacgactaccagccagtgcgcctattgtctaaaccgggagagctgcggagagagtatgaggaggagatctcaaaagtcgccgcggaaagacgggcctctgaagaagaagagaacaaagccagcgaggagtatatccagcgcctcttagccgaggaggaagaagaggagaagcggcaggcagagaagagacggcgcgctatggaggagcagctgaaaagtgatgaggagttggcgaggaagttaagcatagatataaataacttttgtgaaggtagcatttcagctagccccctgaactcacggaagtcagatcccgtaacgcccaaatcagagaaaaaatccaaaaacaagcagaggaataccggcgatatccaaaagtaccttactccaaaaagccagtttggctctgcctcacattcagaggcagttcaagaagtgagaaaagattcagtgtctaaagatattgacagttctgacaggaagagtccaaccgggcaggataccgagatagaagatatgcccaccctttctccgcagataagtctgggcgtgggcgagcagggggctgactcatcaatagagtccccaatgccctggttgtgcgcctgcggcgctgagtggtatcacgaagggaatgtgaagacacgcccaagcaatcacggaaaggagctttgtgtgctctctcacgagcggcccaagacccgtgtcccgtatagcaaggagaccgccgtgatgccttgcggcagaactgaatccgggtgtgcacccactagcggcgtgacccagactaacggtaacaacacaggtgagacagaaaacgaggagtcatgtctgctgatcagtaaagaaatctcaaagaggaagaaccaagagtcttcattcgaggcagttaaagacccgtgtttcagcgccaagaggaggaaagttagcccggaaagtagcccagatcaggaggagacggaaatcaacttcacccagaaactgattgaccttgaacaccttttgttcgagaggcataagcaagaggagcaggatagactgctcgcattacagctgcaaaaagaggtggacaaggagcagatggttcctaaccgtcaaaaaggatcccccgacgaataccatcttcgcgccacaagctccccacccgacaaggtgctgaacggacagcgtaaaaatcccaaagatggcaactttaaaaggcagactcataccaaacaccccacccccgagagaggtagccgagacaagaatcggcaggtatcccttaaaatgcagctgaaacagtcggtgaatagacgcaagatgccaaactctacaagggatcattgcaaggtctcaaagtccgcacactctctgcagccttccatcagtcagaagtccgttttccagatgttccaaagatgcacaaaatag

SEQ ID NO: 203856 - DNA, 4872 bp, Artificial Sequence
  Description of Artificial Sequence: Synthetic coding sequence
atggccgccgaggccagcaagaccggccccagccggagcagctaccaaaggatgggccgcaagtctcagccctggggagctgctgagattcagtgtactagatgtggtaggagggtgtcccggagctcaggccatcactgtgagttacagtgtggccatgccttttgcgagctctgcctgcttatgaccgaggaatgcaccacaataatctgtccggattgcgaggtggccacagcagttaatacaaggcaaagatactaccccatggccggctacatcaaggaggatagtattatggaaaaactgcagccaaagacaattaagaactgctcccaagatttcaaaaaaaccgccgaccagcttacaactgggctcgagagaagcgctagcacagataagacactgcttaattcatctgctgtgatgctggatacaaacactgctgaggagatcgacgaggcgttaaacacagcgcaccattccttcgaacagctgtcaatcgctggcaaggcactcgagcacatgcagaagcagaccattgaggagcgcgagcgcgtgatcgaagtggtggagaagcaatttgatcagttgctcgccttttttgatagcaggaagaagaacctgtgcgaagaattcgctagaacgaccgacgactatctgtccaacctgatcaaggccaaatcttacatcgaggagaaaaaaaacaacctgaatgctgccatgaacatcgctcgcgcgctgcagctgtccccgagcctgcgcacatattgcgaccttaaccaaataattcggaccctgcagctcacatccgactctgagttagctcaggtgagctcccctcagttgagaaatccaccacgactgtccgtaaattgtagtgaaatcatctgtatgtttaataatatgggaaaaattgaattccgcgattccacaaagtgctatccacaggaaaacgaaatccgacagaatgtccagaagaagtataataataaaaaggagctgtcgtgctatgacacgtaccctccacttgaaaagaagaaggtggacatgagcgtgctgaccagtgaggccccgcctccgcctctgcaacccgagacgaatgatgtgcatttagaggcaaagaactttcaaccacaaaaggacgttgccactgcaagtcccaagactattgctgtactgccccagatgggctccagccccgatgtgatcattgaggagatcattgaggacaatgtagaatcttccgctgagcttgtgttcgtctcccatgtgatcgacccatgtcatttttacatcaggaaatactcacagatcaaggatgcgaaagtcctggaaaaaaaggtgaatgaattctgtaacaggagctcccatctggatccatctgacatcctcgagctcggtgcacgaatcttcgtgagctcgattaagaacggcatgtggtgcagaggcaccattaccgagctcattccgatcgagggccgcaacacccggaagccgtgttcacccacccgcctctttgttcatgaagtggccctgatacagatttttatggtcgattttggaaactccgaggtgcttatcgtcaccggcgtggtggatacccacgttcggcccgaacatagcgccaaacagcatatcgctctgaatgatctctgcctggtactgagaaagagcgagccgtataccgaaggtctgttgaaagacatacagcccttagctcagccttgcagtcttaaggacattgtaccacagaattctaacgagggatgggaagaagaggccaaggttgaatttctgaagatggtcaacaacaaggctgtaagcatgaaggtgtttagggaggaggacggtgtcctgatagtggatctgcaaaagccacctcctaataaaatctccagcgatatgcccgtctctttgcgggacgcactggtgttcatggagctcgccaaatttaaaagccagagcctgcgcagtcactttgagaaaaatacaactctgcattaccatccacccatccttccaaaggagatgaccgatgtctcagtcactgtttgccacattaactccccaggcgatttctaccttcagcttatagagggtttagacattctctttttgctgaagacaatcgaagaattctataagtcggaagatggagaaaatctggagatactgtgcccggtacaggaccaggcgtgtgtcgcaaagttcgaagatggcatttggtaccgcgccaaagtgatcgggctgcctggccaccaggaagttgaagttaaatatgtcgacttcggcaacaccgcaaagatcacgataaaggacgttcggaagatcaaggacgaattcctaaatgcccccgaaaaggctataaagtgcaaactggcctatattgagccatataagaggaccatgcagtggagcaaggaggcgaaggagaagttcgaagagaaagctcaggataagttcatgacatgttctgtgataaaaattcttgaagacaatgtgctgcttgtcgagctgtttgactctctaggggcccctgagatgacaaccacatcaattaacgaccagctagtaaaggagggcctcgctagctacgaaattggctacattttaaaggataacagtcaaaagcatatcgaagtatgggaccctagtcccgaggaaattatctcaaatgaggtacacaatctgaatcctgtgtccgccaagagtttgccaaacgagaactttcagagcctgtataataaggagctccccgtgcacatttgtaatgttatctctcccgaaaaaatttatgtgcagtggctgctgaccgagaacttgctgaattccctggaagagaaaatgatcgcagcttatgaaaattcaaagtgggagccagtgaagtgggagaacgatatgcactgtgctgtgaaaatccaagataagaatcaatggcggcgcggacagatcatccgtatggtcactgataccctggtggaagttttgctttatgatgtcggtgtcgagctggtggtgaatgtggactgtctgagaaagcttgaggagaacttgaaaacaatggggcgtctttcactcgagtgttctctggtcgacattcggccagccggaggatctgataagtggaccgcaacagcttgcgactgcttgtctctgtatctgactggcgccgtcgcaaccattatcctgcaggtggactctgaggaaaataatactacttggcctctgccggtcaaaatcttttgccgagacgagaagggtgagagggtggatgtctccaaatatctgatcaaaaagggcttagccttgcgagagcgacgaatcaacaacctcgataattcccactctttgtccgaaaagagtctggaggtgcctctggaacaagaggactctgtcgtcaccaattgcataaaaacaaattttgatccagacaagaagaccgccgacatcatctccgaacagaaagtctctgagttccaggagaagattcttgagccacgcaccactagggggtacaaacctcccgccatccccaacatgaacgtgttcgaggctaccgttagctgtgtgggggatgatggaacaattttcgttgtccccaaattgtccgaattcgaactcattaagatgacgaatgagattcagtcaaatttgaaatgcttgggactcctagaaccgtacttctggaaaaagggagaagcctgtgccgtacgcggtagtgacacactgtggtaccggggcaaagtaatggaggtggtaggcggagccgtgagggttcaatatttggaccacggattcacagagaagatcccccagtgccacttatatcctatcctcctatatccagacatccctcagttctgtattccatgccagctgcataacactacgccagtgggaaatgtgtggcagcccgatgctatcgaagtcttgcagcagctgctttcaaaacgccaggtcgacatccatattatggagctgcctaagaatccttgggagaaactgagcattcacctgtactttgacggcatgtccctgagctactttatggcctactataaatattgtacctcagaacacacagaagagatgctgaaggaaaaaccaagaagtgaccacgataaaaagtatgaagaggaacagtgggagatcaggttcgaggagctgctttccgcagagaccgataccccactgcttcccccttacttatccagctcactgccctctcctggagaattatacgcagtgcaggtgaaacatgtggtgtcgcccaatgaggtgtatatatgcttggattccattgaaactagtaaccagtcaaaccaacactcagacacagacgattctggcgtgagcggggaaagtgagagtgagagcttggacgaggcacttcaaagagtgaacaaaaaagtcgaggctcttcctccactgaccgattttaggacagagatgccatgcctggccgagtacgacgacgggctctggtacagggctaaaatcgtggctattaaggagttcaaccctttgtccatactggtccagtttgtcgactacggatcgactgctaaactgactctgaaccgcttatgccagatacctagccatctcatgagatacccagcaagggcaattaaggtgctattggccggttttaaaccaccccttcgcgatctcggcgaaaccagaatcccctattgtcctaagtggtctatggaggcactatgggctatgattgactgtctccaagggaagcagctgtatgcagttagtatggctcctgcccctgaacagatcgtgactctgtatgacgacgaacagcatcctgtccatatgcctctggtcgagatggggctggcagacaaagacgagtag

SEQ ID NO: 203857 - DNA, 1350 bp, Artificial Sequence
  Description of Artificial Sequence: Synthetic coding sequence
atggccgccgaggccagcaagaccggccccagccggagcagctaccaacgaatgggacgcaagtcacagccatggggggcggctgagatacagtgcacacgctgcggacggagagtgtctcgctccagcggacatcattgcgagcttcagtgcggtcacgccttttgcgagctttgcctcctcatgacagaggaatgtaccaccattatttgcccagactgcgaggtggcgactgctgtcaatacccgacagcggtactaccctatggccggttatattaaagaagattccataatggaaaaattgcagcccaagactatcaagaactgttcccaggacttcaaaaaaaccgccgatcagttaaccactggtttggagaggtctgcctctacagataaaactcttcttaactctagcgccgtcatgctagacacaaataccgctgaagagattgacgaggctcttaacaccgcccaccactcctttgagcagctctctatagctgggaaagcacttgagcacatgcaaaaacagaccatagaggagagagaacgggtaattgaggttgtcgagaaacagtttgatcagctgctggctttttttgatagccggaagaagaatctctgcgaggagtttgcccgcacaaccgacgattacctgtccaatttaataaaagccaagtcctacattgaggagaaaaagaacaacctgaatgcggctatgaacatcgccagagcattacagctgtctcccagcctacgcacctactgtgatctcaatcagatcattcgcactttacagctgacatcagattccgagctggcccaggtgtcttcaccccagctccgcaatcctcctcgcctgagtgtaaactgctcagagattatttgcatgtttaataacatggggaaaattgaatttagagatagtaccaaatgctacccgcaggagaatgaaatcagacagaacgttcaaaaaaaatacaacaataaaaaagaattatcatgctacgacacatacccacccctggaaaagaagaaggtcgacatgagcgtgttaacatcggaggcccctcctcctcctttgcagccagagactaacgatgttcacctcgaggcaaagaatttccagcctcagaaggatgtggccaccgccagtcccaagactatcgccgttctcccgcagatggggtcctcccccgatgtgattattgaggagattattgaagacaacgtggagacatgcggcactgatgaccttggtgaaacgccgaggtaccctaagaaacccctacagaaaaattcatcggtgcctttcggtagtaaggccgacaccgtgaccactgtttag

SEQ ID NO: 203858 - DNA, 4746 bp, Artificial Sequence
  Description of Artificial Sequence: Synthetic coding sequence
atggccgccgaggccagcaagaccggccccagccggagcagctaccagcgtatggggaggaagagccagccttggggggccgccgaaatccagtgtacacggtgtggaaggagagtgtcacggagttcaggtcatcactgcgagcttcagtgcggccatgctttctgtgaactgtgcttactcatgacagaagagtgtactaccatcatctgccctgactgtgaggtcgccacagccgtaaacacacggcagcgctactaccctatggcagggtacatcaaagaggattccatcatggagaagctccagcctaaaactatcaagaattgctcacaagacttcaagaagacggcagatcagttgaccactgggctggaacggtccgcctccactgataaaaccctacttaattcgtctgcggtgatgctcgacacaaatacagccgaggagattgacgaggccctgaatacagctcaccactctttcgaacagctgagcatcgctgggaaggcgctcgagcatatgcagaagcagactatcgaggagagggagcgagtgattgaggtagtagagaagcaattcgatcagctgctagcgtttttcgattccaggaaaaaaaatctatgtgaggaatttgcccgcaccaccgacgactacctgtctaacttgataaaggcgaagtcttatatcgaagagaaaaaaaataacctcaacgccgctatgaacatcgccagagctctgcagctatctcctagtctccggacatactgcgatctgaaccagatcatcaggacacttcagcttacatccgattcagaactggcacaggtgagcagcccccaactgagaaaccctcctcgactgtccgttaattgctcagagattatatgtatgttcaataatatggggaaaatcgagttccgtgatagcaccaagtgttacccccaggagaatgagatcaggcagaatgtacagaaaaagtataacaacaagaaggaactgagttgctacgatacttacccccccttagagaaaaaaaaggtggacatgagtgtactgactagcgaggccccgcccccacctctccaacccgaaaccaatgacgtgcatctcgaagctaagaatttccaaccccagaaggacgtcgccaccgctagccccaagacaatcgccgtgctccctcagatgggatcctccccagacgtgatcatcgaggagatcatagaggataacgtggagtcctccgcggaactagttttcgtcagtcacgtgattgatccctgccacttctacatccgcaaatatagccagatcaaggacgcaaaggtgctcgaaaaaaaagtaaatgagttctgtaaccggtccagtcaccttgacccttcagatattttggagctgggtgcgagaattttcgtatctagtattaagaatggaatgtggtgtagagggaccatcacagaactgattcccatcgagggtaggaacactcggaagccctgtagtcccacccggctgtttgttcatgaggtagcgctcattcagatatttatggtggattttggaaactctgaagtattaatcgtgacaggcgtggttgatacacatgtgcgcccagagcacagcgcaaaacagcacatcgccttgaatgatctctgtctcgtgctcaggaagagcgagccttataccgaagggctgctgaaggatatccaaccactcgcgcaaccctgcagcctgaaggatatcgtccctcagaatagtaatgagggatgggaagaggaggcaaaggtggagttcctgaaaatggttaataataaggccgtgtccatgaaggtgtttcgagaagaagacggcgttctcatcgttgacctccaaaaaccaccaccaaataaaatcagttcagatatgcccgtgagcctccgggacgcgcttgtgttcatggaactggccaaattcaagagccagtcacttagatcacacttcgaaaaaaatacaacactccactaccatccccccattttgcccaaggagatgaccgatgtctcagtgaccgtctgtcacattaacagccccggggacttctatctgcagctcatcgagggactcgatatcctctttctactgaagacaattgaagagttctacaagtcagaggacggtgagaatctggagattctgtgccctgtgcaggaccaagcatgtgtggctaaattcgaagacgggatttggtacagggccaaagtgatcggactgcctggccaccaggaagtggaagtcaagtatgtggattttggaaacacagctaaaataaccattaaggatgtacggaagattaaggatgaatttttaaacgcgccggagaaagctatcaagtgcaagcttgcttatatcgaaccctataagagaactatgcagtggtctaaagaggccaaagagaaattcgaggaaaaggcccaggacaagttcatgacttgttcagtgattaagatcctggaggataatgtgcttcttgtggagctatttgatagcctaggcgcccctgaaatgacaactaccagcatcaatgatcaactggtcaaggagggtctcgcctcctatgagatcggttatatcttgaaggacaattctcaaaagcatattgaagtctgggatccaagcccagaagagattatcagtaatgaggtccataatttgaaccccgtgtccgctaaatccctgcccaacgagaacttccaatcgttgtacaacaaagagctgcccgtccatatctgcaatgtgatttctccggagaaaatctacgtgcaatggctgctgacagagaacttattgaacagtctcgaggaaaagatgattgctgcctatgagaactccaagtgggagccggtgaagtgggaaaatgacatgcattgcgcggtcaagattcaggacaaaaatcagtggcggcggggacagattattaggatggtgacagatactctggtggaggttttactatacgacgtaggagtggaactcgtcgtaaatgtcgactgcctgcgaaaactagaagagaacctgaaaaccatggggcgactcagcctggagtgcagcctagtcgacattagacccgctggtggttccgataagtggaccgctaccgcgtgtgattgcctgtcactctacctgacaggagcggttgccaccataattctgcaggtggattcagaggagaataatacgacctggcctctgcctgttaaaatattctgtcgcgacgagaaaggcgaaagggtagacgtgagcaaatacttaatcaaaaagggccttgctcttcgcgagcgaagaatcaacaatctggataacagccattctctcagcgaaaaatccttggaggtgccacttgagcaggaggactctgtggtgacaaattgcatcaagacgaacttcgatcctgacaagaagaccgcagacatcatctcagaacagaaagtctcagagtttcaggaaaagatcctggaaccacggaccacaaggggctacaagccccctgctatccccaacatgaatgtgttcgaagctactgtttcatgcgttggagacgatgggaccattttcgtggtgcctaagctctctgagtttgaactgatcaagatgacgaatgaaatacagagtaacctcaagtgtctgggccttctggaaccttacttctggaaaaaaggggaggcctgcgcggtacgcggtagtgacactctgtggtaccgcggtaaggtcatggaagtagttgggggcgccgtgcgagttcaataccttgatcatggctttacagagaaaatcccccaatgccacttatacccaatattgttgtatccagatatccctcagttttgcataccatgtcagctgcataacaccacacccgttggcaacgtttggcaacccgacgctatcgaagtgctgcagcagcttttgtctaaacggcaggtagacatccacatcatgaagcctcgatccgaccacgacaagaagtacgaggaggagcaatgggagatcagattcgaggagttgttgtccgccgaaacagatactccactcttaccaccataccttagttcatcattgccaagcccgggcgagctgtatgccgtgcaggtgaaacatgtagtgtctcctaatgaggtctacatttgtctggactccattgaaacgagtaatcagtcgaatcagcactctgacaccgacgactccggcgtctcaggtgaaagcgaatcagagtcgctggatgaggcactgcaacgcgttaataaaaaagtggaagccctgcctcctttgaccgacttccgtaccgagatgccttgtctcgccgagtacgacgacgggctgtggtacagggcaaagattgtcgccattaaagagtttaatccactctccattctcgtccagttcgtggattacggatctacagccaagctgaccctgaaccgcctctgtcagattcctagccacctgatgcgctatccggcacgcgctattaaggtcctgttggctgggttcaagcctcccctgcgcgacctgggggaaaccagaatcccttactgtccgaagtggagtatggaagcgctttgggctatgatagattgcctgcagggaaaacagttgtatgctgtaagcatggcccccgctccagagcagattgtcacactgtacgacgatgaacagcatccagtgcatatgcccctcgtggagatgggtttagctgacaaggacgagtag

SEQ ID NO: 203859 - DNA, 3207 bp, Artificial Sequence
  Description of Artificial Sequence: Synthetic coding sequence
atgctggacaccaacaccgccgaggagatcgacgaggccctgaacaccgcccaccacagttttgaacagctcagcatagctggcaaggcccttgagcacatgcagaagcagaccatcgaagaacgagaacgagttattgaggtggtcgaaaagcagttcgaccaactgttagcctttttcgacagccggaagaaaaatctttgcgaggagtttgcaaggacgaccgacgactatctcagtaacctcatcaaggcaaaaagctatatcgaagaaaagaagaacaatttgaatgcagccatgaacattgcaagagctcttcagttaagtccgagcctgagaacatactgtgacttgaatcaaattatccgcactctgcaactgacttcagactcagaactcgcccaggtgagctctccgcaactgcgcaatccaccgcgcttgagcgtgaactgttccgaaattatttgtatgtttaataatatgggcaaaatcgagtttagggactcgaccaaatgctacccacaggagaatgagataaggcagaatgtgcagaagaaatacaataacaaaaaggagctgtcatgctacgacacttatccaccgttggaaaaaaagaaggtggacatgagcgtcctgacctccgaagctccccccccccctctccagcccgagaccaatgacgtacatctggaagcgaaaaattttcagccacaaaaggacgtggccaccgccagccctaagacaatcgctgtgttaccccagatggggtccagtcccgacgtcatcattgaggagatcatcgaagacaatgtcgaatcatcagcggagctggtcttcgtaagtcacgtcattgatccttgtcacttctatatacgtaagtatagtcaaattaaggatgccaaggtcctggaaaagaaagtgaacgagttctgcaacagatctagccacttagatccgagcgacattcttgagttgggtgccagaatctttgtctcttcgattaagaacggtatgtggtgtagagggaccataacggaacttataccaattgaaggaaggaacacacggaagccctgctcacctacacggttattcgttcatgaagtggcgcttatacagattttcatggtcgactttggaaactcagaagttctgatcgtgaccggagtggttgatacacatgttcggcccgagcactcagctaagcaacatattgccctgaacgatctgtgtctggtcctgcgcaagtctgagccatataccgaagggcttctgaaggatattcagcccctcgctcaaccttgctccctaaaagatatcgttccccagaacagcaacgagggctgggaggaggaagcgaaagttgagtttcttaagatggtcaacaacaaagccgttagtatgaaagtctttagagaggaagacggtgtgttaatcgtagacttacaaaagcctcctccaaataagatcagctctgatatgcctgtgtcccttagagatgcactggttttcatggagcttgcgaaattcaaatcacaaagcctgcggtcacattttgagaagaatacaaccctacattatcacccgccaattttgccaaaggagatgacggacgttagcgtaacagtttgccacataaacagccccggagatttttacctgcagctcattgaggggctggacatccttttcctcctaaaaacaattgaggaattttataagtctgaggatggcgaaaacctggaaatcctttgcccagtacaggatcaagcttgcgtggccaagttcgaagacggaatctggtatcgcgccaaggtcatcgggctcccaggtcaccaagaggtggaagtgaaatacgtagattttgggaatactgcaaagattaccatcaaggacgtacggaaaattaaggacgaattcctgaatgcacctgagaaggccattaagtgcaagttagcctatatagaaccatataagcgaacaatgcaatggtctaaggaggccaaagagaaattcgaagaaaaggcccaggacaaatttatgacctgctctgtgatcaaaatcttggaggacaatgtcctattggtggaactcttcgattcactcggagccccagaaatgaccaccaccagtattaacgaccaactcgttaaagaaggactcgcatcctatgagattggctatatcctgaaggacaactcccagaagcacatcgaggtttgggacccctctcccgaagaaattatctcaaacgaggtgcacaatctgaacccagtttctgctaagagcttacctaatgagaattttcagtctttgtacaacaaagagctccccgtgcatatttgcaacgtgatctcacccgaaaagatttacgtgcaatggcttctgacggaaaatctgctcaattctttagaagaaaagatgatcgccgcatacgagaactccaaatgggagccagtgaagtgggagaacgacatgcactgcgctgtgaagatccaggacaaaaatcaatggcggcgcggccaaatcatccgcatggttaccgacacacttgttgaagtccttttgtacgacgtaggtgtcgaactggtcgtcaatgtggactgccttcgtaagctagaggaaaacttgaagacaatgggtagattgagcctcgagtgttcgcttgtggacatcagaccagctgggggctcagacaaatggacggcaaccgcttgtgactgcctgagcttgtatttaaccggagccgtggctaccatcatactgcaagtggattcggaagagaacaacaccacatggcctctccccgtgaagatcttctgtcgcgatgaaaaaggcgagagagttgacgtgtcaaaatatctgataaagaaaggactcgcgttgcgggagagacggattaataatcttgacaattctcatagcctgagtgaaaagtcgctggaagtgccactggagcaagaggactccgtggttactaattgcattaagactaactttgatcctgacaaaaagaccgccgatattatttccgagcagaaggtcagcgagttccaggagaagatcctggaaccaaggactacaagaggctacaagccccccgccatcccaaatatgaatgtgttcgaggccacagtttcctgcgtgggagatgacggtacaatctttgtggtgccaaaactttccgaattcgagctaattaagtag

SEQ ID NO: 203860 - DNA, 462 bp, Artificial Sequence
  Description of Artificial Sequence: Synthetic coding sequence
atggccagctacttcgacgagcacgactgcgagcccagcgaccccgagcaagagacaaggaccaacatgctccttgagcttgctagatccctgtttaatcgcatggacttcgaggacttgggcctggtggtagactgggaccatcatctgccaccgcccgccgctaaaacagtggtggagaatttacctcgcaccgtgattaggggctcacaggccgagcttaagtgcccggtgtgtctacttgagttcgaggaggaagaaactgccatcgagatgccttgccaccacctcttccactcttcctgcatcctgccctggctgtctaaaacaaatagttgcccactctgtcggtacgaacttcccacggatgacgatacctacgaagaacacaggagggacaaggcacgaaaacagcagcagcagcatcgcctcgaaaatctccatggagctatgtatacatag

SEQ ID NO: 203861 - DNA, 684 bp, Artificial Sequence
  Description of Artificial Sequence: Synthetic coding sequence
atggcctgcaccaagaccctgcagcagagccagcccatcagcgccggcgccaccactacgacaaccgccgtggcacccgccggagggcattcgggcagcacagagtgcgacctcgaatgtctcgtatgccgagagccgtactcttgcccacggcttcctaaacttcttgcctgccagcatgccttttgcgcgatttgcctcaagctactcctgtgtgtgcaagacaatacctggtctatcacttgcccattgtgcagaaaagtgactgcagtacccggtggactgatttgttcactgcgtgaccacgaggctgttgtcggccagttggcacaaccatgcactgaagtgagcctatgtccacagggcttggtcgatcccgcagacctggccgccggacacccaagtcttgtcggtgaagatgggcaggacgaggtgtccgcaaatcacgtcgctgctagacgactagccgctcatcttttgctgctggctttgttgataatactgatcggcccgtttatttaccctggagttcttaggtgggtgctcaccttcattatcgctttggctctcctcatgtcaaccctgttttgttgcctgccaagcacccgcggctcttgctggcctagttctaggactttgttctgcagagagcaaaaacacagccacatttcgtccatcgcctag

SEQ ID NO: 203862 - DNA, 795 bp, Artificial Sequence
  Description of Artificial Sequence: Synthetic coding sequence
atgagccaggccgtgcagaccaacggcacccagcccctgagcaagacatgggagttgtctctctatgaattgcaaagaacacctcaagaggcaattactgacggtctggagatcgttgtgagccctcgaagtctgcatagcgaactcatgtgccccatctgcctcgatatgctgaagaataccatgacaacgaaggaatgcctgcaccgcttctgcgcggactgcattattacggccctgaggtccggcctgcagagggggaagaagcagcagatcgagaacgggtcaggagcagaggacaacggagattcaagccattgctctaacgcatcaacccactctaaccaggaagctgggccatctaacaagcggaccaagacatccgatgacagcggtctcgagttagataacaacaacgccgcgatggcgattgaccccgtgatggatggggcctcagaaatagaactcgtgttccgcccacaccctactctgatggaaaaggatgactccgcccagacgaggtatataaaaaccagtgggaatgctacagtggatcatctgagcaagtacctggcagtacgtctggctttagaggaactcagatccaaaggagagagcaaccagatgaacctcgacacggcctctgagaagcagtacaccatttacatcgctaccgcgagtggacagttcaccgtgctgaacggatctttttccctggaattggtgagtgagaagtattggaaagtgaacaaacccatggaactgtactacgccccaaccaaagagcacaagtag

SEQ ID NO: 203863 - DNA, 1011 bp, Artificial Sequence
  Description of Artificial Sequence: Synthetic coding sequence
atgagccaggccgtgcagaccaacggcacccagcccctgagcaagacctgggaactgagcctctatgagctccagcggactccgcaggaggcgataacggacggactggagatagtggtgtcgcctcggtcgctgcactccgagctgatgtgtccgatttgcctggacatgctaaaaaataccatgaccactaaggagtgtctccaccggttttgcgctgattgcataatcactgccctccggagcgggaacaaagagtgccccacctgcagaaagaagctggtctcaaagaggtcactcaggccggatccaaacttcgacgctttaatttccaaaatttatccatcgcgggatgagtatgaagcacatcaggagagagtcctcgccaggataaataagcacaataatcagcaagcactcagtcattcaatagaggagggactcaagatccaggcaatgaataggcttcaacgcgggaagaagcaacagatcgagaacggcagtggcgccgaggataatggggacagctcccactgcagcaacgcatctacgcactccaaccaggaagctggaccatctaacaagcggactaaaacctctgacgatagcggactcgaattagacaataacaacgcagccatggcaattgaccccgtgatggatggcgcctctgaaatcgaactggtcttccggccgcaccctacgctgatggaaaaggacgattctgctcaaaccaggtacataaagacaagcggcaatgccacagttgatcatctgtccaagtacctcgctgtacgcctggccctcgaagaactgaggagcaagggggaaagcaaccaaatgaacctggatacagcctctgaaaagcagtatacgatctatatcgcaacagcatcaggccagttcactgttctgaacggatcattttctctggaacttgtcagtgaaaagtactggaaggtgaataagcccatggagctgtattatgccccaactaaggagcataagtag

SEQ ID NO: 203864 - DNA, 741 bp, Artificial Sequence
  Description of Artificial Sequence: Synthetic coding sequence
atgagccaggccgtgcagaccaacggcacccagcccctgagcaagacatgggaactgtccctttatgaactccagaggacacctcaggaagcaatcacagacggcctcgagatcgtggttagccctagaagtttgcactctgaactgatgtgccctatatgcttggacatgctgaagaataccatgacgactaaagagtgcttacacaggttctgtgcagactgtatcattacagccttgcgtagcggcaacaaggagtgccctacttgccgcaagaagctcgtcagtaaaaggagtctgagaccagaccctaacttcgatgcactaattagcaagatttaccccagtagagatgaatacgaagctcatcaggaaagagtgctggccaggatcaataaacacaacaaccaacaggcactgagccattcaattgaggagggacttaaaattcaggcaatgaataggttacagcgcgggaaaaagcagcagattgagaacggtagcggcgccgaggacaatggagactcaagtcattgcagcaatgcatctacacactccaatcaggaagccggcccttctaacaagcgtacaaagacaagcgatgattccggcctggagctggacaacaacaacgcagccatggctatcgatccagtgatggatggcgcctcagagattgagctggtcttcaggccacatcccaccctaatggagaaggatgatagcgctcaaacccgatag

SEQ ID NO: 203865 - DNA, 822 bp, Artificial Sequence
  Description of Artificial Sequence: Synthetic coding sequence
atggccaactgggtgttctgcaaccggtgcttccagcccccccaccgaaccagctgcttctccctgactaattgtgggcacgtctactgtgacgcttgccttgggaaggggaaaaaaaatgaatgcctaatttgtaaagccccctgtaggaccgtcctactgagcaagcatacagatgccgatatacaggctttttttatgtccatcgacagcttatgcaagaaatatagtcgggagactagtcagtacctgagattgtccaggggctgttgtagactcaagctgtgtcccgcaaccagctccaaggaagtgcctcgtgggagtacacacgggagccaagctgccgcgcgggatccacaggagcactgggtctcgaccacacgcgcgcctaggccaggatgccggaggtctcagtcccaacctgaagcccaaggtaacaccattcaagatgcgcctcatccactgacgctacttcatccttcaaggaccttaattcatacaaaatcaccgtggggccagaagctgttggagttcattaagcacgtctgttatcatcgacaccagagccatcgaccttgcgctcccggatggttctgccaagtccttcaaaggccaggcgcagttagtggcgaaaaaacccaacagacccggcccgccccacccgcgacctgtctcctatgtttaagctgcttaagtggtttccggcacggcccttggcgctctcaagctcttcccagcgacctcgtggccccgttatttgttagctacacggtcgaggtgagtatcaccaacgccgggtggagcttccccgccgcagtttag

SEQ ID NO: 203866 - DNA, 699 bp, Artificial Sequence
  Description of Artificial Sequence: Synthetic coding sequence
atggccaactgggtgttctgcaaccggtgcttccagcccccccaccggacttcgtgcttctccctaacaaactgtggtcacgtgtattgtgatgcttgcctaggaaaaggaaagaaaaatgagtgcctgatctgtaaggcaccatgtcggacagtcctgctaagcaaacatacggatgccgatattcaagcctttttcatgagcatagactccctttgcaaaaaatacagcagagagacctcgcagatattagagtttcaggagaagcaccggaaacggctgctcgcattttatcgcgaaaagatctcccgcctcgaggaatcattaaggaaaagtgttctgcaaatcgagcagcttcagagcatgcggagcagtcagcagacagctttcagcacgataaaatcttctgtcagcacaaaaccacacggctgcctgctgcctccacactccagcgctcctgaccgcctggagagcatggaggtcgatctgtccccttctcctatcagaaagtctgagattgccgcaggaccggcccgcatctccatgatcagtcccccccaagatggtagaatggcgccctgtgctagaagagtgtgccactttcaaaggttcaccatgttcctgcatcggagactaagctcactcgctgctcccccgagcgttcagttttggaaagccagggggacccatcagttgtag

SEQ ID NO: 203867 - DNA, 894 bp, Artificial Sequence
  Description of Artificial Sequence: Synthetic coding sequence
atggccaactgggtgttctgcaaccggtgcttccagcccccccacagaacatcctgcttctctctgaccaattgtggtcacgtttactgtgacgcctgtctgggcaaaggaaaaaagaacgagtgcctgatatgtaaggccccatgtcgcaccgtgctcctctctaagcatacagacgcagacatacaggccttctttatgagtattgacagtttatgtaagaaatactcacgcgaaacgtcccaaattcttgagttccaggaaaagcacagaaaaagactgctcgctttctatcgtgagaaaattagcagactggaagagagtttgagaaagtccgttctccagattgagcaattgcaaagcatgagatcgtcacagcaaaccgcttttagcacaattaaatcaagtgtaagcaccaagccgcacggctgtttgttgcccccacattctagcgcccccgataggctggaaagcatggaggttgacttgtccccatccccaatccgtaagagcgaaatcgcagccggccctgcgcggatatccatgatctctccaccccaggatggccggatgggtcctcacctcaccgcgtcattctgctttatcccctggcttacactctcaaaaccccctgtacccggagaatgtgtaatcagcagaggctccccatgcttctgcatagacgtgtgtccccactggttgctgctgctagctttcagttccgggcgacatggggaactcactaactccaaaacattaccgatttacgccgaggtgcagcgggctgttctatttcctttccagcaggcggaaggaactctggacacatttagaacccccgctgtatcagttgtgttccctttgtgccagtttgagaggaaaaagtctttttag

SEQ ID NO: 203868 - DNA, 3192 bp, Artificial Sequence
  Description of Artificial Sequence: Synthetic coding sequence
atggagtgccccagctgccagcacgtgagcaaggaggagacccccaagttctgctctcagtgcggagaaaggctgcctcccgctgcacctatcgctgactcagaaaataacaattcaaccatggctagtgcgtcagaaggtgaaatggagtgcggccaggagttaaaggaggaggggggcccctgcctgtttccaggatccgatagttggcaggagaatcctgaggagccctgctcgaaagcgagctggaccgttcaagagagcaaaaaaaaaaaacggaagaaaaagaaaaaagggaacaagagtgcctcatcagaactggcatccctccccctgtcacctgcctcaccatgccaccttacactgctgtctaacccatggccacaggacaccgctctccctcattcccaggctcaacaatctggccctactggacagccaagccagcccccgggcactgccactacgcccctggaaggcgatggactgtcagccccaaccgaggtgggggattctcccttgcaggcgcaggcactcggcgaagccggagttgccacagggtccgaggcacagagttctccccagttccaggaccacaccgaaggggaggaccaggatgcgtcaattcctagcgggggacgcggactttctcaagaggggaccggtccaccaacttccgctggggagggtcacagcagaacggaggacgccgcccaggaactcctcctgccagagtcaaaaggcgggagctctgagcccgggactgagctgcagaccacagagcagcaggcaggggcgagtgccagcatggctgtggatgcagtggccgaacctgctaatgctgttaagggggccggaaaggaaatgaaagagaagacccaacggatgaaacagcccccggccaccacaccaccgtttaaaacccattgtcaggaagccgaaaccaagacaaaggacgagatggccgctgctgaggagaaagttggaaagaacgagcagggtgagccagaggacttgaaaaagccagaaggtaaaaataggagtgccgctgccgtgaagaacgagaaagagcagaaaaaccaggaggccgacgttcaggaagtcaaggctagtaccctctctcccggcggcggggtgacagtatttttccatgcaataatcagtttgcactttccttttaaccctgacctgcacaaggtattcatcagaggaggtgaagagttcggggaatcaaagtgggattcgaacatatgcgagctgcactacactagggatctggggcacgaccgcgtcttggttgaaggaattgtttgcatctccaagaagcacctggacaaatatatcccttataagtacgtgatctataatggagaaagtttcgaatatgagtttatctataagcaccagcagaagaaaggggagtatgtcaaccggtgcctgtttataaagtccagtctactcggcagcggggactggcaccagtactatgatatcgtctatatgaagcctcatggtagacttcagaaggtgatgaaccacatcacagatggccccagaaaagacttggtgaaaggcaagcagatcgccgccgctttgatgctggacagcacctttagcatcctgcagacatgggacacaataaacctcaattctttcttcacccagtttgaacaattctgtttcgtattacagcagccaatgatctatgaaggccaagctcagctttggacagacctacagtacagggaaaaggaagttaaacgctatctctggcagcacctgaagaagcacgtagttcctctgccggatggaaaaagcaccgatttcctaccagtagattgccctgtccgtagcaaactcaagaccggattgatcgtactgttcgtggtcgagaagattgagctgttactcgaagggagcttggattggctttgtcatctcttgacgtctgacgccagcagccccgacgagtttcaccgcgacctttctcatatccttggcatcccacaatcttggaggctatacctggttaacctgtgccagcggtgcatggacacccggacttacacttggctgggggctctgccagtgctgcactgctgcatggaactggctcctcggcataaagatgcctggagacagccagaagacacctgggccgcgctggagggcctctcgttcagcccattccgcgagcagatgctcgatacgagctcccttctgcaattcatgagagagaagcagcacttgctgagcatagatgaacccctctttcggtcctggttttctttgctgccccttagccatctcgtgatgtatatggagaatttcattgagcatctcggtagattcccggcacacattctggattgcctgagcggaatttattataggctgccgggactagagcaggtgctcaatacgcaagacgttcaggacgtgcaaaacgtgcagaatatcctagagatgctgctccggctcctagacacctacagggataagattccagaggaggccctgagtccaagttacctgactgtgtgtctgaaactacatgaggcaatttgcagctccaccaaactactcaaattctacgagctccccgccttatctgctgagattgtctgcagaatgataagacttctgtctctggtggattccgccggccaacgagatgagaccggaaataatagtgtgcagaccgtcttccagggcaccctggccgccacaaagagatggttacgagaagtgttcacaaaaaatatgctcacaagttccggtgctagctttacttatgtcaaagagatcgaggtctggcgaagactagtcgagattcagttcccggctgagcacggttggaaggagagtttgctcggtgacatggagtggcgtctcactaaggaagagcctctcagccagattaccgcctactgcaacagttgttgggacacaaagggtctagaggactcagtggcaaagaccttcgaaaaatgtattattgaagccgtgagcagcgcctgccaggtgaataatcttagctcatgggagactgatagcggtagtcagctgtgttctgctatgacccagcttcgggccatgaagcatcctcttggattgtcatcgtccgcgaatagtgagataggtaagtgggcgcctagctccctggctaaaggcaacggtgccgagatctag

SEQ ID NO: 203869 - DNA, 9843 bp, Artificial Sequence
  Description of Artificial Sequence: Synthetic coding sequence
atggtgtgcgacggcgactgggagcactgctacctgcccagcgccttctctcaacataaagtgtttgtaaccccacaggcgcctctggaagccatacaggcctatttggcaggtcactacagagtccctaagcagacactgagcgcagctgctgttttcaatgatcgcctctgcgtagggattgtggcttctgaaagagccggagtcgggaagtctctatatgtaaaacgcctacatgataagatgaaaatgcagctcaacgtcaagaacgtacccttgaagaccatacggttgattgatccgcaggtcgacgagtctcgggtactgggcgccctgttgccttttctagatgcgcagtatcagaaagtacctgttctatttcacctggatgtcacaagttcagttcagaccggcatttgggtgtttctgtttaagctgcttattttgcagtacctcatggacatcaacggcaaaatgtggctgagaaatccctgtcatctgtacatcgtagagatattggaaagacggaccagtgttccgtcgaggtcttcaagcgcactacgaacacgggtgccccagttctccttcctagatatctttcccaaggtgacctgccgccctccgaaagaggtgattgacatggaactttctgcactgcggagtgacaccgagcccgggatggacctatgggagttctgctccgaaacctttcagcgaccgtatcagtacctcaggcgctttaatcaaaatcaagaccttgacaccttccagtaccaggagggctctgtggagggaaccccagaagaatgccttcagcacttccttttccactgcggagtgattaatcccagctggtctgagcttcgtaacttcgcgaggtttctgaactaccagttgagggattgtgaggccagcttgttttgcaaccccagttttattggggacaccctgcggggatttaagaagttcgttgtcacatttatgatttttatggcccgtgatttcgccactccttctctgcatacatctgaccagtcgccaggaaagcacatggtcaccatggatggagtgcgtgaggaggacctcgccccgtttagcctgaggaagcggtgggaatctgagcctcacccttatgtattttttaatgacgaccacaccactatgacctttatcggattccacttacagcccaatatcaatggaagcgttgacgccatttcccacttgaccggcaaggtgattaaaagagacgttatgacccgagacctctaccagggactgcttctgcagcgcgtcccatttaacgttgatttcgacaagttaccccgacacaaaaagttggagaggctctgtctgacactggggattccccaagctacagaccctgataagacgtatgagcttaccacagataatatgctgaaaatactagcgattgaaatgcgttttaggtgcggcattcctgtcatcattatgggcgagactggttgcggcaaaacacggctgatcaaatttctgtctgatttgagaagaggaggaactaatgctgacacaatcaaactagttaaagtacacggtgggactactgcggatatgatctactcccgggtgcgagaggccgaaaatgtagctttcgccaacaaagaccagcatcagctggataccatcctgttcttcgatgaggcgaataccaccgaggccattagctgtatcaaggaagtcctatgcgaccatatggtcgatggccagcctctggccgaggattctggcctacacatcatagccgcctgtaacccttatagaaaacatagcgaggaaatgatctgtcgcctggaatctgccggtctagggtaccgcgttagcatggaggaaacagctgacagactcgggagtataccgctccgccagctggtatatcgcgtgcatgctctccctcccagtctcatcccgctggtttgggatttcggacagctgagtgacgttgcggagaaactgtacatccagcagatcgtccaaaggctggtggagagcatcagtctggatgagaacggaacccgcgtgattaccgaggtgctctgcgcgagccaaggttttatgaggaagactgaggacgaatgctccttcgtctccctgcgcgacgtggaacgatgtgtaaaagtctttagatggtttcatgaacattccgctatgctgctggcccaacttaatgcgtttctgagcaaatccagcgtatctaaaaatcacacggagcgcgacccagttttatggtcactgatgctagcaattggggtgtgctatcatgccagtctcgagaagaaagattcttatagaaaggctatcgcccgcttttttcccaagccgtatgacgatagcaggttactactggacgagatcacccgagcccaggacttgtttctcgacggcgtcccgctgcgcaaaacaattgccaagaatctggccctcaaagagaatgtcttcatgatggtcgtatgcatcgagctgaagattcccctgtttctcgtcgggaagcccggctctagtaagagcctggccaagaccatcgtggctgacgccatgcaaggacctgccgcttacagcgatctatttcgcagcttgaagcaggttcacctcgtgtcttttcagtgttccccccatagcactccgcagggaattatatccacttttagacaatgcgcacgattccagcaaggtaaagatttgcagcagtacgtgagcgtcgtggtgctggacgaagtcggcttggccgaggatagtcctaaaatgcctcttaagacactgcatcctctgctggaagatggatgtattgaagacgacccggctcctcataaaaaagtagggttcgtaggaatctccaattgggccctggaccccgccaagatgaatcgcggcatttttgtgtctcgcggatccccaaacgaaaccgagctgatcgaatctgcgaagggaatttgtagcagcgacatcctggtgcaggaccgcgtgcagggatacttcgccagcttcgctaaggcttacgagactgtctgtaagcgccaggataaggaattttttgggctgcgtgactattatagcttgattaagatggtgtttgccgcagccaaggcctctaatcggaagcctagcccacaggacattgctcaagccgttctaagaaacttcagtggaaaggatgatatacaagcactggatatatttctcgcaaacctgcccgaggccaagtgtagtgaggaagtgtcaccaatgcagctcattaagcagaacatcttcggtcccagccagaaggtgccaggaggcgagcaggaggacgccgaatccaggtaccttctggtcctgacaaaaaattacgtggccctccagatcctgcagcaaaccttcttcgagggggaccagcagcctgaaattatctttggaagtggattccctaaggaccaagaatatacacagctatgtcgaaacattaatagagttaagatttgcatggagacaggcaagatggtgctgcttctgaatcttcagaatctgtatgaatcactgtacgacgctctgaatcagtactacgtccatctcgggggccagaaatacgtcgatctgggcctcggaacccaccgggtgaaatgtcgggtccacccaaattttaggctaatagttattgaggagaaggatgtagtgtacaaacattttcccatccccctgatcaatcgcctcgaaaaacattacctggatattaacacagttttggaaaagtggcagaagagcatcgtggaggagttgtgcgcttgggtggaaaagtttatcaatgtgaaagctcaccacttccagaagcgccacaaatacagtcccagtgatgtgttcatcggctatcactctgacgcttgtgcttctgttgtcctgcaggtgattgagcgacagggcccaagggcgttgactgaagagttgcatcagaaagtttccgaggaagctaagagtatcctcctgaactgcgccactcctgatgccgttgtaagactctccgcatacagccttgggggatttgcggccgaatggctcagccaagagtatttccaccgacaacgacataacagttttgccgatttcctgcaggcacacctccacacggccgatttagagcgacatgcaatttttaccgagattaccaccttctctaggcttctgacaagccacgattgtgagatcctggaaagtgaggtgaccgggcgggcaccaaagccaaccttgctgtggctgcaacagttcgataccgagtactcttttctgaaagaggtgcggaattgtctgactaacaccgctaaatgtaagattcttatttttcagaccgactttgaagatgggatccggtccgcccagctgatagcaagcgccaagtactccgtgattaacgaaataaataagatccgcgaaaatgaagacagaattttcgtgtacttcattactaagttatcaagagtcggacgcggcacagcctacgtgggatttcacggtgggctgtggcagtctgtacacattgacgacctgaggcgatccactctcatggtttcagacgtcactcgactgcagcacgtcactatctcacaattgtttgcacccggcgacttgcccgaacttggtctggagcaccgagcggaggacggacacgaggaggcaatggaaaccgaggcctccacttccggcgaggttgcagaagtcgccgaggaggctatggagactgaatcctccgagaaagtgggcaaagagaccagcgagctgggcgggagcgacgtatccatactcgacaccacacgcctgctgagatcttgtgtacagtccgccgtggggatgctcagggatcaaaacgaaagctgcactcgaaatatgcggcgcgtggtacttctgctgggtcttctgaacgaagacgacgcctgccacgcatcatttctgagggtgtccaaaatgcggctttctgtgttcttgaagaaacaggaagagagtcagttccatcctttggagtggttggcccgcgaagcctgtaaccaggacgcactccaggaggctggcacttttcggcatactctgtggaagcgcgtgcaaggagctgtgacacccctacttgctagtatgatctcctttatcgatagggatggaaacctggagttgctgactagacccgatacccctccctgggccagggatctgtggatgttcattttttccgataccatgctgctaaatatccctctggtaatgaacaatgagagacacaagggagaaatggcctacattgtagtgcagaaccatatgaacttaagtgaaaacgcctccaacaacgttcccttttcatggaagattaaggattatttagaagagctgtgggtacaggcacaatatatcaccgatgccgaaggcctccctaaaaaattcgttgatatctttcagcaaactccattggggcgatttttagcccagcttcacggtgagccccagcaggagttgctccaatgttaccttaaggattttatcctgctgactatgcgcgtgagtacagaagaggaattgaagtttttacagatggccctgtggtcctgtactagaaaacttaaggctgcctcggaagccccagaggaagaggttagcttgccatgggtgcatttggcttatcagagattcaggtctcgtctgcagaatttttcccgtattctgactatctacccacaggtattgcatagcctcatggaagcaagatggaaccacgagctggctggctgcgagatgaccttggatgctttcgccgctatggcatgtaccgagatgcttacccgaaacacccttaaaccttccccccaggcatggttgcagctggtgaaaaacctgtccatgccactggaacttatctgctctgatgaacacatgcagggcagcggttccttggcacaggcggtcatacgcgaagtgcgcgcacagtggtcaaggattttcagtactgcattattcgtcgagcacgtgcttctcggaacagagtccagagtgcccgaactacaggggctcgtgaccgagcatgtgtttctgctggacaagtgtctgagggagaattcagacgttaagactcatggaccttttgaggctgtgatgcggaccctctgcgaatgcaaggagacagcctcgaaaacactgtcccgcttcggaattcagccatgctccatttgtctcggcgatgcaaaggatcctgtctgtcttccttgcgaccacgtccactgtctgcggtgcctacgggcctggtttgcctcagagcagatgatctgcccatattgcctcacggccctcccagacgagttttccccggccgtttctcaggcccaccgggaggctatcgaaaaacacgcaaggtttcggcagatgtgcaattctttctttgtggacctggtatccaccatctgtttcaaggataatgcaccaccagagaaagaggtaatcgaatccctgctttctctgctattcgtccaaaagggccggctccgcgatgcagctcagaggcactgcgagcatacaaagagcctgtcacctttcaacgacgttgtggacaagactccagtaattaggagtgtcatcctgaaacttttactgaaatattctttccatgatgttaaagattatattcaggaatatcttaccctgctgaagaagaaagccttcatcaccgaagacaagaccgagctttacatgctgttcatcaactgtctggaggattccattctcgaaaagacttcagcctactccagaaatgatgaactcaatcatttggaggaagaagggaggtttctcaaggcatatagccccgcctctaggggacgggagcctgcgaacgaggcatctgtggagtatctgcaggaagtcgccagaattcgcctgtgcttggatagggctgccgatttcctgtctgagccggagggaggaccggaaatggcaaaggagaagcagtgctatttacagcaggtcaagcagttttgtatccgggtggaaaatgattggcacagagtttatctcgttcggaagcttagcagtcaaagagggatggaatttgtgcagggcttaagcaaacccggacgtcctcaccagtgggtttttccaaaggacgtggttaagcagcagggattgcgtcaggatcatcctgggcagatggaccgttacctggtgtacggtgacgagtataaggccctacgcgatgccgtggctaaggcggtgttggaatgtaaaccactagggatcaagaccgcattaaaagcttgtaaaactccccagagccagcagagcgcctacttccttcttaccctattcagagaagtcgccatcctttatcgtagccataatgctagcctgcatccaacgcctgaacagtgtgaagcagtctcaaagtttatcggggaatgcaaaatcctttctccaccggacatctcccgcttcgccacctctctggtggataattccgtgcccctccttcgagccggaccaagtgacagcaacctggatggaactgtgaccgagatggcgatccatgctgcggcggtgttgctgtgcggccaaaacgaacttctggagcccctgaagaatctggcgttctctcctgcaaccatggcacatgccttcttacccacaatgcccgaggatcttctagcccaagccagacgctggaagggcctggaaagagtgcactggtatacttgcccaaacggccacccctgctccgtgggggagtgcgggcggccaatggaacagagcatctgcatagattgtcacgccccgatcggagggatagaccataagcccagggatggcttccacctcgtgaaagacaaggccgatagaacccaaaccgggcatgttctgggaaaccctcagcggagagacgtggtaacatgcgaccgcggtctgcctccggtggtctttctgctgatccggctcctcacacacctggcattgctgttaggtgcatcccagtcaagtcaagctctgatcaacatcatcaaacctccagtgcgtgaccccaagggtttcttgcaacagcatatcctgaaagacctggagcaattagcaaaaatgctaggtcattccgcagatgaaacgataggagtagttcaccttgtgctgaggaggcttttgcaagaacagcaccagctgtctagtcggaggctgcttaactttgacactgagctgagtacaaaagaaatgagaaacaactgggagaaagagatcgccgccgtcatcagcccagaattggaacacttagacaagactctgccgacaatgaataatttgattagtcaggacaagaggatatcatccaatcccgtggcaaagataatctacggcgaccctgtgacattcctcccccatctgccacggaagtctgtggtacattgcagtaaaatatggtcttgcaggaaaaggataaccgtcgaatatctccagcacattgttgaacagaaaaatgggaaggaaagagttcccatactctggcactttctccaaaaggaggccgagctgaggctcgtgaagtttcttcctgagatattggcccttcagagggatttagtgaaacagttccagaacgtgcagcaggtggaatacagcagcattcggggtttcttatctaaacacagcagcgacggactccgacagctgctgcacaatcggattacagtcttccttagcacatggaacaagctgagaaggtcactggaaaccaatggagagatcaacctgccaaaggattactgttccacggatttagacctcgacaccgaatttgaaatcctcctccccagacgccggggtctgggtctgtgtgctactgcgctcgtctcatacctaatccgcctgcataacgagattgtttacgctgttgagaagctctccaaagaaaataactcctatagtgtagatgccgccgaggttacagagctgcatgtgatttcttacgaggtggaacgagacctcacacccctgattttgagcaactgtcagtaccaggtggaggagggcagggagaccgtccaggaatttgacctagaaaaaatccaacgccagatcgtatcccgctttctgcagggtaaaccgcggttgagcctgaaggggattcctactctagtgtatcggcacgattggaactacgaacatctgttcatggacatcaaaaacaagatggcccaggactccctgcccagctctgtgatttccgccatctcaggccaattgcagagctattccgatgcctgcgaagtgctgagcgtagtggaagttaccctggggtttcttagtaccgctgggggggaccctaatatgcaactgaacgtctacacccaggatatcctgcagatgggtgaccagacaatccacgtgttgaaggctctaaaccgctgccaattaaaacatacaatcgccctgtggcagttcctgtctgcccataagtccgagcagcttctgcggctccataaagagccctttggtgaaattagtagcagatataaggcggatctgtctcccgagaatgccaaactgctctccacgttcctgaaccagaccggtctggacgctttcctcctggagctccatgagatgattatactgaaactgaagaatccgcagactcagaccgaggagaggtttcgtccccagtggtccctgagggacactctagtctcctacatgcagacaaaggagtccgagatcctgcctgagatggcatcccagtttcccgaggagattctcctggctagttgtgtctccgtgtggaaaacagccgccgttctcaagtggaatagggagatgcgctag

SEQ ID NO: 203870 - DNA, 4653 bp, Artificial Sequence
  Description of Artificial Sequence: Synthetic coding sequence
atggagtgccccagctgccagcacgtgagcaaggaggagacccccaaattctgttcccagtgtggtgagcgtttgccaccggcggcccctattgcagatagcgaaaataataattccacaatggcttctgcttcggagggcgagatggagtgcgggcaagagctaaaggaagaaggcggcccgtgcctatttcctggaagcgatagttggcaggaaaacccagaagagccgtgctccaaggcctcttggaccgttcaggagtctaagaaaaaaaaacgtaaaaagaagaagaaaggcaataaatccgcttcttccgagctcgcatccctgccattgtctccagcaagtccctgtcatctaaccctcctgagcaacccatggcctcaggataccgctctgccacatagccaggcccaacagtccggtcctacaggacagcccagccagcctccaggcacagcaacaaccccactggagggggatggactcagcgcccccaccgaggtcggagactctcctcttcaggctcaggctttgggcgaggctggcgtggccaccggctctgaagcccagtctagcccacagttccaggatcacacggaaggggaggatcaggatgccagcattccctctggcggacggggactgtcccaggagggcactgggccccctacaagtgctggggaaggccactccaggacagaggatgctgctcaggagctcctgctccctgaaagtaagggagggagcagtgagcctggtacagaactgcagaccaccgaacagcaggcaggagccagtgccagcatggccgtcgacgcggtagcggaaccagccaatgccgtgaagggagccgggaaagaaatgaaggaaaaaacccagcgaatgaaacagccacccgcgaccacacctccattcaaaacccactgccaggaggccgaaaccaagaccaaggatgaaatggcagccgctgaggaaaaggtggggaaaaatgagcaaggcgagcccgaggatttgaaaaagcccgaaggtaagaacagaagcgccgccgccgtgaagaacgaaaaagagcagaaaaatcaggaggccgatgtacaggaagtcaaggctagcactctctctcctggtgggggcgtgaccgtgttcttccacgcgattatcagcttacattttcccttcaaccctgatctccataaggtgttcattaggggcggggaagaatttggcgagtccaagtgggattcaaacatttgcgagctgcactacactcgggatcttggccacgaccgcgtgctggtagaaggaatcgtgtgcatcagcaaaaaacaccttgacaagtatattccctacaagtatgtgatctacaacggcgaaagcttcgagtatgaattcatatacaagcaccagcaaaagaagggggaatacgtgaaccggtgtttgttcatcaagagttcactgcttggatcaggagactggcatcaatactacgacatagtgtatatgaagccccacggccggctccagaaggtcatgaaccacatcactgatgggccccgtaaagacttagtcaaaggcaaacaaattgcggctgccctgatgctggattctacattctccatcctacagacttgggacaccattaacctgaacagttttttcacgcagttcgaacaattctgttttgtgctccaacagcccatgatctacgaaggccaggctcagctgtggaccgaccttcagtatcgtgaaaaagaagtgaaacgctacttgtggcaacacctgaagaagcatgttgtccctcttcctgacggaaagtctacagattttctgcctgtcgactgtcctgtgcgatccaagctgaaaactgggcttatcgtgctgtttgtcgttgaaaaaattgaactgctcctcgaaggcagcctggactggttgtgccaccttctgacaagcgatgcctccagccccgatgagttccacagagatctgagccatatactgggcattccccagtcttggcgcttgtatttggtgaatctatgtcagcggtgcatggatacgcgcacctacacgtggcttggtgccctgccagtccttcactgctgcatggaattggccccgagacacaaggacgcttggcgtcagccggaggacacttgggccgctcttgagggtctcagtttctcgccttttagagagcagatgctggatacctccagtctgcttcaattcatgcgagagaaacagcacttactgagtattgatgaacctttgtttagaagctggttcagtctgcttcccctgagccacctggtcatgtatatggagaattttattgaacatctcggcagattcccagcacacatattagattgcctgtccggaatatattacagattacccggtctggaacaagtgctgaacactcaggatgtacaagatgtgcaaaatgtacagaacattctggaaatgctgctgcggctacttgacacatacagggataaaataccggaagaagccctaagtccgagctatcttaccgtatgtctcaaactacacgaagccatctgctcatctactaagctgctcaagttttatgaactgcccgccctttctgctgaaatagtatgccggatgatcaggctgttgagtctagtggattccgccggtcaacgtgacgagacaggaaataattctgtgcaaacagtgttccaaggaactttagctgctacaaaacgctggttgagagaggtgttcaccaaaaatatgctcaccagtagtggcgctagtttcacatatgtaaaggagatcgaagtctggcgtagactcgtggaaatccagtttccagctgaacatggatggaaggagagcttactgggagatatggagtggcgacttacaaaggaagaacctctttcacagatcaccgcctactgtaactcttgctgggacaccaagggcctcgaagactccgtggcgaaaacattcgagaaatgcatcatcgaggccgtcagcagtgcctgccagtcccagacgtccattcttcagggattcagttactccgatttgaggaaatttgggatcgtgctcagcgccgtgatcacaaaaagttggccacgcacagccgacaattttaacgacatcctcaagcacctcctcacacttgcagatgtcaagcatgtgtttaggctttgcggtactgacgagaaaattctggccaatgtgaccgaagatgcgaaaaggctgatcgccgtggctgatagtgtcctcaccaaagtcgtgggggacctgctaagtggtaccatcctggtgggccagttggaactcattataaagcataaaaatcaattcctggatatttggcagctcagggagaagtcattatctcctcaggatgaacagtgtgccgtcgaggaggcattggattggcgcagagaggaactgctactactgaagaaggagaagagatgtgttgattcacttctgaaaatgtgcggaaacgttaaacacctgattcaggtcgacttcggcgtcctcgcagtgcggcattctcaggacttgtcctccaagaggttgaacgataccgtcaccgtacgattgtctacctcaagtaactcacagcgtgctactcactatcatctgtcatcccaggtgcaggaaatggcaggaaaaatcgacctactaagggattcacacatcttccagctcttctggcgggaggcggccgagcctctttcagaaccaaaggaggaccaggaggccgctgagcttctttcagaacccgaggaggagtctgaaaggcatattctggagctagaagaagtgtacgactacttataccagccgagctatagaaagtttatcaagttgcaccaggatctgaaaagcggcgaggtgaccttagctgaaattgatgtgatctttaaggacttcgtcaacaaatataccgatttggactccgagctcaagatcatgtgtacggtcgaccatcaggaccagagagactggatcaaggatcgtgttgaacaaataaaggaataccaccatctccaccaggccgttcatgcggccaaagtcatcctgcaagttaaggagtctctcggcctgaatggcgacttctcagtgctcaacacacttttaaactttaccgataattttgacgactttagaagagagacgctcgaccagataaaccaggagctgattcaggctaaaaaactgctgcaggacatcagcgaagcaagatgcaagggtctgcaagctctcagtctgaggaaggaatttatttgttgggtaagggaagctcttggcggcatcaacgaactcaaggtattcgttgatctagcgtccattagcgctggggagaatgatattgacgtggatcgagtggcgtgcttccacgatgccgtccaggggtatgcttctttgttgtttaagttggatccaagcgtggacttctctgccttcatgaagcacttgaagaaactctggaaggctctggataaggatcagtatctcccacggaagctcgtaagtctgattctctcccttatgcagatcctcctgaatcgggctctgttgagcaatgtcagagctgtcacagttgaaatggtcgcacacttgtgcgggcgttttgtgcattccagattccagtag

SEQ ID NO: 203871 - DNA, 15771 bp, Artificial Sequence
  Description of Artificial Sequence: Synthetic coding sequence
atggagtgccccagctgccagcacgtgagcaaggaggagacccccaagttctgcagccagtgtggagaaaggttgcctccagcagctcccatcgccgattctgagaataacaattcaaccatggcttcggctagcgagggcgaaatggagtgcggacaagaactcaaggaagaggggggcccatgcctatttcctggctccgattcctggcaggagaatcccgaagaaccttgtagcaaggcttcttggactgtgcaggaaggggctacttctgaggtcttggtcgacgctgctgtcgacctgatcagcgatgagtgggaggcagctaatgcaatcccttctaagcggagaaagcaggacgcggcacctctggaggcagcttcagtaccgtctgctgattgtgaacagtccaaaaaaaagaaacgcaagaaaaaaaagaaaggcaataaaagcgcttcttctgagctggctagtttgccactctcgcccgcatctccgtgccacttgactctcttgtctaacccctggcctcaagacaccgctttgccccactcgcaggcacagcaatccgggcctactggtcaacctagccagccccctggaacagcaaccaccccacttgagggtgatgggctgtcagctccgactgaggtgggcgactcacccttgcaagcacaggccctcggagaagccggggtggcaacgggctctgaggcgcagtccagtcctcagttccaagaccacacagagggagaggaccaggatgcgtcaatcccttctggtgggaggggactgtcccaggaaggaacagggcctcccacctcggcgggcgagggccactcaagaacagaagacgccgcccaggagttgcttctgcccgagagcaaggggggtagctctgaaccagggacggagcttcagactaccgaacagcaggctggtgcttctgcctcaatggccgtcgacgccgtggcggaacccgccaatgccgtgaaaggggctgggaaggagatgaaggagaagacacagaggatgaagcaaccacctgccaccacgcccccatttaaaactcactgccaggaagccgagacaaagacgaaggatgagatggctgccgctgaggaaaaagtgggcaagaatgagcagggagagcccgaagacctcaaaaaacccgagggcaaaaaccgctcagccgcagccgttaagaatgagaaggagcaaaagaatcaagaggctgatgtgcaagaagtcaaagcaagcactctctctcctggagggggggttacagtcttcttccacgccataatttcactccacttcccctttaaccccgacttgcacaaggtcttcatccgggggggagaagagtttggagaatccaagtgggacagcaatatctgcgaactccactacactcgagacctgggacatgatagggtgctggtggaagggatagtctgtatctctaaaaaacacctggataagtatattccctacaagtacgtgatctacaatggggaatctttcgaatacgagttcatttacaaacatcagcagaaaaagggggagtatgtgaatcgctgtctcttcatcaaaagttcgcttcttggaagtggggattggcaccaatactacgatatcgtctatatgaaaccacacggtcgcttgcagaaggtcatgaaccacatcactgatgggccaagaaaggaccttgtgaaagggaagcaaatagcagcagccttgatgctcgattcgacgttctccatcctccaaacatgggacacgattaatctgaactccttttttacacagtttgagcagttctgctttgtgcttcagcaaccgatgatatatgaggggcaggcgcagctctggaccgatctccagtatcgggagaaggaggttaagcgctacctgtggcagcatttaaagaaacacgttgtcccacttcctgatgggaagtccacggactttcttcctgttgattgccctgtgagatcaaaattaaaaacaggtctgattgttttatttgtcgtggaaaagattgaacttttattagagggaagtttagattggttgtgccatctgttgacctcggacgcgagcagccctgatgagttccaccgggatctctctcatatactggggattccccagagctggagactgtacttagtaaacctttgtcagcgctgcatggacacacggacatatacctggctgggagctctgcccgtgcttcactgttgcatggagttagccccccgacataaagacgcatggcgccaacccgaagatacatgggcagccctggaaggcttgtccttctccccttttagggagcagatgctggatacatcttctttgctccaattcatgagggagaaacaacacctgctatctatcgatgagccgttgttccgatcttggttcagcttgttaccactttcacacttggtaatgtacatggagaacttcattgagcacctcggtaggtttcctgctcatattcttgactgcctctccgggatctattatagactccctggcctggagcaggtgctgaacactcaggatgtacaggacgtccaaaatgtgcagaacatactcgagatgctgctcagactcctggacacttatagggataaaataccggaagaggcattgtcgccctcctacttgactgtctgtctgaagttgcatgaagcgatttgtagctccaccaagctgctgaaattttacgagctgcccgcactgtctgcagagatagtttgtaggatgatccggctgttgtcgctggtcgatagcgccggccagcgtgacgaaacaggcaataactccgtacagactgtgtttcagggcactctggccgcgaccaagaggtggctaagagaagtgttcacaaagaacatgcttacaagttctggcgcgtccttcacttacgtaaaggaaatcgaagtttggcgacgacttgttgagatccaattccccgccgaacatggctggaaggaaagcctgttgggggatatggaatggcgcctcactaaggaggaaccactttcccagatcacagcgtattgcaatagttgttgggataccaagggcttggaggattctgtcgccaagacatttgagaagtgtataattgaggctgtgagtagcgcttgtcagagtcagacttccattctccagggattcagttactctgacctgagaaaattcgggatagtcttaagcgcagtgattactaagagctggcccagaacagcggacaacttcaatgacattcttaagcacctgttaacactggccgacgtgaagcatgtttttagattatgcgggaccgacgaaaaaatcctggccaacgtgaccgaggatgcaaagcggctaatcgccgtggctgacagcgtgctgacgaaggtcgttggcgacctattatccggcactatcctcgtgggccaattggaacttatcatcaaacacaagaaccagttcttggacatctggcagctgcgagagaagtccctttcccctcaagacgaacagtgtgctgtggaggaggctttggactggcgcagggaagaacttcttctgttgaagaaagagaaaaggtgcgtggattctttgctgaaaatgtgcggtaacgtgaagcatctgattcaggtggactttggcgtgttagccgtacggcacagccaggacctcagtagcaaaagactgaatgacactgtaacagttcgcttatctacctcaagtaactctcagcgggccacccattaccatctctctagccaggtgcaggaaatggccggcaagatagatcttctccgcgactcacacatattccagctcttttggagggaggctgccgagcccctgtcagagcccaaagaggaccaagaggcagccgagcttctatccgagccagaagaggagtcagagagacatatactcgaactggaagaggtgtatgactatctatatcagccatcctataggaaattcataaaattacatcaagacctcaaatcaggggaagtgaccctcgcagagatcgatgttatcttcaaggatttcgtaaataagtacacagatctagatagcgagctcaagatcatgtgcaccgttgaccatcaggatcagagagattggataaaggatcgcgtggaacagataaaggagtaccaccatctgcatcaagccgttcacgctgcgaaggtcatcttgcaggttaaggagtccctaggcctaaatggcgatttctccgtgctcaatacactgctcaattttaccgataactttgacgatttcaggagggagacacttgatcagatcaaccaggagctgatacaggctaagaaactgctgcaggacatctccgaagccagatgtaagggtcttcaagccctcagccttagaaaagaatttatttgttgggtccgggaagccttgggaggaattaatgaactgaaagtgttcgtcgatcttgcctcaatcagtgctggcgagaacgacatagacgtggaccgcgtcgcatgctttcacgatgctgtacaaggctacgcgtcactgttgtttaaacttgatccaagcgtcgacttttccgcattcatgaagcacctgaagaagctgtggaaggccttggacaaggaccagtatttgccccggaagctctgcgattccgcacgaaacctagagtggttgaagacagttaacgagtcccacggctctgtcgagcgcagctccctgacattagccacggctattaatcagagaggtatttacgttatccaggcacctaaagggggacagaagatttcccccgatacagtactgcaccttatactgccagagtctcctggctcgcacgaagaatcacgagagtattcccttgaggaggtaaaggaactgctgaataagttaatgctaatgtcgggtaaaaaagaccggaacaatacagaagtagagagatttagcgaggtattctgttccgtgcagcgactgtcccaggctttcatcgacctgcattccgctggtaacatgttgttccgtacttggattgccatggcttactgtagtcctaaacaaggagtttccctgcagatggacttcgggctggatctcgtgactgaactgaaagagggaggtgatgtgacggaactactggctgccctgtgtcggcagatggaacatttccttgactcctggaaaagatttgtcacgcagaaaaggatggaacacttttatcttaacttttatactgcagaacagcttgtctacttgtccaccgaactgcgtaagcagcccccatctgacgctgccctaacgatgctgtcctttatcaagagcaactgcacactcagggacgtgctcagggcctcagttgggtgcggatcagaggctgcacgatataggatgaggagggtcatggaggagctgcctctgatgctgctgagcgaattcagcttggtcgataagcttaggattatcatggagcaatccatgaggtgtttaccggcattcctgccagattgtctagacttagaaactctgggacattgcctggcccacctggccgggatgggtggctcccccgtggaacggtgcctgcccaggggtttacaagtgggccagccaaatctcgtcgtatgcggacactctgaggtcctacctgctgctttggccgtgtatatgcagaccccgtcacaacccctgcccacctatgatgaggtgctgctgtgtacacctgctactactttcgaagaggtggccttgctgctccggcggtgcctcacactcggctcactggggcataaagtctactccctgctctttgccgaccagctcagctacgaagtagcccgtcaggccgaggagctttttcataatctatgcacccagcaacatagagaggactatcaactggtcatggtctgtgatggcgactgggagcattgttacctgccttcagcttttagccagcataaggtgtttgtcaccccacaggctcccctggaagcaatccaggcctacctggccggccactacagagttcccaaacagactttgtccgccgcagcggtatttaacgacaggctgtgcgttggcatcgtggccagtgagcgggccggtgtgggcaagtctctgtacgtgaaacgcctccacgataagatgaaaatgcagcttaacgttaagaacgtgcccctgaagaccattcggttaattgatccccaggtcgatgagagcagggtcctgggcgcactgctgccatttctggatgcccagtaccagaaggtccccgttttatttcatctggacgttactagctccgtgcagactggtatttgggtgtttctgtttaaactactgatcctgcaatacctgatggacattaatgggaagatgtggctgaggaatccatgccacctttacatcgtcgaaatcctggaaaggaggacctccgtaccaagtaggtcgtctagcgccctaagaacaagggtccctcagttctctttcctagatatcttccctaaggtgacatgtaggcctcccaaagaagtgatcgacatggagctgagcgctctgcgcagcgacaccgagcccggcatggatctgtgggagttttgcagtgagacttttcaaagaccctatcaatatctgagaagatttaaccagaatcaggatttggataccttccagtaccaggaaggctccgtcgagggtacacctgaagaatgcttacagcacttcctttttcactgcggggtgattaacccatcgtggagcgagctgcgcaactttgctcgtttccttaattaccagcttcgcgattgcgaagcctcacttttctgcaatcccagctttatcggtgacacattacgtggatttaaaaaatttgtcgttacatttatgattttcatggcgagggacttcgctaccccctcacttcatacatccgatcagtccccgggaaaacatatggtgacaatggacggcgttcgcgaagaagacctggcccctttttccctgcgcaagaggtgggagtcagaaccacatccatacgtcttctttaatgacgaccacacaactatgacttttatcgggtttcacctccaacctaacataaatgggagtgtggacgcaatatctcacctcactggcaaggtgatcaagagagacgtgatgacccgggatctttaccaagggctgctgctgcagcgagtgccattcaacgtagacttcgacaaattgccaagacataaaaaactggaacggctatgtctgacactgggcatccctcaggccacagacccagacaagacttacgagcttaccaccgacaatatgctgaaaattctggctattgagatgagatttcgctgcgggattcccgtgattatcatgggcgagacaggctgtgggaagactagattgataaaattcctttctgatctgcggcggggaggcacaaacgcggataccattaagctcgtaaaagtacatggtgggacgaccgccgacatgatctactcccgggtcagggaggcagagaacgtggcctttgccaacaaggaccagcaccaactggatacaatcctattcttcgatgaggccaataccacagaggccatttcctgcatcaaagaagtgctttgcgaccacatggtggatgggcagccactggccgaggactcggggttgcacattattgccgcatgtaacccctatcgcaagcactctgaagagatgatctgtcgtttggagtccgcaggtctgggctatagagtgtcaatggaggaaactgcagaccgcctcggctccatccccctgaggcagttggtgtatagagtgcacgccctccctcctagtctgattccactcgtgtgggattttggccagcttagcgacgtcgctgaaaagctgtacatccagcagattgtgcaaagactggtcgagtccatcagcctggacgagaatggtactagggtcatcaccgaagtattatgcgcttctcaaggctttatgaggaagactgaggatgagtgcagttttgtctccctccgagatgtggagaggtgtgtcaaggtttttaggtggttccacgaacacagcgcaatgcttctggcacagttaaatgcattcctctcaaaatcatcagtgtccaagaatcacaccgaaagggatcctgtgctctggtcgctgatgctggctattggagtctgctaccatgcctctctggaaaagaaggactcttatcgcaaagccatcgctcgcttttttccaaaaccatacgacgatagtcgccttttgttggatgagatcactcgagcccaagatctttttctggacggggtgcccctcagaaagacgatcgccaagaacttagcactgaaagaaaacgtgttcatgatggtcgtgtgcattgagctaaaaatccctttgtttttggttggaaaacccgggtcttctaagtctctggcaaagacgatcgtcgccgacgccatgcaaggccctgccgcctattcagatctgtttaggtccctgaagcaagtgcatttggtctcttttcagtgcagtccccactccacccctcaaggcattatctccacattccgccagtgtgcccgtttccaacaaggcaaggacctccagcaatacgtgagtgtcgtggtactcgacgaagtcggtctggcggaagattcccccaagatgccattgaagacccttcaccctctgttggaggatggttgtatcgaggacgatcccgctccacacaaaaaagtaggcttcgtcgggatctcaaattgggcactggaccctgctaagatgaaccgtggcatttttgtgagccggggctcgcccaacgagaccgagctgattgagtctgctaagggaatttgctccagcgatattttggtccaggatcgcgtccagggctatttcgcctcctttgccaaggcatacgaaacagtgtgtaagcgacaagataaggagttcttcggcctgagggattattattcactcattaagatggtgttcgccgcggcaaaggcatcgaatagaaagccgagtcctcaagatattgcccaggccgtgctgcgtaatttctccgggaaggatgacatccaggccttggatatctttctcgcaaacctgccagaagctaagtgttctgaggaggtttcacctatgcaactgattaaacagaatatatttggaccgagtcagaaagtgccaggcggtgagcaggaggacgctgagtcacgctatttactggtacttaccaaaaattacgtcgctctgcagatccttcagcagactttcttcgagggggatcaacaaccagagattatattcggatctggctttccaaaagatcaagaatatacccagctatgtcggaatatcaaccgagttaaaatctgtatggaaaccggaaagatggtcctgctgctgaatttgcaaaacctgtacgagtctttatacgatgcccttaaccagtactacgttcatctgggcggacaaaagtacgtcgacctcggcctgggcacccacagggtaaagtgtcgcgtacatccgaacttccgcctgatcgtgatcgaggaaaaagatgtcgtatataagcacttcccgattccacttatcaaccgacttgagaagcactatcttgacatcaacaccgtcttagagaagtggcaaaaatctattgtggaggagctttgtgcctgggtggagaaatttatcaatgtaaaggcacaccacttccaaaagaggcacaagtacagcccctctgatgtgttcataggatatcattcggacgcatgcgcctccgtggtgctccaggtgatcgagcgccagggtcccagggcattaacagaagagttgcatcagaaagtatctgaagaggctaaatcaattttgctcaactgtgccacgcccgacgccgtagtcagactgagcgcctatagcctggggggcttcgcagcagaatggctgagccaggagtatttccaccggcagcgccataatagcttcgccgacttcctgcaggcccaccttcatactgctgatcttgaaaggcatgccatcttcaccgagattaccaccttcagcaggctcctgacatcacacgattgtgagatcttagaatctgaggtcacgggcagagcccccaagccaaccctgctttggctccagcaattcgatacagagtactcattcttaaaggaggtgaggaattgcttgacaaacacagctaagtgcaagatattaattttccaaacggatttcgaagatggcatcagatccgctcaactcattgcaagcgctaaatattctgttataaacgaaatcaataagattagagaaaatgaggatcgaatttttgtgtactttatcacaaagctctcaagagtgggtagaggtacagcatacgtgggttttcatggagggttgtggcagtcggttcacatcgatgacctccgccggtctacgctcatggtctctgatgtcacaagattacaacacgtgacgatttcccagttatttgcacctggcgatctgccagagttaggtctcgaacacagggctgaagatggccacgaggaggctatggaaactgaggcaagtacgagcggcgaggtggcagaggtcgctgaggaggccatggaaactgaatccagcgaaaaggtcggaaaagagacaagtgagctcggcggatctgatgtgtcaatcttggacactaccaggctactgcgatcttgcgtccaaagtgccgtggggatgcttagggaccaaaacgaaagctgcactcgcaacatgagaagggtggtgttactgctgggcctcctcaacgaggacgacgcctgtcacgccagttttctgcgagtatctaagatgagacttagcgtgttcctgaaaaagcaggaggaatcgcagttccatccgctggaatggctggcgcgtgaggcttgcaatcaagacgccctgcaggaagcaggaaccttcagacacacactctggaaacgcgtgcagggcgccgtgacccccttactggcttcaatgattagtttcattgatcgggatggcaacctggagctgttgacgcgacccgacacccctccctgggctcgtgacctgtggatgttcatattctcagacacaatgttactgaatatcccactcgtgatgaacaacgaaaggcacaaaggcgagatggcctacattgtggttcagaatcacatgaatctgtcagagaacgcatcgaataatgtccctttctcctggaaaattaaagactatcttgaagaactgtgggtccaggctcagtatatcacggacgccgagggactacctaaaaaattcgttgacatttttcagcaaacacccctcggccgattcttagcccaattacatggcgaaccccagcaagaactattacagtgctacctgaaggattttatcctactgacaatgcgtgtgtcaacagaggaggagcttaagttcctgcagatggccctgtggagctgcactaggaagcttaaggccgcatcagaggcccctgaagaagaagtctctctgccatgggtgcatctggcttaccagagatttcggagcagactccagaatttttctagaattctgactatatacccacaggttctccacagtctcatggaagcccgctggaaccacgaactggccggttgcgaaatgacgctggatgcctttgctgccatggcatgtaccgagatgctgacccgcaacactctgaagccctctccccaggcatggctccagctcgtgaaaaatctaagtatgcccctggagttgatttgttctgacgaacatatgcaggggagcggctccctggcccaagccgtgatccgcgaggttagagctcagtggagtagaatattttctactgcactgtttgtcgagcacgtgctactcggaaccgagtcacgggtcccagaacttcagggactggttaccgagcacgtctttctgctcgataaatgtcttagagaaaatagcgacgtcaaaacccacggtccttttgaggctgtaatgagaactctctgcgagtgcaaggagacggctagcaaaactctatcacgcttcggaattcagccatgctcaatttgcctgggcgacgccaaagaccctgtctgtctgccttgtgaccacgtgcactgtctgcggtgtctaagagcatggttcgcatcggaacagatgatttgcccttactgtttgacggccttgcccgatgagttcagccccgccgtgtcacaggcccatcgtgaggcgatcgaaaaacatgctcgattcagacagatgtgcaactcgtttttcgttgacctggtaagcacaatatgtttcaaggataacgctccacctgagaaagaggtgatcgagtctctgcttagtttgctcttcgttcagaaaggccgactccgcgacgcggcccagaggcactgcgagcacacgaagtctttaagccccttcaatgacgtggtggataaaacccccgtgatccgtagcgtaatactcaagttacttttgaagtactcttttcacgacgtcaaagactacattcaagagtacctcacattactgaagaaaaaggctttcatcaccgaggacaagaccgagctatacatgctttttatcaactgtctcgaagatagtatccttgagaaaacatccgcctatagccggaatgacgaactgaatcatctcgaggaggagggccgattcctgaaagcatactcacctgcttccagaggcagggagcccgccaacgaggccagcgtggaatatcttcaggaggtcgccaggatcaggctctgcctggatcgtgccgcagattttttatcagagcccgagggaggtcccgaaatggcaaaggagaagcagtgttatctgcaacaggtgaaacaattctgtatccgtgtggaaaacgactggcaccgcgtctatttagttcgaaagctgagctcccagcgaggaatggagttcgtgcaaggactgtccaagccaggtagaccccaccagtgggtctttcctaaagacgtggtgaagcagcaagggctccgtcaggaccacccaggtcagatggaccgctatctggtctatggcgacgagtataaagcactgcgagatgccgttgccaaagcagttctggaatgcaaacctctcggcattaagacagccttaaaggcatgcaagactcctcagtcccagcagagcgcgtactttctgttaaccctctttcgggaggtggcaatcttgtaccggagtcacaatgcgtccctccatccgactcctgaacagtgtgaagctgtgtccaaatttatcggtgaatgcaagattttatcaccccccgacatttctagattcgccactagcctggttgacaactctgtgcctcttttaagagcaggtcccagtgactctaacctggacggcacagtaacagagatggccatccacgcggctgccgtgctgctatgtggccagaatgaactgttagaaccccttaagaacctcgccttttcacctgccaccatggcccatgcctttttgcccacaatgcccgaagacttgctcgcacaggcgaggcgatggaaaggcctggagagggttcactggtatacatgtcccaacggccacccctgctccgtaggagagtgcgggcgcccaatggaacagtccatatgcatcgactgtcatgcccccatcggaggaatcgatcataaaccacgtgatggcttccatctagtgaaggataaagccgacaggacacagactggccacgttctgggcaatccccagcgacgggatgttgttacttgcgacaggggacttcccccggtggtgttcctcctgatacgtctgctgactcaccttgcactgctcctaggcgcgtcccagtcatcccaggcactgataaacatcatcaagccgcccgtgagagatcccaaaggtttcctccaacagcatatcctcaaagatttggagcagctggctaaaatgctcggccattcagctgacgaaacgatcggggtcgtgcatctcgtgttgagaagacttctgcaggagcaacatcagctctcctcccgaaggctcttaaacttcgatactgagttatctacgaaagaaatgcgtaacaactgggaaaaagagatagccgcagttattagcccagaactagagcatctcgacaaaaccctgcccacgatgaataacctgatcagccaagacaagcgaatctcctccaatccagtagcaaaaattatctatggagaccctgtcacatttctcccccatcttccccggaagtccgtggttcactgctctaagatctggtcctgccgcaagaggatcactgtggagtatctccagcatatcgtcgaacagaagaacggaaaagagagagttcctattctctggcacttcctgcagaaggaagctgaattacgcctagtgaagttcctgcctgaaattcttgctctgcaaagggacctagtcaaacaattccagaacgtacagcaggtggagtatagcagcatccggggttttctgtccaaacactcaagcgatggcctcagacagctgctgcacaatcggattaccgtttttctatcgacgtggaataagctgaggaggtcactcgaaaccaatggtgagatcaatctgcctaaggactattgctccacagacctcgatttggacaccgagtttgagattctgctgccaaggcgacgcgggttgggcctctgtgcaacagccctagtgtcatacctgatccgattgcacaacgaaatcgtgtatgcagtggaaaaactgagtaaagagaataactcatactccgtcgatgcagcggaggttaccgagctgcacgtgataagctacgaggtcgaaagggaccttacacccctgatcctcagcaattgtcaatatcaggtggaggagggacgcgagacagtacaggagttcgatctcgagaagatccaaaggcagatcgttagtcgcttcctgcaggggaaaccaagattgtcactgaagggcattcccacgctggtctaccggcacgactggaactacgagcacctgtttatggacattaaaaataagatggctcaggactccctcccatccagcgtcatctccgctattagcggccaattacagtcttactccgatgcctgcgaggtgctttctgtcgtggaggtgactctgggatttctcagcaccgcaggcggggaccctaacatgcagctgaatgtctatacccaggatatcctgcagatgggagaccagacaattcacgtgttaaaagctctgaatcgctgccagcttaaacatacaatagctctctggcagttcttgagcgcccataagtcggagcagctgctgcgactgcataaagagccctttggcgaaatttcgtctagatacaaggccgacctgtcacccgaaaatgccaagcttttgagcacattcctcaaccaaaccggattggatgctttcctgttggaactgcacgagatgatcattctgaagctcaagaaccctcagacccagaccgaagagaggtttcgaccacagtggtctctgcgcgatactctagtatcttatatgcaaacaaaggagtcagagatcctacccgagatggcctcgcagtttcctgaagaaattcttctggcgtcatgtgtgtctgtctggaaaaccgccgccgttttgaagtggaacagggagatgcgttag

SEQ ID NO: 203872 - DNA, 15624 bp, Artificial Sequence
  Description of Artificial Sequence: Synthetic coding sequence
atggagtgccccagctgccagcacgtgagcaaggaggagacccccaaattctgttctcagtgcggggaaagactgcctcccgccgcacccatcgctgactccgagaataacaactccacaatggcctccgcctccgaaggcgagatggagtgcggacaggagcttaaagaggagggcggaccttgtctgtttcctggatccgatagttggcaggaaaaccctgaggaaccctgttcaaaagcctcttggactgtacaagaatctaaaaaaaaaaaacggaagaaaaaaaagaagggtaataagtctgcaagcagcgagcttgcttccctgcctttaagtccagcatctccatgccatctcacgttgctctccaatccttggccccaggacacagctctacctcatagccaggcacaacagtcgggccctaccggacaaccatcacaaccgcctggaactgccacaaccccccttgaaggcgatggattatccgccccaactgaggtgggagacagtcctctgcaggcccaagcactgggggaggctggcgtggcaacgggatccgaggcccaatccagcccccagttccaggaccacacagaaggggaggaccaggatgcttcaatcccttctggaggcaggggccttagtcaggagggcaccgggccccccacatcagccggagagggacattctaggaccgaggatgccgcccaagagctcctgttgcctgaatctaaagggggctcatctgagccaggcacggaattacagactaccgagcaacaggctggcgcatccgcaagcatggccgtggacgctgtcgccgagcccgctaacgcagtgaagggggccgggaaggaaatgaaagagaaaacgcaacgcatgaagcaaccccccgccacaacaccaccttttaaaacacactgccaggaagcggagactaagaccaaagatgaaatggctgcggcagaggagaaagtgggcaagaatgagcagggcgagcctgaagatctcaagaagcccgaaggtaagaacaggagcgctgccgcggtaaaaaacgaaaaagaacagaaaaatcaggaggccgatgtccaggaggtgaaagctagcaccctctcccccggaggcggcgtaactgttttttttcacgcgatcatcagcttgcacttcccatttaatcctgatctgcacaaggtgtttatcagaggcggagaggagttcggagagtccaaatgggactctaacatttgcgagctccattacacgagggacttggggcacgatcgcgtgctcgtggaaggtattgtctgcattagtaagaaacacctggacaaatatatcccttataaatacgtgatatataacggcgaatccttcgagtacgaattcatatacaaacaccagcagaaaaagggtgagtacgttaaccggtgcctcttcatcaaatcatctttgctggggtcaggagattggcaccagtactatgacatcgtgtacatgaagcctcatggcagattacaaaaggtcatgaaccacatcaccgatggcccaagaaaagatctggtgaaaggaaaacagatcgccgcagctctcatgctggatagtactttctcgattcttcaaacctgggataccattaacctcaactcattctttacacagtttgagcagttctgctttgttcttcagcagcctatgatttatgaggggcaggcccagctttggactgatctgcaatatcgggagaaggaagtgaaacgatacctgtggcagcatctgaagaagcatgtggtgcccctgcctgacggtaaatccactgacttcttgcctgtggattgtccagttcgaagcaagctgaagacgggactcatcgtgcttttcgtggtggagaaaattgagctcctattagaggggtcactcgattggctttgtcacttgctgaccagcgacgcaagttccccagacgagttccaccgcgatcttagtcatattctgggaatcccacagtcctggagactttatcttgtgaatctatgccagagatgtatggatacaaggacttacacctggcttggcgccttgcccgtgctccattgttgtatggagctggccccccgacacaaagatgcttggagacagcccgaagacacctgggcagcccttgaaggactaagcttctctccttttcgggagcagatgctagatacatcctctttacttcagtttatgagggagaagcagcatctgctgagtattgacgagccactcttccggtcatggttctcactcctgcctctgtcgcaccttgtgatgtacatggagaacttcatcgagcatctgggtaggttcccagcccacatcctggactgcttgagcggcatctattatcgattgccgggtctagaacaagtgctgaatactcaggacgttcaggacgtacaaaatgtgcagaacattctggaaatgctgctgcgcctgctagatacctacagagacaagattccggaggaagccttgagcccaagttacttgaccgtatgtctcaaactgcatgaagccatttgctcatctactaaacttctgaagttttacgagctacccgcgctgtcagcagaaatagtttgcaggatgattcgtcttcttagtctcgtggacagtgctggacagagagacgaaaccggtaacaactctgttcagactgtcttccagggcacacttgctgccacaaaacgctggttgagggaggtttttacaaaaaatatgctcacatcttccggtgcaagcttcacgtacgtgaaggagatagaggtgtggcggcgattggtcgaaattcaatttccggccgaacatggctggaaagagagcctcctcggtgatatggaatggaggctcaccaaggaagagcccctgtcccagataactgcttactgcaatagctgttgggacaccaaaggtttggaggatagcgttgctaaaacctttgagaaatgtatcatagaagcggtttctagcgcatgtcaatctcagacaagcatcctgcagggcttcagctattccgacctgcggaagttcggcattgtattgagtgctgtcattaccaaatcatggccccgtactgccgacaatttcaacgacatacttaagcatctactgaccctagcggacgttaaacatgtgttccggttgtgcggtaccgatgagaagatcctggcgaacgtgacagaagacgctaagcgacttattgctgtggccgattctgtgctaacgaaagtcgtcggcgacctcctgtccggaactattctcgtgggacagctggagctcattataaaacataaaaatcaattcctggacatctggcagctgcgagaaaagagtttaagtccacaggacgaacagtgcgctgttgaggaggccctggactggcgtagggaggaactcctgcttctgaaaaaagagaagcggtgtgtagacagcctgctgaaaatgtgtggcaatgtgaagcatctcatacaggtggactttggtgtgctggcagtaagacacagtcaggatctgtcgtccaagaggttgaatgataccgtgacagttcgactgtcgacatccagcaactcacagcgtgcgacacactaccatctgagcagtcaggtgcaagaaatggcaggcaagattgacctactccgggattcccatatttttcagctattttggcgcgaggcggctgaacctctgagcgagcctaaagaggaccaggaggccgctgagctgctgtccgaaccagaggaagagtccgagagacatatcctggagttggaggaggtgtacgactacctctatcagcccagttataggaagtttattaagctgcaccaggacttgaaatccggagaagtgacactggctgagatcgacgtgatcttcaaggacttcgtgaacaaatatactgacctcgattcagagcttaagatcatgtgcacagtagatcatcaggatcagcgagactggatcaaggaccgggtcgaacagatcaaagaatatcatcacttgcatcaggcagttcacgccgccaaagtgattttgcaggtgaaggagagcctgggtttgaacggcgattttagcgtgctgaatactcttctaaacttcactgataactttgacgacttccgtcgggagaccctggatcagatcaaccaggagcttatacaagcaaagaaattactccaggatatttccgaggccaggtgcaagggtttgcaggccctgtccctgagaaaggagttcatttgttgggtaagagaagctcttggtggaatcaatgagctaaaagtgttcgttgatttagcgagcatatcagcgggcgaaaacgacattgatgtggacagagttgcctgtttccacgatgctgtgcaaggctacgctagtctcctttttaaacttgaccctagcgtggacttttctgccttcatgaaacatctcaagaagctgtggaaggccctggataaagaccagtaccttccgcgtaagctctgcgactcagctaggaatctggagtggctgaaaactgtgaatgaatcacacggcagtgtggagaggtcaagcctaacactagccactgccattaatcagagagggatctacgtaattcaagccccaaaggggggacaaaaaatcagccccgacacagtcctccatctcatactacctgagtcccctggaagccatgaggagtcaagggagtactctttggaggaagtgaaagaactcttgaataaacttatgctgatgtcaggcaaaaaggatcgcaacaacactgaggttgaacgattctcagaagtgttctgttcagtgcagcgattgtcccaggcgttcattgacctccacagcgctggtaatatgcttttccgaacttggattgcaatggcctattgctctcctaagcaaggagtatctttgcagatggactttgggctggacttggtgacagaactcaaagagggaggtgacgtgacggaattgttggccgccctgtgtcgccaaatggagcatttcctcgattcctggaaacgctttgtgacccagaagagaatggagcatttctatcttaacttctataccgccgagcagcttgtgtatctcagcacagagctgcgtaagcagccacctagcgacgccgctttaacaatgctttcctttatcaagtctaactgcaccctgagggacgttctcagagcatcagtgggctgcggctccgaggctgcacgctataggatgaggagggtgatggaagagctcccattaatgctgctgagcgaattttccctggtagacaagctcaggataatcatggaacagtctatgagatgcctcccagcttttctcccggattgtctcgaccttgagacactggggcactgcttggcccatctggcgggcatgggaggtagtcccgttgaacgctgtctgccacgggggctccaggtcggacaaccgaacctggtagtctgtggccactccgaggtgctacctgccgctctggctgtttacatgcagactccttcacagccccttccgacatacgatgaagtgctgctatgcacccctgcaacaacctttgaagaagtggctttgctgttgcgccggtgtctgaccctggggtcactgggacacaaggtgtatagcttactcttcgccgatcaactgtcttacgaggtggcgagacaggccgaggagctgtttcataacctttgcacgcagcagcaccgggaggactatcagctggttatggtgtgtgacggtgactgggaacattgttatcttccatccgcattcagccaacacaaggtgttcgtcactcctcaggcgcctctcgaggctatccaggcttacctcgcgggtcactaccgagtgccgaaacaaacgttgtctgctgctgctgtctttaatgaccgcttgtgtgtaggtattgtcgccagcgagcgggccggggttggtaagagcctgtacgtcaaaaggttacacgacaaaatgaaaatgcagcttaacgtcaagaatgtgccacttaaaacgattaggctaatcgatccgcaggtcgacgaatctcgggtacttggagcgctactgcccttcttggacgctcagtatcagaaagttcccgttctgttccacttagatgtgaccagcagcgttcaaacaggaatctgggtttttttgtttaagttgcttattctgcaatatctgatggacatcaatggaaaaatgtggctgagaaacccctgccatttgtatattgtggagattctggaacgccgtaccagtgttccatctcggtcaagctccgccctgagaacccgcgttccccagttctcgttcctggatattttccccaaggtgacgtgcagacctccaaaagaggtgattgacatggagctctcagctcttcgatccgatacagagcccggaatggacctttgggagttttgtagcgaaaccttccaacgtccttaccaatacctgaggagattcaatcaaaaccaagacctggatacctttcagtaccaggagggatcagtcgagggtacaccggaggaatgcctccagcatttcctgtttcactgtggcgtgattaatcctagttggtctgagctcagaaacttcgcgaggtttttgaactaccaactgcgcgactgtgaagcatccctgttctgcaatcccagctttatcggagatacattacggggcttcaagaaatttgtggtgacatttatgatttttatggctagggactttgccactccatctctgcacacctctgaccaatcacctggcaagcacatggtgaccatggatggcgtgcgcgaggaagacttagctccgttctcacttcgaaaacgctgggaaagcgagccgcacccatacgtcttcttcaatgacgaccataccaccatgacatttattggcttccacctgcagcccaatataaacgggtcggtcgatgccattagtcatctgacaggcaaggttattaagcgtgacgtgatgacaagagatctgtaccagggtttgctattacagcgcgttccctttaatgtggacttcgacaaactaccccgacacaaaaaactggaacggctgtgcctcacactcgggataccacaggctacggatccagataagacctatgagctgaccactgataacatgttgaagattctggcgattgagatgagattcagatgcggcatcccagtgatcataatgggggaaacagggtgcgggaaaactcggctgatcaagttccttagcgatctcaggcggggaggaaccaacgccgacactataaaactcgtgaaggtacacgggggtaccaccgcagacatgatctacagtagagttagagaggctgaaaatgttgcctttgcaaataaggatcaacaccaattggataccattctgttttttgatgaggcaaataccaccgaagcaatctcctgcattaaggaggtactctgcgaccatatggtggacggccagcctctggctgaagactccggcctgcacattatcgctgcatgtaatccataccgtaagcacagtgaagagatgatttgccggcttgagtctgccgggttgggctaccgggtcagcatggaggagaccgccgaccgtctgggctccattcccctccgccagctcgtgtaccgcgtccatgcactgccaccgagcctgatccccttggtatgggacttcggacaacttagcgacgtggctgagaaactctacattcaacagatcgtccagcgcttagtagaaagcatctctttggatgagaacggcactagggtgatcacagaggtgctctgcgcctcgcagggatttatgcggaaaacagaggacgaatgtagcttcgtctcactgcgcgatgtcgaaagatgcgtaaaagtgttcagatggttccatgaacactccgcgatgctgttagcccagctgaacgcctttctgtcaaagtcttctgtgagtaagaatcacaccgagagagatcccgttctctggagcctcatgcttgcaatcggagtgtgctaccacgctagtctggaaaaaaaggattcttacagaaaggccatcgccagattcttccccaagccctatgacgactccagactgctgctagatgagataacacgggcccaggatctgttcctggacggcgtgcctctacgcaaaactattgcgaagaatctcgccctaaaggaaaacgtgtttatgatggtcgtatgtatcgaacttaagattccactgtttctcgttggtaagccagggtcgagtaaatctctggctaaaaccatcgttgccgacgccatgcaggggcctgctgcatattccgatttgtttcgctcacttaagcaggtgcacctcgtttccttccagtgttcacctcacagcactcctcagggcattatcagcaccttccgccagtgtgccagattccaacaaggaaaagacctgcagcagtacgtgtccgttgtggtactagatgaagtgggtctggccgaagattcaccaaaaatgccccttaaaactctgcaccccctgttggaagacggctgcatcgaggacgatccggctccacataagaaggtgggatttgttggtatctcgaattgggctcttgatcccgccaaaatgaatcggggcatctttgtaagccgcgggagtcccaatgaaactgagctcattgagagcgccaaaggaatctgtagttccgatattctggtccaggatcgagtgcagggctactttgccagttttgccaaggcatacgaaaccgtgtgtaaaagacaggacaaggaattctttggcctgagggactactatagcctcatcaagatggtctttgcagccgccaaggccagcaaccggaagcccagcccacaggacatcgctcaggctgtcctgcgtaatttcagtgggaaggacgacatccaggccctcgacatattcctggctaacctgcctgaggcaaagtgctctgaagaggtatcccccatgcagctcattaagcaaaatatcttcggtccaagtcagaaggttcccggcggtgagcaagaggatgcagagtccaggtacctgcttgtcctcacaaagaattatgtggcactccagattcttcaacagactttctttgaaggtgaccaacaaccagagatcatctttgggagcggcttccctaaggatcaggagtacacgcaactctgtaggaacatcaacagggtgaaaatctgcatggaaaccggtaaaatggtccttttgctcaatttacagaatctctatgagtccttgtacgacgccctgaaccagtactatgtgcacctcggcggccagaagtacgtcgatctcgggctcgggacacatcgggtcaaatgtagagtgcaccctaacttccgccttatcgtgatcgaggagaaagatgtggtctacaaacattttcccattcctcttattaatcgactggagaagcattatctggatatcaatacagtgttggagaagtggcagaaatcgattgtcgaggagctgtgcgcttgggtggaaaaattcattaacgtcaaggcacaccactttcaaaagagacataagtattctccctcagacgtctttatcgggtatcattctgacgcttgtgcgtcagtggtgcttcaagtaatagagcggcagggtccaagggccctaaccgaagaattacatcagaaggtttcggaggaggccaagtctattctccttaactgcgccactcccgacgcagttgtgcgcctgagcgcatattctctcggaggattcgctgcagagtggctgtctcaggaatattttcaccgtcagagacataacagcttcgccgattttctacaggctcacctgcatactgccgatctcgagaggcacgccatctttactgagataaccacctttagcaggctgttgacctctcacgactgtgagattcttgagagtgaggtgactggcagggcgcccaaaccgactctgttgtggctgcagcagtttgataccgagtattctttccttaaggaggtacgcaattgtttgaccaacacagctaaatgtaagatactgatcttccagaccgatttcgaagatggtatccgaagtgcgcagctgattgcctctgctaaatacagcgtcatcaacgaaatcaacaagattcgcgaaaatgaggacaggatattcgtatattttatcactaagctctctagagtgggccgaggcacagcttatgttggctttcacgggggcctgtggcagagcgtccatatcgacgacctgcggcgttccaccctgatggtgtccgatgtgacacggttacagcacgtgactatcagtcagctgtttgctcctggagacctgcctgagctcggtctcgaacaccgtgcagaagacggccatgaagaggccatggagaccgaggcatcgacttccggggaggtcgccgaggttgcagaggaggccatggaaaccgagtcatcagagaaggtagggaaggaaacatcagagctgggcggttccgacgttagcatcctggacaccactagactcctgaggtcttgtgtacagtccgctgtgggtatgctgcgagatcaaaacgagtcatgtacaaggaatatgaggagggtggtgcttctgcttgggcttcttaacgaggatgacgcgtgccatgccagttttcttcgcgtgtctaagatgagattgtcagtgttccttaagaaacaggaggagtcccaattccacccgctggaatggttggctcgtgaggcatgcaaccaggacgcacttcaggaggctggaacctttagacacaccctgtggaaacgtgtacagggcgcagtaacgcccctgctggcatcaatgataagctttatcgaccgcgacggcaatcttgagctgttgacgagacccgacacgccaccttgggctcgagatctgtggatgttcatcttttccgataccatgctcttaaacattcctctagtgatgaacaatgaacgtcataaaggcgaaatggcttatatcgtggtgcagaaccacatgaacctgtctgaaaatgcgagtaataatgtgccattctcttggaagataaaagattatttagaggagctgtgggtccaggcacagtatataaccgatgcggaaggattgcctaaaaagttcgttgacatcttccagcagacgcctctcggcaggttcttagctcagctccatggggagccacagcaagagctcctccaatgttacctgaaggacttcatcctgctaaccatgagggttagtacagaagaggagctgaagttcctccagatggccctgtggtcatgcacgagaaaactcaaagccgcctctgaagcccccgaggaagaggtgagtctgccttgggtccacctggcctaccagcgattcagatctcggttacagaattttagtagaatcctcaccatctatcctcaggtcctgcattctctcatggaggcacgctggaatcacgaactggccgggtgtgagatgaccttggatgcctttgctgcaatggcttgcaccgagatgctcactcggaacacgctcaagccatctccgcaggcttggctgcagctggtgaaaaatctgagcatgcctcttgagttgatctgctctgacgagcatatgcagggttcgggctccctcgcccaggctgttatacgagaggtgcgggcacagtggagccggatcttttcaaccgccctgttcgttgagcatgtgttgctgggcaccgagagcagagtccccgagctgcaaggcttggtgactgagcatgtgtttctgctggacaaatgtctgagagagaatagcgatgtaaagacgcacgggccttttgaagccgttatgcggactttatgcgaatgtaaagagaccgcctccaagaccctgagtcgttttggtattcagccctgcagcatatgtctgggtgatgcaaaggatccagtatgtctgccttgcgatcatgtgcattgcttacgttgcttacgggcctggttcgccagcgaacagatgatttgcccctactgcttgacagctctgcctgatgagttcagcccggccgtgagccaagcccatagggaagccatcgagaagcacgccagatttcgccagatgtgcaacagttttttcgtggacctggtcagtactatctgcttcaaggataatgcgccgcccgaaaaagaggtcattgagtccctgttatctctgctgttcgtccagaagggccgactgagagacgctgcccagaggcattgtgagcacaccaagtccctgagtcccttcaacgatgtagtcgacaaaacgccagttattaggtccgtgattctgaagctcctgctgaagtactcttttcacgacgtaaaagattatattcaggagtacctcacgctgctgaagaaaaaagccttcataacagaagacaagacagagctgtatatgttgttcattaattgtctggaggactctatacttgagaaaacctcagcttactcaaggaacgacgagctaaatcacctcgaggaggaggggcgcttcctcaaagcctattcacctgcttcacgagggcgcgagcccgctaatgaggcaagtgtggaataccttcaggaagtggctcggattagattatgcctggaccgcgctgcggattttctgtccgagcctgagggcggacccgaaatggcaaaagagaagcaatgttacctgcagcaggtgaagcagttttgcatccgagtggagaatgactggcaccgcgtatacttggtgagaaagctctcttctcagaggggaatggagtttgtgcagggactctccaagcctggacgcccccatcagtgggtattccctaaggatgtggtcaagcagcagggcctccggcaggatcatcctggccagatggaccgttatctagtctacggcgatgaatacaaagcgctgagagacgccgtagcaaaagcagtgctcgaatgcaagccactcggtatcaagactgccctgaaagcatgcaaaacgccccagtcccagcagagcgcctacttcttgctcacgctcttccgcgaggtcgcgattctatacaggagccacaacgcttccctccaccccacgcctgaacaatgcgaggcagtgtctaagtttatcggagagtgtaagattctctcaccaccagacatttcccgcttcgccacttctctcgtcgataatagcgtccccctccttagagctggaccatctgatagtaatctcgatgggactgtgacagaaatggctattcatgccgccgcggtcctcctttgcggccagaacgagctgttagaaccgctgaagaatttggcgttctctcccgcgactatggcccacgcttttctccctactatgcccgaggacctgttagcccaggccagacgctggaagggtttggagagggtgcattggtacacctgcccaaacgggcacccatgttctgtgggcgagtgtggcaggcctatggaacagtctatctgcatcgactgccacgctcctatcggcggtattgaccacaagcctcgggacggatttcatttggttaaagataaagcagataggacacagacagggcatgttctcggcaacccgcagagacgcgatgttgttacatgtgaccgaggtcttccgcccgtggtgtttctgttgattaggctcctgacccatctcgcactactgttaggagcatctcagtccagccaggccctcatcaacattattaagccccccgttcgtgacccaaagggcttcctgcaacagcatatcttgaaagacctggaacaacttgccaaaatgctcggccattccgccgacgagaccataggagtcgtgcacctggttctccgacgactcctacaggaacagcaccagctgtcttcgcgtaggctcctgaattttgacactgagctctcaaccaaggagatgcggaacaattgggaaaaggagatcgctgccgtcattagtcctgaacttgagcatctggacaaaacgctccctactatgaacaatttgatctctcaggacaagcgcatttcttccaaccccgtcgccaagatcatctatggcgaccctgtgacctttctgcctcatctgcccagaaaatccgtcgtgcattgcagtaaaatctggagctgcaggaaaagaatcactgtggagtatttgcagcacatcgtggaacaaaagaacgggaaggaacgggtccccatcctgtggcactttctccagaaggaggctgagttgaggctggtcaaattcctccctgagatcctcgctctccagcgcgatctcgtaaaacaattccagaatgtgcagcaggtcgaatactcctccatccgcggttttttgtctaagcactcttccgatggactcagacagcttttgcataatcgcattacagtgtttctcagcacatggaacaagctgcgaaggtccctggaaactaacggggagattaacctgccaaaagactactgctctaccgatctcgatctcgatactgagtttgagatattgttgcctaggcgccgcggattgggtttgtgtgctactgccctggtctcatatctgattcgcctgcacaatgaaatcgtttacgcggtggaaaagcttagcaaggaaaacaactcatacagtgtggacgccgcagaggtaacagaactgcacgttattagctacgaggttgaaagagacctaacacctcttattctgtccaactgtcaataccaggtcgaagaaggccgagaaactgttcaggagtttgatctcgaaaagatccagcgacaaatcgtttcaaggtttctccaaggcaagcctaggctgagcctgaagggtatacctacgctggtgtacaggcatgactggaactatgaacatctgtttatggatattaagaacaagatggcccaggatagtttaccttcctctgttatctcggcaatcagtggacagctgcagagttacagtgacgcatgtgaagtactgtcggtggtcgaagtgacccttggatttctgtcgaccgctgggggcgacccaaacatgcagttgaacgtctatactcaggatattctgcaaatgggcgaccagactattcatgtcctgaaggccctgaaccgctgccagcttaagcacactattgccttatggcagtttctttctgctcataaaagtgagcaactattacgattgcataaagaaccattcggagagatttcttcccggtataaagccgacctgagccccgagaatgctaagctcttaagcaccttcttaaaccagacaggtctcgacgcctttctgctcgagctgcacgagatgattatcctgaaattaaagaacccccagactcagaccgaggagcgctttcggccccagtggtctctccgggatacactagtctcttacatgcaaacaaaagagagtgaaatcctgcctgaaatggcttcccaattcccagaagagatcctacttgcaagctgcgtctccgtttggaagacggccgctgtccttaagtggaacagggagatgaggtag

SEQ ID NO: 203873 - DNA, 2772 bp, Artificial Sequence
  Description of Artificial Sequence: Synthetic coding sequence
atggaggagggcaacaacaacgaggaggtgatccacctgaacaacttccactgtcataggggccaagaatggatcaatctgagggatgggcctatcacaatctcagacagcagcgacgaagaaaggatccccatgctggttacgcctgccccccagcaacatgaggaagaggatttggacgatgatgtgattttaaccgaaactaataaaccccagcgaagtcgtccaaacctgatcaagcctgcagcccagtggcaagaccttaagcgccttggtgaggaaagacccaaaaaaagtagagctgcctttgaaagcgacaagtcaagctacttctctgtgtgcaataatcccctcttcgattcaggcgctcaggacgacagcgaggacgactacggcgaatttcttgacctcggccctccaggtattagcgagttcaccaagccgtcagggcagacagagcgcgagccaaagcctggtccctcgcataaccaggctgccaatgacatagtgaacccccgttctgagcagaaggtgataatcctggaggaaggcagcctgctgtataccgagagcgatcctttggagacgcagaaccaatctagcgaagacagtgagaccgaattactatcaaatctgggtgagagtgccgcactcgcagacgatcaagctatcgaggaggattgctggctagaccacccatatttccaaagtctgaaccagcagcctcgtgaaatcacgaaccaagttgtcccacaagagcggcagccagaggccgagttagggcggctgctgtttcaacacgagttccccggcccagcttttcctaggcctgagcctcagcagggcgggatatcggggccgtcgtcaccccagccagctcaccctttgggcgagtttgaagaccaacaactggctagtgacgacgaagagcctggtcctgcgtttccaatgcaggagagccaggaaccaaacctcgaaaacatctggggacaggaggctgctgaggtggatcaagaattagtcgaattactggtgaaagagacggaagcccgcttcccagacgtggcaaatggattcatcgaggagatcatacacttcaagaactactacgatttaaacgtactctgtaattttttgctcgaaaaccctgattatcctaaaagggaagataggattatcattaacccgtcctcctctctgcttgcctcgcaggatgagaccaaactgcccaaaatcgatttcttcgattacagtaagctgacgccattggatcaaagatgtttcattcaggccgccgatcttcttatggctgacttcaaggtgctctcatcccaggacattaagtgggcacttcatgagttaaagggtcactatgccatcacccggaaagccctctcagatgcgatcaaaaagtggcaagagttgagtcctgagacttctgggaaacgcaagaagcggaagcaaatgaatcagtacagctatatagattttaaattcgagcagggggacattaagatcgagaagcggatgttcttcctggaaaacaaaaggaggcattgccgcagctacgacagaagagcactgttacccgctgtgcagcaggagcaggaattttacgagcagaagattaaagaaatggctgagcatgaagactttcttcttgcactgcagatgaacgaggagcaatatcagaaagacgggcaactcatagagtgtcgttgctgttatggtgaattcccattcgaggagctgacgcaatgcgccgatgcacatctgttttgtaaagagtgtctcattagatacgctcaagaggctgtcttcggttccggaaagctggagttgagttgcatggaaggatcatgcacttgttcctttccaacttccgagctagaaaaagtgcttcctcaaactatcctctacaagtattatgagagaaaagccgaggaggaggtagctgccgcctatgccgacgagctggtgcggtgcccttcatgtagtttcccagccttactcgattcagatgtgaagagattttcttgtccaaacccccattgcaggaaagaaacgtgtagaaagtgtcagggtctctggaaagagcacaacgggctgacttgtgaagagctagccgaaaaagatgatattaaatatcggacgtctatcgaggagaagatgactgctgcacgaattaggaaatgtcacaaatgcggcacaggtttaattaagtccgagggatgcaacagaatgtcttgtcgatgtggggctcaaatgtgctatctgtgccgagtgtcaattaacggttacgatcatttttgccagcatccaaggagtccaggcgccccatgccaagagtgtagccggtgctctttatggacagatccgacagaggacgatgaaaaactgattgaagaaatacagaaagaagccgaagaagagcagaaacgcaagaatggggagaacacctttaagaggattggtcctcctctagagaaacctgtggagaaggtacaaagagtggaggccttacccagacccgtaccccaaaatctgccccagcctcagatgccaccatacgctttcgcccatcccccattcccactaccgcccgtgcggccggtgttcaataatttcccgttgaacatgggacctattcctgcaccctacgtgcctccattgcccaacgtgcgcgtgaattatgatttcggccctattcacatgcctttggaacacaatctgccaatgcatttcggtccccagccaagacacagattttag

SEQ ID NO: 203874 - DNA, 63 bp, Artificial Sequence
  Description of Artificial Sequence: Synthetic coding sequence
atggaggagggcaacaacaacgaggaggtgatccacctgaacaactttcattgccacaggtag

SEQ ID NO: 203875 - DNA, 2601 bp, Artificial Sequence
  Description of Artificial Sequence: Synthetic coding sequence
atggaggagggcaacaacaacgaggaggtgatccacctgaacaactttcactgccatcgcggccaagagtggataaacctgcgcgatggcccaatcacgatatcagatagttctgacgaggaacgaataccaatgttagtgacgccggctccccagcagcacgaggaggaggaccttgacgatgacgtcatcctcaccgaggatgattccgaagatgattacggggagttcctggacctgggcccgcccggtatatctgagtttacaaagccaagtggacaaacagagagagagcccaaaccagggccatcacacaaccaagcagccaacgacatagtgaatccacgtagtgagcagaaggtcataattctggaagagggtagcctcctctacactgagagcgacccccttgagactcaaaaccaatctagcgaagactctgagaccgaactgcttagtaacctgggcgagtcagctgcacttgcggacgatcaggcaattgaggaagactgttggttagatcatccatattttcaatctctcaatcaacagcctcgcgagatcacaaatcaggtagtgcctcaggagcgacaaccggaggctgagctgggacgcctcctgttccagcatgaatttccaggaccggcctttccccgccccgaacctcagcaggggggaatttctggcccatcatcaccccagcctgcccatcctctgggcgagttcgaggaccagcagctggcaagcgatgacgaagaaccggggcccgctttcccaatgcaggagtctcaagaacctaatctggagaatatctggggacaggaagccgccgaggtggatcaggagctagtcgagttactggtgaaggagacagaagcgcggtttccagatgtggccaacggctttatcgaagagatcatccacttcaaaaactattacgatctcaacgtgctgtgcaactttcttctggaaaatcccgactatccaaagcgcgaggatcgtataattatcaatccctctagcagcctgctcgcctcccaggacgagactaagctgccaaaaattgacttcttcgattattccaagctgacaccgctcgatcaaaggtgcttcattcaggccgccgatctgctgatggcagacttcaaagtactcagttcccaggatataaagtgggctctgcacgaactgaagggccattacgcgatcacaaggaaagctctttccgacgctattaaaaagtggcaggaactgagcccagagacatcaggcaagcggaagaaacgcaagcagatgaatcaatattcctacatcgacttcaagttcgaacagggtgatattaagatcgaaaagcggatgttctttctcgaaaacaaacgcagacattgccgaagttacgatcggcgagccctcctgcctgcagtccaacaagagcaggagttttacgaacagaagatcaaagaaatggccgaacatgaggatttcctgctggccctccaaatgaacgaggagcaataccagaaagacggtcagctgattgaatgtagatgttgctacggtgagttcccattcgaggagctaactcagtgtgcagatgcccacctgttttgtaaggaatgccttattcgctacgcccaggaggccgtctttgggtctggtaaattggagctctcttgcatggaaggatcctgtacatgttcattcccaacttccgaactggagaaagtgttaccccaaaccatcctttacaagtactatgaaagaaaagccgaagaggaggtcgcagccgcctacgccgacgaactcgtgcgctgtcctagttgctccttcccggcacttctagattctgatgtgaagagattttcttgcccgaacccacattgcagaaaagagacctgtaggaaatgccagggtctgtggaaagagcataatgggcttacttgcgaggagttggccgaaaaagacgacataaagtacagaacttcaattgaggagaaaatgaccgcagctagaattcggaaatgccataaatgcggcacgggactcatcaaaagcgaaggttgcaaccggatgagctgtcgttgcggagcacagatgtgctatctgtgtcgggtctccataaatgggtatgatcatttttgtcagcaccctcgtagccctggagctccatgccaagaatgcagcagatgttcactgtggaccgaccctacagaagatgatgagaaactgattgaagaaattcaaaaggaggccgaagaggagcagaagagaaaaaatggcgagaacaccttcaagaggattgggcctccactggagaagcctgttgaaaaagttcagcgggtcgaagcacttcccagacctgtgccccagaacttgccgcagcctcaaatgcccccttatgcttttgcccatcccccatttccattgccccctgtccggcccgtgttcaataattttcctctaaacatgggtcccattccagcaccttatgttccgcccctgcccaacgtacgggtcaactatgacttcggaccaatccacatgccgctcgagcataatctgccgatgcacttcggacctcagcctcgacataggttctag

SEQ ID NO: 203876 - DNA, 2037 bp, Artificial Sequence
  Description of Artificial Sequence: Synthetic coding sequence
atggaggagggcaacaacaacgaggaggtgatccacctgaacaacttccactgtcacaggggacaagaatggataaatctcagggacggtcccatcactatctcagacagcagtgatgaggagcgcataccaatgctggtcactccagccccccagcagcacgaggaggaggatttggatgatgacgtcattttgacggaaaccaacaagccacagagatcaaggcccaacttaatcaaaccagccgcacagtggcaggaagccgccgaggtggatcaggaactcgttgagttactcgtaaaggagacagaagctcggtttcctgacgtggcgaatgggttcatcgaagagattattcattttaagaattattatgacctcaatgttctctgtaactttttgttggagaaccccgattatccaaagcgcgaagatcgcataatcatcaatcctagttccagtctgcttgcgtcgcaagatgaaacaaagctaccgaagatagactttttcgactactctaaacttacccctctcgaccagcgctgcttcattcaggctgctgacttattaatggccgattttaaggtgttaagctcgcaggatatcaaatgggcactgcatgaactcaaaggccactacgctatcaccaggaaagctctctctgatgctatcaagaaatggcaagagcttagcccagaaactagcgggaagcggaagaagcgtaaacagatgaatcaatatagctacatagacttcaagtttgaacagggcgacatcaaaatcgagaaaagaatgtttttcctggaaaataaacgacggcactgtcggtcgtacgatcggcgggctctgcttccagcagtccagcaagaacaggaattttacgagcagaaaattaaggagatggctgagcatgaagactttcttttagccctgcagatgaacgaagagcaataccaaaaggacggccagcttatagagtgtcgttgctgctatggtgagttcccatttgaagaattaacccagtgcgcagacgcccatctgttctgtaaggagtgcctgatccgttacgcccaggaagctgtcttcggatctggaaagcttgagctgagctgcatggagggttcctgtacatgtagttttccgacatcagagctcgaaaaggttctgcctcagaccatactctataaatactatgaaaggaaggcggaagaggaagttgcggcagcttacgccgatgaacttgtgcggtgcccgtcatgctccttccccgctctgctcgacagcgatgtgaaacgattttcttgtcctaatcctcattgccggaaagagacttgcagaaagtgccaaggcttatggaaggagcataatgggcttacgtgcgaggagctcgctgaaaaggacgacataaagtaccgcacctccatcgaagagaaaatgaccgccgcccgaatacggaaatgccacaagtgcggaacgggccttattaaaagtgaaggatgtaatagaatgagctgtcgatgtggcgcacagatgtgttatttatgcagggtctcaattaatggttatgaccatttctgccagcaccctaggagccccggcgccccctgtcaagaatgttctcgctgtagcctctggaccgatcctacagaggacgatgagaagcttatcgaagagatccaaaaagaggccgaggaagaacaaaaacgtaaaaatggagagaatacctttaagagaattggcccacccctagagaagccagtcgaaaaggtgcagagggtcgaggctctgccacgtccagtgccccagaatctgccacagccacagatgccgccatatgcgtttgcacatcccccatttccactccctcctgtgcggccggtgtttaataacttccctctgaacatgggtccaataccagccccatacgtcccacctcttcctaacgtgcgcgtcaactacgacttcgggccaattcatatgcctctggaacacaatcttcccatgcactttggccctcagccccgccacagattctag

SEQ ID NO: 203877 - DNA, 447 bp, Artificial Sequence
  Description of Artificial Sequence: Synthetic coding sequence
atgagcagcgacttcccccactacaacttccggatgcccaacatcggtttccagaatctccctttgaatatttatatagtggtgtttggcacagctatatttgtttttatcttgtcccttcttttctgctgctatctgattcgacttcgacaccaggcacataaggagttttacgcttacaaacaagtcatcctgaaggaaaaagtgaaggagttgaacctgcacgagttatgcgcagtgtgtctggaagactttaaaccccgcgacgaactaggcatctgcccttgtaagcacgcatttcataggaagtgtctgatcaagtggctcgaagttcggaaggtttgtcctctatgtaatatgcccgtgcttcagctggcacaactgcactccaagcaggaccgcggtcccccccagggacccctaccaggagctgaaaacatagtgtag

SEQ ID NO: 203878 - DNA, 447 bp, Artificial Sequence
  Description of Artificial Sequence: Synthetic coding sequence
atgagcagcgacttcccccactacaacttccggatgcccaacatcggcttccagaacctgccactgaacatttacatcgtggtctttggaactgcgatttttgtgtttatccttagcctcctgttctgctgttatctcatcagattacgccaccaagcccacaaggaattctatgcatacaaacaggtcatcctgaaggagaaagttaaggagctgaaccttcatgaactttgcgcagtgtgtcttgaagacttcaagccacgggacgagctggggatctgtccctgcaagcacgctttccatcgcaaatgtctcataaaatggctggaggtgagaaaagtctgtccgctgtgcaatatgcctgtgctgcaactggcgcaactccatagcaaacaagacagaggaccaccccagggaccactgccgggagccgagaatatagtgtag

SEQ ID NO: 203879 - DNA, 510 bp, Artificial Sequence
  Description of Artificial Sequence: Synthetic coding sequence
atgctgaacaagagcggcgagagccggtaccccgccctgttccccgtgctgggaggcagttccatgtcaagcgatttcccccactacaactttcgcatgccaaatattggtttccagaatctgcctctcaacatctacattgtcgtgtttggaacggccatcttcgtcttcatcctgtcccttctgttctgttgctatctgatcagactcaggcatcaggctcacaaagaattctatgcctacaagcaggtcatattaaaagagaaggtcaaagaactgaacctccacgagctgtgcgcggtctgcctcgaagacttcaaaccccgggatgagctaggaatctgtccgtgtaaacatgcctttcaccgcaaatgtttaattaaatggctcgaagttcgcaaggtgtgtcctctctgcaacatgcccgttctacagctggcccagctgcatagcaagcaggaccgcggacccccccagggtccattaccaggtgccgaaaacatcgtctag

SEQ ID NO: 203880 - DNA, 510 bp, Artificial Sequence
  Description of Artificial Sequence: Synthetic coding sequence
atgctgaacaagagcggcgagagccggtaccccgccctgttccccgttttaggaggctctagcatgtcctccgactttcctcactataatttcaggatgcctaatataggtttccaaaatttgccactgaacatatatattgttgtatttgggacagctatcttcgtgtttattctgtcacttttgttctgttgttacctgattagactcagacatcaagctcataaggagttctatgcgtacaaacaggttatattgaaggagaaggtcaaggaattaaatctacacgagctgtgtgcagtgtgcctggaggatttcaagcccagagacgagcttgggatatgtccttgcaagcacgcatttcatcgcaagtgtctgattaaatggttggaagtgagaaaggtgtgtcccctgtgcaacatgcctgttctgcaacttgcacagctccattccaagcaggatcgcgggcctcctcaaggcccactgcccggtgctgaaaacatcgtatag

SEQ ID NO: 203881 - DNA, 1302 bp, Artificial Sequence
  Description of Artificial Sequence: Synthetic coding sequence
atggaggccgtgtacctggtggtgaacggcctgggcctggtgctggatgttctaacactggtgttggatttaaactttctgctggttagctccctgctggctagtcttgcctggctgcttgcgtttgtgtataacctgcctcataccgtcctgaccagcctgctgcacctgggccgcggcgtgctgttgtccttgcttgctttaatagaagcagtcgttcgcttcacttgcggcggtctgcaggcattatgtacacttttgtacagttgctgttccgggctggaatcactgaagctcttaggccatttagcgagccatggcgcactgagaagcagagagattctccaccggggcgtgctgaacgtcgtctcctccggacatgcgctgctccggcaggcatgcgatatctgtgcaatcgctatgtccctggtggcatacgtcattaactccctcgtgaacatttgtcttataggcacccagaatttgttttctctggtcctggccctgtgggatgccgtcacaggccccctgtggcgcatgaccgacgttgttgccgcctttctggcgcacatttcttcatccgcggtggccatggccatactgctatggacaccttgccagctcgcgttggagttactagcatccgccgcgaggttgttggccagtttcgttttggtcaatctgactggcctcgtgctgttagcctgtgtgcttgccgtgactgtaactgtcctgcaccctgatttcacactgagacttgctacacaggccctgtcacagctgcacgccagacctagctatcaccggctgagagaagatgtgatgcggttgtccaggctggccctgggctcagaagcgtggcgaagggtctggtctaggagcctccaactcgctagttggcccaatagagggggcgctccgggcgccccacaaggcgacccaatgcgggtttttagtgtccggactcgcagacaggatacactgcctgaagccggccgcagaagcgaggcagaggaagaagaggcccgaactatccgcgtgacgcctgttagaggtagggagaggctaaatgaggaggagccccctggaggacaagacccctggaagctgctgaaggagcaggaggaaaggaaaaagtgtgtcatctgccaggaccagagcaagactgtgcttctactgccctgtagacatctgtgcctctgccaggcctgtaccgagatattgatgcgccaccccgtgtatcatcgcaactgccctctgtgcagaagaggaattttgcagacattgaacgtgtatctatag

SEQ ID NO: 203882 - DNA, 3219 bp, Artificial Sequence
  Description of Artificial Sequence: Synthetic coding sequence
atgcccggcgaggaggaggagcgggccttcctggtggcccgggaggaactcgccagtgcactgcgaagagactcaggacaggccttcagcctcgaacagttacgccctctgctggcttcaagcctccccctggccgcgcggtacctgcagctcgacgccgctcggctcgttcgctgcaacgcgcatggcgagccaagaaactacctaaatactttgagcacagccctaaacatactcgaaaagtatggccgcaatcttctttcgcctcaaagaccgcgctactggcgcggagtcaagttcaacaatccagtcttccgcagtaccgtggatgccgttcagggaggcagagacgttttgcgcctgtacggctatacagaagaacagcccgacggtctgtcctttcctgagggacaggaggagccagacgagcaccaagtagccactgtgacattggaggtgctgctgctgaggactgagctgtcattattactacagaacacacaccctaggcagcaggcgctggagcagctgctagaggataaggttgaggatgatatgcttcaactctctgagttcgatccactgttacgcgagattgcaccgggccctcttaccaccccaagcgttccagggtccacccctggtccttgttttctctgcggcagcgcacctggaacactccactgtccgagctgcaaacaggcgctctgtccagcttgcgatcacctttttcatgggcacccctcaagagcccaccatcttcggcagaccttgcctggggtgctccagggaacccatctgtcacctagcctgccagcttccgcccagccaaggccccagtcaacgtctttgctggcgctgggagatagttcgctgtcctctcctaaccccgcctctgcccatttaccttggcactgcgcagcatgcgcaatgcttaatgaaccttgggcagtgctgtgcgtcgcctgcgatagacctcgggggtgtaaaggacttggtctcggcacagagggcccgcagggcacaggcgggctggagcccgacctggctcgagggcgatgggcctgccagtcttgtaccttcgagaacgaagccgcagcagtgctgtgcagcatttgtgaacggccacggctcgcacagccaccaagtcttgtggttgactctcgcgacgcgggaatttgcctgcaaccactgcaacagggggacgcgctcttagcttcagcccagtcacaagtgtggtactgcatccattgcacgttctgcaattcctctcccggttgggtttgcgtgatgtgtaaccgcaccagctcccccatccccgcccagcatgctccacggccttatgcatccagtctggaaaaaggccctccaaagcccggaccaccccgccggcttagcgcaccactgcctagcagttgtggcgacccagagaaacagaggcaggataaaatgcgggaagagggcttacagcttgtgtccatgatccgcgagggcgaagcggccggggcctgtccagaagagatattctctgcgcttcagtattctggcaccgaagtcccattgcagtggctgaggtcggagctgccctatgtcctcgagatggtggccgagctggccggacagcaggatccaggtcttggggcgttctcctgtcaggaggcccgtagggcgtggctggatagacatggcaatttagatgaagctgttgaggagtgtgtgaggaccagacggcgcaaggtgcaggagttacagagcctgggctttgggccggaggagggtagtttacaggcactgttccaacacgggggcgacgtgtcccgagctctgaccgagcttcaaagacagcggcttgaaccttttcgccagcgactctgggattcgggacctgaaccaacaccctcgtgggacggccccgataaacagtcactcgtgcgccggctgcttgctgtgtatgccctcccaagttggggtcgggctgagctcgccctcagcctgctgcaggaaacccctcgaaactacgagcttggtgacgttgtagaagcagtgagacattcccaggaccgagccttcctgcgccggctattggctcaagagtgcgcggtctgtgggtgggcccttccccataataggatgcaagccctgacatcttgcgagtgcacaatttgccccgattgtttccgtcagcactttacaatcgctctgaaagagaagcatattacagacatggtttgtcccgcttgtggccgcccggacttgaccgacgacacacagctgctctcttatttcagcactctggacattcagttgagagagtctctggagcccgacgcttatgctctttttcacaaaaaactgaccgagggggtcctcatgcgtgacccaaaattcttatggtgcgcgcagtgcagtttcggcttcatatacgagagggaacagcttgaagccacttgtccccaatgccaccagactttttgcgtgcgttgtaaacgccaatgggaggaacagcaccgagggaggtcgtgtgaggacttccagaactggaaacgtatgaacgatcctgaataccaggcacagggcctggccatgtatctccaggagaacggtattgactgccccaaatgcaaattctcctacgccctggctcgtgggggatgtatgcatttccactgtacccaatgccgccatcaattctgcagcggttgttataacgccttctacgccaaaaacaaatgccccgagccaaattgtcgggtaaagaaaagcctgcacgggcaccaccccagagactgtttattctatctacgtgactggaccgccctgcggctgcagaagctgctccaggataataatgtcatgtttaatactgagccacctgctggcgcaagagccgttcctggaggaggctgtcgagtgatagagcagaaagaggtgccaaatgggctccgagacgaggcatgcgggaaagagacccccgccggctacgccggactgtgccaggctcactataaggaatatctcgttagccttattaatgcccacagcctcgacccagccactctgtacgaagtcgaagaactggagacagccaccgagaggtatctgcacgtgagaccgcaaccattggccggcgaggatcctcccgcctatcaggcacgcctattacaaaaacttaccgaggaggtcccgttgggccagtcaataccccgcagaaggaagtag

SEQ ID NO: 203883 - DNA, 1518 bp, Artificial Sequence
  Description of Artificial Sequence: Synthetic coding sequence
atgcccggcgaggaggaggagcgggccttcctggtggcccgggaggagctggcaagcgctttaagacgcgattcaggacaggctttctccctggagcagctccgccccttgttggcttccagcttacctctcgccgctaggtacctccagttggatgctgccaggcttgtccggtgcaacgcccacggagagcctagaaattaccttaatacccttcccacaccgtcttgggacgggcccgacaagcagtcactcgtcagaagacttctcgctgtgtatgcacttccctcctggggcagagcagagctcgccctttcattgctccaagaaacaccacggaactacgagctaggagacgtcgtggaggcagtcaggcattcccaggatagagccttcctgaggcgactcctcgcccaagaatgtgcagtatgtggatgggccctcccccataacagaatgcaggctctgaccagctgtgagtgtaccatctgtccagactgcttccgtcagcacttcaccatcgcactgaaggaaaagcacattactgatatggtgtgcccagcttgtggccggcctgatctgactgacgacactcagctcctttcttacttcagcactttagatatacagctgagggagtctctggagccagatgcctacgctttatttcacaagaaattaaccgaaggggtgctcatgcgggatcctaaatttctatggtgtgcccaatgcagtttcgggttcatttacgaaagagaacagctcgaagcaacttgcccgcagtgtcaccaaaccttctgtgtccggtgcaaacgacagtgcgaggatttccagaattggaaacgtatgaatgaccctgagtaccaggctcaggggctcgctatgtatttgcaggaaaatgggatcgattgccctaaatgtaagttttcatatgctctggcccgggggggctgtatgcactttcattgcactcaatgtcgacaccagttttgcagcggatgctacaatgcgttctatgcaaaaaacaagtgtcccgagccaaactgtcgcgttaagaagtctcttcatggccaccaccctagagattgtctgttttatttacgagactggaccgccctgaggttgcagaaactgcttcaggataacaacgttatgttcaacactgaaccgcccgccggcgcacgagccgtgcctggcggcggatgcagagtcatcgagcagaaggaagtgcctaatggactgcgcgacgaggcttgtggcaaggagacacctgcaggttatgctggcctttgtcaggcccactacaaagagtatttagttagcctgattaacgctcattcattggacccagcaacactctacgaagttgaggaattggagacggctacagaacgatacctccacgttaggccccagccactcgcaggcgaggatccacctgcttaccaggcacggttgctgcaaaagctgaccgaggaggttccactgggccagtctatccccaggcgcagaaagtag

SEQ ID NO: 203884 - DNA, 2766 bp, Artificial Sequence
  Description of Artificial Sequence: Synthetic coding sequence
atggacctgtgcacccgggccggcgagcccagcctgacccagaacacacaccccagacagcaggcgctggaacaattactggaagacaaagtagaagacgatatgcttcaactttctgagtttgatccactactgcgggaaattgcccctggaccacttaccactccctcagtgccgggatcgacacccggcccatgcttcctgtgcggctctgcaccaggcaccttgcactgcccgtcgtgtaaacaagccctgtgtcctgcctgtgaccacctcttccacggccacccttcccgggcccaccatttgagacagactctgccgggggtgctgcagggaacgcacctctccccctcactgcctgcctctgcccaaccaaggccacagagtactagtctcctcgcactcggagacagcagcttgtcaagcccaaaccctgccagtgcccacctaccttggcactgtgccgcttgcgccatgctgaacgaaccttgggccgtcctgtgcgtagcctgcgacaggcccaggggttgcaaggggctaggcctgggaaccgagggaccccagggcactgggggcctggaacccgacctagcccgcggccgatgggcatgccagtcttgtacttttgaaaatgaggcagcggcggtgctatgctccatttgtgagcgtcccaggctcgcccagccaccctctctggtggtggactctcgggacgcaggtatctgcctacagcctctgcaacaaggggacgcgttgctggcctcggctcagtctcaggtgtggtactgcatccattgtactttttgtaattcttctccagggtgggtttgcgtgatgtgtaaccgtaccagcagccccatcccagcgcagcacgctccccggccttacgcctccagtttggaaaaaggtcctcctaagccaggaccccccaggcggctgagcgcacctttgcctagctcctgtggggacccagagaaacagcggcaggacaaaatgcgggaagaaggactccaactggtcagcatgatacgcgagggcgaagcggccggagcctgtccagaagagattttctcggcccttcagtattccggaaccgaggttccactgcaatggttacggtctgagctgccatacgtgttagagatggtggctgaactggccggccagcaggatcctggtctcggagcattctcatgccaggaggcaaggagggcgtggctggaccgccacggtaacctggatgaggccgtggaggaatgtgtgaggacccggaggcggaaggtccaggagctgcagtcgttggggttcggccctgaggagggcagcctgcaagccctgtttcagcacggtggtgacgtgagtcgtgctctgacagaactccaaaggcagcgactagagccattcagacagagattgtgggattccgggcccgagccaacaccatcctgggacggtcctgataaacagtccctcgtccgccggctgctggcggtctacgcattgccatcctgggggcgagccgaactcgctctatctctgctgcaggagaccccgcggaattacgagctcggagacgtggtggaggccgttagacacagccaggatcgtgcctttctgcggcgtctcctggcacaggagtgcgccgtgtgtggatgggccctgccccacaacagaatgcaggccctaacatcctgcgaatgcacaatctgtcccgattgtttccggcagcactttaccattgccctaaaagagaaacacataacggacatggtgtgtcctgcctgcgggaggcctgatctcactgatgacactcagttgttgagttatttctctacactagatatccagctgagagagtcgctcgaaccggacgcttacgcattatttcataaaaagcttaccgaaggggttctgatgagagacccaaagttcctttggtgcgcgcagtgtagtttcggcttcatctacgaacgggaacaacttgaagctacatgtccgcagtgtcatcagacattctgcgtcaggtgtaaaaggcagtgggaagaacagcacagaggaaggagttgcgaggacttccaaaactggaaacgcatgaatgacccagagtaccaggcccaggggcttgccatgtacctccaggagaatggtatagattgccccaagtgtaaattctcctacgctttagctcgaggaggttgtatgcatttccattgtactcagtgcagacatcagttctgcagcgggtgctataatgcgttttatgcgaagaataaatgtccagagcctaattgccgagtgaagaaaagcttgcatggacatcatccgcgggactgcctgttctatctccgggattggaccgcactccggttacagaaactactccaggataataacgttatgtttaacacagagccccctgctggggcaagagccgtgccagggggagggtgcagggtcatcgaacaaaaggaggtccctaacggattgcgggatgaggcatgcggaaaggagacccctgccgggtacgctggtctttgtcaggcacactacaaagaatacctcgtttccctgataaacgcccattcactggacccagctactctatatgaagtggaggagttagagacggcaaccgagcgctatctccacgtgcgccctcagcctctggccggtgaggacccacccgcctatcaggctcgacttctgcagaagctgaccgaggaagtgcccctgggtcagagtattccacgaagaagaaagtag

SEQ ID NO: 203885 - DNA, 513 bp, Artificial Sequence
  Description of Artificial Sequence: Synthetic coding sequence
atgcccggcgaggaggaggagcgggccttcctggtggcccgggaggagctggcttccgcgttgagacgggattcgggtcaagcattctctctggagcagctccggcctctcctagcatcgagcctcccattggctgccaggtacttgcagctggatgccgcgcggctcgtgcggtgtaatgctcatggagaaccgagaaactacctgaacaccctaagcacggcgctgaacatcttggagaaatacggcagaaaccttttgagtcctcagcgtccaagatactggcggggtgttaagttcaacaatcccgtgtttagatccacagtggacgcagtgcagggaggccgcgacgtgctcaggctctacggttacactgaggagcagcctgatggactgtcttttcctgaaggccaagaggaacctgatgagcaccaggttgcaactgttacactggaggtgttgctcttacggacagaattgagcttgctcctgcagaacacccatccgagatag

SEQ ID NO: 203886 - DNA, 171 bp, Artificial Sequence
  Description of Artificial Sequence: Synthetic coding sequence
atgcccggcgaggaggaggagcgggccttcctggtggcccgggaggaactagcttccgccctaagacgggattctggccaggccttctctctggaacaactgcgcccactgctggcgagtagcctccccctggctgctaggtacttgcaactcgatgccgcgcgactttag

SEQ ID NO: 203887 - DNA, 1122 bp, Artificial Sequence
  Description of Artificial Sequence: Synthetic coding sequence
atgcggaaggccggcgccaccagcatgtgggccagctgctgcggcctattgaatgaggtgatgggcaccggcgctgtgcgagggcagcagtctgctttcgctggggcgaccggtccattccgatttactcctaatccagaattttccacttacccacctgctgccacagaagggcctaacatcgtatgtaaggcttgcggtctttcatttagcgtttttaggaagaaacatgtatgctgtgattgcaaaaaggacttctgctcagtctgttctgtcttgcaggaaaatctgagacgctgttccacctgccatctcttacaggagaccgcatttcaaaggccacagctcatgcggcttaaggttaaggacctcagacagtaccttattctgcgcaacattccaattgacacgtgtagagagaaggaggacctcgtggatctcgtcctctgccaccatggcctaggctccgaggacgacatggacacatccagcctcaactcatctaggagtcagacttcaagcttctttacgcgctcattcttcagtaattacactgccccttctgccacaatgagcagtttccaaggcgagctgatggatggtgatcagacgtcacgctctggggtgccagcccaggttcagagcgaaatcacctctgccaacacagaagacgacgacgacgatgatgatgaggatgatgacgatgaggaggagaatgccgaggatagaaatccaggcctgagcaaagaacgtgtgcgtgcgagtctctccgatttgtcgtcccttgacgacgtggaaggcatgtccgttcgccagctgaaggaaatcctggcccgaaacttcgtcaactatagcggttgttgtgagaagtgggaattggtcgagaaagtgaaccgtttatataaagaaaatgaagaaaatcagaaaagctacggagagaggctgcagctgcaggatgaggaggatgattctctctgccgtatctgtatggacgccgtcatcgactgcgtgttactggaatgcggccacatggtaacttgcacaaagtgtgggaagcgaatgagtgagtgtccaatatgccggcagtacgtggttcgtgcggttcacgtgtttaagtcctag

SEQ ID NO: 203888 - DNA, 1119 bp, Artificial Sequence
  Description of Artificial Sequence: Synthetic coding sequence
atgaaggccggcgccaccagcatgtgggccagctgctgcggcctgctaaacgaggtgatggggactggcgcagtgaggggccaacagtctgccttcgctggagccacgggtcccttccgctttacaccgaacccggagttctctacgtacccacctgctgccacagagggccccaatatcgtgtgtaaagcctgtggacttagcttctcggtgtttagaaaaaagcacgtgtgctgcgactgcaagaaggacttctgttcagtgtgcagtgttcttcaagagaacttacgacgctgtagtacatgtcacctcctacaggaaaccgcgtttcagagacctcagctgatgagactaaaagtaaaggatctacgacagtatctcatcctgcgcaacattccaatcgatacctgtagagaaaaggaagacctggtggacttagtgctgtgccatcatggactggggtccgaagacgatatggacacttcctctttgaatagctcccgcagccaaacgagctcctttttcacaaggtcgtttttttccaactataccgcccctagcgcaaccatgtcctcatttcagggggagctcatggacggcgatcagactagcagatcaggcgtacccgcacaggtgcaatccgagataacctctgctaacacagaagacgacgatgacgatgacgatgaggatgacgacgatgaggaagagaacgcagaggaccggaacccaggattaagcaaagaaagggttcgggcctcgctgtccgatctctccagcctggacgacgtcgaggggatgtctgtgaggcagttaaaagagatacttgccagaaactttgtcaattactctggttgctgtgaaaaatgggaattggtagagaaggttaacagattgtacaaggagaacgaggaaaaccagaaaagttatggcgaaagactccagcttcaggacgaagaagacgactctctgtgcaggatatgtatggatgcagtgatcgactgtgtgcttctcgagtgcggccacatggtgacctgcactaagtgcggcaaaagaatgagcgaatgccccatatgccgacagtacgtggtgagagcagtgcatgtattcaaatcatag

SEQ ID NO: 203889 - DNA, 1122 bp, Artificial Sequence
  Description of Artificial Sequence: Synthetic coding sequence
atgcggaaggccggcgccaccagcatgtgggccagctgctgcggcttgctaaacgaggtgatggggactggggcagtgagaggtcagcagtcagcatttgcgggggcaactgggccgttccgcttcacgcctaaccctgaattcagcacctaccccccggccgcaactgaaggtcctaacatcgtctgtaaagcttgcggtctctcattcagcgtctttaggaaaaaacacgtttgttgcgactgcaaaaaagatttctgctctgtgtgcagcgtcctgcaggagaacctgcgacgatgtagcacttgtcacctgctccaggaaacagcatttcaacgcccccagttaatgcggcttaaggtgaaagacctcagacagtatcttatcctgagaaatatcccaattgacacctgcagggagaaggaggatctggtggatctggtcctttgccatcacggattggggtccgaagacgatatggatacatccagtctgaactcttcccgtagtcagacctccagcttcttcacaagatcttttttttcaaactatactgccccttcagcaactatgtcctcgttccagggagagctgatggatggagatcagacctccaggtccggtgtgccagcacaggtccagtctgagatcactagcgcaaatacagaggatgatgatgacgacgacgatgaggacgacgatgacgaggaggagaatgctgaagaccgcaacccaggtttatccaaagagagggtcagagccagtttgtctgacctgagctcactcgatgatgtggaagggatgtccgtacggcaactgaaggagatcctggcccgcaatttcgtaaactactctgggtgttgcgaaaaatgggaactggtggagaaagtgaacagactgtacaaagaaaacgaggaaaaccaaaagtcctatggggaacgactccagttacaggacgaggaggatgactcactgtgtcgcatatgtatggatgctgtcatcgactgcgtcctactcgaatgcgggcacatggtcacttgcacgaagtgcggtaaaagaatgtcggagtgcccaatttgcagacaatatgtggtgcgagccgtccacgtctttaaatcatag

SEQ ID NO: 203890 - DNA, 1548 bp, Artificial Sequence
  Description of Artificial Sequence: Synthetic coding sequence
atggcctgcaagatcagccccggcgccaacagcgccagcctgcccgggcaccctaataaagtcatctgcgagcgagtgagactccaaagtctgttcccactcctgccgtccgatcaaaatactaccgtgcaggaggacgcccatttcaaggctttctttcagagtgaagattccccatcccctaagcgccaacgcctgagccatagcgtatttgattacacctcagccagcccagcccccagtccccctatgcgcccttgggagatgacgagcaaccgacagcccccaagcgttcgcccgagccaacaccacttctcaggcgaacgatgcaatacccccgctcggaatcgaagatctcctccggtgagacggcaacggggcagaagggatcggctcagcagacacaattccatcagccaggatgagaactaccaccaccttccctacgcacagcagcaggccatagaggaaccacgggcctttcacccgcccaacgtgtccccgagattgctccatcctgccgcccatccaccacagcagaatgccgtgatggtggatatccacgatcagctgcaccaaggcactgtccctgtcagctataccgtgaccacagtcgctccgcacgggatccccctctgtaccggccaacatataccagcgtgctctacacaacaagtacccggctgtagtgtggtcttcagcggccagcatttgcctgtttgtagcgtaccgccacccatgctgcaggcctgtagcgtgcagcatctgccagtgccatatgctgccttccccccgttaatctccagtgacccctttctgatccatccgcctcacctaagcccccaccacccaccgcaccttccacccccaggtcagttcgtaccctttcagactcaacagagtcgctcccctctgcaaagaatagagaacgaggtcgagttgctcggtgagcatttaccagtgggagggtttacataccctcctagcgctcatcctccaacactgccaccctccgctcccctgcagttcctgacccatgaccccctgcatcaggaggtgtccttcggggttccctaccctccgtttatgccgagaagactgaccggtagatcaagataccgaagtcagcagcccatccccccccccccgtatcatccctcccttcttccttatgttctcagtatgctaccggttccgccagcagtcgggccgaccttcagttttgaactagacgttgaggatggcgaggttgagaattatgaagcactactcaatctagcagagcggctcggagaggcgaagcctcgtggcctgaccaaggctgacatagagcagctgccgtcttacaggttcaatccgaataatcaccagtccgaacagactctgtgcgtggtctgtatgtgtgattttgagtctaggcagctgcttcgggtactgccctgcaaccacgagtttcatgccaagtgcgtggataaatggctgaaagccaaccgtacatgccccatatgccgcgccgacgcatcagaagtccaccgtgacagtgaatag

SEQ ID NO: 203891 - DNA, 1299 bp, Artificial Sequence
  Description of Artificial Sequence: Synthetic coding sequence
atgcggccctgggagatgaccagcaaccggcagccccccagcgtgagaccttcccaacaccacttctcaggagagaggtgtaacacacccgctagaaatcgacggtcaccaccagtgaggcgccagaggggccgcagggatcgcctttcacgacataactcgatctcgcaggacgaaaactaccaccacttgccctacgcacaacagcaggccatagaagagccacgagcatttcatccccccaacgtcagcccacgtctcctccatccagctgcccaccccccacagcagaatgctgtaatggtggacatccatgatcaactgcaccagggaaccgttcccgtgagctacaccgtgacaactgtcgctccgcacgggattcctctgtgcacgggacaacatatccctgcctgctctactcagcaggttccagggtgttccgtggtgtttagcgggcagcacctccctgtatgcagcgtcccgccaccaatgcttcaggcgtgctcagttcagcatctaccagttccatacgctgcattcccacccctcattagctcagacccgttcctaatccaccccccccatctaagcccccaccatcccccccacctcccgcccccgggacaatttgttccatttcagactcaacaatcccggtctcccctgcagagaatcgagaatgaggtggagctgctcggcgagcacttgcccgtggggggattcacgtatccaccatcagctcacccaccgacgctccctcctagtgcccccctccagttccttacccacgaccctctacatcaggaagttagttttggcgttccttacccacccttcatgccacggagactcacaggcaggtctagataccggagccagcaacccatacctcctccaccctatcatcctagtctgctaccatatgtgctgagtatgctgcccgtgccaccagcagttggccctacattctcttttgagctggatgtagaagacggagaagtcgaaaactatgaagcgctcctgaatctcgccgagcgattaggcgaagccaagcctcggggactgacaaaagccgacatagagcaactgcccagctacaggttcaatcccaacaaccaccagtcagagcagacactctgcgtcgtttgtatgtgtgactttgagtcccgacagctgctgcgtgtgctgccctgtaaccatgagttccatgcaaagtgtgtggacaagtggctgaaagcaaacagaacttgtccaatctgcagagcagacgcatccgaggtgcaccgcgattctgagtag

SEQ ID NO: 203892 - DNA, 1398 bp, Artificial Sequence
  Description of Artificial Sequence: Synthetic coding sequence
atggcctgcaagagcgaggacagccccagccccaagcggcagcggctcagccattcggtttttgattatactagcgcttcccccgccccatcccctccaatgaggccctgggagatgactagcaatcgccagcctccatctgtacggccctcccagcaccactttagcggggagagatgcaacacgcccgcccgtaaccgtcgatcacccccggtcagacggcagagaggacgtcgagataggctgagtagacataattcaatctcacaggacgaaaattaccatcatctgccttatgctcagcagcaggctatcgaagaacctcgggcttttcatcccccaaatgtctcccctcggctcttacacccagcggcccacccaccccagcaaaacgcagtgatggttgatatccacgatcagcttcaccaaggaaccgtacctgtatcctatacagtcaccactgtggccccgcacggcatccctttatgcacagggcaacacattcccgcctgctcaacccagcaagtgcccggatgttccgtggtgttcagcgggcagcacttgcctgtgtgcagtgtgccgcccccaatgctgcaggcctgcagtgtgcagcatctgcccgtaccctatgctgcctttccacctctcattagctctgaccccttcttaatccatcccccccacttgagcccccaccatccaccccacctgccaccgccaggacagtttgtaccctttcagacgcagcagagccggtctccgctgcagcgcatcgagaatgaggtcgagcttctcggggagcatctcccggtgggtggctttacataccccccctctgcacacccgcccaccctgcctcccagcgcaccactccaattccttacacacgacccattacaccaggaagtgagctttggcgtgccttaccccccattcatgccaagacgtctgacagggaggtctagataccgatcacagcagcccatccccccgccgccctatcaccccagcctgttaccctacgtcctgtccatgttgcccgtgcctccagccgttgggcctactttttctttcgagctcgacgttgaggacggcgaagtggagaattacgaagccctgctgaatttggcagaacgcctgggagaggccaaacccaggggcctcaccaaggccgacattgagcaacttccatcctaccgatttaatcccaataaccaccagagtgaacagacattgtgtgttgtctgcatgtgtgatttcgaaagccgacagctgctgcgggtgctgccctgcaaccacgaatttcatgccaaatgcgtagacaagtggctgaaagccaacaggacttgccccatttgtagagccgacgcctcagaagttcaccgggactccgaatag

SEQ ID NO: 203893 - DNA, 1299 bp, Artificial Sequence
  Description of Artificial Sequence: Synthetic coding sequence
atgcggccctgggagatgaccagcaaccggcagccccccagcgtgagacctagccaacatcacttttcaggcgagcgatgcaacacccctgcaaggaacaggcggtcccctcccgtgcgccgccaacgcggacggagggataggctgtccaggcacaattctatcagtcaggacgaaaactaccaccacctcccctatgcgcagcagcaggctatcgaagaacctagagccttccatccacctaatgtcagccctcggcttctgcaccctgccgcacacccaccgcagcagaacgctgtaatggtggacatacatgatcagctgcaccagggaacggtgcccgtttcctacaccgtcacaactgtggcccctcacggcatccccttatgtacgggccagcacattcccgcatgctccacacaacaggtgcctggatgtagtgtcgtttttagcggtcagcacctgcccgtctgctccgttcctccgccaatgcttcaagcatgcagtgtgcagcacttaccagttccctacgcagcctttccccccttgataagcagcgatccatttctgattcaccccccccacctgtcaccacaccacccaccacacttgcccccccccggacagtttgtgccatttcagactcaacaatcgaggagtcctctccagaggatcgaaaacgaggttgaactgctgggagagcatcttcctgtggggggattcacgtacccacctagtgcccaccctcctacattgcccccaagtgctcccctgcagtttctgacacacgacccactacaccaggaggtcagctttggcgtgccctaccctcccttcatgccaagaagactaacaggtcgctcaagataccgtagccaacagcccattcctccgcctccatatcacccctccttgcttccctacgtgcttagtatgctccctgtgccccccgctgtgggccccacatttagtttcgagctggacgtggaagatggtgaagtcgagaactacgaggcccttttaaatcttgcagagagactgggcgaggccaagccaaggggcctcactaaagctgatattgaacagctaccttcttaccgttttaatcccaacaatcatcagtctgagcagacgctgtgcgtcgtgtgtatgtgtgactttgagagcagacaactgctgagagtcctgccctgcaaccatgagttccacgccaaatgtgtggataagtggctgaaagccaatcggacttgcccgatttgcagagcggatgcctccgaagttcaccgggacagtgagtag

SEQ ID NO: 203894 - DNA, 1320 bp, Artificial Sequence
  Description of Artificial Sequence: Synthetic coding sequence
atgcagcacacctgcacccagcagaagaaggtgacctacaagcacatagcccgattctcgccacgcaatcgcctttgccaggcagatgccgtgttcaataataatctggctggctttcaactccagagccccccagttaggcgccagcgcggacgaagagaccggttgtctcggcacaattccatttcccaagatgagaattatcaccaccttccctatgctcagcaacaggccatcgaagagcctcgggcttttcatccaccaaacgtgagccctagactgctgcatccagcggcacatccgccccagcagaacgccgtaatggttgacatccatgaccagctccaccagggcactgtcccagtgtcatatacggtcaccactgtagcaccacacggcatccctttgtgtactggccaacacattccggcttgctctacccagcaagtgcccgggtgttccgtggtcttttccggacagcatctacccgtgtgcagcgtccctcctcccatgctccaggcctgttctgttcaacacttaccagttccttatgcggcttttcccccgctaatttctagcgatccttttttaatacatcctccgcacctgagcccccatcacccacctcaccttcccccgcccgggcagtttgtcccattccagacgcaacagagccggagccccctgcagcggatcgaaaatgaggtggagttgttgggcgagcatttgccggtggggggatttacttaccctccttcagcccatccgccaactttgccacccagtgcccccctccaattcctgacacacgacccgcttcatcaagaggtttcatttggagtcccatacccaccatttatgccacgacgcttgacaggacggagtcgatataggtctcagcagcctattccaccgcctccttatcacccatcattgttgccatatgttctaagcatgctgcctgtccccccagctgtgggccctaccttttcctttgaactggacgtagaggacggagaggtggaaaattatgaggccctgttgaacctggcggagcgacttggggaggctaagccacgcggcctgacaaaagcggatatcgagcagttaccaagttacaggtttaatccaaacaatcatcagtccgagcagaccttgtgtgtcgtctgtatgtgcgatttcgagtctagacagctgctacgcgttctgccatgtaaccacgaatttcatgcaaaatgcgtggataaatggttgaaggctaatcgcacctgtccgatctgtcgggccgatgcctccgaggtccaccgggatagcgagtag

SEQ ID NO: 203895 - DNA, 999 bp, Artificial Sequence
  Description of Artificial Sequence: Synthetic coding sequence
atggtggacatccacgaccagctgcaccagggcaccgtgcccgtgtcctatactgtcactacagtggcaccccacgggataccactttgtacagggcagcatatcccagcatgctccacccagcaggtgcccggttgctcagtggtcttctctgggcagcatttaccagtctgctccgtgcctccgcccatgctgcaggcctgcagcgtgcaacacctgcctgtcccttacgcagcattcccccctcttatttcttccgacccctttctgatccacccgccccacctgtcaccacatcatccccctcacctcccccctccgggccagtttgttcctttccaaacacaacagtccagatcccccctacagaggatagaaaatgaggttgaattattgggcgagcacctgccagtgggtgggttcacatacccaccaagcgcccaccctcccacactgcctccatcagccccacttcagttcctgactcatgacccactgcatcaggaggttagttttggtgtcccttaccccccatttatgccccgtagactaaccggacgatcccggtaccgcagtcagcagcctattccaccccctccataccatccatcgttgctgccctacgtcctttctatgttacccgtaccccctgcagtgggcccgacattcagctttgaactcgacgtggaggatggcgaagttgaaaattacgaggcacttctgaaccttgccgaaaggctgggggaggctaaaccccgcggactgaccaaggcagacatcgagcagctgccttcataccgcttcaaccccaataatcaccaaagtgaacaaacactttgtgtggtgtgcatgtgtgattttgagtctaggcaacttctaagggtcctgccgtgtaaccacgagttccacgccaaatgcgtggataaatggttgaaagcgaatcggacatgcccaatttgtagggctgatgctagcgaagttcatcgggattcagagtag

SEQ ID NO: 203896 - DNA, 1320 bp, Artificial Sequence
  Description of Artificial Sequence: Synthetic coding sequence
atgcagcacacctgcacccagcagaagaaggtgacctacaagcacattgctcggttctcgcctagaaaccgactgtgtcaggccgatgccgtattcaataataatctcgccggctttcagcttcagtctccaccagtgagacgccaacggggtagacgagatcgtttgtccagacataattctatcagccaggacgaaaactatcaccacctcccttacgctcagcaacaggccatcgaggagcctcgagccttccaccctcctaatgtcagtcccaggctgctgcacccagccgctcaccctccgcaacaaaacgctgtcatggtggatattcatgaccagctgcaccagggcaccgtgcccgtctcttacacagtgacaacagtggcgccccacgggataccgctgtgcactggtcagcacataccggcatgctccacacagcaggttcctgggtgcagcgttgtttttagtggtcagcatcttccagtgtgctcagtgccgccgcctatgctgcaggcctgctccgtgcagcacttgcctgtcccgtacgcagcattccccccactaatctctagtgatccttttctgatccacccccctcacctctcaccacaccacccaccccatctcccccctccgggccaatttgtgccattccagacccagcagtcccgttcacccctgcagaggattgagaatgaggttgaacttcttggcgagcatctgccggtgggcggattcacctaccctcccagcgcacatccccctacactcccacccagcgcgcctctgcagtttctcacccacgatcccctgcaccaggaggtgagtttcggagtgccatacccacccttcatgccaagacgactgactggtcggtccaggtatcggtcccagcagccaatcccaccgcctccctaccatcctagtcttctcccatacgtcctatccatgcttccggtgccccccgccgtgggtcccaccttttccttcgagctggacgtggaggatggggaggtggagaattatgaggcattgctgaacttggccgagaggctaggagaggctaagccgcggggactgaccaaagcagacatagagcagctcccctcttacaggttcaatccaaacaaccaccagtccgagcagacactttgtgtcgtgtgcatgtgcgattttgagagccgacagctgctcagagtgttgccatgcaatcacgaattccatgctaaatgcgtggacaagtggttgaaagccaacaggacctgtcccatttgccgcgctgacgcgagcgaagtgcatcgtgactccgagtag

SEQ ID NO: 203897 - DNA, 1299 bp, Artificial Sequence
  Description of Artificial Sequence: Synthetic coding sequence
atgcggccctgggagatgaccagcaaccggcagccccccagcgtgcgcccctcgcaacatcatttctctggggaacgatgtaatacaccagcacggaaccgccgatcccccccagtcaggcgacagagagggagacgagaccgcctctcccgacataattccatttcccaggatgaaaattaccaccatctcccctacgctcagcagcaggctattgaagaacctagagccttccatccaccaaacgtttcccctagacttctccaccccgccgcgcacccaccgcagcaaaatgccgtaatggtcgacattcacgaccagctccatcagggaaccgtgcctgtgagctacacagtgacgaccgtcgccccgcatggcatacccctatgtacagggcagcatatccccgcctgttccactcaacaggtccctggttgttcagtcgtgttctcagggcagcacctgccggtgtgttcggtacccccacccatgcttcaggcttgttctgtgcaacacttacccgtgccctatgctgccttcccccccctgatctcaagcgacccctttctgatccatcccccacacctgagcccacatcacccccctcatcttccaccacctgggcagtttgttcctttccagacccagcagagtagatccccacttcagaggatagagaatgaggtggaactgcttggagaacatctgcctgtgggcggttttacttaccccccgtccgcccacccccctactctgcctccctccgcacctctgcagttcctgacacacgacccattacaccaggaggtgagtttcggagtgccatacccacctttcatgcctcggcgactgacaggacgctcacgctaccgatcccaacagccgatcccgccacccccttatcatccttccctcctgccctacgtactgtccatgctgcctgtgcctccagccgtcgggccaaccttcagcttcgaactggatgtggaagacggcgaggttgaaaactatgaggcactgctcaacttggctgagagactgggcgaggctaagcctagggggctcaccaaggctgatatcgaacagctgccctcatacagatttaatccgaacaaccaccagtcagagcagactctgtgcgtcgtgtgtatgtgcgactttgagagccgacaactgctgcgcgtgcttccttgtaaccatgaattccacgccaagtgtgttgacaagtggctcaaagcgaaccggacctgtccaatttgccgtgcagatgcatccgaggtacatcgcgattccgaatag

SEQ ID NO: 203898 - DNA, 1263 bp, Artificial Sequence
  Description of Artificial Sequence: Synthetic coding sequence
atgtggtggcgggacctgacccggctgcggctgtggctgaagcgggaggcaatccctggagagggacggaaagcagctaaagtcaacgccggtgtgggcgaaaaaggtatctacactgcctcgtccaggggggggccgcccagtgctagatctaaggcagtgacagtggtcgcagagggggctgcatctcggtcctggctgtcaatggatgctcccgaactgggacccggcctggtagagaggctagaacagctcgccacttgccccctttgtggaggctccttcgaagacccggttcttctagcttgcgagcactccttttgcagagcatgcctggcacgccggtggggaactcccccggcgactggtaccgaggctagccccacagcctgtccctgctgcggtctgccctgtcctcgaagatcacttcggagcaacgtgcgcctagccgttgaggtgcggatatcgagggagttacgcgagaaactagccgagcccggggcgcgagccggccgtaggagaggtggtagaatacctacgatggggtgtctggacttaccaggagaagacatgcgcaaaacgtggcgtaggttcgaggtcccgacttcaaaatcttctaactccgaagacgacttgcctgaggattacccagttgtgaaaaagatgcttcatcgcctgactgccgaccttacactcgatcccggtactgcgcaccgaagacttcttatctctgctgatcggcgtagcgtacagctcgccccacctggaactcccgctcctcctgacggccccaagagattcgaccaactgcccgctgttctcggagctcaaggctttggagccggacgccactgttgggaagtcgagaccgcagacgcggctagctgtcgcgatagctccggagaggatgctgatgatgaagaatctcattatgccgtgggtgctgccggggaatcagtccagaggaaggggtgcgtgcggctgtgccctgccggcgccgtttgggccgtggagggtagaggcggcaggctgtgggcgctgaccgctccagaacccacgttactcgggggtgtggaacccccacctcgccggattagagtggacctggattgggagcgcggccgcgttgctttttatgatggcagaagcctggacctgctgtatgctttccaggcccctggacctctgggtgagaggatctttcctctgttttgcacctgcgatcccagagccccactaagaattgtgcctgctgagtcttag

SEQ ID NO: 203899 - DNA, 756 bp, Artificial Sequence
  Description of Artificial Sequence: Synthetic coding sequence
atgtggtggcgggacctgacccggctgcggctgtggctgaagcgggaagccattcctggcgaaggtaggaaagctgctaaagtgaacgccggcgtcggggagaagggaatctacacagcctcttcacgaggcgggccccctagcgcccgttcaaaggcggtgaccgtggtcgctgaaggagcagctagccgctcttggctctctatggacgccccagaactgggccccggcctggtcgaacggctggagcaactcgcaacttgccccctgtgtggtgggtccttcgaggaccccgtgttactggcttgcgagcacagcttttgcagggcctgcctggcaagacgctgggggacgccccctgccactggtaccgaggctagcccaaccgcctgcccatgttgtggcctgccctgtccaaggagatcccttaggtcgaacgtgaggctcgctgtcgaggtgcgtatttctagggagctgctcttcggcggcggcatcccacattccttcctcgggacccattcacacgctcattgtaggagcattaacagtaacccacactttcgtccaaagattatgagaccgcacctggtgtccaccttccctcgtccatgcagtaaacctaacccatttcttccaagtggcagccaaaatttgctctctccaaccgcaaccacagtgttgccagatttttctcacagtaatcattcaagacccgcgatgggcaacagaccaagtccctctgtcctcgtgaagtag

SEQ ID NO: 203900 - DNA, 1065 bp, Artificial Sequence
  Description of Artificial Sequence: Synthetic coding sequence
atgtggtggcgggacctgacccggctgcggctgtggctgaagcgggaggctatccctggagagggccgtaaagccgcaaaggtgaacgccggcgtcggggagaagggcatatacactgcgagctctcggggcggcccccctagcgccaggtccaaagcggtcaccgtggttgcagaaggcgccgcaagtcgtagttggcttagcatggacgcccctgagctcggcccaggactagtagagagactcgagcaacttgcgacttgccctctgtgcggaggatcctttgaggatcccgttttactggcttgcgagcactccttctgtagagcatgccttgccaggaggtggggcactccaccagcgacaggcacagaagctagtcccacagcctgcccctgctgcgggctgccttgcccacggagaagcctacgcagtaacgtcagattagccgtcgaggtccgcatctcgcgcgaattaagggaaaagcttgctgagccaggtgccagggcgggccgaaggagaggcggccggatcccaacaatgggctgcctagacttgcccggcgaagatatgagaaaaacatggagaaggttcgaggtgcccactccaaagtcttccaattctgaggacgacctcccagaggactacccggtcgtgaagaagatgctccataggttaactgcagatctgacgctggaccctggtaccgctcaccgtcggctcctgattagtacagacaggagatccgttcagttagcaccacctggtacccccgccccacccgatggaccgaagagatttgatcaactgcccgctgttctgggggcccaaggtttcggcgccgggcggcattgttgggaagttgagacggccgatgcagcaagctgcagggacagttccggagaagatgaggatgatgaggaatctcattatgcggtgggcgccgccggagagtccgtgcagcgaaaagggtgtgcacccgggcctctaggggaacgcatctttccgttattttgcacatgtgatccccgtgcaccactgcggatcgtgcctgcagagtcctag

SEQ ID NO: 203901 - DNA, 1065 bp, Artificial Sequence
  Description of Artificial Sequence: Synthetic coding sequence
atgtggtggcgggacctgacccggctgcggctgtggctgaagcgggaagcgattcccggggagggcaggaaggccgccaaggtgaacgcaggagttggcgaaaagggtatctatacggcctctagccggggtggcccgccgtccgcaaggtcaaaggctgtgaccgtggtggctgagggggccgcttcccggtcatggctgtccatggacgcgcccgaactcggaccaggccttgttgagcggcttgaacaacttgcgacttgcccactatgcggcgggagctttgaggatccggtcttgctggcgtgcgagcattccttctgcagggcatgccttgccagacgatggggaactcctccagctaccgggaccgaggcctccccaacggcatgtccctgctgcgggttaccctgcccacgtaggagccttaggagcaatgtgcgcctggcggtggaagttaggattagcagggagctgcgtgagaagctagccgagccaggtgctagagcaggaagacgtcgcggggggagaatcccgacaatggggtgtctagaccttcctggggaggatatgcgtaagacttggcgccgctttgaggtccctacgtccaagagctcaaatagtgaagatgacctcccagaggattacccagtggtaaaaaaaatgctgcatcgcctgaccgctgacctgactctcgacccaggtacggcccatcggagactgctcatctcagcagataggagaagcgtgcaactggctccccctggcactccagcaccgcccgacggccctaagcgtttcgaccaacttccagccgtgctgggtgcacaaggtttcggtgcaggtcggcactgttgggaggtagagacagcagacgcggcttcttgcagggattctagtggggaggacgcagacgacgaggaatcccactacgcagtcggcgcagccggtgagtctgttcagagaaaggggtgcgccccaggaccactcggcgaaaggatttttccactcttctgcacctgtgatccccgggcgcccctcaggatcgtcccggcagaatcatag

SEQ ID NO: 203902 - DNA, 1263 bp, Artificial Sequence
  Description of Artificial Sequence: Synthetic coding sequence
atgtggtggcgggacctgacccggctgcggctgtggctgaagcgggaggctattcccggagagggcagaaaggctgccaaagtaaatgctggagttggggaaaagggaatctacacggccagtagtagaggaggcccgccaagtgcacgcagtaaagccgttactgttgtagcggaaggagctgccagcaggtcctggctgagcatggatgcaccagaactagggcctggacttgttgagcggcttgaacagttggctacatgtcctctctgtggtggtagcttcgaagatcccgtgctgctggcatgtgaacattccttctgtcgtgcctgtctggcacgtcggtggggaacaccccccgccacgggcacagaggcatcacctacagcctgcccctgttgcgggcttccatgtccccgccgctccctgagaagcaatgtgcgactcgcagttgaagtgcggatctctcgggaattgcgcgagaagctggccgaaccaggtgcaagggctggcagaagaagggggggacgaatcccaacaatgggttgtctggacttgcctggggaagacatgcggaaaacttggcgaaggtttgaagtcccgacccctaagtcctccaactcagaggatgatctccctgaagactatcctgtcgttaagaagatgctccatcgccttactgccgacctgacactggacccaggcacagcacataggaggttgttgataagtaccgatcgaaggagcgtgcagctggcccccccaggaacccccgcgccccccgatggaccaaagcggtttgaccaactgcccgccgtgcttggcgcacagggatttggcgccggccggcattgttgggaagtggaaactgccgatgccgcatcttgccgggatagctccggggaggacgaagacgatgaagaaagccattacgccgtgggcgcagcaggtgagtcagtgcagagaaaggggtgcgttaggctgtgtcctgcgggcgcggtgtgggctgtagagggccgtggagggagattgtgggcccttacggcgcccgaacctaccctgctgggcggagttgaacctcctccaaggaggattagggttgaccttgattgggagaggggaagggtggctttctatgacggtagatccctggacctcctgtatgcctttcaagcccccggacctctgggggagcgcattttcccgctgttctgcacatgtgatcctcgcgctcctctccgcatagttcccgcagaatcttag

SEQ ID NO: 203903 - DNA, 1065 bp, Artificial Sequence
  Description of Artificial Sequence: Synthetic coding sequence
atgtggtggcgggacctgacccggctgcggctgtggctgaagcgggaggccattccaggcgaagggagaaaggccgcgaaggtaaatgccggggtgggcgaaaaagggatatacacagcttcaagccgcggcggcccccctagtgcccgttctaaggcagtgactgtggtcgccgaaggggcagcctcacggtcgtggttgagcatggacgctcctgaactgggtccgggccttgtcgagaggctggagcagttggccacttgccccctctgcgggggaagttttgaagaccccgttctgctggcatgcgaacacagcttttgtagagcgtgcctcgccaggcgatgggggactcctccagccactggcaccgaggcctcgcccacagcatgcccgtgttgtgggttaccgtgccctaggcggtctcttcgcagcaacgtacgtcttgcggtcgaggtccgcatctcacgcgagctgcgcgaaaagctcgccgaacctggagcacgtgctggtagacgtcgaggaggacgtatacccacaatgggctgcctagatttaccaggggaggatatgaggaagacatggaggcgatttgaggtacccaccagcaaatctagcaattctgaagatgatctgcccgaggactaccccgtggtgaagaagatgctgcacaggctgaccgctgacctgaccttagacccaggcacagcccatagaaggctcctgatctctgccgacagaaggtctgttcaactcgcaccacctggaacgcccgcaccacctgatggtccaaagcgcttcaatcagcttccggccgtactgggggcccagggttttggagcaggtcggcactgctgggaggtcgaaactgccgacgccgcctcctgtagggactctagcggagaggatgctgatgacgaggaatcgcattatgcggtgggagctgctggggagtctgtgcagcgcaagggatgcgcccccggtccactgggagaaagaatttttcccctgttctgcacctgtgatccccgggcacccctgcggattgtgccggccgagtcatag

SEQ ID NO: 203904 - DNA, 1263 bp, Artificial Sequence
  Description of Artificial Sequence: Synthetic coding sequence
atgtggtggcgggacctgacccggctgcggctgtggctgaagcgggaggccatccccggggaaggcaggaaggcggcaaaagtgaacgccggagttggtgagaaaggaatctacactgcctcaagtagagggggacccccttcagcgagatcaaaagccgtgaccgtagttgccgaaggcgccgcaagtcggagctggctatctatggatgctcccgagctgggaccagggctggtggagcgtttagagcagctcgccacctgccccctatgtggcggaagtttcgaggatccagtgcttctggcctgcgaacactccttctgccgtgcctgcctggctcggaggtggggaacccctcctgcaacaggcacagaggcttcccccacagcatgcccttgttgtggtctcccctgcccgaggcgaagtctccgctcaaacgtgagactcgccgtggaagtgaggatttcgcgcgagctgagagagaaactggccgagccaggggcccgggccggtcggcggaggggcggccggatccccacaatgggttgcctcgacttaccaggggaggatatgcggaagacctggcggagattcgaagtgcctacttcgaaatccagcaactccgaggacgatttgcccgaggactacccagtggtgaagaagatgctccaccgcttgaccgccgatctcaccctcgacccggggacagcacatcggcgcctcctaattagcgccgacaggaggagcgtgcaacttgccccaccaggtacaccggctccaccagatggcccaaaacggttcgatcagcttcccgcggtgctgggggctcagggtttcggagccggaagacactgttgggaagtggagacagccgacgctgcctcctgtcgagacagcagcggcgaggatgcagatgacgaagaatcccactacgctgtgggggctgcaggcgaatctgtgcaacggaaaggctgcgtgaggctgtgtcccgcaggcgcagtgtgggccgtgggagggagaggaggacgcctgtgggcacttacagccccggaaccaacactgctgggtggtgtggagccccccccccgtcgcattagggtcgatctggattgggaaagaggcagggtggccttttatgacggacgatctctcgatttgctgtatgcctttcaggcgccagggcccttgggtgagcggatcttccccctgttctgtacctgtgaccccagagcccccctacgcatcgttcctgccgaatcctag

SEQ ID NO: 203905 - DNA, 1263 bp, Artificial Sequence
  Description of Artificial Sequence: Synthetic coding sequence
atgtggtggcgggacctgacccggctgcggctgtggctgaagcgggaggccatccctggagagggaaggaaagcagctaaggtgaatgctggagtgggagagaaggggatatacaccgcctcatcccgtggcgggccccccagcgcccgatctaaagccgtgacagtcgtggctgaaggggcggcctcaaggagttggctgtctatggacgctcctgagctcgggcctggactggtcgaacgtctggagcagttagctacttgccctctgtgcggtggctcgtttgaagacccagtactccttgcctgtgaacacagcttctgcagagcctgtctggcacggcggtggggaacaccgcctgcaaccggaaccgaggcctcaccgacagcatgtccctgctgtggattgccctgccccaggagatcactccgctccaatgtgcgactggccgtcgaggttcgaataagtcgggaattacgcgaaaaattagcagagcctggcgcccgcgcaggacggcggagaggagggagaatccctactatgggttgcctggacctaccaggagaggacatgcgcaagacctggcgccgattcgaagttccgacctccaaatcctctaatagcgaggacgatctcccggaagactatccagtggtaaaaaagatgctgcatcgccttaccgccgatctaacactcgatccgggtaccgctcatcgcaggttgctcatatctgccgacagacgcagcgtgcagctggccccacccggcacccctgcccctccggatggccccaagaggttcgatcagctgcccgcagttttgggagcgcagggatttggcgccggcaggcattgttgggaggtggagaccgcagatgccgcgtcctgtcgagattcatccggagaagacgctgatgatgaagagagccactacgctgttggtgccgccggggagtcggtgcagcgcaaaggatgtgtccgcctttgtcctgcaggggccgtgtgggcggtggaaggtaggggtggaaggctgtgggctttgaccgccccagagcccaccttactgggtggagttgagccgcccccacggcgtattcgagtggatctggattgggaacgagggcgggtggctttttatgatggccggtctctcgatttattatacgccttccaggcgccaggtccccttggtgagagaatttttccactgttttgcacatgtgatcctcgcgctccattacggatagtgccagcagaatcttag

SEQ ID NO: 203906 - DNA, 1263 bp, Artificial Sequence
  Description of Artificial Sequence: Synthetic coding sequence
atgtggtggcgggacctgacccggctgcggctgtggctgaagcgggaagcaataccgggcgagggtaggaaagccgccaaggtaaacgcaggcgtcggtgagaagggcatttatactgcctccagtagaggaggacctccatcagcgaggtctaaggccgtgacagtggttgctgagggcgccgcatcccgaagctggctgtccatggacgccccagagttggggcccggcctagtcgaacggctggagcagctagcgacctgccccttgtgtggaggatccttcgaggaccccgtgctgctggcctgtgaacactcattctgccgcgcttgtcttgcaagacggtggggaactcctccagccacaggtactgaggccagtcccactgcctgcccctgttgcggtctgccttgcccaaggcgtagcctgcgaagcaatgtacgtctcgctgttgaggtccgtatttcaagagagctccgcgagaaactggccgagccaggagctagagctggtcgccgtaggggaggccggatcccaaccatggggtgcctcgacctccccggagaggacatgcggaagacctggcggcgttttgaagttccaaccagtaaaagctctaacagtgaggacgacctgccagaagattaccctgtggtgaagaagatgcttcacaggctgacggccgacttgaccctcgatcccggtaccgcccaccgcagactgttgattagcgccgacaggcgcagcgtccaactagcaccaccaggcacccctgctcctccagacggcccaaaacgctttgaccagctccctgctgttcttggagctcagggctttggagccgggcggcactgctgggaggtggaaactgccgacgccgcgtcgtgccgggactcgagtggtgaggacgctgacgacgaggaatcacactatgccgtcggcgcagctggggaaagtgttcagagaaagggatgtgttaggctgtgcccggctggggcagtatgggccgtagaaggccggggtgggcgattgtgggcacttaccgcacccgagccaactctcttggggggggttgaaccccccccacgccggattagggttgacctagattgggagcgcggacgtgtcgctttttacgacggccgctcattggacctactctacgccttccaagctcccggcccactcggcgagagaattttcccactgttttgtacctgcgacccccgcgccccccttaggattgtccccgcagaatcttag

SEQ ID NO: 203907 - DNA, 1065 bp, Artificial Sequence
  Description of Artificial Sequence: Synthetic coding sequence
atgtggtggcgggacctgacccggctgcggctgtggctgaagcgggaagctatacctggggaaggacgcaaggctgctaaagtcaacgcaggcgtgggagaaaaaggtatctatactgcctcgagcaggggcgggccaccttctgcccgatccaaagcggttacagttgtggccgaaggcgctgccagtaggtcgtggctgagtatggatgctcctgagttggggcctggcctcgtagaacgcctggagcaactcgctacctgcccactctgtgggggatcttttgaggacccagtgcttcttgcctgcgaacatagtttctgccgagcttgcctagccagacggtggggaacacctccggctaccgggaccgaggcatcccctacagcctgtccatgttgcggactcccctgcccacgccggtccctgcgatccaacgtgaggctcgctgttgaagtccgcatatctagggagctcagggagaaattagccgagcccggtgctcgggccgggcggagaagagggggccgaatccctacgatgggctgtttagatctgcctggggaagatatgcgtaaaacctggcgcagattcgaggtgcctacttctaagtcttccaatagcgaagacgatcttcctgaggattacccggtggtgaagaaaatgcttcacagacttaccgcggacctcactcttgacccaggaaccgctcatcggcgcctactgatatcagctgatcgccggagcgtccagctcgctccccccggaacccccgcacctcctgatggtcctaagcgctttgatcagctgcctgcagtgctgggagctcaggggtttggggccggacggcactgctgggaggttgaaactgccgatgccgcctcttgtagagactcctcgggagaggacgcggatgatgaggaatctcattatgctgtgggcgcagccggtgaatcagtgcagcggaaaggttgcgcacccgggccacttggagaaaggattttcccactgttctgtacctgtgacccccgcgcgcctctgagaatcgtcccagcggagtcatag

SEQ ID NO: 203908 - DNA, 1065 bp, Artificial Sequence
  Description of Artificial Sequence: Synthetic coding sequence
atgtggtggcgggacctgacccggctgcggctgtggctgaagcgggaagcgatccccggggagggaaggaaagccgctaaagtaaacgccggagtgggcgagaaaggcatctacacagcaagttccaggggcggcccaccatctgcccgcagcaaagcagtgacagtcgtagcagagggggcagcttctagaagttggctgtctatggacgccccagagttgggaccagggttggtagaacgactcgagcagttagccacctgtcccctgtgcggaggctcatttgaagaccctgtgctcttggcctgcgagcactccttctgccgggcctgcctggcacggcgctgggggacccctccagctaccggcaccgaggcatcgcccaccgcctgtccatgctgcggattgccatgtccccgaagaagtttacgctccaacgtgcgactggccgtcgaagttcggatatcccgcgagctaagggagaaattggccgagcccggcgctagggccggacgaaggcgcggggggaggatcccaactatggggtgtttggacttgccaggtgaggacatgcgtaaaacatggcggaggtttgaagttccaacctcgaaatcttctaactctgaggacgatctgcccgaggactaccctgttgtcaaaaaaatgcttcataggttgactgctgatttgaccctcgatcccggcactgcccacaggaggctgctgattagtgccgaccgacggagcgtccaactcgcccctcccgggaccccggctcctccagatggtcctaagcgatttgaccaacttcccgcagtactcggcgcacaagggttcggcgctggccgacactgttgggaagttgaaacggccgacgccgcctcttgtcgcgattcctcgggcgaggatgccgatgacgaggaatcacattatgctgtgggcgcagcaggtgagagtgtacagcggaaggggtgcgcaccaggccccctgggagaaaggatctttccacttttttgtacttgtgatccccgcgctcctctgaggattgtgccggcggagtcctag

SEQ ID NO: 203909 - DNA, 1065 bp, Artificial Sequence
  Description of Artificial Sequence: Synthetic coding sequence
atgtggtggcgggacctgacccggctgcggctgtggctgaagcgggaagcgatcccaggcgaagggagaaaggctgctaaggtgaatgctggagtgggcgagaaggggatctataccgcttcctcccgggggggccctccatctgctcgctccaaggcagtgactgtggtcgctgaaggggcggcgtctcggagttggctgagtatggacgccccagaactggggccaggcctagtggagaggctggagcagctagctacatgccccctatgtggaggctccttcgaggaccccgtactactggcgtgtgagcactctttctgccgggcctgtctcgctagaagatggggaactcctcccgcaaccggaactgaagccagcccaacagcatgtccttgctgcggcctcccatgtccacgcagaagcctcagatcaaacgtgcgcctggctgttgaagttcggatctcaagggaactgcgggagaagttggccgagccaggtgccagagccgggagacgacgcggagggaggattccaacaatgggatgtctggacctgcccggggaggacatgcgaaagacttggaggagatttgaagtgccgactagcaagtcttccaattccgaggatgatttaccggaggattaccccgtcgttaagaaaatgctgcacaggttgactgccgacctgaccctcgacccagggacagctcatcgaagacttctgattagtgcagaccgaaggagtgtccagctcgcccccccaggtacaccagctcccccagacgggcctaagcgattcgaccaattaccagctgtgctgggcgctcaggggttcggtgccggccgacactgctgggaagtagagactgccgatgcggcgtcctgtcgcgactctagcggtgaggatgccgacgatgaggagagccattacgccgtaggcgccgccggtgagtcggtacagagaaagggctgtgcacctggtcccctgggcgaacggatcttcccattgttttgcacctgtgacccccgggcccctctccgcatagtaccagccgaatcttag

SEQ ID NO: 203910 - DNA, 1263 bp, Artificial Sequence
  Description of Artificial Sequence: Synthetic coding sequence
atgtggtggcgggacctgacccggctgcggctgtggctgaagcgggaagctataccaggcgaagggcgaaaggctgcgaaggttaatgccggcgtgggtgaaaagggtatctacacagccagctctcgcggcggccctccgagcgcacgttccaaagctgtgacagtcgtggccgagggcgctgcctcacgaagttggttgtctatggacgctccagagctgggcccaggactcgttgagcgcttggagcaactggctacctgccccctgtgcgggggttcctttgaggatcccgtgctgctcgcctgcgagcacagtttctgccgggcttgtctcgccagacggtggggtactcctccagccacaggcacagaagcctcccctaccgcttgtccctgttgtggtctgccatgcccaaggaggagcttacgcagcaacgtgcggctggcagtcgaggtcagaatttctagagagctccgggaaaagttagctgagcccggtgcccgcgccggcaggcgcagagggggaagaattccaaccatgggctgcctggatttacccggggaggatatgcggaagacttggcgccggtttgaagttccgacttccaaatcctccaatagtgaagacgacttgcctgaagactaccccgtggtcaaaaaaatgctccaccgcctgactgctgaccttactctggacccagggacagcccacagaaggcttttgatcagcgccgaccgcagaagcgtacagctcgctccgcccggtacacccgcaccacctgatgggcctaaaaggttcaaccaactccccgccgtccttggggcccaaggtttcggagccgggcggcactgctgggaagtagaaaccgcggatgctgcttcctgcagagattcttccggagaggacgcagacgatgaagagtcccactatgccgttggagccgcgggcgaatctgtccaaaggaaagggtgtgtgcgtctgtgcccagctggcgctgtgtgggccgttgaaggtcgagggggtaggctgtgggccctgactgccccggaacctaccctgctgggcggtgttgagccacctccccgacgcatccgtgtggacctagattgggagcggggccgggttgctttctatgacggccggagtctggacttgctgtacgcattccaggctcctggccccttgggcgagagaatcttccctttgttttgtacatgcgacccccgcgcacccttgcggatagtaccagcagagtcttag

SEQ ID NO: 203911 - DNA, 1263 bp, Artificial Sequence
  Description of Artificial Sequence: Synthetic coding sequence
atgtggtggcgggacctgacccggctgcggctgtggctgaagcgggaggcgatacctggagaaggccgcaaagcagcaaaagtgaatgctggcgtgggagagaagggcatctacacagcttcttcacgcggtggccccccaagcgccaggtccaaggcagtgacagttgttgctgagggcgctgccagccgaagttggctctccatggatgctcctgaactcggcccagggctggttgaaagactagaacagcttgccacctgtcctctgtgtggtggctccttcgaagaccccgtcctgttggcctgcgagcattcattttgtcgggcttgtcttgcacggcgctggggaacccctcccgccaccgggaccgaggcttcaccaacagcctgcccctgctgtggtctgccatgccccaggcggtctctcaggtcaaatgttaggctggccgtggaggtgcgtatcagccgggagctgagggaaaaattggctgagccaggagctcgagcaggaagacggagggggggtcgcattcccacgatggggtgcctcgatcttcccggtgaagatatgaggaagacttggcgccgatttgaggtcccgacctccaagtctagtaatagcgaggatgacctgcctgaggactatccagtggtgaaaaaaatgttacatcgcctaacagctgacttgacattagatcctggcacggcccataggaggctgctcatttccgccgaccgccgcagcgtgcagctggcccctcccgggactccggctccacctgacgggcctaaacgattcgatcagttgccagcggtcctgggggcacaggggttcggcgctggaaggcattgttgggaagtcgagacagctgatgcagcctcgtgcagagatagctctggcgaagatgctgacgatgaggaatcacactatgctgtaggtgccgccggagagtcagtacaacgtaaaggatgcgtgcggctttgcccggccggcgctgtgtgggctgtggaagggcgcggtggtcgattgtgggcattgactgcaccagagccaaccttactgggaggtgtggagccaccaccaagaaggattcgggtcgatctggactgggagagaggtcgggtggctttctacgacgggcggtcactggacttactgtacgcatttcaggcacccggaccactgggagagaggatcttcccactgttctgcacctgcgacccccgggcacccctgcggatcgttcctgcagaaagctag

SEQ ID NO: 203912 - DNA, 1065 bp, Artificial Sequence
  Description of Artificial Sequence: Synthetic coding sequence
atgtggtggcgggacctgacccggctgcggctgtggctgaagcgggaggcgattcctggagaaggccggaaagccgccaaagtgaatgctggggtaggtgagaagggcatttatacagcaagctctcggggaggtccacccagcgcccgctctaaggccgttacggttgttgccgaaggagcagcttctcgctcatggctctcaatggatgcgcctgagctcggccccggtctagttgagaggctggagcagctggccacctgccccctgtgcggtggttcgttcgaggacccggtactgctcgcctgcgagcactctttctgccgggcctgcttggccaggcgctgggggacgccccctgcaacaggtactgaagcaagtcccacggcttgcccctgttgtgggcttccctgcccacgaaggtctctgcggtctaacgttcgcctggccgtggaggtcagaatcagccgggaattgagagaaaaactggccgagccgggcgccagggccgggcggagacggggcgggaggataccaacaatgggctgcctcgacctacctggggaagacatgcggaagacctggcgccggtttgaggtgcccaccagtaaatcatctaattcagaagacgacttgcctgaagactatcctgtcgtcaagaagatgttacaccggcttacagccgacctgacgcttgatccggggaccgctcacagacggcttctgatctcggcggacagaaggtcagtgcaactagctccaccagggaccccggccccaccagatggtccaaagcgatttgatcagctgccggctgtactgggagcccagggctttggggctggtagacattgttgggaagtggaaaccgctgatgccgccagctgcagggacagtagcggggaagacgccgatgacgaagagtcacattatgccgttggcgcagcaggagagtcggtacagcggaagggatgtgcgccaggccccctgggggaacggatcttccctctattctgtacatgcgacccaagggcccctttgcgaatcgtacccgcagagtcatag

SEQ ID NO: 203913 - DNA, 1263 bp, Artificial Sequence
  Description of Artificial Sequence: Synthetic coding sequence
atgtggtggcgggacctgacccggctgcggctgtggctgaagcgggaggcgatccccggagagggacgtaaggcagccaaggtgaacgccggagtcggtgagaaaggcatctataccgcatcctcccggggtggccctcctagtgcacgcagtaaggcagttacagtggtggcagaaggtgccgcgtcccgctcttggctttcaatggatgcacccgagcttggccccggcctggtagagcgactggaacagctggccacgtgcccactgtgcggcggatccttcgaggatccagtcttactcgcgtgtgagcattctttctgtcgtgcctgcctcgctaggcgttggggcaccccaccagccacagggactgaggctagccctaccgcgtgcccatgctgcggcctgccctgccccaggaggtccttgcgatccaatgttaggttggccgtcgaagttcgaatcagtcgagagctgagagagaagctagctgaacccggcgctcgggcagggcgtaggagaggcggaagaattcctactatgggctgcttggacctcccaggcgaggatatgcggaaaacatggaggaggttcgaggtacctactagtaagagttcaaacagcgaggacgacctcccagaggactatcctgtagtcaagaaaatgctccaccggctgacggccgatctgactctggaccccggcacagcccaccgtcgtctcctcatcagtgcggatcggcgctctgtgcagctcgccccacctggcacccccgctcctcccgacggtcccaaaaggttcgaccagttgccggccgtactcggcgcccaggggttcggcgcgggcaggcactgctgggaggtggagaccgcggacgccgcaagctgccgcgactcttcgggggaagacgctgacgacgaggagtcacattacgccgtgggggccgccggagaaagcgtccagagaaagggctgcgtgaggctgtgtcctgctggagctgtctgggctgtagagggtcggggaggacgactctgggccctgaccgcgcctgaacccaccttgcttggtggcgtggaaccccctccccggaggattagagttgatctcgactgggaaagaggtcgggtggctttttatgatggtaggtctctggatttgctctatgcatttcaggcccccggtcctctgggagagcggatcttccctctcttttgtacttgcgatccaagggctccgctaaggatagtgccggctgaatcttag

SEQ ID NO: 203914 - DNA, 1065 bp, Artificial Sequence
  Description of Artificial Sequence: Synthetic coding sequence
atgtggtggcgggacctgacccggctgcggctgtggctgaagcgggaggctattccaggggagggccgtaaagctgccaaagtgaacgctggagtgggagagaagggcatctacactgccagctccagaggagggcctccctccgcgagatcaaaggcggtgacagtggtagctgagggggcggccagtcgcagctggctgtctatggatgccccagagttaggccccggcttggtcgagaggctcgagcagctggcaacttgccccttgtgtgggggatcctttgaggaccctgttctattagcatgcgagcacagtttctgtcgggcctgtctagctcgccggtggggaactcccccagctacgggaacggaggccagtcccactgcatgcccatgctgtggcctcccttgcccgaggcgttctctgagatcaaacgtacgactggcagtagaagtgaggatcagtagagaattgagagagaaactagccgagcccggcgcaagagccggacggcgcaggggcggacgtatccccacaatgggttgtctggacttgccaggcgaggacatgcgtaaaacatggcgcagattcgaggttcctacttccaaatccagcaactccgaggacgacttgccagaagactaccctgtggtgaaaaagatgttacacaggcttaccgctgacctgacactggaccccggcacagctcaccggcgcctccttatatctgctgatcgtaggtccgttcaacttgcaccaccgggaaccccagccccacctgacggtcctaaaaggttcgaccagttgccagccgttctgggtgctcagggttttggtgctggccgccattgttgggaggtggagactgcagacgcggctagctgccgggattcttccggtgaggatgctgatgacgaggagagccattatgcggtgggagctgccggagagtccgtccaacggaagggctgcgccccaggtccactaggtgagagaatatttcctctgttttgtacttgtgatccgcgcgccccgctgcggatcgtccctgctgaatcctag

SEQ ID NO: 203915 - DNA, 756 bp, Artificial Sequence
  Description of Artificial Sequence: Synthetic coding sequence
atgtggtggcgggacctgacccggctgcggctgtggctgaagcgggaggcaatacccggagaggggaggaaggccgcaaaagtgaatgctggcgtgggcgaaaaaggaatttataccgccagctcccggggcggacccccatccgcccggtccaaagccgtcactgttgtggcagagggggctgcgagcagatcctggctctccatggacgcccccgaactgggtcccgggcttgtggagcgtctggagcaactggcaacatgccctctgtgtggaggaagcttcgaagatcccgttcttttagcttgcgagcactcattttgtagagcttgtctcgctagacgatggggcacacctcctgcgaccggaaccgaggcctctcctacggcctgtccctgttgcggactcccctgtccacgccggagcctgcgatcgaacgtcagactggctgttgaagtcagaatatcgagagagctcctcttcggaggagggattccacatagctttctaggcacccactcacatgctcattgcagaagcatcaattccaacccccatttccgcccgaagatcatgagaccccacctggtgagcactttccccaggccatgttccaagcccaacccgttcttgccaagtggctctcagaatcttctgtcccccacggctaccactgtcctgcccgatttttctcacagtaaccactctaggcccgcaatgggaaaccgaccctcaccatcagtccttgttaaatag

SEQ ID NO: 203916 - DNA, 756 bp, Artificial Sequence
  Description of Artificial Sequence: Synthetic coding sequence
atgtggtggcgggacctgacccggctgcggctgtggctgaagcgggaggccattcccggggaggggcgaaaggcggcaaaggtgaacgccggggtcggtgagaagggaatttatacagccagttcaaggggcgggcctccctccgccaggtccaaagctgtcacagtggtagctgaaggcgctgcaagccgctcctggcttagcatggacgctccggagttagggcctggtctggttgagcgactggagcagctagccacctgtcctctttgtggcggcagcttcgaggatcccgtgctcttagcctgcgagcattctttttgtcgagcttgtctcgcccgtagatggggcactcccccagcaaccgggaccgaggcatcgcctaccgcgtgtccctgctgcgggttaccatgcccacgaaggtccctgcggtcaaatgttcgcttggcggtggaagtcagaatttctcgcgaacttttatttggcggcggaattccccacagcttcctcggaacccactcccatgctcattgccgatctatcaattcaaatccccacttccggcctaagatcatgcgaccacacctggtgtctacctttcctaggccatgttctaagccaaaccccttcctgccctcaggtagccagaatctgctgagtccgacggctacaaccgttcttcccgactttagccactcgaaccactcacggcccgctatgggtaacagaccatccccaagtgtgctggtgaaatag

SEQ ID NO: 203917 - DNA, 756 bp, Artificial Sequence
  Description of Artificial Sequence: Synthetic coding sequence
atgtggtggcgggacctgacccggctgcggctgtggctgaagcgggaggccatccccggggagggtcggaaagcagccaaggttaacgcgggggtcggtgaaaaaggtatttacactgctagtagtaggggtggtccaccgtctgcacggtccaaagccgtgacggtggtcgccgaaggggcggcctccagatcatggctgtccatggatgctccagagcttgggcccgggctggttgaaagactggagcagcttgccacttgtcccctgtgtggcggatctttcgaggaccccgttctgctcgcctgcgagcacagcttctgccgcgcctgtctggcccggaggtggggtacccctcccgctacaggaacagaagcctcacccactgcctgcccatgttgtggtctgccctgtccacgcaggtcgttgcgctcgaatgtgaggctggccgtcgaagtgcgtatcagccgcgaactgctctttggcgggggaatacctcactcgttcctggggacacacagccacgcccactgccgctccatcaatagcaatcctcattttagacccaaaattatgcgtccgcacctggtcagcaccttccctaggccctgttctaaacctaatcctttcctgccaagcggcagtcagaaccttctttcgccaaccgcaacgactgtgctgcctgactttagccactccaatcacagtcggccagcaatggggaaccgccccagcccctcagtgctcgtgaaatag

SEQ ID NO: 203918 - DNA, 756 bp, Artificial Sequence
  Description of Artificial Sequence: Synthetic coding sequence
atgtggtggcgggacctgacccggctgcggctgtggctgaagcgggaggctattcctggggaagggagaaaagccgccaaggttaacgccggcgtgggcgagaaagggatctataccgccagcagccgaggaggtccaccaagtgctaggtctaaggcggtcactgtggtggctgagggggcagcgtccagaagttggttgagcatggacgcacccgagttggggccaggcctggttgagagactcgagcagctagcgacgtgtccgctgtgcggaggaagcttcgaggaccccgtgctgctggcctgtgagcatagcttctgtcgcgcctgccttgcccgtaggtgggggactcccccagcgactgggactgaagccagtccaaccgcgtgcccctgttgcggcctgccctgcccccggaggtctctacggagcaatgtgagactagctgtcgaagttcgcatctcccgcgaactgctgttcggaggcggcatacctcattcgttcttggggactcacagtcatgctcattgtaggtcaataaattccaacccccactttaggccaaaaatcatgcggccccacttggtgtccacgtttcctcgtccgtgtagcaaaccaaaccctttcctacccagcggttctcagaatctgctgtcgccgaccgctacaactgtgctcccggacttttctcactctaatcactcccggcctgcgatgggcaatcggccctcacccagcgtcttggtaaagtag

SEQ ID NO: 203919 - DNA, 756 bp, Artificial Sequence
  Description of Artificial Sequence: Synthetic coding sequence
atgtggtggcgggacctgacccggctgcggctgtggctgaagcgggaggcgataccaggagaaggacgaaaggctgctaaagtgaacgcaggggtcggggaaaaggggatctatacggcctcaagtcgcggcggtcctccaagtgcgcgctccaaggccgttacagtggtagctgagggagctgcttctcgatcctggctttctatggatgccccagaactgggtcccggattagtagaaagactggaacaattggcgacttgtccactctgtgggggctccttcgaagatcctgtgctgctggcatgcgagcacagtttttgtcgagcctgcctggcccggaggtggggaacgccgcctgctacaggaacggaggcctcacctaccgcctgcccttgctgcggattaccctgtcctcgacgatcgctgcggtccaatgtacgcctggcagtggaggtccggataagccgggaactcctttttggtgggggcatcccacattccttcctcggcacccactcccacgcacattgcaggtcaattaattccaacccacactttcggcctaagatcatgcggccacaccttgtgtccacatttccacgtccatgttctaaaccgaatccatttctgccctccggctctcaaaatcttctgtctcccactgcgactacagtgctccccgacttttctcacagcaaccattcccggcccgccatgggtaataggcccagtccgtccgtactcgtgaagtag

SEQ ID NO: 203920 - DNA, 756 bp, Artificial Sequence
  Description of Artificial Sequence: Synthetic coding sequence
atgtggtggcgggacctgacccggctgcggctgtggctgaagcgggaggccatacccggggaaggcaggaaagccgcaaaagtgaatgctggcgtgggagaaaaaggaatctacaccgcctcctctcggggcggaccgccctccgctcgaagtaaggctgtcacagtggttgctgaaggcgctgcgtcacgctcatggctttccatggacgcaccagaactgggccccggtttggtggagcgcttggaacaactggccacctgtcctctctgcggagggagcttcgaagatcctgttctgctagcctgcgagcacagtttctgccgcgcctgcctagcccgcaggtggggcactcccccggccaccggaactgaagcttctcccaccgcttgtccttgttgcggactgccctgcccacgtaggtcactgaggtccaatgtgcggctcgcagtggaggttaggatcagcagagaactactgtttgggggagggatcccacatagtttcttaggcacacatagccacgctcattgtagaagcattaattccaatccacattttagacccaaaataatgcggcctcacctcgtgtccacgtttcctaggccgtgctcaaaacccaatcctttccttccctccggctctcagaacctgctgagccctactgcagccacagtcctacccgatttttctcatagtaatcactcacggcccgcaatgggcaatcgacccagcccctcagtactcgtgaaatag

SEQ ID NO: 203921 - DNA, 756 bp, Artificial Sequence
  Description of Artificial Sequence: Synthetic coding sequence
atgtggtggcgggacctgacccggctgcggctgtggctgaagcgggaggccatcccaggggaggggcgcaaagcagctaaggtaaatgctggcgtgggcgagaagggaatttatactgcatccagccgcggtggtcctcccagcgccaggtctaaggccgtcacggtggtggcggagggcgcagcaagccgcagctggctgagcatggatgcgccggagctgggccccggcctggtcgagcgcctggagcagctggcaacatgcccactgtgtgggggatcgttcgaagatcccgtcctgctcgcctgtgaacacagcttttgccgggcctgtctcgcccgccgttggggtacaccccccgcaacgggcactgaggcaagccccaccgcatgcccttgttgcggtctaccgtgtcccaggcgatccctgcgatccaacgtcaggttggccgtggaggtgcgaatttcgcgcgaacttttatttggtcggggcatacctcactcgttcctgggcacacactcacatgcacattgccgctccatcaacagtaacccccactttcgcccaaaaattatgaggccacatctggtttcaacgttccctcatccctgttcaaaaccaaatccctttctgccctccggcagccagaacctcctgagtcccaccgccaccactgtacttcctgatttctcacacagcaaccatagccgccccgctatgggcaaccgcccaagcccttcagtgttggtaaagtag

SEQ ID NO: 203922 - DNA, 573 bp, Artificial Sequence
  Description of Artificial Sequence: Synthetic coding sequence
atgagcacccggaagcggcggggcggcgccatcaacagccggcaggcccagaagcgcacccgtgaggccaccagcacaccggaaattagcttggaagcagagcccattgagctggtcgagaccgccggagatgaaatcgttgatctgacctgcgaatccctagaaccagtggtggttgatctcacacataacgacagcgtggtaatagtggatgaacgccgccggccccgaagaaatgcgcgcagactgccccaagatcacgccgattcgtgcgtggtgtcatctgatgacgaagaactgagtagggatcgcgacgtgtacgtgacaacccatacaccaagaaacgcgcgcgatgagggggccacgggtttgcgccctagcggcactgtgagctgccctatttgcatggatggctattcagaaatagtccagaatgggcggctgattgtgtctactgagtgcgggcatgtattttgctctcagtgtttgcgcgacagcctgaagaacgctaacacctgcccgacatgtaggaagaaaatcaaccataagcggtaccatcctatttacatttag

SEQ ID NO: 203923 - DNA, 18 bp, Artificial Sequence
  Description of Artificial Sequence: Synthetic coding sequence
atgagcacccggaagtag

SEQ ID NO: 203924 - DNA, 573 bp, Artificial Sequence
  Description of Artificial Sequence: Synthetic coding sequence
atgagcacccggaagcggcggggcggcgccatcaacagccggcaggctcagaagagaactcgggaggccacctcaacgccggaaatcagtctggaggccgaacctatcgagctggtggaaacagcgggcgatgagatcgtggatctaacatgtgagtcattagagcccgtggttgttgacctgacacataacgactctgtagttatcgtggacgagcggcgccgccctcgtcggaacgcccgtcgactgccacaagaccatgcggacagctgcgtagtgtcatcagacgacgaggagctgtctagggaccgagatgtatacgtgaccacacacacaccccggaatgccagagatgaaggggctacaggcctgaggccttctggtaccgtcagctgccctatttgcatggacggctactctgaaatcgtgcagaacggtagactgattgtgagcaccgagtgcggacatgtgttctgtagccagtgtttaagggactcactcaaaaacgcaaatacatgtcccacatgtagaaagaagattaaccacaagcgataccacccaatctatatctag

SEQ ID NO: 203925 - DNA, 573 bp, Artificial Sequence
  Description of Artificial Sequence: Synthetic coding sequence
atgagcacccggaagcggcggggcggcgccatcaacagccggcaggctcaaaagcgtacacgtgaggccacctctacacctgaaatttccctggaagccgagcccatcgagttggtggaaaccgctggagacgagatagttgatctaacatgtgaaagtttggagccagtagtagtcgacctgacccacaacgactccgtggtgattgtcgacgaaagacgcagaccaagaaggaatgcacgcaggttgcctcaggatcacgctgacagttgtgtcgtctctagtgacgacgaggaactgagccgggacagagatgtctacgtgacaacccatacgccccgaaacgcacgggatgagggtgctacgggcttgcgcccgtctggaacagttagttgcccgatctgcatggacggatactctgaaattgttcaaaacggcaggttgatcgtgtccaccgaatgcggccacgtgttctgctcccagtgtctgcgagattcactgaaaaatgccaatacctgtccaacttgcaggaaaaagattaaccataaacgctatcacccaatctacatctag

SEQ ID NO: 203926 - DNA, 165 bp, Artificial Sequence
  Description of Artificial Sequence: Synthetic coding sequence
atgagcacccggaagcggcggggcggcgccatcaacagccggcaggcacagaaacggactcgtgaagcaacctcaacaccagaaattagcctggaggctgagccaatcgagctggtcgagactgctggagatgaaatagtggacctcacatgcgaatccctctag

SEQ ID NO: 203927 - DNA, 345 bp, Artificial Sequence
  Description of Artificial Sequence: Synthetic coding sequence
atgagcacccggaagcggcggggcggcgccatcaacagccggcaggcccagaaacgcacaagggaagctacatctacccctgaaatctccctggaggcagagcccattgaactagtggagaccgcaggggacgagatcgttgacctcacctgcgaaagcctggagcctgttgtggtggaccttactcacaatgactccgtcgttgtgagcgtcggggttccccaagtgctgtctgtggtgccctccgcctggactgatacccagcgctcctgtagaatggacgtctcatcattcccacaaaacgcggccatgagtagcgtcgccagtgcaagtgtgattccatag

SEQ ID NO: 203928 - DNA, 573 bp, Artificial Sequence
  Description of Artificial Sequence: Synthetic coding sequence
atgagcacccggaagcggcggggcggcgccatcaacagccggcaggcccagaagaggaccagagaggcgacttcaacgcctgaaatttctttggaagccgagccaattgagctcgtcgaaacagcaggagatgaaatagtggacctgacatgcgagagtctggaaccggttgtggtggacctgacacataacgattctgtggtggttagtgacgagaggagacggccccggaggaacgcgcgccgtctcccacaggatcatgccgatagttgcgtggtctcttcagacgatgaagaattgagcagggatagagacgtgtatgtgaccacacacactccaaggaacgcgagagacgaaggcgcgacaggcttgcgtccatctggaactgtgagctgcccaatttgtatggatggttattctgaaatcgtccagaatggaaggttaatcgtgtctacagagtgcggacatgtgttctgctctcagtgtctgcgggatagcttaaagaacgctaacacatgccccacatgccgtaagaaaattaatcacaaacgataccatcctatctatatctag

SEQ ID NO: 203929 - DNA, 342 bp, Artificial Sequence
  Description of Artificial Sequence: Synthetic coding sequence
atgagcacccggaagcggcggggcggcgccatcaacagccggcaggcacagaagcggactagagaagctaccagcaccccggagatcagcttggaggcagaaccaatagagctggtggaaacagcgggcgatgagattgtggatttgacatgtgagtctctggagcctgtagtagtggacctaactcataatgacagcgttgtgattgtcgatggtcctcaggttctgtccgtggtcccctccgcgtggaccgatactcaacggagctgcaggatggatgtgagcagtttcccccagaacgctgcaatgagttcagttgcctccgctagtgtaattccgtag

SEQ ID NO: 203930 - DNA, 2352 bp, Artificial Sequence
  Description of Artificial Sequence: Synthetic coding sequence
atgagcggcggccaccagctgcagctggccgccctgtggccctggctgctgatggcgaccctgcaagccgggttcggccgcactgggttggtattggctgctgctgtggagtccgagaggtctgctgaacagaaggctatcatcagggtgattcctctaaaaatggatccaactggcaagcttaatcttaccctcgaaggagtctttgctggggttgctgagataactccagcggagggcaaactgatgcagtcacacccactctacttatgcaatgcttccgacgacgacaatctcgaacccggcttcattagcatcgtgaagttggaaagtccccggagagctccgcgcccttgcctgtcactcgccagtaaggctcgcatggctggggagcgaggagcctccgcggtgttgtttgacatcaccgaggaccgggcggcggctgaacaactgcagcaacccctggggctgacttggccggtggttttaatttgggggaatgatgccgaaaaactcatggaattcgtctacaagaatcagaaagcccatgtgagaatcgaacttaaggaaccacctgcatggcccgactacgacgtgtggatcctgatgaccgtcgtgggaactatctttgtgataattctggcctccgtgttaagaatacgctgcaggcctcgtcactccaggccagacccactccaacagaggacagcatgggctatttcccaactagcaacacgaagataccaggctagctgcagacaagctagaggagaatggcccgactcagggagttcttgttcctctgccccggtgtgtgcaatatgcctcgaagagttttcagaaggacaggaactgcgggtgatctcttgccttcacgagtttcaccgcaactgcgtagacccgtggctacatcagcacaggacctgtcctctgtgcatgtttaacattacggagggcgactcattcagccagagtctgggtccttctcgatcttaccaggagcccggaagaagattgcacctgattcgacagcaccctggccacgcccactatcatttgcccgcagcctaccttttgggtccctcacggtccgctgttgcccgccctcctagacctgggccgtttctcccttctcaggagcccggcatgggccccaggcaccatcggtttccccgggctgctcatccacgagcaccaggcgaacagcagaggctagcaggggcccaacatccctatgcccagggatggggccttagccatctgcagagtacctcacagcatccggcagcatgtcccgttcctcttcgaagggcaaggcctcctgatagctcaggttcaggggaatcctattgtacagagcgctccgggtacctggcagacggccccgcgtcagatagctcctccggaccatgccacggctccagctctgacagcgtggtgaactgtacagatatttctctgcaaggcgtgcatggttcttcaagtacattctgcagttctttgtcatctgactttgaccctttagtgtattgcagccctaaaggcgatccgcagagagtagatatgcagcctagcgttactagtagacctaggtcccttgacagcgtggtccctactggggaaactcaggtgagttcccacgtacactaccaccgccaccggcaccaccactacaaaaaaagattccagtggcacggacgcaagcctggccctgagacaggcgttccgcagagtaggccaccaatcccgcggacacaaccacagcctgaaccccctagcccagaccagcaggttacgcggtctaactctgccgcgcccagcggtcgcctctccaatccccagtgtccgcgcgccttacctgaacctgcaccggggccagtcgatgctagcagtatatgtccctccacctccagcctcttcaatctgcaaaagtccagtctgtctgccaggcacccccagaggaagcggaggggagggccttcagaacccaccccaggctcaagacctcaggacgctacagtccacccagcctgccagattttcccacattacacaccatccgtagcctatccctggtctcctgaggcccaccctctgatttgcgggcctcccggattggataagcggctgctgccggaaactcctggtccatgttatagcaatagccagcctgtgtggctttgtctgacacccagacagcccctggagccccatccgccgggtgaaggcccctcggaatggagttcggacaccgcagagggtcggccctgcccttatcctcactgccaggtcttaagcgcccaaccaggatctgaagaggagctcgaggaactctgcgaacaagccgtgtag

SEQ ID NO: 203931 - DNA, 2229 bp, Artificial Sequence
  Description of Artificial Sequence: Synthetic coding sequence
atgagcggcggccaccagctgcagctggccgccctgtggccctggctgctgatggcgaccctgcaggccggattcggacgtaccggtttagtgttggcagcggccgtggagagtgagagaagcgccgagcaaaaggcaatcatcagggtcattcccttgaaaatggatcctaccggtaagctgaacctgactctggaaggtgtttttgctggggtcgcagagatcacgcccgctgaaggaaaactaatgcaggcacggatggccggcgaacgaggcgctagcgctgttctgtttgatatcactgaggatcgagccgcagctgagcagttgcagcaacctctgggcctgacatggcccgttgtcctaatctggggcaatgacgctgagaagctgatggagttcgtttacaaaaaccagaaggcccatgtgaggattgagctgaaagagccccccgcgtggcccgactacgacgtatggatcttaatgaccgtcgttggaacaatctttgtgatcatcttggcctctgtcctcagaattcgctgtagaccgcggcacagccggccggaccccctccaacagagaacagcgtgggccattagtcagctcgcgacaaggagatatcaagctagttgccggcaagccaggggcgaatggcctgattctggcagcagttgctcctccgctcctgtttgtgcgatctgccttgaggagttcagtgaggggcaagaactccgggtgattagttgcttgcacgagtttcatcgcaattgtgtagacccctggctgcatcaacaccggacatgccctttatgtatgtttaacattaccgaaggggacagcttcagccagtctctggggcccagtcggagttaccaagagccaggaaggcggctccatttgatccggcagcaccctggccacgctcattatcatcttccggccgcttatctgctgggtcccagtcgctccgccgtcgccagacctccacgacctgggccttttctgccttcccaggaacccgggatggggccccgtcaccacagattccctagagccgctcatccacgagccccaggagagcagcaacggcttgcaggggcacagcacccctacgctcaggggtggggtttgtcacacctgcagagcaccagccaacacccggccgcttgtccagtgcctctgcgacgcgctcggcctcccgacagctcgggctccggcgaatcatactgtaccgagcgatccgggtacctcgctgacggaccggcttcggatagtagctccggcccttgtcacggatcaagcagtgattccgtagttaactgcaccgacattagcctccaaggggtccatggtagcagctcaactttctgcagttcactttcctccgatttcgaccccctagtgtactgctcgccaaagggggacccccaaagggtagacatgcagccatctgttacatccaggccgcgctctcttgactccgtggtcccaaccggcgagactcaggtaagcagccacgtccactatcatcgacacagacatcaccattacaaaaaacgatttcagtggcatgggcgaaagccagggcccgaaaccggtgtccctcaaagccgtccgcccattcctcgcacacagccccaaccggagcccccatctcccgaccagcaagtgacccgttcaaacagtgctgctccatcaggaagactgtcaaacccccaatgtccgcgggccctgcccgagccagctcccgggcctgtggacgctagtagcatatgcccctccacatcttccctattcaacctgcagaaaagcagcttatcggctagacaccctcagcggaagcgccgcggtggtccgtccgaaccaacacctggctcccgcccacaagacgcaacggtccatcccgcctgccagattttcccacactataccccttctgttgcatacccctggagccccgaggcccaccctctgatctgtggtcctcccggactcgacaagcggctcctgcctgagacacccggcccatgctattcaaatagccagccggtctggctctgcctgacccccagacagcctcttgaaccacaccctcctggggaaggcccgtctgagtggtccagcgatacagctgagggccgaccctgtccgtacccgcattgccaagtgttgtccgcacaaccaggtagcgaggaagaactggaggagttgtgtgagcaagctgtttag

SEQ ID NO: 203932 - DNA, 543 bp, Artificial Sequence
  Description of Artificial Sequence: Synthetic coding sequence
atggccgccgccgaggaggaggacggcggccccgagggccccaaccgggaaagagggggggccggcgcaacttttgaatgtaacatctgtctggagactgctcgagaagccgtagtttccgtctgcggtcatctgtactgttggccttgcttgcaccagtggctggagactaggcctgaacgtcaagaatgtcctgtctgcaaagctgggatatcgcgagaaaaggtggtaccactttatgggagaggctctcagaagccacaggatccccgtctgaaaacaccccccaggccacaaggacagaggcctgcccctgagtctaggggtggctttcagccattcggagatactggcggctttcacttctcttttggtgtgggagccttcccgtttggattctttacgaccgtgtttaatgctcatgagccattcagacggggaaccggcgtcgatctggggcaagggcatcctgcttcaagctggcaggacagcctgttcctcttcctcgccatttttttctttttttggctcctgtctatttag

SEQ ID NO: 203933 - DNA, 543 bp, Artificial Sequence
  Description of Artificial Sequence: Synthetic coding sequence
atggccgccgccgaggaggaggacggcggccccgagggccccaaccgcgagcggggaggagccggcgctacatttgagtgcaacatctgtttagaaacggccagagaggccgtggtctctgtctgtggccatctgtactgctggccatgcctccatcagtggctggagacccggcccgaacgccaagaatgcccagtgtgcaaggctggaatctcacgggagaaagttgtacctctgtatgggcgagggtcccagaaaccccaggacccccgtcttaagacccctccgagacctcagggccaacggcccgctcctgagagccgcgggggatttcaacccttcggtgacacagggggatttcacttttccttcggagttggtgccttcccatttggattttttactacagtgtttaacgcccacgaaccatttcgtcgcggtacgggagtggatctcggtcagggtcatccagccagttcgtggcaggattctttgttcctctttttagcgattttcttctttttctggctgttatccatttag

SEQ ID NO: 203934 - DNA, 549 bp, Artificial Sequence
  Description of Artificial Sequence: Synthetic coding sequence
atggccgccgccgaggaggaggacggcggccccgagggccccaacagagaacgcgggggagcgggcgccacatttgagtgtaacatctgcctcgagactgctcgtgaggccgtcgtgagcgtgtgcggacacctctactgttggccctgcctgcaccagtggctcgaaaccaggcctgaacgacaggagtgtcctgtgtgtaaggcaggcatctctagagaaaaggtggtcccgttgtatggaagaggtagccagaaaccacaggatcctcgtttgaaaactcccccgagaccacaaggccagaggcctgctccagaatctcgcggtgggttccagccctttggcgacacggggggattccatttctcatttggcgtgggagcattccccttcggtttttttacaactgtgttcaacgcccatgaaccattcagaagaggcactggtccttttagcacctctcccgccttttttcattatcttattggaaacacatccagggaattcaggggacggatctacaatttttggctgccaaggaatctgtag

SEQ ID NO: 203935 - DNA, 543 bp, Artificial Sequence
  Description of Artificial Sequence: Synthetic coding sequence
atggccgccgccgaggaggaggacggcggccccgagggccccaaccgcgagcgcgggggggcaggggccactttcgagtgcaatatctgtctagagaccgcacgcgaggctgttgtgtcggtgtgcgggcacctgtattgttggccttgcctgcatcaatggctggaaacccgccccgagcgtcaagagtgccccgtttgcaaggctggaattagcagagaaaaggttgtacccttgtacgggcgggggtcccagaagccacaggacccaaggctcaagactccgcctaggcctcaaggacagcgtcccgctccggaaagtagaggaggcttccaacctttcggagataccggcggcttccacttctctttcggtgtgggggcctttccttttggtttttttaccaccgttttcaatgcgcatgaacctttcaggagagggaccggagtggacttaggccagggtcaccccgcatccagctggcaagatagtctctttcttttcttggccatctttttctttttttggctcctgagtatatag

SEQ ID NO: 203936 - DNA, 543 bp, Artificial Sequence
  Description of Artificial Sequence: Synthetic coding sequence
atggccgccgccgaggaggaggacggcggccccgagggccccaaccgcgagagaggcggggctggcgccactttcgagtgtaatatatgtttagaaacagctcgcgaggcggtagtgtcagtgtgcgggcatctgtactgttggccttgtctacaccagtggctcgaaacccggcccgagcgtcaggagtgccctgtgtgtaaggccggcatctccagggaaaaagttgttccgctgtatggacgtggaagccagaagccgcaggatccccggctgaaaactccccctcgccctcaggggcagcgacccgccccggagagccggggagggttccagcctttcggggatacaggggggttccatttcagctttggggtcggagcattcccatttggattctttacaactgtgtttaatgcccatgaaccctttaggagaggcaccggcgtagatttaggccagggacacccagcttcaagctggcaggactcactcttcctgtttttggctattttttttttcttctggttactgagcatatag

SEQ ID NO: 203937 - DNA, 543 bp, Artificial Sequence
  Description of Artificial Sequence: Synthetic coding sequence
atggccgccgccgaggaggaggacggcggccccgagggccccaaccgagagaggggaggagctggggccacattcgagtgtaacatctgcctcgaaaccgccagagaggcagtcgtcagtgtctgcgggcatctgtactgttggccttgcttgcatcaatggctggaaacgaggccggagagacaagagtgtccagtttgtaaggctgggatctcacgcgagaaggtggtcccgctgtacgggaggggcagccaaaaaccacaggacccaaggttgaaaacgcccccccgccctcaaggccaaagaccagccccggaaagccgcggtggtttccagcccttcggggataccgggggattccacttttcgtttggggttggtgcattcccgtttggcttcttcactactgtttttaacgctcatgagccctttaggcggggtaccggcgttgatttagggcaaggacatcctgccagctcgtggcaggactctctattcctgtttctggccattttctttttcttctggctgctctccatctag

SEQ ID NO: 203938 - DNA, 543 bp, Artificial Sequence
  Description of Artificial Sequence: Synthetic coding sequence
atggccgccgccgaggaggaggacggcggccccgagggccccaaccgggaacgcgggggcgctggggccactttcgaatgtaacatatgcctggagaccgctcgggaggccgtggtgtcagtatgtggccacctgtattgctggccatgcctccaccagtggctggaaactcggcccgaaagacaggagtgccctgtgtgcaaggcgggaatcagccgagagaaggtggttcctttgtacggacgcggtagccagaaaccccaggacccaaggctgaaaactccaccccgcccacagggccagaggccagctcctgaatcccggggagggttccagccatttggcgataccggtggctttcatttttcattcggagtcggcgccttccctttcggcttttttacaaccgtgttcaatgcccacgagcctttccgtagaggaactggagttgatctgggccagggtcatccggccagttcttggcaggactcactcttcttgttcttggctatcttttttttcttctggctgctgagcatatag

SEQ ID NO: 203939 - DNA, 543 bp, Artificial Sequence
  Description of Artificial Sequence: Synthetic coding sequence
atggccgccgccgaggaggaggacggcggccccgagggccccaacagagaacgtggcggagccggtgctacctttgaatgcaacatctgcctcgagaccgcccgagaagcagtggtcagcgtttgtggccacctatattgctggccatgccttcaccaatggctggagacccgccctgaacgccaggagtgtccggtgtgcaaggccggaatctctcgtgaaaaggttgtgcccctctatggtcgaggtagtcagaaaccacaagatccacgtttgaagaccccccctcgaccacaggggcagcggccggcgcctgagagccgtggcgggttccaaccatttggcgacacggggggctttcatttttccttcggcgtaggcgccttccccttcgggttctttactacagtgtttaacgcacacgaacctttccgccggggtacaggggtggatcttgggcagggtcacccggcaagtagctggcaagatagcctcttcctgttcctcgctatattcttctttttttggctcctgagcatctag

SEQ ID NO: 203940 - DNA, 549 bp, Artificial Sequence
  Description of Artificial Sequence: Synthetic coding sequence
atggccgccgccgaggaggaggacggcggccccgagggccccaaccgggagcgggggggcgcgggagctacttttgagtgtaacatttgtttagagactgcaagggaggccgtcgtgtcggtttgtggccacctttattgctggccatgtctgcatcagtggcttgagacacgacccgaacggcaagagtgtcccgtgtgtaaagccggtatttcccgggaaaaagtcgtgcctctctatggacggggctctcagaaaccccaagatccccgccttaagacccctcccaggccacagggacagcgtcccgcccccgagtctagagggggctttcagcctttcggagacacaggaggttttcatttctcatttggcgtgggggccttcccattcggattttttacaactgtctttaatgcccatgagcctttccgtcggggaacgggccccttctccacatctccagcatttttccactacctcataggaaacacttcacgcgagttccgcgggcgaatatataacttttggctgccgagaaacctgtag

SEQ ID NO: 203941 - DNA, 549 bp, Artificial Sequence
  Description of Artificial Sequence: Synthetic coding sequence
atggccgccgccgaggaggaggacggcggccccgagggccccaaccgggagcgtggcggcgccggcgccacatttgaatgtaatatttgtctggagaccgccagagaggccgtggtctccgtatgcgggcacctgtactgttggccctgtctccaccagtggctcgagacccggccggagcgccaagagtgccctgtgtgcaaggcaggaattagccgggagaaagtcgtccctttatacggccggggaagccagaagccccaggatccaagactcaaaaccccccccagaccacaggggcagcggccggcaccagagagtcgcggagggtttcagcccttcggcgataccgggggctttcacttcagcttcggggtcggagcttttccattcggcttctttactactgtcttcaacgcgcatgaaccttttcggcgcggaactggccccttcagcactagtccagcttttttccattacttgattggcaatacatcacgcgagttccgcgggcgtatctataacttttggctgccacgtaatctctag

SEQ ID NO: 203942 - DNA, 549 bp, Artificial Sequence
  Description of Artificial Sequence: Synthetic coding sequence
atggccgccgccgaggaggaggacggcggccccgagggccccaaccgcgagcgggggggtgccggagccacattcgagtgtaacatttgcctcgagacagcgcgcgaggctgtcgtgtcagtttgtgggcacctgtattgctggccctgtttgcaccagtggctggaaactcgccccgagagacaggagtgcccagtgtgtaaagctgggatttctagagagaaagttgtgcccttatacggcagaggatcacagaaaccacaagaccctcgacttaagacacctcctcgacctcaaggccagcgccccgcccctgagtcaagaggaggcttccagccatttggagacacaggcggattccacttttcatttggtgtcggcgcgttccctttcggcttttttacaaccgtgtttaacgcacacgagcccttcagacgcggtactgggcctttcagtacatccccggcctttttccattacctaatcggcaacacaagtcgggagtttaggggtcgcatctataacttttggttgccacgcaatttgtag

SEQ ID NO: 203943 - DNA, 549 bp, Artificial Sequence
  Description of Artificial Sequence: Synthetic coding sequence
atggccgccgccgaggaggaggacggcggccccgagggccccaacagggaaaggggtggcgcgggcgccacttttgaatgtaatatatgcctggagactgctcgcgaagccgtagtctcagtgtgcggacatctttactgctggccttgcttgcaccagtggctcgagacgcggccggaaagacaggaatgccccgtctgcaaggccgggatttcaagggaaaaggtcgtcccgttgtatggtcgagggtcacagaaaccccaggatccccggctgaaaacccctcctcgtccccagggacaaagacctgcaccagagtcaagaggaggattccagccatttggcgatactgggggatttcacttctcatttggcgtgggggcttttccctttggcttttttaccacagtgttcaacgcgcacgagcctttccgacggggcactggcccattcagcactagtcccgcgttttttcactacctcatcggcaatacttctcgggagttcaggggccgtatctacaacttttggctgcctcgcaacctatag

SEQ ID NO: 203944 - DNA, 549 bp, Artificial Sequence
  Description of Artificial Sequence: Synthetic coding sequence
atggccgccgccgaggaggaggacggcggccccgagggccccaacagggagcggggcggagccggagctacatttgaatgcaacatctgccttgagaccgccagggaagctgtggtgtctgtgtgcgggcacttgtactgctggccctgcttgcaccagtggttggagactcgccccgaaaggcaggagtgcccagtctgcaaggccggtatttccagggagaaggtggtgccactgtacggacggggaagccagaagccccaagatcctcgacttaagacacctccaagaccccaaggccagaggcccgctccagagagccgcggtggatttcaaccatttggcgatactggggggtttcactttagttttggcgtcggggcctttccatttggattctttaccacagtgttcaacgcccacgagccatttagacgaggaactggaccatttagtacatcaccagccttcttccactacctgattggcaacacatcccgggaatttcgtgggcgcatctataacttttggttgccaaggaacctctag

SEQ ID NO: 203945 - DNA, 549 bp, Artificial Sequence
  Description of Artificial Sequence: Synthetic coding sequence
atggccgccgccgaggaggaggacggcggccccgagggccccaacagggagagaggcggggcaggggccacttttgagtgcaacatttgccttgagaccgcccgggaggcagttgtgagcgtgtgtggacacctgtactgctggccctgcctccaccagtggctggaaactcggcctgaaaggcaggagtgtccagtctgcaaggcaggcatttcccgggagaaagtggtccccctgtatggcagaggatcccagaagccacaggatccccgactcaagactcctcccagaccccagggacagaggccagcccccgagtcacgcggaggttttcagccgtttggcgacacaggaggcttccactttagctttggtgtgggggcctttcccttcggtttctttactacagtgtttaatgcccacgagccattccgccgtggcactggaccattcagcacaagcccggcgttttttcactatctcatcgggaacaccagtagggagttccgcggcaggatatataatttctggctacctcggaatctgtag

SEQ ID NO: 203946 - DNA, 342 bp, Artificial Sequence
  Description of Artificial Sequence: Synthetic coding sequence
atggccgacgtggaggacggcgaggagacctgcgccctggccagccatagcggcagctcgggctctaagagcggtggagataagatgttctctctgaagaagtggaatgcagtggccatgtggagttgggatgttgagtgcgatacctgtgctatctgtagagtacaggtgatggacgcttgcctcagatgccaggccgagaacaaacaggaagattgtgtggtcgtgtggggggaatgcaaccactcatttcacaattgctgcatgagcctgtgggtgaagcagaacaaccggtgtcccttatgtcagcaagattgggtggtacagcggattgggaagtag

SEQ ID NO: 203947 - DNA, 273 bp, Artificial Sequence
  Description of Artificial Sequence: Synthetic coding sequence
atggccgacgtggaggacggcgaggagacctgcgccctggccagccattctggctccagtggcagcaagtctggcggggacaaaatgttttcactgaagaaatggaacgctgtggcaatgtggtcttgggacgtcgaatgtgacacctgtgctatttgtagagttcaaatgcctgtcctcgacgtgaagttgaaaacaaacaagaggaccgtgctgtggtccggggagaacgtcattattccttcgaccactgccgcgtgtccttgtgggtag

SEQ ID NO: 203948 - DNA, 294 bp, Artificial Sequence
  Description of Artificial Sequence: Synthetic coding sequence
atggccgacgtggaggacggcgaggagacctgcgccctggccagccattctggcagcagcgggtctaaatctggaggagacaagatgttctcccttaaaaagtggaacgccgtagccatgtggagctgggacgtggaatgtgatacatgtgcaatttgcagagtgcaggtgatggtggtttggggcgagtgcaaccactcctttcacaactgttgcatgagtctgtgggttaaacagaacaaccgctgcccactgtgtcagcaggattgggtggtccaacggattggcaagtag

SEQ ID NO: 203949 - DNA, 1875 bp, Artificial Sequence
  Description of Artificial Sequence: Synthetic coding sequence
atggagaacagcgacagcaacgacaagggcagcggcgaccagagcgccgcccaaagacgttcccagatggaccgcctcgaccgggaggaagcgttctaccagttcgtgaataacctcagcgaagaagattaccggctcatgagggacaacaatctgctggggacgccgggagaatctaccgaggaggagctcctcaggcgtctgcagcagattaaggaaggcccaccaccacaaaacagtgacgagaataggggaggcgacagttcggatgatgtgtctaacggcgacagtataattgattggctaaattctgtgaggcagaccggaaacactacccggtctggacagagggggaaccagtcgtggcgtgccgtctcaagaaccaatccaaacagcggagactttaggtttagcctggagataaatgtgaacaggaataatggctcccaaaacagcgagaacgaaaacgagccctcagcccgcaggtccagcggcgagaacgtcgaaaacaatagccagcgccaggtggaaaaccctcgctctgagtctacctctgcccgtccctctcgctctgaaaggaactctactgaggccctaacagaggtgcccccaacgcgaggtcagcgacgagctcgcagccggtcccccgatcacaggagaactagggcccgcgccgagagatccagaagtcctttgcatccaatgtccgagatccccagaagaagccatcacagcatcagttcccagaccttcgagcatccccttgttaatgaaactgagggttctagtcgaactcggcaccacgtgaccctacgccagcaaattagcgggccggagttgctcagtcggggactatttgccgcaagtggcacaaggaatgcatcccagggagctggtagctccgacacagccgctagcggggagtctacaggaagtgggcagcggccaccaaccattgtccttgacttgcaggtgcgacgagttcggcccggcgagtatcggcaacgggatagcatagcgagcaggaccaggtcaaggtcacagacgccaaataatactgtgacttacgagagcgagcggggtggattcaggcgcaccttttccagaagtgaaagggctggtgtgcgaacctatgtgagtactatcaggatccctatccgtcggatcctgaatacagggcttagcgagactacatccgtagctatccagaccatgcttcgccaaatcatgaccggatttggtgagttgagctattttatgtatagtgatagcgattctgagccaactggaagtgtatcaaatcggaacatggagcgcgctgagagtcgctccggcaggggcggcagcggagggggaagctcctctgggtccagttcctcatccagttccagttcttcatccagtagttcttcaagctcatcctcatctccgagctcctcatccggtggggaatcctccgagactagctctgatttattcgagggcagcaatgaaggatcaagttcttctggcagttccggggccagaagggaagggcgtcacagggcgccagtgacttttgacgagagcggtagcctccccttcctgtctctggcccagttcttcttactgaatgaggacgatgatgatcagcctagaggcctcacaaaggagcaaattgataacttggcgatgagatcctttggcgagaatgatgccttgaagacctgctccgtttgcattactgagtatacagaaggcaataaacttcggaaactaccatgctctcatgaataccatgtccactgtattgacaggtggctgtctgaaaattctacctgtcccatctgccgcagagccgtgctagcaagtggtaacagggagagcgtcgtatag

SEQ ID NO: 203950 - DNA, 1875 bp, Artificial Sequence
  Description of Artificial Sequence: Synthetic coding sequence
atggagaacagcgacagcaacgacaagggcagcggcgaccagagcgctgctcaaagaaggagtcagatggaccggctggaccgcgaggaagctttttaccagttcgtcaacaacctgtcagaagaggattaccggctaatgcgagacaataatctccttgggacgccaggcgagagtactgaggaagagctgctgaggcggctgcaacaaattaaagagggaccacctccccagaattctgatgagaacagggggggtgattcatcggacgatgtttctaatggagattcaatcatcgactggcttaacagcgtccggcagacaggaaacaccacccgcagcggacagagaggtaatcagtcttggcgcgccgtgagtagaacaaaccctaatagcggagacttccgcttttctctcgaaatcaacgtgaaccgcaacaacggatctcaaaattcagaaaatgaaaatgaacccagtgcccgtagatcaagcggggagaatgtggagaataatagtcaaaggcaggtggagaacccccgtagcgagagcacttccgcccgcccatctcgatccgagcgaaattcaactgaagccctgacagaggtgccgcccactcggggccaaaggcgcgctcggagtcgttcccccgaccaccggcgaacgcgcgcccgcgctgaacgatctagaagccctctgcatcctatgtctgagatcccgcggcgtagtcatcactccataagtagccaaacttttgagcaccccctcgtgaacgagacagagggcagcagtcgaacccgtcaccacgttaccctccgtcaacagatctctgggcccgaactgttgagcaggggactcttcgctgcatctgggacccgaaacgctagccagggggccggttccagcgataccgctgcatccggcgagtccaccggcagtggccagcgaccccccacaatcgtgctcgatctccaggtaagacgggtaagacccggtgagtatcgtcaaagagattctatcgcttctcggacccgaagtcgaagccagactcctaacaacacagtgacatacgagtccgaacgcggaggatttcggcgaaccttctcaaggagtgaacgggccggcgtcagaacatatgtcagtacaatcagaatccccatccggagaattctgaacaccggactgagtgagacaacatcagtggccattcagacgatgcttcgacagattatgactggatttggtgagctgagctattttatgtactccgattccgatagtgaacctacggggagtgtttctaatagaaacatggagcgagccgaaagccgaagcgggagagggggatccggcggaggatctagtagtggcagttcctcttcgtccagctcttccagctcaagctcatcttcatcaagttcttcatcctccccaagttccagtagtggaggagagagtagcgaaacatcatccgacctatttgagggcagtaacgagggatcttccagttctggttcaagcggggcgagaagggaggggcgtcatagagcaccagtcacattcgacgagtctggctccctgccattcctctcactggcccagtttttcctgttgaacgaggacgacgacgaccagccccggggcctcactaaagagcaaattgataacctcgctatgcgatcatttggggagaatgatgctttgaagacttgttctgtgtgtatcacagagtatacagagggcaataaactcagaaagctcccatgcagtcatgagtatcacgtgcattgtattgacagatggctctctgagaacagcacttgccccatatgccgcagggctgttttagcctctgggaaccgtgagtcagtggtgtag

SEQ ID NO: 203951 - DNA, 954 bp, Artificial Sequence
  Description of Artificial Sequence: Synthetic coding sequence
tgactgcccgcccccgccgccgccctgcccggcgccccccccccccctcccggcgtgcgcggataccccgcgcgagcccgcggcttgcagggggcatctggcggtgctagattcccgtcttccttgtcactcccagtcccaggtaaaggaggctgggtggtgtcccgtgccaagtttcccgcactggactcatgtgagatcacaaccgctcacccccgtttgtgttttgcagtaagtcctcccttttcctgctcacttcctctgccctcgctctttcctcatagtccactcctaggaagacccaagcgacaggctaaacccgctgcggatgaaggtttctgggattgttcggtttgcactttccgcaacagcgccgaggcattcaaatgttcaatttgcgatgtccgcaaaggtacaagcacaaggaagcctcgcatcaactcccaactcgtcgcccagcaggtggcccagcagtacgccacaccgcccccacccaagaaagaaaaaaaggagaaagtggagaagcaggataaagagaaacctgaaaaggacaaagagatttcaccttcagtgacaaaaaagaacacaaataagaaaaccaaacctaagtctgatatcttgaaggatcccccaagcgaagcaaactctatccagtctgcaaatgcgacgaccaagacctctgagacaaatcacacctcacgacccagactgaagaatgtggataggtccaccgctcagcagctggcggtgactgtagggaatgtgaccgtaatcataactgactttaaagagaagacccggtccagtagtacctctagttccaccgttactagttctgcaggctcggagcagcagaatcagagctcctcagggtcggagtcaacggacaaaggatcatctaggagctcaacgcccaagggcgacatgtccgctgttaacgatgagagtttttag

SEQ ID NO: 203952 - DNA, 456 bp, Artificial Sequence
  Description of Artificial Sequence: Synthetic coding sequence
atggacagcgccgcctgcgccgccgccgccacccccgtgcccgcccttgcgcttgcgctcgcacccgatctcgctcaggcccctctggctctgcccgggctcttgtccccttcttgtctccttagttcaggacaggaagtgaatggcagtgagcgcggaacgtgcctgtggagaccatggctgtcgtcaacgaacgattcccctcgccagatgcgaaagcttgtggacctggccgccggcggcgcgaccgcagcagaagtgacgaaggcggaatcaaaattccatcatcccgttagactgttttggccaaagtctcggtctttcgattacctttacagcgctggcgagattctcttgcagaactttcctgtccaggcaacaataaacctctacgaagactccgatagcgaagaggaggaggaggatgaagaacaggaagacgaggaggaaaagtag

SEQ ID NO: 203953 - DNA, 315 bp, Artificial Sequence
  Description of Artificial Sequence: Synthetic coding sequence
atggacagcgccgcctgcgccgccgccgccacccccgtgcccgccttggccctggcgctagcccctgatctggctcaagctcccctggcactgcccggcctgctgtccccgagttgcctgctgagctcaggccaggaggtgaatgggagtgagcgactattctggccaaagagcagatccttcgactacctgtactctgctggggaaattctcctacagaactttcccgtccaggctacaattaacctttatgaggacagcgactcggaagaagaagaagaggatgaggagcaggaggacgaagaggagaagtag

SEQ ID NO: 203954 - DNA, 213 bp, Artificial Sequence
  Description of Artificial Sequence: Synthetic coding sequence
atgcccgacggccccggcatgaccgccgccagcggcaagctgtaccagttccggcatcccgtccgactcttttggcccaagagtaaatgctatgactatttgtatcaggaggctgaggcacttctaaagaattttcccatccaggcaaccatcagcttctacgaagattcagactccgaggatgaaatcgaggatcttacctgtgaaaattag

SEQ ID NO: 203955 - DNA, 387 bp, Artificial Sequence
  Description of Artificial Sequence: Synthetic coding sequence
atggagaacgccggcggcgccgagggcaccgagagcggcgccgccgcctgcgcagctaccgatgggcctactcggagagccggcgcagattcagggtacgccggcttttggcgaccctgggtcgacgctggtggcaagaaagaggaggagactcctaaccacgcagctgaagcaatgcctgatggacctgggatgactgcagcatccgggaaactctatcagttccgccatccagtgcgtcttttttggcccaaaagtaaatgctatgattatctttatcaggaagccgaggccctcctcaagaattttccaatccaagcaacgataagcttttacgaggattccgactcagaagatgagatcgaggaccttacctgcgaaaattag

SEQ ID NO: 203956 - DNA, 444 bp, Artificial Sequence
  Description of Artificial Sequence: Synthetic coding sequence
atggccgccgccgccgacagcttcagcggcggccccgccggcgtgaggctacctcgctctccgccactgaaagttcttgccgaacagctcaggagggacgcagagggcggcccaggagcttggcggctatctcgcgcagccgccgggcgaggccccctggacctggccgctgtgtggatgcaagggagagtggtcatggccgacaggggagaggcgcgtctccgagatccaagcggcgacttttcagtgagaggccttgaaagagttccccgcggcaggccatgtcttgtcccggggaagtacgtgatggtgatgggtgttgtacaggcctgttctccagagccttgcttgcaagccgtcaagatgaccgacctcagcgacaatcccatccacgaatccatgtgggaattggaggtggaggatttgcacaggaacatcccatag

SEQ ID NO: 203957 - DNA, 255 bp, Artificial Sequence
  Description of Artificial Sequence: Synthetic coding sequence
atgaagcagacccaggtgggcagcctgttcagcctgggcatccggaatcccgaacctggacccgttagcggcacagccgtgcctcggcagctcgcatggaaatctggaaaatacgtcatggtgatgggggtggtacaggcttgttcccctgagccctgccttcaggcagttaagatgactgacttgagcgataatccgatccatgaatccatgtgggagctggaagtggaggatcttcatagaaatatcccttag

SEQ ID NO: 203958 - DNA, 1431 bp, Artificial Sequence
  Description of Artificial Sequence: Synthetic coding sequence
atggccaacagcgccaaggccgaggagtacgagaagatgagcctggagcaggccaaggcctctgtcaactctgaaactgagtcctccttcaacattaacgaaaacacgactgcttctggcaccgggctgtccgagaagacgtctgtgtgccggcaggtggatattgccaggaaaagaaaggagtttgaggacgatctagtcaaggaatcctcctcttgcggcaaagacaccccctctaagaaaagaaagctggacccggaaatcgtgcccgaggagaaagactgtggcgacgcagagggaaattctaagaagcgaaagagagagactgaggacgttcccaaggataagagtagcaccggcgatggaacccaaaacaaacgtaaaatagccctcgaggatgtgccggaaaagcagaaaaatctagaagagggccacagcagtacagtggcggctcattacaacgaacttcaagaggttggactggaaaagaggtctcagtctaggatcttctacctcaggaacttcaataattggatgaaatccgtcctcatcggcgagtttctggaaaaggtgaggcagaaaaaaaagcgagacatcacagttttggacctgggttgtggtaaaggaggagacttgctgaaatggaagaagggacgaatcaacaagttggtttgtacggatattgccgatgtgtcagtgaaacaatgccagcagcgttacgaagatatgaaaaaccgaagagactctgagtatatcttcagtgctgagtttatcaccgccgacagttccaaagagttactcatcgacaaatttcgcgatccccagatgtgctttgacatctgctcatgccagttcgtttgtcactacagctttgaaagttatgagcaggctgacatgatgctccgcaatgcttgtgaacgcctctctcccgggggctactttatagggaccacccccaactcatttgaactcattaggagacttgaggcatccgagaccgagtcattcggaaacgaaatctacaccgtgaagttccagaaaaaaggtgactacccactgtttggttgtaaatacgacttcaacttagagggagtggtggacgtccctgaattcctcgtatactttccactcctgaacgagatggctaagaaatacaacatgaagctcgtctataagaaaacattcctggagttctatgaggagaagataaagaataacgagaacaaaatgctgctgaaacggatgcaagcgttggagccatatcctgctaacgaatcatccaagctcgtctctgagaaggtggatgattacgaacacgccgctaagtacatgaagaactcccaagtccgcttgcctcttggtacattgagcaagagtgagtgggaggctacgagtatctacctggtgttcgccttcgaaaagcagcagtag

SEQ ID NO: 203959 - DNA, 1431 bp, Artificial Sequence
  Description of Artificial Sequence: Synthetic coding sequence
atggccaacagcgccaaggccgaggagtacgagaagatgagcctggagcaggccaaggcgtctgtaaactcagagacagagagtagctttaatattaacgaaaataccacagcctctggaacaggcctatccgagaaaacctctgtctgtcgccaggtcgatatcgctcggaagaggaaggaattcgaggatgatctggtcaaagagagtagtagttgcggcaaggatacaccgagtaaaaagagaaaactcgacccagaaatcgtaccagaagagaaagattgtggcgacgctgagggtaacagcaaaaagagaaagcgggaaacagaagacgtccctaaggataagagcagcacaggcgatgggacccaaaacaagaggaagatcgcattggaggacgtgcccgagaaacagaagaacctagaagaaggacattcatcaaccgtggccgctcactacaacgaactgcaggaggtgggactcgaaaaaaggtcccagagtcgcatcttttatcttcgcaacttcaacaactggatgaagagcgtgctaattggggagtttctggagaaagtgaggcaaaaaaagaaacgtgacataacagtgctcgacctgggatgtgggaagggtggagatctgctgaagtggaaaaagggtcgaatcaataaactggtctgtacggatatcgccgacgtatcagtgaaacagtgtcagcagcgatatgaagacatgaaaaatcgtcgtgattctgagtacattttttcagccgagtttatcacagctgacagctccaaggagttgctgatcgacaaattccgagatccccaaatgtgctttgacatttgctcttgccagttcgtatgtcactatagctttgaatcctacgagcaggcagatatgatgctgcggaatgcttgcgagagactgagccctggggggtactttatcgggaccactccaaattcttttgagctcatcagaaggctcgaggcatctgaaactgaaagttttggcaacgaaatctataccgtgaaattccagaaaaagggcgattaccccctgttcggatgcaaatatgattttaatctggagggtgttgtggacgtacccgagtttctggtgtatttcccccttcttaatgaaatggctaagaaatacaacatgaagctggtgtacaagaagacattcctggagttctacgaagagaaaatcaaaaacaatgagaacaaaatgttgctgaagcggatgcaggcattggagccttatccagctaacgaaagtagcaagttggtgtcagaaaaagtagacgattacgagcatgctgcaaagtacatgaagaactctcaggttaggctgccgctgggaactctgagtaagtccgaatgggaagcaacctcaatatacctggtgtttgctttcgagaaacagcagtag

SEQ ID NO: 203960 - DNA, 705 bp, Artificial Sequence
  Description of Artificial Sequence: Synthetic coding sequence
atgaagaaccggcgggacagcgagtacatcttcagcgccgagttcatcactgcagattcgtccaaagagcttcttatcgacaagttcagggacccacaaatgtgttttgatatttgttcctgccagttcgtttgtcattactcatttgagtcttatgaacaagcagatatgatgctgcgcaacgcctgtgagagacttagtccaggggggtattttattggcactacccccaattcattcgaacttattagacggctggaggccagcgagacggaaagtttcgggaatgagatttacacggtgaaatttcagaaaaagggcgattaccccctttttggctgtaagtatgattttaacttggaaggagtggttgatgtacctgagtttttggtatatttccctcttctcaatgagatggccaaaaaatacaatatgaaactggtatataaaaaaacatttcttgaattttatgaagagaaaatcaaaaacaatgaaaacaagatgctgttgaagcgcatgcaggccctggagccctatcctgcaaatgaatcctcgaagctggtcagtgagaaagttgacgattatgagcatgccgccaagtacatgaagaattcgcaggtaaggctgccgctggggaccttaagcaagagcgagtgggaagcaacttcaatctacctggtctttgctttcgagaagcagcaatag

SEQ ID NO: 203961 - DNA, 1431 bp, Artificial Sequence
  Description of Artificial Sequence: Synthetic coding sequence
atggccaacagcgccaaggccgaggagtacgagaagatgagcctggagcaggccaaagcaagcgttaactcggaaaccgaatcctcctttaacatcaatgagaatactacagctagcggcacgggactatctgaaaaaacgtcagtgtgcaggcaagtagatattgcgcgcaaaagaaaggagttcgaagatgacctggtaaaagaatctagctcatgtggcaaggatactcctagcaagaaacgtaagctggatcccgaaatcgtccctgaagaaaaagattgtggagacgccgaaggtaattccaagaaacgcaaaagagaaacagaagacgtgcccaaggataaatcctccactggcgacggcacccagaataagagaaagatagcactcgaagacgtccccgagaaacagaagaatctggaggagggacactcaagcaccgttgcagctcattacaatgagttacaggaggtgggcctcgaaaaaagaagccaatccaggattttctacttaagaaattttaataactggatgaagtcggtcctgattggtgagttccttgagaaggtccgccagaagaaaaagagggacattaccgtgttggatcttggatgcggaaagggtggagatctgctgaaatggaaaaagggcaggattaataaactggtgtgcaccgacattgccgacgtctccgtgaaacagtgccaacaaaggtatgaggacatgaagaatcggcgggattccgagtatattttttctgccgagtttatcacagccgacagctccaaagagctcctcattgacaagttccgagatccacagatgtgcttcgatatctgctcttgtcaatttgtatgccactatagtttcgagtcgtacgaacaggcagatatgatgttacgcaatgcatgtgaaagactgtcaccgggcgggtatttcattgggactacgcctaactcttttgagctcattagacgcctggaagcttcagagaccgaatcctttggtaatgagatctacaccgttaagtttcagaaaaaaggtgattacccccttttcgggtgcaagtacgactttaatctggaaggagtagttgacgtacctgagttcctggtgtactttccactcttgaacgagatggccaagaaatataacatgaaactggtgtataaaaagacatttcttgaattttacgaagaaaagatcaaaaataatgagaacaaaatgctgctgaagcgaatgcaggctctggagccttaccctgccaacgagtcttcaaagcttgtctctgagaaggttgacgattatgagcacgcggcgaaatacatgaaaaactcccaggtgcgactgcctcttggcacactctccaagtccgaatgggaggccacttctatttatttggtctttgcctttgaaaagcagcagtag

SEQ ID NO: 203962 - DNA, 390 bp, Artificial Sequence
  Description of Artificial Sequence: Synthetic coding sequence
atgaagagcgtgctgatcggcgagttcctggagaaggtgcggcagaaaaagaaacgggatatcacagtactggacctggggtgtggtaaaggcggggatctgctcaagtggaaaaagggccggattaataagctagtgtgcactgacatagccgacgtcagtgtgaagcagtgtcagcaaagatacgaggatatgaagaaccgtcgggattctgaatacatattctcagcagaattcattaccgccgactcaagcaaggagcttctaatcgataagttcagggacccgcagatgtgctttgatatttgttcttgccaatttgtctgtcactatagtttcgagagctacgaacaagcagacatgatgctccggaacgcatgcggcacatag

SEQ ID NO: 203963 - DNA, 468 bp, Artificial Sequence
  Description of Artificial Sequence: Synthetic coding sequence
atggccccccggacctggtgccccgccggcatcttcggcctgttctgtccacttaccctggcatgttcctcactaacgattgccctgaccgattgccagcccattatactggtgagccccacactcagtctgtggatggtggtgcggagtgtctggatcatgcaggcctctctactgggggagccagaagaagtcgcactcggccccatgggtgtggtggctgcgaccttggaggttgtcggaacaagagctatgggcgtggccgggatcatgacagtggacttggaggggatggatatggacatggacgtgcccgaaaccatcatggcagaaacccgcgtcgtcatgactgctactcaagaggaaattaccgagactataatgacaacggagatgcgtcatgcgcacaatatcggggagacctggatttctgcactgagtgaaccagtctgtcataccctgtcttag

SEQ ID NO: 203964 - DNA, 474 bp, Artificial Sequence
  Description of Artificial Sequence: Synthetic coding sequence
atgagcagcgaggagggcaagctgttcgtgggcggcctgaacttcaataccgacgagcaggcgctggaagaccatttttcaagcttcggccctatcagcgaagtggtggtggtcaaggaccgcgagactcaacgtagcagagggttcggttttattacgttcactaatcctgagcacgcatcggtcgccatgagggctatgaacggcgagtcgctggacggccgacagattcgtgtcgaccacgctgggaagtccgctagggggacccgagggggaggattcggagcacacggccgcggccgttcttacagcagaggtggcggcgatcaggggtatggttccggccggtattacgattcccgaccaggcgggtacggctacggctatggacgctctcgcgattacaatggcaggaatcagggaggctacgaccggtactctggcggtaactacagagacaactatgataattag

SEQ ID NO: 203965 - DNA, 474 bp, Artificial Sequence
  Description of Artificial Sequence: Synthetic coding sequence
atgagcagcgaggagggcaagctgttcgtgggcggcctgaacttcaatactgatgaacaagctctggaggaccacttctcatcgttcgggccaattagcgaagtggtggtggtcaaagatagagagactcagcgtagcagaggtttcggtttcattaccttcaccaatccggaacacgcctccgtcgctatgagagcgatgaatggggagagcctagacggccggcagattagggtggaccatgccggcaaaagcgcacgcggcacacgggggggtgggttcggcgcccatggaaggggacgcagctacagtcgcggtgggggagaccagggatacggctccggcaggtactacgattctcgccctgggggttatgggtatggatacggtagatctagggattataacggacgaaatcaggggggttacgatcggtattcgggggggaactatcgcgataattatgacaactag

SEQ ID NO: 203966 - DNA, 510 bp, Artificial Sequence
  Description of Artificial Sequence: Synthetic coding sequence
atggccccccggacctggtgccccgccggcatcttcggcctgttctgccctctgacacttgcctgtagctctctgaccattgcgctgaccgactgccagccaatcatcctggtctctccgaccctgagtttgtggatggtagtaagatccgtgtggatcatgcaggcaagcctgttgggtgagccggaggaggttgccctgggtccaatgggcgtcgtggcagcaaccctggaagtggtggggacgcgggcgatgggcgtggcaggcatcatgactgtggacttagagggcatggacatggatatggacgtgcctgaaacgatcatggccgaaactcgcgtcgtgatgactgccacgcaagaagagatcaccgagaccataatgaccaccgagatgagacatgcccacaatatcgacacccagggcattatctcggatccgggctcaagttttcagatggccgtgtttattaaggttttcggtgccgcacccaaacatttgattctgtag

SEQ ID NO: 203967 - DNA, 2559 bp, Artificial Sequence
  Description of Artificial Sequence: Synthetic coding sequence
atggagtacgagcggcggggcggccggggcgaccggaccggccggtatggtgctaccgataggagtcaggacgacgggggcgagaacaggtctcgtgatcatgattacagggacatggattatagatcgtaccccagagagtatggaagccaggagggcaagcatgactacgatgacagcagcgaggagcagtcagcagaaattcggggacagctgcagagtcacggcgtgcaggcacgggaagtgagacttatgaggaacaaatcctcagggcaatcccgggggtttgccttcgtggagttctctcatctccaggacgccacaaggtggatggaagcaaaccagcatagcctgaacatcttgggccagaaggtttctatgcactattcagaccctaaaccaaagattaatgaggattggctgtgcaataagtgcggtgtacagaacttcaaacgacgcgagaaatgctttaaatgtggagtacctaagagcgaagctgaacagaaacttcccctcggtacacggttggatcagcaaacgctgccactgggcggacgagagctctcccaagggttgttacctttgccgcagccttatcaagctcaaggggtccttgcctcacaagcgctgtcccaaggctctgaaccatcctctgaaaacgccaacgatactataattctgcggaacctgaacccacatagtacaatggattcgattctgggcgccctggcaccctacgcagtcttgagctcctcaaatgtgagagtgatcaaagataagcagacccagctgaatcgggggttcgccttcattcagctttcaacaatcgaggctgcccagcttcttcaaattctgcaggccctgcacccgcccctcacgattgatggcaaaaccattaatgtggagttcgcaaagggctccaagagggacatggcaagcaacgaaggcagcaggatttcagccgcctccgtggcttccacagctatcgccgcagcacagtgggcaatcagtcaagcttcacagggaggagagggcacatgggcaacatccgaagaaccacccgttgactatagttactaccagcaggatgagggctatgggaacagccaaggtactgagagcagcctctacgcacacgggtacctgaaggggaccaaaggacccggaatcactggcaccaagggggacccaacaggcgccggcccagaagctagcctggaacccggggccgattccgtctctatgcaagccttttctcgcgcccagcccggcgccgcccctgggatttaccagcaatcagctgaggcatccagtagccagggcacagccgcaaactcccagagctatacgataatgagtccagccgtgctaaagtcggaactccagagccctacacacccttcatccgcactgccacctgcaacaagccccaccgcccaggagagttactctcagtaccctgtccctgacgtttcgacctatcagtatgacgagacttctggctactattatgatccacagacaggtctgtattacgaccctaattcccaatattactataatgcccagtcccaacagtatctgtactgggatggggagagacgcacatacgtcccggcactggagcagtctgcggacggccataaggaaactggcgctccttccaaggagggcaaggagaaaaaagagaagcataaaacaaagactgcgcagcaaattgcaaaggacatggagaggtgggccagatcattaaataagcaaaaggaaaattttaaaaactcatttcagcccatctcttctttgagagatgatgagagacgagaaagcgccaccgccgatgccggttacgcaatcttggaaaaaaagggcgcactggccgagagacagcatactagtatggacctgcccaaattggcaagcgatgatcgtccctcaccgccacggggtctcgtggccgcttactccggtgagtccgatagcgaggaggaacaagagcgcggagggcccgaacgcgaggaaaagctgactgattggcagaagttggcttgtctgttgtgccgacgtcagtttccctcgaaagaagctctgattcgacatcagcagctctctgggctccataaacaaaatctggagatccacaggcgtgcacatctgtccgagaatgagctggaggcccttgaaaagaatgatatggagcagatgaaatacagagacagggccgccgaaagaagggaaaagtacggcatcccagaaccccctgaacctaaacggagaaaatatgggggcatcagcacagcctctgtcgatttcgagcagccaactagggacggattgggatccgacaacatcggatcaagaatgctacaggccatgggctggaaagagggctctgggcttggtcgaaaaaagcagggaattgtcaccccgatagaagctcagacgcgggttcggggcagtgggctgggagctagagggtcttcgtatggtgtgactagtacagagtcctacaaggagactcttcataagacaatggtcacgcgtttcaacgaggctcagtag

SEQ ID NO: 203968 - DNA, 2562 bp, Artificial Sequence
  Description of Artificial Sequence: Synthetic coding sequence
atggagtacgagcggcggggcggccggggcgaccggaccggccggtacggggccacagatcgctcgcaagacgacgggggggagaatagatctcgggatcacgattacagagatatggattacagaagttatccccgtgaatacggcagtcaggaagggaaacacgattatgatgattcatctgaggagcagtcagccgagattcgtggccagcttcagtcgcacggtgtccaggccagagaagtacggcttatgaggaacaagtccagtggacagagccgcggttttgcatttgtggagttttcgcacttacaggatgcaactcgctggatggaagccaaccagcactcactgaatatcctaggacagaaggtaagcatgcactacagcgacccgaagccaaagataaatgaagactggctctgtaacaagtgcggcgtgcagaacttcaaaaggagggagaaatgtttcaaatgcggtgtgcccaagtcggaggccgagcagaagctgccactgggaactaggttggatcaacagacacttccactgggcgggcgtgagctgtcacagggccttctgccccttcctcaaccataccaggcccagggcgttctcgctagtcaggctctcagtcagggctctgagccaagttctgagaacgccaatgacacaattattcttcgcaatctaaacccccatagtaccatggacagcatactaggggcactggcgccttacgctgttctgtcatcatctaacgtgagagtcattaaggacaaacagactcagctgaaccggggcttcgctttcatccagctgtccaccattgttgaagcggcacaactgctacagatacttcaggcacttcatcccccattaacgatcgacggcaaaactattaacgtagaattcgctaaaggctcaaaacgggatatggcctccaatgaaggatccaggatttccgctgcctctgtggcatctaccgctatcgcggcagcccagtgggccatcagtcaggcctcccaagggggcgaaggcacttgggcgacctctgaggagccccccgtcgattattcttattaccagcaagatgaaggatacggcaactctcagggtactgaaagtagcctgtacgctcacggttacttgaaagggacaaaagggccaggaatcactggaacaaaaggagatcccaccggcgcagggcctgaggcaagcctggagcctggcgccgatagtgtttccatgcaagcttttagtagagcccaaccgggagcggctcctgggatttatcagcaaagtgccgaagcctcttcctcacaaggcaccgccgctaactcacagagctatacgatcatgtcgccggccgtccttaagagtgaattgcaatccccaacacacccgtcctccgctcttccacctgcaacctcgcctaccgctcaggaatcttacagtcagtatcccgtgcccgacgtgagcacataccagtacgatgaaacatcagggtattattacgacccccagactgggctgtactacgatccaaatagccagtattactataatgcccagtcacagcagtatctgtattgggatggcgagcgcaggacttacgtgcccgctctggagcagtctgctgatggccataaagaaacaggcgcaccctctaaggaggggaaggagaaaaaggaaaagcacaaaaccaagactgctcaacagatcgctaaagacatggagcgctgggccaggagtctgaacaagcagaaggaaaacttcaaaaacagctttcagccaatcagtagcctccgggatgatgaaaggcgagagagcgcaacagccgacgccggatatgccatcctggaaaagaaaggtgccctcgccgaacgccagcatacctctatggatctcccaaaactcgctagtgatgaccgacccagcccaccaagaggactcgttgccgcttactctggggaaagtgattccgaagaagagcaggagaggggcgggcccgaacgggaagaaaagttaacagactggcaaaagcttgcttgtttactctgcagaagacagtttccttccaaagaggcactgattagacaccagcagctttccgggttgcacaaacaaaaccttgaaatacatagacgggcccatcttagtgagaacgagctcgaggccttagagaaaaatgatatggaacagatgaagtacagagaccgagccgccgaacgacgtgaaaaatatggaatccccgagcctccggagcccaagaggagaaagtacggcggaataagcaccgcaagtgtggactttgagcaacccacacgtgacggcctaggctccgataatatcggctcacggatgctccaggctatgggttggaaggaaggatccgggttgggccggaagaaacagggcatcgtaaccccgatagaggctcaaacccgggtgaggggctctggcctcggagcccgagggtcgtcttacggtgttacctccactgagtcctacaaggagactctgcataagacaatggtgacacggtttaacgaagcgcaatag

SEQ ID NO: 203969 - DNA, 2793 bp, Artificial Sequence
  Description of Artificial Sequence: Synthetic coding sequence
atggagtacgagcggcggggcggccggggcgaccggaccggccggtacggagccacagataggtcccaagacgatggcggcgagaatcggtctagagaccatgactaccgagacatggattatcggtcctatccacgcgaatacggatctcaggagggaaaacatgactacgatgattcctccgaagagcagagtgctgaggattcatacgaggctagcccgggatctgagacacagaggaggcggaggcgccgacatcggcactcacccaccggaccacccggattccctcgcgatggcgactacagagatcaggattatcgtactgagcagggcgaggaggaggaagaggaggaagacgaggaggaagaagaaaaggcgtctaatatcgtcatgctgaggatgctcccacaggccgcaacggaggatgatatcagaggacagctgcagtcacacggcgtgcaggctcgcgaggtgaggctgatgcgaaataaatctagtggtcaatccagggggtttgcttttgtggaattcagtcacctccaggacgcaacaagatggatggaagccaaccaacactcccttaacatcttggggcaaaaggtgtccatgcattactctgaccccaaacctaagatcaacgaggattggttgtgtaataaatgcggagtgcagaacttcaaacgccgagagaagtgcttcaagtgtggcgtgcccaagtcggaggctgaacagaagctgcctctcggcactaggctcgatcagcagaccctacccctcggaggcagggagctctcgcaggggctcttgccactgcctcagccgtatcaagctcagggtgtgctcgcctcacaggctctaagccagggcagtgaaccttctagcgagaatgccaacgacactatcattctcaggaacttgaatccccattcaaccatggatagtatacttggagcactggctccctatgccgtcctttccagctctaacgtcagggtgatcaaggataagcagacccagctcaaccgaggcttcgctttcattcagctcagtacaattgtggaagctgcacaactgctccagattctgcaggccctccacccgccattgacgatcgatgggaaaacgataaacgtggagtttgccaaaggctcgaagcgcgacatggcgtccaatgagggcagccggatctccgctgcttccgttgcatccacagcaattgccgcggcccagtgggctatctctcaggcttcgcagggcggggaggggacgtgggctacatcagaagaacccccggtcgattatagctactatcaacaggatgaagggtacggaaattcgcagggaactgaatcttccttgtacgctcacgggtatctcaagggcacaaagggaccagggattacaggcacgaagggggatcccacaggggccggccccgaggccagcctggagcctggcgcggactccgtgagcatgcaggcattcagccgggctcagccaggcgccgcaccgggaatttaccaacagtccgctgaggccagtagctctcagggcacagccgccaactcccagtcctacacaataatgagtcccgctgtcctgaaatcggaacttcaatcccctactcacccgtccagcgcattgccacccgcgacatctcctaccgctcaggagagctactctcaatatcccgtgccggacgtctctacatatcagtacgatgaaacaagcgggtactactacgacccccaaaccggactgtactatgacccgaactctcaatactactataatgctcaaagccagcagtacctctactgggacggcgagcggagaacctacgtgccggccctggaacagtcggcggatggtcacaaggagacaggggccccttctaaagagggaaaggaaaagaaagaaaagcataagacgaagacagctcagcaaatagcaaaagacatggaacggtgggctcggagcctcaacaaacagaaggagaactttaagaatagcttccagcccatatcctccttgagggacgacgagagacgggaatccgctactgccgacgccggatatgccattctcgaaaagaagggtgcgctggctgaacgccagcacacatcaatggatttgcccaaattagcgtctgatgatcgacctagtccccctcgcggtctggttgctgcttattcaggtgagtctgactccgaagaagagcaggagcgcggcggcccagaaagagaggagaagctgacagactggcaaaaactggcctgtttactgtgtaggcgccaattcccttctaaggaggctctgatacgccatcagcagctttctggattgcacaagcaaaacctggagatacaccggcgggctcacctgtcagagaatgaactggaagcactggagaaaaacgacatggaacagatgaaataccgtgatagagcggcggagaggagagagaagtacggaatccctgaaccacccgaaccaaaacgcagaaaatacggaggaattagcactgctagcgtcgattttgagcagccaactcgggacggcctcggatcagacaatatcgggagccgcatgctgcaggcaatggggtggaaggagggttccggcctcggacgaaagaagcagggtattgtgacacccatcgaggctcaaacaagagtgagaggctctggtctgggcgccagaggaagctcctatggagtgacgtccaccgagtcctacaaagaaacattgcacaagacgatggtgacgagatttaacgaggcgcagtag

SEQ ID NO: 203970 - DNA, 2010 bp, Artificial Sequence
  Description of Artificial Sequence: Synthetic coding sequence
atgaagatcttcgtgggcaacgtggacggcgccgacaccacccccgaggagctggccgcgctcttcgctccctacggcaccgtcatgagctgtgctgtcatgaagcagtttgccttcgtgcatatgagggagaacgccggcgctctgagagctatcgaggctctacatggccatgaactccggcccggcagggctttggtcgtcgaaatgagccgaccacgcccattgaacacatggaaaatttttgtcggaaacgtctccgcagcctgtacctcacaggagctccggtccctgtttgaaagacgcggccgggtcatcgagtgcgatgttgtgaaggattatgcttttgtgcacatggagaaagaggcagacgcaaaagctgcaattgcccagcttaatgggaaagaagtcaaaggcaagagaatcaatgtagagctgagtaccaaagggcagaaaaagggacctggtctggcagtgcagagtggggacaagacaaaaaaaccaggagcaggtgataccgcgttcccagggaccggaggtttttccgcaacattcgattaccagcaggcctttgggaattctacagggggctttgatgggcaggcaagacagcccactcctccgttctttgggcgcgacagatcccctctgagaagatctcccccacgcgcaagctatgtggccccgctcactgctcagccggctacctacagggctcagccttcagtgtcattgggcgctgcctacagggctcagccctctgcttctctgggtgtgggatacaggacgcagcccatgaccgcccaggcggcatcgtacagagctcagccaagtgtgtctctgggggcaccctacaggggccagctggctagcccaagctcacaaagcgcggctgctagttccctgggcccctacggtggcgcccagccaagcgcctccgctctctcttcttacggcggccaggctgcagccgctagctcattaaactcatacggcgcccagggcagctctttggcctcttacgggaaccagccctctagttacggggcccaggccgcttcaagctatggagtaagggccgctgccagctcatacaacacacagggggccgcaagctccctcggctcatacggcgcgcaggctgccagttacggagctcagtctgctgcctcatcactggcctacggggcccaagcagcatcttataatgctcagccatccgcctcctacaacgcccagtctgcaccttatgcagcacagcaggctgcttcatacagcagtcaacctgccgcatatgttgcacagcctgcaacggccgcagcatacgcgtcccagcccgccgcttatgccgcccaggccaccacaccaatggctgggagctacggcgcccaaccagtggtacaaactcaattaaattcctatggcgctcaggcttcaatgggattatctggaagttacggggcacaaagcgccgctgctgcaacaggtagttatggtgctgcagccgcttatggggcccagccctccgctactctggccgccccctaccgcacacaatctagcgccagcctcgccgccagctacgccgcccagcaacaccctcaggcagcggcctcttaccgcggacagcctggcaatgcctatgacggcgccggacagccttcagcagcttacctctcaatgagccagggggccgtagcgaacgctaactcgacccctcccccttacgaaagaacaaggctcagtcctccacgcgcttcatatgacgacccttacaaaaaagccgtcgccatgtcaaagaggtatggttcagaccgtaggctggcagaactaagtgactaccggcgtttatctgaatctcagctgtccttccgaaggtctccaacgaagagcagcctggattacaggaggttgcctgacgcccacagcgactatgcccgttattccgggtcatataatgattacctgagagctgctcagatgcacagcggctaccagcggcgcatgtag

SEQ ID NO: 203971 - DNA, 471 bp, Artificial Sequence
  Description of Artificial Sequence: Synthetic coding sequence
atgaagatcttcgtgggcaacgtggacggcgccgacaccacccccgaggagttggccgccttgttcgccccctacgggacagtgatgtcctgtgctgtaatgaaacaattcgcctttgtccacatgagagagaatgctggggccctgagagccattgaggcacttcatggccacgagctccgacctggcagagcccttgttgttgaaatgtccaggccaagaccactgaatacatggaaaattttcgtgggcaacgtatccgccgcctgcacatcccaggagctgcgcagcctatttgagcgtagggggagagtgatcgagtgtgacgtcgtcaaggattacgcctttgtgcacatggaaaaggaagcagatgccaaagctgctatagcacagctgaacggaaaggaggtgaagggaaaaagaatcaacgtcgaattgagtacaaagggaatggtcccgacaggggtttag

SEQ ID NO: 203972 - DNA, 360 bp, Artificial Sequence
  Description of Artificial Sequence: Synthetic coding sequence
atgaagatcttcgtgggcaacgtggacggcgccgacaccacccccgaagaactagctgcccttttcgccccgtacggcaccgttatgagttgcgcagtgatgaaacagttcgcctttgtgcacatgcgcgagaatgcgggtgctctccgagctatcgaagcgctgcacggtcatgaacttcggcccggcagagccctggtcgtggagatgtctcgccctcgacctctgaatacatggaagatattcgtcggcaatgtgagcgctgcctgcacgtcgcaggaactacggagcctcttcgagcgtcgcggtcgggtcatagagtgcgacgtcgttaagggaatggtcccgaccggggtgtag

SEQ ID NO: 203973 - DNA, 2934 bp, Artificial Sequence
  Description of Artificial Sequence: Synthetic coding sequence
atgcggaccgccggccgggaccccgtgccccggcggagcccccggtggaggcgggctgttccactttgtgaaactagtgcaggaaggcgggtaacgcagctgcgaggagatgacttgcggagacctgctacgatgaagggtaaggaaaggagtccagtcaaggcaaagcgttcaagagggggcgaggactcaaccagccggggggaacgatctaagaagctcggggggtccggaggctccaatggaagcagctcaggcaagaccgacagtggtggtggctcccgtaggagcctccacctggacaaaagctcctctcgcgggggaagcagggaatacgataccggtggagggagcagctccagtaggctacatagctatagcagtccaagtactaagaatagctccggagggggggagtccaggtccagtagcaggggcggcgggggggaatcacgttcgtcaggcgctgcgagtagtgcaccagggggtggggacggcgcagaatacaaaacactgaagatttcagagctcggatcgcagctcagcgacgaggctgtcgaagatgggctttttcacgaattcaaacgttttggggacgtttcagtgaaaataagccacttgagcggaagtggaagcggggatgagcgagtggccttcgtcaattttcgacgacccgaggatgcccgtgccgcaaagcacgcccgggggaggctcgttctgtacgatcgccccctgaaaatcgaggccgtttatgtatcgagaaggaggtccaggtcccccctggataaggatacatacccccctagcgcttccgtagtaggggcctcggtgggtggtcatcgccatcccccgggtggagggggtggtcagaggtctctttcccctggcggggccgcactgggataccgagattacagactacagcagctggctttggggaggctccccccccctccccccccgcctctgcctagggaccttgaaagagaaagggactacccgttctatgagagggtgcgcccagcatattccttagaaccaagagtcggcgccggagcaggtgcagcacctttccgggaggtggacgaaatatctcctgaagatgatcagcgagctaataggacccttttcctgggaaacctcgatattacagttacagaaagcgatctaaggcgagcattcgaccgcttcggagtcatcacagaagttgatatcaaaaggccctcacgcgggcaaaccagcacttatggcttcctcaagttcgagaacctggacatgagtcatagggcgaagttggccatgagcggaaagatcatcattaggaaccctattaagattgggtacggtaaagctacaccgacaactcggctgtgggtgggcggtcttgggccttgggtacccctggcagcgctcgccagggaattcgatcgctttgggacaattcggaccatcgattataggaaaggagattcctgggcttatatacagtacgagtccctggatgccgcccatgccgcctggactcatatgaggggcttcccactaggcggtccagacagacggcttcgggttgatttcgcggacacagaacatcgctatcaacagcaatacctgcagccactccctttgacacactacgaattggtaacagatgcgtttggtcaccgtgcgcctgaccccctaaggggggcacgggaccgcaccccccccttactgtaccgagacagagatcgcgacctgtatcctgacagcgattgggtgcctccccccccccccgtcagggagagatcgacgcgcaccgccgctacatccgttccagcgtacgaaccactggattcactggaccgaaggcgggacgggtggtcactcgaccgggatagaggtgatcgggacctccctagcagcagagaccagcctagaaagaggagactgccggaagagagtggagggaggcacctggacagatcccctgagagtgacagaccacgaaagaggcactgcgccccgagccccgaccggtctccagagctgtccagcagtcgtgaccgatacaacagcgacaacgaccggtccagtcgactgctgctcgagaggccgtcaccgattcgcgatcgcagaggctcgctggaaaagtcacagggagacaagagggatcgcaagaatagcgcatcagcagaacgagaccggaaacatcggacgacagcccccacagaaggaaagtctccgttgaagaaggaagaccgatccgacggcagcgctcccagcacttccacggctagctcaaagctcaaatccccctcccaaaaacaagacggaggtaccgcaccagtggcctccgccagccccaaactctgcttggcatggcagggcatgcttctgctgaagaacagcaacttcccctccaatatgcacctacttcaaggcgacttacaagtcgcgtcgtcccttctggttgaaggatcgactggtggaaaggtcgctcaacttaaaataactcagcgactgcgcttggatcaacccaaactggacgaggtcacgagaaggatcaaggtggcagggcctaacggatacgccattcttctggctgtgcccgggagctctgacagccggtcctcttcttccagcgccgcctccgacaccgccaccagcactcagagacccctgcgaaacctggtctcctatcttaaacagaaacaggccgccggcgttatctccctccctgtcggtgggaataaagacaaagagaataccggcgttctgcacgcatttcccccatgtgagttttcgcagcagttcttagattctcctgctaaggctctcgcaaaatcggaagaggattaccttgtgatgattattgtaaggggctttggattccagatcggcgtccgatatgaaaataaaaaaagggaaaaccttgccctgacactgctgtag

SEQ ID NO: 203974 - DNA, 2673 bp, Artificial Sequence
  Description of Artificial Sequence: Synthetic coding sequence
atgaagcggcagagcgagcgggacagcagccccagcggccggggctccagcagttccgccaagcgcccaagagagagggagcgggaggccgaggccgggggtcggagagcagcgcacaaggcttcgggaggtgctaagcatcccgtcccggcgagggcacgagacaagccaagggggagtggaagtgggggaggcggacaccgggatgggcgaggcacgggcgacgcaaaccaccgcgcctcttccggccggagctcaggctctggggcaggcggaggtggccggggaggcaaggcctcaggcgatcccggggcatccggcatgtcccctcgcgcttccccgcttcctcctcctccaccccctcccggggctgaaccagcgtgccctgggtctagcgcagctgcgcctgaatataagaccctcctgatctcttcgttgagccctgcattacctgccgaacaccttgaggaccgactcttccaccagttcaagagatttggggagatttcactccggctctcacatacccctgagctgggccgggtggcttacgtaaactttcgacatccacaggacgcacgtgaggcacgccaacatgccctggccagacagcttcttctgtacgatcgccctctgaaagtcgagcccgtgtacctaagagggggaggtggttcttccaggcgcagtagttcctctagtgccgccgcgagcacacctccccccggccccccagcacccgcggatccgctcggatacctgccattgcatgggggctaccagtataagcagaggtccctctcaccagtggctgcacctccattgagggagccacgtgcacgccatgccgccgccgctttcgctttggatgctgcagctgctgccgctgtcggactgagccgcgaacgcgccctcgactactacggcctgtatgacgatcgcggacggccctatggctacccagccgtgtgcgaggaggatctgatgcccgaggacgatcagcgtgctacacgcaacctgttcattggtaacctcgaccacagcgtttccgaagttgaattgaggagggcatttgaaaagtatggaatcattgaggaggtcgtgatcaaaaggccggcgcgcggacagggaggggcctatgcctttttaaagtttcagaacctggacatggcccatcgagcaaaagtcgcgatgtccggccgcgtgatcggacgaaatccaataaaaatcggttacgggaaggctaatcctaccacacgtctgtgggtcggcggtctggggcccaacactagtttggccgcacttgcccgcgagtttgaccgctttgggtctatacgtactattgatcatgtcaagggcgactcatttgcctacattcagtatgaatctctggatgctgcacaggccgcttgtgcaaaaatgcgcggatttcccctgggcggcccagacagacgactgcgggtagactttgccaaggcagaagagacacgctatccacagcagtaccagccgtccccgttgcctgtccattatgagctgctgactgacggctatactaggcataggaaccttgatgcggatctggttcgcgaccgcaccccacctcatctgctgtatagtgatagggatcgcaccttcctggagggggattggacatctcctagcaaatctagcgatcgaagaaatagtttagaggggtatagcaggtctgtgcggtcccgcagcggtgaacgatggggggccgatggagacagggggctacctaaaccctgggaagaaaggcgaaagaggcgtagtttgtcctctgatcggggaaggaccactcattccccttatgaggagcggtcgcgtaccaagggcagtggccagcagtcggagagaggctctgatcgaacaccggaacggtcacggaaggaaaaccatagctccgagggaactaaggaatcttcttccaactctctgtcaaattcaaggcatggagctgaagagcgaggccaccatcatcaccaccacgaggcggcagacagcagtcatggaaagaaggccagggactccgaaagaaatcaccggactaccgaggcagaacccaagccactagaagagcctaagcacgagaccaagaaacttaagaatctgtcagaatacgctcagacattgcagcttggttggaacggcctgttggtgttaaagaattcttgtttccccacttccatgcatattctcgagggtgaccagggggtgattagttccctgcttaaagatcatacatccggaagtaagctcacacagctgaagattgcccaaaggttaagattggaccagcccaagttggatgaggtaacgcgtcggatcaagcagggaagcccaaacggttatgccgtgcttctagcaacccaggccacgcccagtggcttaggaactgagggcatgcccacagttgaacccggactccagcgcaggctgttgcgcaacctggtatcatatctcaaacagaaacaagccgcaggcgttatcagcctgcccgtcggtgggagcaagggaagagacggcacaggtatgctgtatgccttccctccatgcgacttttctcaacagtacctgcagtcagcccttagaacattaggaaagcttgaggaagagcatatggtaatcgtgatcgtgcgcgacacagcctag

SEQ ID NO: 203975 - DNA, 765 bp, Artificial Sequence
  Description of Artificial Sequence: Synthetic coding sequence
atggagaccgtggtgtgccccccctgggaggagcggcggaagcggcggagcctctctagcgatagaggacgcaccacccattccccctacgaagagcgcagtaggacgaagggctcaggccagcagagtgagcgcgggagcgatcggactccagaacggtctcggaaagagaatcattcctccgaaggaaccaaagagtcttcttcaaatagcttgtccaattcacgccacggcgcggaggaacgggggcaccaccatcaccatcacgaggcggctgacagttctcacggaaagaaagctcgcgattctgaacgaaaccacagaacaaccgaggccgagcctaagcctctggaagagcccaaacatgagacaaagaagcttaagaacctgtcagaatacgcacaaactctgcagctgggctggaacggactcttagttctcaagaattcctgctttccaacatcaatgcacatccttgagggtgaccagggcgtgatctctagcctgctaaaggatcacaccagcggctcaaaactgactcagctgaaaattgcgcaacgactgagactggatcaacccaagttggatgaggtaactcgccggatcaaacagggatccccgaacggatacgcagtgttgttagctacacaagcgactccttccggtctggggacagagggcatgcctactgtggaaccaggtctacaacggcgtctgctgcgaaacctggtatcctacctaaaacagaagcaagcagccggttag

SEQ ID NO: 203976 - DNA, 636 bp, Artificial Sequence
  Description of Artificial Sequence: Synthetic coding sequence
atgaagcggcagagcgagcggaaccaccggaccaccgaggccgagccaaagcctctcgaggaaccaaagcacgagaccaaaaagctgaagaatctgtccgaatatgctcagacattacagttaggttggaatggcttgctagtactgaaaaatagctgtttcccaacgagtatgcacatactggaaggagatcagggagtcatatcctccttgctgaaggatcataccagcgggtctaagttaacgcagctgaaaatagctcagcgactgcgtcttgatcagcccaagcttgacgaagtgacgcggcggataaagcaaggcagtccaaacggttatgctgtactattagccacccaggccacacccagtgggctcgggaccgaaggcatgcctaccgttgagcctggcctccagaggagattgctgagaaatctggtctcatacctaaagcagaagcaagctgcgggcgtgattagcctacctgttgggggcagcaagggccgggacggaaccggcatgctttacgctttccctccctgcgatttcagtcagcagtatcttcaaagtgccctgcgcaccctcgggaagctggaagaggaacacatggttattgtgatcgttagagacaccgcgtag

SEQ ID NO: 203977 - DNA, 1692 bp, Artificial Sequence
  Description of Artificial Sequence: Synthetic coding sequence
atgcccgaggacgaccagcgggccacccggaacctgttcatcggcaatctcgatcatagtgtgtcagaggtcgaattaaggcgcgcgttcgagaaatacggaatcattgaagaggtcgtgatcaagaggcccgccagaggtcaaggtggggcttatgcgtttctgaagttccagaacctcgatatggcacaccgggcaaaggtggcgatgagtggccgagtaatcgggcggaatccaataaaaatcgggtatggcaaagccaaccccactacaagactgtgggtgggcgggctgggcccaaatacctcactggccgccctggctcgagagtttgatagatttggtagtatccgcacaatcgatcatgtgaaaggtgattcctttgcgtatatacaatacgaaagccttgacgcggcacaggcggcgtgtgccaagatgaggggctttcctctcggcgggccggacaggaggcttcgcgtagactttgcaaaggccgaggagacaagataccctcagcagtaccagccgagccccctgcctgtccactacgagctactgacagatgggtatacaagacatcgcaacttggacgccgacctggtgagagatcgaaccccacctcacctcctttactctgacagggacaggacgttcctggagggcgattggacgagcccttctaaatccagtgaccgcaggaacagcctcgagggatacagccgctccgtgcgcagcaggagtggggagcgatggggagctgacggtgacagaggactgcctaagccctgggaggaacggaggaaaaggcgctctctgtcctctgacagaggcagaaccacccatagcccatatgaagagcgttcccgcacgaagggctctgggcagcagtccgaaaggggctcagataggacaccggaacgctcaagaaaggaaaaccactcctccgaggggacgaaggagagtagctctaattcactgtccaacagtcgccatggagcagaggaaagaggccaccatcaccatcaccacgaggctgctgatagctcacatgggaaaaaggctagggattccgagcgtaaccataggaccaccgaggcagagcccaagcctcttgaggaacccaaacatgaaacaaagaagctgaaaaatctctcagaatacgcccaaaccctgcagttgggatggaatggtctcctggtgctcaagaacagctgttttccaacctctatgcatatcttagaaggggaccagggcgtgattagctccctgctgaaagatcatacctcgggttctaagttgacccagctcaagatcgcacaacggctgcggttagatcaacccaaactggacgaggtgactcggaggattaagcagggaagcccgaacgggtatgccgtgctgctggccacccaggccacaccttcgggactcgggactgagggaatgcccacagtggagcctggactacaacgtaggctgttgcgtaacttagtctcgtacctgaaacagaagcaagccgcaggagtcatctctctcccagttgggggaagtaagggtcgggacgggactggcatgctgtatgcctttccaccctgcgacttttctcaacagtacctccagagtgccctcaggactctcggtaaacttgaggaagaacacatggtgattgtgatcgtgcgcgacacggcctag

SEQ ID NO: 203978 - DNA, 732 bp, Artificial Sequence
  Description of Artificial Sequence: Synthetic coding sequence
atgggccgggtgggccgggccggccggagccagcggaccaagcagtccacagttttggcccccgtcattgaccttaagcggggcggttcctccgacgacaggcaaatagtggacactccccctcacgtcgcagctggccttaaagacccggtccccagcggattctccgccggcgaagtgctgataccacttgctgacgagtatgaccctatgttccctaacgactatgaaaaggtggtgaagcgccagagggaggaacggcagcgccagagagaacttgaaaggcagaaagaaatcgaggaaagggagaaaaggaggaaagaccgacacgaagcctcaggctttgcacgcaggcccgacccagactccgacgaagacgaggattatgagagagaacggaggaagagatcgatgggcggtgcagcaatcgctcctccgacatctctggtggagaaggacaaagagcttccaagggacttcccatacgaggaggattctagaccacgctctcagagtagcaaggccgctattcctcccccggtttatgaggaacaagataggcctaggtccccgacggggcctagcaacagcttcctcgcaaacatgggaggaacagtggctcataagatcatgcagaagtacggcttccgcgaagggcagggtctgggaaaacacgagcagggcctgtcgacagcgcttagcgtggaaaagacttctaagcggggaggctag

SEQ ID NO: 203979 - DNA, 1206 bp, Artificial Sequence
  Description of Artificial Sequence: Synthetic coding sequence
atgagcctgtacgacgacctgggcgtggagaccagcgacagcaagacggagggatggagtaagaactttaaactgcttcagtcccagcttcaggtgaagaaagctgctttgactcaagccaaaagccagaggaccaagcaaagtacagttctggcgcctgttattgacctaaagcgggggggctccagtgacgacaggcagattgttgataccccacctcacgtcgcagctggccttaaggacccggtcccctcaggcttctccgcgggagaagttctgatacctctggccgacgagtacgatcccatgttccctaacgactatgagaaagtagtcaaaaggcagcgggaagagagacagcgccagagagaattagagaggcagaaggagatcgaggagcgggaaaaaaggcggaaggatcggcatgaggcttccggctttgctagaaggccggatcccgactcagacgaagacgaggattacgagagggagcgcaggaagcgctcaatgggaggggccgcaattgcacctccaacatccctggttgaaaaggataaggaactcccaagggactttccgtatgaagaggactccagacctcggagccaaagttcgaaagctgccatccctcctccagtctatgaggagcaggaccgcccacgctccccaactggaccaagcaattcgtttctagctaacatgggtggcactgtggcacacaaaattatgcaaaagtacggattcagagagggccaggggctcgggaaacacgaacaaggactgagtacagccttatcagttgaaaagaccagcaaaagaggcgggaaaattattgttggcgacgcgacagaaaaggatgcgtccaaaaagtcagactccaatcccttaacagagatcctcaaatgccctactaaagtggttcttctgagaaatatggtgggcgcaggggaggtggatgaagacctcgaggtggagaccaaagaggagtgtgagaaatatggcaaggttgggaagtgcgtgatttttgagataccgggcgcccccgacgatgaggccgtgagaatcttcttggagttcgagagagtagaatctgccattaaggccgtcgtggatctcaacgggagatacttcggagggcgagtggtgaaagcttgtttctataacctggacaaattccgcgtcctagacttggccgagcaggtctag

SEQ ID NO: 203980 - DNA, 639 bp, Artificial Sequence
  Description of Artificial Sequence: Synthetic coding sequence
atgagcctgtacgacgacctgggcgtggagaccagcgacagcaagacagaaggttggtccaagaactttaaactgctgcagagccagctccaggtgaagaaagccgcactaacacaagcaaagagccagagaacaaaacagtctaccgttctggccccagttatcgatctaaagcggggcggttcaagtgatgatagacagatagttgatactccacctcacgtcgctgctggtctcaaagacccagtgccctccggtttctccgccggggaggtgttgatccctttggcagacgagtacgaccctatgttcccaaatgactatgaaaaggtcgtgaagagacagagagaagagcgtcaacggcagcgggaactcgagcggcagaaagagatagaggagagggaaaaacggaggaaagacagacatgaagcttcaggatttgcacgtcggcccgatcccgactcagacgaagatgaggactacgaaagagagagacggaagcgctcgatgggaggagcggccattgctcctcctacatcattagttgaaaaggataaggagctgcccagagatttcccgtatgaggaagactcccgcccacggagtcagtcatctaaggccgctatcccaccaccctag

SEQ ID NO: 203981 - DNA, 666 bp, Artificial Sequence
  Description of Artificial Sequence: Synthetic coding sequence
atgagcctgtacgacgacctgggcgtggagaccagcgacagcaagacagagggctggtctaagaactttaaactgctccaatcccaactccaggtgaagaaggccgcgctcacacaagctaagtcccaaaggactaagcagagtacagtgctagcacccgtgatagacctcaagaggggggggtcaagtgatgacaggcagattgtggacacaccaccacatgttgccgctggtcttaaggatcccgttccctccggattttctgcaggggaggttctgatccctcttgccgacgagtatgaccccatgttcccaaacgattacgagaaagttgtcaagcggcagagagaggaacggcagaggcagcgcgagcttgagcggcagaaagaaattgaagagcgagagaaaaggaaagatcgtcacgaagcttctggcttcgcccgccgcccagacccagattccgacgaggatgaagactacgagcgggagcgtagaaagagatcaatgggcggagccgcaatcgcccctcctacttcgctcgtggagaaggacaaagaacttcctagagattttccgtatgaagaggactccaggccacgatcacagtccagcaaagccgccatcccaccaccagtttacgaggaacaggatcgtcctcgctcctag

SEQ ID NO: 203982 - DNA, 732 bp, Artificial Sequence
  Description of Artificial Sequence: Synthetic coding sequence
atgggccgggtgggccgggccggccggagccagcggaccaagcagtccacggttttagctcctgtaatagaccttaaaagaggaggaagtagtgacgatagacagatcgttgatactcctccacatgtggcagcaggacttaaggaccccgtgccctctggcttttcggcaggagaggttctcatacctttggcagatgaatacgaccctatgttcccaaatgattatgaaaaggtggtcaagaggcagcgtgaagagcggcaaagacagcgagagctggagcggcaaaaggaaattgaggagagggaaaaacggcggaaggatcgccacgaagcctctgggttcgcccggcgacctgatccagactcagatgaggacgaagactacgaaagggagcgccgtaagcgcagcatgggtggtgccgctatcgcccccccaacttcgctagtcgagaaggataaggaactcccccgggatttcccatatgaagaggactcccggcctagaagtcagagcagtaaagccgcgatacctccgccagtctacgaggagcaggatagacccagatcccccactgggccttccaacagctttctcgcaaacatgggaggtacagtcgcacataaaatcatgcagaagtacggctttcgagaaggccagggacttggaaagcacgagcaggggctgtcaacagcgctgtcagtcgaaaagactagcaagcggggtggctag

SEQ ID NO: 203983 - DNA, 1206 bp, Artificial Sequence
  Description of Artificial Sequence: Synthetic coding sequence
atgagcctgtacgacgacctgggcgtggagaccagcgacagcaagacagagggatggtccaagaacttcaaacttttacaaagccagctccaagtgaagaaagcagccttgactcaagccaaatcacagcgaaccaagcagtctaccgtgcttgcgccggttatcgacctgaaaaggggaggctcctctgatgatcgacaaatcgtggacacacccccccacgtagctgctggcctgaaggacccagtgccatcaggattctccgctggcgaagttctgatccccctggctgacgaatacgacccaatgtttcccaacgactatgagaaagtggtcaagagacagagagaggaaagacaacggcagcgcgagctggaaagacaaaaggaaattgaagagcgcgagaaaaggcggaaggatcggcacgaggcttctggatttgcaaggaggccagatcccgacagtgacgaagacgaggattacgagcgggagaggcggaaacgaagcatgggaggggctgccattgccccccctacttctctcgtagagaaagacaaggagctgcccagagactttccctacgaagaggattctaggcctagatctcagagttccaaagcggccatcccacccccggtgtatgaagaacaagatcgcccccgatctccaaccggtccttccaacagctttctggccaatatgggcggtaccgtagctcacaagattatgcagaagtacggattccgcgaggggcagggactcggcaagcatgaacaaggactgagtacagccctatctgtggagaaaaccagcaagagaggcggtaaaatcatagtcggcgatgctacggaaaaagatgctagcaaaaaatcggactcaaatccccttacagagattctgaaatgccccacaaaggtggttcttctgcggaacatggtgggggccggagaagtggatgaggacctcgaagtagaaaccaaggaagagtgtgagaaatatggaaaagtggggaagtgtgtgatcttcgaaatacccggcgccccagacgacgaagccgtacgcatcttcttagagtttgaacgcgtcgagtccgctatcaaggctgttgttgacctgaatggtagatattttggaggcagagtggttaaagcatgtttttataatctagacaaattccgagtgttagatctcgctgagcaagtatag

SEQ ID NO: 203984 - DNA, 678 bp, Artificial Sequence
  Description of Artificial Sequence: Synthetic coding sequence
tgacccctggccgacgagtacgaccccatgttccccaacgactacgagaaggtggtgaaaagacagagagaggagagacagcggcaacgagagctcgagcggcaaaaagaaatagaggagcgcgaaaaaagacggaaagaccgacatgaggcaagtggctttgctagacgccctgaccctgactctgacgaagacgaagactacgaaagggagcggcggaagcggtctatgggcggggccgcaattgcccctccgaccagtcttgtggaaaaagacaaggagctgccccgtgatttcccctacgaagaggacagtcgcccaagaagccaaagctcaaaggctgccatccccccccccgtctacgaggaacaggataggccacggagccccactgggccaagcaattcatttctggctaatatgggagggactgtcgcccataagatcatgcagaagtacggattcagggagggccagggactgggcaagcacgagcaggggctgagtacagccctttccgttgaaaaaacatctaaaaggggcggtaagattattgttggggacgccactgaaaaaggggtttcacccggaaagcgggtgaccagaggaaaaggtctcgctccctctatttcagacatggcatcactcgatccacacgtgtctgcgggtggacagtag

SEQ ID NO: 203985 - DNA, 3684 bp, Artificial Sequence
  Description of Artificial Sequence: Synthetic coding sequence
atggtgctggccgccgccatgagccaggacgccgaccccagcggccctgaacagcctgatcgtgtggcttgttccgtgcccggggcacgggctagccccgctccttctggtccaagggggatgcaacaaccacctccacccccacaaccacctcccccaccccaggcgggactacctcagataattcagaacgccgctaagcttcttgacaaaaacccattctcggtgagcaatccaaaccctctcctcccgtcacctgcctcgcttcaattagctcagctgcaggcgcagcttacattgcaccggcttaagctggcacagaccgctgttacaaacaatacagctgccgcaacggttctgaatcaggttctaagcaaagtggcaatgagccagccactgtttaatcaactccgtcacccatctgtgattaccggtccccatggacacgccggggttccccagcacgctgcagccatcccgtctacccgctttcctagtaacgccatcgctttctccccgccatcgcagacaaggggtccgggaccttcgatgaatttgcctaatcaacccccgtccgctatggtgatgcatcctttcaccggcgtgatgcctcaaacccctggccagccagccgtgatcctcggcatcggtaagactggccccgccccagctacagctggattttatgaatacggcaaagcctcttctggccaaacatacggccctgagaccgatggtcagcccggctttctacctagcagtgcctctacttccggctcggtgacatatgaaggtcactactctcatactggacaagatggtcaggctgctttttcaaaggacttttatggccctaatagccaagggagccacgtcgcctcagggttccccgcggagcaggccggtggactcaagtccgaagtaggcccgttgctgcaagggactaattcccagtgggagtccccacatgggtttagtgggcagagcaagccagacttaactgctggtcctatgtggccccccccccacaaccagccatatgaactttatgaccctgaagaacccacaagcgacaggacacctccatcctttgggggcaggctcaataattccaagcaagggttcatcggtgcgggtagacgcgctaaagaagaccaagccctgttgagtgttcggcccctgcaggcacacgaacttaacgattttcatggagtggccccccttcatttgcctcatatctgttccatttgcgacaagaaagtgtttgaccttaaagattgggaattgcacgtcaaaggaaagctgcacgcacagaaatgtcttgtcttcagtgagaacgccggcatccggtgtattctggggtcagccgagggcaccctttgcgcatcccctaatagcaccgctgtgtataatccggccgggaacgaagactacgcgtctaacttagggaccagctatgtgccaattcccgctagaagcttcactcaatcttcacctacattccccttggcgagtgtgggaacaacatttgctcaacgaaaaggtgccgggagggtcgttcacatctgcaatctacctgaagggtcttgcaccgaaaatgacgttataaatctcggcctgccattcggaaaagtcacgaactacattctgatgaaaagtaccaatcaggcttttctggaaatggcctacaccgaggcagcacaagcgatggtccaatattatcaggagaagagcgctgtgatcaacggggagaaactcctgattcggatgagtaagcgctataaagagctacagctgaagaaacccggcaaggcagtcgccgcaattattcaggacatacacagtcagagagaacgcgacatgtttcgagaggctgatcgctacgggcccgagcgaccgagaagccgaagtcccgtgagccggagtctgtctcccagatcccacacaccatccttcacatcatgcagttcatctcactccccacctgggcccagccgggccgattggggaaacgggcgggatagctgggagcactcaccctacgcccgacgggaggaagagcgcgatccagccccttggcgggacaatggggacgataaaagagatcgaatggatccatgggcacatgacagaaaacatcaccctcgtcaattagacaaagccgaactggatgaacgccccgaaggggggcgcccccatcgagagaagtaccctagaagcggcagtccaaatctccctcactccgtgtccagttataaaagccgcgaagatgggtattatcggaaagaacccaaagctaagtgggacaaatacctgaagcagcagcaggatgcccccggacgcagtcgtcggaaggatgaggcgcgactacgagaaagccgccatcctcacccagatgattctggaaaggaggacgggttaggcccaaaggtgacacgggctccagagggcgcaaaagccaagcagaacgaaaagaacaaaactaaacgtactgacagagatcaggagggagccgacgacagaaaggagaacacgatggcagaaaatgaagccggaaaagaggagcaggagggaatggaggagtcccctcagtctgtgggcaggcaagaaaaagaggcggaattcagcgatcccgagaacacaaggacaaagaaagagcaagattgggaatcagaaagtgaggccgagggagagagctggtaccccacaaacatggaggagttagtaaccgtcgatgaggtaggtgaagaagaagactttattgtggaaccagacatccctgaattggaggagatcgtgccaatcgatcagaaagataagatctgcccagagacttgtctctgtgttactactacactcgatctcgacttggcccaggatttccctaaggagggagtcaaggccgtgggtaacggcgccgcggaaatttccctgaaatccccccgggagttgccttcagccagtacttcatgcccttcagatatggatgtggaaatgcccggccttaatctagatgctgagcgaaagcctgcagagtccgagacaggactgtctctggaggacagcgattgctacgagaaagaggccaagggcgtggagtcatccgatgttcaccctgcacccaccgtgcagcagatgagcagtcctaaacccgctgaagagcgagcccgacaaccgagccccttcgtagatgactgtaaaacacgtggcacccctgaggacggtgcttgtgaggggtctccactcgaggagaaggcctctcctccaatcgagactgacctgcagaaccaagcctgccaagaggtcctgactcccgaaaactcacggtatgttgagatgaaatcccttgaagttcgctctccagagtataccgaagtggaattgaaacaacctctgtctctcccaagctgggaaccagaagatgtcttctcagagctctcaatcccccttggagttgagttcgtcgtgccccggactggcttctattgcaagctgtgcggactgttctatacttcagaagagaccgctaaaatgagccactgcaggtcggccgtgcactatcggaacctccaaaaatacctgtctcagcttgctgaggaagggttaaaggagaccgagggggccgattccccgcgccccgaagactccggaattgtgcctcgtttcgaacgaaagaagttatag

SEQ ID NO: 203986 - DNA, 3378 bp, Artificial Sequence
  Description of Artificial Sequence: Synthetic coding sequence
atggtgctggccgccgccatgagccaggacgccgaccccagcggcccggagcagcccgatcgtgttgcgtgcagcgtgcccggagccagagcttccccagctccatcaggacccagggggatgcagcagcctccgcctcccccacagccaccacctccaccacaagcaggattaccacagatcatacagaacgccgctaaactgctcgataaaaacccattcagcgtttccaatcccaacccgcttcttccgagcccggctagcctccagttggcacagctgcaagcccagcttactctccacaggctcaaacttgcccagactgcagtgactaataataccgctgcagctaccgtcctgaatcaagtgttatcaaaagttgccatgtctcagccgctgtttaatcagctgaggcacccttccgtgatcacagggccccatggtcatgcgggggttccccagcatgctgcggccatcccgtccacccgatttccatctaacgccatcgccttctcacccccatcacagacccgaggtcccggcccatccatgaatcttcccaaccagcctccctctgctatggtgatgcatcccttcaccggtgtaatgcctcagaccccaggtcaacctgccgtcatcctcggcatagggaaaactggacctgcccccgcaaccgctggtttttacgagtatgggaaagcatctagcggacagacctatggtcccgagacagacggacaacctggctttcttcccagcagcgccagcacaagtgggtctgttacctatgaggggcattactcacacactgggcaggacggccaggcggcctttagtaaggatttttacggccccaactcccaaggaagtcatgtggcatctgggtttcccgctgagcaggctggtggcctaaaatccgaggtcgggccattgctgcagggcaccaattcacagtgggagagcccacatggcttttccggccagagtaagcctgatcttacagctggaccaatgtggcccccccctcacaatcaaccatatgagttatacgatccggaggagcccacttcggacaggaccccaccctcattcggaggccgactcaataactccaaacaggggtttatcggagcagggagacgggcaaaagaagaccaggctttacttagcgtcagaccgctacaagcccatgagctcaacgactttcacggcgtagcccctctccacttgccacatatctgttctatctgtgacaagaaagtgttcgatctcaaagactgggaactccacgtgaagggaaagctccacgcacagaagtgtctggtattcagcgaaaatgccgggatacgctgtatcctgggtagcgcagagggaacactctgcgcgtcccccaactctacagcagtatacaacccggccggtaacgaagattacgcctcaaacctggggacaagttacgtcccaatcccggctcgctctttcactcagtcctcccctacttttcctctggcctccgtgggcaccactttcgcccaaaggaaaggggctggacgggttgtccatatctgtaacctgcctgaaggttcctgcactgaaaatgacgtgatcaacttgggattaccattcggtaaggtaaccaactacattctgatgaagagcactaaccaggcttttctggagatggcttacacagaggctgcgcaggccatggtccagtattaccaggagaagagcgccgtaattaacggtgagaaactactgataaggatgtcaaaacggtacaaagagttgcagctcaaaaaacccgggaaagcagtggctgccatcatccaggatatccactcacagagggagcgcgatatgttcagagaggcggaccgctacggccctgagagacctcgatcaaggtctcccgttagtcggtcattgtctccacggtcgcataccccaagttttacatcgtgcagcagttcccactcccctcctggcccttccagggcagattgggggaacgggcgggactcatgggagcactctccatatgcccggagagaagaagagagggacccggcaccttggagagataacggcgatgacaaacgcgacaggatggacccatgggcacatgaccggaaacaccatcccagacagcttgataaggccgagttggatgagagaccggagggaggaagacctcatagagagaagtacccaagatccgggtctccaaacctcccccactccgtctcctcctacaaaagtagagaggatgggtattatcgcaaagagccgaaagctaaatgggataaatacctcaagcagcagcaggacgcccctggccggtctaggcgcaaagatgaggctcgccttcgggaatcccggcaccctcatccagacgactctggaaaagaggacggactcggacctaaggtgacacgggctccagaaggtgccaaggcaaagcaaaatgaaaaaaacaagactaagaggaccgacagagaccaagagggggccgatgataggaaagaaaacaccatggccgaaaatgaagctgggaaagaggagcaggagggtatggaagaaagcccccaaagtgtcggacggcaggaaaaggaggctgagttctccgatcccgaaaataccaggacaaagaaagagcaagattgggagtccgagtccgaggctgagggggaaagctggtaccccacgaatatggaggaactggtgaccgttgacgaggtcggcgaagaggaagactttatcgtcgagccagacatccccgagctggaggagattgtacccatcgaccaaaaggacaaaatttgccccgagacctgcctctgtgtcacaaccacactagaccttgatttagctcaggacttcccgaaagaaggcgtgaaagccgtaggtaatggcgccgctgagatttctctgaagtctcccagggagcttcctagtgcttccacctcctgtccctccgacatggatgtggagatgcccggcctaaatttggacgctgaacgtaagccagccgagtccgagaccggcctgtcccttgaggacagcgattgttatgagaaggaggcgaaaggagtcgagtccagcgatgtgcatcccgctccaaccgtacagcagatgtcaagtcccaagcctgccgaggaaagggctagacagcctagcccgttcgttgatgactgtaaaacacgcggcaccccagaagacggagcttgcgagggtagtccactggaggaaaaggctagtccgcccatcgaaaccgacctgcagaatcaagcctgtcaaggttcagacagtgatacccgcctggtttcaggttacagcctcacccctctcgagaaaactcccggtacatggaaatag

SEQ ID NO: 203987 - DNA, 1263 bp, Artificial Sequence
  Description of Artificial Sequence: Synthetic coding sequence
atggccaccagcctgggcagcaacacctacaaccggcagaactgggaagatgccgattttccaatcctatgccagacttgcctgggggagaacccgtatatccgcatgaccaaggagaagtatgggaaagagtgtaaaatctgcgccaggccgttcacagtctttaggtggtgccccggggtgcgcatgagattcaaaaagaccgaggtctgccagacatgcagtaagcttaagaacgtctgtcagacatgcctgctggatctggagtatggactgccaatacaggttagagatgccggcctgtcttttaaggacgacatgccgaaaagcgatgttaacaaggagtactacacgcagaacatggaacgcgaaatttcgaattcagacggcactaggccggtggggatgctcggaaaagcaacttcaacctcagacatgctgctgaaactagcaagaactacaccatattataagcggaaccgaccccatatctgctcgttttgggtcaagggggaatgtaagcggggcgaagaatgtccatacagacatgagaagcccaccgatcccgacgaccccctagccgatcaaaacataaaggataggtactacggcataaatgatcctgtcgcagacaaactgcttaagcgagcatccacgatgcccaggctcgatccccccgaggataagactatcacgactctctacgtgggcggtctcggagatacaattacagagactgatttacggaaccacttttatcagttcggcgagatcaggacaattaccgtggtccagcggcagcagtgcgcttttatccagtttgccacccgtcaggcggctgaagtcgctgccgaaaagtcatttaataaactcattgtgaacggcagaaggttgaatgtgaagtggggaagaagtcaggctgcacgaggcaaagaaaaggagaaagatggcacgactgattctggaattaagctggagccggtccccggactacctggggccctgcctcctccccccgcagcagaggaggaggcatccgcaaactacttcaacttgcccccctcaggtcccccagccgtggtaaacatcgcattgcctcccccgccaggcatcgcgccaccacccccccccggatttggtcctcacatgttccacccaatgggtcccccacctccatttatgcgggcccccggacccatacactacccctcccaggacccacagcggatgggagcacatgctggcaagcactctagtccctag

SEQ ID NO: 203988 - DNA, 1116 bp, Artificial Sequence
  Description of Artificial Sequence: Synthetic coding sequence
atggccaccagcctgggcagcaacacctacaaccggcagaactgggaggatgccgacttcccaattctttgccagacctgcttgggggaaaatccctatatccgcatgacgaaggaaaaatacggattgcccatacaggtccgggatgctgggctgtccttcaaagatgatatgcccaagagcgatgtgaacaaggaatactatactcaaaacatggagcgtgagatttctaattctgatggcactcggccagtaggcatgttagggaaggctacatctacctctgacatgctcctcaaactggcccggacaaccccctattacaagagaaaccggccccatatttgctcattctgggtcaagggcgaatgcaagagaggcgaggagtgtccatacagacacgaaaaaccaacagaccctgatgatcccctggctgaccagaatatcaaagacagatactacggcataaacgatccagtggctgacaaactccttaagcgggcctccaccatgccaaggttggatcctcccgaagataagaccatcaccactctgtacgtagggggactcggtgacacgattacagagacagacctcaggaaccatttctaccaattcggggagattcggactatcaccgttgttcaaaggcagcagtgtgcttttatccagtttgccacgagacaggcagccgaagtggccgccgaaaagtcgtttaataagctgatcgtgaacggtcgacggctgaacgtgaagtggggcagaagtcaggccgcacgcggaaaggaaaaggagaaggatgggaccactgactctggcatcaagttggaaccagtaccaggactgccgggtgccttgccacctccccctgctgcggaggaggaagcttccgctaactactttaacttgccaccatctgggccacccgccgtcgtgaatattgccctgccacccccaccaggtattgcccccccaccacctccaggattcggcccccacatgtttcaccctatggggccacctcctcctttcatgcgtgctcccggtccaatccactatcctagtcaggacccccaacgcatgggtgcccacgccgggaaacattcttcgccctag

SEQ ID NO: 203989 - DNA, 1116 bp, Artificial Sequence
  Description of Artificial Sequence: Synthetic coding sequence
atggccaccagcctgggcagcaacacctacaaccggcagaactgggaggacgccgacttccctattctatgccaaacctgcttaggagagaacccatacattagaatggaaagagagaaatctgggctgccaatccaggtcagggacgctggactgtcctttaaagatgatatgcctaagtcggacgtgaataaagagtattacactcagaacatggaaagagaaatcagcaattcagatggtactcgacctgtggggatgctggggaaggcaacttctacatcagatatgctcttaaaactcgcaaggactacaccttactacaagaggaatcgacctcacatatgctcattttgggtcaaaggcgaatgcaaaagaggagaagagtgtccttacaggcacgagaaaccgacggatccggacgatcctcttgctgaccaaaatatcaaggaccgctattacggaatcaacgacccggtggcagacaaactgctcaaaagggcctcaaccatgccgcggctggatcctccggaggacaagacaatcacgactctgtacgtcggagggctgggcgacaccatcaccgaaacggacctgaggaatcacttctaccaattcggcgaaattcgcactattacggtggtgcaaagacagcagtgtgctttcatccagttcgcgacaagacaggcagccgaggtggccgcagaaaaaagttttaataaacttatagttaacggtagaagactcaacgtcaagtggggacgtagtcaggccgctcgcggcaaagaaaaagagaaagatggcaccactgactcgggtatcaagttggaacctgttcctggattgcccggcgcgttgccgcctcccccagcggcggaggaggaagcctccgcaaactactttaaccttccacccagcggaccacctgccgtagtaaatattgccctgcctccaccacctgggattgctccgcccccacccccaggattcggaccacatatgtttcacccaatggggcctccaccaccatttatgagagccccaggaccaatccactaccctagtcaggacccacagcgaatgggcgcacatgcagggaagcactccagcccctag

SEQ ID NO: 203990 - DNA, 2532 bp, Artificial Sequence
  Description of Artificial Sequence: Synthetic coding sequence
atgagcttccccccccacctgaaccggccccccatgggcatccccgctcttccacccgggatccctccaccgcagtttcctggatttcccccacccgtgccgcctggaaccccgatgatccccgttcccatgagtatcatggccccggcccccaccgtcctcgtaccaacagtgagcatggtaggcaagcacctaggtgcacggaaggaccacccgggtctgaaggcaaaggagaacgacgagaattgcggaccaaccactactgtgtttgtagggaatatcagtgagaaggccagcgatatgttgataagacagctgcttgcaaaatgcggacttgtgttgtcatggaagagggtgcaaggcgcgagcggcaaactgcaggcgtttgggttttgcgaatataaagagcccgaatccactcttagagccctgagattgctgcacgacctacagatcggcgaaaagaagttgttagtcaaggtcgatgctaaaactaaagcccagcttgacgaatggaaagccaagaaaaaggcctcaaacggaaatgcacgccctgaaactgtgaccaacgacgacgaagaggctctggacgaagagaccaaaaggcgagaccagatgattaagggcgctattgaggtacttatacgagagtatagctcagagctgaacgctccttcacaggagagcgattcccatccacggaagaagaagaaggaaaagaaggaagatattttccggcgtttcccggttgcgcccctgataccatatcctctgatcaccaaagaggacatcaatgcaatcgagatggaagaggataagagagatctgatcagccgcgagatatccaagttccgcgatactcataagaaactagaagaagaaaaaggcaaaaaggagaaagagagacaggaaatcgagaaagaaagacgggaacgtgagagggaacgtgagcgggagcgcgaacgacgcgagcgggaaagggagagggagcgtgagagggaaagagaaaaagaaaaggagcgcgaaagagagcgggaacgggaccgagatagggatcgcacgaaggagcgcgatagggaccgagacagggagagggaccgagatagagaccgcgagcgctccagcgataggaataaggatcgttcacgttcgcgtgagaaatcgcgcgatcgcgagcgggagagggagcgagagcgggaaagagagagagaacgcgagagggagagggagcgcgagagggagcgggaacgggaaagggaacgcgaaagagagcgggaaaaagacaaaaagcgtgatcgggaggaggatgaggaggacgcctacgaacgcagaaagttggaacgcaagcttcgagagaaggaagccgcatatcaggaacgcctgaaaaactgggagatacgcgaaagaaaaaaaactagagaatacgaaaaggaagctgagcgcgaagaggagagaagacgagaaatggcgaaagaggcaaaacgcctaaaagagttcttagaggattacgatgacgaccgtgacgaccctaagtactacaggggttctgctcttcaaaaaagactgagggatcgagaaaaagaaatggaagcggacgaacgtgatcggaaacgagaaaaggaggagttagaggagatacgccagcgtctcctggccgaggggcaccctgaccctgatgctgagctccagcgaatggagcaagaagccgagcggagacgtcagccacaaataaaacaagagcctgaatcagaggaagaagaggaagagaagcaggaaaaggaagaaaaacgggaagaacccatggaggaggaagaggaaccagagcagaaaccttgcctaaagcccactctgcggcccatatcttccgccccttcagtttcatctgcgagtggaaacgcgacaccgaatactcctggtgacgaatctccctgcggcatcattatcccccacgaaaacagtcccgatcagcaacagcctgaggagcaccgcccgaagattgggctctcgcttaagctcggagcctctaactccccaggacagcctaattcagtgaaacgcaaaaagctgcctgtcgattcagtgtttaataagtttgaagatgaggactccgacgacgtgcctcgtaaacgaaagctggttccccttgattacggcgaggatgacaaaaatgccacaaagggaactgtgaacaccgaggaaaaaagaaagcacattaagtccctgatagaaaaaatacctaccgcgaagcccgagctattcgcttaccctctagattggtccattgtggattctatcctgatggagaggagaattcgcccatggatcaacaaaaaaatcattgagtacatcggggaggaggaggccaccctcgtggattttgtttgctctaaagtaatggcccacagctctccccaatctatacttgacgatgtggctatggtactggacgaggaggcagaggtatttatcgtgaaaatgtggcggctcttaatctacgagaccgaagccaagaaaatcgggctcgtgaagtag

SEQ ID NO: 203991 - DNA, 384 bp, Artificial Sequence
  Description of Artificial Sequence: Synthetic coding sequence
atgagcttccccccccacctgaaccggccccccatgggcatccccgcattgccccccggcataccacccccgcagttccccggcttccctcccccagtgccacccgggaccccaatgattccagtgcccatgtctattatggcccccgcgccaaccgtgctggtccccactgtctctatggtgggcaaacacttgggagctcggaaagaccatccaggtctgaaagccaaagaaaacgacgagaactgcggtcccactacaacagtgttcgtcgggaacatctcagaaaaggcctcagacatgctgatccgccaactgttagcaaagtgcggactggttttaagctggaagcgcgtgcagggtgctagcggaaagttgcagtag

SEQ ID NO: 203992 - DNA, 903 bp, Artificial Sequence
  Description of Artificial Sequence: Synthetic coding sequence
atgagcttccccccccacctgaaccggccccccatgggcatccccgcccttccaccaggtattccacccccacagttcccaggtttcccaccgcccgttcctcctgggacacccatgatccctgtccctatgagtatcatggcacctgcacccaccgtattggtgcctaccgtgtctatggtcggaaaacaccttggtgctagaaaagaccaccccgggctgaaggccaaggagaatgacgaaaactgtgggccgaccactacggtgttcgtgggtaatatctcagaaaaagcctccgacatgctcatccggcaacttctcgccaaatgtggcttggtactttcttggaaacgcgttcaaggagcttccggcaagctgcaggcctttggcttctgcgagtacaaggaacctgagagtacactgagggctctccggttgctacatgacctccaaatcggagagaagaagctgttagtgaaagttgacgccaagaccaaggcccaactggacgagtggaaagctaagaaaaaagcatctaacgggaatgccagacccgagaccgtgacaaatgatgatgaggaagccctggacgaggagacgaagcgacgcgaccagatgatcaaaggtgctatagaagttctaatcagggaatactcttctgagcttaacgccccaagccaggagtccgacagccatcctaggaaaaaaaaaaaggagaaaaaagaagacatctttcgtcgctttcccgttgcacccctgatcccttaccccttgattactaaagaagatatcaacgcaatcgagatggaggaggataagcgagaccttatttcccgtgaaatttccaaatttcgggatacccacaaagtagtttttctgagttttcacctcatccctatttag

SEQ ID NO: 203993 - DNA, 885 bp, Artificial Sequence
  Description of Artificial Sequence: Synthetic coding sequence
atgagcttccccccccacctgaaccggccccccatgggcatccccgccctgcctcctggcatcccacctccccaattccctggatttccaccgcctgtaccacctggaacacctatgatcccggtgcccatgagtatcatggcccccgcacctacggttctggttccaacggtgagcatggtcggcaagcatctcggagctcggaaagatcaccccgggctgaaggctaaggagaatgatgagaactgtggcccaactactaccgtgtttgtcggcaatatatccgagaaggcctccgatatgctaattaggcagctgctggcgaagtgcggcttggttctgtcttggaagagggtccagggcgcaagcggcaagctgcaggccttcggattctgtgagtacaaggagcctgagagcaccctgcgtgccttgaggctcctacatgacctgcagatcggggagaaaaaactgttggtcaaagtcgacgcaaaaacgaaagcccaactcgacgagtggaaagcaaaaaaaaaagccagcaacggtaacgcccgacccgaaacagtgacaaatgacgacgaggaggccttggatgaagagactaagaggagagaccagatgatcaagggggcgatcgaggtgctcataagggagtacagttccgagctgaatgccccctcccaggagtcggacagtcaccccagaaaaaagaagaaagaaaagaaggaagatatcttcagaagatttccggtggcccccctgattccctaccctctcattacgaaggaagacatcaacgcaattgaaatggaagaggacaagcgagacctgatttcaagagagatttcaaagtttcgcgacacccacaagagatcctacggcgattag

SEQ ID NO: 203994 - DNA, 2532 bp, Artificial Sequence
  Description of Artificial Sequence: Synthetic coding sequence
atgagcttccccccccacctgaaccggccccccatgggcatccccgctctgccaccaggaattccacccccacagtttcctggttttccgccccctgtgcctccagggactcccatgatcccagttcccatgagtataatggccccagcacccacagtgctggtgccaaccgtttccatggtgggaaagcatctaggcgccagaaaggaccaccccggactaaaagccaaggagaatgatgagaactgtggccctaccacaaccgtcttcgttggtaatatttctgagaaggcttcagatatgctgatcagacagctgttagccaaatgtggcctcgtgctgagctggaagagagtccagggtgcctctggcaagctgcaggccttcggcttctgcgaatataaagagccagagtctacactgcgggctctacgactgctacacgacctccaaattggggaaaagaaactcctggtgaaggtggacgccaaaaccaaagcgcagctggacgaatggaaggccaagaagaaagcctctaatgggaacgccaggcctgaaaccgtgacgaacgatgacgaagaagccctggatgaggagaccaagagaagggaccagatgataaaaggagcaattgaagtgttaatccgggagtactcttccgaactcaacgcgccttcccaggaatctgacagccaccctagaaagaaaaagaaagaaaaaaaggaggatattttccggaggtttcccgtggctcctctgataccttaccctctgattacaaaagaagacataaacgcaatcgagatggaagaggacaagcgtgatctgatcagccgtgagattagtaaattccgtgacacccacaagaaactggaggaggagaaggggaaaaaggaaaaagagagacaggagatagaaaaggagcgcagggagagggaaagggaacgggaaagagagcgggaacgcagggaaagagagcgggagagagagagggaaagggagagagaaaaggagaaagagcgggagagagagcgcgagcgggatcgggaccgtgataggacgaaggaacgggatcgcgatagggatcgtgagcgtgatagggatcgcgacagagaacggtctagcgatagaaataaagaccggagccgcagtagggagaagtccagagatcgcgagcgggaacgtgaaagagagcgcgaaagagaaagggagagagagcgtgagagagagcgggagagagagcgcgagcgtgagcgggagagagaacgggaacgggaaaaggataagaagcgtgacagggaggaggatgaggaagatgcgtatgagagaaggaagcttgagcgaaaacttcgcgagaaggaggccgcatatcaagagcgcctaaaaaactgggagatccgcgaacgaaagaagacccgagagtacgagaaagaagctgaaagggaggaggaaaggcgcagagagatggcaaaagaggcaaaacgcctcaaagagtttctggaggactacgatgacgatcgagatgacccaaaatactacagaggaagcgccctgcaaaagcgccttcgcgatcgggagaaagagatggaagccgatgagcgggaccgcaaacgggagaaggaagagctggaagaaatccggcaacgcctactagctgagggccaccctgatccagatgcggaactccagcggatggaacaggaggcagagcggcggcggcaaccacagatcaagcaagagcctgagtcggaagaggaggaggaagagaaacaggagaaggaggaaaagcgggaagaaccaatggaggaggaggaagaaccggaacagaagccttgcctgaagcctacactgaggcccatttcttcagctccctcagttagctctgcttcaggaaacgctacaccaaatacacctggcgatgagtcgccatgtggcattattatcccacatgagaactcaccggaccagcagcagcctgaggagcaccgccctaaaattggcctttctctgaagctcggggcttccaattctcctggccagcccaatagcgtaaagcgaaaaaaactccctgtcgatagtgtcttcaataagttcgaggatgaggactccgacgacgtgccgaggaagcgaaagctggtcccactcgattacggagaagacgacaagaacgctacaaaaggtacggtgaacactgaagaaaagaggaagcacattaagtccctcatcgaaaagattcctacggctaagcctgagctttttgcctacccattggattggtccattgtagacagcattctgatggaacggcgcattagaccttggattaataaaaaaatcatcgaatacattggagaggaggaagctactctcgtcgacttcgtctgttcaaaggttatggcccactcctccccacagtctatcctggacgacgttgctatggtactcgatgaagaagccgaagtttttattgtgaagatgtggcgactgctgatatatgaaacagaggcgaagaagattggacttgtcaaatag

SEQ ID NO: 203995 - DNA, 732 bp, Artificial Sequence
  Description of Artificial Sequence: Synthetic coding sequence
atgagcttccccccccacctgaaccggccccccatgggcatccccgccttgccccccgggatccccccaccacagtttcctgggtttcctccgccggtgccccccggcacacccatgattccggtgccaatgtctatcatggcacccgctcccacagtgctcgtgcctacagtttctatggtgggtaagcacctcggcgcccgaaaagatcacccaggactaaaagccaaagagaatgacgaaaattgtggacctacaaccacggtatttgttgggaacatttccgaaaaggccagtgacatgctgatcaggcagttgctcgccaagtgcggactcgttttgagttggaagcgtgttcagggcgcttccggtaagctgcaggcatttgggttttgcgagtacaaagagccagagtccaccttgcgtgctcttcgcctgctgcacgacctgcagattggagaaaagaaacttctcgtcaaagtcgacgcaaagactaaagcacaactggatgaatggaaggctaaaaagaaggcgtccaatggtaacgcccgccctgagaccgtgacaaatgacgatgaggaggccctagatgaagaaacaaagagaagggaccaaatgatcaaaggagctatagaagtcctgattcgggagtacagctccgagctgaatgccccatcccaggagtctgattctcatcctcgcaagaagaaaaaggagaagaaggaagattag

SEQ ID NO: 203996 - DNA, 885 bp, Artificial Sequence
  Description of Artificial Sequence: Synthetic coding sequence
atgagcttccccccccacctgaaccggccccccatgggcatccccgcactgcccccagggatccctccccctcagtttcctggcttccctccaccagttccacctggcacacccatgattccggtgcctatgtcaataatggcccccgcaccaaccgtgctcgttcccactgttagcatggtgggaaaacatctgggcgcacgcaaagaccacccaggcttgaaggccaaggagaacgatgagaattgcgggcctaccacgactgtattcgtcggaaatatttccgaaaaggcatcagacatgctgatcaggcagctcctagccaagtgtggattggtactgagttggaaaagggtgcagggcgcttccggaaagttgcaggcgttcggcttttgtgaatataaggaacccgaaagcacgctccgggccctgagacttctgcacgacttacagataggagaaaagaaactcctggtaaaagtagacgctaaaaccaaggcccagctggacgaatggaaagctaagaagaaggccagcaacggtaacgctcgacccgaaactgtgactaatgatgatgaggaggccctggatgaagaaacaaaacggagagatcaaatgattaagggcgcaatcgaggtcctgatccgggaatactcaagtgagctgaacgcccctagtcaggagtctgatagccaccccaggaagaaaaagaaggagaagaaggaggacatctttcgacgcttcccagttgccccactgattccataccctctcataaccaaagaggacattaatgccattgaaatggaggaggataagcgtgatcttatcagcagagagatttccaaatttcgggacacccataagcggtcttacggcgattag

SEQ ID NO: 203997 - DNA, 1350 bp, Artificial Sequence
  Description of Artificial Sequence: Synthetic coding sequence
atgctgcccgccgccaccgccagcctgctgggccccctgctgaccgcttgcgcactcctgccattcgcacagggacagactccaaattataccaggcccgtctttctctgtggtggtgatgtgaaaggggaatctggatacgtggcttccgaggggttcccaaacttgtatccgccaaacaaagagtgcatttggactattacggttccagagggtcaaacagtgagcttgagcttccgggtgttcgacttagaacttcacccggcctgtagatatgatgccctggaggtgtttgcgggctccggcacctctggtcagcggctgggaagattctgtggcacattccggccagcgcctcttgtggcaccaggtaaccaagttaccctaaggatgactactgatgaaggaacaggtggcagaggctttctcctctggtacagcggaagagctacatccgggactgagcaccagttttgcggcggacgattagagaaggcacaggggactctaaccacacctaactggcccgagtctgattatcccccgggaattagttgttcctggcacatcattgctcctccagaccaggtaatcgcactcacgtttgaaaagtttgacctcgaacccgatacatattgcaggtacgattctgtgtcagtgtttaatggagctgtgagtgacgattcccgcaggcttggcaagttttgtggagacgccgtgccaggctccatctcttctgaaggcaacgagcttctggtacagttcgtgagcgacctgagcgtaaccgctgatggattctctgctagctacaagaccctgccccgtggtacagccaaggaaggccagggtcctgggccaaagaggggcaccgaacccaaggtcaagttgccccccaagtcccagcccccggaaaaaacagaggagtctcctagcgcacctgacgctccgacttgtcccaagcagtgtcggcgcacaggaactctgcaatccaatttctgcgcctcctctctcgttgttaccgcaactgtcaagagcatggtccgagagcctggagaagggctagctgttacggtctctctgataggcgcctacaagaccggagggctcgatctgccttcaccacctacaggggcgtccctaaaattttacgttccatgcaaacagtgtccccccatgaagaaaggggtttcatatttgctcatgggtcaggtggaggaaaataggggccccgtacttcctcctgagtccttcgttgtacttcatcgcccaaaccaggaccagatccttaccaacctgtccaaacgcaagtgtcctagccagccagtaagggcagccgcatctcaagattag

SEQ ID NO: 203998 - DNA, 1857 bp, Artificial Sequence
  Description of Artificial Sequence: Synthetic coding sequence
atggccggcctgaccctgttcgtgggccggctgccccccagcgcccgttccgaacagcttgaggaacttttctctcaggtaggtcccgtgaaacagtgtttcgtggtaacagagaagggcagaaccgtggctgtggattgggcggtggccaaagacaagtataaggacactcagtcagtgtccgcaattggcgaggagaaaagtcatgaatcaaagcaccaggagtcagtgaagaaaaaagggcgggaggaggaagatatggaggaggaagaaaacgacgacgatgacgacgacgatgacgaggaggacggagtattcgacgacgaagacgaagaagaggagaatatcgagtcgaaggtgacaaagcccgtacagatccagaagcgcgcagtaaagagacctgcacctgcgaaatcaagcgaccactctgaagaagactccgatctcgaagaatccgacagcatagacgacggagaggagctcgcccagtccgacaccagcaccgaggagcaggaagataaagccgtgcaagtttctaacaaaaagaagaggaagctaccttcagacgtgaacgaaggcaaaacagtatttattaggaacctgtctttcgattctgaagaggaagagctgggagagctccttcagcagttcggggaacttaaatatgtcagaatcgtgctacacccggatacagaacatagtaagggatgcgcgtttgcccagttcatgactcaggaagcagctcaaaagtgtctgcttgccgcatctccagaaaatgaggccggcgggttaaagttggatggccggcagttaaaggtggacctggccgtgacgagggacgaggctgccaaactgcagactacaaaggtgaaaaaacccaccggcacccggaatctatatctggctcgcgaaggtttgattcgagccgggaccaaggcagctgagggcgtcagcgctgcggatatggcaaaacgggagcgctttgaactgttgaagcaccagaagttaaaggaccagaacatcttcgttagcaggactagattgtgcctccataacttgcccaaggccgtggacgataaacagcttcggaaacttttgttgtccgcaaccagtggggaaaagggcgtccgaattaaggagtgtagggttatgcgggacttgaaaggcgtgcacgggaatatgaagggacagtcactgggctatgcattcgcggagtttcaggaacacgagcatgcactgaaggccttaagattgattaataataatcctgaaatatttggcccccttaaacggcccatcgtcgagttctctctcgaagatcgccgcaagcttaagatgaaggaactgagaatccagcggagtctgcaaaaaatgcgttccaagcctgccactggcgagccacagaaaggccagcccgagccagcgaaagaccagcagcaaaaggctgctcagcatcataccgaagagcagtctaaagtgcctccagagcagaagcgaaaggctggctcaacctcctggaccggattccaaactaaagcagaggtagaacaggttgagctgcccgacggtaagaaacgacgtaaagtgctcgccctcccaagccacagggggcccaaaatccgcctgcgagataagggtaaggtgaaaccagtgcaccctaagaagcccaagccacagatcaaccagtggaaacaggaaaagcagcagctcagctccgagcaggtgtcccgaaaaaaagctaaaggtaataagacagagactagattcaatcagttggttgagcagtataagcagaaattgctgggcccctccaagggcgctcctcttgccaaacggtctaagtggttcgacagttag

SEQ ID NO: 203999 - DNA, 720 bp, Artificial Sequence
  Description of Artificial Sequence: Synthetic coding sequence
atgctgctgcagcccgccccctgcgcccccagcgccggcttccccagacccctggccgcccctggggccatgcacggatcccaaaaagacacgacgttcacaaaaatttttgtaggcggattaccataccataccactgacgcctcacttcggaaatattttgaggggttcggggatatagaagaggctgtcgtgatcacggataggcaaacaggcaagtctaggggctatggttttgtcaccatggctgaccgggccgccgccgagcgggcctgcaaggatccaaaccctatcatcgatggccgaaaggccaacgttaacctggcttacctgggagccaagccccgcagtttacagactgggttcgccataggcgttcagcagctccatcccactctcatccagcgcacctatggtctgaccccacactacatttatcctcctgcaatcgtgcagccttctgttgttatccctgcggctcccgttccctcactgtcctctccctatatcgagtacaccccagcctcccctgcctacgcccagtatcctcctgctacttacgaccagtacccatacgcagcttccccggctacagctgcttcattcgtcggatactcttacccagcggccgttccccaggcgctgtctgcagctgctcctgccggaactacattcgttcagtaccaggcacctcagctgcaacccgacagaatgcaatag

SEQ ID NO: 204000 - DNA, 477 bp, Artificial Sequence
  Description of Artificial Sequence: Synthetic coding sequence
atggccgaccgggccgccgccgagcgggcctgcaaggaccccaaccccattattgatggaaggaaagccaatgtcaacctggcttacttgggagcaaagccaagatcactgcagacgggttttgcaatcggtgtacaacaactgcatccgactctgatccagagaacctacggcctcacgcctcattacatataccctccagccattgtgcagccctctgtcgtgatacctgccgcaccagtccctagcttgagcagtccttacatcgagtacacacctgcctcacctgcgtatgcccagtacccccccgccacctacgatcagtatccctacgccgccagcccggcgacagccgcctcatttgtgggttacagttacccggctgccgtaccgcaggctttgagcgcagctgcccctgcgggcaccacgtttgtacagtatcaggcaccgcaattgcagccggaccgcatgcagtag

SEQ ID NO: 204001 - DNA, 366 bp, Artificial Sequence
  Description of Artificial Sequence: Synthetic coding sequence
atgctgctgcagcccgccccctgcgcccccagcgccggcttcccccgaccactggcagctcctggggcaatgcacggcagccagaaagacaccaccttcactaaaatatttgtcggcgggttgccctaccacacgacagatgctagtctgcgcaagtacttcgagggctttggggacattgaagaagcggtggtgataacggatcgtcagactggaaaaagtagaggctatgggtttgtcaccatggcggaccgcgccgccgcagagagagcgtgcaaggatccaaacccaatcatcgacgggcggaaagcgaacgtgaacttagcctacctgggagctaaaccccgttcactgcagacgggatag

SEQ ID NO: 204002 - DNA, 1095 bp, Artificial Sequence
  Description of Artificial Sequence: Synthetic coding sequence
atggtgaagctgttcatcggcaacctgccccgggaggccaccgagcaagaaattagaagtctgttcgagcagtatggtaaagtgttagaatgtgatatcatcaaaaactatgggttcgtgcacatcgaggataaaacggcagccgaagatgccattcgtaacctgcaccattataagctccatggggtgaatataaatgtcgaagcctctaaaaacaagagtaaaacttccacaaaactgcacgtcggcaacatctccccaacatgcactaataaagagctccgggcaaagttcgaagagtacggacccgtaattgaatgtgatattgtcaaagactatgcttttgtccacatggaacgtgcggaagacgccgtcgaggccatccgcggtctcgataacacagagttccagggaaaaaggatgcacgtgcaactgagcacttcacgattgaggacagcgcccgggatgggagatcagtctggatgttacagatgtggaaaggaaggtcattggtctaaagaatgccccatcgatcgatctggaagggtcgctgacctgaccgaacagtataacgagcaatatggagccgtcaggaccccctataccatgtcttacggtgacagtctttactacaataatgcatacggagcccttgatgcttattacaagcggtgccgggcagcgcggtcatacgaggctgtggcggccgccgctgcttctgtatataactatgcggaacagacgctgtcccagttaccgcaagtgcagaataccgcgatggccagccacctgacctccacctctttagacccgtacgacaggcacctgcttcctaccagcggggcagccgcaacggccgcggcagctgccgctgccgctgccgctgtgactgctgccagtacctcctactacggccgtgatcgatcacccttgcggagggctactgcccccgttccaactgtgggagaggggtacggctacggccatgagtcggaactctcccaagcttccgctgccgcgcgtaacagcctatatgacatggccagatacgagagggagcagtatgccgatagagcacggtacagcgccttctag

SEQ ID NO: 204003 - DNA, 1095 bp, Artificial Sequence
  Description of Artificial Sequence: Synthetic coding sequence
atggtgaagctgttcatcggcaacctgccccgggaggccaccgagcaggaaattcgatccctatttgaacaatacggaaaggtgctggagtgcgatattatcaaaaactatggattcgtccatatagaagacaaaacagccgccgaggacgcaatcaggaacctgcatcattacaagctccatggagtgaatattaatgtagaagcctccaagaacaaatccaaaacgagcaccaagttacacgtgggtaatatttcaccaacttgcacgaataaagagctgagggcaaaatttgaggaatatggacctgtgatcgaatgtgatatagtgaaagattacgcttttgttcatatggaacgggctgaggatgctgtggaggcaataaggggcctggataacaccgaattccaaggcaagcgaatgcatgtacagctgagcactagcagactacgtacggcacctggaatgggtgatcagagtggatgttacaggtgcggtaaagaggggcactggagtaaggagtgcccaatcgaccgctccggccgtgtggctgacctgaccgagcagtataatgagcagtatggcgccgtcaggactccttataccatgtcctatggcgattcactgtattacaacaatgcatatggcgcactggatgcatattacaagcggtgtagagcagcccgatcctatgaggcagtcgctgcagcagctgcctctgtgtataattacgcggaacaaaccctctcccaactgcctcaggttcaaaacactgctatggcaagtcatttgacatccacgtctcttgatccgtatgatagacacttacttccaacctccggcgctgctgctaccgctgccgcggctgcggcagctgcagcagccgtcacggcagcgagcacttcttattacggccgggaccggagtcctctccgccgtgcaaccgcccccgtccctaccgtgggagaaggttatggctacgggcatgagtccgagctgtcccaggcctctgctgccgcccgcaacagtctgtatgacatggcaagatatgagcgggagcagtacgccgatcgggcacggtactccgccttttag

SEQ ID NO: 204004 - DNA, 1095 bp, Artificial Sequence
  Description of Artificial Sequence: Synthetic coding sequence
atggtgaagctgttcatcggcaacctgccccgggaggccaccgagcaggagattcgcagtttatttgagcagtatggaaaagtgctagagtgcgacatcatcaaaaattacgggttcgtgcacatcgaggacaagaccgccgccgaggacgcgatccgaaatctgcatcattataaactccatggcgtgaacatcaacgttgaggcctccaaaaataagtccaaaacatctacaaaactgcatgttggcaatataagccctacttgcaccaataaagaactgcgagccaagtttgaggaatatggacccgtgattgagtgcgatattgtcaaagactatgcgttcgtgcatatggagcgggctgaagatgccgtggaggctatcaggggcctggacaacaccgaattccaagggaagaggatgcacgtccagttatctacctccagactgcgcacagccccagggatgggcgatcagtccggatgttacagatgtggtaaggaaggtcactggtcaaaggagtgtccaattgacaggagtggaagggtagccgacttaaccgaacagtataatgagcagtatggcgccgtaagaaccccatacacaatgtcctacggggattctctgtattataataatgcttacggtgcactcgacgcttattacaagaggtgtagggctgcccgttcatacgaggccgtggctgcggccgcagcttccgtctacaattacgctgagcaaacgttatctcagttgccccaggtccaaaatacggccatggcgagccacttaacatcgacctctctcgacccgtacgacagacatcttctgccgacctctggcgcggctgccaccgctgccgccgccgcggcagccgctgctgcggtgactgctgcgtctacctcttactacggacgagaccgttcccccctgcgccgggcgaccgcaccagtccctacagtgggtgaagggtacggctacgggcacgagagcgaactcagccaggcaagcgccgctgcccgaaattcactgtatgacatggcccggtatgagagggaacagtacgccgacagggcccggtattcagctttttag

SEQ ID NO: 204005 - DNA, 534 bp, Artificial Sequence
  Description of Artificial Sequence: Synthetic coding sequence
atggtgaagctgttcatcggcaacctgccccgggaggccaccgagcaggaaatccgatctctgttcgaacaatatgggaaggttctagagtgtgacatcatcaagaattacggctttgtgcatatagaggataaaactgccgccgaagacgccattaggaacctccatcactacaaactccacggggtgaacattaacgtggaagccagcaagaataagagcaaaaccagcacgaaactgcacgtcgggaatatttccccaacctgcaccaacaaggagctgagggccaagtttgaagagtatgggccagtcatcgaatgtgatatcgtaaaggactatgcatttgtgcatatggagagggctgaggacgcagtcgaggccatccgcggcctggataacactgaattccagggggaaccaccttcactaggccggggactcaatactcgcttatgcgctgaaaatgggtggatctccaaacgccgaggcttagtcaaaataaccgctgtcgggtggcttgtgatgaagaagtag

SEQ ID NO: 204006 - DNA, 534 bp, Artificial Sequence
  Description of Artificial Sequence: Synthetic coding sequence
atggtgaagctgttcatcggcaacctgccccgggaggccaccgagcaggagattcggagcctcttcgagcagtatgggaaagttctggaatgtgatattattaagaactacggctttgtccatatcgaggacaaaaccgccgctgaagatgccattaggaatctgcatcattataaactccacggagtgaacatcaatgtggaggcttccaagaataagtccaaaactagcactaaactgcacgtgggcaatattagcccaacatgtaccaataaagaactgcgcgctaaatttgaggaatatggcccagtcatcgaatgtgacatcgtgaaagattatgcctttgtgcatatggaacgagccgaagatgctgttgaggctattcgcgggctggacaacacggagtttcagggtgagcctccatctttaggaagagggctgaataccagactgtgtgctgagaacggatggatctctaaaaggcgggggttggtgaaaataacagccgttggatggttggtgatgaagaaatag

SEQ ID NO: 204007 - DNA, 522 bp, Artificial Sequence
  Description of Artificial Sequence: Synthetic coding sequence
atggtgaagctgttcatcggcaacctgccccgggaggccaccgagcaggagatcaggagcctttttgagcagtatggtaaagtgctggagtgcgacatcattaagaactatggatttgtgcatatagaggataaaacagctgcagaggatgctatcaggaatctgcaccattataaacttcatggggtaaacatcaatgtggaagcttccaagaataagtccaaaacaagtacaaaactccacgtgggtaacatttcacctacctgcactaataaggagctccgcgctaagtttgaagaatacggcccagtgatcgaatgcgatatcgttaaggattatgccttcgtgcacatggaacgtgctgaggacgcggtggaagccatccgggggctggacaacaccgaatttcaagggaaaataacacctgtcaccgaaggctactgctgctgcaataagggccacacatacatattcaagaactgcaacctgatcctggaatccagaaagagccggcgctgttag

SEQ ID NO: 204008 - DNA, 432 bp, Artificial Sequence
  Description of Artificial Sequence: Synthetic coding sequence
atggtgaagctgttcatcggcaacctgccccgggaggccaccgagcaggagatccgatcactatttgagcagtacggcaaagtgttggaatgtgacatcatcaagaactacggattcgttcacattgaggataagactgctgcggaggacgcaatcaggaatctccatcattacaagctccacggcgtgaacattaatgtggaggcaagcaaaaacaaaagtaaaacctccacgaaattgcacgtcggcaatattagtcccacatgtactaataaagaattgagagccaagtttgaagagtacggacctgtgattgagtgtgacatcgttaaagattatgctttcgtgcacatggagcgcgcagaggacgctgtagaggcaatacgcggactcgataacactgaatttcagggggggatgtgcgttgggtag

SEQ ID NO: 204009 - DNA, 1443 bp, Artificial Sequence
  Description of Artificial Sequence: Synthetic coding sequence
atggccggcgccggccccgcccccggcctgcccggcgccggcggccccgtagtgccaggccccggggccggcattcccgggaagagcggggaagaacgcctgaaagagatggaggcggagatggctttattcgagcaagaggtcttaggcgccccagtcccagggattcccaccgcggttccagccgttcctaccgttcctacagtccctacggtggaggccatgcaggtacccgcagcacccgttatcagaccaataatcgctacaaatacctaccaacaggtgcagcagacgttggaggctagagccgcggccgcagcaactgtggtaccgccaatggtgggcggccctcctttcgtggggccggtaggattcggtccaggcgaccgatcccacttagatagccctgaagctcgagaggctatgtttctccggcgcgcggccgtggcgccacagcgtgcccctatcctgcgtccagctttcgtcccccacgttttacagagagccgactccgccttgtcttcagcagccgcaggccccagaccgatggcccttcggccccctcatcaggccctggtgggacctccgcttccaggacctcctggtccacctatgatgctcccccctatggcccgtgcacccgggcctcccttggggagcatggccgccctgcgcccaccattagaagagccagctgcaccaagagaacttggactcggccttggcctgggtctgaaggagaaagaagaagctgttgttgccgccgccgccgggctcgaggaggcctccgctgccgtcgctgtcggggcaggtggcgccccggccggaccagctgtgattggcccaagtctgcctctggccctcgctatgcccctgccagagcccgagccactgccgttgccgctcgaagtggttcgaggcttgctccccccactcaggatccccgaactgctgtctctgagaccacggcctcgaccaccaagacccgagccgcctcctggcctcatggccctagaggtgccagaaccactaggggaagacaagaaaaagggtaaacccgagaaacttaaaagatgcatacgcactgccgccggctctagttgggaagatcctagcctcctggagtgggatgcagacgatttcagaatcttttgcggggatttaggaaacgaggtgaacgatgatatcttggctagggctttttcgagattcccgtcattcctgaaggccaaggtcatccgggataagaggactggtaaaacaaaaggctatgggtttgtgagcttcaaggaccctagcgactatgttcgggccatgagggagatgaatggaaagtacgtggggtccaggccaatcaaactgagaaaatcaatgtggaaggacaggaacttggatgtggtgagaaaaaagcagaaagagaaaaaaaaactcggtcttaggtag

SEQ ID NO: 204010 - DNA, 1356 bp, Artificial Sequence
  Description of Artificial Sequence: Synthetic coding sequence
atggccggcgccggccccgcccccggcctgcccggcgccggcggcccagttgttccagggcctggcgctggcattccaggaaaatctggggaggagcggctgaaagaaatggaggctgagatggctcttttcgagcaggaggtgctgggcgcccctgtacccggaatacccactgctgtcccagctgtacctactgtgccaacggtgccaactgtggaggccatgcaggttcctgccgcccccgtgattagacctatcatcgcaacaaatacttaccagcaagtccagcagacgcttgaagctcgggcggcagccgctgcaactgtggtgccacctatggtgggaggacctccattcgttggacccgtggggttcggccccggcgaccgatctcatcttgactccccagaagcacgcgaagcaatgtttttgcgacgcgcagcagctgggccacgccctatggccctgaggcccccccaccaagcccttgtaggccctcccttgcctgggccacctggtcctcccatgatgctgccgccaatggctagagcccctggacctccacttggatccatggcagcgctcagacctcccctcgaggaacccgccgcgccaagagaactggggctgggcctcggtctgggactcaaggagaaggaagaggccgtggtggcagccgccgcggggctcgaagaagcctctgcggcagtggctgtgggagccggaggagcccctgcaggcccggccgtgataggtccttcattacccctcgctctcgcaatgcccctgcccgaacctgaacctctgcccttgcctttggaggtcgtccgagggctgctgccgcccctgcggattcctgagctgctgtctcttcgacccaggcctcgacctcctcggcctgaacctccccccgggttgatggcgctggaagttcccgaacctctgggcgaggacaagaagaaagggaagcccgagaaactgaaaagatgtatacgcaccgctgcgggatcttcttgggaagacccaagcttgttggagtgggatgccgatgatttcagaatattttgcggcgatttaggaaatgaagtgaacgacgacatcctagcccgggctttctctcggtttccaagtttccttaaagcaaaagtcatacgcgataaaaggaccggcaagaccaaaggatacggcttcgtaagcttcaaggaccctagcgattacgtgcgggccatgagagagatgaatggtaaatatgtgggaagtcggcctatcaagctaagaaaaagtatgtggaaggaccggaatttagacgtggtccgaaagaagcagaaggaaaagaaaaagctgggcctgagatag

SEQ ID NO: 204011 - DNA, 801 bp, Artificial Sequence
  Description of Artificial Sequence: Synthetic coding sequence
atgggcgccgccgccgccgaggccgaccggaccctgttcgtgggcaatctggaaactaaagtgacagaggaactcctattcgagttgtttcatcaggccgggccagtgatcaaggtgaaaattcccaaagacaaggacggcaagcccaaacagtttgccttcgtcaacttcaagcacgaggtgtctgtgccctacgccatgaacctgttgaacggcatcaaactgtacgggagacccatcaaaatccagtttagatcagggtctagccacgctccgcaggacgtttcattaagttaccctcagcaccatgtaggtaatagtagcccaactagcacctcacctagccgctacgagaggaccatggataacatgacttcgtccgcccagattatccagagaagcttcagtagccctgagaattttcagcgacaggccgtcatgaatagtgcactgcggcagatgagctacggaggcaaatttggaagctccccactggatcagtctgggttctccccgtcagtgcagagtcatagccactcttttaaccaatcctcatctagtcagtggcggcagggcactccctcttcgcagcgcaaagtgaggatgaactcctacccatatttggctgatcggcactactcccgagagcagcgctataccgatcacggatccgaccaccactataggggaaagagagatgacttcttctatgaggacagaaaccacgacgactggtcacatgattacgacaacaggcgcgattctagtcgggatgggaagtggaggagtagccggcattag

SEQ ID NO: 204012 - DNA, 525 bp, Artificial Sequence
  Description of Artificial Sequence: Synthetic coding sequence
atggccgacgtgctggacctgcacgaggccggcggcgaggacttcgccatggacgaggacggcgacgaatcaatccacaaactaaaagaaaaggccaagaagcggaaagggcgaggatttggatctgaggaagggagccgcgcccggatgagagaagattatgatagcgtggagcaggatggagatgaacctggcccccaacggtcggttgaaggctggatcttatttgtaacaggcgttcatgaagaagctacggaggaagacatccatgataagtttgccgagtacggcgagatcaaaaatattcacctcaacctagatcggagaaccgggtatcttaaaggttatacattggttgaatatgagacctacaaagaagcccaggccgcaatggaagggctgaacggacaggatctgatggggcagcctatctcggtggattggtgcttcgtgagggggccaccgaagggaaaacggcggggtggcaggaggcgctcccgttccccggatcgcaggcggcggtag

SEQ ID NO: 204013 - DNA, 522 bp, Artificial Sequence
  Description of Artificial Sequence: Synthetic coding sequence
atggccgacgtgctggacctgcacgaggccggcggcgaggacttcgccatggacgaggacggtgatgaatcgattcacaaactgaaagaaaaagcaaagaagcggaagggaagaggtttcggctctgagggctctcgggccagaatgcgggaggactacgacagcgtagagcaggacggggatgaaccagggccacagcggagtgttgaaggctggatattgttcgtcaccggcgtgcatgaggaggcgaccgaggaggatatccacgataagtttgccgaatacggtgagatcaagaatatacatctcaacctagacaggcgcactggttacctgaaggggtataccctggtggaatacgagacgtacaaggaagcccaggctgccatggagggacttaacgggcaggacctgatggggcagcctatctcagtcgattggtgtttcgtgagagggcctcccaagggcaagagaaggggcggtaggcgtaggagccgctctccagatcgccggagacggtag

SEQ ID NO: 204014 - DNA, 1179 bp, Artificial Sequence
  Description of Artificial Sequence: Synthetic coding sequence
atggtggaggccgaccggcccggcaagctgttcatcggcggcctgaatctggagactgacgaaaaggcactcgaggccgagttcgggaaatatgggaggattgtggaggtgctcttaatgaaagatcgtgagaccaacaagtcgcgcggattcgcgttcgtcacattcgaatcacccgcagatgccaaggccgctgcccgtgatatgaacggcaaaagcttagacggcaaagccattaaggtcgctcaggctactaaacccgccttcgagagttctcgccgtggcccacccccacccagaagtcgtggtaggcctcggttcctcagagggacccgcggcggcggcgggggaccacggcggtccccgagtcgtggaggtcccgacgatgatgggggatacacggccgatttcgacctgcggccatccagggctcctatgcctatgaaacgcgggcctcccccacgacgtgttggcccccccccaaaaagggcggccccaagcggaccagcgagatcatcgggggggggaatgagaggaagagccctcgctgtcagaggacgtgatggatactcaggcccaccaagacgggagccactccctcctagaagggatccctacttaggccctcgggatgaggggtacagcagtcgcgacggatatagtagccgcgattatcgcgaacccagaggctttgccccaagccccggagagtacacccaccgcgactacgggcattccagtgttcgcgatgattgcccactgcgcggttattccgaccgcgacgggtatggagggagagaccgcgactacggcgaccacctcagtagagggtcccaccgcgaaccatttgagagctatggcgagctgcgcggggcagccccaggacgggggacaccacccagttacggtggtgggggccgatacgaggaatatcgtgggtactcccctgatgcctattctggtggccgggactcctactcgtcttcatacggacggtccgataggtactcacgcggccgccacagagtcggccggcctgaccggggcctgagcctgtccatggaacgaggctgccccccacagcgggatagctactcgcgatctggatgcagggttccccgtggaggggggcgcttaggcgggagactggaacgggggggcggacgctcgcggtactag

SEQ ID NO: 204015 - DNA, 1491 bp, Artificial Sequence
  Description of Artificial Sequence: Synthetic coding sequence
atggtggaggccgaccaccccggcaagctgttcatcggcggcctgaaccgggagaccaacgagaaaatgctgaaagccgtattcggcaagcacggacctatatccgaagtcctccttatcaaagacaggaccagtaaaagccgaggattcgccttcatcacctttgaaaatcctgcagacgccaaaaatgccgccaaagatatgaacgggaaaagcctacacggcaaggcgattaaggtggaacaagcaaaaaagcccagcttccagagcggcgggcgcaggaggccacccgctagtagtagaaacaggagcccctccgggtccctacggtcagcgaggggctcccgtggagggaccaggggatggctgccctcacacgaaggccatctcgatgatggcgggtatacacctgacttgaaaatgtcttactcaaggggtctcatccccgtgaaacgcggcccttcttcccggtccggaggtcctcctccaaagaagtctgccccaagcgcggtggcccgctcaaattcatggatgggctctcagggtcccatgagccagcgcagagagaactacggcgtgccccccagaagggcaacgatctccagttggcgcaatgacaggatgtctaccaggcacgatggatacgctacaaatgacggaaatcacccaagttgccaggagaccagagactatgctcctccctcaagaggctatgcctatagggataacggccactcaaatagagacgaacacagttcacggggttaccgcaaccacagaagtagcagggagactcgggactatgcaccacccagtcggggtcacgcctatcgggattatgggcattctcggcgagacgaatcatacagtagaggttaccggaacagacgttcttctcgcgagaccagggagtacgctcctcccagtcggggacacgggtaccgagactacggacacagtcgccgacatgagtcttattcaagaggataccgcaaccatcccagctcgagagaaactagggattacgcacccccccaccgtgattacgcctacagagactatgggcactcctcatgggacgaacactcctcgagagggtactcctatcacgacggatacggcgaggccctgggcagagatcattctgaacatctgtctggttctagctatcgggacgctctacagcgctatggaacatcccatggagctcccccggctcggggccctcgtatgtcttacggcggctccacgtgtcacgcctactctaatacccgcgatcgctacggccgatcctgggaatcatatagctcttgcggcgattttcactattgcgatcgcgagcatgtctgtaggaaggatcaaaggaatccaccgagcttgggaagagtgctgccagacccccgagaggcttgcggcagttcgtcttacgtggcctccatagttgatgggggagagtcgcgctccgagaagggggacagctcaagatattag

SEQ ID NO: 204016 - DNA, 1491 bp, Artificial Sequence
  Description of Artificial Sequence: Synthetic coding sequence
atggtggaggccgaccaccccggcaagctgttcatcggcggcctgaatagagagacaaacgagaaaatgttaaaggccgttttcggaaagcacggacccatctctgaggtgctgttgataaaggaccgcaccagcaaatcgagaggatttgcttttattaccttcgagaatcccgccgatgcaaagaatgcagcaaaagacatgaatggcaagagtctgcacgggaaggctatcaaggtcgagcaagcaaagaagccctcctttcagtctggcggccgtcgtcgccctcccgcctcgtcccgcaacaggagtccttctggctcgcttaggagtgctaggggttctagaggcggtactcgaggctggctgccaagccacgaaggacacctagacgatggaggttacacacctgaccttaaaatgtcctattctcgcggattgataccggttaagagaggccctagcagccgatccggggggcccccacccaaaaagtccgccccctccgccgtggcacgctctaactcatggatgggtagccagggaccgatgtctcagcgccgtgaaaattacggagtgcctccacgcagagctacaatctctagttggcggaacgaccggatgagcacaaggcatgatggctatgccactaatgacggaaatcatcctagctgccaagagacacgagactatgcgccgccatcccggggctatgcctacagggacaacggccattccaaccgcgatgagcactcctcacgcggctatcgcaatcaccggagtagtagggaaacacgtgattatgccccaccctctagaggacatgcctatcgcgactacggacatagtagacgggacgaaagttatagtcgggggtaccgtaatagacgctccagtagagagacacgagagtacgcacccccctccaggggccacggatatcgggattatgggcacagccgccgccacgagtcctatagccgcgggtatagaaaccaccctagttcgagggaaacaagagactacgctcctccgcatagagactatgcataccgggattacggccactctagctgggacgagcattcgtctaggggatattcctaccacgacggctacggtgaggcactcggccgtgaccactccgagcacctgagcgggtcctcatatcgcgatgctctccagcgctacgggacctctcacggtgccccaccagcccgggggccaaggatgtcatacgggggcagtacgtgccatgcttacagtaataccagagaccggtacgggcgctcgtgggagagttacagttcatgcggcgacttccattactgtgaccgagaacacgtttgcagaaaggaccagagaaatcccccatctctcggccgagttctccctgatcctagagaagcatgtggcagtagcagctacgttgcgtctatcgtagacggcggcgaatcccggtctgaaaaaggtgattcgtctaggtactag

SEQ ID NO: 204017 - DNA, 870 bp, Artificial Sequence
  Description of Artificial Sequence: Synthetic coding sequence
atgagcacccggcacgacggctacgccaccaacgacggcaaccacccttcttgtcaggaaacccgcgattatgcgcccccctcccggggatacgcttatcgcgacaacgggcatagcaatcgggacgaacactcaagtagagggtacagaaatcatcgaagtagtagagaaacgagagactatgccccaccttcacgagggcacgcgtatcgcgactacggccattctcgtcgggacgagagttactcaagaggttataggaaccgcagaagctcgagggaaacccgggaatatgcccccccctccagagggcacggctaccgggactacgggcactcacgaaggcatgagtcctatagccgggggtatcgcaaccacccttcaagtcgggaaactcgcgattacgctccccctcaccgcgactacgcatacagagactacggccactccagctgggacgaacattctagccgaggttactcctaccatgatggttacggggaggctctgggcagggaccattcagagcatctctctggatcctcttacagagacgctttgcagaggtacggtacaagtcacggtgctccacccgccagaggccccagaatgtcatacggaggtagcacttgtcacgcctatagtaataccagagatcggtacggccggtcctgggaatcatattccagttgcggggactttcactactgcgatcgtgagcatgtgtgccgcaaagaccagagaaatcctccgagccttggacgggtgttaccggaccctcgcgaggcctgcggcagctcatcttatgtcgccagcatcgtagacggaggagagtccagatctgaaaagggtgacagctcaaggtactag

SEQ ID NO: 204018 - DNA, 1266 bp, Artificial Sequence
  Description of Artificial Sequence: Synthetic coding sequence
atgggcaagcggctggaccagccccagatgtacccccagtacacctactattatccgcattatctgcaaacaaagcagtcttatgccccggctccacatccaatggctccaccctcaccctctacaaattcttcaagcaataactccagcaacaattcgtcgggggagcaattgtccaagaccaacctgtacattcgaggactccctccgggaactactgatcaggatttaattaagctttgccaaccttacgggaagatcgttagtacgaaagctatccttgataaaaataccaatcaatgcaaaggctatgggtttgtggactttgattcaccggctgctgcgcagaaggccgtggcatctctgaaagccaatggagtccaggctcagatggcaaagcagcaggagcaggaccccacgaatctctacatttccaatctgccaatctctatggacgagcaggaactggaaaacatgttgaaaccattcggccatgttatttccactcgcatcctccgagatgctaatggcgtgagccggggcgtaggattcgcacggatggaatctaccgaaaaatgcgaagttgtgattcagcactttaacggcaagtacctcaaaacaccacccggtatacctgcccccagcgagcctctcctgtgcaaattcgctgatggcggacagaagaagaggcagaaccagtcaaagtacacccagaacggccgtccatggccccgggagggagaggccggaatggcactaacgtatgatcccacagcagctatacaaaatggtttttatagctccccttactccatcgcaacgaaccgaatgattcctcaaacctccattactccattcattgctgcttctcctgtctcgacctaccaggtgcagtcaaccagctggatgcctcaccccccgtacgtgatgcaaccaaccggcgccgttattacaccaactatggaccatccgatgtcaatgcagcccgccaatatgatgggccccctgactcagcagatgaatcacttgagcctggggaccaccgggacctacatgaccgccgctgccccaatgcaaggaacttacattcctcagtatacacccgtaccccccacggcagtatccatcgaaggtgtggtagccgacacatcaccacagaccgttgcaccatcttcacaggataccagcggacagcaacaacagatagccgtcgacacctcaaacgagcacgccccggcgtattcttaccaacagagcaaaccatag

SEQ ID NO: 204019 - DNA, 1263 bp, Artificial Sequence
  Description of Artificial Sequence: Synthetic coding sequence
atgggcaagcggctggaccagccccagatgtacccccagtacacctactattacccacactacctccagaccaagcagtcttacgctcccgcccctcaccccatggccccacctagtccctccacgaatagctccagcaacaattccagtaacaactcctcaggtgagcagctctcaaaaacaaacctatatatccggggtctgccacctgggaccacagatcaagacttaatcaagctgtgccagccatacggcaaaattgtgtccactaaggccatcctggacaaaaatacaaaccagtgtaaaggctacggtttcgtggattttgatagccccgccgccgcgcagaaggctgtcgctagcttgaaagccaatggagtgcaggctcagatggccaagcagcaggagcaagaccccacaaatttatatatctcaaatttacctatctcgatggatgagcaagaattggaaaacatgcttaaaccattcggccacgtgattagcaccaggatcctgcgcgacgctaacggcgtgtcaaggggagtcggtttcgccagaatggagtccacagaaaagtgcgaagtggtcattcagcattttaacgggaagtacctcaagacccctcccggaatccctgccccatctgagcctcttctgtgtaaatttgctgacggtggtcaaaagaaacgacagaaccagagtaagtacactcagaacggccgaccttggcctagagagggtgaggcagggatggcactgacctacgacccaaccgccgccatacagaatggcttctattcttctccttatagcatcgccaccaatcgcatgattccacagacgtcaatcacccccttcattgcagccagtcccgtgagtacttatcaggtgcagagtacctcgtggatgccccacccgccttacgtgatgcagccaactggggcggtgatcacaccgaccatggatcaccccatgagcatgcaaccggccaacatgatgggtcctctcacacaacagatgaaccatctctcccttggaacaaccggtacttatatgacagctgcagcccccatgcaaggcacatacatccctcaatacacccccgtcccgccaacagccgtcagcatcgaaggcgtcgtcgcagacaccagcccccagacagtggctccatccagccaagacactagcggccagcagcagcagatagctgtggatacctccaatgagcatgcccctgcctactcatatcagcagtcaaaatag

SEQ ID NO: 204020 - DNA, 1260 bp, Artificial Sequence
  Description of Artificial Sequence: Synthetic coding sequence
atgggcaagcggctggaccagccccagatgtacccccagtacacctactattatccccattatctgcaaacaaagagctatgcacctgccccacatccaatggctccaccctcacccagcaccaacagctcgagtaataattcctcaaataactcttccggcgaacagctgagtaagacaaacctttacatccggggactccccccagggactacagaccaagacctgattaagctgtgccagccctatggcaaaatcgtcagtacaaaggcgatcctagataagaacaccaatcagtgcaaaggttacggcttcgtggatttcgattctccagccgctgcccagaaggcagtcgcgtcacttaaggcaaacggagtgcaggcacagatggctaaacaacaggaacaggatccaaccaatctttacatcagcaacctcccaattagcatggacgagcaagaactggaaaacatgctgaaaccatttgggcatgttatttccaccaggatactgagagatgccaacggcgtaagtaggggcgtgggattcgcccggatggaatccaccgaaaagtgcgaagtggtaattcagcacttcaatggtaagtacctcaaaaccccccccggcatacccgcaccctctgaaccccttctatgcaagttcgctgacggtggacagaaaaaaaggcagaatcagtccaaatatacccagaatggcagaccctggcctcgagagggcgaagccggcatggccctgacatacgatccaacggccgctattcagaatggattctacagtagcccatactccattgcaactaaccgcatgatccctcagaccagtataacgccttttatcgccgccagtcctgtctcgacttaccagggggcagtaatcacacccactatggaccaccctatgtctatgcagcccgccaacatgatggggccccttactcaacaaatgaaccatctgtccctcggcacaacaggcacgatccaatcacaggaccgcataatgattctgcatcagctcctttgccagtacatgaccgcagcagcacccatgcaagggacctacataccccagtacacacccgtcccaccaacagcggttagcattgagggcgtcgtcgccgacactagcccacagacagtggccccaagcagccaggatacatccggccagcagcagcagatcgcagttgatacctccaacgaacacgcccctgcctatagttaccagcagtccaagccgtag

SEQ ID NO: 204021 - DNA, 1314 bp, Artificial Sequence
  Description of Artificial Sequence: Synthetic coding sequence
atgggcaagcggctggaccagccccagatgtacccccagtacacctactattatccccattatttgcagactaaacaatcttatgctccggcgcctcatcctatggccccaccgtcgccaagtaccaactcttcaagtaataattcctccaataatagctctggggagcaattaagcaaaacaaatctttacatcagaggattaccccccggcaccaccgatcaggatctaatcaagctgtgccaaccctacggcaagattgtgagtacaaaagctattctcgacaaaaacacgaatcagtgcaaaggctatggatttgtggactttgattctcccgctgccgcccaaaaggctgtggcttcattgaaagccaacggtgtgcaagcacagatggccaaacaacaagagcaggaccccaccaatctctatatctctaatctgccaatcagtatggacgagcaggagctggagaacatgttgaagccttttggccacgtaatctccactcgcattctgcgggacgcaaacggagtgtctagaggggtcgggtttgccaggatggaatccactgaaaaatgtgaggtagtaattcagcattttaatggaaagtatctgaaaacccctcccggaattcctgctcccagcgaaccgctcctctgtaagttcgccgacggtggccagaaaaaacgtcaaaatcagtccaaatatactcagaacggcaggccgtggccgcgtgagggggaagctgggatggccttgacatacgaccctacagccgctatccagaacggcttctacagttctccctattcgattgcaactaatcggatgattccgcaaaccagtattaccccatttatcgccgccagcccggtgtccacctatcaggttcaatcaaccagttggatgccacacccaccatatgttatgcagccaactggagccgtcattacccccacgatggatcacccaatgagcatgcagcctgcaaatatgatgggtccactgacacagcagatgaaccacctctctctcggtactacgggaaccatacagtcccaggacagaatcatgatcttgcaccaactactgtgtcagtacatgactgccgccgcccctatgcagggaacttacattccgcagtatacccccgtgccccccactgcagtgagcatagaaggcgtcgtggcggataccagcccccagacggttgctcctagtagtcaagatacctctggacagcaacagcagatcgctgttgatacctctaatgagcacgctcccgcctatagttatcagcaatctaaaccgtag

SEQ ID NO: 204022 - DNA, 1305 bp, Artificial Sequence
  Description of Artificial Sequence: Synthetic coding sequence
atgggcaagcggctggaccagccccagatgtacccccagtacacctattactaccctcattacttgcagactaagcagtcttatgccccagcccctcacccgatggctcccccgagcccctccaccaactcgtcatcaaacaactcatcaaacaattcgtcaggtgagcagctttccaagacaaacttgtatattcgaggcctgccccctggaaccactgaccaagacctgatcaagctgtgtcagccctatggcaaaattgtgtctacaaaggcaatcctggacaagaacactaaccagtgtaaaggatatgggttcgttgatttcgactcgcctgcggccgcccagaaggccgtggcaagcctcaaagccaacggcgtgcaggcccaaatggccaaacagcaggaacaagatccaacgaacctgtacatttctaacctacccatttctatggatgaacaggagctggaaaacatgcttaagcctttcggtcatgttatctcaactcgcatcttgagagatgcaaatggtgtgagtaggggggttggattcgcacggatggaatccactgagaagtgcgaagtggtcatccaacatttcaacgggaaatacctaaaaactcctcctggtatccccgctccaagtgagcccctactctgtaagtttgccgatggcggccagaagaaacgacagaaccagtcaaagtacactcagaacggacggccttggcctagggaaggagaagtgctgagaggccggaccgtacctcggcaaaaccgggaggccggaatggcattgacctacgaccctaccgccgctatccagaatggcttctactcctcaccttatagcatcgcaacgaatcgaatgatcccacagacatcaattacgcccttcatagccgcctctccagttagcacctaccaggttcagtcaacctcttggatgcctcaccctccatatgtgatgcagcctaccggcgctgtgataacaccgactatggaccaccccatgtcaatgcagcctgccaacatgatgggacctctcacgcaacaaatgaatcatcttagcttgggcacaactggcacatatatgacggctgccgcacctatgcaagggacgtatataccacagtacaccccagtgccgccaaccgcagtttcaatagaaggggtggtcgccgatacttcccctcagaccgtcgctccaagtagccaagacacgtctggacagcaacagcagatcgcagtggatacctctaacgagcacgcacccgcctattcgtaccagcaatctaaaccctag

SEQ ID NO: 204023 - DNA, 1311 bp, Artificial Sequence
  Description of Artificial Sequence: Synthetic coding sequence
atgggcaagcggctggaccagccccagatgtacccccagtacacctactactatccacattacctccagacgaaatcatacgccccagccccgcatcctatggcaccaccctccccttccacaaacagcagtagtaataactcgagtaataactcctccggagaacagctctccaagacaaacctctacatccgtggtctcccacccggaacaacagaccaggacctcatcaagctgtgccagccttatggtaagattgtgtccacaaaagccattcttgataagaacaccaatcaatgcaagggatatggtttcgtggactttgattctccagcggccgcgcagaaggcggtggccagcttaaaggccaacggggttcaggcccagatggcaaagcagcaagaacaggacccaacaaacctgtacatttctaatctccccatttctatggacgagcaggagctggagaatatgctgaaaccattcggacatgtgatttcaactcgcatcctgcgcgatgcaaatggggtttctagaggggtgggattcgcgcgcatggagagcacagaaaaatgcgaggttgtcatacagcacttcaacggaaagtaccttaaaaccccacccggcatccctgccccttctgaacctctgttatgcaaatttgccgatggaggacagaagaaacgacaaaatcagtctaaatatacccagaatggccgtccatggccccgggagggcgaagctggtatggctcttacttatgatcccactgcggccatccagaacgggttttattcaagtccatacagcattgcaaccaatcgcatgatccctcagactagtattacacccttcatcgcggcctcacctgttagtacctatcaagttcagtctacctcttggatgccccaccccccttacgtcatgcagccaactggggctgtgatcacccctacaatggaccaccccatgagtatgcagcctgccaatatgatgggtcctcttacccaacaaatgaaccacctcagtttaggcaccaccggcaccattcaatcccaagaccgcattatgattctccaccagctcctgtgtcaatacatgaccgctgccgctcccatgcaagggacctacattccccagtatacaccagtgccccctacggcagtcagcatagaaggcgtggttgctgacacctctccacagaccgtggccccatcatctcaggacacgagcggccagcagcagcagatagcggtggatacgtcaaatgaacatgcccctgcatactcctatcagcagagtaaaccatag

SEQ ID NO: 204024 - DNA, 1302 bp, Artificial Sequence
  Description of Artificial Sequence: Synthetic coding sequence
atgggcaagcggctggaccagccccagatgtacccccagtacacctattactatccacactacttacagacaaaacagagttacgccccggcaccccatcccatggctcccccatctcctagcactaatagttcctctaacaacagcagtaacaactcatccggcgagcaactctctaaaaccaatctctatatcagagggctgccacccggcaccaccgatcaggacctgatcaagctgtgccaaccttacggtaaaatcgtgagcaccaaagctatactagacaagaacactaaccagtgtaaaggatacggattcgtcgactttgatagcccggccgcggctcagaaggcggtcgccagcctcaaagccaacggagtgcaagcccagatggcaaagcagcaagaacaggacccaacaaacttgtatataagcaatctgcccatctccatggatgagcaggaactggagaatatgctaaagcccttcgggcatgtgatatccacacgaattctgagggatgcaaatggcgtttcaaggggcgttggctttgcccgaatggagtcaacagagaaatgtgaggtcgtcattcagcactttaacggcaaatatctgaaaaccccacccgggatcccggctccgtccgagcctttactttgcaaatttgccgatggtggccagaaaaaacgccaaaaccagtccaagtatacacagaacggcaggccctggccacgggaaggggaagttttgcgcggtcgaacagtcccgcgacaaaatcgagaagccgggatggccttgacatatgatcccaccgccgcaattcagaatggtttctatagcagcccatactccatagccacaaatcgaatgatcccccagacttcaatcacaccctttattgccgcttcaccagtgtctacctatcaggtgcagtcaacctcttggatgcctcatccaccatacgttatgcagccgactggagctgtgataacccctaccatggatcacccaatgagcatgcagcccgccaatatgatgggaccgctgacacagcaaatgaaccatttgtcccttgggactacagggacatatatgacagctgcggcccctatgcagggcacatacattccccaatacacaccagtacctccaacagccgtgtcaatagagggagtggtagccgacactagtcctcagacagtagccccttcatctcaagacacttctgggcaacagcagcagatcgccgtcgatacctccaacgagcacgcccctgcatattcttatcaacaatcaaagtag

SEQ ID NO: 204025 - DNA, 615 bp, Artificial Sequence
  Description of Artificial Sequence: Synthetic coding sequence
atgaacaacggcggcaaggccgagaaggagaacacccccagcgaggccaatctccaggaagaagaagtgaggacgctgtttgtgagtggactgccattggatataaaaccacgcgagttgtatttattgtttcggccattcaaaggctacgaggggtctctcatcaaattgactagcaaacagcctgtcggattcgtgagttttgacagtagatctgaggctgaggcagccaaaaacgccttgaatgggatccgatttgatccagaaatcccgcagactctgcgactggaattcgcaaaggccaacaccaaaatggcaaaaaataaactggtgggcactcctaacccctccactccactgcccaatacagttccccagtttattgctagagaaccttacgaactaaccgtgcccgccttgtacccctcaagccctgaggtctgggcgccttaccccctttatccagctgagttggccccagcgttgcccccaccagcttttacataccctgctagtttgcatgctcagctttgtgaaggacagacagtgcgacgcagtcatcctctgtctgcacccagtcccgactcagccagccttgcatggttccccgtgtag

SEQ ID NO: 204026 - DNA, 591 bp, Artificial Sequence
  Description of Artificial Sequence: Synthetic coding sequence
atgaacaacggcggcaaggccgagaaggagaacacccccagcgaggccaatttgcaggaagaggaggtgcgcacactgttcgtatcaggactgccgcttgatatcaaaccccgcgagctgtacctgctattccgcccatttaaaggttacgaaggaagcctgataaaattgacatcgaaacaacccgtaggtttcgtgagcttcgacagtcgaagcgaagcggaggctgcaaagaatgctcttaatgggattaggtttgaccctgaaattccgcagactctccggctagagttcgcaaaagccaataccaagatggccaaaaacaagctggtaggcaccccgaacccaagcacccctcttcccaacactgtgcctcagtttatcgctcgcgaaccttacgaactcacagttcctgctctgtaccccagctcaccagaagtgtgggccccttacccactgtatccagcggagcttgcacccgcactgccacctcctgcattcacctacccggcatcgttgcacgcacagatgaggtggctccccccgagcgaagctacgtcccagggctggaagtctaggcaattttgttag

SEQ ID NO: 204027 - DNA, 660 bp, Artificial Sequence
  Description of Artificial Sequence: Synthetic coding sequence
atgaacaacggcggcaaggccgagaaggagaacacccccagcgaggccaacctgcaagaagaagaggtgcgcacgcttttcgtgagtgggctgccgctcgacattaagccacgggagttgtaccttctctttaggcccttcaagggctacgaaggctccctgataaagctgacctctaagcaacccgtcggtttcgtcagttttgacagccggtccgaagcagaggctgcgaaaaatgccctgaatggcattcggtttgatcctgaaattccacaaacgctcaggttagaattcgctaaggccaatactaagatggccaagaataagcttgtgggcactccaaaccccagtactcccttgcctaacacggtgccacagttcattgctagggaaccctacgagctcaccgtgcccgccctgtacccctcaagtccggaggtctgggcaccctaccccttataccccgccgagctcgctcccgcactccctcctcctgccttcacatatccggcctcacttcacgcccagtgttttagtcccgaggccaagcccaatacccccgtgttctgccccctgctgcagcagatacggttcgtgagcgggaatgtttttgtgacttaccaaccaaccgctgaccagcagagagagcttccatgctag

SEQ ID NO: 204028 - DNA, 591 bp, Artificial Sequence
  Description of Artificial Sequence: Synthetic coding sequence
atgaacaacggcggcaaggccgagaaggagaacacccccagcgaggctaaccttcaggaagaggaggttcgtaccctgttcgtgtcagggctgccactggacattaaaccccgcgagctgtacttgctcttccggccgttcaaaggctacgaaggctccttaatcaaactcacgtcaaagcagcccgtcggatttgtttcatttgactcacgcagcgaggctgaggcagctaagaatgctcttaacgggatccgcttcgaccctgagattcctcaaacacttagactcgagttcgccaaggctaataccaagatggcgaagaataagctggtcggcacacccaacccgtccactccgctccctaataccgtgccccagtttatcgctcgcgaaccttatgaattgacagtgccagctctctacccaagcagccccgaagtctgggccccctaccccttgtacccggcagaactggcccctgcgctgcctcctcccgcttttacataccctgcctctctgcacgcccagatgcggtggctgcctccgtcagaagctacatctcagggctggaaatcgaggcaattttgttag

SEQ ID NO: 204029 - DNA, 462 bp, Artificial Sequence
  Description of Artificial Sequence: Synthetic coding sequence
atgaacaacggcggcaaggccgagaaggagaacacccccagcgaggctaatctacaggaagaagaagttaggaccctcttcgtctccggcctgcctctggacattaagccacgtgagctgtaccttctgtttcggcctttcaaagggtacgagggcagcctgatcaagctaaccagcaagcagcccgtgggctttgtgtcttttgactcaagaagtgaagccgaggccgccaaaaacgcgctaaacggaataaggtttgatccggaaatcccgcagacgctgcggttggaattcgctaaggcaaacactaaaatggccaaaaataagctggtagggacacccaaccccagcaccccacttccaaacactgtgccacaattcattgcacgtgagcctctcatgcgctggctgcctcctagtgaagccaccagccagggatggaagtccaggcaattttgctag

SEQ ID NO: 204030 - DNA, 1257 bp, Artificial Sequence
  Description of Artificial Sequence: Synthetic coding sequence
atgctggccagccagggcgtgctgctgcacccctacggcgtgcccatgatcgtcccagcagccccatacttacctggtttaatacagggtaaccaggaagccgccgcagccccagacaccatggcccaaccgtatgcctcagcacagtttgcccccccccagaatgggatccctgctgaatacacagcccctcaccctcatcccgccccagagtataccggccagaccacggtgcccgaacacaccctgaacctgtacccaccagctcagactcatagtgagcagtcacctgccgatacctccgcacaaactgtttcaggtaccgcgacacagacagacgacgccgctccaaccgacggtcagcctcagactcagccttccgagaacactgaaaacaaaagtcagcctaaacggctacacgtgtccaatatccccttccgtttcagggaccccgacttacgccaaatgttcggacaatttggcaagattttggacgttgaaatcatttttaacgaaagaggttccaagggctttggctttgtaacatttgagaactcagcggacgctgaccgtgcacgtgagaagttacatggcacagtagttgagggaaggaaaatcgaagtgaataatgccacagcgcgagtcatgaccaataaaaagacagttaacccctacaccaatggctggaaattgaatcccgtcgtgggggcagtatattcccccgagttctacgcaggaaccgtgcttctgtgccaggcgaatcaggaaggatccagtatgtatagtgcaccatccagtctggtttacacctcagctatgccagggtttccttaccccgctgccaccgctgccgcagcttaccgcggcgcgcatttgaggggcagggggcgcaccgtgtacaacaccttcagagctgcagcccctccacccccaattcctgcatacggcggcgtggtgtaccaggagccagtgtacggaaataagctcctccagggagggtacgccgcctatcgatacgctcagccaacccctgcaactgcggctgcatactcagactcctatgggagggtgtacgccgccgatccgtaccaccacgctctagcccctgcacccacttatggggtgggcgcaatgaatgccttcgctcctctgacagatgcaaagaccaggagccacgccgacgatgtggggttagtgctgtcttcacttcaggccagtatctacagggggggctacaaccgtttcgctccctattag

SEQ ID NO: 204031 - DNA, 1209 bp, Artificial Sequence
  Description of Artificial Sequence: Synthetic coding sequence
atgatcgtgcccgccgccccctacctgcccggcctgatccagggcaatcaggaggccgcggccgcacccgacacgatggctcaaccatacgcgtccgcacagttcgcaccaccacaaaacggaattcccgccgagtataccgcaccgcacccccatcctgctcctgaatacactgggcagaccacggtgccagaacacactttaaatctgtacccacctgctcaaactcatagtgaacagtccccagccgacactagcgcccagacagtatctggtacagcaacccagacagacgacgccgccccaaccgacggccagcctcaaacgcagccttccgagaatacagaaaacaaaagccagcccaagcgcctgcacgtgagcaatatccccttcaggttccgagaccccgatcttaggcagatgttcggccagttcggtaaaattttggacgtggagattattttcaatgagagaggatccaagggatttggcttcgtaacgtttgaaaacagcgccgatgccgaccgagcgcgcgagaaactgcatggcaccgttgtagaggggcgaaaaattgaggttaataatgccacagcacgtgtaatgaccaacaaaaagaccgtgaatccttacaccaatggttggaagctgaatccagtggtcggagctgtgtattcaccagagttctacgccggcactgtactcttgtgccaggccaatcaagagggatcatctatgtacagcgcaccatcatcactcgtatacacttcagccatgcccggttttccttacccagctgctaccgcagccgcagcttatcgaggggcccacctgagagggagagggcggaccgtctataatacctttagagcggccgctccccccccgcccatcccagcatatggcggcgtagtttatcaggatggattctacggggcagacatatatggcggctacgccgcgtatcgatatgcccagcctactccagcgactgccgctgcgtactcagactcatacggccgcgtttacgctgccgatccatatcatcacgccctggctcccgctcctacttacggggtaggtgccatgaacgctttcgcgcctctaacggacgccaagacaaggtcccacgcagacgatgtgggcctggtgcttagctccctccaggcgtccatatataggggcggctataaccggttcgccccatattag

SEQ ID NO: 204032 - DNA, 1176 bp, Artificial Sequence
  Description of Artificial Sequence: Synthetic coding sequence
atgctggccagccagggcgtgctgctgcacccctacggcgtgcccatgattgtgccggctgctccatacctgccagggctcatccaaggtaaccaggaggcagcagctgcccccgataccatggctcagccatatgccagtgctcagttcgcaccgccccagaacggaatcccggcagagtatactgctccgcaccctcatccagctccagagtataccggccagaccaccgtccccgaacacactctgaacctgtacccccctgcccagacacattcggagcagtcccctgccgacacgtcagcgcaaactgtcagcggaaccgccacccagacagacgatgcagcaccaaccgatggacagcctcaaacacagcccagcgagaacacagaaaataagagtcagcctaagcgcctgcatgtgtccaacatacccttccgctttagggaccctgacttgagacagatgttcggtcaatttggtaagattcttgatgtagagatcatttttaacgaacggggctcaaagggattcggattcgtaacgttcgaaaacagcgccgacgctgacagggctcgtgagaaattgcacggtactgtggtcgaaggaagaaagatcgaggttaacaatgccaccgcacgggtgatgactaataagaagaccgttaacccatacaccaacggatggaagctgaaccctgttgtgggtgccgtatactccccagaattctacgcagttcccggcttcccttacccagccgcaactgccgcagcggcctatagaggagctcacctgcgtggccgtggtaggactgtgtacaacaccttccgtgctgctgccccaccacctcccattccagcttatggaggagttgtctatcaggagcccgtgtacggaaacaaattgctccaagggggttacgccgcttacaggtacgctcagcccactcctgcaacagcagccgcatattccgactcttacggccgggtgtatgccgccgacccataccaccatgcacttgcaccagcccctacatatggcgtgggagcgatgaacgccttcgcacctttaaccgatgccaagacccggagtcacgccgacgatgtggggctggtgttaagctcactccaggccagcatctaccgaggaggatacaatagattcgccccgtattag

SEQ ID NO: 204033 - DNA, 1188 bp, Artificial Sequence
  Description of Artificial Sequence: Synthetic coding sequence
atgctggccagccagggcgtgctgctgcacccctacggcgtgcccatgatcgttcctgcggccccgtatctgcctggattgatccagggtaatcaagaggccgcagccgcgccagataccatggctcagccctacgcgtccgctcagttcgcacctcctcagaacgggataccagcggagtacactgcaccccaccctcaccccgccccagagtataccggccagacaactgtacctgagcacaccctgaacctgtatccccctgctcagacccatagtgagcagtccccggcggatacctctgcccagaccgtgtccggaacggccacgcaaactgatgatgcagccccgaccgacgggcagccacaaactcagcccagtgagaataccgagaataaaagccagcctaaacgtctgcacgtctcaaacattcccttccggtttcgcgatccagacttgagacaaatgtttgggcagtttgggaagattctggacgttgaaataatttttaatgagcgggggagcaagggatttggtttcgtgactttcgaaaattctgcagatgctgatcgcgcgcgggagaagctccatggcaccgtcgtggagggacgcaagatcgaagtgaacaacgcaaccgccagggtgatgaccaataagaaaaccgttaacccgtatacaaacggttggaagctcaaccctgtggtgggggccgtttacagtccggaattctatgctggcactgtcctactgtgtcaggccaaccaggagggatctagcatgtactcagcacctagctcactggtgtacacctccgcgatgcctggctttccttaccctgccgcaaccgccgccgctgcgtatcgcggagcgcacctgaggggcagggggcgcacagtttacaacacattccgcgctgcagcaccccctcctcctatccctgcatatggtggggtagtctaccaggagcctgtctacggtaacaaattactccagggtgggtatgccgcataccgttatgcgcaacctacgcccgccaccgccgccgcatactccgacagaaatcaattcgtgtttgtcgcggcggacgaaatttcctgtaatacttccgcagtcaccgatgagttcatgctaccaaccccaactactacacatttgctgcagcctccccccactgctctggtcccctag

SEQ ID NO: 204034 - DNA, 1179 bp, Artificial Sequence
  Description of Artificial Sequence: Synthetic coding sequence
atgctggccagccagggcgtgctgctgcacccctacggcgtgcccatgattgtcccggcggctccctacctgcccggcttgatacagggaaaccaagaggccgccgccgctcctgatactatggcacagccctatgcttcagcacaattcgctcccccacaaaatgggatccctgcagagtatacagcgccacacccacaccctgcccccgaatatacaggacagaccaccgtgcccgagcacaccctcaatctctatccacccgctcaaacgcattcagaacagtcacccgccgacaccagcgcacagacagtgtcaggcaccgctactcagaccgacgatgcagccccaacagacggccagccccagactcagccttcagaaaataccgagaataaaagccagcctaagagactgcacgttagcaatataccgtttcgctttagggacccggacttacgccaaatgttcgggcagttcggcaaaatcttagacgtggaaatcattttcaatgagagaggctctaaaggtttcggatttgtaaccttcgaaaacagcgccgatgccgaccgagctcgcgaaaaactgcacggaaccgttgtcgagggacgcaagattgaggtcaataacgccactgcccgagtcatgacaaacaaaaaaaccgtgaacccatataccaatggatggaagctgaatccagtggtgggagctgtttatagcccggaattctacgcagggaccgtgttactttgccaggccaatcaagagggaagttcgatgtatagtgctcccagttccctggtctatacgagcgcaatgcctggcttcccctacccggccgccaccgcggctgccgcatacagaggcgcacatctgcgaggcaggggccgaacggtctacaataccttccgtgcggctgctccccccccaccaattcccgcttacggcggcgtggtgtaccaggagcctgtatacgggaacaagctgctccagggaggatacgcagcttacaggtacgcacaacccacacctgcaacagcagcggcctactctgacagttacgggcgggtctatgcagcagatccataccatcatgcgctcgctcccgcaccaacctatggagttggagccatggcctccatatatcgcggtgggtataatcgttttgctccatactag

SEQ ID NO: 204035 - DNA, 1194 bp, Artificial Sequence
  Description of Artificial Sequence: Synthetic coding sequence
atgaactgcgagcgggagcagctgcggggcaaccaggaggccgccgccgcgcctgacactatggcacagccctatgccagcgcccagtttgcccctccacagaatgggattcctgctgagtacaccgccccccacccacaccctgctcccgagtatacaggccaaacaaccgtgccagagcatactctaaacctataccctccagctcaaactcactccgagcagagcccagctgatacctctgcccagactgtgtccggtacagccacacaaaccgatgacgccgcacccactgacgggcagcctcagacgcagccgtctgagaatacagaaaataagagtcaacctaaacgactccatgtgagtaatattccgttccgctttagagatccagacctccggcagatgtttggtcagttcgggaaaattttggatgtcgaaattatctttaatgaacggggctccaaaggattcggctttgtcacatttgaaaattcagccgatgccgatagggcacgggagaaacttcatgggacggttgtggaggggagaaagattgaggttaataatgctactgcacgggtgatgacgaataagaaaaccgttaatccttacacgaacggttggaaactcaatccagtggtaggtgccgtctatagccctgagttctatgcaggaactgtgcttctctgccaggccaaccaggaggggtcttcaatgtatagcgccccgtcttcattagtgtatacgtcagccatgcccggatttccttaccctgcagcaacagctgccgctgcctacaggggggcccatttacggggccggggaagaacagtatataacacatttcgagccgccgccccccctcctcccattccagcttacggcggtgttgtgtaccaagatggattttacggtgccgacatctatggaggctatgccgcttataggtacgcgcagccgacacccgctacggccgcagcctatagtgacagctatggcagagtctacgccgccgacccttaccaccatgctctggcaccggctcccacctatggcgtgggagccatgaacgcttttgcccctcttaccgacgctaaaacacggtcccacgccgacgacgtgggactggtgctgtcgagtttgcaagcctctatttatcggggcggctacaacagatttgccccttactag

SEQ ID NO: 204036 - DNA, 1401 bp, Artificial Sequence
  Description of Artificial Sequence: Synthetic coding sequence
atggagaccggccagcggacccacgccagcggcacctacagcttcctggatcgcacacagcattccgacattaaggccgactgcaacacatgcgtggagatcgaagatcgtaaagtaagcaggcagcagatgaattgcgaaagagagcagctccgtggaaatcaagaggccgccgcagcgcctgatactatggcccagccctatgcatcggcccagttcgcccctccacagaacggaatccctgctgagtataccgccccacacccacatcctgcccccgagtacaccggccaaactacagtgcccgagcatacactgaacttgtaccctcccgcacaaacacacagtgagcagagccctgcagacaccagcgcacagacagtctccggcactgcaacacagacagacgacgctgcgcctactgacggccagccccagacccagccctcagaaaatacggagaataaatcacagccaaagaggttgcacgtttcaaacatcccttttagatttagggacccagacctccggcagatgttcgggcagtttggcaaaatactggatgtcgaaatcatcttcaatgagaggggctcaaagggatttggatttgttacatttgagaactccgcggacgccgacagggctagagaaaagttgcacggaacagtcgtggaggggaggaaaattgaggtgaacaacgctaccgccagggtcatgaccaataaaaagacagtgaacccttatacaaatggatggaaacttaacccagtcgtgggggccgtgtacagcccggagttttatgcaggaacagtcctcctgtgtcaggcaaatcaggaggggtccagcatgtattctgccccgagcagcctggtttacacatctgctatgcctggatttccttaccctgcagccacagctgcagccgcttaccgcggagcccacctgcgcggccgtggccggacagtgtacaacacgttccgcgcagcagcgccccccccgcctatccctgcatatggcggcgtagtttaccaggatggattttacggcgcggatatctatggagggtacgctgcgtacaggtacgcccagcctacccccgctacagcagccgcttactctgaccgaaatcagtttgtgttcgtcgctgctgacgagatttcctgcaacaccagcgcagttactgatgagtttatgctgcccacgcctacaacaacacatttgcttcaacctccaccaaccgcattagtgccatgtccaaaagtgcctgccccggcacaaacaagcgaagagttgagctgcacactgccaggcctttgctgtcaagcggcggaaaatctgactgcctctccaccattgctccagtttatgtttaaggttatagtcgcccaagaacggaagtag

SEQ ID NO: 204037 - DNA, 1194 bp, Artificial Sequence
  Description of Artificial Sequence: Synthetic coding sequence
atgaactgcgagcgggagcagctgcggggcaaccaggaggccgccgccgcaccagacacaatggctcagccatatgcctccgctcaatttgcacctcctcaaaacggaatacctgccgaatatactgccccgcaccctcatcccgcgccagagtacaccggccagacaacagtacccgaacacaccctgaacttgtatcccccggcgcaaactcacagtgaacagtccccagcggatacaagcgcccagaccgtatccggaacggccacacagacagatgacgctgcccccacagatgggcagccccagacgcagccctctgaaaatactgagaataagtcccagccaaagagactgcacgtcagcaacatccccttccgctttcgtgatccggatctacgccagatgtttggtcagttcggaaaaatactggacgtggaaatcatctttaatgagcgtgggtctaagggatttggatttgtcactttcgagaatagcgcagacgccgatagggctagggaaaaactgcacggaactgtggtagaaggcagaaagatagaggtgaacaatgcaacagctcgtgttatgaccaataaaaaaactgttaatccatacaccaatgggtggaaactaaaccctgtggtgggcgcagtgtatagccctgagttttacgccggaacagttctactatgtcaagccaatcaggaaggctctagcatgtatagtgcgccatcctccctcgtttacacctcagcaatgcctgggtttccctatcctgccgccactgcagcagccgcataccggggagctcatctgcggggcaggggtcgtaccgtgtacaacactttcagagctgccgcccctcctccccccatcccagcctatgggggggtcgtgtatcaagacggattttacggagcagatatctatggcggttacgccgcttaccgctacgcccagccaacacctgcaaccgcagcagcatactctgacagttacgggagagtgtacgcggccgacccataccatcacgcactggcgcccgcgccaacgtatggcgttggagcaatgaatgcctttgccccactgacggacgctaaaaccaggtctcacgccgatgatgttggacttgtgttatcgagcctccaggcctcgatttaccgtggaggctacaaccgatttgcaccatactag

SEQ ID NO: 204038 - DNA, 792 bp, Artificial Sequence
  Description of Artificial Sequence: Synthetic coding sequence
atgaactgcgagcgggagcagctgcggggcaaccaggaggccgccgcagcacctgacactatggctcagccctacgctagcgctcagtttgcaccgccccagaacggaataccagcagagtatacagcgcctcatccccacccagcgccggaatataccgggcaaacaaccgtcccggaacatacccttaacctttacccaccagcccagacacacagcgaacaaagcccagccgatacctctgcccaaactgtgtcaggaaccgccacccagacggatgacgccgcgccaactgatgggcagccccagacccagccgagtgaaaacacggagaacaaaagccagcctaaaagattgcacgtcagcaacattcctttccggttccgggatcctgacctgaggcagatgttcggacaattcggaaagattctggatgtggaaattatattcaacgagagagggtcaaagggctttggatttgtcaccttcgagaacagcgccgacgcagatagggccagggagaaacttcatggtacggtggtggaagggcggaaaatcgaagtcaataacgcaacagcgagagtaatgacgaacaagaaaacggtaaacccttacacaaatggatggaagctaaacccggtggtcggcgccgtgtatagcccagagttctatgccggcactgtcttgttatgccaggcgaatcaggaagggtcctccatgtatagcgcgccaagtagtctggtgtacactagtgcaatgccggggttcccctatccagctgctacagcatag

SEQ ID NO: 204039 - DNA, 1113 bp, Artificial Sequence
  Description of Artificial Sequence: Synthetic coding sequence
atgaactgcgagcgggagcagctgcggggcaaccaggaggccgccgccgctcctgacacgatggcgcaaccatatgcctcggcacagttcgcaccaccccaaaatggcatccctgctgaatacacagcaccccacccgcacccagcacctgagtacacgggacagactaccgtacctgagcacaccctgaacttatatccaccggctcaaacacactccgagcagtcccccgcagatacctctgcacaaaccgtgtccgggacagccacgcagacagacgatgctgcaccgacggacggccagccccagacacaaccatcagagaataccgagaataagtcccagcctaaacgtctgcatgtcagtaatatccccttccggttcagggaccctgacctgaggcaaatgtttggacagtttgggaagattctggatgtggagataattttcaacgagcgtggcagtaagggattcggctttgttacctttgaaaactctgctgatgctgaccgggctcgagaaaagctacacgggacagtagtcgaggggcggaaaatcgaagtgaacaacgcaacagctagggtcatgaccaacaagaagacagtaaatccatataccaatggatggaagctgaaccccgtggtcggcgccgtgtattcaccagaattttatgccgtccctggatttccatatccagctgctacggctgctgcggcttatcggggagctcatctcaggggacgcggacgcacggtctataacacctttagagccgctgccccaccaccccctattcccgcatacggaggcgtcgtgtatcaggatggattctacggggccgacatctacgggggctacgcagcctataggtacgcccagcccacccccgcaactgcagccgcatactccgacagttacggtcgtgtttatgctgctgacccttaccatcacgcccttgcgcctgcaccaacatacggggtgggtgcgatgaatgcatttgctcctctgaccgatgccaagacacgctcacacgccgatgacgtcggtctggtcctgtcatctctacaggcctcgatttacaggggcgggtacaaccgatttgccccatactag

SEQ ID NO: 204040 - DNA, 1725 bp, Artificial Sequence
  Description of Artificial Sequence: Synthetic coding sequence
atggcccacaacaagatccccccccggtggctgaactgcccccggcgcggtcaacctgtcgcaggtcgcttcctacctctaaagacaatgctaggaccccggtacgattctcaggtagccgaagagaaccgtttccacccgagcatgctctccaattatctgaagtcgctgaaggtcaaaatgggtcttctcgtggacttaacaaatacgagccggttctacgaccggaatgatattgagaaggaaggtataaagtacatcaaacttcagtgcaaaggacacggggaatgcccaacaaccgaaaacacggagacttttattagactttgcgagcgcttcaacgagcgcaatccccctgaactgataggggttcattgcacccacggctttaatcgtactgggtttctcatttgcgcattcctggtcgagaagatggactggtcaattgaggccgccgtggcaacatttgcacaggcccgcccccctggaatttacaaaggcgattatcttaaggaattgttccggcgatatggtgacattgaagaggccccccctccccccctgctgcccgattggtgcttcgaagatgacgaagacgaagatgaagatgaagatgggaaaaaggaatccgaacccggttcatcagcctcctttgggaagcgccgcaaggaacgactgaaactgggtgccatcttccttgagggcgtgacagtcaaaggcgtgacccaggtaaccacgcagcccaaactgggagaagtccaacagaagtgccaccaattttgcggatgggaggggagcggctttcctggggctcagcctgtctcaatggataaacaaaatattaagctgctggatcttaagccttacaaagtgagctggaaggcagacggtactaggtatatgatgctgatagatggcacgaacgaggtttttatgatagacagggataacagcgttttccatgtgtccaatttggaattccccttcaggaaagacctgcggatgcatttaagtaatacacttctggatggggagatgataattgacagagtaaacggtcaggcagtccctcgatacctgatttatgacattatcaagttcaactcgcaacccgtgggagactgtgatttcaatgttcggcttcaatgcattgaaagggagatcattagtccgcgtcatgaaaagatgaagacaggcttaattgacaaaacgcaggagccttttagtgtacgcaataagccctttttcgacatttgtacctcaaggaagaagtataagcccggccgctgtgacgacatcctcaaatggaaacctccctctcttaacagcgtggatttcagactgaagataacaagaatgggcggcgagggactactgccccagaacgttggcctcttatacgtgggaggatacgagcgcccctttgcccagatcaaggtgaccaaagagttaaagcaatatgataacaagattattgaatgcaagttcgagaacaatagctgggtgttcatgcggcaacgaacagataagtccttccccaacgcctacaacaccgccatggcggtttgtaactccatttcaaaccctgttactaaggagatgcttttcgagttcattgataggtgtacagcagcttctcagggccagaagagaaagcatcatctcgaccccgacacagaactgatgcccccccctccacctaagagaccgcggcccctgacctag

SEQ ID NO: 204041 - DNA, 1626 bp, Artificial Sequence
  Description of Artificial Sequence: Synthetic coding sequence
atggcccacaacaagatccccccccggtggctgaactgcccccggagaggccaacctgtggccggcagattcctgcctcttaagacaatgttgggccctagatatgacagccaggttgctgaagagaatcggtttcacccttctatgttgtctaattacctgaagagcctgaaggtgaaaatgggactcctggtggatctaacgaatacatcgcgcttctatgatcgaaacgatatcgaaaaagaaggaatcaaatacatcaaactccagtgtaaaggtcacggtgaatgtcctaccactgagaacaccgagacctttattcgcctctgcgaaagatttaacgaacgtaatccaccagagttgattggtgtccactgtacccatgggtttaataggacagggttcctcatctgtgcttttctcgtggagaaaatggattggagtatagaagccgccgtggctacattcgcccaggccagacctcccggcatctacaagggcgattacctcaaggaattattcaggcgctatggggacatcgaggaggccccccctccacctctgctcccagactggtgtttcgaggacgacgaggacgaggatgaagacgaggatggcaagaaagagagtgagcccggcagtagtgcgagcttcggaaaacgacggaaggagcgcttaaagctcggcgcgatatttttagaaggcgtaacagtgaaaggagttactcaggtgactacacagcccaagctcggagaggtgcaacaaaaatgccatcagttctgcgggtgggaaggatcaggctttcccggagcgcaacctgtctctatggacaagcagaacataaagttactggacttaaagccatataaagttagttggaaggccgacggcaccagatacatgatgttaatcgatgggactaatgaggtctttatgatcgatagagacaacagcgtgttccacgtatccaatcttgaatttccttttcgtaaggacctacggatgcacctatccaacactctgctggacggggagatgattatcgatagggtgaatggccaagcagtgcctaggtacttaatttacgacatcatcaagttcaacagccagcctgtcggcgactgtgactttaacgtccgtctgcaatgtatcgaacgcgagattattagcccccgacacgaaaagatgaagaccggattgattgataagacacaggagcctttttccgtcagaaataaaccattttttgatatttgcacatcaaggaagctactggaaggtaactttgctaaggaagttagtcacgaaatggatggcctgattttccagccaaccggcaaatataagccaggccgatgcgacgacatcctgaaatggaaaccaccttcgctgaattctgtggattttcgcctgaagatcacccgaatggggggggaaggcctgctgccccagaatgtcgggctgttatacgtggggggctacgagagacccttcgcgcaaatcaaagtctgcctttttatatttagcgtcctgttccttgatgttctgctgagcagaatacaccagaacctggctaataacaaccaacatattaaaatttcttgttcttcgactctcgggggctag

SEQ ID NO: 204042 - DNA, 1794 bp, Artificial Sequence
  Description of Artificial Sequence: Synthetic coding sequence
atggcccacaacaagatccccccccggtggctgaactgcccccggcgtggtcagcctgtggcggggaggttcctacccctcaaaacaatgctaggacccagatatgactcacaagtggctgaagaaaacaggttccacccatctatgctgtcgaattatctgaaaagtctgaaggtaaaaatggggctgctggtcgatcttaccaatacctcgaggttttatgatcgaaatgacatcgaaaaagaaggaatcaagtatatcaaacttcagtgtaagggtcacggtgagtgtcccacaaccgagaatactgaaacgttcatccgcctatgcgagagatttaatgaacgcaatcctccagaactgattggggttcattgcacccacggctttaaccggacgggtttcctgatatgcgctttcttggtcgaaaagatggattggtcaatagaagctgcagtggctactttcgcgcaggcccggcctcccggcatttataagggggactacctcaaggaactgttcaggagatatggggatatagaagaagccccgccaccacctctgctgcctgactggtgcttcgaggacgacgaggatgaggatgaggatgaagatgggaaaaaagaatcggagccaggctcttctgcgagcttcggcaaaaggagaaaggagaggctgaaacttggagcgatctttcttgagggagtcaccgtgaagggtgtgacacaggtgaccacacagcccaagttaggagaagtgcagcagaagtgccatcagttttgtggctgggagggcagtggcttcccgggcgctcagcccgtatccatggataagcaaaatatcaaactgctggatctgaaaccttacaaagtgtcttggaaagcagatggtacgcgttacatgatgctgattgacgggactaatgaggtgtttatgattgatagagacaacagcgtttttcatgtatcaaatctggaatttcccttccgaaaagatctacgcatgcacttgagcaatacactgctggacggcgagatgatcattgatcgagtgaacgggcaagcagtgccccgttacttgatctatgacatcatcaagtttaattctcagccggtgggagactgtgattttaacgtgagattgcagtgcattgagcgcgagatcatctctccacgccacgaaaagatgaagacaggcctaatcgacaagacccaagaaccatttagtgtccgaaacaaaccctttttcgacatttgcactagcaggaagctgcttgagggcaactttgctaaagaggtttcccacgagatggacggcctcatcttccagcctacaggaaaatataagcctgggaggtgtgacgatatactgaaatggaagcctccttctctgaactcagtcgattttagattgaaaatcactcgcatgggtggggagggactcctccctcagaatgtcggcctgctctatgttggcggatatgagcgtcctttcgcacaaattaaggtgacaaaggaactgaagcagtacgataacaagataatagaatgcaaatttgagaacaactcctgggtgttcatgagacagagaaccgataagagctttcccaacgcctacaatacagccatggcagtctgcaacagcatctcgaaccctgttaccaaagaaatgctcttcgagttcattgaccgatgtactgctgccagccaagggcagaagcgaaaacaccacctagaccccgatactgagcttatgcctcccccaccccccaagcgcccccgccccctcacatag

SEQ ID NO: 204043 - DNA, 1707 bp, Artificial Sequence
  Description of Artificial Sequence: Synthetic coding sequence
atgctgggcccccggtacgacagccaggtggccgaggagaaccggttccacccatctatgctcagtaattacctgaagagcctgaaagtcaagatgggacttctcgttgatctgacgaatacatccagattttacgacaggaacgacatcgaaaaggagggaattaaatatatcaagctgcagtgcaaagggcatggagagtgtcccaccaccgaaaatacagaaactttcatccgcctgtgtgaacggttcaatgaacggaatccccccgagctgatcggggtgcactgcacacacggcttcaatcgtactggattcctcatttgcgcattcctagtggagaaaatggactggtcaattgaggcagcagtcgctacgttcgctcaggcccgccccccaggaatctacaaaggagactatctgaaagaactgtttcggcggtacggcgacattgaggaggccccaccacctcctttgcttcccgattggtgcttcgaggacgacgaagatgaggacgaggacgaggacggcaagaaggagagtgagccaggatcttcggcatcattcggaaaaaggaggaaggagagattgaagctgggagctatcttcctggagggagtgacggtgaaaggggtgacacaggtaacgacccaacctaaactgggggaggttcagcaaaagtgccatcagttctgtgggtgggagggctcagggtttccaggagcccagcccgtttcaatggataagcagaacataaagttgttggatctcaaaccttacaaagtgtcttggaaggcagacggcacaaggtatatgatgctgatcgacggcacaaacgaagtgtttatgatcgaccgcgacaattcagtgtttcatgtgtccaatcttgagttcccttttcgcaaagatctgcgaatgcacctgtctaatacgctgctcgatggagaaatgattattgatagggtcaacggacaggccgtgcctagatacctaatttacgatataatcaaatttaattcacagcccgttggcgactgtgatttcaacgtgcggctccagtgtattgaacgagagatcatcagtcctcggcatgagaagatgaagactggattgatcgataagacccaagagccttttagtgtgaggaacaagccatttttcgatatatgcacatcccgaaaattattagagggtaacttcgctaaagaggttagccatgagatggatggcctgatattccagccaacaggaaaatacaaaccaggcagatgtgatgacattctgaagtggaagcctcctagcttgaacagtgtggattttcgtctgaaaattactcgaatgggcggggaaggcctgctaccacagaacgtcggcttgctctacgtcgggggctacgaacgcccctttgcgcagatcaaggtcaccaaagaactcaagcagtatgataacaaaattatcgaatgcaaatttgagaataactcttgggtattcatgagacagcggaccgataagagctttcctaacgcctataataccgcaatggctgtgtgcaattctatctcaaaccccgtgacaaaagagatgctgttcgagttcatcgaccggtgcaccgctgcctcccaagggcagaagcgcaaacaccatctggacccagatactgagctgatgcctcctccccctcccaaaaggccccgtccacttacatag

SEQ ID NO: 204044 - DNA, 1545 bp, Artificial Sequence
  Description of Artificial Sequence: Synthetic coding sequence
atgggcctgctggtggacctgaccaacaccagccggttctacgaccggaatgacattgagaaggaagggataaaatatataaaacttcagtgcaagggtcacggggagtgcccaaccacagagaataccgagacttttatcagactgtgtgagaggtttaatgagcgcaaccctcctgagctgatcggggtccattgcacacatggatttaacaggaccggcttcctgatatgcgcttttctggtagaaaagatggattggagcattgaagctgcagtggccacctttgctcaggcccgacctcctggtatttacaagggagattacctgaaggaactgtttcgcagatatggcgatatagaggaagccccgccaccgcccttgcttcccgactggtgttttgaagacgatgaggatgaggatgaggatgaggacgggaagaaggagtctgagcccggatccagtgcttccttcgggaagagaaggaaagagcggcttaaactcggtgctatatttttggagggcgtgacggtgaaaggggtcactcaagtaaccacccagcccaagctaggagaggtccagcagaagtgccaccagttttgcggatgggaggggtctggattccctggcgcccagcctgtttctatggacaaacagaacattaagctactagacctgaaaccttataaagtgtcatggaaagccgacggtacacgctatatgatgttaatcgatggaacgaacgaagtgtttatgatcgatcgcgacaattccgtattccatgtgtccaatctcgagtttccttttagaaaggacctgaggatgcatctctccaataccctactcgacggcgagatgatcattgatcgtgtgaatgggcaggcggtgccaaggtacctgatatacgacattatcaagttcaattcccagcccgtaggagactgcgatttcaacgtgcgcctccagtgtattgagagggaaataataagtcccaggcacgagaagatgaagacgggcttgatcgataagacacaagaaccctttagcgtcagaaacaaaccttttttcgatatatgcacttctcggaaaaaatataagcctgggcggtgtgatgacatcctgaaatggaaacccccgagcctaaattctgtggactttcgcctcaaaatcaccaggatgggtggggaaggcctcctgccccagaacgttggcctgttgtacgtgggcggatacgaacgaccttttgctcagatcaaagtgacaaaggagctcaagcagtacgacaataagataatcgagtgcaaattcgagaataatagctgggtgttcatgagacagagaacagataagagttttcccaacgcttataataccgcaatggcggtctgtaatagcatctctaatccagtcactaaagagatgctgttcgagtttatcgacagatgcaccgctgcatctcaaggccagaagcgcaaacatcacctggatccggataccgagttgatgccgcctcccccccccaaacgcccccggcccctgacttag

SEQ ID NO: 204045 - DNA, 1263 bp, Artificial Sequence
  Description of Artificial Sequence: Synthetic coding sequence
atggccgccctggtgcggcccgcccggttcgtggtgcggcccctgctccaggtggtccaagcatgggatcttgacgcccggagatgggtaagagcacttaggaggtctcccgtgaaggtggtgttccctagtggcgaagtcgtcgagcagaaacgcgcacctggtaaacaacctcgcaaagcgccttcagaggcctccgcccaggagcagagggagaagcagcctttggaggagtcagcatcccgcgcaccttcgacgtgggaggagagtgggctgcggtacgataaagcttatccaggggatcggaggctctcttccgttatgactatcgtgaagagtaggccttttcgggagaagcagggcaagatcctcctcgaaggtcggagactgatctccgacgccctgaaggccggagctgtgcctaagatgtttttcttctcccgcctcgagtacctgaaggaattgcccgtcgataagctaaaaggggtgtccctcatcaaagtgaaattcgaagacattaaagactggagtgacctggtcacgccccaaggtattatggggatcttcgcaaaaccggaccatgtgaaaatgacatatcccaagactcaactgcagcacagcctgcctctcctgctgatctgcgataacctccgtgacccagggaacctgggaacgatcctcaggagtgcagccggcgccgggtgctctaaggtcttactgaccaaggggtgcgtggatgcctgggagccaaaggtccttagggctggtatgggcgcccactttaggatgcccattatcaacaacctggaatgggagacagtgccaaattatttaccccccgatacgagggtgtatgtggctgacaactgcggactttatgcccaggcagaaatgagcaacaaggcttctgaccacggctgggtgtgcgatcagcgggtgatgaagttccataagtatgaagaggaggaggacgttgaaactggagcctcacaggattggctgccccatgtggaggtgcagtcttatgatagtgactggacagaggccccagctgccgtggtaatcggtggcgaaacttacggggttagccttgaatctttacagctggctgaatcaactggaggaaagcgcctactcatccccgtcgtaccaggcgtcgatagcctcaattcagcaatggctgcttccatcctgctctttgaaggaaagaggcagctacggggacgagcagaagatttaagccgcgaccgctcataccactag

SEQ ID NO: 204046 - DNA, 4182 bp, Artificial Sequence
  Description of Artificial Sequence: Synthetic coding sequence
atgctgagccggcccaagcccggcgagagcgaggtggacctgctgcatttccagagccagtttctggcggcgggcgcggctcctgcagtccagctcgttaaaaaaggcaaccgggggggcggggatgctaactcagacaggccacccttgcaagatcaccgggatgtggtgatgttggacaatttacctgacctgccacccgccctggtgccttcccctcctaagcgggcccggccaagccctggccactgtctgcccgaggacgaggatccagaggaacggttgcgccgccacgatcagcacattacagcagtactgacaaagatcattgagagagatacaagttcagtagcagtgaacctacccgtgccttcaggtgtggcctttcccgccgtgttcctgcgatccagggacacccagggcaaatccgccacatccggtaagagatccatcttcgcccaggagattgctgcccgacgtattgctgaggccaagggcccctccgtgggcgaggtcgtcccaaatgtcggcccgcccgagggcgctgtgacctgcgagacccccactccccgtaaccaaggctgtcagttgccgggatcctcacattctttccaagggcctaacctcgtcaccggcaagggacttagagaccaggaagccgagcaggaggctcagacaattcacgaggagaatatcgccaggctacaggcaatggcccccgaggaaatcctgcaggagcagcagagactcttggcccagctggatccttctctcgtagcctttttaaggtcgcatagccatactcaggaacaaacgggagaaactgcctcagaggagcagaggcccggaggaccgagtgctaacgtcacaaaggaggagcccctgatgagtgcttttgcgtcagaaccgaggaagcgtgataagcttgaacccgaggccccggcactggcattacccgtgacgcctcagaaagagtggctacatatggataccgtggagctcgagaagcttcactggacacaggatttaccacctgtgcgaaggcagcaaacacaggagcgcatgcaggcccgtttcagcctgcagggtgagttgctggccccagacgtggaccttcctacccacttgggacttcaccaccatggggaagaagccgaacgggccggctactccctgcaggagctgtttcatctgacacggagtcaggtgagccagcagagggccctggcactgcatgtattggctcaagtgatttcccgggcacaggcaggggagtttggcgaccgccttgcaggatcagtactctctctgctgctagatgctggcttcctgtttctcttaagattctccctggacgacagagtggacggagtgatcgctacagccatccgggcccttagagccctgctggtggccccaggcgatgaggagctcctggattccacttttagctggtatcatggagccctgacgttcccgctcatgccttctcaggaagataaagaagatgaagatgaggatgaggagtgccccgccggaaaagccaagcggaaatcccccgaggaggagagccgaccaccaccagatttggccagacacgatgtcataaagggattacttgctacctccttactgccaagactgaggtacgtgctcgaagtgacataccctgggcccgctgttgttctcgacatattggcggttctgatacgcctagctcgtcattccttggagtctgctacaagagttctggagtgtcccagactcatcgaaaccattgttcgcgagttcctgccaacaagctggagcccagtcggcgcagggcctacaccctctctgtacaaggtaccatgcgctactgccatgaaactgttaagagttctggcttccgccggacggaatatcgcagccagattactctcatcctttgaccttcggagtcggctatgtcggatcattgccgaagccccgcaggagctggccttgccacctgaggaagccgaaatgctaagtactgaggctctgagactgtgggcagtggctgcctcatacggccaaggggggtatctttaccgggagctctatcctgtgttgatgagagctctgcaagtggtgccgagggaactgtccacccatccacctcagccactgagtatgcagaggatagcctctctgttaacattattgacacagctgacgctcgccgcgggctccactcctgcagaaaccatctccgattccgcagaggcgagtctgagtgccacgccttctttagtgacatggactcaagtgtcgggattgcagccactggtggaaccatgccttagacaaaccctgaagcttctcagcaggccggagatgtggagagctgtagggcctgtgcccgtggcctgcttactctttctaggtgcttattaccaggcctggtcacagcagcccagctcttgtcctgaggattggttgcaggacatgcagcgtctatcagaagagctcttgttgccccttctgtcccagcccacactgggaagtctgtgggactcactgcggcactgcagcctgctatgcaatcctctcagctgcgtgcccgctctggaagcacccccttcccttgtcagcctgggatgttctggaggttgtccccgacttagcctggccggatcagcgtcaccgtttcccttcctcacggcactgctgtctctgctcaatacactggcacaaatccacaaggggttgtgtgggcagcttgccgccattctggcagcccccggacttcagaactattttctacaatgcgtggcccccggtgccgcccctcaccttacaccattttcagcctgggcgctgcgccacgaataccatctccagtatctggcgcttgctctcgcacagaaggccgccgcactacaaccattgccagccactcatgcagctctgtaccacggaatggctttggccctgctgtcccgcctactaccaggaagcgagtaccttacacatgagttactcttatcctgtgtcttcagactggagtttctgcctgagcgcacctctgggggacctgaagcggcggatttctctgatcagctcagtctggggtcttcccgcgtcccccgatgtgggcagggaacactccttgcacaagcctgccaggatctcccgtcgatccgtaactgttacctaactcactgttctccagcacgcgccagcttgttggcgtcccaggctctgcatagaggggagctccaaagggtccccaccctcttactgccaatgccaactgaacctctgcttcccacagactggccttttttgccgctcattcggctgtaccatagggcctctgacacgccctcagggctgtctcctaccgacaccatgggtaccgcaatgcgcgttctgcaatgggtgcttgtcctggagtcatggcggccacaggcactttgggccgtgccccctgccgcccggctggcacggttgatgtgcgtgtttctggttgatagcgaactgttcagagagagccccgtgcagcacctagttgcggccttactggcccaactttgtcagccacaagtcctgccaaatctgaaccttgattgtaggcttcctggcctcacttcattcccagacctgtacgctaacttccttgatcattttgaagcagtgtcattcggagatcatctatttggcgccttggtgctgctgcccctacagaggaggttttcagtaacactaagactcgccttgtttggggagcacgtgggggcactgcgcgctctgtcgctgcccctcactcaattgcccgtcagtctagaatgctacaccgttcccccagaagataacctggccttactgcagctgtactttcgaacactcgtgacaggcgcactccgcccccggtggtgccctgtgttatatgccgtggccgtcgcccatgttaatagcttcattttctctcaggacccccaaagctctgatgaagtcaaggccgcccggagaagcatgctccagaaaacctggctccttgccgacgaaggcttaaggcaacacctgttacactacaaacttccaaattccacattacctgagggtttcgaactttactcacaactgcccccgctgcggcagcattatctgcaacgcctgacgtctaccgtgctccaaaacggcgtgagcgaaacatag

SEQ ID NO: 204047 - DNA, 1839 bp, Artificial Sequence
  Description of Artificial Sequence: Synthetic coding sequence
atggccgacttcgccggccccagcagcgccggccggaaggccggcgcccccaggtgttcacggaaagcagccggaaccaagcagacatctaccctgaagcaggaggatgctagtaaaaggaaagctgagctcgaagccgccgtgcgcaagaagatcgaattcgagcggaaggcactccatatcgtggagcagctcttggaagagaacattacggaggagttcctgatggagtgtggccggtttattacacctgctcactacagtgacgtagtagatgaacggagcatcgttaagctgtgtgggtatcccttgtgtcaaaaaaagctggggatcgtacctaaacaaaagtacaaaatttcaacaaagacaaataaggtgtatgatataacagagcggaagtcattttgcagtaatttctgttatcaagcttctaagttcttcgaagcccagatccccaaaacaccggtatgggtaagagaggaggagagacatcccgactttcagctgcttaaagaggagcagtctgggcactccggcgaggaagtgcagctgtgttctaaagcaattaagaccagcgacatcgacaatcctagtcacttcgaaaaacaatacgaatcttccagctcttccacgcattctgattcaagtagcgacaatgaacaggacttcgttagcagtatactgcccgggaaccggcccaattcgaccaacatccggcctcagcttcaccaaaaatctatcatgaagaagaaagccggacacaaagcaaatagtaagcataaagacaaagagcagactgtcgtggacgtgacagaacagctgggagactgtaagcttgattcccaagagaaggatgcaacttgtgagctcccactgcagaaggtgaacacccaaagctcttccaacagcacactgcccgagcgactgaaagcgtccgaaaatagcgagagtgagtactccagaagcgagattacacttgtgggcattagcaaaaaatcagccgagcatttcaaacgcaaattcgcgaagtccaaccaagtctcacgcagcgtgtcatcttccgttcaggtttgtccagaggttggcaagcgaaaccttctgaaggtgctcaaagaaaccctgatcgaatggaagactgaggagactctgcgttttctgtatggccagaactacgcgtctgtgtgtctgaaaccagaagcgagtttagtaaaagaggagctggacgaggacgatattatcagcgatccagatagtcactttcctgcctggcgcgaaagccagaattcactggatgaatccttacccttccgtggtagtgggaccgccatcaagccgcttccatcatacgaaaacctgaagaaggaaaccgagaagcttaatctaagaattagggaattttatcgcggaaggtatgtcttaggcgaagagactactaaatcgcaggactcagaggagcatgatagcacttttcctttgatagacagcagcagccaaaatcagatccggaaaaggattgtgctcgaaaagctgagcaaagttttgccgggactcctcgtgccgctccaaataactctcggcgatatctatactcagctcaaaaatttagtgagaaccttcaggctgacaaaccgcaacattattcacaaaccggctgagtggactcttatcgccatggtcctactctctctcctgacccccatcttgggcatccaaaaacactctcaggaaggcatggtattcactcgcttcttggatactttgctggaagaactgcacctaaagaacgaggatcttgagagcctgacgattatcttcagaacatcatgcctccccgagtag

SEQ ID NO: 204048 - DNA, 1755 bp, Artificial Sequence
  Description of Artificial Sequence: Synthetic coding sequence
atggccgacttcgccggccccagcagcgccggccggaaggccggcgcacctcgatgtagcaggaaagcggccggaacaaagcaaacgtccacacttaaacaggaggacgcatcaaagcgaaaagccgaacttgaagccgcagtccgtaaaaagatcgaattcgagcgaaaagccctacatatcgtggaacaactcctcgaagaaaatatcactgaggagttccttatggaatgcggcagatttattaccccagcccattatagcgacgtggtggacgaacgtagcatagtgaagctctgcggctatcccctgtgccaaaagaagctgggaatcgtgcccaagcagaagtataagatctcaaccaaaactaacaaggtgtatgatatcaccgaacgtaagtctttttgctcaaatttctgctaccaagcatcaaagttctttgaggctcaaatccccaaaacgccagtgtgggtcagggaggaagagcgccacccggactttcagctactgaaggaagagcaaagcggccattcaggggaggaggttcagctctgtagtaaggccataaaaactagtgacattgacaacccctcacactttgagaaacagtacgagagtagctcgtctagcacccactcagattcaagctctgacaatgaacaagacttcgttagctcaattttgccagggaaccgtcccaattcgaccaacattcgcccacaattgcaccagaagagcataatgaagaaaaaggccgggcacaaagctaatagcaaacataaggataaagagcaaactgttgtggacgtgaccgagcagcttggggactgtaaactggattcccaggagaaggacgcgacctgtgaactcccccttcagaaggttaacacacagagctcgtccaactcgaccttgcctgagagacttaaggctagtgagaactcggagtctgagtacagccgcagcgaaataactctggtaggaataagcaaaaaaagcgctgagcactttaagcggaaattcgcgaaatcaaaccaggtaagccggtctgtaagctcctctgtgcaggtgtgtcccgaggttggaaagcgtaatctgctgaaggtgttgaaggagaccctgatcgaatggaaaactgaagagacacttcgctttttatatggacagaactatgcctccgtgtgtttaaaaccagaagcctcactcgttaaagaggagcttgatgaggacgacattatcagcgatccggatagtcactttcccgcctggagggaaagccagaattcactggatgaatccctgcctttccgcggttcaggtacggccattaagcccctgccttcttatgaaaacctgaagaaggagaccgagaagctcaatctgagaatccgagagttttataggggacgatatgtgctgggagaggaaactacaaagtcccaagactctgaagaacacgattccacttttcctctgatcgattccagctcccagaatcagatcagaaaacggatcgtgctggagaagctgagtaaggtgcttcctggcttactagtgccactccagatcactcttggtgacatctatacccagctaaagaatctggtaaggacgttcagactcacaaatagaaatatcatccacaaacctgcagaatggacactcattgctatggtgctgttaagtttcttgcttaatgtcaagacgagaatcaaaacattcatgatgatatatttccacttaatgaactcctag

SEQ ID NO: 204049 - DNA, 1998 bp, Artificial Sequence
  Description of Artificial Sequence: Synthetic coding sequence
atgaccagcgccaacaaggccatcgagctgcagctgcaggtgaagcagaacgctgaggagctgcaggatttcatgcgcgatttagagaattgggagaaagacatcaagcaaaaagatatggagctgcgccgacagaatggcgtgccagaagaaaatctccccccaattagaaatgggaacttcagaaaaaaaaaaaagggtaaagccaaggagtcctccaaaaaaactagagaggagaacactaagaataggattaagtcttacgactacgaggcctgggccaaattagacgttgatcgcatcctcgatgaactggataaggatgacagtacccacgagtctctgtcccaggaaagcgagagcgaggaggacggcattcatgttgacagccagaaggcgttagtgctaaaagagaagggcaacaaatacttcaagcaagggaaatacgacgaggctatcgactgctatacaaaaggaatggacgccgacccttacaacccggtcctgcccacaaaccgcgccagtgcctatttccgactgaagaagttcgcggtggccgagagtgactgcaacttagcagtggctctcaataggtcatatactaaagcctattctagaaggggggccgcccgcttcgctctgcagaaattagaggaggcaaaaaaagactatgaaagagtgttggaacttgaacctaataactttgaggccaccaatgagctgcgaaaaatctcccaggccctggcttccaaggaaaacagttatccaaaggaggccgatatcgttatcaagtccactgagggcgagagaaagcaaatcgaggcccagcaaaataagcagcaggctatcagcgagaaagatcgcggaaatgggttcttcaaggaggggaagtatgagcgggctattgagtgctatacccgggggattgccgcggacggcgccaacgccttgctgccagcaaaccgggctatggcttatctgaaaattcagaagtacgaggaagccgagaaagactgtactcaggccattctgcttgacgggtcatattcgaaggccttcgccaggcgcggaacagctcgtacgtttctagggaaacttaatgaggcaaagcaagattttgaaaccgtcttgctattagagcccggcaacaaacaggcagtgactgaacttagtaagattaagaaagagctcatcgagaagggccattgggacgatgtcttcttagacagcacacaacggcagaacgttgtgaagcccatagataatccaccacacccagggtctaccaagcccctcaagaaagtgatcatcgaagagaccggcaatctcatacagacgatagatgtgccagacagcacgactgccgcagccccagagaacaatccaatcaatcttgcaaatgtcattgcggcgacgggcacaaccagtaaaaaaaattctagccaggatgacctgttcccaacgagcgacacaccacgcgctaaggtgcttaaaattgaagaggtttcagatactagtagcctgcaaccacaggcgagtctcaaacaggacgtttgccaaagttatagcgaaaaaatgccaatcgagattgaacaaaagcctgcccagttcgccactaccgtcctccctcccatcccggccaacagttttcagcttgaaagtgactttcggcagctgaagtcctctcccgatatgctttatcagtacctgaaacaaatagagccatccctgtatcccaagctgtttcaaaagaaccttgacccagacgtcttcaaccagatcgtcaaaattctccacgatttttatattgagaaagagaagccgctcctgatctttgaaatcctccagcggctttcagaattgaagcgtttcgatatggccgtgatgttcatgtccgagacagaaaaaaaaattgctagggctctgttcaatcatatcgataaatctggtcttaaagattcttcagttgaggaactcaagaagaggtacggagggtag

SEQ ID NO: 204050 - DNA, 1896 bp, Artificial Sequence
  Description of Artificial Sequence: Synthetic coding sequence
atgaccagcgccaacaaggccatcgagctgcagctgcaggtgaagcagaacgcggaagaactccaggacttcatgcgcgatctggagaactgggaaaaggatataaaacaaaaggatatggagctgcgacgccagaacggggtaccggaggagaacttgccccccatccggaatggtaattttagaaagaagaagaaggggaaggccaaggagtcaagcaaaaagacccgggaggaaaacacaaagaatagaatcaagagttatgactatgaggcctgggccaaactcgacgtggatcggatactggatgaattggacaaagacgacagtacacacgagtctctctcccaggagagtgagagcgaagaagacggaatacacgttgatagccagaaggctctggtcctgaaagagaaaggtaataagtacttcaaacagggtaagtacgatgaagccattgactgttacacaaagggcatggatgccgatccatacaatcctgttctgcccaccaacagggcctcggcgtattttcggctaaaaaaattcgcagtggcagaatctgactgtaacctcgcagtagccttgaacagaagctacacgaaagcctatagccggcgcggggcggcacgctttgcactacagaaattggaggaggccaaaaaggactacgagagggtgcttgagttagagcccaacaatttcgaagccacaaacgaattacgaaagatttcacaggccctggcatctaaagagaatagttacccaaaggaagcagacatcgtgataaaatcaaccgagggcgagcggaaacaaatcgaggcccagcagaacaagcagcaggccatatcggaaaaagacagaggcaatggattttttaaagaaggcaagtatgagcgagccatagaatgctacacaagggggatagccgcagatggcgctaacgcgcttttacccgctaacagagcaatggcttacctcaagattcaaaaatacgaagaggccgagaaagactgcacgcaggcaattctgttggatggtagttattcgaaggcatttgccaggcggggaacagccagaactttcctgggaaaactgaacgaagccaagcaggactttgaaacggttctgcttctggaaccagggaacaaacaggccgtgactgagttgtctaaaattaagaagaagcccctgaagaaagtgataattgaagagaccgggaatctgatccagacaatcgatgtgcccgatagcactaccgctgccgccccggagaacaacccaattaacctggccaacgttatcgctgccactgggactacttccaaaaagaactcttctcaggacgacctcttccctacaagcgacaccccgagagcgaaggtgctgaaaattgaggaggtgtccgacacaagctctttgcagccacaggcgtctctgaaacaggatgtgtgtcagtcctactccgagaagatgccaattgagattgagcagaaacccgcccagtttgcaaccacagtgttgcccccaatccccgccaactcgttccagttggaatcagattttcgacaactgaaaagctctcctgacatgctgtatcagtacctaaagcagattgagccgtcattgtaccccaagctcttccaaaaaaatctggatcccgacgtattcaaccagatcgtaaagatcctgcatgacttttatatcgagaaagaaaagcccctcctaatctttgaaatcctccaacggctcagcgagttgaaaagatttgatatggcagtaatgtttatgagtgagaccgaaaaaaaaattgcaagggcactctttaaccacatcgacaagtcaggtctaaaggacagcagcgtggaagaactgaagaagcgttatgggggatag

SEQ ID NO: 204051 - DNA, 1521 bp, Artificial Sequence
  Description of Artificial Sequence: Synthetic coding sequence
atggacgccgacccctacaaccccgtgctgcccaccaaccgggcctcagcctatttccgtcttaaaaagtttgcagtggcagagtctgattgtaacctggccgtggctctgaatcgcagctatactaaagcctatagccggaggggagccgctaggttcgcactgcagaaactggaagaggccaaaaaggattacgagcgtgtgctagagctggagccaaataactttgaagccaccaacgagttgcgaaagatcagtcaagccctggcctctaaggagaatagctacccaaaggaggcagatattgtcattaaatctaccgagggtgaacgaaagcagatcgaggcacagcaaaacaaacagcaggccatctccgaaaaagaccgggggaacggttttttcaaggaaggaaagtacgagcgcgccatagaatgctacacccgcggtatcgccgctgacggagctaatgctctgttaccagccaacagagccatggcgtatctaaagatacagaagtatgaggaggctgaaaaggattgcactcaggctatcctgctggatggttcttatagtaaggcttttgcgcggcgaggaaccgcaagaacattcttaggtaaactgaacgaagcaaagcaggattttgagaccgtcctgctcctcgaaccaggtaacaagcaggcggtgactgagctgtcaaagattaaaaaggagctgatagagaaggggcattgggacgatgtgtttctggatagcacccaaagacaaaacgtcgtcaaacctattgacaatcctcctcatcccggctccactaaacctcttaagaaagtgatcatagaggagaccggcaacctgattcagactatcgatgtccccgattcaactactgccgccgcccccgaaaataaccctatcaacctggcaaacgtaatcgctgccactggtacaacttccaaaaaaaattccagtcaggatgacttattcccaacatctgataccccaagggcaaaggttctgaaaatcgaagaagtttcagacacatcctccctacagccacaggcatctcttaagcaggacgtatgccagtcctactctgaaaagatgccaatcgaaattgaacagaaacccgcccagtttgccactacagtgctcccgcctatcccagcaaacagcttccagcttgagtctgatttcaggcagctcaaaagcagccctgatatgctttatcagtatctgaaacagatcgagccaagtctgtatcccaaactttttcagaagaatctggatcctgatgtgttcaaccaaattgtgaaaatattgcatgatttctacatagagaaagaaaagcccctgctcatttttgaaattttgcagcgccttagcgagctgaaacgctttgacatggctgttatgttcatgtccgagacggagaaaaagatcgctagggctctttttaatcacatcgacaagtccgggctcaaggatagcagcgtcgaggagcttaaaaagcggtacggcgggtag

SEQ ID NO: 204052 - DNA, 4821 bp, Artificial Sequence
  Description of Artificial Sequence: Synthetic coding sequence
atgatcgccgagcccgcccacttctacctgttcggcctgatctgcctatgtagcggcagtcggttgcgccaggaagactttcctccccgcattgtggagcatccttccgatctaatagtaagtaagggggagcccgccacgctgaactgtaaggctgaaggccgaccaacccctaccatcgagtggtacaaaggcggagagcgggtggaaaccgataaggacgacccaagaagtcacagaatgctccttccaagtggctctctattctttctgagaatagttcacggtcgaaaatcgaggccggatgagggggtgtacgtctgcgtggcgcggaattacctgggcgaggctgtgagccataatgcaagcctggaagtggcaatcctgcgggatgattttcgtcagaatcctagcgacgtgatggttgccgtcggcgagccagccgtgatggagtgtcaaccaccaaggggccatcccgaacctactataagctggaagaaggatgggtctccccttgatgataaagacgaacgcatcaccatcagagggggcaaactgatgattacatatacacgcaaatctgatgccggcaaatatgtgtgcgtgggtaccaacatggttggcgaaagagaaagcgaggttgcggaactaacagttctcgagaggccatctttcgtaaagcggccaagcaacttggccgttacggtagacgattctgccgagttcaagtgtgaggcaaggggagaccctgtcccgacagtaaggtggcggaaggacgacggagaacttccaaagtctagatatgaaatcagggatgaccacactttaaaaataaggaaggtgaccgcgggcgatatggggagctacacatgtgtggcggaaaacatggtcggcaaagcagaagcctctgctactctaactgtgcaagccccttccgagccaccccacttcgttgtgaaacctcgtgatcaggtggtagccctcggacgcaccgtgaccttccagtgcgaggctacgggcaaccctcaaccagctattttctggcgccgggaaggctctcagaatctgctcttctcttaccaaccgccccagtcaagcagccggttttccgtgtctcagaccggagatctgactatcactaacgttcagcgatccgacgtcggctattatatttgccaaacattaaacgtcgccggatcaataatcacgaaggcctacctggaagtcactgacgtcatagccgacaggccaccaccagtgattcggcagggacccgtaaatcagacagtggcagtcgacggtacctttgtcctgtcatgtgtggccacaggatccccagtgccaacaattctatggaggaaagatggagtgttagtgtccactcaggacagcaggattaaacagctagaaaacggagtccttcaaataagatacgcaaagctaggcgacactggacggtatacttgtattgcaagcacaccttccggagaggcgacatggtcagcctacatcgaggtacaggagtttggcgtgccagtgcagccaccccggcccaccgatccaaatctgattccgtcagccccttcaaagcctgaggttacggatgtatccagaaacaccgtcaccctgtcttggcagcctaaccttaattccggtgccacccccacatcgtatatcatcgaggcattttcccacgcttccggcagctcctggcagactgtagctgagaacgtaaagactgaaacgagcgctattaaaggactgaagcctaacgccatatatttgttcctcgtgagggcagccaacgcctacggaatctcggatccaagccagattagcgatcccgtcaagacacaggatgttctccctaccagccagggagtggaccacaagcaagtgcagcgggagttaggcaacgctgtgctccatttgcacaacccaactgtcctgagcagctcttcaatcgaagtgcactggactgtggaccagcagtctcaatatatccagggttataagatcctgtacagacctagcggcgccaatcatggagagtctgactggttggtgtttgaggtccgcaccccggcaaagaacagtgtggttatcccagacctccggaagggtgtcaattatgaaattaaggctcggccatttttcaacgaattccagggggcagacagtgagatcaaattcgcaaagaccttggaagaggcaccgtcggcccctccacagggcgtaaccgtttcaaaaaacgatggcaacggcacagcgatcctggtgtcctggcagcctccccctgaagacacacaaaatggcatggtccaagaatataaggtctggtgcctgggcaacgaaacccgctatcatatcaataaaaccgtggatggaagtaccttctcggtcgtcataccctttctcgtacccggcattaggtacagtgtcgaggtggccgcctctaccggagccgggtcgggtgtaaaaagtgaacctcagttcattcagttggatgcacacggcaaccctgtgtctccggaagaccaagtatcgctggcacaacagatctctgatgtggtgaagcaacccgcattcatcgcagggatcggggccgcatgctggattatccttatggtcttcagcatttggctatatcgtcatagaaagaaaagaaacggcctgacttctacatacgccggaatacggaaggtaacatatcaaagaggaggcgaggccgtctcttccggcggccggcccgggctgctcaatatctcagagcctgccgcacagccctggctggcggacacatggcccaatactggtaataatcacaatgattgttctatttcgtgctgcactgcagggaacggcaactccgacagcaacctgacaacttattccaggcctgcagattgcattgcaaactacaacaaccagctggacaacaagcagaccaatctcatgttgccagagtctacagtgtacggagacgtggatctctccaataagatcaatgagatgaaaacgttcaattcgccaaatctcaaggacgggcgttttgtcaacccgtcaggtcagcccacgccatacgcaactacacaacttatccagagcaatctgagcaataacatgaataacggctccggagattcaggagaaaagcactggaagcctctgggccagcagaaacaagaagtggctcctgtacagtacaacatcgtggagcagaataaacttaataaggactacagggccaatgacacagtgccacctactatcccttacaatcagtcctacgatcagaatacgggtggaagctacaacagcagtgatagagggtcttcaacgtcggggagccagggacacaagaagggcgcccgcaccccgaaggtccccaaacagggaggaatgaactgggcagacctactgcccccgccacctgctcaccctcccccccactccaactccgaagaatacaacatttccgttgatgagagctacgatcaagaaatgccctgtcccgtaccacccgcgcggatgtacttgcagcaggatgagctggaggaggaggaggatgaacgagggccgacccccccggtacggggtgccgcgtcttcccccgccgctgtgtcatattctcaccagtcaaccgcaacattgacgccgagcccccaggaagaactccaacccatgttgcaggattgcccggaggagacagggcatatgcagcaccagccggaccggcggcggcagcccgtgtccccaccaccgcctccccgacctatatcgccgcctcacacatatgggtatatctctggccccctggtcagcgatatggacacagacgctccggaggaggaggaagatgaggctgacatggaggtggccaaaatgcagactcggaggttgctactcaggggactcgagcagactccggctagcagtgtgggagacctggagtcatcagtcactggatcaatgattaatggctggggatctgcatctgaagaggataatatttccagtggaaggtcgtccgtctctagttccgatggatcttttttcaccgacgctgactttgcacaggctgtggccgcggcggctgaatatgctggcctgaaggtggcaagacggcaaatgcaggacgccgccggaaggaggcatttccacgcgtcccaatgtccccgcccaacaagtcctgtgagtaccgactcaaatatgtccgctgctgtgatgcagaagacgcgccccgccaagaagctgaaacatcagccgggccacctgcgccgggagacctacaccgatgatctccctcctccccccgtgccccctcccgcgattaagtctcctacagcacagagcaagacccagttagaagtccgaccagtggtcgtgcccaaactgccgtctatggatgctaggactgataggtccagtgaccgaaaaggttcaagctataaagggcgggaggtacttgacggaaggcaagtcgtggacatgcgtacaaatccgggagatccccgggaggctcaagagcaacagaatgacggaaaggggcgaggtaataaagcagctaaaagagatctgcccccagctaagacacatttaattcaagaagacatacttccctactgccgcccaacttttccgacctcgaacaacccgagggacccatcttcctcctcgtccatgtcctcccgcggctcaggctctagacaacgcgagcaggcaaatgtgggccggcgtaacattgcagagatgcaagtgctgggaggctacgagaggggagaggataacaacgaggaactggaagaaacagagagttag

SEQ ID NO: 204053 - DNA, 4968 bp, Artificial Sequence
  Description of Artificial Sequence: Synthetic coding sequence
atgaagtggaagcacgtgcccttcctggtgatgatcagcctgctgagcctttctcctaatcacctcttcttggctcagctgatcccagaccccgaggatgtggagagaggaaacgatcatggaacaccaattccaactagtgataacgacgataatagcctgggctataccggatctagactgcgtcaagaggactttcctcctcgcatagtggaacatccttctgaccttatcgtgagcaagggagagcctgctactctcaactgcaaagcagaaggcaggcctacacccactatcgagtggtacaagggtggagaaagggttgagactgataaagatgatccacgctctcaccgcatgttgctgcctagtggcagcctgttcttcctccgcatcgtgcacggtcgcaaatctaggccagacgaaggcgtgtacgtgtgtgtggctcgaaattatctgggggaggccgtctcgcataacgctagcctggaggtagctatccttcgtgacgattttcggcagaacccttcagatgtcatggtggccgttggcgagcccgccgtaatggagtgccagcccccacgtggacatcctgagcccactatttcctggaaaaaagacggtagcccgcttgacgacaaggacgagagaattaccatccggggcggaaagctgatgatcacatacacaaggaagtcggacgctgggaagtatgtatgtgtcggaacaaacatggtgggagaaagggagtccgaggtcgctgaattgaccgtgttggagcggcccagcttcgtgaagagaccaagcaacctggcagtaaccgtggatgactctgcagagtttaagtgcgaggctaggggggacccagtccccactgtccgttggagaaaggatgacggcgagctcccaaagagtaggtacgagattcgagacgaccatactctaaagattagaaaggtaactgcaggcgatatgggtagctatacttgtgtcgctgaaaacatggtgggcaaagcagaagcttccgcaacactgacagtgcaggaaccgccccacttcgttgtgaagccaagagatcaagtggtcgctctgggtcgtacggttacattccagtgtgaggccacgggaaatcctcagccggccatcttctggagacgggaaggcagccagaacctgctcttctcttatcagccccctcagagctcctcacggtttagtgtctcacagacaggagacctcacaatcacaaatgttcagcgctccgacgtaggctactacatttgtcagacactgaatgtcgcaggttcaatcataacgaaggcttatctggaggtaactgatgtgatcgccgataggcccccacctgtcatccgtcagggacctgttaatcaaaccgtggccgtcgacggtacattcgtgcttagttgtgtcgccactggcagccctgtgccgaccattttgtggaggaaggacggggttctggtttcaacgcaggactctcgtatcaagcagttagagaatggagtcctgcagatcagatatgccaagttgggggacacagggaggtacacctgcattgccagcacaccctccggcgaggccacatggagcgcctacatcgaagtgcagggtaaggttaatgagttcggcgttcccgtgcaacctcctcgacctactgatcccaatttgatcccctcggctcccagcaagcctgaagtgaccgacgtgagtcggaataccgttacgctgtcctggcagcccaatttgaatagtggtgcaacccctacatcttatataattgaggctttctcccacgcatccggatccagttggcagacggtggccgaaaacgtgaagaccgaaacaagcgcaattaagggactcaaacccaacgccatctacctgtttctcgtgcgcgccgccaacgcttatgggatctccgatccaagtcagatttcagatcccgtcaaaacacaggatgtgctacccacaagtcaaggcgtggaccataagcaagtccagcgcgagttgggaaatgccgtcctccacttacacaaccccaccgtgctgtcatccagttccatcgaagtgcactggaccgtggaccagcagagccagtacatccagggatacaaaattctctatagaccaagtggagctaatcacggagaaagcgattggcttgtcttcgaagtcaggaccccagccaagaattccgtggttataccagatctgagaaagggagtgaattatgagatcaaagccagacctttttttaatgagtttcaaggtgccgattccgaaattaagttcgccaagaccctggaggaagccccgagcgcccctccacagggcgtgaccgtgtccaagaacgacggaaatggaactgctatactcgtgtcatggcagccccccccagaagacacgcagaacggaatggtccaggagtataaagtctggtgtttaggcaatgagactcgataccacatcaataagacagtcgatggatctacattttctgtggtgataccttttttggtccctggtattagatactctgtggaggtggccgcctcaacgggagctgggagcggggtgaaaagtgaaccgcagtttatccagctggatgcccacggcaatcccgtaagccctgaagaccaggtgagccttgcccagcagattagcgatgtcgtcaaacagccagcattcattgctggcataggggcggcttgttggatcatcctgatggtgttctcaatctggctctaccgccacagaaagaagagaaacggtcttaccagtacatatgccgggataagaaaagtcccatcttttacatttacaccaaccgttacctaccagcgcggaggcgaggccgtgtcaagcggaggccgcccagggttgctgaatatctctgaaccagcggcccagccatggctggccgacacctggcctaatacaggtaataaccacaacgattgtagtatttcttgctgcacggccggtaacggaaacagcgactccaacttaacaacatactcacgacctgccgactgcatagctaactataataatcagctggataataagcaaaccaacctgatgctccccgagagcaccgtgtatggcgacgtggacttatccaacaagatcaacgagatgaaaaccttcaacagccctaacctgaaggacgggaggttcgtgaacccctcagggcaacctaccccctacgctaccacccagctgatccagtctaacctgagcaacaacatgaataacggaagtggtgacagcggtgagaaacactggaagccactgggacagcagaagcaggaggtagcaccagttcaatataacatcgtcgagcagaataagcttaacaaagactatagagctaatgacacagtgccgccaactattccctataaccaatcttatgaccagaataccgggggaagctataactcctccgacagagggagcagcactagcggcagtcaaggccacaagaaaggcgctcgcacacccaaagtccctaagcagggagggatgaattgggctgatctcctgcctcccccgcccgcacatcctcctccgcatagcaacagtgaggagtacaacatcagcgttgatgaaagttacgaccaagagatgccatgccctgtcccccccgctcgaatgtacttacagcaggacgaacttgaagaggaagaagatgagcgcggacccaccccacccgtacggggtgctgcttcttcacctgcagctgtgagctattctcaccagagtacagccactctgacgccatcaccccaagaggaactccaacccatgttacaagattgtcccgaggagacgggacatatgcagcaccagccggataggagaagacagccagtcagtcccccaccacctccaaggcctatctctcctcctcacacatacggatatatctctggtcccttggtgtccgacatggataccgatgcacccgaggaagaagaagacgaagctgatatggaagttgcaaaaatgcagactcggcggctcctactcagaggtctagagcagacgcccgcttctagcgtgggcgatctggagagcagtgttactggaagtatgattaatgggtgggggagcgcctctgaagaagataatatttcttctggcagatctagcgtcagcagcagtgacggctcatttttcaccgatgccgacttcgcccaggctgtggcggctgccgctgagtatgctgggctgaaagtggcaagacggcaaatgcaggatgcagcaggcagaagacattttcacgcctctcagtgtcccagaccaacatctcctgtgtccaccgattccaacatgtctgccgccgttatgcagaagacccgtcctgctaagaagcttaaacatcagcctggccatttacggagagagacctacaccgacgatctccccccacctcctgtccctcccccggccattaaatctcctaccgcccaatccaaaacacagcttgaagtgaggccggtcgtcgtgcccaaactgccgtcgatggatgcacgcactgacagaagtagcgatcggaaggggtcttcttataaaggacgagaagttcttgatggcaggcaggtggtcgatatgaggaccaacccaggcgaccctagagaggcccaggaacaacagaacgacggcaagggcagggggaacaaagctgcaaagcgggatctgcccccagcaaaaacacatctgatccaggaggacattctaccttactgccgcccaaccttcccaacgtccaataatccccgagatccttctagcagcagcagcatgagttccaggggcagcggttctagacagcgagaacaggccaacgtcgggcgccggaacatagctgaaatgcaggtgctgggagggtacgagcgcggagaggacaataacgaggagctcgaggaaccttccagctag

SEQ ID NO: 204054 - DNA, 4839 bp, Artificial Sequence
  Description of Artificial Sequence: Synthetic coding sequence
atgatcgccgagcccgcccacttctacctgttcggcctgatctgcctctgttcaggctcccgattgcgtcaggaagattttccaccgcgcattgtcgagcatccatctgatctgatagtctctaagggcgaacctgctacactgaattgtaaggctgaaggccgccccacacccaccattgagtggtacaaagggggggaacgcgtcgagactgataaggacgatccgaggagtcacaggatgctgctgcctagcggcagtctgttctttctgaggattgtgcacggcaggaaatcacggcccgacgagggagtgtacgtgtgtgtcgcgagaaactacctaggtgaggctgtctcccacaatgcgtcactcgaggtcgcgatactgcgcgatgacttccggcagaatccgagtgatgtgatggtcgcagtcggcgagcctgccgttatggaatgccagcctccgcggggacaccccgaacccacaatctcctggaagaaggatggctctcctctggatgacaaggatgagcgcataacaattcgtggtgggaagcttatgattacatatacaaggaaaagcgacgctggcaagtacgtatgtgtcggcactaatatggtcggggagagggagtcagaagtggctgagcttactgtgttagaacgcccgagttttgtgaagcgcccgtctaacctggcagttaccgttgatgattcagcagagtttaagtgtgaagcccgaggggaccccgttccgaccgtgaggtggagaaaagacgacggcgaactgccaaaatcccgctatgagatacgcgatgatcatacgctgaagatcaggaaagtaactgccggtgacatgggcagctatacgtgcgttgcagagaatatggttgggaaggcagaggctagtgctacactgactgtccaggaaccccctcacttcgtcgtaaagcccagagatcaggttgtcgccctggggagaaccgttacatttcagtgcgaagcaacaggtaatccccagcctgctatcttttggcggcgggaaggaagccagaatctgttgtttagctaccagcccccgcaatccagtagccggttctctgttagccagaccggcgatctcacgattaccaacgttcagcgaagcgacgttgggtactacatctgccagactttgaatgttgccggcagcataatcactaaggcctacctcgaggtcactgatgtgatcgccgatcggccccctcccgtgatccggcaaggacctgttaaccaaaccgtggcagttgacggaacttttgtgctgtcctgcgtggcaactggtagccctgtgcctacgatcctgtggcggaaggatggcgtgctggtgtcgactcaagatagtcggatcaagcagctcgaaaacggtgtgctgcagattcgatatgccaaactgggggacaccggaaggtacacttgtatagcctctaccccctctggagaagctacttggtcagcatacattgaggtccaagagtttggtgtgccagtacagccacctaggcctacagatccgaatttaattccaagcgctccttccaaacctgaggtgacagacgtatctcggaacacagttacattgagctggcagccgaacttgaattctggcgccactcccacttcctatattatcgaagcttttagccacgcttctgggagctcgtggcagaccgtggccgaaaacgtgaagacggagaccagtgcaattaaaggattgaaacctaacgcaatctatctgttcctcgtgagggctgctaatgcctacggtatctccgacccaagccagatctcagatccagttaagacacaagacgtgcttccaactagccagggggtggaccacaagcaagtccagagggagcttggaaacgccgttttgcacctgcacaaccccaccgttctgtcctccagttcgatcgaagtgcactggactgtggaccaacagtcacagtacatccaaggctataagattctgtataggccctccggggctaaccatggagaatctgactggctcgtgtttgaggttaggacacctgccaagaactccgtcgtaatacctgatctgcgcaagggtgtgaactacgaaataaaggcacgaccgttctttaacgagtttcagggagccgacagcgaaatcaagttcgcaaagacacttgaggaggcacccagcgccccccctcagggagtgaccgtgtccaaaaacgacggaaacggcactgccatcctcgtgtcatggcagccgccgcctgaggatactcagaacggaatggttcaagagtacaaggtctggtgtctgggtaacgagacccggtatcacatcaataagaccgtcgatggctctactttttccgtggttatcccattcctagtgcccggcattaggtattctgttgaagtagctgcatccactggcgcaggctccggtgtgaaatctgaaccacaattcatccagcttgacgcgcatgggaaccctgtgtcacccgaagaccaggtaagtctcgcgcagcagattagcgacgtggttaaacagcccgccttcatcgctggcattggggccgcctgctggatcattctgatggttttctccatctggctatatcgacaccggaagaagcggaatggccttacctctacatacgccggtattaggaaagtgccaagctttaccttcactcctactgtgacataccagaggggaggagaggctgtcagcagtggtggcaggcctggactcttgaatatctcggagcccgcagctcagccctggttggcagacacctggccgaatacagggaacaatcacaatgattgcagcatttcttgctgtacagccggaaatggtaatagcgactcaaacctgactacgtacagtcgacccgcagactgcatcgcgaattataataatcagctggacaataagcagaccaacctgatgcttcccgaaagcactgtgtatggtgacgtcgatctatctaataaaataaatgaaatgaaaacatttaactctcctaatctgaaggacgggcggtttgtcaacccatccggacagcctacaccttatgctactacacagctgatccagtccaacctgtcgaataacatgaataatggaagcggcgatagcggcgaaaaacattggaagcccctaggccagcaaaagcaggaagttgctccagtgcaatataatatcgtggaacagaataagcttaacaaagactacagagccaacgatactgtgccacctaccataccatataaccagtcctatgaccagaatacgggtggctcctacaactctagtgataggggtagctcaacctcagggtcccagggacacaaaaagggggccaggacccctaaggtgcccaagcaaggcggtatgaattgggctgacttactgcctcccccaccggctcatcctcccccacatagtaactcagaggagtacaacatcagtgtggacgagtcttacgatcaggaaatgccctgccctgtccctccggcccggatgtatttgcagcaggacgaactggaggaggaggaggacgaacggggcccaacgcctccagtcagaggcgccgccagctccccagccgctgttagttacagccaccagtcgactgctaccttaaccccctcccctcaagaggagctccaacctatgttacaagattgtcccgaggagactggtcacatgcaacaccagcctgacagaagaaggcagccagtgagtccaccgccacccccccgacctattagcccccctcatacatatgggtacatttccggtccactagtcagcgatatggacactgatgcacccgaggaggaggaagatgaggctgatatggaagtggcaaagatgcaaaccaggcggctgctcttacgcggtctggagcagacccccgccagctccgtgggggatttagaaagctctgtgacggggtcaatgattaatggctgggggtcagcctcagaagaggataatatttcttccgggcgatcctccgtttcaagctccgatgggtcatttttcacagatgccgatttcgcccaggcggttgcagctgcagccgagtacgctgggcttaaagttgcccgacggcagatgcaggacgctgcgggtagacgccacttccacgcatcacagtgtccccggccgaccagtcccgtgagcactgactccaacatgagcgccgccgtcatgcaaaagacccgtccggccaagaaactgaagcatcagcccggacacttgcgacgagagacgtacacagatgatctgccaccgccccctgtgccacctcctgccatcaagtcacccaccgcccagagcaaaacacagctcgaggttagacctgtcgtcgtacctaagctgccctctatggatgccagaacagataggtcaagcgatagaaagggctcctcctacaaaggacgggaggtgctcgatggccgacaggttgttgacatgaggacgaatcctggtgatccacgcgaagcccaagaacaacaaaacgacggtaagggtcgcgggaataaagcagccaagagagacctccctcctgcgaaaactcacctcatccaggaagatatcctcccttattgccggccgaccttcccgacaagtaataatccaagggacccttcatctagcagtagtatgagctccagaggatccggctctcggcaacgggagcaggccaacgttggaaggaggaacatcgccgagatgcaggtgttaggcgggtacgaacgcggagaggataataatgaggagttagaggagaccgagtcctag

SEQ ID NO: 204055 - DNA, 4956 bp, Artificial Sequence
  Description of Artificial Sequence: Synthetic coding sequence
atgaagtggaagcacgtgcccttcctggtgatgatcagcctgctgtctctctccccgaaccatctatttctggcacagctcatccccgacccagaagacgttgagaggggaaacgaccacggaacaccaattccaacgtctgacaatgacgataattccctcggctacacaggctcaagactgagacaggaagactttccaccgcgcatcgtggagcacccaagcgacttaatcgtgagcaaaggcgaacctgctaccctcaattgtaaggcggagggccggccaactcctaccatcgagtggtacaaaggaggagaaagggtggaaactgacaaagacgatcctcggtcacaccgaatgttgttgccatccgggtcgctgttcttcctccgtatcgtgcacggacggaaatctcgcccggatgaaggtgtgtacgtttgcgtggctaggaattacctgggcgaggccgtgtcccataatgcttccttagaagtggctatcctcagagacgattttcgacaaaatccttctgatgtaatggtggcggtcggcgagccagctgtgatggaatgtcagcccccacgcggccatcccgaacccacaatctcctggaagaaggatgggagtccgcttgatgacaaggacgagcggattaccatcaggggcggtaaactgatgataacttacaccaggaagtctgacgctggcaagtacgtgtgtgtcggaacaaacatggtgggcgagcgtgaaagcgaggttgcagaactcactgtcctagaaagacccagttttgtcaaacggccatccaatctggcggtcactgtggatgattcagctgaatttaagtgtgaagcgcggggcgatccagttccaacggtgaggtggcgcaaggatgatggtgagttgccaaaaagcagatacgaaatccgcgacgaccatactctgaaaatccgtaaagtgactgcgggggacatgggctcatatacctgtgttgcagagaatatggtggggaaggcagaggccagtgccaccctgaccgtgcaggagcctccacactttgtcgtaaaaccccgcgaccaagtggtcgctctgggccgaacagtgacttttcaatgcgaggccactggcaacccccagccggcaatcttctggcgcagggagggatcccagaacctccttttcagctatcaaccaccacagagttcatctagattttctgtcagtcagaccggggacttgactattacgaatgtccaacgcagcgacgtggggtattacatttgccagacgctgaacgtggccggctctatcatcaccaaagcatacttggaggtgactgacgtcattgctgatcggcctcccccggtcatcaggcaaggacccgtgaatcagactgttgcagtggatggaacctttgtcctgtcatgcgtggcaaccggaagccctgtgcccaccatcctctggagaaaggacggagtcttagtcagtactcaagacagccgcatcaagcagttagaaaatggagtgctgcagataaggtacgccaaactgggcgacaccggtagatatacctgtatcgcgtctaccccgtcgggtgaagccacttggagcgcctacattgaggtacaggagttcggtgtgcctgtgcagccgcctcggcccaccgatccaaacctgatcccaagtgccccttcgaagcctgaggtgaccgacgtctcccgcaacactgttactctgagctggcagcctaatttgaattccggcgccactcccaccagctatatcatagaggccttttctcacgcaagcggctcatcatggcagacggtagcagaaaatgtgaagacggagaccagcgcaatcaaggggctgaagccgaacgctatatatttatttttagtgagagccgcgaacgcctacggtatcagcgatccatcccaaatcagcgacccagtcaagacccaggacgtcctcccaaccagccaaggggtcgaccacaaacaggtacagcgggagttggggaacgctgtgttacacctgcacaatcccacagtcctgtcttcctcttctatcgaggtccactggactgttgatcagcagtcacagtatatccagggatacaaaattctgtatcggccatccggtgcgaatcacggtgagtccgactggctcgtttttgaggttcggactcccgccaagaattccgtcgttatacccgacttacgaaagggcgtcaattatgagatcaaggccagaccatttttcaacgaattccagggtgccgattccgagatcaaattcgcaaagactttggaagaggctcccagcgcccctccccagggagtgacagttagcaaaaatgatggaaatggtactgccattcttgtgtcatggcaaccacctccagaagacactcagaatggcatggtgcaggagtataaggtatggtgcttgggaaacgaaacgaggtaccatatcaacaagaccgtggacgggtccacattctcagtcgttattccctttttggttcctggaatacggtactctgtggaggtggcagctagtactggtgctggctctggcgttaagagcgagccacaatttattcaactcgatgcccatgggaatcccgtatcgccagaggatcaagtttccctcgcccaacagatttccgacgttgtcaagcagccggcattcatagcaggcatcggggctgcctgttggatcattttgatggtgtttagtatctggttgtaccgacacagaaaaaagagaaacggactgacatcaacatatgcggggataaggaaagtgccgtcattcacgtttacccctaccgtgacataccagagaggcggggaagccgtgtctagtggtggtaggccaggcctgcttaacatcagcgaacctgcggcccaaccgtggctggccgatacctggccaaacaccgggaataaccataatgactgctctatctcctgctgtaccgccggtaacggcaacagtgacagtaacttgacaacatattcgcgtcctgctgactgtattgccaattataacaatcagcttgacaataagcagacgaacttgatgttacccgagagcaccgtatacggggacgtcgatctgtcaaacaagatcaacgagatgaaaacttttaactctcccaacctgaaggacggtaggttcgtgaatccttccggtcagcccactccatatgcaaccacacagctcattcagtcgaacctgtctaacaatatgaataatggaagcggagacagcggagagaagcattggaagccattaggacaacaaaaacaggaagtggccccagtgcaatataatatcgttgaacagaacaagctcaataaagactatcgcgctaatgatacagtcccacccactatcccctataatcagtcctatgaccagaacaccgggggttcctacaactcttccgaccgcgggtcttctacgagtgggtcccagggccacaagaaaggtgccaggacaccgaaggtgcccaagcagggcgggatgaattgggccgatctcctgccaccaccacccgctcatccgccaccccactcaaattctgaggagtataatatctccgtggacgaaagctatgaccaggagatgccctgcccggtgcctccggcacggatgtacctgcaacaggacgaacttgaagaggaagaggatgaaagaggcccgacacctccagtacgcggcgctgcatccagccctgctgcggtgtcttatagccaccagtcgaccgctacccttacaccctccccccaggaagagctccaaccaatgcttcaagactgccccgaggagacggggcacatgcagcaccagcccgataggcgcaggcaaccagtatctcctcccccgccacctcgacctatttcacccccacacacctacggatacatctccgggccccttgtgagcgatatggacacagatgccccggaggaggaggaggatgaagccgacatggaggtcgccaaaatgcaaacgagacggttactcttgagggggctcgagcaaactcccgcatccagcgtgggggatctggagtcctctgtgacggggtcgatgattaatgggtgggggagcgcaagcgaggaagataacatcagctctggtcgctcatcggtttcttcaagtgacgggtccttctttaccgacgcggattttgcccaagccgtcgcagccgctgcggagtacgctgggctcaaggtcgctcgccggcagatgcaagatgctgctgggcgccgccactttcacgcttcccaatgccctaggcctacctcaccagtgtcaactgatagcaacatgtcagccgcagtaatgcaaaagacaagaccagccaagaaactcaaacaccaaccgggtcaccttagacgggagacttataccgatgacctacccccacctccggtcccaccacccgcaatcaaatccccaactgctcagagtaaaacccagctcgaagtacggcccgtagtggtcccaaaactgccaagcatggacgctcgtaccgatcgatcttccgacaggaaggggtctagctataaaggtagagaggtgctggacggaagacaagtcgtggacatgcggaccaatcccggggatcctcgggaggcacaagagcagcagaatgatggtaaaggacgcggcaataaagctgcaaagcgcgacctgcccccggccaagacacacctcatccaggaggatatcttaccatactgtagacccacgtttccaacttctaataatccacgggatccgtcctctagttcaagcatgagctcgagggggagtggtagcaggcagagggaacaggctaacgtcgggcgccgtaatattgctgagatgcaggtcctgggcgggtatgagcgcggggaagataacaatgaggagctggaagaaaccgagagttag

SEQ ID NO: 204056 - DNA, 4656 bp, Artificial Sequence
  Description of Artificial Sequence: Synthetic coding sequence
atgatcgccgagcccgcccacttctacctgttcggcctgatctgcctgtgttctggctcaaggttacggcaggaagactttccccccaggatagttgagcatccgtctgatctgattgtgtccaagggggaacccgccacactgaactgcaaagccgagggcagacctacccccaccattgaatggtataagggaggcgaacgagttgagactgataaggatgaccctaggtcccaccggatgttgttgcctagcgggagcctgtttttcctgaggattgtgcacggccggaaatcgagaccagacgaaggtgtatacgtatgcgtggctcgaaattacctcggggaggccgtttcccataatgcttcgctggaggtagccattctccgggacgactttcgccaaaacccctccgacgtaatggtcgcagtcggtgagcccgcagttatggaatgtcaaccgccacgggggcatcctgagccgactatttcttggaaaaaggatggtagtccattagacgacaaggacgagcgcataaccatccggggagggaagttgatgattacctatacgcgtaaaagcgatgcaggcaagtacgtgtgtgtgggcacaaatatggtgggggagcgggagagcgaagtcgccgaactgaccgtgcttgaacggccgtcctttgtgaaacgcccctcaaaccttgccgtgaccgttgatgactcagctgagttcaaatgtgaagctagaggcgatccggtgccaacagtccggtggcgaaaagacgacggtgaattgccaaaatcacggtatgaaatccgggatgatcatacactcaagattagaaaagtgaccgccggcgatatgggaagctacacatgtgttgcagaaaatatggtgggcaaagctgaggcctctgcaactctcacagtgcaagtgggtagtgagccgccccactttgttgtgaaaccgcgcgaccaggttgtggcccttgggcggacagtgacttttcagtgcgaggccactggtaacccccagccagccatcttttggaggagggaaggaagccagaacttactatttagttaccaacccccacagtcatcctctcggttttcagtctctcagactggggaccttacaattaccaacgtacagcgctcagacgtgggatactatatttgccaaaccctaaacgtggccgggtctataatcaccaaggcctatcttgaagtgactgatgtgattgccgacagacctcctcccgtcatccgccaaggacccgtgaatcagaccgtcgctgtggacggaacgttcgtactgtcgtgtgttgcaaccggctcccccgtccccaccatcttatggagaaaagacggtgtgctcgtttcaacacaagattcccgcattaagcaactggagaacggtgttctacaaatccgatatgctaagcttggcgacaccggtcgatacacttgtatcgcctccacgccgtccggggaagcaacttggagcgcctacatcgaggtccaggaatttggcgtgccggtgcagcccccacggccaacggaccccaatctgatcccatccgctccgagtaagccggaggtgactgatgtgagccgtaatactgttacactgtcctggcagccaaatctaaacagtggtgcaacgcccaccagttacataatcgaagcttttagtcacgcctcaggcagcagctggcagactgttgcagagaatgtgaagactgagacatccgccataaaaggcctcaagccaaacgccatctatctgttcctcgtaagagcagccaacgcatacggcatatctgacccgtcccagatcagcgatcctgtgaagactcaggatgttctgcccacaagccaaggcgtcgatcataaacaggtgcagagagaactgggaaatgcagtgctgcacttacataacccaaccgtgctctcctctagtagcattgaggtccactggactgtcgatcagcagagccagtacatacaggggtacaagattctataccggccaagcggtgctaaccacggtgagagcgattggctggtcttcgaggtccgcactccagcgaagaactccgtcgtaataccagatctgcggaaaggagttaattacgaaatcaaagcaaggccattctttaatgagttccaaggagctgactctgaaataaaattcgccaagacacttgaggaggcacctagcgcccctccccaaggagtcacagtgtcaaaaaatgacgggaacgggaccgcaatattggtttcttggcagccccctcccgaggacacccagaatggtatggtacaggaatacaaagtctggtgtctgggtaatgagacaagataccatattaacaagacagtggatggaagcacatttagcgttgttattccatttttggttcccggcatcagatattccgtcgaggtggcagcctccaccggagccggatcaggcgtgaagtctgaaccccaattcatccagttggacgcccatggcaatcctgttagtccggaggatcaggtgagtctggcgcagcaaatttctgatgtcgttaagcagcccgcctttatcgcagggattggcgcagcctgctggatcatcctgatggtcttctctatttggctttacagacacaggaagaagaggaacggcctgacctcgacgtatgctggtatcagaaaagttacataccagaggggcggcgaagcagtctctagcggtggacggcccgggcttttgaatatcagtgaacctgcggcacagccctggctggcggatacatggcccaatacgggcaacaatcataacgattgttccattagctgttgtactgctggcaatgggaactctgactcgaatctaaccacttattcacgccctggtcaaccaacaccctacgcgactacccaactcattcagtcaaatctgtccaataatatgaacaatggatcaggcgatagtggcgagaaacactggaagcccttaggccagcagaagcaagaagtcgccccagtgcagtacaatattgtggagcaaaacaaactcaacaaagattatcgggctaacgacaccgtgcccccaactattccatacaaccagagttacgatcagaatactggcggttcctacaactcgtcagacagaggttcgtctaccagcggaagtcaaggccacaaaaaaggagcacggacccctaaggtgcctaaacaaggcgggatgaactgggccgatctcctgcccccaccgcccgctcaccctcccccccactccaacagtgaggaatataatatcagtgtagatgaaagttatgaccaggagatgccatgcccggtcccaccggccaggatgtaccttcagcaagatgaacttgaggaggaggaggacgagcgggggcccaccccccctgtgagaggagcggcttcctcccccgctgcagtgagctactcacatcagtcaacagctacgctcactccctcaccacaggaggagcttcaacctatgttgcaggactgtcctgaggaaactggacacatgcagcaccagccagaccggcgccggcagccagtgtcgcctcccccaccccccaggccaatctcgccgccacacacctatggttacatctctggaccactcgtgagcgatatggataccgacgcaccggaggaggaagaagatgaggccgacatggaagtggccaagatgcagaccaggcgactcctgttgaggggtctggaacagaccccggcatcctctgtgggtgacctggagtccagcgttaccggtagtatgatcaatgggtggggcagcgctagcgaagaagacaacatttcttccgggagaagcagtgtatcctcatctgatggttctttttttacagatgcagactttgcccaggcggtcgctgctgccgctgagtatgctggccttaaagtagcgcggaggcaaatgcaggatgctgcagggaggcgccattttcatgcctcccagtgtcccaggcctaccagccccgtttccacagattctaacatgagtgccgcagtcatgcaaaaaacaaggcccgccaagaaactcaagcaccaacccggccacctgcgtcgagagacatacactgacgacctgccacctccaccggtgccaccgcccgccattaaatcccccaccgctcagagcaaaacccagctggaggttcgccccgtggtggtgccaaaattaccatcaatggacgctaggaccgacagatcaagtgatcggaaagggtctagttataaagggagggaggtattggacggccggcaggtcgtggatatgaggaccaaccctggcgacccaagggaggctcaggagcagcagaacgacggcaagggacgtgggaataaggctgccaaacgtgacctccccccagccaaaacccacctaatacaggaggatatcttaccatactgtcgtcctaccttccccaccagcaacaatccaagagacccttccagtagctcctccatgagcagcaggggttccgggagcagacagagagagcaggctaacgtaggcagaaggaacatcgctgagatgcaggtcctaggcggatacgaaagaggagaagataataatgaggaactcgaggagaccgagtcctag

SEQ ID NO: 204057 - DNA, 4821 bp, Artificial Sequence
  Description of Artificial Sequence: Synthetic coding sequence
atgatcgccgagcccgcccacttctacctgttcggcctgatctgcctttgcagcggatctaggctgcgtcaggaggactttccgcctagaatcgtcgagcacccctccgatttaattgtttccaaaggggaaccggccaccttgaattgtaaggcggagggcaggcctactcccactatagagtggtacaaaggcggtgagagagtggagaccgacaaggatgatccaaggtcccatcgaatgctgctcccttcaggcagcttgttttttctcagaatagtgcatggccgtaaatccagacccgatgaaggggtctatgtttgcgtggcccgtaattacctcggtgaggcggtgtcacataacgcctctttggaagtggctattctgagagatgacttcagacagaacccttctgatgtaatggtagcagtcggggaacctgcagtgatggaatgccaaccacctcggggccatccagagcctacgatcagctggaagaaagacggctcacctctggacgacaaggatgagcgaattaccatccggggggggaaactgatgattacttacacaagaaaaagcgacgcaggtaaatatgtgtgcgtgggaacaaacatggtaggcgagagggagagtgaagtcgccgagctcacagtgctagaaagaccatcctttgtcaagagaccctctaacctggccgtgactgtcgacgacagtgcggagtttaagtgcgaagcaagaggggatcccgtgcccacggtgagatggcgcaaagacgacggagagttgccaaaaagcaggtacgagattagagacgatcacacccttaaaattagaaaagtcacagcaggggacatgggctcctacacttgtgtggcagaaaatatggtcggaaaggctgaggcatccgccacgttgacagtacaggtcgggagcgaacctcctcacttcgtggtcaagccacgggaccaagtggtggcgttaggccggaccgtaacattccagtgcgaggctactggcaacccgcagcctgcaatcttttggcgtagggaggggtcccaaaacctcctcttctcctaccagcccccgcagagctcatctcgtttcagcgtctcccagactggcgatctgaccatcacaaatgttcagaggagtgatgtgggttattacatctgccaaaccctcaacgttgccggctcaatcataaccaaagcctatctggaagtgacagatgtgatcgcggatcgaccccccccagttattaggcagggccccgtgaatcagacagtggctgtcgacggcactttcgtcctgtcttgtgtcgccacaggcagtcccgtacctaccatcctatggcgaaaggatggagtgctggttagtactcaagatagtcgtatcaagcagcttgagaatggcgtcctgcagattaggtacgctaaacttggggacacaggcaggtatacttgtatcgccagtacacctagcggagaggcaacctggtccgcctacattgaggtgcaagagttcggcgtgccagtgcagccgccgagacctaccgatcctaatctgataccctccgcgccaagtaagcccgaggtaaccgacgtgagtcgcaacaccgtcactctctcgtggcaacccaatcttaactccggcgctacacctacttcctatattattgaagccttcagtcatgcaagtgggagctcatggcaaacagtcgcagaaaacgtgaagactgagacttcagccatcaaggggctgaagccaaacgctatttacttgtttctggtcagggcagccaatgcatacggtatttccgatcctagccaaattagtgatccagtgaaaacacaggacgtgcttcctacctcccaaggggtcgatcacaagcaagtccaacgagagctgggaaacgcggtgctgcacttacataaccctacagtgctgtcttcgagttccatagaggtgcattggaccgtggaccagcagtcccaatatatacagggatataaaatcctctatcgccccagtggagctaaccatggtgaatcagactggctggtatttgaggtgcgcactccggcaaaaaacagtgtggtaatccctgacctaaggaagggcgtgaactatgaaatcaaagccagacccttcttcaatgagttccagggggccgatagtgaaattaagttcgcaaaaaccttagaagaagcaccgagcgccccaccgcagggtgtaactgtatctaaaaacgacggcaacggtacggctattttagtgagctggcagccccccccagaagatactcagaacggcatggtgcaggaatataaggtgtggtgtctcggaaatgagacaaggtaccacatcaacaagaccgtcgatggatcaaccttttcagtcgtgatcccttttcttgtgcctgggatacggtactctgtggaggtggccgcctctacgggcgcaggctccggggtcaagagcgaaccccagttcatccaactggacgctcacggcaacccagttagtcccgaggaccaggtcagtcttgcccaacagatttcggatgtggtaaaacagccagctttcatcgcaggaattggcgcggcttgttggatcatcttgatggtgttcagtatttggctctataggcaccggaagaagagaaatgggttgacctccacttatgccggtattaggaaagttacctatcagagaggcggcgaggccgtgtcttccggaggtcggcctggcctgctgaacatcagcgagccggccgctcagccctggctggctgacacttggcctaataccggcaataaccacaatgattgtagcatatcctgctgcaccgcggggaatggaaattccgattcgaatcttacaacttactcccggcccgccgactgtatcgcaaattacaataatcagctggacaacaagcagacaaatctcatgcttcctgagtcaactgtctacggcgacgtcgacttgtcgaataagatcaatgaaatgaagacattcaatagccccaatctgaaggatggacgctttgtcaaccccagtggccaacctaccccgtacgcgactactcagttgattcagagtaacctgtctaacaacatgaataatggatcaggtgattcaggagagaagcattggaagccactaggacagcagaaacaggaggtggctccagtccagtacaacatagtggagcaaaataagttaaacaaagactaccgggccaatgatacagttcctcctaccattccttacaaccagagctatgaccagaatacaggaggcagctacaattcctccgatcgcggtagtagtacctcaggctctcagggacataaaaagggagctcggacgccaaaggtgcccaagcaggggggcatgaactgggccgacctgcttcctccccccccagcacacccacccccccattccaactcggaagaatacaacatctcagtcgatgaatcctatgatcaagaaatgccctgccccgtgcccccggcccgcatgtacctgcagcaggatgagctggaggaagaagaagacgagcgcggccctacccctcctgtgagaggagccgctagtagtccagccgcagtgagctatagtcaccaaagtaccgctactcttaccccgagcccacaggaggaactgcagccgatgcttcaggactgcccggaagagacaggccatatgcagcatcagccagacaggaggcggcagcctgtatccccacccccccccccgaggccgattagccctccacatacatacggttatatcagcgggcctctggtgagtgacatggacaccgatgcccccgaagaggaagaggacgaagcagatatggaggtggccaagatgcagacacggcggctcctcctccggggtctggaacagactccagctagcagcgtaggggatctcgagtcatctgtgaccggtagtatgattaatggctggggcagtgcgagtgaggaggataatatcagttctggccggagcagcgtgtcttcttccgatggttcctttttcactgatgccgactttgcccaagcagtggccgctgccgccgagtacgctggcctgaaagtagcccggcgccagatgcaggacgctgccggcagacgccacttccacgccagtcaatgccccagacccacttctcccgtgtctactgactctaatatgtcggccgccgtaatgcagaagacaagaccagcgaaaaagttgaagcaccaaccaggtcatctgcgccgcgagacctacacagatgatctcccaccaccacctgtgcccccccccgcaattaagtcccccacagctcaaagtaaaactcagctcgaggttcgccctgtcgtcgttcctaaactccctagcatggacgcccggacggacaggagttcagatcgtaaaggaagctcctataagggacgggaggtgctggacggacgccaggtcgtggatatgagaactaacccgggtgatccaagagaggctcaggagcaacaaaatgatggtaaggggaggggcaacaaagccgctaaacgcgacctgccacccgccaaaacacatctgatccaagaggacatcctaccttactgcaggcctaccttcccaacctcaaataacccaagagatccaagtagttctagctcaatgtctagtcgggggtctggctctcggcagcgcgaacaggccaatgtcggtcgaaggaacattgcggagatgcaagtgctgggcggctatgaacgcggagaggacaacaacgaagagttggaggagactgaaagttag

SEQ ID NO: 204058 - DNA, 3213 bp, Artificial Sequence
  Description of Artificial Sequence: Synthetic coding sequence
atggcccggcggcacgagcgggtgacccggcggatgtggacctgggctcctgggctcctgatgatgacagtggtcttttggggacaccaggggaacggacagggtcaggggagtcgactccgacaggaagattttccaccaagaatcgtcgaacacccctccgatgtcatcgtttccaaaggggagcctacaaccctgaactgtaaggcagaggggcggcctacccctacgattgagtggtataaggacggagaacgggttgagactgataaggacgacccgcggtcacacagaatgctactgccctccgggtctctgttcttcctacgaatagtccacgggcgtcgttctaagccagatgaaggcagttacgtgtgtgtcgcccggaattacctgggtgaagccgtctcccgtaacgcaagcctggaggtagctcttctgagggacgatttccgccaaaatccaaccgatgtggtggtagcagctggcgagccggcaatccttgagtgtcaaccccccaggggccacccagagcccaccatttattggaagaaggataaggtcagaatagacgacaaggaagaacgcatctccattcgcgggggaaagttaatgatatccaacacacgcaaaagtgacgcgggaatgtacacgtgcgtggggaccaacatggtgggcgagcgcgatagtgatccagccgagttgacggtgttcgaacgtccaacatttctgcggaggcccattaaccaagtcgtgttagaagaagaggccgtcgaatttcgctgtcaagtccaaggggacccgcagccaacagtcagatggaaaaaagatgatgccgatcttccccggggccgttatgatattaaagatgactacacacttaggattaaaaaaaccatgagtacggacgagggcacctatatgtgtatcgccgagaatagagtgggtaagatggaagccagcgcaactttgactgttcgtgggggcgtgattgcccccccccagttcgtcgtgaggccccgggaccagatcgtggcacaaggccggacagttactttcccttgcgaaaccaaaggcaatccccagccagccgtattctggcagaaagaaggctcacagaatctgttgttccctaaccaacctcaacaacccaactcccggtgctctgtttcacccaccggcgatctcactatcacaaatattcaacgtagcgatgctggctattacatttgccaggccttgacggtggcaggatccatactggccaaagctcagctggaggtaacagacgttttgactgacaggcctcctccaataatcctccaagggcctgccaaccagacattggccgtagacggaaccgcccttctgaaatgcaaagcgacgggtgatcccctgccggtcatctcttggctcaaggagggatttacattccccggacgggatcccagagctaccattcaggaacagggcaccttgcagattaagaacctgaggataagtgacaccggtacgtacacatgtgtcgcgacatcctctagcggcgagacgtcctggagtgctgtgctggacgtcactgaaagtggtgctacgatctccaagaactatgatttgagtgatttgccaggacccccctctaaacctcaggtgactgacgtgactaaaaactctgtgactctcagttggcagccaggcacccccgggacgctgcctgcatcagcctacatcatagaggccttctcacagagcgtcagtaattcttggcaaacagtcgccaaccatgttaagacaactctgtacaccgtcagaggcctgaggcccaataccatctacctgttcatggttcgcgccatcaacccgcagggtctttccgacccatccccgatgtcagacccagttaggactcaggatatctctccccctgcacagggggtggaccatcgacaggtgcagaaggagctgggcgacgtgttggttcggctgcataaccccgtcgttctaacccctacgacagtgcaggtaacctggacggtagacagacagccacagtttattcagggctacagggtaatgtatagacagacatctgggctacaagcgacatcaagctggcagaaccttgacgcaaaggtgcctacagaaaggagcgctgtgcttgtgaatcttaagaagggggtaacctacgaaatcaaggttaggccatactttaacgaatttcagggcatggatagcgagtcaaaaacggtcaggactactgaagaggccccatccgcgcctcctcagagcgtcaccgtactcacagtggggagttacaactccacgtccatcagtgtaagttgggatcctcctcctccagaccaccagaacggtatcattcaggagtacaagatttggtgtctcggcaacgagacccgattccatatcaacaagacagtcgatgctgccatcaggtccgtgattattggagggctgttccctggaatacagtaccgagtcgaagtagctgcctccacctcagcaggggtcggtgtcaaatccgaaccacaacccatcattataggacggcggaacgaggtggtcatcacagaaaataacaactcaattacagaacagatcaccgatgtggtgaagcagccagcctttattgccggtatcgggggcgcctgttgggtgatcctgatgggtttcagcatctggttgtactggcgacgtaagaaaagaaaaggattatccaactatgcagttacttttcagcgaggggatggcggtctgatgagcaacggatcaaggcctggtctgctaaatgctggggaccccagttacccctggctcgccgattcctggcctgccacttccctgcccgtgaataatagcaattccggccccaacgaaatcggcaattttgggcggggggacgtccttccaccggtgcctggccagggggacaaaaccgcaactatgctctcagacggagctatctacagcagcattgatttcacaaccaagactagctacaactcctcatcacagatcacccaagccactccttatgcaaccacacaaatcctgcactctaactcaattcatgaactagctgtggatttacccgatcctcagtggaaaagcagtattcagcagaaaactgacttgatgggctttggttactctttgcctgatcagaacaaagggaataacggagagtcgggtagctag

SEQ ID NO: 204059 - DNA, 1713 bp, Artificial Sequence
  Description of Artificial Sequence: Synthetic coding sequence
atgagcaccgacgagggcacctacatgtgcatcgccgagaaccgggtgggtaaaatggaggcctccgctaccctaacggtgcgcggtggagtgatagctccacctcagttcgtggttcggcccagggatcagatagttgcacaagggaggaccgtgacattcccctgcgaaacgaagggcaatcctcagccagcagtattttggcagaaggaaggttcgcaaaacctgctgtttccgaatcagcctcagcagccgaacagccggtgctctgtatcccccacaggcgacctgactattaccaatatacagcggtcagacgccggctattacatatgtcaggcccttacagtcgctgggtcgattctcgccaaggcccagctggaagtaactgatgttctgaccgaccggcctcctccaatcatactacaggggccagctaaccagactctggccgttgacggaacagccctgctaaaatgtaaggccaccggcgaccctctgccggtgatttcctggctcaaggagggatttacattcccaggtagggaccccagagctacaatacaagaacagggcaccctgcagataaagaaccttcgtatctctgatacaggaacatatacatgtgtggcaacctcttcctcgggtgagacctcttggagcgccgtcttagatgtgacagagagcggggccacgatcagtaagaattatgatttaagcgatctgcccgggccaccctctaagccccaggtcaccgatgttactaaaaacagtgtgaccctaagctggcagcccggcacaccaggcacccttcctgccagcgcgtacatcatcgaggctttctcccagtcggtgagcaactcctggcagacagtggctaaccacgtcaagacaacactgtacaccgtacggggcttaagaccaaatactatatatctctttatggtgcgcgccatcaatccacagggcctgagtgacccctcccctatgtccgacccggtgcggacacaggacatcagccctccagcgcagggcgtagaccatcgccaagtgcaaaaagaactgggagacgtgctcgttcgcctgcacaatcccgtcgtgttgacgccaacgactgtgcaggtgacatggacagttgatagacagccccagtttatccagggttaccgtgtgatgtacagacagacgtcagggctgcaggccactagctcctggcagaatctcgacgccaaggtccccactgagcgatccgcggtgctggtcaatctaaagaaaggagttacttacgagatcaaggtccgcccctatttcaatgaattccagggaatggattctgaaagtaagacagtgcgtacaacagaggaggctcctagtgcaccgccgcaatcagtcaccgttctaacagtgggctcctacaactcgacatctatttccgtgagttgggatccgcctcctcccgaccaccaaaatggaatcattcaggaatataaaatctggtgtctgggcaacgaaactcgatttcatatcaataaaaccgttgacgccgcgatccggagtgtgataatcggggggctttttcctggtatccaatatcgagtggaggtggccgcaagcaccagtgcaggcgtgggcgtcaagtctgagcctcagcctaacaataccggctaccctatttgtcatgacaccgatcttgctttccagcagcacacatag

SEQ ID NO: 204060 - DNA, 4185 bp, Artificial Sequence
  Description of Artificial Sequence: Synthetic coding sequence
atggcccggcggcacgagcgggtgacccggcggatgtggacctgggccccaggtctcctcatgatgaccgtcgtattttggggtcaccagggcaatggacagggtcagggcagtcggttgcgacaggaggactttccgccccggatcgttgaacatccttctgacgtgattgtttcgaaaggggagccgaccactcttaattgcaaagcagaagggcgacctacaccaacaatcgagtggtacaaagacggggagagggtggaaaccgataaggacgatccccgatcccacagaatgttgctcccttcagggtcgctcttcttcttgagaatcgtgcacggtcggaggagtaaaccagacgagggctcatacgtatgcgttgcacgtaactatctaggggaagcggtaagccggaatgcaagccttgaggtggccctcctgcgggatgacttccgacagaatccaacagacgtcgtcgttgcagccggagagccagcgatcctggagtgtcagccaccacgaggccacccagaacctacaatatactggaagaaagataaggtccggattgatgataaggaggagagaatatccatacgaggcggaaaactgatgatttccaatactagaaagtctgatgccggcatgtacacttgcgtggggactaacatggtgggcgaacgcgatagcgatccagcagagctgaccgtgttcgaaaggcctacgttcctaaggcgaccgattaaccaagtagtgctagaggaagaggctgtggagttcagatgccaagttcagggggacccccagcccactgtccggtggaagaaagacgacgcagacttgcccagaggccgatacgacatcaaggacgattacaccctgagaatcaagaagactatgagtacggatgagggtacctatatgtgtattgcagaaaatagagtaggcaaaatggaagcatccgccacactcaccgtgcgtgcccctccccagttcgtcgtgagaccacgagaccaaatcgtagcccaaggcaggacagtaacctttccctgtgagaccaaaggcaatcctcaaccggccgtcttctggcaaaaagaggggtctcagaatctgttgttcccaaatcagccacagcagcctaactctaggtgttctgtgtcacctaccggagatctgaccattacgaacatccagagatccgatgctggctactacatctgccaggcgctgacagttgccggtagcattcttgccaaagcccagctagaggtgactgacgtgctcacagatcgtcctccgcccatcattctgcagggaccagccaaccaaacattagctgtggatggtaccgcacttctgaagtgcaaggctacaggggatcccctgcctgtgatttcatggttgaaggagggtttcacattccctggaagagatccgcgcgccactatccaggagcaaggcactctgcagattaagaatctgagaatttcggatacaggcacctatacctgtgtggccactagctcctccggcgaaacttcttggtccgctgtgctggatgttactgaatccggggctactatttccaagaactacgatttaagtgacctgcctgggcctcccagtaagccacaggtgacggacgtgactaagaactcagttacgctctcctggcagcctggaactcccggcaccctccccgcatccgcttatataattgaggccttcagtcagtccgtgagtaattcctggcagacagtggcgaatcacgtgaaaactaccctgtatactgttcggggcttgagaccaaacactatttacctgttcatggtgcgggcaataaatccacagggactgtcagacccctcccctatgtctgaccctgtcaggactcaggacattagccctccagcacaaggggtggatcatcgtcaggtgcagaaggagttgggggatgttctggtgaggcttcataatcctgttgttctgaccccgacaacagtgcaggtcacatggactgtcgatcgtcaaccccagttcattcaagggtaccgcgtgatgtaccgccagacatctgggcttcaggctacgtcgtcatggcagaacctcgacgctaaggtgccgacagagcgctctgcagttctggtcaatttaaagaaaggcgtcacatacgaaattaaagtgagaccttacttcaacgagttccaaggaatggacagcgagtcaaaaacggtcaggacaaccgaggaggccccatcagcccccccacagagtgtcactgtcctcactgtggggtcctacaattctacttctatttctgtcagctgggacccccctccgccagaccaccaaaacggcataatccaggagtacaagatctggtgcttaggcaacgagaccagattccacattaacaagaccgttgatgctgctattcgaagcgttatcattggcgggttatttcccggcatccaataccgggtcgaggttgccgcctcaacgtcggcgggtgttggtgtgaagtctgagccccaacctataataatcggcagacgcaatgaggttgtgattactgaaaacaataactcgataaccgagcaaatcaccgatgtagtgaagcagcccgcgttcatcgcaggaatcggtggtgcgtgctgggttattttgatgggcttctcgatttggctgtactggcggcggaagaagcgcaaaggactgtcgaattatgctgtgacatttcagagaggtgatggtggtcttatgagcaacggtagtcggcctggactgctgaatgccggcgatccttcttacccttggctcgccgattcatggccggccacttctcttccagtcaataattccaattctggccccaatgaaattggtaactttggccgcggggacgtgcttccaccagtcccgggacaaggggataaaacagcgaccatgttatcagacggcgccatatatagcagcatcgacttcaccacaaagacatcttataactcttcatcacagattacccaagcaaccccttatgcaacaacacagatactccactccaatagtatccacgaactggcggtagaccttcccgatcctcaatggaagtcttccatccagcagaaaaccgatctgatgggttttggctacagtctgcccgaccaaaacaaaggcaataatggcggtaagggcggaaagaaaaaaaaaaacaagaattctagtaaacctcagaaaaacaatgggtccacctgggctaatgttcccctgcctccgccccctgtgcagccactgccgggaactgaactggagcattacgctgtggagcagcaagaaaacgggtatgatagcgatagttggtgcccccctctcccagtgcagacctacttgcaccaaggccttgaggacgagctcgaagaagacgatgatcgcgtccccacccctccggttagaggagtcgctagtagtcctgctatctccttcggccagcaaagcacagccactcttacaccatcacccagagaggagatgcagcccatgctccaggcacacctcgatgaactcacccgtgcctatcaattcgacatagccaaacagacatggcatatccagtccaataatcagcccccacagcctcccgtgcctcctctgggatatgtgtctggtgcactcataagcgatctcgaaaccgatgttgccgacgatgatgccgatgacgaggaggaagcactagagataccacggcctctgcgcgctctggaccaaacccctggctcttcaatggataatctggactcctcagtcactggaaaagcttttaccagcagccagcgccccagacccacttcacctttcagtaccgatagtaatactagcgcagccctgtcccagagtcagcgaccacgccctaccaagaaacataaaggcgggaggatggaccaacagcccgcactcccgcaccgtcgggagggcatgacagatgaagaagccctggtaccatacagcaagccctcatttccgagccccggcggtcattcatcttctggaacagcatcgagcaagggatcgaccgggccaaggaaaacagaggtgctccgcgcagggcaccagagaaatgccagcgacctcctagacattggctacatgggcagcaacagtcagggtcagttcacgggagagctctag

SEQ ID NO: 204061 - DNA, 4137 bp, Artificial Sequence
  Description of Artificial Sequence: Synthetic coding sequence
atgagcctgctgatgttcacccagctgctgctgtgcggcttcctgtacgtgagagttgatggcagcagactccggcaggaagatttcccaccaaggattgtcgagcatccctcggacgtaatagtatccaagggtgagcccacgaccctcaactgcaaagcagagggtaggccaacccctacaatagagtggtacaaggatggggagagggtggaaacggataaagacgatccaaggtcgcacaggatgttgctgccctccggctccctgtttttcctccgcatcgtgcacggtaggaggtccaagccagatgagggatcctacgtgtgcgtggcaagaaattatctgggcgaggcggtgtctcgcaacgccagcctggaggttgccctgctgcgggacgactttcgtcaaaaccccaccgacgtggtggtcgctgccggagagccggcaattttagaatgccaacctccgaggggtcaccctgaacccacaatctactggaagaaggataaggtccggattgacgataaagaggaacgcataagcattagaggaggcaagttgatgatatctaacaccagaaagtccgacgctgggatgtacacctgcgtgggtactaacatggtgggcgagcgggattccgatccagctgagctaaccgtgttcgagcgccctacattcctgaggcgccctatcaaccaggtggtgctagaagaagaggcagtcgaattcaggtgtcaggtccagggcgatccacagcctacagtccggtggaaaaaggatgatgctgacctgcctagaggaagatatgacataaaagatgattatacattgaggataaagaaaacgatgagcactgacgaaggaacatacatgtgcatcgccgaaaatcgagtcggaaagatggaagccagcgccaccttgaccgttagagccccacctcaatttgtggttaggccaagagatcaaattgttgcacagggcagaactgttactttcccatgtgagacaaaggggaatccccagccagctgtcttctggcagaaggaaggcagtcagaatctgctgtttccaaatcaaccacagcagcctaattctagatgctcagtatcaccaacaggggatctgaccatcactaatattcaacgcagcgacgctggatactatatttgtcaggcccttacagttgccgggtctatcctcgcaaaggctcaattagaagtgactgacgtgctgaccgatcgaccgccaccaatcatactgcaggggcctgctaatcaaacacttgctgtggatgggactgccctgttgaaatgcaaagcaaccggtgaccccctccctgtgatatcctggctgaaggagggcttcacctttcccggacgggatcctcgggctactattcaggagcagggcacacttcagatcaagaaccttaggattagcgacaccgggacatatacctgcgttgccacctcctctagtggagaaaccagctggtctgccgtattagatgtgactgagtccggcgctactatctctaagaactacgacctgtccgaccttcctggacctccttccaagccccaggtcaccgacgtgaccaaaaactcagtgaccctgagttggcaaccgggcacccctggcaccctccccgcgtcagcctacatcatagaggctttctctcagtccgtgtcaaactcatggcagacagtagccaaccacgtgaagaccacgctttacaccgtcagaggcctgagacctaataccatttacctcttcatggtgagggcaatcaatccccaggggctctccgacccaagtcccatgtcggatcccgttcggactcaagacatttctcctccagcgcagggcgtggaccaccgtcaggtccagaaagagctcggcgacgtgttagtgcgtttacataatcctgtagtgctgacccccactacagttcaggtgacttggaccgtagacaggcaacctcagttcatccaaggttatcgcgtaatgtatcgtcagacatcaggactgcaggccactagttcctggcagaatctggacgcaaaggtgccaacggagcgttctgccgtgctcgttaacctgaaaaagggcgtcacctatgaaattaaggtccgcccctattttaatgagttccaaggcatggacagcgagtcaaaaactgtccggaccactgaagaggcaccttcagcgcctccacagtcagtgacggtactgaccgtgggaagttataactctacaagtatatcagtgagctgggatcccccaccaccagaccaccagaacggaattattcaggaatataaaatatggtgtctcggaaatgagaccagattccacattaataaaacagtggacgctgcaatacgaagcgtcatcataggtgggctgttccctggtatacagtatagagttgaggtcgctgcctccacttctgccggcgtgggtgtgaagtccgagcctcagccgattattatagggagacgtaatgaggtggtgattactgagaataataactccattacagaacagattacagatgttgtgaaacaaccggcttttatagcaggtattgggggggcgtgctgggtgatcctgatgggcttttccatctggctatactggaggagaaaaaagaggaaggggcttagtaattacgcggtcacattccaaagaggggatggtggactgatgtcaaacggttcgagaccgggcttgctgaatgccggcgaccccagctatccttggctggcggacagctggccagctacatcattaccagtcaacaattccaattctggccccaacgaaattgggaacttcggtcggggagatgtgctccctcccgttcccggtcagggcgacaagacagcaacaatgctctctgatggagccatctattcctccatcgacttcactactaagacgagttacaactctagctcgcagataacacaggccaccccctatgctacgacacagatcttgcactctaacagcattcatgagctggcggtggacctccccgacccacagtggaagtccagcatacagcagaaaaccgacctgatgggattcgggtactctctgcccgaccaaaataaggggaacaacggtggaaaaggagggaaaaagaagaagaataagaacagcagcaagccgcaaaaaaataatggaagtacttgggctaatgtacctctgccgcctcctccagtccaaccgcttccaggcaccgaactggaacattacgccgtcgagcagcaggaaaacggatacgacagtgactcttggtgtcccccattaccagtgcagacttacctacatcagggcctcgaggatgagctggaagaagatgatgacagagtgccaacacctccagtgaggggggtggcgtcttcgcccgctatttcttttgggcaacagagtacggcaaccttaaccccaagcccccgagaggaaatgcagccaatgttacaggcccatctcgatgagctcacccgagcctaccagtttgacattgccaagcagacatggcacattcagagcaacaatcagccacctcagcctccagtgcctccactgggctatgtctccggagcgcttatttcagacttagaaactgatgtagccgatgatgacgctgatgatgaagaagaagccttagaaatccctaggcccctccgggcgcttgaccagaccccgggatccagtatggataatctagatagtagcgtgaccgggaaagctttcactagctctcagagaccacgacctacatctcctttctccactgattccaatacatccgcagcgctgagccagagtcaacgtcctaggcccactaagaaacacaaaggaggtagaatggatcagcagcccgcactgcctcacaggcgagagggaatgacggacgaagaagccttggtcccctatagcaaaccgtcctttccgagtcctggcgggcactcttcttcaggaacggcttcgagcaaaggctctaccggtcctcgcaaaaccgaggtgctgcgagcgggacaccagcgaaatgcttccgatcttctcgatattgggtatatgggctccaattcgcaaggtcagttcacgggagaactctag

SEQ ID NO: 204062 - DNA, 4185 bp, Artificial Sequence
  Description of Artificial Sequence: Synthetic coding sequence
atggcccggcggcacgagcgggtgacccggcggatgtggacctgggcaccaggcctactgatgatgaccgtagtcttctggggtcaccagggcaacgggcagggacaaggctccagactgaggcaggaagatttccctccgagaattgttgaacatccctccgacgtcatcgtgtccaagggcgagcctacaacactgaactgcaaggccgagggccgccctacccccacgattgagtggtacaaggatggtgaacgagttgagacagataaggacgaccccaggtctcatagaatgctgcttccctccggttcactgttcttcctacgaatcgtacacggtaggcgaagcaaacccgacgagggctcttacgtgtgtgtggctaggaactatctcggcgaagcggtgagtcgcaatgctagtcttgaagtcgccttactgagggacgatttccgccagaaccccaccgatgtggttgtcgccgctggtgagcccgctatcctagagtgccagcccccacggggacacccagaacccacaatatattggaagaaggacaaggtgcgcatcgatgataaggaagaaagaatctctatcagggggggtaagttgatgatatcaaatactaggaaatccgatgcaggtatgtatacctgcgtcggtaccaatatggtgggggaaagggactcagatcctgctgagttgacagtatttgagagacccaccttccttagacggcctattaatcaggtggtgctggaggaagaggcggtcgagttccgatgtcaggtacagggagatccacagcctacagtgcgctggaagaaggatgatgctgatttaccacgagggcggtatgatatcaaggacgattacactcttcggatcaaaaaaacaatgtcaacagatgaaggcacttacatgtgcatcgccgagaatagagtgggcaagatggaagcttccgcaactctcacagtcagggctcctccccagtttgtggtcagaccccgcgaccaaattgtcgcccaggggagaaccgtgacctttccttgcgaaaccaaagggaacccacaaccagccgtcttttggcagaaagagggctcacagaacctgttgtttccaaaccagcctcaacagccaaattctaggtgcagcgtcagtcctactggggacctcacaatcacgaatatacaacggtcagacgccgggtactatatttgccaagctctgaccgttgctggttcgatcctggctaaggcgcagctggaggtgactgatgtgcttacagacagaccgccccccattatcctgcagggacctgccaatcagaccctggccgtcgatggcaccgctctgcttaaatgtaaggcaacaggcgaccctctccctgtcatctcatggctgaaggagggcttcacatttccagggagggacccaagagccaccattcaggaacaaggtactcttcagattaaaaacttgcggatctccgacaccggcacctatacatgcgtggcaacaagcagtagcggtgagacctcttggagtgccgtccttgatgtcacagagagtggggctactatcagcaagaactacgatctctccgacctgcccgggccgccttcaaaaccccaggtcaccgatgttactaagaacagcgtaaccttgagttggcagcccggcacacccgggacgttgcccgctagtgcatacataatcgaagcgtttagccaatctgtctccaattcctggcaaaccgtcgctaatcatgtcaaaacaactctgtacacggtgagaggcttacggcctaatacaatctacctgttcatggtgagagcaatcaacccccaggggctaagtgatccgagccccatgtccgatccggttagaacacaggacatctctcccccagcccaaggcgtggatcacagacaggtccaaaaggaactgggagatgttctggtccgcctgcataatcccgtagttctgacgcccactacagttcaggtaacttggaccgttgatagacagccgcaattcatacaaggctaccgggtgatgtatagacagaccagtggcctgcaggccactagctcatggcagaatttggatgccaaggttcctactgaaagatctgccgtcctggtgaatctgaaaaagggagttacctatgagattaaggttcggccatacttcaatgagttccagggcatggatagcgagtctaaaacagtcagaaccaccgaggaggctccgtcggctcctccccagagcgtcacagtcctaacagttggaagctataactcaacaagcatttcagtaagctgggacccgccccctccagatcatcaaaatgggatcattcaggagtacaagatctggtgtttgggaaatgaaacccggttccacatcaacaagacagtcgacgctgcaatccgaagcgtgatcattggtggattgtttcccggtatacagtacagggtagaagtggcagcctccacatctgctggggtgggtgtgaagtccgaaccccaaccgatcatcattggaaggcgcaacgaggtggttataacagaaaacaacaattccatcactgagcagataaccgacgtggtgaagcagccggcgttcattgcgggaatcggcggagcttgctgggtgattttgatgggttttagtatctggctgtactggcgaagaaagaagaggaagggattaagtaattacgccgtgacctttcagcgcggagacgggggcctcatgtctaatgggagtcggccaggcctgttaaacgccggggacccatcatatccttggctcgccgactcctggcctgctacttccctgcctgtgaataacagtaacagcggtcccaacgaaattggaaattttggcagaggcgacgtgctgccgcccgtcccagggcagggcgataaaaccgcgaccatgcttagtgacggagcaatatatagtagtatcgatttcacgaccaagacaagctacaactcctcaagtcaaatcacgcaggcaacaccatatgccacaacacaaattttacactctaattccatccacgaactcgctgttgacctccctgatccacagtggaagagctctatccaacagaagactgaccttatgggctttggatactccttacctgaccagaataagggaaacaacggcgggaaaggaggaaagaagaagaagaataagaactcatccaagccacaaaagaacaacgggtctacatgggcaaatgttccgctgcccccccccccagttcagcctctgccaggaactgaattggaacactacgccgttgagcagcaggagaacgggtacgatagcgattcctggtgcccccctttgccagtccagacatatctgcaccaggggctggaggacgagctcgaggaggacgatgacagagttcccacacctcccgtgcgaggtgtcgcctctagccctgccatttccttcggccaacagtccacagccacactgacacccagtcctagggaggagatgcaacccatgctgcaggcccacctcgacgaactgacgcgggcctatcagttcgacatcgctaagcagacctggcatatccaaagtaacaaccagccaccacagcccccggtcccccccttgggatacgtgtctggtgcgcttatctctgatctagagactgacgtggcagacgacgatgcagatgacgaagaggaagctctggaaattcctcgccctcttagagctctggaccagacaccgggatctagcatggacaacctggacagttctgtgacagggaaggcttttaccagctcccagcgcccaagaccaaccagccctttcagtaccgattctaatacctcagccgctctctcccagagccagaggccgcgaccaacaaagaagcacaaaggggggaggatggatcaacagcctgccctgccacacaggcgggaggggatgactgatgaagaggctctcgtgccttatagtaagccctcttttccctcccctggaggacattcctcaagtgggacggctagttcaaagggatccactggcccacgtaagacggaggtgcttcgcgctggacatcagagaaacgcatctgacctgctggacattggctacatgggttcaaattcccagggccagtttacaggggagctctag

SEQ ID NO: 204063 - DNA, 4161 bp, Artificial Sequence
  Description of Artificial Sequence: Synthetic coding sequence
atgctgcggtacctgctgaagaccctgctgcagatgaacctgttcgctgactcacttgccggtgacatttccaactcctcagagctgctgctaggtttcaacagcagcctagcagcgctgaaccacactctgctaccacctggcgatcccagtttgaatggcagtagggtagggccagaggacgccatgccccggatcgtggagcagcctccggacctactggtaagtcggggggagccggcgaccctcccttgcagggccgaaggccgtcctaggcccaacatcgaatggtataagaacggcgcaagggtagcgactgttagggaagatcctcgagctcatcggctactgctgccctcaggtgcactgttcttcccacgcatagtgcatgggcggagggccagacctgacgaaggggtgtacacctgtgtggccagaaactacctgggagcagctgcgtcacgtaatgcatccctggaggtcgcagtgctgcgagatgacttcagacaatctccgggtaatgtggtcgtcgcagttggggaacccgccgtccttgagtgcgtgccgccgcgaggccacccagaaccatcggtttcctggagaaaagatggtgctcggttaaaagaggaagagggccggatcactatcagaggagggaaacttatgatgtctcacacgctaaagtccgatgccggaatgtacgtgtgtgtggcttcgaatatggctggcgaacgcgaaagtgctgccgctgaagtcatggtcctcgaaaggccttcctttttgcgacggcccgtgaaccaggtggtactggccgatgcccctgttacatttctttgcgaagtaaagggtgaccctccgccaagattaaggtggagaaaggaagacggcgaattaccaaccggacggtatgagattagaagcgaccattccctgtggatcggtcatgtctcagcggaggatgaaggaacttatacctgtgttgccgaaaactctgtcggcagagccgaagcgtccggtagtctttcagtgcatgtgcccccgcagctggtgacgcaaccgcaggaccagatggctgccccgggggagtctgtggcctttcagtgcgaaaccaaaggaaatcctcctccagcaatcttttggcagaaggaggggtctcaagtcctgctttttccgtctcaatctctgcagccaaccggcaggttttctgtctcacccaggggccagctgaatataaccgccgtgcaaagaggcgacgccggctactacgtatgccaggccgttagcgtggcggggtccatactggcgaaggccctgctggaaatcaagggagccagtttggatggactgccgcctgtgatcctgcaggggcccgctaaccaaacgctcgtcctggggagttccgtgtggctgccctgcagggttaccgggaacccccagccctcagtgcggtggaaaaaagacgggcagtggctccagggagacgatctccagttcaagactatggctaacggcactctgtacattgcgaacgtgcaagagatggacatgggattctactcctgtgtcgccaaaagctctacgggtgaggccacttggtccggatggcttaagatgagggaggactggggtgtatctcccgatccaccaacggaaccctcttcgccacccggagcaccatcacagcccgtcgtcacagaaatcacgaagaactcaataactctgacctggaagcctaatccacaaaccggggctgccgtgacgtcctacgttattgaagcgtttagccccgccgcaggaaacacatggcggaccgtggccgacggcgtccagctagaaacccacaccgtgagcggccttcagcccaacacaatctacttgtttctggtgcgagccgtcggggcatggggactatctgaaccgtctcctgttagcgaacctgtccgaacacaggacagcagtccctctaggcccgttgaagatccatggcgtggccaacagggcctagcagaggtggcggtaaggctgcaggaacctattgtgctcggacccaggaccttgcaggtaagctggacggtggatggacccgtccaattggttcagggattcagggtgtcgtggcgcgtggctgggcctgaaggagggagctggaccatgctcgatctacagtccccatcccagcagagtaccgtgttgagaggattaccacctgggacgcaaatacagatcaaagtgcaggctcaagggcaagagggactcggtgcagaaagcctgtctgtcacgagaagcattcccgaggaggccccatcggggcccccacaaggagttgctgtggcactcgggggagacgggaatagctctatcacagtgtcctgggagcccccgcttccaagtcaacagaatggcgtcatcaccgaataccaaatttggtgtcttgggaatgagagccggttccatcttaaccgtagcgccgcagggtgggcaagaagcgctatgctccgcgggctagtgcccggactcctgtatcgcactcttgtcgcggctgccacgagtgccggagtgggtgtaccctccgcccccgttttagtgcaacttccatctcccccagatctcgagccagggcttgaggtcggcgccggactcgcagtccgtctagccagggtgctgcgcgaaccagccttcctcgcaggatccggagcggcgtgcggcgctctgctgctcggcctgtgcgccgctctctactggcggcgcaagcaacgcaaggagctgagtcattacactgccagtttcgcctatacccctgcagtatcttttccccactcagaaggcctttctggggctagtagcagaccaccaatgggacttgggcccgcaccctactcttggctagccgattcttggccccacccctctagatcaccttctgcccaggagcctagaggtagctgctgcccaagcaatcccgatccagacgatagatactataatgaggctggtatctccctgtacctggcgcagacagcccgcggtacggccgcgcccggcgaaggcccagtgtacagcacgatcgaccctgctggcgaggaacttcaaacgtttcacggcgggttcccacaacatccctctggagatctgggcccttggagtcagtacgcaccacccgagtggtctcaaggggacagtggagccaagggtggcaaggtgaaactgctcggcaagcctgtgcagatgccctcccttaattggcccgaagcactgcccccacctccaccctcctgcgaactgtcctgtctcgagggaccagaagaggagctggaggggtcctctgaacctgaggagtggtgcccaccaatgcccgagagatcccatcttacagagccatcaagttctggaggctgtttggtaacccctagccggagggagaccccctcccctactcccagctatggccagcagtctactgccactctaaccccgagtccccctgatcctccacagccccccaccgatatgcctcatctgcatcagatgccgcgcagagtgcccctgggcccgtcttctcccctctccgtctcccaaccaatgttaggtattagagaagcacggcctgctggcctcggagccggccccgccgcatctccccatctgagtccatcaccagctccgtcaacagcatcctctgcaccaggtcggacctggcagggtaacggtgagatgactcctcctctgcagggtcctcgggccagatttaggaagaagcctaaagcactgccgtataggcgcgagaattcacccggggaccttccaccgcctccactgccccccccagaggaggaggctagctgggctctggaattgcgggctgcaggctccatgtctagtttggagcgagagaggagcggtgagagaaaggccgtccaggcagtgccgctagcggcccaacgagtgctacatccagatgaggaggcatggttgccctacagtagaccgagtttcctaagcagaggacagggcaccagtacatgcagcacagcaggtagtaacagttcaagaggcagcagtagttcccgaggttctcgcggcccgggccgttcccggagtaggtcccagagtaggagtcagagtcaaagacccggtcagaaaagaagagaagaaccccgatag

SEQ ID NO: 204064 - DNA, 4095 bp, Artificial Sequence
  Description of Artificial Sequence: Synthetic coding sequence
atggagcggcccgaggacagcctgagcctgtggagcctgaacctgtcgccccagttcccttgccttaacgccctgagacacccgctctcacctggctcaagagtcgggccagaagacgctatgccccgcattgtggagcagcctcctgatctattagtttctcgcggcgagcctgcaacactgccctgtcgagctgaaggtcggccccgtccaaatatcgagtggtacaagaatggggcccgggtggccactgtaagagaggacccaagagcccacaggctgctgctgccaagtggggctctcttctttcccaggatcgttcacgggaggcgggcacgacctgatgagggagtttacacttgcgtcgcacggaattatctaggtgccgccgcatctaggaacgcatccctggaggtggctgtacttagagatgacttcaggcaaagtcctggaaatgtggtggtggccgtgggggaaccggccgtgcttgaatgtgtcccccccagggggcatccagagccttcggttagttggcggaaggatggagctagactgaaggaagaggagggacggattacaattcggggcggaaaactgatgatgtcacacactctcaaaagcgatgccggcatgtacgtctgcgtggcatccaacatggccggtgaacgagagagtgccgcagcggaggtgatggtattggagcgaccttcatttcttcgcaggccggttaaccaggtggttctggcagatgcaccagttacctttctttgtgaggtgaagggggacccaccccctcgcctgcgctggcgaaaggaagatggtgagctgccaaccggacgctacgaaattcgctcggatcacagtttgtggataggtcacgtttcagccgaggatgagggaacttatacttgcgtggcggaaaactcggtgggccgcgcggaggcctctggcagccttagcgttcacgtgcctccacaactcgtgacgcagcctcaggaccaaatggccgcccccggagagtctgtcgcttttcaatgcgagactaagggcaatccaccacccgcgatcttttggcaaaaggaggggtcccaggtgctgctgtttccatctcagagccttcagccgaccggacgctttagcgtaagcccgcggggccagctaaacattaccgccgttcagcgcggggacgctggctactacgtctgccaggcggtgtctgttgccgggtcaatattggccaaagccctgctagaaattaagggggccagtctcgacggactgcccccagtgatcctgcagggccctgcaaatcagacactggtactcggcagcagcgtgtggctcccatgcagggttactggcaacccacaaccatctgtacgctggaaaaaagacgggcagtggcttcagggcgatgacctgcagtttaagaccatggccaacgggaccctttatattgccaatgtgcaggagatggacatgggattctactcttgtgtcgctaagagttctacaggcgaagcgacatggtctggatggctgaagatgagggaggactggggggtatcgcccgaccctcccactgagccatcaagtccccccggtgccccctctcaacctgttgtgaccgaaatcacaaaaaactctatcaccctaacctggaaacctaatccccagacgggagctgccgtgaccagttacgttattgaagccttctcccctgccgccgggaatacttggcgaaccgttgccgacggggtccagctggaaacgcatacagtgagcggtctccagcctaatactatctatctgtttcttgtccgcgccgtcggcgcgtggggtctgtcagaaccttcgcctgtgtccgagccggtccgtacacaggactcaagcccctcccgtcccgtcgaggacccgtggagggggcagcagggactggctgaggtcgctgtccgattgcaggaaccaatcgttctgggacccagaacactgcaggtcagctggaccgtagacggtcctgtgcagctagtgcaggggttcagagtgagttggcgggtggccgggcctgaggggggaagttggaccatgctggacctccagtcaccatctcaacagtctacggtgctgcgcggcctgcctccaggcactcagatccagataaaagtacaggcacagggccaagagggcttgggggctgagtccctgtctgtgacccggtcaattcctgaagaggcaccaagtggaccacctcagggagtcgccgtcgctttgggcggcgacggaaacagttctattacagtgtcatgggagcccccattaccttcccagcagaacggcgttatcactgagtatcagatctggtgtctgggaaacgaatcgaggtttcatctgaaccgatccgccgctggttgggcgcgctccgcaatgttaagaggtctcgtgccgggattgctgtaccgcactctggtggctgcagccacctctgctggggtgggggttccaagcgctccggtactggtgcagctgccgtctccacctgacctggagccagggctggaagtgggagctgggttggcagtccgcctggcccgagtgttgagggaaccagccttcttggcagggtcaggggcagcctgcggcgcacttctgctgggtctgtgcgccgccctgtactggagaaggaaacagcggaaagagctaagccactacacagcaagtttcgcgtacacacctgcagtcagtttcccccactccgaagggctgtcgggagccagctcccgcccaccgatgggcttgggaccggccccatactcctggctggctgactcctggccacatccatcacgttccccatctgcacaggagcccaggggctcttgctgcccttcaaaccccgatccagacgacagatactacaatgaagcaggaatctcattgtatttggctcaaacagctaggggtaccgctgcccccggagaaggcccggtgtattcaacaatcgatcctgccggagaggagctccagacattccatggtgggtttccccagcacccgtcaggggacctgggcccctggagtcagtatgcccctccagagtggagccagggggacagcggggctaaaggtgggaaggtcaagttgcttggcaaacccgtccagatgccctcacttaattggcccgaggcactgccgcctcctccaccgagctgtgagctgtcttgcctagagggaccagaggaggagcttgaggggtccagtgagccagaggagtggtgtccaccaatgcctgagaggagccacctcactgaaccctctagtagtggcgggtgcctggtcacgccatctagaagagaaacaccctcaccaaccccatcatatggacagcagagtaccgccacactgacacctagtcctcctgacccgcctcagccccctacggatatgcctcatctgcaccagatgccccggagagtaccccttggcccctcctctccactcagcgtgtcgcagcctatgttgggcattcgagaagctcgccccgctggcctaggcgcgggccccgcggcaagtccacatctgtcgccaagccctgcaccaagtacggcctcaagtgctcccggcaggacctggcaaggaaatggagagatgacgcccccactccagggaccgcgggcccgcttccgcaagaagccgaaagccctgccctatcgccgagagaactcgccaggagacctgcccccaccccccctccctccacccgaagaggaagctagctgggcactggagctcagagcggccgggtccatgtcctcgctggaacgagagcgaagtggggaaaggaaagcagtccaagcagttcctctagcggcccagcgggtgctccaccccgacgaagaggcgtggttgccctatagtagaccaagttttctgagtcggggacagggcacttccacttgctcaactgctggttcaaatagtagccgcgggagcagttctagccgaggaagtcgcggcccgggccgtagcagatcgcgcagtcagtcacgcagccaatcacagagaccaggacagaagaggcgagaggagccccgttag

SEQ ID NO: 204065 - DNA, 450 bp, Artificial Sequence
  Description of Artificial Sequence: Synthetic coding sequence
atgaccccccccctgcagggcccccgggcccggttccggaagaagcccaaagccttgccatacaggagggaaaacagcccgggtgacctgcctcccccacctctccctccgcctgaagaggaggcgagctgggcactggaacttcgcgccgcgggctctatgagtagtctcgagcgagagcgaagtggagagagaaaagctgttcaggccgttcccctggcagcccagagagttttgcatcccgatgaggaggcgtggttaccttattcgcggcccagcttcctgagtcggggccagggcacctctacctgctccacggctgggagtaactcaagcagagggtcctcgtccagcagagggtcacgtggtccgggtaggtcacgtagcagatctcagagtcgatctcagtcacagcgccctggccagaagcgtagggaagagccacgctag

SEQ ID NO: 204066 - DNA, 3024 bp, Artificial Sequence
  Description of Artificial Sequence: Synthetic coding sequence
atgggcagcggcggcgacagcctgctgggcggccggggcagcctgccgctactgctgctattgatcatgggggggatggctcaggactcaccccctcaaatcctggtgcatccccaggaccagctgttccagggccctgggccagcacgcatgagctgccaagcatcaggtcagcctccaccaacgatcaggtggcttctgaacggtcaacccctgtcgatggtgccaccagatcctcatcacctgctccccgacggtaccctactgctgctacaaccccccgccaggggtcacgcccatgacggccaagcacttagcactgatctaggagtgtacacttgcgaagcctctaatcgactaggcactgctgtaagccgcggtgctcggctctccgtagccgtgctgagagaggacttccaaattcaacctcgggacatggtcgctgtggtcggtgaacagttcacactggaatgtggccctccttgggggcacccagaacctaccgtgtcctggtggaaggatggaaaacctttggctctgcagcccggccggcataccgtgtccggcgggagcctgctgatggcccgggccgaaaagtcagatgagggcacatacatgtgtgtcgcaaccaattctgcagggcatcgggagtcgcgcgcggcccgggtatctatacaggaacctcaggactataccgaacccgttgagctactcgccgttcgaattcaactggagaatgtgacactgttgaacccagaccctgctgagggtcccaagccacggcctgcagtgtggctgagctggaaagtgagcgggcccgctgcacccgctcaaagctataccgccctgttcagaactcagactgcacccggtgggcaaggagctccctgggccgaggagttactcgctggatggcagtctgcagagctgggggggttacattggggacaggactatgagtttaaggtgagacccagcagtgggcgggccaggggccccgattcaaacgtgctcttgctgcgcctgcctgagaaagtccccagtgcccccccacaggaagtgaccctgaaacctggaaacggaacagtgttcgttagctgggtcccaccacccgcagagaatcacaatggaattatccgcggctaccaggtatggtctcttggcaacacctccctgcccccagccaactggaccgttgtaggtgaacagactcagctggagatcgccacgcatatgcctggatcatactgtgtccaggtggccgcagtgacaggtgcaggggccggggaaccatctaggcctgtttgcctactccttgagcaggcaatggagcgtgcaacccaggagcccagtgagcatggcccatggacactggagcaacttcgcgcgaccctcaagaggccagaagtcattgccacgtgcggtgtcgcattatggctcttgctgctgggaacagccgtctgcattcacaggaggcgaagagcccgagtccacctgggtcctggcttgtacaggtataccagcgaggatgccatccttaaacatcggatggatcactcggactcacagtggttagccgatacatggaggtctaccagcgggtcccgcgatttgagctcctcttcttctctgagtagtaggcttggtgccgatgctagggatccactggactgtcgtcggtccctgctgagctgggatagtcgttcacccggggttcccctcttgcccgacacaagcacattctacggatctcttattgccgaactgccctcaagtactccggcgcggccctcccctcaggtccccgcagttaggcggttacctcctcaactcgcccaactctcatctccctgttcatcctccgattctttgtgttcgagacgagggctaagttctccgcgtttatccctcgcacccgcagaagcttggaaagcgaaaaagaaacaggagctccagcacgctaattcaagcccactcctcagggggagccacagtctggaattgcgcgcatgcgagcttggcaatagaggatctaaaaatctcagccagtcccccggcgcagttcctcaggcgctggtagcatggcgagcactgggtcctaaacttcttagcagctcaaatgagctggtgaccaggcatctgccgccggcgcccttgtttccccatgagacccctccgacccagagtcagcagacccagcctcccgtggccccccaagcgcctagtagcatccttctacctgccgctcctatccccatcctctccccctgtagcccaccgtccccccaggccagcagtctttctggcccgtcacctgccagttcaagattgtctagctcaagtctgagcagcctcggagaggatcaggactcagttctcacacccgaagaggtggctttgtgtctcgagctatctgaaggcgaggaaacaccccgaaattccgtcagtccaatgcccagagccccatcccctccaaccacatatgggtacatctctgttcccactgcctccgaattcaccgacatgggcaggacaggcgggggcgtgggccccaaggggggggtcctcctgtgccctccccggccgtgtctaacacccacacccagcgaaggcagcctagcgaacggctggggaagcgcatccgaagataacgcagcaagtgcccgagcgtcactggtaagctcctctgacggttctttcttggcagacgcccactttgcgagggccctggcagtagccgtggacagcttcgggttcggtctggagcccagagaagccgattgtgtgtttattgacgcctcaagccccccttcacccagagacgaaatctttttaacaccaaacttatcccttcccctctgggagtggcgtcctgattggctagaagatatggaagtaagccatacgcagagacttggtagggggatgcctccttggcctcctgactcacagatttcctctcagcggtcacagctccactgtcgcatgcctaaagctggtgcaagtccggtggattatagctag

SEQ ID NO: 204067 - DNA, 2106 bp, Artificial Sequence
  Description of Artificial Sequence: Synthetic coding sequence
atgggcagcggcggcgacagcctgctgggcggccggggcagcctgccccttctgttgttgttgatcatggtgctgagagaggatttccaaatccagccaagggatatggttgccgtggtgggagaacagttcaccctggaatgcggtcccccgtggggacatcctgagcccactgtgagttggtggaaagatggcaaacctctggcgctgcagcctggtcgccacaccgtgtcggggggctccttgttgatggctagagccgagaagagcgacgaaggcacctacatgtgtgtggccaccaactcagctggtcatagggagagccgggccgcccgagtgagcatacaggaaccccaagattataccgaacccgtggaattattggctgttcgcattcagttggagaatgttacgttgctgaaccccgaccccgccgagggcccgaagccgaggcccgcagtgtggctaagctggaaagtgtccggtcctgctgctccagctcagtcatacactgctctgtttcgaacacagacagcacccggcggtcaaggagccccctgggcagaggaacttctggctggctggcagtccgccgaacttggcggcctgcactggggacaggattatgagttcaaggtgcgcccttcaagcgggcgggcacgggggcctgactccaacgtcctcttgctcagacttcctgagaaagttccatcagcccctccacaggaggtgacactcaagcccgggaacgggaccgttttcgtcagttgggtgccaccacctgctgagaatcataacggaatcatccgcggatatcaggtgtggtccctcggtaacactagcttacctccggctaactggaccgtagtcggcgagcagacccaactcgaaattgctacccacatgcctgggtcttattgtgtgcaggtcgcggcggtcaccggggccggggcaggggagccatcacggccggtgtgcctcctcctcgaacaggccatggagagagctacccaggaaccaagcgaacacggtccatggaccctagagcaacttcgagccactctgaaaagaccagaggtgatcgccacttgcggagtcgctctgtggcttctcctcctcggcaccgccgtatgcatccaccggcggcgccgggcacgcgtgcacctaggaccagggctttacaggtatacctcagaagacgccatattaaagcatcgaatggatcatagcgacagccaatggctcgcagatacatggcgcagtactagcggttctcgcgacttatctagcagctcttccttgtccagcagactgggtgcagacgctcgcgaccccctggattgcagacgctcgctgctatcctgggactcaagatcaccaggagtacccctgctcccagatacttccaccttttatggatccctcatagcggagcttccatccagtacccccgcacgcccatccccccaggtcccagcggtccggcgcctgcccccacagctggcacagctatcatcaccctgtagttccagcgactccctctgttcaagacgtggtctgagtagtccgcgtctaagccttgcccccgctgaggcttggaaggccaagaaaaagcaggaactgcagcacgccaactcctctccgttgctccgaggaagtcattcccttgaactgagagcctgtgagctcggcaatcgcggttccaaaaatctctctcagagcccgggtgcggttccacaagccctggtagcatggcgggcgcttggtccgaaacttctgagtagcagcaatgagctagtgacccggcacttgccccccgcacctctgttcccccatgaaacccctcctactcagtcgcaacagacacaacctcccgttgccccccaggccccaagcagcatcctgctgcccgctgcgcccataccaattctgagtccatgtagccctcccagcccccaagctagctccctcagcggccctagtcccgccagcagccggctgtccagctctagcctatcatctctaggagaagaccaggacagcgtgctgacaccagaggaggttgctctttgcttggaactgagcgaaggagaggaaaccccctag

SEQ ID NO: 204068 - DNA, 2589 bp, Artificial Sequence
  Description of Artificial Sequence: Synthetic coding sequence
atggtggccgtggtgggcgagcagttcaccctggagtgcggccccccatggggtcacccagagcctacagtgtcatggtggaaggatggaaagcccctagctctccagcccggccgccataccgtctccggcggcagtctgcttatggcacgagctgaaaaatctgatgagggcacctatatgtgtgtggcaacaaattctgccgggcaccgggaatcccgcgcagccagagtgtccatccaagagccacaggactacacagagcccgtcgagctgcttgccgtgcgtatccagctggaaaatgtgaccctgctcaatccggatcctgcagagggtcctaagccacggcccgctgtatggctgagttggaaggtttcaggtcctgcagcgcctgcacagagttatacggcccttttcaggactcagacagctcccgggggacagggggccccctgggcagaagaactccttgccgggtggcaatcagctgaactgggaggattacactggggacaggattacgagttcaaagtgcgacccagcagcggaagggcccgtgggccagatagcaatgtccttctgctgcgattgcccgaaaaggtgccttccgctcctcctcaggaggtgaccttgaaacccgggaatggcacggtcttcgtgtcctgggtgcctcccccagccgaaaatcataacggcatcataaggggctaccaagtctggagcttaggcaacactagtctgccaccagcaaactggactgtggtcggcgaacagacgcagctcgaaattgccacccacatgcctggaagttactgcgtgcaagttgctgccgtgactggggccggcgcgggagaacccagcaggcctgtgtgtctgctcttggagcaagctatggaaagggccactcaagagcctagtgagcacgggccttggactttggaacagttacgggctaccctgaagcggccagaagtgatcgcgacttgtggcgtggccttgtggttgctgctgctcggaaccgccgtctgcatacacaggagacgacgagcacgagtgcatctggggcctggactatataggtacacaagcgaggatgctatcctcaaacataggatggatcactccgacagccagtggttggctgatacatggcgctcaaccagtgggtctcgggatctctcctcgagtagcagcctgagctcccggcttggcgcagatgcgcgcgaccccctggactgtaggaggtccttgctcagctgggactcaaggtctcccggagtgcctctgttgcccgacacttccactttctacggttctcttatagccgaactcccttcctctaccccagcacgccccagtcctcaggtccctgctgtgaggcgtttgccacctcagctggcccaactttcatctccctgttccagcagcgactccctttgcagtcggaggggtctatcatccccgcgcttgagtctagctccagccgaagcatggaaggcaaagaaaaagcaggagttgcagcatgccaactcttctccactccttaggggcagccacagcttggagctgcgcgcctgcgagctggggaatagaggttctaaaaatctctctcaatctcccggggcagtaccccaggctctggtggcatggcgcgcacttgggcctaaactgctgagttctagcaacgagctggtcaccaggcatctgcctcccgcccccctctttccacacgagacccccccaacccagtcacagcaaactcaaccaccagtggcccctcaggcaccctcctctattctattaccggcagccccaattcctattctgtcaccatgctctcccccatctccccaggccagcagcctttctggaccgtcacccgcctcatccagactttcttcgtcttcactgtcttcattgggcgaagaccaggatagcgtgcttaccccagaggaggttgcactgtgcttagagctgagcgagggggaggaaacacctagaaattcagtgtctcccatgccacgtgcgccctcccctcctacaacctacgggtacatttcagtgccaacagcctccgagtttacagatatgggcaggaccgggggcggtgtgggacccaaagggggggttctcctttgccctcccaggccctgcctgaccccaacccccagtgagggatcgctggccaacggctggggttctgcgtctgaagataatgccgcttcagcccgcgcatcactggtgagctcatcggacggcagttttcttgctgatgctcattttgctcgggccttagctgttgcagtggacagttttgggtttggtctggagcccagagaggccgattgcgtcttcattgacgcgtcatctccccctagcccgagggacgagatcttcttgactcccaacctaagcctgcctttgtgggagtggaggcctgattggctggaagacatggaggtgtctcacacgcagagattgggtaggggaatgccaccttggcctcccgacagccagatctcttcacagagatcccagctgcactgcaggatgcccaaggccggagcctcccccgtggactactcctag

SEQ ID NO: 204069 - DNA, 3708 bp, Artificial Sequence
  Description of Artificial Sequence: Synthetic coding sequence
atgagcggccccaccgacgagaccgccggcgacctgcccgtgaaggacacaggactgaatctttttggaatgggaggcttgcaggagacttccactaccaggacaatgaaaagtcgtcaggccgttagtagggtgtcccgtgaggagttggaagaccgatttttacgcctacacgatgaaaacatcttgctgaaacagcacgccaggaagcaggaagacaaaatcaagaggatggccacaaagctcataaggctcgttaacgataaaaagaggtacgagcgagttggaggaggcccaaaaaggctgggtcgagacgttgaaatggaggagatgatcgagcagctacaggagaaggtgcatgaactcgagaaacagaacgagactcttaaaaaccgcttaatctcagccaaacagcaactgcagacccaaggctaccggcagactccatataacaacgtacagtcaaggattaatacaggaagacgcaaagctaatgaaaatgctggtctgcaggagtgtcccaggaagggaataaagtttcaggacgctgatgtcgccgaaacgccacacccaatgtttaccaagtatggaaattctcttctggaagaggccaggggagagattcgtaatctcgaaaatgtgatccagtctcaacgggggcagattgaggaattggagcatttggctgagattctgaaaacccaactgcgtagaaaggagaacgagatcgagctctcactgctgcagcttagggagcagcaggcaaccgatcagcggagcaatattcgtgacaacgttgaaatgatcaagctgcataaacaactcgtggaaaaatcaaatgccttaagcgctatggaaggaaaattcatccagctacaagagaaacagcgaacacttagaatcagccatgacgctctgatggccaacggcgatgaactgaatatgcagttgaaagagcagaggctcaaatgttgcagccttgagaagcagctgcattccatgaagttctcagaaaggcggatcgaagagttgcaggatcgcatcaacgaccttgagaaagaacgcgaactcctcaaggagaactacgataagctgtatgactcagccttctctgccgctcatgaagagcaatggaagctcaaagagcaacaactgaaagttcagatcgcgcagctggagaccgcgctgaaatccgatcttaccgacaagactgaaatcctggaccggcttaagacagagagggaccagaatgagaaattagttcaggaaaacagggagcttcagctgcaatacctcgagcagaaacagcagctggatgagctgaaaaaacgaatcaagctatacaaccaggaaaacgatattaatgccgatgaactgtctgaagctctcctccttatcaaagcccagaaagagcagaaaaatggagacctgtcctttctggtgaaagtggattccgaaataaacaaagatctggagcgatccatgagggaactccaagctactcacgcagaaaccgtccaggagctggagaaaacacggaacatgttgattatgcagcacaagataaataaggattatcagatggaagttgaagccgtgactcggaagatggagaatctgcagcaggactacgaacttaaggtggaacaatatgtgcatctcctggacatcagagccgcacgaattcacaagctagaggcgcagctcaaagatattgcttatgggacgaaacagtacaagtttaaacccgaaattatgcccgacgacagtgttgacgagttcgacgagaccatacacctggaaagaggcgagaatctttttgaaattcatattaataaggtgacattctcttccgaggtgctgcaggcaagtggcgacaaagaacccgtcacattttgtacgtacgcattctacgacttcgagctgcaaaccacaccagtcgttcgcggcttgcaccctgagtataactttacgagccagtatctggtgcatgtgaatgacctgttccttcagtatatccagaagaacaccattacgctggaggtgcatcaagcatactccactgaatacgagacaattgccgcctgccagctgaagtttcatgagattctggagaagagtggtaggattttctgcactgcttctctcattgggactaaaggagatatacctaattttggcaccgtggaatattggttccggctgcgcgtgcctatggatcaggccatcagactgtatcgagaacgggccaaagctctcggatacattaccagtaacttcaagggaccagaacacatgcagtccctgagtcaacaggcgccaaaaactgcgcaacttagtagcactgactccacagacggtaacttaaatgagttacacatcacaatccgatgctgcaaccatctgcagagcagggcttcccacctacagcctcacccatacgttgtttataagtttttcgattttgcggaccacgataccgccattattccctcatcgaacgaccctcagtttgatgatcacatgtatttccctgtcccaatgaacatggacctggatcgctacctgaagagtgaatccctgagcttctatgtgttcgacgacagtgacactcaggagaacatttatataggcaaagttaacgtgcctttaatctctctggcccacgatcgttgtattagcggtatttttgaactgacagatcaccagaagcatcccgctggtaccatccatgtaattctcaaatggaaatttgcttacctacctccaagcgggtcaattacaacagaggacctgggcaacttcattcgctctgaggagccggaagtggtacagcgactccctcccgcctcttccgtttccaccctagtcttggccccgcgcccgaaacctagacaaaggctgacgcccgtcgataagaaagtgagcttcgtcgacataatgccccatcagtcagacgtctcccaggagggttccgtggatgaggttaaggagaacaccgagaagatgcagcagggaaaggacgacgtctccctgctcagtgaaggccagctggcagagcagtctcttgcgtcttccgaagacgagacggagattactgaagacctggaacccgaagtcgaggaagatatgagcgcttccgactcagatgactgcataatccccggtccaatctcaaagaacataaagcagccttccgaaaaaatcaggattgagattatagctttaagcttgaatgactctcaagtcaccatggatgacactatccagagactgtttgtcgaatgcaggttttatagtttgcctgctgaggagacacctgtcagcctacccaaacccaaaagcgggcagtgggtttattacaattactcaaacgtgatatacgtggataaggagaacaataaagccaagcgcgacatactgaaagctatactgcaaaagcaggagatgccgaatagaagcttacgcttcactgtcgtctccgatccccctgaggatgagcaagatttagaatgcgaagacatcggggtggctcacgtggacctggcagatatgtttcaagagggcagagacttaatcgagcagaatattgacgtgttcgacgcacgggcagatggcgaaggcatcggtaagctgagagtgactgttgaggcactccacgcacttcaaagcgtttacaagcagtacagggacgacctggaggcatag

SEQ ID NO: 204070 - DNA, 3948 bp, Artificial Sequence
  Description of Artificial Sequence: Synthetic coding sequence
atgagcggccccaccgacgagaccgccggcgacctgcccgtgaaggatactgggcttaatttgttcggtatggggggcctgcaagagacaagtactacaaggacaatgaaaagccgccaggctgtgtctcgggtctcaagagaggaacttgaagacagattccttagactgcacgacgagaacattctgctgaagcagcacgcgcgcaaacaggaagataaaattaaaaggatggcaactaagctgatcaggctggtcaacgacaaaaagcgctacgagagggtgggggggggcccaaaaagacttgggcgggacgttgagatggaggaaatgatagagcaactgcaggaaaaggtgcacgagcttgaaaaacagaacgagacgctgaagaatcgcctgatatctgccaagcaacagttacagactcagggatacagacagaccccatacaacaatgtacagtctcgcatcaacaccggccgcagaaaagctaacgaaaatgctggcttacaggaatgcccccgaaaggggatcaagttccaggatgccgatgttgcggaaacccctcatcctatgttcaccaaatacggcaactcgttacttgaagaagcaaggggcgaaatcagaaatctggagaatgtgatccagagccagcgggggcagatcgaggagctggagcacctcgctgaaatactgaagactcaactgcgccgcaaggaaaacgagatcgagctcagcctgctgcagctccgggagcagcaggccaccgaccaacgctctaacatccgggataatgtggaaatgatcaaattgcacaaacagctggtggagaaatccaacgcactgtcggcaatggagggtaaatttattcagctgcaggagaaacagaggactttgaggatatcccatgacgccctgatggctaacggcgacgaactgaacatgcaactgaaggagcagcggctgaagtgttgcagtttggaaaaacagcttcattccatgaaattctccgagcggagaatcgaggaactacaggatcgaatcaacgacctagaaaaggagcgagaattacttaaggagaactacgataagctctatgatagcgcattttctgctgcccacgaggaacagtggaaactaaaggagcagcagctcaaggtgcagatcgctcagttggaaactgctttaaagtcagatcttaccgacaagactgagattctcgaccgattgaagactgagcgggaccagaacgagaagctggtacaggagaacagggaactgcagctgcaatatctcgagcaaaaacaacaattagacgagttgaaaaagcgcatcaagctttataaccaggagaatgacatcaatgccgacgagctttcggaggcacttctgctgattaaggcccagaaagagcagaagaatggagacctaagttttctcgtgaaggtggactccgagatcaataaggatctcgaacggtctatgcgcgagttacaggctacacacgccgaaactgtgcaggagctggagaaaactcggaacatgctgattatgcaacacaagatcaataaagactatcagatggaagtggaggcagtgacccgtaagatggaaaatctccagcaggactacgaactaaaagtggaacagtacgtccacctgctggacattcgcgctgcccggatacataagcttgaggctcagctgaaagacatagcctatggaaccaaacagtataaattcaagccagagatcatgccagatgattccgtggatgaatttgatgagacgatacaccttgagcgtggcgaaaatctattcgaaattcacatcaacaaggtaacattctctagtgaagtgctgcaagctagtggggacaaagagcccgttacattttgcacatacgccttttacgactttgaattgcagactacgcctgtagtgaggggtctgcatcccgaatacaacttcacctcccagtatctggtgcacgtgaatgatctctttcttcagtatattcagaaaaatacaattactctggaggtccatcaggcctacagcactgagtatgaaactattgccgcttgccagctgaagttccacgagatcttagagaagtctgggagaatcttctgcactgctagcctaatcggaacaaaaggagacatccctaattttggcacagtggagtattggttccgacttagagtgccaatggaccaggctatccggctctaccgcgaaagggccaaggctctgggatacattacatccaacttcaaagggccggaacatatgcagtctcttagccagcaggctcctaaaactgcccagctgtcgagcacagacagtaccgatggaaatcttaacgagctccacataactatcaggtgttgtaaccaccttcaatctagggcttctcacctgcagccacacccttacgtggtctacaagttcttcgactttgcggatcacgataccgcaattataccaagctctaatgatcctcagttcgacgatcacatgtacttcccggttcctatgaatatggatctcgatcggtaccttaagtctgagagcctaagcttttacgtattcgatgactcggacactcaggaaaacatatacattgggaaggtaaatgtgcccctcataagtcttgcccatgaccggtgtattagcgggatttttgagctcacagaccaccagaaacacccagctggaactattcacgtgatattaaaatggaaatttgcgtaccttccacccagtggatcaatcacaaccgaagatctgggtaacttcatccgttccgaggaaccagaggtagtccagaggctgccaccagcatcatccgttagcacacttgttctggctccccgccctaagccgagacaacgactgaccccagttgacaaaaaggtgagctttgtcgatattatgcctcatcagtctgacgagacttcaccacctcctgaggatcgaaaagaaatatctcccgaagtagagcacattcccgagattgaaatcaacatgttgacagtcccgcatgtgcctaaagtgtctcaggagggctcagtggacgaagtgaaggaaaacaccgaaaaaatgcagcaggggaaggacgatgtctcgcttttatctgagggccaactcgccgagcaaagcttggcatcttcagaagatgaaaccgaaataaccgaggaccttgaacccgaggtggaagaggacatgtcagcctctgacagcgacgattgtatcattccaggcccgatctccaaaaatatcaagcaaagcctggctttatcccccggcttgggctgcagcagtgccattagcgctcactgcaattttcgccttccaggctcaagtgacttccctgcctcagcctcccaggtcgacggcataaccggggcatgccaccacacccaaccatctgaaaagattcgaattgagattattgctctctcacttaacgatagccaggtgacaatggatgataccatccaacggctttttgttgagtgtagattttattctctgcctgctgaagagacacccgttagcctgccgaagcctaaatcaggccagtgggtgtactacaattatagcaatgtcatctatgtggacaaggagaataataaagctaagcgagacatcctaaaagccattctgcagaaacaggaaatgcccaataggtccctaagattcacagtcgtgtccgaccctccggaggatgagcaggacctcgagtgcgaagatatcggtgtggcacacgtggaccttgcagacatgtttcaggaggggcgagaccttattgaacagaacattgatgttttcgacgccagagccgacggtgaaggaattgggaaactgagggtgacggtcgaggcactccacgcactccagtcagtgtataagcagtatcgggacgacctggaagcttag

SEQ ID NO: 204071 - DNA, 1956 bp, Artificial Sequence
  Description of Artificial Sequence: Synthetic coding sequence
atggccgcccccctgctgcacacccggctgcccggcgacgccgccgcatcatcaagcgctgtgaagaaattgggagccagccgcaccgggatttcaaatatgcgcgcattggagaacgacttctttaatagtccccccagaaagactgtgaggtttggggggaccgtcacggaggtgctccttaagtataaaaagggtgagacaaacgattttgagctgctgaagaatcagttacttgatccagacatcaaggacgaccagatcataaactggttgttggaattccggtcatctatcatgtatctaaccaaagattttgaacaactgatctctatcatcctaaggctgccgtggctcaataggtcccagaccgtagtggaggagtacttagcatttctggggaatttggtctccgcacagaccgtcttcttgcggccgtgtttgtccatgatcgcctcccacttcgtccctcccagagtgatcatcaaggaaggcgatgtcgacgtgagtgattccgatgacgaagacgacaatctgcccgcgaactttgatacctgccatcgcgccctgcaaattatagcacgctatgtgccgagtactccctggtttcttatgccaatattggtggaaaagttccctttcgtgcggaagtcggagcgcacgctggaatgctacgtgcacaacttactgaggatctcagtgtacttccccacattaagacacgaaatccttgagctgatcatcgaaaagctgttgaagctcgacgtcaacgcaagcagacagggcatagaagacgccgaagaaacggctacgcagacctgtgggggtaccgatagcactgaaggtctgtttaatatggatgaggatgaggagacagagcatgaaaccaaggctggccctgaaaggctggaccagatggtgcaccccgtcgctgagcggctagatattctgatgtcactggtgctgtcttatatgaaagatgtctgttatgttgacgggaaagttgacaacgggaagaccaaagacttgtacagagacctgattaacatattcgacaaattgctgcttcctacacacgcctcctgccatgtccagtttttcatgttctatttgtgctcatttaagttgggatttgctgaagcttttctggagcacctgtggaaaaaactgcaggatccttctaatcccgccatcatccgacaggcagcaggaaactacattggttcatttttagctagagctaagtttattcctctgattactgttaaatcttgtctggacctactggtgaactggctgcatatctatctgaacaatcaagactctgggactaaggctttctgcgacgttgccctccatggtcccttctattcagcgtgtcaagcggtcttctacacgtttgtattcaggcacaagcagttgctgagtggtaatctgaaggagggactgcaatatctgcagagcctgaatttcgagaggattgtcatgtcgcagcttaaccctttgaaaatctgtctgccctcagtggtaaatttcttcgcagcgataaccaacaaataccaactggtcttctgttatacaatcatagagcggaacaaccggcagatgctccctgtgataagatccacggcaggaggtgattctgtgcagatctgtactaaccccctggatacctttttccctttcgacccatgcgtgctaaagcgaagcaagaagtttatcgacccaatttatcaggtctgggaggacatgtctgccgaagaattacaggaatttaaaaagccaatgaaaaaggacatcgtggaagacgaggacgacgactttcttaagggggaagtgcctcagaatgacacggtgatagggatcacaccgtcctcattcgatactcactttcgctccccttcaagctccgtgggctccccaccagtgttgtacatgcagccctccccattgtag

SEQ ID NO: 204072 - DNA, 1857 bp, Artificial Sequence
  Description of Artificial Sequence: Synthetic coding sequence
atgcgggccctggagaacgacttcttcaacagccccccccggaagaccgtacgttttggcggaacggtcacggaagttctgctgaagtacaaaaagggagagactaatgatttcgaactactgaagaatcagttgctggatccagatattaaagatgaccagatcataaactggctcctggaattccggtctagcatcatgtatcttacgaaagactttgaacagctgatctcaataattttaagactcccttggctaaaccgcagccaaacagtggtcgaggagtacctggctttcctcggtaatctggtttctgcccagaccgtttttctacgcccctgccttagtatgatcgcttctcacttcgttccccctcgggtgatcatcaaggagggagacgtcgatgtgtctgattcagatgacgaggacgacaacctgccggcaaactttgacacctgccaccgcgcgttgcagatcatagcccgatacgtgccaagcaccccatggttccttatgccaatcctcgtggaaaagttcccctttgtccgaaaatctgagagaaccctagagtgttacgtgcacaatctgttgcgaatctccgtgtatttccctacccttaggcatgagattctggaattaattattgagaaacttttaaaactggatgtgaatgccagcagacagggcattgaggatgctgaggagacagcgacccagacatgcggtgggacagactctactgagggtctgttcaatatggatgaggatgaggagaccgaacatgagaccaaggcaggcccagaaagattagatcagatggtccatcctgtggccgaacgcctagatatcttaatgtccctagtgctgagttacatgaaagatgtttgctatgtcgatggtaaagtggataacggtaaaacaaaagatctgtaccgggacctcatcaatattttcgacaaactgcttctccctacccacgcttcctgccacgttcagttctttatgttctacctttgttcttttaaactgggttttgccgaagctttccttgaacacttgtggaagaagctacaggacccttctaatcctgctataattcgtcaagcagccggcaattatataggcagcttcctggctcgggcaaaattcatcccacttatcactgtgaaaagttgtctcgatctcctggtcaactggctgcacatctacctcaacaatcaggatagtggaactaaggcgttctgcgacgtcgcattgcatggccccttttacagtgcatgtcaggccgtgttctacacttttgtgttccggcataaacagctgctgtctggtaatctgaaggagggcctgcagtacttgcagagcctgaacttcgagcggattgtgatgagccagctcaacccgctaaaaatctgccttccatcagtggtgaacttcttcgcagcaataacaaataagtatcagcttgttttttgttacaccattattgagcgcaataaccggcagatgttaccagtcattaggtctacagccggcggcgactctgtgcaaatctgcactaaccctctcgacacctttttcccattcgacccatgcgtgctgaaaagatcaaagaagtttatcgatcccatctaccaggtatgggaagacatgtccgcagaagagctgcaggagtttaagaaacccatgaagaaagatatagtcgaagatgaagatgacgacttcctgaagggagaagttccccagaatgacaccgtgatcggcattactcccagtagttttgacacacacttccgctccccctccagttcagtgggatctccacctgtgctgtatatgcaaccctccccactctag

SEQ ID NO: 204073 - DNA, 1866 bp, Artificial Sequence
  Description of Artificial Sequence: Synthetic coding sequence
atggccgcccccctgctgcacacccggctgcccggcgacgccgccgcctcttcgtctgccgttaaaaaactgggcgcttctaggaccggcatttccaacatgcgcgccctcgaaaacgactttttcaactcacccccacggaaaactgtgcgatttggagggaccgtgaccgaggttctgctaaaatacaaaaaaggagaaactaatgattttgaacttttaaaaaatcagctccttgaccccgacatcaaacgtctgccctggttgaacagatcccagactgtcgtcgaagaatatctcgccttcctggggaatctagtatccgcccagacagtgttcttgaggccatgtctgtccatgattgcttcccacttcgtgcccccccgggtcatcataaaagaaggcgacgttgatgtgtccgattccgacgacgaggacgacaaccttcccgctaacttcgacacttgtcatagagccttgcagattatcgccaggtacgtgcccagtaccccctggtttctgatgcccatcctggtggagaagttccccttcgttcgaaaatcagaacggacacttgaatgctacgtacacaacctcctgaggatcagcgtgtattttccaacactcagacacgagatcctggaactcatcatagaaaagttgctgaaactggacgtgaacgcatccagacagggcatcgaggatgccgaggaaacagctacgcagacctgcgggggtaccgacagcaccgaggggctgtttaatatggacgaagatgaagaaacagaacatgaaactaaggcaggccctgagagattggaccagatggtgcaccccgtggccgagcgccttgacattctaatgtctctggttctttcttatatgaaggacgtttgctatgtggatggcaaagtggataatgggaagaccaaagatctatatagagacctgattaacatatttgacaagctgctgctccccacgcacgcctcctgccacgtgcagttttttatgttctacctgtgcagttttaagttgggcttcgccgaggcatttttagaacacctatggaagaaactgcaggatccaagcaatccggccatcatccgccaagcggcaggcaactatattggctcatttctggcgcgggccaaattcatacccttgatcactgtgaagtcgtgtttggatctacttgtgaattggttacacatatacctaaataaccaggattcaggcactaaagccttctgcgacgttgccctgcacggaccgttttacagcgcttgccaggcagtcttctatacattcgttttccgacataagcagctgctgtccgggaacctgaaagagggcctccaatatctccagtcgcttaacttcgagcggatagtgatgagccaactgaaccccctgaaaatttgtctcccaagtgttgtgaacttctttgctgccataacaaacaagtatcaactcgtgttctgctacacaatcatcgagcggaataaccggcagatgctgcccgttatccgcagcacagccggcggagatagcgtgcagatttgcaccaaccctctcgatacatttttccctttcgatccctgtgtcctaaagcgtagtaagaaattcatcgatcctatctatcaggtatgggaagacatgtcagctgaagaactgcaggagtttaagaagccaatgaaaaaagacattgtcgaagacgaggatgacgacttcttaaagggcgaggtcccccagaacgatacggtgattggtatcacacctagtagctttgatacacactttcgatctccgagtagcagcgtcggatcacctcccgttctctatatgcagccctcacctctgtag

SEQ ID NO: 204074 - DNA, 1410 bp, Artificial Sequence
  Description of Artificial Sequence: Synthetic coding sequence
atgatcgccagccacttcgtgcccccccgggtgatcatcaaggagggggacgtggacgtaagtgatagtgacgacgaagacgataacctccctgcgaattttgacacctgccaccgcgctctgcagatcatcgctaggtatgtaccttcaactccatggtttctgatgcctatcctggtcgaaaagttcccattcgtcaggaagtcggaaaggacactcgttaatgcatctaggcagggaattgaggacgctgaagaaacggccacacaaacttgcggagggaccgacagtacagagggcttgttcaacatggatgaggacgaggaaaccgaacacgagaccaaggctgggcccgaacgactggaccaaatggtacatcccgtggcggagagactggacatcctgatgagtctcgtgctgtcatatatgaaagatgtctgctacgtggatggtaaagtcgacaatggaaaaacgaaggatctctacagagatctgataaatattttcgataagctcctgcttcccacacacgcctcttgtcatgtgcaatttttcatgttttacctgtgttcattcaaattaggcttcgcagaggcttttctggagcacctttggaagaagttgcaggatccatccaaccctgcgattatcaggcaggcagctggaaactatatcgggtcatttctcgcccgagccaagtttattccgctcatcactgtaaagtcctgtttggacctgttggtcaactggctgcacatctacctaaacaatcaagactcaggcaccaaggctttctgtgatgttgctcttcatggacccttttactctgcttgccaggccgtgttctacacctttgtcttcagacacaaacagctcctctcaggaaatttgaaagaagggcttcagtacctgcagagcctaaatttcgagagaattgtaatgagtcagctcaatcctctcaaaatttgtttgccctcagtggtaaatttttttgctgctataacaaacaagtaccagctcgttttctgctatacaatcatagagcgcaataatcggcagatgctccctgtcatacgatcaacagctgggggcgattctgtccaaatctgtactaatcccttggacacattttttccctttgacccatgcgtccttaagagatccaaaaagtttatcgaccccatctaccaggtatgggaagacatgagtgctgaagagctgcaggagttcaaaaagcctatgaaaaaagacatagtggaagacgaagatgatgatttcctcaagggcgaagtgccacagaatgacacggtcattggaatcacccctagctctttcgacactcattttaggagtcctagcagttcagtaggaagtccaccggtgctttacatgcagccgtctcctctatag

SEQ ID NO: 204075 - DNA, 792 bp, Artificial Sequence
  Description of Artificial Sequence: Synthetic coding sequence
atgcggctgggcctgtgcgtggtggccctggtgctgagctggacccatctcaccatttcgagccgcggtatcaagggtaaaaggcaaaggaggattagtgcggaaggctcccaggcttgcgccaagggatgtgagctgtgctctgaagtcaacggatgcctcaaatgtagcccgaagctgtttatccttctggagcggaatgacattaggcaagtgggagtttgtttaccctcttgccccccaggttattttgacgctcgaaaccccgacatgaataagtgcatcaaatgtaaaattgaacactgtgaggcctgttttagccacaatttctgcaccaagtgtaaagaaggcctgtacctccacaaaggccggtgttaccccgcatgtccagagggttcatctgccgccaatggtactatggagtgctccagccccgcccaatgcgaaatgtccgagtggagcccatggggcccttgctcaaagaaacagcagctctgtggttttagacgcggaagcgaggaacggacccggcgggtcctccatgcacccgtcggagatcacgccgcttgtagcgacactaaggagacacggagatgcacggtgcgacgggtgccatgtccggaaggacagaaaagacgtaagggcggccaggggaggcgggaaaacgctaaccgaaacctggcacggaaagaaagtaaagaagccggagccggatccagacgcaggaagggacagcaacagcaacagcaacaaggtacagtgggcccgcttacctccgcaggccccgcatag

SEQ ID NO: 204076 - DNA, 792 bp, Artificial Sequence
  Description of Artificial Sequence: Synthetic coding sequence
atgcggctgggcctgtgcgtggtggccctggtgctgagctggacccacttaaccatttcatcccggggcatcaagggtaaacggcagcggcgcatttccgcagaagggagtcaagcttgcgcgaaagggtgtgagctgtgtagtgaagtcaatggatgcctcaagtgttctccaaagctgttcatcctccttgaaagaaatgacattcgacaagtgggggtatgcctgcctagctgccccccagggtacttcgacgcccgaaacccagacatgaataaatgcataaagtgcaagatcgaacattgtgaggcctgttttagtcacaatttctgtactaagtgtaaggaaggactgtacctacacaaggggagatgctaccctgcctgcccagagggttcatccgccgctaacgggaccatggaatgttctagtcctgcccagtgcgagatgtccgaatggtccccatgggggccctgcagtaagaagcagcagttatgtggtttcaggcgcggatccgaagagagaacacggagagtgcttcatgcgcccgtgggagaccacgctgcctgtagcgacactaaagagacgcgtcgatgcaccgtgaggagggtgccttgtcccgaaggccagaagcgccgtaagggtggacagggccggagagaaaatgcaaacagaaatctcgcccgtaaggaaagcaaggaggctggggctggctcccggagaaggaagggccagcagcagcagcagcagcagggtacagttggccctctgacgagtgccggaccggcctag

SEQ ID NO: 204077 - DNA, 792 bp, Artificial Sequence
  Description of Artificial Sequence: Synthetic coding sequence
atgcggctgggcctgtgcgtggtggccctggtgctgagctggacccacctgacaatatcctctaggggaattaaaggaaagagacaaaggcgcataagcgctgaaggttcccaggcctgtgctaaaggctgcgagctttgttccgaagtcaatgggtgtctgaagtgttcccccaaactattcatcctcctggaacgtaatgacatcagacaggttggcgtctgcctcccttcttgccctccgggatactttgatgccaggaaccctgatatgaataagtgcatcaagtgcaaaatcgaacactgtgaggcttgcttctcacataatttttgtaccaaatgtaaagaagggctgtaccttcacaaaggcaggtgttatcccgcctgccccgaagggtcatctgccgctaacgggacaatggagtgcagcagcccggcacagtgcgaaatgtcagagtggtctccctggggcccttgcagcaaaaagcagcaattgtgcggcttccggaggggaagcgaagaaagaacccgtcgcgtgttgcatgccccagtgggtgaccacgccgcgtgcagcgatacaaaggagacacgaagatgcaccgtcagaagggtaccatgtcctgaggggcagaagaggcggaaaggcgggcagggtaggcgagagaacgccaacaggaatctggctcgtaaggagtcaaaggaggctggtgccggatcacggcggcggaagggccaacagcagcagcagcaacagggaaccgtcgggccgttgacatccgcggggccagcctag

SEQ ID NO: 204078 - DNA, 603 bp, Artificial Sequence
  Description of Artificial Sequence: Synthetic coding sequence
atgcggctgggcctgtgcgtggtggccctggtgctgagctggacccacttaaccattagcagtagagggatcaaagggaagaggcagcggcggattagtgcagagggcagccaggcttgcgcaaaaggatgcgagctttgctcagaagtcaacgggtgcttaaaatgttctcccaaactcttcatcctgctagagaggaacgatatccgacaggtcggagtctgcctgccaagttgtccccccggatacttcgatgcgcggaatcctgacatgaataaatgcatcaagtgtaagatcgaacactgcgaggcatgtttttcacataatttttgtactaaatgcaaggaaggattgtacctccataagggtaggtgttatcctgcttgtcctgaaggatcttccgccgcaaatggaaccatggagtgttcgtctcccggccagaagcgacggaagggcggtcagggcaggcgggaaaacgcaaaccgtaacctggcgcgaaaagagtccaaagaggctggagcaggttcccggcgcaggaaaggccagcagcagcagcagcagcagggaaccgtagggccactgacatccgcaggccccgcctag

SEQ ID NO: 204079 - DNA, 711 bp, Artificial Sequence
  Description of Artificial Sequence: Synthetic coding sequence
atgatcttccgggtgagcgccgagggcagccaggcctgcgccaaggggtgtgagctttgttccgaggttaacggatgcctcaaatgttctcccaaactgttcatattgttagagcgcaacgatatccgccaggtaggtgtttgcctgcccagctgccctccaggttactttgatgctagaaacccagatatgaataagtgcatcaaatgtaagattgagcactgtgaggcctgtttctcgcataacttttgtaccaaatgcaaggagggactgtatctacacaagggccggtgttatcccgcatgtcctgagggatcttccgctgctaacggaaccatggaatgcagttcacccgcgcagtgcgagatgtcagaatggagcccctgggggccttgttcaaaaaagcagcagctctgtggtttccgaaggggctccgaggagcgcacaaggagggtactgcatgcccccgttggggatcacgccgcttgctctgataccaaagagacccggcggtgtactgtgcgaagagtgccctgccccgagggtcagaagagacgcaaaggcggccagggtaggagggaaaacgccaatagaaacctggctcgcaaggagtctaaagaggccggtgcggggagtcggcgaaggaagggtcaacagcagcagcaacagcagggtactgtggggcccctgacgagcgcaggaccagcctag

SEQ ID NO: 204080 - DNA, 732 bp, Artificial Sequence
  Description of Artificial Sequence: Synthetic coding sequence
atgcagttccggctgttcagcttcgccctgatcatcctgaactgcatggattactcgcactgtcagggaaataggtggcgccgcagtaagcgagcctcatacgtttccaatcccatatgtaagggatgtctgtcctgttctaaagacaacggctgtagcagatgccaacagaagctgttctttttcctgagaagagaaggaatgcgtcagtacggagaatgcctgcactcttgtcctagcggctattatggccacagagccccagacatgaatcggtgcgctcgttgtagaattgagaattgcgacagctgtttctcaaaggacttctgcacgaagtgtaaggtcggtttctatctccataggggcaggtgctttgatgaatgtcccgacgggtttgcaccgcttgaggaaacaatggagtgtgtggaaggttgcgaggttggccattggagcgagtggggtacctgctctcggaacaataggacatgtggatttaaatggggattagagacccgtacccggcagatagtgaaaaaacctgtgaaggataccattttatgtccaaccattgctgagagccgtcgttgcaagatgactatgcgccactgccctggtggcaagaggacacccaaggcaaaggagaagcgcaacaagaaaaaaaaacggaaactaatagagagagcccaggagcagcattcagtgtttctggcaactgatcgcgcaaaccagtag

SEQ ID NO: 204081 - DNA, 540 bp, Artificial Sequence
  Description of Artificial Sequence: Synthetic coding sequence
atgcagttccggctgttcagcttcgccctgatcatcctgaactgcatggactattcacactgtcagggaaaccgatggcgtagatcgaaacgaggttgtcgaatcgaaaattgtgattcatgctttagcaaagatttttgtactaagtgtaaagtggggttctacctgcacagagggagatgctttgatgaatgcccagatggttttgcacctttggaagagaccatggagtgcgtaggctgtgaggttgggcattggagtgagtgggggacctgctctcgaaacaatcggacgtgtgggtttaagtggggattagaaacccggacacggcagatagtaaaaaagcccgtgaaggatactatcctgtgtccaacgattgcagaatctcgacggtgcaaaatgacaatgcgccattgcccaggagggaagagaactcctaaagccaaagagaagcgaaacaagaaaaaaaaaagaaagctgatcgagagggcacaggagcagcactcagtctttcttgccactgatagggcaaaccagtag

SEQ ID NO: 204082 - DNA, 540 bp, Artificial Sequence
  Description of Artificial Sequence: Synthetic coding sequence
atgcagttccggctgttcagcttcgccctgatcatcctgaactgcatggactactctcactgccagggcaaccgctggcgccgaagcaaaagaggttgccgcatcgaaaactgcgacagctgtttttcaaaagatttttgcactaagtgcaaagtgggtttctatctccatcgaggaaggtgctttgatgagtgcccagatgggttcgccccactcgaagaaactatggaatgcgtaggttgtgaagttggacactggagtgagtgggggacatgctcaaggaataaccggacatgcgggtttaaatggggactcgaaactcggaccaggcaaatcgtgaagaagcctgtgaaagataccattctgtgccccacaatcgccgaatcaaggaggtgcaaaatgactatgcggcattgtccagggggcaaacgcacccccaaggctaaggagaaacgtaataaaaaaaaaaagcgaaaactgatcgaaagagcacaagaacagcactcggtgttcctagctaccgacagagccaaccaatag

SEQ ID NO: 204083 - DNA, 531 bp, Artificial Sequence
  Description of Artificial Sequence: Synthetic coding sequence
atgcggcagtacggcgagtgcctgcacagctgccccagcggctactatggacatcgtgccccagacatgaatcggtgtgccaggtgtcgcatcgaaaactgcgacagctgcttctccaaggatttttgtacaaaatgcaaagtgggcttctatcttcatcgcggaaggtgctttgacgaatgcccggacggtttcgctccgctcgaagaaactatggaatgcgtagaaggatgtgaggtgggacattggagcgagtggggtacatgttctagaaacaacagaacttgtgggttcaagtggggtctggaaacccgaaccagacaaatcgtgaagaagccggtgaaggatacaatcctgtgtccaaccatagccgaatccagaagatgtaaaatgaccatgaggcactgcccgggtggaaaacgaaccccaaaagccaaggagaaacgcaacaagaagaagaaacggaagctcattgagagagctcaggagcagcatagtgtgtttctcgccaccgacagagcaaatcagtag

SEQ ID NO: 204084 - DNA, 507 bp, Artificial Sequence
  Description of Artificial Sequence: Synthetic coding sequence
atgcggcagtacggcgagtgcctgcacagctgccccagcggctactatggccatcgcgcaccagacatgaacagatgtgcaagatgccggattgagaattgtgacagctgtttttctaaggatttttgtacaaagtgtaaggtggggttctatctacatcgtggtagatgtttcgacgaatgccctgacggtttcgcccctctggaggaaacaatggaatgcgtcgagggctgtgaagtagggcattggtccgaatggggcacatgctccagaaacaacagaacttgcggatttaaatgggggcttgagaccagaactcgacagattgtcaagaagccagtaaaggacaccattctttgtcctaccattgctgagtcccggaggtgtaaaatgactatgcgacactgtcccggtgggaagcggacccccaaagccaaagaaaagcgcaacaaaaagaagaagagaaaattaatcgaacgagctcaggaacagcattccgttttttag

SEQ ID NO: 204085 - DNA, 270 bp, Artificial Sequence
  Description of Artificial Sequence: Synthetic coding sequence
atgcggcagtacggcgagtgcctgcacagctgccccagcggctactatggtcatcgtgcaccggatatgaatcgttgtgccaggtgccggatcgagaattgtgatagttgctttagcaaggacttttgcacaaagtgcaaagttggattctatctgcacagagggagatgctttgacgaatgtcccgacggatttgccccattggaagaaaccatggagtgcgttgaagggtgcgaggtaggacactggtccgaatgggggacgtgctag

SEQ ID NO: 204086 - DNA, 366 bp, Artificial Sequence
  Description of Artificial Sequence: Synthetic coding sequence
atgcagttccggctgttcagcttcgccctgatcatcctgaactgcatggattattctcattgtcaaggcaacaggtggagacggagtaaaagagcctcctacgtcagcaatcccatatgtaagggatgcttgtcttgcagcaaggacaatggctgctctcggtgtcagcaaaagctattctttttcttgaggcgcgagggaatgagacagtacggggagtgtctgcattcttgtccttctgggtattacggtcacagagcacctgacatgaaccgctgcgctagatgtaggattgaaaactgcgactcctgcttttcaaaagacttttgcacaaagtgtaaagtgggattctacctccataggtag

SEQ ID NO: 204087 - DNA, 234 bp, Artificial Sequence
  Description of Artificial Sequence: Synthetic coding sequence
atgcagttccggctgttcagcttcgccctgatcatcctgaactgcatggactattcgcactgtcagggtaacaggtggagacggagcaaaagggcatcttacgtcagcaacccaatctgtaaggggtgcttatcttgtagcaaggataacggatgctctaggtgtcagcaaaaactgtttttcttcctgcgccgggagggcatgaggcagtatggcgaatgtctgcatagctag

SEQ ID NO: 204088 - DNA, 1410 bp, Artificial Sequence
  Description of Artificial Sequence: Synthetic coding sequence
atggccttcctgatgcacctgctggtgtgcgtgttcggcatgggctcgtgggtcacgattaatggcctgtgggtcgagctgcccctcttggtgatggagctccccgaaggctggtacttgcccagttacctgacggtcgtaattcagctagccaacatagggccacttctagtaactctgctgcatcatttccggcctagttgcctgagtgaggtgcccatcatttttactctgctgggggttggtactgtgacttgtatcatcttcgctttcctgtggaatatgaccagttgggtcctggatgggcatcactctatcgccttcctggtcctgacatttttcctggccttggtggattgtacctctagcgttacgttcctccctttcatgtctcgactccctacctactacctgacaacatttttcgtgggggagggccttagtggcctgctgccagctcttgtggccttagcccaaggtagcgggttaacaacatgcgttaatgtaaccgaaatttctgacagcgtgcccagcccagtgcccactcgagaaacagatatcgcccagggagtacctagggccctagtgagtgcactcccaggcatggaagctcccctcagtcacttggagagccgctatttgccagcccacttctcacccttggtgttctttctgcttctctccattatgatggcgtgctgcctggtggccttttttgtgttacagcggcagccaaggtgttgggaggcctctgttgaagatctgcttaacgaccaggtgactttgcatagtattcgacccagagaggagaatgacctgggccctgcaggcacggtagacagcagccagggccagggatatctggaggagaaggccgcaccctgctgtccagctcatcttgcctttatctataccctagtggccttcgtcaacgccctgacaaacggaatgctgccaagtgtgcaaacctattcctgcctgtcatacggtccagtggcttaccacctcgccgccacactgtctatcgtcgctaatcctctggcttccctcgtgtcaatgttcctgccgaacaggtccctgctgttcctcggagttcttagtgtcctggggacctgcttcggtggctataatatggccatggccgtcatgtccccctgccccctcctgcagggccactggggcggggaggtgttgattgtggcttcgtgggtgctgttctctggctgtctgtcttacgtgaaggtcatgctcggcgtcgttcttcgggacctgtctaggtctgccctcctctggtgtggtgccgctgtgcagttgggtagcctgttgggtgctttgttaatgtttccactcgttaatgtgctgcgcttgttttcatctgctgatttttgtaatttacactgtcccgcatag

SEQ ID NO: 204089 - DNA, 519 bp, Artificial Sequence
  Description of Artificial Sequence: Synthetic coding sequence
atgcgggcccccctgtgcctgctgctgctggtggcccacgccgtggacatgcttgctctgaaccgacggaaaaagcaggtgggaacaggactcggtgggaactgtacgggctgcatcatttgctctgaggaaaacggctgttccacctgccaacaaaggctcttcttgttcatccgtagggaagggattagacagtatgggaaatgcttgcatgattgccccccgggctatttcggtatccgaggtcaggaggtaaaccgttgtaagaaatgcggcgccacatgtgaatcctgtttctcacaggacttctgcatacgttgtaagaggcagttctacctctataaggggaaatgtctgcccacttgtccacccggaactctggctcatcagaacactagagagtgtcaggagagaagccctggacagaaaaaagggagaaaagatcgcagaccacggaaagaccgcaagctcgataggaggcttgacgtgcgccctagacagcctggacttcaaccatag

SEQ ID NO: 204090 - DNA, 2133 bp, Artificial Sequence
  Description of Artificial Sequence: Synthetic coding sequence
atgcggggccggctgtgcgtgggccgggccgccgccgccgccgccgctgtcgccgtccccctcgccggggggcaggaggggagcccgggcgggggacgacgtggctcaaggggaactactatggtgaagaaaagaaagggcagggtcgtaatcgactctgatacagaggatagtggcagcgatgaaaatctggatcaagaactactgtctcttgcgaaacggaaacggtccgactccgaagagaaagagccccctgttagccagcccgctgcaagttcagattccgagacgtccgactctgacgatgagtggaccttcggttcaaataagaataagaagaagggtaaggcaagaaagatcgagaagaagggcacaatgaagaagcaggccaataaaaccgcttcctccgggtctagcgacaaagactcaagtgccgagagcagcgcccccgaggagggcgaagtgtctgattctgacagcaattcaagtagcagcagctccgacagcgattctagctctgaggatgaggagttccatgatggctacggtgaagatctgatgggagatgaagaggacagggcccggttggagcaaatgacagagaaagaacgggaacaggagcttttcaatcgaattgaaaagcgagaagtgctgaaacggagatttgagattaaaaaaaaactaaagactgcaaagaaaaaagagaagaaagagaagaagaagaagcaggaagaggaacaggagaagaaaaagctgacacagatccaggagagccaggtgacctcccataataaggaacgcaggagcaagcgagacgaaaagttagataagaagtcccaagccatggaagagctaaaagctgagcgcgagaaaaggaaaaacaggactgccgagcttctggctaagaaacagccacttaagacaagtgaggtgtactccgacgatgaggaagaagaagaagatgacaagtcgagcgagaagtccgatcggagcagccggactagctcctcagacgaagaggaagagaaagaggagatacctcccaaatctcagcctgtaagtctgcctgaagaactcaacagagtgcggctgtcaagacataagttggagcggtggtgtcacatgcccttcttcgccaagacagtcaccggttgcttcgtgcgcatcgggataggcaaccacaactccaagccagtgtatagggtagctgagatcaccggtgtcgtggaaacggcaaaagtgtatcagttgggtgggactagaaccaataaaggcctccagctgcgtcatggtaatgaccagcgggtgtttcgactggagtttgtgagcaatcaagaattcactgagagcgaatttatgaagtggaaggaggccatgttttcagccggcatgcagcttcccacccttgatgaaattaataaaaaggaattatctatcaaggaggccttaaattataagttcaacgaccaggatatagaggaaatagtgaaggagaaggaaaggttccgaaaagctccgccgaactacgcaatgaaaaagactcagctgctaaaagaaaaggcaatggctgaggacctgggagaccaggataaagccaaacagattcaggaccaattgaacgaactggaggagcgagccgaggcactggatcgccagcgaacaaagaatatttccgctatttcatatattaaccagcgcaatcgtgaatggaatatcgtagagagcgaaaaagccctcgtagcagaatctcacaacatgaaaaatcagcagatggatccttttacacggaggcagtgcaagccgacaatcgtctctaactcccgggacccagcagtgcaggctgctatcttggcacagctgaacgctaagtacggttccggcgtcctccctgacgcacccaaagagatgtcaaaaggacaggggaaagataaggacctgaactctaaaagcgcttcagatctgagtgaggatttgttcaaagtgcacgacttcgatgtcaagatcgatctccaggtgcccagcagtgagtccaaggctctagcgattacatctaaggccccaccagcaaaggatggtgctcctcgtaggtcattgaatctcgaggactacaagaaacggcgggggctcatttag

SEQ ID NO: 204091 - DNA, 4551 bp, Artificial Sequence
  Description of Artificial Sequence: Synthetic coding sequence
atggacagcccccccaagctgaccggcgagaccctgatcgtgcaccatattccgctggttcactgccaagtacccgatcgacaatgttgtggcggtgccggaggcggaggcggtagcacgcgacctaatcctttttgtcctcccgagctggggattacccaacccgatcaagacctgggccaggccgacagcctgctattttccagtctgcattccaccccggggggcacagcccgcagcatcgattctactaagagtcgctcccgagatggcagagggcccggggccccaaagcgacataatccctttcttctgcaggagggagtgggcgaaccgggactcggagatctgtatgatgacagcattggagactctgccactcagcaaagttttcacttgcatgggacgggccaacccaacttccacctgagctcctttcaacttccgcctagcggccccagggtagggcggccctggggtactaccaggagccgggccggtgttgttgagggacaggagcaggagccagtgatgaccctcgacacccagcaatgcgggacaagtcattgctgtaggcccgagttggaggccgaaacaatggagctggatgagtgcggaggtccaggcggtagtggttccggcggcggagcctccgatacgagcgggttttcctttgatcaggagtggaagctgtcttctgatgaaagccctagaaatccagggtgttccgggtcaggtgatcaacactgtcgatgttcaagcacctcgtcccagtcagaagccgctgatcaatcaatggggtacgtgagcgattcatcctgcaactcttccgacggagtgctggtgacttttagtacgctttacaacaagatgcatggtacccccagagcaaacttaaactccgccccccaaagttgttccgattctagtttctgcagccactccgatcctggagccttttacttggacctgcagcctagcccctttgaaagcaagatgtcctacgagtcccaccacccagaatccggcgggcgcgaaggcgggtacggttgccctcatgcgtctagcccagagctggacgcaaattgtaactcctatcgcccgcattgtgagccctgtcctgctgtggctgacctaacagcctgttttcaaagtcaggcacgcctcgtggtcgctacccaaaattattataagttggtgacatgtgatctgagttcccagtcctccccaagccctgcaggatccagcatcactagctgctctgaagaacataccaagattagccctccccctggtcctggccccgatcccggcccatcacagccgagcgagtattacctcttccagaagccggaggtgcagccagaagagcaggaggctgtaagtagctctacccaagctgctgccgctgtgggccccaccgttttagagggccaggtgtacacgaacaccagtccccccaacctgtcgacaggccgccagagatccagatcctacgatcggtccctacaaaggtcccctcctgtgcgattaggaagcctcgagcgcatgttgtcctgcccggtgaggctaagcgagggaccggcagctatggcgggaccgggctcccccccccggcgagtgacaagctttgctgagcttgccaaagggcgcaaaaagaccgggggtagcgggtctccaccactgagagtgtccgtcggggacagctcccaggaatttagcccaatccaggaagcacagcaggaccgtggtgccccactggacgaagggacttgttgcagccattcgttgccaccgatgcctctgggacccggaatggacctgctgggacccgatccttcccctccttggtcaactcaggtgtgtcagggcccccacagttcagagatgcccccggcaggcttgcgagccacgggacagggccctctggcccagctgatggaccccggccctgctctgccggggagtccagccaactcccacactcaaagggacgcccgcgccagagcggatggaggcggtacagagtctagacccgtcctcagatactctaaagagcagcgccccacaacccttccgattcagcccttcgttttccaacatcacttccctaaacagttggctaaagcaagggccctgcattcacttagccagttatactctctgtcaggctgtagcaggactcaacagcctgccccacttgctgcaccagctgctcaggtgtctgtgccggccccttcaggtgagccacaggctagcacgccccgcgcaacgggtcggggcgcacgaaaggctggatcagagccggaaacctcacgtcccagtcccctgggctcctatagccccatcaggtcagtgggcccctttgggccctcaactgactctagcgcttctaccagctgcagtcccccccctgaacagcctactgctaccgagtctctacccccttggtcacactcctgccccagcgccgtccgccccgctacaagtcaacaaccccagaaggaagatcagaagatcttgacattgacagagtatcggctgcatggcactggctcactgcctcctctggggagttggcgatctggactgtctagagcagagtctctagcgagggggggtggagaaggtagcatggctacaagaccttccaatgctaatcatctgtctccccaggccctcaaatggcgcgaataccgcaggaaaaatcccttaggacctccggggctgagcggatcactcgatcgacgctctcaggaggcgagattagcgagaaggaatcccattttcgaattccctggatcactgtcagcggcgagtcatctgaattgccgattgaacggccaggccgtaaagcctctaccgttgacctgccccgatttccaggatccctttagcctgaccgaaaaacctccggctgaattctgtctttcccctgacggcagctcggaagctatctccattgatctccttcaaaagaagggtttagttaaagcagtcaacatcgccgtggacctaatcgtagcacatttcggcaccagcagggacccaggcgttaaagccaaactcggtaattcctctgtcagccctaatgtgggccatctggtgcttaagtacctgtgtcctgccgtgagggcagtcctggaggacgggcttaaagcctttgtgcttgatgtcattatcggacaacgaaagaatatgccgtggtccgtggtggaggcatctacacaactgggcccgagcaccaaggtcctgcatgggctgtataataaagtgagccaattccctgaattaacttctcacactatgaggtttaatgcattcattcttgggctgctgaatatcaggtccctggaattctggtttaatcacctgtataatcacgaagacataatccagacccactaccagccatgggggttcctgtcagctgcacacactgtatgtcctggcttattcgaggagctgctcctgctcctgcagcccctggcccttttgcccttttctctcgatctgcttttccagcatagactgctgcaaagtgggcaacagcagagacagcataaagagctactgcgagtgtcgcaggacctgctactttcagcccacagcacactgcaactggctcgcgcgcgaggccaggagggccctggggatgtggacagagccgcacagggggaacgcgttaagggggtaggtgcctctgagggaggagaagaggaagaggaggaggaagaaacagaggaggtggccgaggccgcaggaggatcaggaagagcccggtgggccagggggggccaagctggctggtggtaccagttgatgcagagcagccaagtatacattgatggaagcatagagggttctaggtttccacggggatcctctaacagcagctccgagaagaagaagggcgcgggcggaggcggaccaccccaagcccctcctccccgtgaaggagtcgtcgagggggccgaagcttgtcctgcatccgaggaggcgttaggccgggaacgggggtggccattctggatgggatctccacctgatagtgttcttgccgaactgcggagatcaagggaaagagaaggccccgccgcctctccagccgagaatgaggaaggtgcttcggaacccagtcctggagggattaagtggggacacttgtttggtagcagaaaggcacagagagaggcacggccgaccaatagactgccttctgactggctgagcctggacaagtccatgtttcagctggtggcgcaaacggtggggtctcgccgggaaccagaacccaaggaaagtttgcaggagccacacagcccggcgctcccctcaagccccccttgcgaagtacaggctctctgccatcatctggctacaggacctggacagctctcctttcacaagggcgatatccttcgcgtccttggccgtgctggcggtgattggctaagatgctcaaggggacccgacagcggacttgtccctctcgcctacgtgaccctgacccctaccccctctccaactcctggctcctctcaaaattag

SEQ ID NO: 204092 - DNA, 4551 bp, Artificial Sequence
  Description of Artificial Sequence: Synthetic coding sequence
atggacagcccccccaagctgaccggcgagaccctgatcgtgcaccacattccattggtccattgtcaggttcctgaccgccagtgttgcggcggggcgggtggcggaggcgggtccacgagacctaatccattttgtccaccagagcttggcataacacagcctgaccaggatctggggcaggcagattcactgttattctcgagcctgcacagtacacccggaggaactgcccgaagtatcgatagtaccaagagccgcagtcgtgacggcagaggccctggcgcccccaagcggcacaacccatttttgcttcaggaaggggtaggcgagccggggctaggagacctctatgacgacagcattggtgatagcgccacgcagcaatctttccatttgcatggcacagggcagcctaacttccatctctccagtttccagcttccaccttccggccctcgagttggaagaccctgggggactacaagatcacgggcgggcgtcgtggagggccaggagcaggaacctgtgatgactctagacactcaacagtgcggcacaagccattgctgccgtcctgaactcgaggcagaaacaatggagctcgacgagtgcggcggccctggtgggagcggatctggcgggggggcgagcgacacgagcgggttttccttcgaccaggagtggaaactcagcagcgacgagtcacctagaaacccaggctgctctggctccggtgatcagcactgtcgatgtagttccacttcgagtcagagcgaggcagccgatcagagtatgggatatgtgtctgattccagctgtaattcatctgatggcgttctggttaccttttctaccctgtacaacaaaatgcacggaacacctagagccaatctaaattctgccccgcagtcctgcagcgatagctcattctgttcacactcagatcccggcgcattctatctcgatcttcagccctctcccttcgagtctaaaatgagttatgagagccaccaccccgaaagcggaggccgagaaggtggatacgggtgtcctcacgcctcatcaccagaattagacgccaactgtaattcataccgtcctcattgcgaaccatgtcctgcagtggctgatctgacagcgtgcttccaatcccaggcgcgactcgtcgttgccacacagaactattataagctggttacatgcgacctgagctcacagtcttcaccttcccccgctggatcctcaatcacatcttgcagtgaggagcataccaagatttctcccccaccgggaccagggccagacccaggtccatcccagccatccgagtactatttatttcagaaacctgaggtgcagcccgaggaacaggaggcagtttcctcctccacccaagcggccgcagctgtcgggccaaccgtattggaaggacaagtttatacaaacacctcccccccaaacttaagtacgggccgccagaggtcccgctcctacgatcggagccttcaacggagcccaccagtgcggttaggctccctggagaggatgctgtcgtgtcctgtgaggctgagcgagggtccagctgctatggccggtcctggttccccacctaggagagttacttccttcgctgagctcgcaaagggccgaaagaagaccggtggatcaggtagtccaccattgcgggttagcgtgggggactcttcgcaagagtttagcccaatacaagaggcccaacaggatcggggcgccccgctcgacgaaggtacatgttgtagccattcactgccgccaatgcctctgggtcctggcatggatctcctgggaccagacccctcgcccccatggagcacacaggtatgtcagggccctcactccagcgaaatgccccccgctggcttgcgtgccaccggccaggggcccctggcgcaattgatggatccggggccagcactgcccggctctccagccaactcacatactcagcgggatgcgagagcgcgagcagatggtggcggtacagagagtagaccagtgctgcgatactccaaagagcagagacccactactctgcctatccagccgtttgtgtttcagcaccacttcccaaagcaactggcgaaagcacgggccctgcactccttatctcaattgtacagcctatccggctgctcaaggacacagcaaccagcaccccttgctgcacccgccgcacaagtgagcgttccggccccttccggggagccccaggcgtccacaccaagagccactggccgcggggcgagaaaagcaggctctgaaccagagacatccaggccatctcccctaggatcatactcccccataagatcggtgggaccattcggcccctcgaccgactctagcgcttctacctcttgttccccccctcccgagcagcccacggctactgaatccctccccccatggagccatagttgtccaagcgccgtgcgtcccgctactagccagcaacctcagaaggaggatcaaaaaattttaaccctgacagagtataggctccatggtaccggcagcctgccacctctagggtcttggaggtccggtcttagcagagccgaaagtctggccagaggaggcggggaaggctccatggcaactcggccgtctaacgcgaaccacctgtctcctcaggcactcaaatggcgggaatatcggaggaaaaacccattaggtccccccgggctgtccggatctctcgaccggcggtctcaggaggctcgactagccagacggaaccctatctttgaattccccggtagcctgagcgcagcttcccatcttaactgtaggctgaacggtcaggccgtaaaaccactgccgttgacctgtccggacttccaagacccttttagtctaacagagaagccacctgcggaattttgtctctccccagatgggtcgagcgaggccattagcattgacctcctacagaaaaaaggcctggttaaggcagtgaacatcgctgttgacctgatcgtggcccattttggcacctcacgcgatcctggggtcaaagcaaagctgggtaattcttctgtgagtccaaatgtgggacacttagttctgaaatacttgtgtcctgccgtgagagcagttcttgaggatggattaaaggcattcgtgttggatgttataatagggcagcgcaaaaacatgccttggtctgttgtggaagcctcaacccagctcggcccttctacaaaggttctccatgggctctataacaaggtgtctcagttccccgaacttacctcccatacaatgcggtttaacgcatttattctgggcttgctgaatattcgctcactggagttctggttcaaccatttgtacaatcatgaagatattatccagactcattatcagccctggggtttccttagcgctgcccacacagtgtgtcccggtctgttcgaggaactcttactactgctccagccactggcgttattgcccttttcattagatctactgtttcagcacaggttattgcagtctggtcagcagcagcggcagcataaagagctgttgagggtgtcgcaggatctccttttgtcggcccatagcaccctacagctcgccagagcccggggccaggaaggtccgggcgacgtcgatcgcgccgctcagggggagcgtgtaaagggggtcggcgctagcgaaggcggtgaggaggaggaggaagaggaggaaactgaggaggttgccgaagcagcagggggctcaggaagggcccgctgggccaggggcggtcaggccggttggtggtaccagttaatgcaatctagccaggtttacattgatggcagcatcgaaggttcacgatttccaagaggaagcagcaactctagctctgaaaagaaaaaaggagccggaggcggcggtccccctcaggcccccccacccagggaaggcgttgtggagggagccgaagcgtgccctgcaagcgaggaggcccttgggcgggaacgtggatggcctttttggatgggtagccccccagattctgttctggctgagctacggaggtcgcgagaaagggagggcccagccgcgagcccagccgagaacgaggagggcgccagcgagccctcacctggaggaattaaatgggggcatcttttcggatcacggaaggcgcagcgcgaagcacgacctaccaataggttacccagcgactggttgagtctggataaatcaatgtttcagctggtcgcccagacagtaggcagccggcgcgagccagaacccaaagagagcctccaggagccccactcccctgctctccccagtagtcctccttgtgaggtacaggccctgtgccaccatttggccaccggcccagggcagctgagtttccacaaaggcgatatcctgcgggtcctcggccgggccgggggagattggctccgttgtagtcggggcccagactcagggctcgttcctttggcatatgtgaccctcaccccaacccctagccctacgccaggtagctcccagaactag

SEQ ID NO: 204093 - DNA, 2775 bp, Artificial Sequence
  Description of Artificial Sequence: Synthetic coding sequence
atggacagcccccccaagctgaccggcgagaccctgatcgtgcaccatatccccctggttcactgccaggtccccgatcggcaatgctgtggtggtgccggaggtggcggcggtagcaccagacccaaccccttctgccccccggagctggggataacccagcccgatcaggatcttggccaggcagatagcctgctattctcaagcctgcattcaacccctggagggactgctagatcaattgatagtaccaaatccaggagccgcgacgggaggggcccgggtgctccaaagcgccataaccccttccttttgcaagagggagtaggcgagcccggacttggtgacctctacgatgacagcatcggggactctgcgacccagcagtccttccacctccatggcactggccagccaaatttccatctgagcagtttccagctacctccgagcgggcctagagttggtcgaccatggggtaccacaagatcgcgcgccggcgttgtggaagggcaggaacaggagccggtgatgactttggacactcagcagtgcggcacctcacactgctgtagacctgagctggaagctgagacgatggagcttgatgaatgtgggggccctggcggtagcgggtctggcggtggagcgtctgacacttctggcttttcattcgaccaagaatggaaattaagctctgacgaatctccacgcaacccaggatgttctgggtctggtgatcagcactgtagatgttcatccacttcgagccaatctgaagctgctgaccagtccatgggttatgtgtctgatagttcttgtaactctagtgacggcgtcctggttacatttagcacactgtacaataaaatgcacggaacaccaagagcaaatctcaattcagccccacagtcttgttcagattctagtttctgcagccacagcgacccaggcgctttctatctggatttgcagcccagtccgttcgagtctaaaatgagttacgagagtcatcacccggagtctgggggtcgtgagggaggttacggctgcccacacgcttcttcacccgaactggacgccaattgtaattcctaccgcccacattgcgagccatgcccagctgtggcggatctgactgcttgctttcagagccaagcaagactggtcgtggcgacccaaaattactacaagcttgtcacctgcgacctgtccagccaaagtagcccaagtccggccggcagctccataacctcatgctcagaggagcacacaaaaatatctcccccccccggacccgggcccgaccctggccctagtcagcccagtgagtattatctcttccagaagcctgaggtgcagccggaggaacaggaggcagtgtcgtccagcacacaagccgccgccgcggtaggcccaacagtgcttgagggccaggtatatacgaacacctcgccgccaaatttgtccacaggtcgacaacgctctcggtcttacgaccgctctttacaacggtcaccgcctgtacgactgggctcccttgagcgaatgctgagctgtcctgtgcggttaagcgagggaccagccgccatggctggccccggatcccccccgcgtcgcgtaaccagcttcgccgagctggctaaagggcgaaagaagacgggaggctctggaagccctccacttcgcgtttcagtcggagatagctcccaggagttttcccctatacaggaggcccagcaggatcgtggagcgcccctagatgagggcacttgttgtagtcatagtttacctccgatgcccctggggcctggaatggatctgttgggtcccgaccctagccccccgtggagcacacaggtgtgccaaggcccccattctagcgagatgccaccagcaggcctgcgcgcaactgggcaaggaccactagcccaactcatggatcctggccctgccctgcctgggagtccagccaattcccacactcagcgtgatgcccgggcccgagcggatgggggcgggactgagagtcgacctgtgctcagatattcaaaagaacaacgccctacaaccctccccatccaacccttcgtgttccagcatcactttcctaagcaattggccaaggcccgcgccttacacagcctttctcagttgtacagtctgtcaggctgttcacggactcagcaacctgcacctttagccgctccagccgcccaggtgtccgtccccgctccctccggcgaacctcaggcatctacacctagagctacggggcggggggcccggaaggcagggagcgaaccagagacgtcacgcccgagtcctttagggtcttatagcccgattcggagtgtgggtcctttcggaccgtctaccgattcaagtgcgagcacttcctgtagtcctccccccgagcagcccaccgcgactgaatctctccccccttggagtcactcctgcccctccgccgtgagaccagcgacctctcagcagcctcagaaggaggatcagaagattttgacgctgacagagtaccgactccatggtacaggtagcctccctcccctaggatcatggcgttccgggctgtcaagggccgaatcgttggcccgcgggggaggagagggaagtatggctacccgaccgtccaatgctaatcatctgtcaccgcaagccctgaagtggcgcgagtacagaagaaagaaccccttgggtccccccgggcttagcgggtctctcgatcgtaggagtcaggaagcaaggacagggtag

SEQ ID NO: 204094 - DNA, 591 bp, Artificial Sequence
  Description of Artificial Sequence: Synthetic coding sequence
atgagcatgctgcggctgcagaagcggctggccagcagcgtgctgagatgcggcaaaaagaaggtgtggctggatccgaatgagactaacgagattgccaacgcgaatagccggcagcagatccgtaaactgatcaaggacggcctgattatcagaaagcccgtgaccgttcacagccgggcccgctgtcgcaaaaacacactcgcacgccgcaagggccgtcatatgggtattggaaagaggaaaggaaccgcaaatgcccgcatgccagaaaaggtgacctggatgcgcagaatgcggatacttaggcgtctcttacggaggtacagggagtcaaaaaaaattgaccggcatatgtaccactccctgtatctcaaggtgaaggggaacgtttttaaaaacaaaaggatccttatggaacatatccataagctcaaggcagacaaggcacgtaagaaactgttggccgaccaggctgaggccaggcggtcaaagactaaagaggcgcggaagaggagggaggagagactccaggcaaagaaagaggaaataatcaaaacactcagcaaggaagaggagacaaaaaaatag

SEQ ID NO: 204095 - DNA, 1341 bp, Artificial Sequence
  Description of Artificial Sequence: Synthetic coding sequence
atggaggccagcttcgtgcagaccaccatggccctgggcctgagcagcaagaaagcttcaagtaggaacgtcgccgtggaacgcaaaaacctaattacggtctgtcgcttttccgttaaaactttactggagaagtacaccgccgagccaatagacgacagcagtgaggaattcgtgaatttcgctgccatcctcgaacagattttaagccatcggttcaaggcatgtgcccctgccggccccgtgagttggttttcttcggatggtcaaagaggattttgggactatattcgtctggcctgctcaaaggtgccaaacaattgcgtatcctcaattgagaacatggagaatattagtacagctcgtgcaaaaggcagggcgtggatacgagtagctttgatggaaaaaaggatgtccgagtatatcaccacggccttgcgggatacccgcactacccgcagattttatgattccggcgccatcatgctgcgtgatgaagcaactattctgaccggtatgcttattggcctgagcgccatagacttctcattttgcttaaaaggtgaggtactggatgggaaaacgcccgttgtgatcgattataccccctacctcaagttcacacagtcgtacgattacctaacagacgaagaggaacggcattcagctgagtccagcacaagtgaggacaattctccagagcatccctacttgcccctggttaccgatgaagattcgtggtattccaagtggcataagatggaacagaagtttcgtattgtgtacgcccagaaggggtacttagaggaactggtacgtctgcgtgagagccagttgaaggatttggaagccgagaatcgtcgcctccaactgcagctggaagaggcagcggcacaaaatcagagagagaagagggagctggagggcgtaattctagagctgcaagaacagctgaccggactcatcccttcagaccacgcccccttagcccaaggtagtaaagaactcacaacaccgttggttaatcagtggcccagcttgggaaccctgaatggcgcggagggggcttcaaattctaaactctaccgcagacacagcttcatgtccaccgagcccctcagcgcggaagcatctttaagttccgactctcagcgcctaggggaaggcacccgagacgaagagccttggggcccaatcggtaaagaccccacccctagtatgcttggcttatgtgggagtctcgctagcataccatcttgcaaatccctggcttcttttaaatccaacgagtgtttggtctccgactccccagagggtagcccagctctttctcccagctag

SEQ ID NO: 204096 - DNA, 1371 bp, Artificial Sequence
  Description of Artificial Sequence: Synthetic coding sequence
atgaagatcgaggaggtgaagagcaccaccaagacccagcggatcgcttcccatagccacgttaagggcttaggcttggacgagtctggactggccaagcaggcagcatcaggactcgtagggcaggagaatgcccgggaggcttgtggggtcattgtggaattaatcaagagtaaaaagatggccggccgtgccgtgttgctcgccgggcctcctggcaccggaaagacagcccttgccctagcaattgcccaagagctgggcagtaaagttcctttctgccccatggtgggctctgaggtgtacagcaccgaaatcaagaagactgaggtgcttatggagaacttccggcgagccataggcctcaggatcaaggagactaaagaagtctatgaaggggaagtcaccgaactgacaccctgtgaaaccgagaatcctatgggcggttatggcaaaacaatttcccatgtcataatcggcttgaagacagctaagggcacgaaacagctcaagttagatcccagtattttcgagtcgctgcagaaagaaagggtagaagccggcgacgtaatttacatagaggccaactccggcgcagtcaaacgtcaaggccggtgcgacacgtacgccacagagttcgatctggaggctgaggaatacgtgccattacccaagggagatgttcacaaaaaaaaggagatcatccaggacgtgactttgcatgatctggacgtggccaacgccagaccacaggggggtcaagacatcctgtctatgatggggcaactgatgaaacctaagaagaccgaaatcacagacaaactgcgcggggagatcaataaagtcgtcaataaatacattgaccaaggtatcgctgaacttgtgcccggagtgctgttcgtcgatgaagttcacatgttagacatcgagtgtttcacttacctgcaccgcgccctagaatcctcaattgcgccgatagtcattttcgcatccaatcgtggcaattgcgttattcgcggcacggaggacatcacttctccacacggtatacccttagacctgctcgatagggtcatgatcattaggacaatgctgtacaccccacaggagatgaaacagataattaagatcagagcacagaccgagggtattaacatctctgaagaagctctgaatcacttgggcgagattgggaccaaaacaaccttgcgttacagtgtgcagctgctcacgcctgcgaatcttttagctaagataaatggaaaagattctatcgagaaggagcatgtagaggagatttctgaattgttctatgacgcaaaatcctctgcaaaaattttagctgatcagcaggataagtacatgaaatag

SEQ ID NO: 204097 - DNA, 1161 bp, Artificial Sequence
  Description of Artificial Sequence: Synthetic coding sequence
atgaagatcgaggaggtgaagagcaccaccaagacccagcggatcgcttcccactcacacgttaaggggctcggcctagacgaatcaggtctcgccaaacaagcagcatctggactggtcgggcaagaaaacgcaagggaggcttgcggcgtcattgttgagctgattaagagcaaaaagatggcaggcagggcagtccttcttgctggaccaccaggaacaggcaagaccgccctcgccctagctatagctcaagagctgggcagcaaggtcccattctgtccgatggtgggttccgaggtctactccacagaaatcaaaaagaccgaggttctcatggagaatttccgaagggcaatcggtctccggatcaaggaaaccaaggaggtgtacgagggcgaggtgactgagttaaccccctgcgagacagagaacccaatgggcggatacggcaagacaatcagccacgtgatcattgggctgaagaccgctaagggcacaaaacagctaaagcttgacccttcaattttcgagtcccttcagaaggagcgagttgaggcgggcgatgtgatttacatcgaggccaactcaggagctgtcaaaaggcaggggcgctgcgatacctacgctaccgagttcgacctcgaagccgaggagtacgtacccctcccgaagggcgacgtgcacaaaaaaaaagaaatcattcaggacgtgacactgcacgatctggacgtggcaaacgctcgccctcagggggggcaggacatcctctccatgatggggcaattgatgaagcctaagaagacggagatcacggataagctacggggcgagatcaataaggtggtaaataaatacattgatcagggtatagccgaattggtccctggggtactgttcgtcgacgaggtgcatatgctggacatcgagtgctttacatatctgcaccgggccctggagtccagcatcgcccctattgttatcttcgcatcaaataggggtaactgtgtaatacgtgggaccgaagatataaccagtccacatggaatccccctggacttactggacagagttatgatcattagaacaatgctgtatactcctcaggagatgaaacaggtgctcagcgccgctgccgatccaggccagctcgcctgttag

SEQ ID NO: 204098 - DNA, 2502 bp, Artificial Sequence
  Description of Artificial Sequence: Synthetic coding sequence
atggacgtggtggaccccgacatcttcaaccgggacccccgggaccactacgacctgcttcagagacttgggggcggaacttacggagaagtcttcaaggcccgcgacaaggtctctggcgacctagtggccctgaaaatggtgaaaatggaacccgacgatgatgtgagtactttacagaaagaaatcctgattttaaagacctgcagacatgcaaatatagtagcgtatcacggatcttatctgtggttacagaaactatggatatgtatggagttctgtggagccggatctctgcaggacatttaccaggtgaccggcagcctgtccgagcttcagatcagctacgtctgccgggaggtgttgcagggtctagcttacctacattcccaaaagaagatccatcgcgatattaaaggggccaacatactgatcaatgatgcaggagaggttcggctggcggattttgggatttctgcgcagattggcgccacactggccagaaggctctctttcatagggacgccatactggatggcaccagaagtggcggcggttgctctcaaggggggttataacgaactctgcgacatttggagtctgggtataacggccattgagttggcagaactccagccaccgctgtttgatgtccaccctcttagggttcttttcctgatgacaaagagtggctaccagccaccgcgactgaaggaaaagggtaagtggagtgcagccttccataactttatcaaggtcacgctgactaagtctccgaaaaagagacccagtgcgactaaaatgttgagtcatcaacttgtgagccagccaggtctgaacagagggcttattctggacctccttgacaaacttaaaaatcccgggaaaggccccagcatcggagatattgaggacgaggagccagagctccctcctgctattccaagacgaatccgatccacccaccgctcctcgagccttggtattccagacgctgactgctgcaggagacatatggagtttagaaagctgcgcggcatggagacaagaccccctgcgaacactgccaggctacagccccctagagatcttaggagctcaagccccaggaaacagctgtccgagtcatcagacgacgactatgacgatgtagatataccaacaccggcagaggatacacctccacccctaccccctaaaccaaagttcagatcacccagcgatgagggcccaggttccatgggggacgacggacaactgtcccccggcgtgctggtgaggtgcgccagcggacccccccccaattctccaagacccgggcctcctccgtccacctcaagcccccatctcaccgcccactctgagcctagcttatggaatcccccatcccgcgagctggataagccgccgttgctcccacccaagaaagaaaagatgaagaggaagggatgcgccctattggtgaaactctttaacggttgtccccttcgcattcacagcacagctgcctggactcatccctcgaccaaagaccaacatttgctgttgggagccgaggaaggaatatttatcctgaatcggaatgaccaggaagctacactggagatgcttttcccatccagaaccacctgggtgtactcaattaacaacgtgctgatgagtctgagcggcaagacccctcatctgtactctcactctattctggggctgctcgagagaaaggagactcgcgcgggcaatcctattgcgcacatctcacctcataggctactggcacgtaaaaatatggtgtccactaagatccaggatacaaaaggatgtagagcatgctgcgtggcagagggggcgtcttccggaggaccgttcctgtgtggggcactagaaacatcagtggtactgctgcaatggtaccagcctatgaacaagttccttttagtgagacaggtgttgttcccgctgcccacccccctgtctgtctttgcgttactgacgggcccaggctctgaacttcccgctgtttgcattggtgttagtcccggacgacctggcaagagcgtcctattccatactgtgagattcggtgctctgtcatgctggcttggggaaatgagcaccgaacatagaggtccggttcaggtgacccaggtggaggaagatatggtcatggtgctcatggatggcagcgtcaaactggtcacacctgagggctcgcccgtgcgggggctgaggactccagaaattccaatgaccgaggccgtcgaggccgtggctatggttgggggacaacttcaggcattctggaagcacggcgttcaggtttgggcgctgggatcagatcaactgttacaggagctaagagacccaacactaacctttcgcctgctcggcagcccgcgcctcgagtgctcgggaacaatcagtccccactgcaatctgctgctgcctggcagttctaattctccggcgtcagcctctcgagttgctggtattacgggcctatag

SEQ ID NO: 204099 - DNA, 1257 bp, Artificial Sequence
  Description of Artificial Sequence: Synthetic coding sequence
atggtgggccagctggccgcccggcgggccgccggcgtggtgctggagatgatcagggagggaaaaatagccggaagagccgtgcttatagcgggacagccgggaactggaaaaaccgctatcgctatgggtatggcccaggccctggggcccgacaccccttttacagctattgccggaagcgagatcttttcactggaaatgtccaagacggaggccctgactcaggcatttcgcaggtctataggcgtcaggattaaagaagaaacagagattatcgaaggggaggtggtggaaattcagattgacagacctgcaaccggcacggggtccaaagtcggtaagttgacactgaaaacaactgagatggaaactatttacgatctaggaacaaaaatgatcgagagtctgaccaaggataaggtgcaggcaggagacgtgatcaccatcgataaagctaccggtaaaatatcgaaactagggcggagcttcactcgtgcgcgggactatgacgccatgggctctcaaacgaaatttgtccagtgccccgatggcgaactccaaaagaggaaagaggtcgtgcacactgtttccttgcacgagatcgatgtgatcaactcaaggacgcagggcttcctcgcgttattcagcggtgacaccggcgagattaaaagtgaggttagagagcagatcaacgcaaaggtagcagagtggcgggaggaaggaaaagcagaaatcattcccggcgttctcttcatcgacgaagttcacatgcttgatatcgagtcctttagtttccttaatcgtgccctggaatcagacatggcaccggtgctcataatggcaacgaacagaggcatcacacgcatcaggggcactagttatcagagtccccatggcattccgatcgacctgctggaccggcttctgatagtgagtaccactccttattctgagaaggacacgaaacaaattctgagaatccgctgtgaagaggaagacgtggaaatgagtgaggacgcttacactgtgttgacaagaatagggttggagactagtctccgctatgcaattcagttgatcacagcagcctctctggtgtgtcgaaagaggaaagggacagaggtccaggtcgatgacattaagcgagtctactcacttttcctggacgaatcccgctcgacacaatacatgaaggagtaccaggatgcattcctgtttaatgaactcaaaggagaaaccatggatacctcctag

SEQ ID NO: 204100 - DNA, 1392 bp, Artificial Sequence
  Description of Artificial Sequence: Synthetic coding sequence
atggccaccgtgaccgccaccaccaaggtgcccgagatccgggacgtcactcgcatcgagaggatcggcgcccatagtcacatcagaggtttgggtctggacgatgccctggagccccggcaagcgagtcaggggatggttgggcagctagcggcccggcgcgccgctggggtcgtcctggaaatgatccgagagggaaagatagctggccgtgcagttttgatcgctggccagcccgggaccggcaaaaccgccattgctatgggtatggcccaggccttggggcctgacacgcctttcactgctatagcagggagcgaaatttttagtttggagatgagcaaaaccgaggcattgacccaggcctttaggaggtcgatcggggttcggattaaagaggaaactgaaataatcgagggcgaggtggtcgaaatccagatcgatcgacccgccaccgggaccgggagcaaagttgggaagttgacccttaaaactaccgagatggagacaatttatgatcttgggaccaaaatgattgagtctctaaccaaggataaggtgcaggcaggtgatgtcatcactatcgacaaggcgactggaaagatctcaaagttaggaaggagcttcacacgcgcacgagactatgacgccatgggatcccagacaaagtttgttcaatgccccgacggcgagctgcagaaaagaaaggaggttgttcatacggtaagtctccatgagatagacgtgattaacagccgcacacagggattcttggccctgttttccggggacactggtgaaatcaaatctgaagtcagagagcaaatcaacgctaaggtggccgagtggcgggaggagggcaaggccgaaataattccaggggtgctgtttatcgatgaggtccatatgttggacatcgagagcttttccttcctcaatagggcactggaaagtgatatggctccagtgctcatcatggccactaaccggggaataactagaatccggggcacctcctatcaaagtcctcacggtataccaatcgatctcttggacaggctgctgatagtctcgacgacaccatacagcgagaaagacacaaaacagatcctcaggatccgctgtgaggaggaagatgttgagatgagcgaagacgcctatactgtgttgacaagaattgggctagaaacgtcgctgcggtatgccatacagttgatcacagcagcgtcactagtctgccggaagcgaaagggtacagaagtgcaggtcgatgatataaagcgcgtatacagcctgtttctggacgagagcagaagcacccagtatatgaaggagtaccaggatgctttcttgttcaatgaactcaagggcgagaccatggacaccagctag

SEQ ID NO: 204101 - DNA, 15102 bp, Artificial Sequence
  Description of Artificial Sequence: Synthetic coding sequence
atgggcgacgccgagggcgaggacgaggtgcagttcctgcggaccgacgatgaggtggtgctccaatgttccgctactgttttaaaagagcagctgaaactgtgtttggcagctgaaggcttcggtaatagactgtgtttcttggagcctacaagtaacgctcagaatgttcctcccgatttggcaatatgttgcttcgtgctggaacagtctctcagtgttagggcactacaggagatgctagctaacacggtggaggcaggcgtcgagagcagccagggtgggggacatcgtacgttactgtatggacacgctatcctgctgagacacgcccatagcagaatgtacttgagttgtctgacgacatcccgcagtatgactgataagctcgcttttgacgtgggtcttcaggaggacgctaccggtgaagcctgttggtggacaatgcaccctgccagtaagcagcgcagcgagggggagaaggtccgtgtgggcgatgacataatcctcgttagtgtgtcctcagagcggtacctgcatctcagtaccgcaagcggtgagttacaagtcgatgcaagctttatgcaaactctttggaacatgaatccaatttgttcacggtgtgaggagggtttcgtgactggggggcatgtgctgagactcttccatggacatatggatgaatgtctgactatctctccagcagattctgatgaccagcgacgcctggtttattacgagggaggcgccgtgtgtacccacgcccgaagcctgtggcggctggagcctctgcgcatctcttggtcaggaagtcatcttagatggggccagcctctcagggttcggcacgtgacaacgggccaatatcttgcacttacagaggatcagggtctggtggtggtcgacgcttctaaggctcataccaaagccacaagcttttgcttccggattagcaaggagaaactcgatgtggcccccaaaagagacgtcgagggaatgggacctcccgaaatcaagtacggagagtcactgtgtttcgtccaacacgtggcttctggtctctggctcacctatgctgcaccagaccccaaagccctgcgcctgggggtgcttaagaaaaaagcaatgctccaccaggagggccacatggacgacgctttatcattgacaaggtgccagcaggaggagagccaggccgctcggatgatccatagcaccaatgggctgtacaaccagtttattaaatccctggattctttttctggcaagcctcgaggcagcggcccaccagcaggcaccgccctgcccattgagggggttatactgtccctccaggacctgatcatttatttcgagcctccaagtgaggacctccagcacgaggagaaacaaagcaagctaagaagcctgaggaaccggcagtccctgtttcaggaagagggaatgctgagcatggtgctcaactgtatagacagactgaatgtgtacactaccgcagcccacttcgccgaattcgctggcgaggaggccgccgagagctggaaagagattgtgaacctgctttatgagctcttggctagcctaataagaggtaacagaagtaattgtgcgctgttctcgaccaacctcgactggctagtgtccaaactagatagactcgaagccagtagcgggattctcgaagtcctgtactgtgtgctcatagaatcgccagaagttctcaatatcattcaggaaaatcacataaagtctataatatcacttctggacaaacacgggcggaaccataaggtgctcgacgtcttatgcagtctgtgcgtttgtaacggcgttgccgtcagatcaaaccaagatcttatcaccgaaaatcttttgcccggtagggagctgctgcttcagacgaatctgatcaactatgtgaccagtatacgcccaaatatcttcgtcggtcgtgcagagggaactacccagtactctaagtggtactttgaggtgatggtggatgaggtgaccccgtttctcacggcccaggccacccatctcagggtcgggtgggctctgacggaaggttacacaccttacccgggagctggcgagggctggggaggcaacggcgttggcgacgatttatacagctacgggttcgatggcctccatctttggaccggtcacgtggcaaggcctgttacctcccccgggcagcatctgctggctccggaagatgtgatttcatgctgtcttgatctgtcagtcccctcaattagttttcgcattaatggctgcccagtccagggagtgttcgaatctttcaacctggatggcctttttttccccgttgtaagcttctccgccggggttaaggtgaggtttcttctgggaggccggcacggagagtttaagttccttcctccgcccggctacgcaccctgccacgaggcagtgctccctcgagagcgactgcatctggaacctatcaaggaataccggcgtgagggcccccgaggtcctcacctggtgggtccatcccgatgtttatcacacacagacttcgtgccatgtcccgtggacacggtgcagatagtcctgcctccacacctagagagaatacgggaaaaactcgcagagaatatccacgaactgtgggctctgaccagaatcgaacagggctggacctacggccccgtgagggacgataacaagcgtcttcacccatgcctggttgacttccattctttgcccgagccagagagaaactacaatctgcaaatgtcaggggagacgcttaaaactcttctcgcattaggctgccacgtagggatggccgatgagaaggccgaagacaatctcaaaaagactaagcttcccaagacatacatgatgtcaaatggttataagcccgctcccctggacctttcacacgtgcgtcttacccctgcgcagaccaccctggtggatcggctggctgaaaacgggcacaacgtttgggcacgagatagggtgggacaggggtggtcctatagtgccgtgcaggacatacctgcgaggcggaaccccagacttgtcccctatcgcctactcgacgaagcgacaaagcgaagcaaccgtgactcgctctgtcaggcggttcggacgctgctgggatatggttacaatatagagcctcctgatcaagagccctcacaagtggaaaaccagagtaggtgcgaccgtgtgcggatcttccgcgccgaaaaaagctatacagttcaaagcgggcgctggtacttcgagttcgaggcagtaacaactggagagatgcgggtggggtgggctcgtcctgagcttcgccctgacgtggagctgggcgccgacgaactggcttatgtgttcaacggacatcggggccagaggtggcacctgggtagtgagccattcggaagaccgtggcagccaggggacgtcgttgggtgcatgattgatctgacagagaataccatcatcttcaccctgaatggcgaagttctgatgtctgatagtggatctgaaactgcctttagggaaatagaaataggcgacggattcctgcccgtgtgttctctgggcccaggtcaggtcggtcacctgaacctggggcaagacgttagctctctgcgattcttcgctatctgtggactacaggaagggtttgagccttttgccattaatatgcagcgccccgtgactacttggttcagcaagggtttgccccagttcgaacccgtacccctcgagcatccccattatgaggtgtcgcgcgttgatggaactgttgacacacctccttgcttgagactcactcatcgaacttggggctcccagaacagccttgtcgagatgttgtttttaagacttagcctcccagtgcagttccatcaacacttccggtgcaccgccggggcaacgccattggcaccaccaggactgcagccccctgccgaagacgaagcgcgtgctgcagagcctgacccagactacgaaaatctgcggcgcagcgccggcgggtggtctgaggccgaaaatgggaaagagggcaccgctaaggagggtgcccccggcggaacaccccaggccgggggcgaggctcagccagcaagagctgagaatgagaaagacgccaccacggaaaaaaataaaaagcgaggtttcttatttaaggccaaaaaagtggcgatgatgacccaacctccagctacacccactctaccaaggctgccccacgatgttgtgcctgctgacaacagagacgaccccgaaatcatcctgaacaccactacatactattacagcgtgagggtgttcgccggacaggagccttcatgcgtctgggccggatgggtgacaccagactatcatcagcatgacatgagctttgacctgtctaaagttagagtggtgacagttactatgggggatgagcagggtaatgtacattcctctttgaaatgctctaactgctatatggtttggggtggcgattttgtctcgcctggccagcaggggagaatttcacatactgacctggtcatagggtgccttgtggacctggccactggcctcatgacgttcacagccaacggcaaggagtcaaacacattttttcaagtagagcctaatacaaaactttttccagctgtcttcgtgctccctacccatcagaacgttatacagtttgaacttggcaagcagaaaaacatcatgccactctctgcagccatgtttcagtctgaaaggaaaaatccggctccccagtgcccaccacggctggagatgcagatgctcatgcccgtttcttggtctcggatgcctaaccacttcctgcaagttgaaacacggagggcaggtgaacgtctgggctgggctgtgcagtgccaagagccactgacaatgatggctctgcacatcccagaggagaaccgctgcatggatatcctggagctctcagagcgtctggacctgcaacgctttcatagccacacactgcggttatatcgcgccgtgtgcgctctgggcaataatagggtagcccacgcgttatgctcgcacgttgatcaggcccaactgctccacgctcttgaggacgcgcaccttccaggtcctttaagggccggctattatgacctgctaatctccatccacctggagtccgcttgccgctcaaggcggtcgatgcttagtgagtacatcgtgccgttgactcccgaaactcgagcaattaccctgtttccccccggaaggtcaacagagaacggacacccgaggcacggtttgccgggagtgggcgtcacaactagcttacgtccgccacaccatttttctcctccctgcttcgtagctgctttgcctgctgcaggagcagctgaagccccagccagattgtcacctgcaataccccttgaagctctccgggacaaggcgctcagaatgctaggggaggccgttcgagatggaggtcagcacgccagggatccggtcggcggatcagttgagtttcagtttgtgccggtgctgaagctagtgtctacactcctggtgatgggcatcttcggtgatgaggacgtgaaacagatcctcaaaatgattgagcctgaggtgtttaccgaagaggaagaggaggaagacgaggaggaagaaggggaagaggaggacgaggaagagaaagaggaggatgaggaagaaacagcacaggagaaagaagatgaggaaaaggaggaggaagaagccgcagaaggagaaaaggaagaagggttggaagagggtctcctccagatgaagctgccagaatccgtgaagcttcagatgtgccacctgctagaatacttctgcgaccaggaactccaacacagggttgagtccctcgcagccttcgccgagagatacgtggataaacttcaggccaaccagcgctctaggtacggactgcttatcaaagcattttcaatgactgctgccgagaccgccaggcgcacacgcgagtttcgctcacccccgcaggaacaaataaacatgctcctgcaatttaaggatggtaccgatgaagaggactgccctctgcctgaggagatcaggcaggatctgttggatttccatcaggacctgctggcccactgcggcatccaactggacggtgaggaggaagaacccgaagaggaaacaacgctggggtcaaggcttatgagccttctggaaaaagttagattggtgaagaaaaaggaggagaaacctgaggaggagaggtctgcagaggagagtaagcccagatctctacaggagctcgtgagccatatggttgtcagatgggcccaagaggactttgttcagagtccagagctggtgcgggccatgttctctttgctgcatagacaatacgatggattgggggaacttctccgtgccctgcctcgagcctataccataagcccttcctcagtagaagacactatgagcctgctggagtgtcttggtcagatccgttctttattaatcgtccagatgggaccacaggaagagaacctgatgatacagtctatcggaaacattatgaataacaaggtgttttaccagcatcctaacctgatgcgtgcccttggaatgcatgagactgtgatggaggtgatggtcaacgttttgggtggtggggaatccaaagagatcagatttccaaaaatggttactagttgctgtcgctttctctgctacttttgcagaattagcaggcagaaccagcggagtatgttcgaccatctctcataccttctggagaattccgggatcggactcgggatgcaaggctccaccccactcgatgtagccgctgcatctgtaattgacaataacgaattagccctggctctgcaggagcaggacctggagaaggtggtctcatatctcgcaggctgtggactccaaagctgcccaatgctagtggccaagggttaccccgatatcgggtggaatccctgtggcggcgagagatacctcgatttcctgagattcgccgtgttcgtgaacggcgagtctgtcgaggaaaacgcaaacgtcgtggtgcgcctgcttatcaggaaacctgagtgtttcggtccagcactgcgtggagagggtgggtcaggcctgctggcagccatcgaagaagcgataaggattagtgaagatccagccagagacggcccgggaatccggagggataggagacgggagcactttggcgaagaacctccggaggaaaatcgggtgcatttgggccacgcgattatgtcgttttacgccgcactcattgaccttttgggcagatgtgcccctgagatgcatttgatccaagctgggaagggggaggcgctccgaatcagagcaatattacgatctctggtgcccttagaggacctggtgggtataatcagcttacccctgcagattcccacacttggaaaagacggcgcgttagtacagcctaagatgtcagcctcattcgtgcctgaccataaggcttcaatggtgctattcctagatagagtgtacggtattgagaaccaggattttctactgcacgtgctggacgtcgggttccttcccgatatgcgggccgctgcttctctggatacggccacattctctacgacagaaatggccttggcacttaaccgctacctctgtctcgcagtgctaccattgattaccaaatgtgccccgctgttcgctggaacggaacacagagccatcatggtcgactcgatgctgcacaccgtctataggctctctagggggagatcactaactaaggcccagcgtgatgtcatagaggactgtctgatgagtctgtgtcggtacatcaggccatccatgctgcagcatcttcttaggcggttggtttttgacgtgccaatccttaacgagttcgcgaaaatgccattaaaactgttgacaaatcactacgaaaggtgctggaaatactattgcttacctaccgggtgggccaattttggggttacctcagaagaagaacttcatcttacacgaaaactcttttggggtatatttgacagtctcgcgcacaaaaaatacgacccagagctttaccggatggccatgccttgcctatgtgcaatcgcaggagcccttcctcctgattacgttgatgctagctatagttccaaagccgaaaaaaaggcgactgtcgatgcagagggaaacttcgacccacgtccagttgagaccctgaatgtaattatccccgaaaagctcgatagcttcatcaacaagtttgccgaatacacacatgagaagtgggcatttgacaagatccagaacaattggtcatacggcgaaaatatagatgaggagctcaaaacgcacccgatgctgaggccctataagacattctccgaaaaggataaagaaatttataggtggccaattaaggagagcctaaaggcgatgatcgcttgggagtggaccatcgagaaggcccgggaaggagaggaagagaaaactgaaaagaagaagactcggaagatctcacagtctgcccagacatatgacccccgtgaaggatataaccctcagccaccggacctgtcagcagtgacactgtcaagagaactgcaggcaatggctgaacagctcgcagagaattaccataatacgtggggtagaaagaaaaagcaggaacttgaagctaaaggtggcggaacacatcccttacttgtaccctacgacactctgacagctaaagagaaagcccgcgatagagagaaggcacaggaacttttaaagttcttgcagatgaacgggtatgccgtgacccggggcctgaaagacatggagttagatagcagttcaatcgaaaagcgcttcgcgttcggcttcctgcagcagttactgcggtggatggatatcagtcaggaatttatcgcccacctggaggctgttgttagttccggccgggttgaaaaatccccgcacgagcaagagatcaagttctttgcaaaaattttactgcccctaataaatcagtacttcacaaaccactgcctgtacttcctgtccaccccagcaaaagtccttggatcggggggtcatgccagcaacaaagaaaaagaaatgatcacttcattattctgcaaattggctgccttggtgcggcaccgcgtctctctgttcgggactgatgctcctgcagtcgtgaactgcctgcacattttggccaggagcctggatgcacgcacggtgatgaaatctgggccagagatcgttaaggcagggctgcgatcgttttttgagagcgcgagcgaggatattgagaaaatggtggaaaacctcagactgggaaaagtatcacaggcacgaacccaggtgaagggagtgggacagaatctcacctacacaacagtggctctcctcccagtgttaaccactctcttccagcacattgcccagcatcagttcggggacgatgtaatcctggatgacgttcaagtgagctgctatagaactctgtgttcaatttattctctgggtactacaaagaacacatatgtggaaaagcttagaccggctctcggcgaatgtctggccaggctggccgcggctatgcctgtagcattcttggagccacaacttaatgagtacaatgcctgctcagtttacaccaccaagagcccccgtgaaagggcaatcctgggcctcccaaattcagtggaagagatgtgccctgatatccccgtgctcgaacggctcatggctgacatcggtgggctagccgagtcaggagctagatacaccgaaatgccacatgtgatagaaattacactgccgatgctttgctcctatctgcctcgttggtgggagaggggcccagaggcccctccatctgccctgccagccggtgcccccccaccttgcacagccgttacaagcgatcacctaaactctctgttggggaatattcttcgaatcatcgtgaataacttgggaatcgacgaagccagttggatgaaaaggctggcagtttttgcccaaccgattgtctctcgagcacgaccggagttgctgcagtctcacttcatcccgactatcggcaggcttaggaaaagggctggtaaggtggtctccgaagaagaacaactgaggctcgaagcaaaagcagaggcacaagagggtgagcttcttgtacgcgatgagttctcggtcctctgccgcgatctttacgccctgtatccactcctgattcggtatgtcgataacaaccgcgcacagtggctgacagagccaaacccaagtgccgaagagttgttccgcatggtaggcgagatttttatttactggtccaaatcccacaattttaaacgggaggaacaaaatttcgtggtgcaaaatgaaattaataatatgagctttctaactgcggataataagtctaaaatggccaagagcgggggttccgatcaagaacgcacaaagaaaaagcgccgcggtgatagatattccgtccaaaccagtctgattgttgctaccctcaagaagatgctgcctataggtctcaacatgtgcgcacccactgaccaggacctcatcactctggcgaaaacaagatacgcactcaaggacactgacgaagaggttagagaattccttcataataacttgcacctgcaggggaaagtagagggaagtcccagcctaagatggcaaatggccctctatcggggtgtgcccggcagagaagaggatgctgatgaccctgagaagattgtcaggagggtacaggaagtcagcgcagtcctgtactatttggaccagaccgaacatccctataagtctaaaaaggccgtctggcacaagcttcttagcaagcaaaggcgccgcgctgtcgtagcatgctttcgaatgacaccactatataatctccctacgcaccgggcctgcaacatgtttctggagagttacaaggcagcctggattcttacagaagaccattcatttgaagaccggatgatcgacgacctgtccaaggccggagaacaggaggaggaggaggaggaggtagaggagaagaaaccagaccctctccaccagctcgtgcttcattttagtcgtaccgctttgactgaaaagagcaaactagatgaagattacctctacatggcttatgctgacattatggcaaagtcctgccatctcgaggagggcggtgagaacggggaagctgaggaggaggtggaagtgagcttcgaggagaaacagatggagaagcagagactgctgtatcagcaagcccgcctgcacacaagaggagctgctgaaatggtcctgcaaatgatatcagcctgcaaaggagagacgggcgctatggtttctagcactctcaaactggggatcagtattctcaatggaggaaatgccgaggtccaacagaagatgctcgactaccttaaggataaaaaggaggtgggattttttcagtctatccaggccctgatgcagacttgtagcgtgcttgatttgaacgcatttgagaggcaaaataaagcagagggactgggaatggtgaatgaggacgggacagtgataaaccgccaaaacggagagaaagttatggccgacgacgaattcacccaagatctcttccgatttctacagctcctgtgtgagggccataataatgacttccagaattaccttcggactcagacaggcaacactactactataaatatcattatttgcactgtggattaccttctgagactgcaggaaagcatctcggacttttattggtactatagtggtaaagacgtgatcgaggagcagggaaagcgtaatttctccaaagctatgagcgtggccaaacaggtgttcaacagccttacagaatacattcagggaccttgcaccggcaaccagcagtccctggcacattcacgcctatgggacgccgttgtgggattcctccatgttttcgcccacatgatgatgaaactcgcccaggattcatcacagatagaactgcttaaggagctcctggaccttcagaaggacatggtagtgatgctacttagtttgctggaaggcaatgtagtgaacggaatgatcgcgcgccaaatggtggacatgttagttgaatcatcatctaacgtagagatgatcctgaaattcttcgatatgttcttaaaactgaaggacatagtgggtagcgaagcctttcaggattacgtaacagacccacgcggccttattagcaagaaagactttcagaaagcaatggactcccaaaagcagttcagtgggccagagatccaattcctgctgtcatgctctgaagcagatgaaaatgagatgatcaattgcgaagagttcgccaatcgtttccaggaacctgctcgtgatatcggtttcaacgtggccgtcctccttacaaacctatccgaacacgtgccgcatgacccacgcctgcataactttctcgagttagcagagagcatcctcgagtactttagaccatacctgggacggattgagattatgggggcatcccggcgtattgaacggatatattttgaaatttcagaaactaatcgggcccagtgggagatgccacaggtcaaagagagcaagcgccagtttatcttcgacgtagtgaatgaaggcggcgaggccgaaaaaatggaactttttgtgtccttctgtgaggacaccatattcgagatgcagattgccgcccagatctcagagcctgagggagagcccgagacagatgaggacgaaggtgccggcgcggccgaagcaggagctgagggtgctgaggaaggcgctgccggactggagggtaccgctgcaacagcagcagcaggcgcaacagccagggtcgtggcagccgcaggcagggctcttcggggcctatcataccggagcctccggcgccgtgtacgtcgcttacggcgcctcacagcaagggaggccgccacagcagtggcggccttgctctgggctgcagttaccagagccggcgccgcgggtgctggagcagcagctggcgcgctgggcctgttgtgggggagtctgttcggcgggggacttgtcgagggagctaagaaggtgaccgtcaccgagctgctggcaggcatgcccgatccaactagcgatgaggtgcacggggagcagcctgccgggcctgggggagatgccgacggtgaaggcgcatccgaaggggccggcgatgccgccgagggcgccggggatgaagaggaggccgtccacgaagccgggccaggaggggctgacggggctgtggctgtgactgatgggggacccttccgccctgaaggggccggcggcctcggagatatgggagatactacccccgccgaaccccccacccccgagggatcaccaatactaaaaaggaagctcggcgtggacggcgttgaggaggaattgcctcctgagcctgagcctgagcccgaacccgaactggagcctgagaaggccgacgcagaaaacggtgaaaaggaggaagtgcccgagcctacgcctgagccccccaagaagcaagcccccccatcaccaccccctaagaaggaggaagcaggtggagagttctggggagagcttgaggtacagcgggtgaagtttcttaactacctctccagaaatttttacaccctgaggttcctggcgctgttcctagctttcgccattaacttcattttattattctacaaggtgtccgactccccaccaggtgaggacgatatggaaggcagcgcagccggcgacgtgagcggcgcgggatccggcgggagtagtggctggggcttaggagcaggagaagaggcggagggggacgaggatgaaaatatggtatattactttctggaagagagcactggttacatggaaccagcattaaggtgtctgagtttgttgcacactctcgttgcgttcctctgcataatcggctacaactgtcttaaggtgcctctggtgatcttcaagcgcgaaaaagagctggcaagaaagcttgaattcgacggcctctatatcacggagcagcccgaggatgatgacgtcaagggccagtgggataggctggtgctgaataccccatcctttccaagcaattactgggacaaattcgttaagcggaaagtgctcgacaagcacggagatatttacggtcgggagcgcatcgctgagcttcttgggatggatcttgccacgttagagatcactgcccataacgaaaggaaaccaaaccctccacccggtttactcacctggttgatgagcatagatgtcaagtatcaaatttggaagtttggtgtcattttcacagataacagtttcctgtacctgggttggtacatggtcatgagcttactcggacactacaataatttttttttcgccgcgcacctgttggacattgcaatgggcgtgaagacattgagaactatcctttcgtctgtgacccacaatggtaaacagctggtgatgaccgttgggttactcgccgttgtcgtctacctttataccgtggtggcctttaacttcttccgtaaattttataataaatcggaagatgaagacgagccagatatgaagtgcgatgacatgatgacgtgttatcttttccatatgtatgtaggcgtgagagccggtgggggcattggggacgagatcgaggacccagcgggtgacgaatatgagttatatagggtcgtgtttgacattacttttttcttttttgtgatcgtgatcctgctggcaatcattcaaggactcattattgacgcgttcggagaacttcgcgatcagcaggaacaggtcaaggaggacatggaaactaagtgctttatctgtgggattgggtctgattacttcgacactacaccacatggcttcgagacacacacattggaagaacacaatcttgcaaactatatgtttttccttatgtatctcataaacaaggacgagactgagcataccggtcaagaaagctatgtgtggaagatgtatcaggagaggtgctgggattttttccctgccggtgactgctttcgcaagcagtacgaggaccagctgtcatag

SEQ ID NO: 204102 - DNA, 15117 bp, Artificial Sequence
  Description of Artificial Sequence: Synthetic coding sequence
atgggcgacgccgagggcgaggacgaggtgcagttcctgcggaccgacgatgaggtggtgctccagtgcagcgcaactgttctgaaggaacaactcaaactttgcctggccgccgagggctttggcaacagactttgctttctggagccgacctccaatgcccagaatgttccgcctgacctcgcaatatgctgctttgttctggaacaatctctctccgtgagagccctccaagagatgctggcaaatacagtggaggcgggcgtggagtccagtcaggggggtggtcatcgcacgcttctctacgggcacgctattcttctgaggcatgctcactcaaggatgtacctgtcttgcctgaccacaagcagaagcatgacagataaactcgccttcgatgtaggcctacaggaggatgccactggggaagcatgctggtggactatgcaccccgcaagcaagcagcgatccgagggagaaaaagttagagttggagatgacattatcctggtttctgtgtccagcgaacgctatctccatctgtctaccgcgagcggcgaactgcaagtggatgccagctttatgcagacactttggaacatgaatcccatctgtagcaggtgtgaagaaggctttgtcactggcgggcatgtactgcgcttgttccacggccatatggatgagtgtttgactatctccccagccgactctgacgatcagcgaaggcttgtttactacgaggggggagcggtctgtacacacgcccgatcactctggcgcttggagccactcagaattagctggagtgggtctcacctgaggtggggccagccactacgggtgagacacgtgacaactggtcagtaccttgcacttacagaagaccaagggctagtcgtggtggatgcgagtaaagctcatacaaaagcgactagtttctgtttccgaatatcaaaggagaaattggacgttgcaccaaaaagggatgtggaaggcatgggccccccagaaattaagtatggcgagagcttatgcttcgttcaacacgtggcatccggactctggctgacttatgccgctcccgatcctaaagcactccgcttgggagtgctgaagaaaaaagctatgctacatcaggaagggcatatggatgatgctctgtctctaacccgatgtcagcaggaagagagtcaggccgcgcgcatgattcattctaccaacggactgtacaaccaattcattaaatccctggactccttttccggtaagcctagaggcagcgggccccctgctggcacagccttgcctatcgagggtgtaattttatctctccaagacctgatcatctattttgagccaccatcagaggacctgcagcatgaggagaagcaatcaaagctgcggtctctcaggaatagacagagtttattccaggaagaagggatgttgtccatggtgcttaactgtattgataggttaaacgtgtacacaaccgctgcccattttgcggaatttgccggagaagaggcagccgagagctggaaagagattgtgaatctattatatgaactcctagcatcactcatccgtggcaaccggtctaattgtgcgttattcagtacaaacctggactggttggtgtccaagcttgacaggcttgaggcctcttccggcatccttgaagtcctgtactgcgtgctgatcgaatctcccgaagtgctgaatatcatccaggaaaatcacatcaaatcaatcatttcgctgctggacaaacacggtcggaatcataaggtactagacgtcctgtgttcattgtgcgtctgtaatggtgttgcggtgcgaagcaaccaagatctgatcacagaaaatttgctgcctggacgcgaactgctgcttcagaccaacctgataaactatgttacatccatcaggccaaatatatttgttgggagggcagaggggacaacccaatactctaagtggtatttcgaagtgatggtggatgaggtgacacctttcctgacagcccaggccacacacctccgagtcggctgggccctaacggagggatacacgccctaccccggcgccggggaggggtggggcgggaacggcgtgggggacgacctctattcttatggattcgatgggctccacctttggactggccacgttgcaaggccagtcacaagccccgggcagcacttgttggcacccgaagatgtgattagctgctgccttgacctgagcgtgccatccattagcttcagaattaacggttgccctgtgcaaggagtgtttgagtcattcaatttggacgggcttttcttccctgttgtgtctttctccgccggcgtgaaggtcagattcttgctcggcgggcgccacggggaatttaagtttctgcccccaccaggatacgccccttgtcatgaagcagtgctaccaagggagcgcctacatctcgagccaatcaaggagtacagacgggagggacctcgaggccctcacttggtcggccctagtcgttgtctgtcacacacagatttcgtgccatgtcccgtcgacaccgtgcagatcgttcttccaccacacctcgagcgcatccgagagaagttagccgagaatatccacgagctgtgggcactgaccaggatcgaacagggctggacctatgggcccgtcagagacgataacaagcgcctccatccctgcctggtggactttcactcgttacccgagcccgagagaaactataacctccagatgtctggtgaaacactgaaaacgcttctcgcactgggctgccacgtcggcatggccgatgagaaagccgaagacaacttgaagaagactaagctcccaaaaacctacatgatgagtaacgggtataaaccggctccactggatttgagccacgtgcggctcacacccgcccagaccaccctggtggacagactggccgagaacggacacaatgtgtgggcacgggaccgcgtcggtcaagggtggagttatagcgctgtgcaggatatccccgcacgaaggaatccacgcctggtgccttatcgactgctggacgaagctaccaagagatctaacagggactcgctctgccaagcagtgagaactctgttaggctatggttataacatcgagcccccggaccaagaaccctcccaggtcgagaaccaatctcggtgtgatcgtgtaaggatctttcgcgccgagaaatcctacactgtgcagtctggacgctggtacttcgagttcgaagcggttacgacaggagaaatgcgggtgggttgggcaaggcctgagctgcgacccgacgtggagctgggagcagatgagttagcatatgtattcaatgggcacagaggccagaggtggcacttgggctctgagccttttgggaggccgtggcagcctggagatgtagttggatgtatgattgacctgactgaaaacaccattattttcaccctgaacggagaagtgctaatgtctgacagcggatcagagacagcattccgcgagatcgagattggcgatggtttcctgcccgtttgtagcttggggcccggccaggtgggccaccttaatctgggacaggatgtgagctctcttaggttttttgcgatctgcggcctacaagaaggcttcgaaccgttcgcaatcaatatgcagcgcccagttacaacgtggttctctaagggtctgcctcaatttgaaccggtgcctctcgaacatccacattacgaggtttctcgcgttgacggcacggttgacacacccccctgcctacggctgacccatagaacctggggatctcaaaacagtttggtagaaatgctgttcttaagactaagcttgcctgtgcagttccatcagcatttccggtgcaccgctggggctacccctctggcacccccaggcctgcagccccccgcagaagacgaggcgcgggccgccgagccagaccctgattatgagaacctcaggcgatcagccgggggatggtctgaggcggagaatggtaaggagggaactgcgaaggaaggggccccggggggaacacctcaggctgggggtgaagcccagcccgctcgcgctgagaatgagaaggatgctaccactgagaaaaataagaaacggggctttctcttcaaggccaaaaaggtcgccatgatgacacagccgccggcaacaccgacactgccacggctgcctcacgatgttgtgcccgccgataatcgtgacgatcccgaaatcatcctcaacaccacgacctattattactccgtgagagttttcgccggacaggagccaagttgtgtgtgggcaggctgggtaacacctgactaccaccagcacgacatgagctttgatctgagcaaggttcgggtcgtaaccgtgacgatgggagatgaacagggaaacgttcattcctcactgaagtgctcgaattgttacatggtttggggcggcgatttcgtgtcccccggacagcagggacggatcagtcacacagatctggtgattggctgcctggtagacctggccactggtctaatgacattcacagccaatggaaaggaaagcaatactttctttcaggtagaacccaatacaaagctgttccccgctgtcttcgtgttgccaacccaccagaacgtcatccagttcgagctgggtaaacaaaagaatatcatgcccctgagcgctgcaatgttccagagtgagagaaagaacccagctccccagtgtccccctaggctcgaaatgcagatgctgatgcctgtcagctggtctagaatgcctaatcatttcctgcaggtggaaacgaggcgggcaggagagaggctggggtgggccgttcagtgtcaggagcctctgactatgatggcccttcacattccagaagagaatagatgcatggatatcctggaactaagcgagcgcttggacctgcagcgatttcattcgcacaccttaaggttgtaccgggcggtatgcgccttaggaaacaatcgtgtggcccacgccctgtgcagtcatgttgaccaagctcagcttctgcacgcgctcgaggacgctcatttaccaggcccactgagggccggttactatgacctcctaatatctattcatctcgaatcagcctgcaggtccagacggtccatgctgtctgaatatatcgtgcctctgacaccggaaacgcgggccatcaccctttttcctccaggcagaagtactgaaaacggccacccacgccacggcctccccggcgtgggggtaacaacttctctgcgccccccacaccacttttcacccccttgtttcgtcgcagccttacctgccgctggagccgctgaagcaccagcacgactgagtccggccattccccttgaagctctccgcgacaaagccctgcgcatgctgggcgaagccgtcagagacggggggcagcatgcccgagatcccgttggcggatccgtggaatttcagttcgtgccggtgttgaagcttgtctctacgctgttagtcatgggcattttcggtgacgaagatgtgaaacaaattctcaagatgatagagcccgaggtcttcaccgaagaagaggaggaggaagacgaggaggaggaaggtgaagaggaagacgaggaggaaaaggaggaggatgaagaggagacagcccaggaaaaagaagacgaggaaaaggaggaagaagaggctgcggaaggcgagaaagaagaaggactggaggagggtttgttacaaatgaaactgccagagtccgtgaaacttcagatgtgccacctgttggaatatttctgcgaccaggaacttcagcacagggtggagagcctggccgccttcgcagaaagatacgtagacaagcttcaagccaaccagcgttccagatatggcttgctcataaaggctttctctatgaccgcagccgagactgctcggcgcacccgagagtttcgttcacctccacaggagcagataaatatgctgctccagttcaaggacggcacagacgaggaggactgtccattgcccgaggagatccgccaagacctactagactttcatcaagacctgcttgcacactgtggcatccagttagacggcgaggaggaggaacctgaagaagagacaacactgggctcgcgccttatgtccctcctggagaaggtgcgactggtaaagaaaaaagaagagaagcccgaagaagaaaggtctgccgaagagagcaagccccgctcacttcaggaacttgttagccacatggttgttcgctgggcacaggaagatttcgtccagagcccagagctagtgcgcgcgatgtttagcctgctccataggcagtatgatggtctcggcgaactgctgcgcgcgctacccagagcctatacgatcagcccctcttcagtggaggatacgatgagtctgctggaatgcctcggccagatccggtctctgcttatcgtccagatgggcccccaggaagagaacctgatgatacagagcatcggtaatataatgaacaacaaggtgttttaccagcaccctaatctgatgcgagccctgggtatgcacgagacagtcatggaagttatggttaacgtgctcgggggcggagaatccaaggagattagatttcctaagatggtcacctcttgctgtagattcttgtgctacttttgtagaatttcccggcagaaccagcgatccatgttcgaccaccttagctatctcttggaaaattccggcatcggcctgggaatgcagggtagtacacctttggatgtggcagccgcatccgttattgataacaacgaattagccctcgccctgcaggaacaggatctcgagaaggtggtcagctatcttgctggttgtggtctgcagagttgtccaatgctggtcgcaaaaggataccccgatattggctggaacccttgcggcggggagcgttatctcgacttcctccggttcgcggtatttgtgaatggggagagtgtcgaggagaacgccaatgtggtggttagattgcttatcagaaaacctgaatgtttcgggccggctcttagaggtgaaggcggtagcggcctacttgcagccatagaggaagcaattcgcatctccgaggaccccgcccgggatggcccgggaatccgaagagaccgccgccgggaacacttcggcgaggagcctccagaggagaatagagttcacttgggacacgcaatcatgtctttttatgccgctcttatagatttgttaggacgctgcgctcccgaaatgcatttaatacaagcagggaaaggcgaggctctacgcataagagctattctgagaagtctcgtgcccctcgaagacttggttggtattatctccttgcccttacaaatacctactctagggaaagacggcgcactggttcagccgaagatgtccgcctccttcgtgcctgatcacaaggctagcatggtgctgttcctggaccgcgtatatgggattgagaatcaggactttctgcttcatgttctggatgttggtttcctccccgatatgagggcagcggcctcgctcgataccgccacctttagtacaactgagatggccctggccttaaaccgatacctgtgcctagcagtcctgcccttgatcacgaagtgcgcaccgttgttcgctggtaccgagcatcgcgcaattatggtggacagtatgctgcacacagtatatcgcctgtcccgaggcagatctctcacaaaggcccagagggacgtgattgaagattgtctgatgagcctctgcagatacattcgaccttcaatgctgcagcatctactgcggaggctggtgttcgatgtgccaatcttgaacgagttcgctaaaatgcctttgaaattgctgaccaaccattatgaaagatgttggaagtactactgccttccaaccggatgggccaactttggagtgactagcgaggaggaactgcatttaacaagaaagctcttttgggggattttcgattcactggctcacaagaaatacgaccccgagctctatcggatggctatgccttgcttatgtgctattgctggggccctgcctcccgattacgtggacgccagctattcttccaaggcagaaaaaaaggctaccgtagatgccgaaggcaacttcgatccccgccccgtggaaaccctgaatgttataattccagaaaaactcgactcctttattaacaagtttgcggaatacactcacgagaagtgggcatttgataaaattcaaaacaattggagttacggggaaaatatcgatgaagagctcaagacccaccccatgctgagaccatacaaaacctttagtgaaaaagacaaagagatttatcgatggccaattaaggaaagcctgaaagcaatgatcgcctgggaatggaccatcgaaaaggcacgggagggggaggaagaaaagactgagaaaaagaaaacacgcaaaatctcgcagtccgcccaaacatacgaccccagagaggggtacaaccctcaaccccctgatcttagtgcagttacattgtctagagagctgcaagcaatggcggagcagctggctgaaaattaccacaacacgtggggacgcaagaagaaacaagagctggaggcaaaggggggaggtacccaccctctattggttccatacgatacacttaccgcaaaggagaaggccagggatagggagaaggcacaggaacttctgaagtttttacagatgaacggctatgctgttacacgaggcctgaaggacatggaactcgactcctcttccattgaaaagaggtttgcctttggtttcctgcagcagctgctgaggtggatggatatctcccaagaattcattgcacacttagaggctgtggtctccagcggtcgtgtggaaaaatcgccccatgaacaagaaatcaagttcttcgcgaaaattcttctgcctctgatcaaccagtatttcacaaaccactgtctgtatttcctctcaactcccgcgaaagtcctcgggagcggcggccatgccagtaataaagaaaaagagatgatcacctctctgttctgcaaactggccgcccttgtaagacatagagtgtcattgtttgggactgacgcacctgccgtggtgaactgtctgcacatcttggcccgaagcctcgacgctagaacggtcatgaagtccggcccggaaatcgtcaaggctggcctgcgaagctttttcgaatcagcctccgaggacattgagaagatggttgagaatctgaggctcggaaaagtcagtcaggcgagaacccaggtgaaaggagtgggccagaatctgacatacacaaccgtcgccctcttgccagtcctgaccaccttgtttcaacacatcgctcagcatcagttcggggacgacgtgatcttggacgacgtgcaggtgtcgtgctatcggacactgtgcagcatctattcattgggaaccaccaagaacacttatgtcgaaaaactgcgccccgcactaggggagtgcctggctcgcctcgctgctgcgatgccagtagccttcctggagccccagctgaatgagtacaacgcctgctccgtgtacactactaagagtcccagagagcgcgcaattcttgggctcccaaattccgtggaagagatgtgtccagatattcccgtgctcgagcgcctcatggcagacatagggggcctggccgagtccggggcccgctatacagaaatgccacatgtgatcgagatcacactgcccatgttgtgctcatatctgccccgttggtgggaacggggaccagaggcgccaccgagtgcgcttcccgcgggcgcccctcccccctgcactgccgttacatcagatcatctgaatagtctcttgggaaatatcctgcggatcatcgtaaacaacctgggcatcgatgaagcctcctggatgaagagattggctgtgtttgctcagcccattgtcagccgagcccgacctgaactgctgcaatcccattttataccaacaataggtaggctgcgtaagcgtgcaggcaaagtggtgtctgaagaagaacagttgaggttggaggcgaaggccgaagcacaagagggggaactccttgtaagagacgagttttccgtgctttgtcgtgatctgtacgctctctatccgctgttgattcgctacgttgacaataaccgcgcccaatggttgacagaacccaatccctctgctgaagaattgtttcgcatggtgggcgagatctttatctactggtctaagtcccacaacttcaagcgggaggaacagaactttgtggttcagaacgaaattaataatatgagtttcctgacggctgacaacaagtcaaagatggcaaaggccggggacatccaatccggaggtagcgaccaggaacggaccaaaaaaaaacgacggggcgatcgctactctgtgcagacctccctaatcgtagctaccctgaagaagatgctcccaatcgggttaaatatgtgcgcaccgacagaccaggacctgattactctggccaagactaggtacgcccttaaggacaccgacgaggaagtgcgagaattcctgcacaataatctccatctgcagggcaaggttgaggggtcaccgtccctgaggtggcaaatggccttataccgtggggtgcctgggcgagaggaggacgcggacgacccagaaaaaatcgttagacgcgttcaggaggtcagcgccgtactgtattacctcgatcaaactgaacacccatataaatccaaaaaagctgtgtggcataagctcctgtcaaaacagaggaggagagccgtcgtggcatgcttccgcatgacccccctgtataacctgcctacacaccgggcctgcaacatgtttctggagtcgtataaagctgcatggattcttactgaagatcactcgtttgaggatagaatgattgatgacctatcgaaagccggcgagcaggaagaagaggaggaggaagtagaggagaagaagcccgaccccctgcaccagctggtgctacacttttcacgaactgcgcttacggaaaagagcaagctggatgaggactatttgtacatggcgtacgctgacattatggccaagtcctgtcaccttgaggaggggggcgaaaacggggaggccgaagaggaagttgaagtctcatttgaagagaagcagatggaaaagcagcgcttgttgtaccagcaagctcggcttcacactagaggggccgccgaaatggtgttacagatgatttccgcctgtaagggagaaaccggcgccatggtgtctagtactctcaaactgggaatctcaattcttaatggcggcaacgctgaggtgcaacaaaagatgcttgattatttaaaagacaagaaagaggtcgggttctttcagagcattcaagcactgatgcaaacttgcagtgtgttagacctgaacgcctttgaacggcagaacaaggctgaaggcttaggtatggttaacgaagacggcactgtaattaaccgtcaaaacggggagaaagtgatggccgacgatgagttcactcaggatctgttccggtttcttcagttgctttgcgagggacataataacgatttccagaactacttgcgaacgcagactggcaatacaacaaccatcaatattataatctgcaccgtggattacctcctgcgcctacaggaaagcattagcgacttttattggtattatagcggcaaagacgttatagaagagcagggaaagaggaatttctccaaagctatgagtgttgctaaacaggtctttaacagtctcacggagtatatccaagggccctgcactggcaaccagcagtctctggcacatagccggctctgggacgctgtagtcggatttctgcatgttttcgctcacatgatgatgaaactggctcaagattcgtctcagatcgaactgctcaaagagctgctggacttgcaaaaggatatggtggtgatgctgctgagtctactggagggcaacgtggtgaacgggatgattgctcggcagatggtcgatatgcttgtcgagtcttccagcaacgttgaaatgatactgaagtttttcgatatgttcctgaaacttaaagacatcgtcggcagtgaggcgttccaggactatgtgaccgatcctcgggggctcatcagtaagaaggatttccagaaagctatggatagccagaagcagttcagcggacctgagatccagttcctgctgagttgttccgaggccgacgaaaatgaaatgatcaattgcgaagagtttgccaaccgttttcaagagccggcacgggacattgggttcaatgtggccgttctcttgaccaatctttcagagcatgtgccgcatgatccgcgtctgcataatttcctggagctggcagagagtattctggagtactttcgcccttatctgggtagaatcgagataatgggagcatcaaggcgcatagagagaatctatttcgagatttcagagaccaatagagctcaatgggaaatgccgcaagtaaaagaatccaagcgacagttcatttttgacgtcgtgaacgaaggcggggaagctgagaaaatggagttgttcgtgagtttttgtgaggacaccattttcgaaatgcaaatcgcggcccagatctctgaaccagaaggagagccagagacggacgaggatgagggcgcgggcgccgctgaagccggtgctgagggcgcagaggagggagctgcaggcctcgaggggacagccgccacagccgccgcaggtgcgaccgcccgagtcgttgcagcagcaggtcgggctttaagaggactcagctacagaagtctgaggcgacgcgttcgccggttaagacgcttgaccgctcgggaagccgccaccgccgtagccgctctgttatgggccgcggttaccagggccggggccgctggtgccggtgcagccgcaggtgcccttggtctgttatggggatcattgtttgggggggggcttgtggaaggcgccaaaaaggtgaccgtgacagagctgttggccgggatgcccgatccaacaagcgacgaagtacacggcgagcagcctgccggcccaggcggtgatgcagatggagagggcgctagtgagggggccggcgacgccgccgaaggagcaggagatgaggaggaggccgttcacgaggccggccctggaggtgctgatggcgccgtggccgtcacggatgggggaccttttcggccagagggagccggcggactgggcgacatgggggacactacaccggccgagccccctaccccagagggctccccgattttaaaacgaaaactgggggttgatggtgtcgaggaggagctcccacccgaacctgaaccagagcccgagccagagctggagcccgagaaggccgatgctgagaatggggaaaaggaggaagtgccagagcctacacccgagccgccgaagaagcaagcccctccaagccccccccccaaaaaggaggaagcaggcggcgagttttggggagaactggaggtgcagcgtgtgaagttcctgaactacctttccagaaatttctatacactgaggtttctcgctctgttcctggcctttgccatcaatttcattctgcttttctacaaagtaagtgattccccaccaggcgaggatgatatggagggatccgctgccggcgatgtttccggtgcaggatctggtggtagttcagggtggggtctgggcgccggcgaggaggccgagggcgacgaggacgagaacatggtttactactttctggaagaatccaccggctacatggagcccgctcttaggtgcttgagtctgctccataccctcgtcgcatttttatgtatcataggatacaattgcctgaaggtccccctcgtgatcttcaaacgggaaaaagagttggctagaaaactcgagttcgacggactttacatcacggaacagcccgaagatgatgatgtcaaaggacagtgggatagactggtgcttaacacgcctagcttcccctccaactattgggacaaattcgtgaagcggaaggtgctcgataagcacggtgatatttacggccgtgaaaggattgccgagctcctcggtatggacctggctactttagagatcaccgcccataatgagagaaagccaaacccgcctccaggcctgctgacgtggctgatgagcatagacgtgaaataccagatatggaagttcggtgtgatatttacggacaactcatttttatacctggggtggtacatggtcatgagccttctgggacactacaataacttcttttttgccgcccatctgctagacatcgccatgggcgtcaagactctccgtacaatcctgtccagcgtgacccataatggtaaacagctggttatgaccgtgggattactagctgtcgtggtttacttgtatactgtggtagcgttcaattttttcaggaaattttataacaagagcgaggatgaagatgagcctgacatgaaatgcgacgacatgatgacatgttacttgttccatatgtacgtaggcgtccgtgcagggggaggcataggcgacgagattgaggatcccgccggcgacgagtatgagttataccgcgtcgtgtttgacattaccttcttcttttttgtaattgtgatcctccttgcgatcatccagggacttatcattgatgctttcggcgagctacgtgaccagcaagaacaggtgaaagaggacatggagaccaagtgtttcatctgcggaatcggttctgactatttcgacacaactcctcatgggtttgagacccacaccctggaagagcacaacctggcaaactatatgttttttctaatgtacttaatcaataaagacgaaaccgaacacacgggccaggagagctatgtgtggaaaatgtatcaggaacgctgttgggattttttccccgccggcgactgcttcaggaagcaatacgaggatcagctcagttag

SEQ ID NO: 204103 - DNA, 15102 bp, Artificial Sequence
  Description of Artificial Sequence: Synthetic coding sequence
atgggcgacgccgagggcgaggacgaggtgcagttcctgcggaccgatgatgaggttgtgcttcagtgctctgccaccgtgctcaaggagcagcttaagctctgcttagctgccgaaggatttgggaatcgactgtgtttccttgagcccactagcaacgcccagaacgtgccacccgacctggccatttgctgcttcgtgctagagcaaagcttatccgtcagagcactacaagaaatgctcgcaaatacagtcgaagccggcgtggaatcctctcaaggtggtggtcaccgtacactcctgtacggccatgcaattttacttcggcacgcccatagccggatgtatctgtcttgcctgacgacatcacgcagtatgaccgataaactggctttcgacgtggggctgcaggaagatgcaactggtgaagcctgctggtggactatgcaccccgcatctaaacagaggtcagagggcgagaaagtgcgggtgggggatgatatcatattagtctcagtgtctagcgagcggtacctccacttgagcaccgcaagtggagagttgcaggtagacgccagttttatgcagacattgtggaacatgaatccaatctgtagccgatgtgaggagggatttgtgaccgggggtcacgtactgcgcctttttcatggccacatggatgagtgcctcactatctctcccgcggacagcgacgaccagagaagactggtgtattatgagggcggcgcagtatgcactcacgcgagaagcctgtggcgccttgagccattgcgcatctcctggtctggatcccacttgcggtggggtcagcctctgagggtgcgccacgtcacaaccggtcagtatctagcactgaccgaggaccaaggactggtggtcgtagatgcctccaaggcgcacactaaggcaacgagcttttgttttcgtatctcaaaggagaaactggatgtcgctcccaagcgagatgtcgagggcatgggtccccccgagattaagtacggggagagcttgtgctttgttcagcacgtagcttccgggctatggctgacttacgccgcccccgacccgaaggccctgaggctcggcgtgcttaagaaaaaggcaatgctgcaccaggagggccatatggacgatgccctgagcctgactcggtgtcagcaggaagaatctcaggccgcgagaatgattcactctactaatggattgtataatcaattcatcaagtctctcgacagcttcagtggaaagccgcgcggaagcggcccaccagctggaaccgctctaccgattgagggcgtgattctgagcctccaagatttgatcatatacttcgaacctccttcagaagatttgcagcacgaagagaagcagtcaaagctgcgatcgcttaggaacaggcagagcttgttccaggaagaagggatgttgtctatggttctcaattgtatcgataggctcaatgtgtatacaaccgctgctcacttcgcggagttcgccggcgaggaagcagccgaaagctggaaggagatagtcaatctgctgtatgagctcctggcctctctcattagaggcaaccgctcaaactgcgccctcttctctacaaacctggactggctggtgagcaaactggaccggctagaggcatcctcggggatccttgaggtgctgtattgcgtcttaatagagtccccggaagtgcttaacattattcaggagaaccacatcaagagcataatttccttacttgataaacatggacgtaatcataaagtgttggacgtcctttgctccctgtgtgtatgtaacggcgtggccgtccggtccaaccaggacttgattacagaaaacttgctgcccggacgggaactgctgctccagacaaacctcataaactacgtgacttccatccgcccgaatatctttgtcggtcgcgctgaagggacaacacagtactctaagtggtattttgaagtcatggtagacgaagtcacacccttcctgactgctcaggcaacacatcttcgtgtaggatgggccctgaccgaaggctacaccccataccccggcgcgggggagggatgggggggaaatggggttggcgatgacctgtattcttacggtttcgacggcctacatctgtggacaggccatgtggcgagacctgttaccagcccaggccagcacctcttggctcctgaagatgtcataagctgttgtctggacctgtcggtcccttctatctccttcagaatcaacggttgccctgtgcaaggtgttttcgaatctttcaacctagatggcctgttctttccagttgtcagcttctccgcaggggtgaaggtccgcttcctcctgggcggacgtcacggcgagtttaaatttcttcctccgcccggctacgcaccatgtcatgaagccgtcctccccagggagaggcttcacttagaacccattaaggaatacagaagggagggcccacgagggccccacctggtcggccctagccgatgtttgtcacacacggacttcgtgccatgccctgtggatactgtgcagattgtgctgcccccgcatctcgagcgcatcagggagaagctggccgagaacattcacgaactctgggccttgaccagaatagagcaaggctggacctacggtcccgttagggacgataataagagactccacccctgcctagtggattttcacagcttgcctgagccagaaaggaattacaacctccaaatgagtggagagaccctcaaaactctgcttgcactcggctgccatgtcggaatggcggatgagaaggccgaagataacttaaagaagacgaagttacctaaaacgtatatgatgagtaacgggtataagcctgcccctctggacctgagccatgtgagactgactcccgcccagacaaccttggtggatcggttggccgagaacggtcacaacgtatgggccagggaccgggtcggccagggctggagctattccgccgtgcaggacatcccggccaggcgtaatccccgccttgtcccataccgtttactggacgaagccaccaaacgttctaatagagactccctctgccaggccgttcgaacgctgttgggctacggttacaatatcgaaccccccgatcaggagccctctcaggtcgagaatcaatctcggtgtgacagagttcgaatttttcgggctgaaaagtcctataccgtgcaatcaggcagatggtattttgaatttgaggctgtgaccacaggggaaatgagagtcggttgggctaggccggaattacgaccggacgtggagctcggggctgatgaattggcttacgtgttcaacggtcaccgtgggcagcgatggcatcttgggtccgaaccattcggaaggccatggcagccaggagatgttgtgggatgcatgattgatttgacagagaatacgatcattttcactttgaacggtgaagtgctcatgagcgattccggtagcgaaactgccttccgcgagatcgaaattggtgacggtttcctgccagtttgttccctgggcccaggacaagtagggcacctgaacctcgggcaagatgtgtcatcactgaggttttttgctatctgcggactgcaggagggctttgaaccattcgccataaatatgcagaggccagtgaccacctggtttagcaaaggactgcctcagttcgaaccagtgccactggagcatccgcattatgaggtatcacgggtggacggaaccgtagacactccgccgtgccttcgcctcacgcaccgcacgtgggggagtcagaacagtctggtggagatgctgtttctcagattgagtttacctgttcaattccaccaacatttccgatgcaccgccggcgccacccctcttgctcctcctggccttcagcctcctgctgaggacgaagcaagagccgcagagcctgacccagattatgagaacctgagaaggagcgccggcggatggagcgaagcagaaaatggcaaagagggcacggctaaagaaggggcccctggcggtactccccaggccggcggggaagcacagccagccagagctgagaacgaaaaggatgccactacagagaagaataagaaacgcggatttctgtttaaggctaaaaaggtcgctatgatgactcaaccacctgccactcctaccctgccacggctgccccacgatgtggtgcccgccgacaaccgcgatgacccagaaataattcttaacactaccacttattactactccgtccgggtcttcgcagggcaggagccgtcctgcgtctgggctggctgggtaacccccgattaccaccagcatgatatgtcatttgacctgagcaaggttcgggtcgtgaccgtaaccatgggggacgagcagggcaatgtgcacagtagcctaaagtgtagcaattgctatatggtgtggggcggggactttgtgtctcccggtcagcaaggccggatttctcacacagatctggtgatcggctgtcttgtcgacctcgccacaggactaatgacttttaccgccaacggtaaggaatccaatacgttcttccaggtcgaaccaaacacaaaactgttcccagccgtgtttgtccttccaacccaccagaacgttattcagttcgaactcggtaaacagaagaatatcatgcccctaagtgcagccatgttccaatcggagcggaagaacccagccccccaatgccccccaaggctggagatgcagatgctgatgcctgtgagctggagccggatgcccaatcacttcctccaagttgaaacacgtagggctggggagaggttgggctgggccgtgcaatgtcaggagcccctcactatgatggccctgcatattcctgaggagaaccgatgcatggacatcctggagctgtcagaacggcttgatcttcagagatttcattctcacactctgcggctgtatcgtgcagtctgcgcactgggcaataatcgcgtcgctcacgcgctgtgttctcacgtggaccaagcccagcttctacatgccctggaggatgcccatctacccggccctctgagagcgggctactacgatctactgatctccatacacctggagtccgcttgtcgctcgcgcaggagcatgctgagtgagtacatagtcccccttactcctgagacacgggctatcacactgtttcctcctggacggtccactgagaacggccacccacgccatgggctgcccggggtgggcgtaaccactagcctccgccctccacatcatttttcacctccctgttttgtagcagcacttcccgccgcgggcgctgccgaggcgcccgccaggctgagccctgcgatacctctcgaggcactgcgggacaaagctctgcgcatgctgggggaggcagtgagggacggggggcagcatgcaagagacccggtggggggctccgtggagttccagtttgtacccgtgttgaaactggtctccacgttgctggtcatgggtattttcggcgacgaggacgtcaagcagatccttaagatgatcgagccagaggtcttcactgaagaggaggaggaggaagatgaagaagaagagggggaagaggaggacgaagaagagaaagaagaagatgaggaggaaaccgcccaggaaaaggaggacgaagaaaaagaagaagaagaagctgctgaaggagagaaggaagaaggcttggaggagggtctgctccaaatgaagctgccagagagcgtgaagctgcagatgtgtcacctgctggagtacttctgtgaccaggagctgcagcacagagtcgagagtctagccgcttttgctgaacgatacgtggacaaactccaggccaaccagcgcagcaggtacggactattgatcaaggctttttccatgaccgccgcggagactgctcgcaggactagagaatttagatcaccacctcaagaacaaatcaatatgctgttgcagttcaaggacggcaccgatgaagaggactgtccactcccagaggagatacggcaggatctgctcgattttcatcaggatctactagctcattgtggcatccaactcgatggggaagaagaagaaccagaagaggaaactacactgggcagccggttgatgtcactgctcgaaaaagtgcgactcgtgaagaagaaagaagaaaagccagaagaagagcgctcagctgaagagtccaagccccgcagcctgcaggaattagtctcccacatggtagttcgttgggcccaggaggactttgtccagtctccggagttggtgcgtgctatgttcagcctgctgcaccgccagtatgatggactcggcgaactactccgagcactgccccgcgcttacaccatttccccatccagcgtggaagacactatgtccctgctggaatgcctgggccaaatcaggtcacttctgattgtacagatgggccctcaggaggaaaatcttatgatccagagtattgggaacatcatgaataataaggtattctatcagcatccgaacctgatgcgtgctctggggatgcatgaaaccgtcatggaggttatggtcaatgtgctggggggcggagagtccaaagagatcagatttccaaaaatggttactagttgttgcagattcctgtgttacttttgcagaatatcaagacagaatcagaggtcgatgttcgaccatctcagttaccttctggagaactcaggaatcggtctcggtatgcaaggctcaaccccacttgacgtggctgcggctagtgtgatcgataacaatgaacttgcactagctctccaggagcaagacctggagaaggttgtgtcatacttggccggatgcggcctgcagtcctgcccaatgctcgtcgctaagggttacccggatatcggctggaacccttgcggaggggagagatacttagatttcttacgtttcgcggttttcgtgaatggcgagtcggtcgaagagaacgcaaacgtagtagtgaggctccttatcaggaagcccgaatgcttcggtcctgccctcaggggagagggaggctctgggcttcttgccgccattgaggaagcaattcgaatttccgaggatcctgctagggatggaccaggtattagacgagaccggcgcagagagcatttcggagaggagccaccagaggagaacagggtacatttaggacacgctatcatgtcattttacgctgcactgatagacctactaggcaggtgtgcccccgagatgcaccttatccaggctgggaagggcgaggccctccgtatccgcgctatcttgaggtcactggtcccattagaagatttggtgggcattattagcttgcccctgcaaatccctactctaggtaaagacggcgccctggtgcagcctaaaatgagtgcaagtttcgtgccagaccataaggctagcatggtgctcttcctggatcgggtctatggaatcgaaaaccaagacttcttgctccatgtcctcgatgtggggtttctgccagatatgcgggcagctgcatcactcgacaccgctaccttctcaacgacagaaatggcgttggcgctgaatcgctacctgtgtctcgctgtgttgccactcatcaccaaatgtgcaccccttttcgctgggaccgagcatcgggctattatggtggactctatgctccacaccgtgtaccggctgtcccggggcaggtctctcacgaaagcccagcgggacgtgatcgaagattgcctgatgagcctgtgtcgctacattcgcccatcgatgctacagcatctgctccggcggctggtgttcgacgtgccaatactcaatgaattcgccaagatgcctctgaagctcctcactaatcattacgaacgctgttggaagtattattgtctccccaccggctgggccaatttcggagttactagcgaagaggagcttcacctgaccaggaagctgttctggggaatcttcgatagcctggcccacaagaagtatgatccagagctatatagaatggctatgccgtgcctgtgtgcaatcgccggcgccttacctcctgactacgtagatgcctcctactcaagcaaagccgaaaagaaagctacagtggatgccgagggcaatttcgacccaaggcctgtagagacacttaatgtgattattcctgagaaactggactcttttattaacaaatttgctgagtatactcacgaaaagtgggcttttgacaagatccagaataactggagttatggagagaacattgatgaggaacttaagactcaccccatgttacggccatacaaaacattttccgaaaaggacaaagagatttatcggtggcccattaaagagagcctgaaagccatgatagcgtgggagtggacaatcgagaaagctagagaaggcgaggaagaaaagaccgagaagaaaaagacaagaaagatcagccagagtgcgcagacctacgacccacgggagggatataatccccagccaccagacctgtcagcagtaacattgtctagggaattgcaagcgatggccgagcaactcgccgaaaactatcataatacctggggacggaagaagaagcaggaactggaagcaaagggaggaggaacacaccctctcctcgtaccatacgatacccttaccgctaaggagaaggcccgggacagggaaaaggcacaggaactgctaaagtttctacagatgaatggttatgctgttacccgagggttaaaagacatggagctcgattcctcctcaattgaaaaacgttttgcatttgggttcctacaacagctgcttcgctggatggacataagccaggagtttatcgcacatctggaggctgtggtgtctagcgggagggtcgagaagtcaccacatgaacaggagataaagttttttgcgaagatcctgctgccacttatcaaccagtattttactaatcattgtctgtacttcctgtcaacacccgccaaagtcctggggagtggcggtcacgcatcaaacaaagaaaaggagatgattacctcccttttttgcaagctggccgcgctggttcgtcacagagtctcgctgtttgggaccgatgctcccgctgtggttaattgtctgcatatactcgcccgatcactggatgcccggacagtcatgaagagcggccctgagatcgttaaagccggtttacgcagtttttttgagagtgcatccgaggacattgagaaaatggtggaaaacctgaggcttggcaaagtgtcacaggcccgcacccaggtgaagggagtcggacagaatctcacctatacaacagtggctctgctacctgtcctgacaactctgtttcagcacatcgctcagcatcaattcggagacgacgtgattcttgacgacgtgcaagtctcgtgttaccgcacgctttgctccatctattcactgggaaccaccaagaatacctatgtcgagaaacttcgcccggctctgggagagtgtctggcgaggctggccgctgcaatgcccgtagctttcttggagcctcaacttaatgaatacaacgcatgcagcgtttacacaacgaaatcacccagagaacgggctatacttgggcttcctaacagtgtcgaggagatgtgtccagatataccggtcctagagagacttatggccgacatcggtggcctggccgagtcaggcgcgcggtatactgaaatgccccacgtcattgaaattactctgcccatgctatgttcctacctgccgcgttggtgggaaagagggcctgaagccccaccctcggcactgcccgctggagcgcctcccccttgtacagcagtgacttccgaccatctcaatagcctgcttgggaatatcctccggattattgtgaataacctgggtatcgacgaggcttcctggatgaaacgcctagcagtcttcgcacagccaattgtgtcaagagcccgcccagaacttctgcaaagccattttattccaacaattggcaggttgcgcaagagggccgggaaggtggtgtctgaggaggaacagttaaggctggaggctaaggcagaggcccaggaaggcgaactccttgtcagagatgagtttagcgtcctgtgtagagatttatacgcgttatatcccttactgataaggtatgtcgacaacaatcgggcccagtggttgaccgaacccaacccctcggcagaagaacttttcaggatggtgggggaaatctttatatactggtcaaagagccacaacttcaagagagaagaacagaattttgtcgtccaaaatgagattaacaacatgagcttcctgaccgcagacaataagtctaagatggccaaagcaggtgacatccagagtggaggcagtgatcaggagcgcactaagaaaaaacgccgcggagataggtacagcgtccagactagtctcattgtcgctacattgaagaagatgctccctattggcctgaacatgtgtgcccctaccgaccaagatttaataactctggctaagacacgttacgccttgaaggacactgacgaggaggttagagagttcttgcacaataacttacaccttcagggcaaagttgaaggatccccttcactgcgctggcagatggccctctatagaggcgtgccaggacgcgaagaggacgccgacgatccggagaagatagtaaggagagtgcaggaggtatcggctgtgctttattacctggaccagacagagcacccttataaatcgaaaaaggctgtctggcataagctgttatcgaaacagagacgaagagccgtagttgcctgcttcagaatgacaccactctataatttaccgacccacagagcctgcaacatgttcttagaatcctacaaagctgcgtggatcctgaccgaagaccactcttttgaggacaggatgatcgatgacctctctaaggctggcgaacaggaggaagaggaggaagaagtcgaggagaaaaagcctgatccactgcatcagctagtgctgcatttctcgcgtactgcactcaccgagaaatctaagctggacgaagactatttatacatggcctatgcagatattatggccaaatcctgccatctggaagaggggggagaaaatggggaggctgaggaagaagtcgaggttagcttcgaagaaaagcaaatggagaaacagagactgctctatcaacaggcccggctgcatacacggggtgctgcggagatggtccttcagatgatctccgcctgtaagggggagacgggggccatggtgagttctaccctgaagctgggcatcagcattctaaacggcggtaacgcagaggttcaacaaaagatgttggattatctgaaggataagaaggaggtgggttttttccaatcgattcaggctctgatgcagacctgcagcgtgctggacctcaatgccttcgagcgtcagaacaaggccgaaggcctgggaatggttaacgaggatggcactgtaggagaaaaggtcatggccgacgacgaatttacccaggacctgtttaggtttcttcagctcctctgcgaaggccacaacaacgactttcagaattacctgagaactcagacgggaaatactacgacaataaacataatcatatgtacagtggattatttgcttaggttgcaagaatctatctctgacttctactggtattatagcggcaaagacgtgatcgaggaacagggaaagcggaatttttccaaggcaatgtccgtggctaagcaagtctttaactctctcacagaatatatccagggcccatgcacagggaaccagcagagccttgcacattcacggctctgggatgctgtggttgggtttcttcacgttttcgcccacatgatgatgaaactggcacaggacagttctcaaattgagcttctcaaggagctgctggatctgcagaaggatatggttgtcatgctcttgagcttactggaaggtaacgtggtgaatggcatgatagcgcgacagatggtagacatgctggtcgagtcaagtagcaacgtagagatgatcctgaagttttttgatatgttcttaaaactgaaggatatagtgggtagtgaggcctttcaggattatgtgacagatccacgcggcctcatttctaagaaagacttccaaaaggctatggatagtcagaagcagttctctgggcccgaaatccagttcctactcagctgctcagaggcggatgagaacgaaatgatcaactgtgaggaattcgcgaatagatttcaggaaccggctagagatattggttttaatgtcgccgtcttgctcacaaacctttctgagcacgtcccgcacgatccacgactccataattttctggagctggcggagtctatacttgaatatttcagaccttacctgggccgaattgagattatgggcgcgagtagaagaattgaacgcatttattttgaaatctctgagacaaatcgggcccagtgggagatgccccaggtgaaagagtccaagaggcaatttatttttgacgtggttaacgaggggggggaggccgaaaaaatggagctgttcgtgtccttctgtgaggataccattttcgagatgcagattgcagctcagatcagcgagccagagggagaacctgaaactgacgaagatgaaggagccggggcagccgaagcgggtgctgaaggggccgaagagggtgcggccggattagagggaaccgctgctactgcggccgccggagctacggcacgggtggtagctgcggccggccgtgcattgcggggcctgtcttaccgctcgctgcgaaggagggttcgccgattgaggcgactcaccgcgagggaagcagctaccgctgtggccgctcttctgtgggccgccgtgacccgagccggcgcagcaggagcgggcgcggccgccggagccctgggactgttgtggggcagtctctttggtggcggtttggtcgaaggtgcaaaaaaggtaacagtgacggagttacttgcaggtatgccagaccccacctctgacgaagtccacggagaacagccagctggcccggggggcgatgccgatggagagggggcatctgaaggtgctggtgacgctgcagaaggcgccggcgacgaagaagaggccgtgcacgaggccggtccaggaggcgccgacggggccgttgccgtcacggatggaggcccatttagacccgagggagccggaggactcggggatatgggcgacacaactcccgccgaaccccctaccccagagggctccccaatcttgaaacgcaagttgggggtagacggagtagaagaagagctgcctccagagccagaacccgagccggagccggagctggaaccggaaaaggcggatgcagaaaacggcgagaaagaggaagtgcccgagcccacacccgaacctccgaaaaagcaagcgcctccgtctcctccacctaaaaaggaggaggccggaggtgagttttggggcgaactggaggtgcagcgcgtgaagttcctgaactatctgtccagaaacttttataccttgcggtttcttgcactcttcctggctttcgccatcaacttcatccttctgttctacaaagtctccgattcccctccaggcgaggacgatatggagggctcagctgctggagacgtctctggggccgggtccggcggaagttccggctggggcctgggcgccggcgaggaggctgagggagacgaggacgaaaacatggtctattatttccttgaagagtcaacggggtatatggagcccgccctccgttgtctgtcacttctccacaccctggtcgcattcctctgcattattggttacaattgcctgaaagtgccactggtcatcttcaaacgagagaaggagctggctcgcaaacttgaattcgacggcttgtacattaccgaacaaccagaagatgatgacgtaaaaggccagtgggacaggctggtcctcaacactcccagcttcccctcaaattattgggacaaatttgttaagagaaaagtgcttgataagcatggcgacatttatggtagagagaggatcgctgagctgttgggcatggacttggccacactggagatcacagcacacaatgagcgaaaaccgaacccccctccaggactactgacctggctgatgagcatagacgtaaagtatcagatctggaagtttggagtgatcttcaccgacaactccttcctgtacctgggatggtatatggtgatgtcactattgggacactacaataatttttttttcgctgctcatctgcttgacatcgccatgggtgtgaagacactaaggactatactctcatccgtgacccataacggaaaacagctggttatgaccgtcggtctgctggctgtggtcgtgtatctttacaccgtggttgcgttcaacttttttcggaaattctacaacaaatccgaagatgaagatgaacctgatatgaagtgcgatgacatgatgacatgctacctgttccacatgtatgtgggggtaagggctggagggggtatcggtgacgagatcgaagatccagctggcgacgagtacgagctttaccgcgtagtctttgacatcacgtttttttttttcgttattgtaattcttctggcaatcattcaaggccttattatcgacgcattcggcgaactgagggaccaacaggaacaggtcaaagaggacatggagacgaagtgtttcatttgcggtatcggatccgactacttcgacacaaccccgcacgggtttgagactcacactctggaggaacacaatctggccaattacatgttcttcttaatgtacctcattaataaggatgagacagagcataccggccaggagagctacgtatggaaaatgtatcaggagcggtgttgggacttttttccagcaggagactgctttaggaagcagtacgaagaccagctgtcgtag

SEQ ID NO: 204104 - DNA, 2031 bp, Artificial Sequence
  Description of Artificial Sequence: Synthetic coding sequence
atgaagagcggccccgagatcgtgaaggccggcctgcggagcttcttcgaaagtgctagcgaggatatcgagaagatggtggagaatctgcgcctcggcaaggtttcacaagcaaggactcaggtgaagggcgtgggacaaaacttgacttacacaacggtagcccttttgcctgtcctgacaacactctttcaacatatcgcccagcaccagttcggggacgacgtcatccttgacgatgtgcaggtctcctgttaccgcactctctgcagtatctactctttaggaacaactaaaaatacatatgtcgagaagttaagacctgcactaggtgaatgtttagcacggcttgcggcagccatgccagttgcctttctggaaccccagctgaacgagtacaacgcatgtagtgtctacactacaaagtctccccgcgagcgcgcaatcctgggccttcccaattccgttgaggaaatgtgccccgatatcccagtgctcgagagattaatggccgatatcggtgggctggcggagagcggagcacggtacacagaaatgccacacgtcatcgagattaccttgcccatgctctgttcttacctccctaggtggtgggagcgcggccccgaggcacccccatcagcactgccagccggtgcacctccaccctgtacagcagtcacatcggaccatttgaattcactcctagggaatatcctgagaattattgtcaataacctcggcatcgatgaagcctcatggatgaaacgattggctgtgttcgcccagccaattgtgtcccgagctcggcctgaacttttacagtcacacttcatccccactatcggccgtctgcgaaaaagggctggcaaggttgtctctgaggaagagcaactgcgcctggaagccaaagctgaggcccaagagggagaattactcgtgagggacgagttcagtgtgctgtgccgggatctctatgccctctacccacttctgataagatatgtggataacaatagagcacagtggttaaccgaacctaatccgtcagccgaagaattgttcaggatggtcggtgagatcttcatatattggtctaagtctcacaactttaaacgggaggaacagaactttgttgtgcagaatgagattaataacatgagtttccttaccgctgataataaatctaagatggccaaagcaggggatatccagtccggcggctccgatcaggaaagaaccaaaaaaaaacgccgtggggatcgctattccgtacagacctctttgattgtcgcaacgcttaagaagatgctgcccatcggactgaacatgtgcgctcctaccgatcaggatctcattacactcgccaaaacccgatatgccctaaaggatacggatgaggaagtccgggagttccttcacaataacctgcacctgcagggaaaggtggaagggagtcccagcctgagatggcagatggccctgtaccgaggcgtgccaggccgggaggaggacgccgatgaccctgaaaaaatcgtccggagggtgcaggaggtgtctgccgttctctactacctcgatcagacagaacacccgtacaagtccaagaaggccgtgtggcacaagttgctctccaagcagcgacgaagagctgtcgttgcctgtttccgaatgaccccactttataacctccccacacatcgggcatgcaacatgtttcttgagtcttataaggcagcttggatacttaccgaagatcacagctttgaagacagaatgatcgatgatctgagcaaggccggggaacaagaagaagaggaggaggaggttgaggagaagaagcccgaccccctccatcagcttgtgcttcacttttctcggacagcgctgactgagaaatctaagttggacgaagattacctttacatggcctacgccgacattatggccaaatcttgccatcttgaagaaggtggtgaaaatggcgaggctgaagaggaagtggaggtctccttcgaggaaaagcaatag

SEQ ID NO: 204105 - DNA, 14922 bp, Artificial Sequence
  Description of Artificial Sequence: Synthetic coding sequence
ctgggcccccggagcagcagcaacaagctgagcaacaagaagatgatgaagtggttctgctctgccccacagccatcaactaaaaacaataggtcttacgcttggcagcagaaagacctggccaccgattttgtttcttggtccccgctgccgatccctcgaatgtgtccccaaacctcaccctctgctccgttatgctggagctcgccttctctgagtggtcgatgcaggcgatgttggctgaccccttggcgaaatcagaaaggacagttagacatcatcaagtggtcttttgggctgaaaacagcacaggggggcggccatcggaccctcttgtacggacacgccattcttctgcgccactcttacagtgggatgtacctgtgttgcctgagcacgagccgctcgagtactgataagctggcatttgatgttggtctgcaggaagacactaccggagaagcatgctggtggacgattcacccagccagcaaacagagatccgagggcgaaaaggtcagggttggagacgacctgattctggtgagtgtatcttcagagagatatcttcatctttcctatggtaacggaagtcttcacgtggacgcggcattccaacagactctgtggtccgtggcacctatatcttcaggcagtgaagcagcgcagggatatttaatcggcggcgatgtattgcggttgctgcatggccatatggatgagtgtctgacagtgcccagtggagagcacggggaggagcagaggagaaccgttcattatgagggaggcgcggtaagcgtacacgccagatccctgtggcggctggaaacccttcgagttgcctggtcaggcagtcacattagatggggccaaccgttcaggcttcgccacgtgaccacagggaagtacctctctctgatggaagataagaacttgctgctgatggataaggagaaagctgacgtgaagtctaccgcatttacattcagatccagcaaggagaagctggacgttggcgtgaggaaagaggtagatggcatgggcacatctgagatcaaatacggcgattccgtgtgttatattcagcacgtcgacacaggactgtggcttacttaccagtctgtggacgtcaagagtgttagaatgggatcgatccagcggaaagcgatcatgcaccatgagggccatatggatgacgggatatccctttctcggagccagcacgaagaaagccgcacggctcgggttataaggagtacagtctttttgtttaaccgctttatccgcggcctagatgccctatccaagaaagccaaagccagcaccgtggacctgcccatcgaatcagtatctctgtcactgcaggaccttattgggtacttccatccgccggacgaacatttggaacacgaagacaaacagaatcggcttcgcgctttgaagaacaggcagaatttgttccaagaagagggaatgattaacctcgtgctcgagtgcatcgatagactgcacgtgtattctagcgcagcacactttgccgacgtggccggacgtgaagcaggggaatcttggaaaagcatcttgaatagcttgtatgagctgcttgcggctttgataagaggcaatcggaagaattgtgcacagttctctggtagcttggactggctgatctctcgcctagaacggctggaggcttcttccgggatcctggaagtgctgcactgtgtcttggtggaaagcccggaggctctgaacattattaaagaggggcacatcaagagcatcatctccctccttgacaagcatggccgtaatcacaaagtcctggatgtcctgtgttccctctgcgtttgtcacggagtggcagttcgatcaaatcagcatttaatctgcgacaacctgctgcccggccgcgacctcctgctgcagactcgcctcgtgaatcacgtctcctcgatgagacctaatattttcctcggcgtgtctgagggcagcgctcagtataaaaagtggtattatgagcttatggtggatcacactgagcccttcgtgacagccgaggccacccacctgcgggttggctgggctagcaccgaggggtattccccctacccagggggtggagaagaatggggcggaaacggggtaggggatgacctgttctcctacggatttgacgggctccacctctggagcggatgcatcgcacgtactgtttcatctccgaatcagcacctgctcagaacagatgatgtaatctcttgctgcctggacctctcagctccgagcatctctttcaggattaacgggcagccggtgcagggaatgttcgagaacttcaatatagacgggctgtttttcccagtggtgagctttagcgccggcatcaaagtgcggttcttattagggggccgccacggagaatttaagtttctgcctcccccgggctatgctccctgttacgaagcagttcttcccaaggagaaactgaaggttgagcacagccgagagtacaagcaggagcggacctacacccgggatctattgggcccgactgtgtcccttacacaggccgccttcacaccgattcctgtggacactagccagatagtactaccccctcacttagagagaatccgcgaaaagttagcagagaacattcacgaactttgggtgatgaacaagatcgaattgggatggcagtacgggccagtgcgagacgacaataagaggcaacacccatgtttggtcgaattctccaaactgcctgagcaggagcgtaattataatttacagatgagcctggagacattgaagacactgcttgccctgggttgtcatgtcggtatctccgatgaacacgccgaagacaaagtgaaaaagatgaaactccccaagaactatcagctgactagcggatataagcctgcccctatggatctcagctttatcaaacttactcctagccaagaagccatggttgataagctcgccgagaatgcacacaatgtgtgggcccgcgacaggatccggcagggttggacatacgggatccaacaagatgtcaaaaaccgaagaaaccctcgtcttgtaccgtataccttactcgacgaccgtacaaaaaaatccaacaaggattcgctccgcgaggctgttcgcaccttgcttgggtacgggtacaatctcgaagccccagatcaggaccatgctgcccgggctgaagtgtgttcaggcaccggagaaaggttccgtatattcagagctgagaaaacatatgccgttaaggccggcaggtggtactttgagttcgagacggtcaccgccggcgatatgcgtgtgggctggagcagacccggatgtcagccggaccaggagctgggatctgatgaaagggcctttgcttttgacggctttaaggcacaacgctggcaccagggaaatgagcactacgggcggtcgtggcaagcaggcgacgtggtcgggtgcatggtcgacatgaacgaacataccatgatgttcaccctgaatggcgagatactccttgacgattccggcagcgaactggccttcaaggatttcgacgttggagatgggtttattcctgtttgttcgctgggagtggcccaggtagggagaatgaattttgggaaagacgtctctactctaaagtactttacaatctgtggactgcaggagggctacgagccttttgccgttaataccaaccgggacattaccatgtggttgagcaaacgattgccccagttcctgcaagtgccaagcaatcatgaacacatagaggtgactcgcattgacggcacgatcgacagtagcccctgtctgaaggtaacgcagaagtcatttggatcgcagaattccaacacagacattatgttctaccgcctgagcatgcctatcgagtgcgccgaggtcttttcgaaaactgtggctgggggcctcccaggcgccggcctctttggccccaagaacgacctcgaggactacgatgccgatagcgacttcgaggtcctcatgaaaacagcccacggtcatctcgtgcccgatagagtcgataaggataaggaggctaccaaaccagagttcaacaaccataaggattatgcccaggaaaaacccagccgcttgaagcagaggtttctactgcggcggaccaaaccggactatagtactagtcattctgctcgactgactgaagacgttcttgctgacgacagggacgattatgacttcctgatgcaaacatccacttactattactcggttaggatctttcccgggcaggagccagccaatgtgtgggtgggttggataacaagcgattttcaccagtacgacactggcttcgacctcgatcgcgtcagaacagtgacagttacactcggagacgagaaggggaaagtgcacgagtccatcaaacgctctaattgttacatggtgtgtgcaggtgagagcatgtcacctggacagggacgtaataacaatggcctggaaatcggatgcgttgtggacgcagcctcgggtcttttaacatttatagcaaacggcaaggagctcagtacctattaccaggtggagccgagcacaaagctgttcccagcggtgttcgcacaagccacttcacctaatgttttccagttcgagttgggtaggattaagaacgtcatgccactgagtgctgggctgtttaagagcgagcataagaacccggtcccccagtgccccccccggctacatgtgcagttcctgtcacacgttctttggagtcggatgcctaatcagttcctaaaagtggacgtatcaagaatcagcgagcggcaggggtggttagtgcagtgccttgacccactgcagttcatgagcctgcatatcccagaggagaaccggagtgtggatattcttgaactgacggaacaagaggagctcttgaaatttcattatcacacactgaggctgtatagcgctgtgtgtgctctggggaaccaccgggttgctcacgcactgtgcagtcatgtagacgagccacagctgctctatgccattgaaaacaagtacatgcctgggctgctgagagctggctattacgacctactaatcgatattcatttgtcttcctatgcaactgcaagactgatgatgaacaatgagtatatcgttccaatgacagaggagacgaaatccatcaccctgttccctgatgagaataagaagcacggactgcccgggataggtctctccacaagtctgcgcccacgaatgcagttctcctctccatccttcgtctccatctctaatgagtgctaccagtatagccccgagtttccactggatattctcaaaagtaagaccatccagatgctaactgaagcagtaaaggagggcagtctccacgctcgtgatcccgtgggaggcactacggagtttttatttgtacctttgattaagctattctacaccctgctaatcatggggatttttcataatgaggacttgaaacatattctgcagttgattgaaccttccgtattcaaggaagcagccacacctgaggaagagtctgacaccctggagaaagaactgtcagtagacgatgccaaacttcagggagctggggaagaagaagccaaaggaggtaagcggccaaaagaggggctgctccagatgaaactgcccgagccagtgaagctgcagatgtgcctgctcctccagtacctgtgtgattgtcaggttcgtcaccgcattgaagcaatcgtcgcatttagcgacgattttgtggctaagctacaggataaccagcggtttcggtataacgaggtgatgcaggcactgaacatgtccgcagcactgacagcccgcaagacaaaagagtttagaagcccaccgcaggagcagataaatatgctgctcaactttaaggacgataaaagcgaatgcccatgccccgaggaaatcagagatcaactgctcgactttcacgaagatttaatgactcattgtggaatcgagcttgatgaagatggatctttggacgggaacagtgatcttactatccgagggcgtctcttgtctcttgttgaaaaggtgacatacttgaagaagaagcaggctgagaagcccgtggagtcagactctaaaaagtctagcaccttacagcagctgattagcgagacaatggtcagatgggctcaggaatccgttatcgaagatcctgaactggtgagggccatgttcgtactgttacaccgccagtatgacggcattggcgggcttgtccgggctctgcccaaaacgtatacaatcaatggggtcagcgtcgaagatactattaaccttttggctagcctggggcagatacgtagccttctgtctgtgcgcatgggaaaggaggaagagaagctgatgatcagggggctaggcgatataatgaataataaggtgttttaccagcatccaaatctgatgagagccctcggcatgcatgaaactgtgatggaggtcatggtgaacgtgctgggaggaggtgagagcaaggaaatcaccttcccaaagatggtggccaactgttgtcgttttttgtgttatttttgccgtatctctagacagaatcagaaggcgatgttcgatcacctttcttacctgttggaaaattctagcgtgggcctggcttcaccagctatgagagggagtaccccattggacgttgccgccgctagcgtgatggataataatgagctcgccttggccctgagagagccagacctggaaaaggttgtgaggtatttggccggatgtggattacagtcctgtcaaatgcttgtaagcaagggatacccagacattggctggaaccccgtggagggtgagcgttatttggattttctgcgctttgccgtcttttgcaatggagagtcggtggaagaaaatgctaacgtggtagtgcgcttgctcattcgaagaccagagtgtttcggacctgcactgagaggcgagggagggaacggcctcttggctgctatggaggaggctattaagattgctgaagacccttctagggatggtccgtcacccaacagcggctcctcaaaaacactggataccgaggaggaggaagacgacacgatccacatgggaaacgcaatcatgacgttctatagcgccttgatagacctgctcggaagatgcgcgcccgagatgcaccttattcacgcgggcaagggcgaagccatcaggattagaagcatcctgcggtctctcatacccctcggcgacctggttggggtcatctccatagctttccagatgcccacaatcgcaaaggacggtaatgtggtcgaacccgacatgtccgcggggttttgtcctgaccataaggccgccatggtccttttcttagaccgagtctacggaatagaggtccaggacttcctgctgcacttgctggaggtgggattccttcctgatttacgggcagctgcctccctcgataccgcagctctaagcgcaaccgacatggccctggccctgaatagatatctgtgtaccgctgtcctgcccctactaacacggtgtgcacctctgttcgccggaaccgaacaccacgccagcctgattgacagtctgctgcacacagtatatagactgtcaaagggctgcagtctcacaaaagctcaacgagatagtatcgaagtttgcttgctgagtatttgcggtcagctgcggccctcaatgatgcagcacctgcttagacggctagtctttgacgtgccccttttgaatgaacacgccaagatgcctcttaagcttctgacaaaccattacgagcgctgttggaaatactattgtctccctgggggatggggcaacttcggagcagcttcagaagaggagctgcatctcagcagaaagctattctggggaatatttgacgcactctcgcagaagaagtacgagcaggagctctttaagctggcccttccatgcctcagcgctgtagcaggggctctgccaccagattacatggagtcgaactacgtgagtatgatggagaagcagagcagcatggattccgagggcaattttaatccgcaacctgtggatactagtaacataaccatacccgagaagctggaatattttattaataagtatgccgagcactcccacgataaatggagtatggacaagctcgcaaacggatggatctatggcgaaatctacagtgactcgagcaaggtgcagccacttatgaagccttataaactgttatcagagaaggaaaaggagatatatagatggcccattaaagaatcattaaagactatgctcgcgtgggggtggagaatcgagcgaacccgagagggagactctatggctctgtataatagaaccaggaggatttcacagacctcacaggtgagcgtggatgccgctcatgggtattctccgagggcaatagacatgtccaacgtgacactgagtagggacctccacgcaatggcagagatgatggccgagaattaccataacatttgggccaagaagaagaaaatggagctggaatccaaaggtggcggcaatcatcccctgttagtgccatatgacactcttactgcaaaggaaaaagctaaggatcgcgaaaaggcacaggatattttaaaatttttgcagatcaatggctatgcggtttcaagggggttcaaagacctggagctggatacaccgtcgatcgagaagaggttcgcttacagctttctgcaacaattaattcgttacgtcgatgaggctcaccagtatatcttggaatttgacgggggctccagaggaaagggcgagcacttcccatacgagcaagagatcaaattttttgcgaaagttgtcctgcccttaattgaccaatactttaaaaatcaccggctctatttcttgtccgccgcctccaggccactctgcagtggtggacacgcaagcaacaaggaaaaggagatggtgacttcccttttttgtaaactgggggttctggtgcgccaccgaatctcattgttcggtaacgatgccacctccatcgtgaattgtctgcatatcctgggccagacactggatgccagaaccgtgatgaaaacgggactggagtctgtcaagtcggcactccgcgccttcctagacaacgctgccgaggatttggagaaaactatggagaatctcaagcaaggacagttcacccacacacgcaatcaaccgaagggagtaactcaaattatcaattataccacggtggcgcttcttcctatgctcagcagcctgtttgagcatattggtcagcatcagtttggggaggacctgatcctggaagatgttcaggttagctgctataggattctgactagcctttatgctctgggaaccagcaaatccatttacgtggagcgacagcgcagcgctctcggcgagtgcctggccgcttttgccggtgctttcccggtggcttttctggagacccaccttgataagcataatatttacagtatctataacaccaagtcctccagagaacgcgctgcactgagccttccaaccaacgtggaagacgtgtgtcctaacatcccatctctcgagaaactgatggaggagatagtcgagttggcggaatcaggcattcggtatacgcagatgcctcacgtgatggaggtcatcctgcccatgctgtgtagttacatgagcagatggtgggagcacggacccgaaaataacccagagcgtgctgaaatgtgttgtaccgctctgaactccgagcacatgaatactcttttggggaacatcttgaagattatctacaataacctgggcatcgatgagggcgcttggatgaaacggttggcggtgttttcacagcccattattaataaggtgaagcctcagctcctgaaaacgcatttcctcccgctgatggaaaaactgaaaaagaaggctgctactgtggtgtctgaggaagaccacctgaaggcagaggcaagaggcgacatgagtgaggcagagcttttgatcctggatgaattcacaactctagcacgcgatctctacgcattctatcctctcctgatcaggtttgtggattataacagagcaaaatggttaaaggagcccaacccagaggcagaggaactcttcaggatggttgccgaagtctttatctactggtccaaaagccataatttcaagcgggaggaacagaacttcgtggtccagaacgagattaataacatgtccttcctgatcacagataccaagtctaaaatgtctaaggccgccgtgtccgatcaggagcgaaagaagatgaagaggaaaggagatcggtactccatgcagacatctctgatcgtcgctgccttgaagcggctgttaccgattggtctgaatatatgcgctcccggtgatcaggaactgatagccttggccaaaaataggttctctctgaaggacaccgaggatgaggtgcgggacatcattcggtctaacatacatctccaaggcaagctggaagaccctgccatccggtggcagatggcgctatataaagatctgccgaatcgaacagacgacacgagcgatccagagaagacagtcgaacgggtcctagatatagccaatgttctatttcatctggagcagaaatccaaaagagttggcaggcggcattattgtcttgtggagcacccacagcggtctaagaaggcagtctggcacaagctcctgtccaagcagcggaaacgggcagttgtggcttgtttcagaatggctcctttatataatcttcctagacaccgtgctgtcaacctgttcctccagggctatgagaagagctggatcgagaccgaagaacattatttcgaagacaaactaattgaggatctcgccaagccaggcgcagagccccccgaagaggatgaggggaccaaaagggtggacccactccatcagcttatcctattgttctccaggaccgctttgacagagaagtgcaaactggaagaggactttttgtacatggcttacgcagacatcatggccaaaagctgccacgatgaggaggacgacgatggtgaggaggaggtgaagagcttcgaagtcaccggaagtcagaggtctaaggagaaggaaatggagaagcagaaacttctctatcaacaggctagactccatgaccgaggggctgctgagatggtcctccaaacaatttctgcttcgaagggagaaactggcccaatggtggctgctacgcttaagctgggcattgctatccttaatggcggcaattccacagtgcagcagaaaatgctggattatttaaaagaaaaaaaggacgttgggttctttcagtctctcgctggacttatgcaatcttgttccgtccttgacttgaacgccttcgagcggcagaataaggccgaggggcttggtatggtgacagaagagggcagcggagaaaaggtcctgcaagatgacgagttcacgtgcgacttgttccgcttcctgcagcttttgtgtgagggccataactccgattttcagaattacctgaggacgcagaccggtaacaatacgaccgttaatatcattatctctaccgtggactacttgttgagggtccaagaatccatttcagacttttattggtattatagcggaaaagacgtgatagatgagcagggccagcgtaatttcagcaaagccatccaggtggcgaaacaagtattcaacacgctgacagaatacatacaggggccttgtaccggcaatcagcagagcttagctcacagtcgcctttgggatgctgtggtgggcttcctgcatgtgttcgcccacatgcagatgaagctgtctcaggattcgagccagattgagttactgaaggagctgatggacctgcagaaagatatggtcgtaatgctgctgtcaatgcttgaagggaacgttgttaatgggaccattggcaagcagatggtcgatatgctagtggagtcatccaacaatgtggaaatgatcctcaagttcttcgacatgttcctgaaacttaaggacctcacttccagcgacaccttcaaagaatatgatcctgacggaaaaggggtcatttccaagcgcgactttcacaaagccatggaaagccataagcactacacgcagagcgagacagagtttctgttgtcgtgtgctgaaaccgatgagaacgagacacttgactacgaggagttcgtgaagcggttccacgaacccgcaaaggatatcgggtttaatgtggcagtgctcttgacaaacctgtccgagcatatgccaaacgataccagactgcagaccttcctggagctcgcggaatcggtgctgaactattttcagccatttctgggtagaattgagattatgggctccgccaagcgcatcgagagagtttacttcgagattagtgaatcatctcgcacccagtgggagaagccacaggtcaaagagtccaagaggcaatttattttcgacgtcgtcaatgaaggcggcgagaaagagaagatggagttgttcgtaaatttctgcgaggacaccattttcgagatgcagctggccgcgcaaatctcagaaagtgacctgaatgagagatctgcaaataaagaggaaagcgaaaaagaaagaccagaagagcagggaccacgcatggctttcttcagcattcttactgtccgctccgcgctgtttgcactgagatacaatatcttgactctcatgagaatgctgtctctaaagagtcttaagaaacaaatgaagaaagtaaaaaagatgactgttaaagatatggtgaccgcattcttcagctcttactggagcattttcatgaccctcctgcacttcgtagccagtgtcttcaggggtttctttcgcatcatctgttcccttctgctcggcggcagtctcgtcgaaggggcaaagaagatcaaagtggctgaattgctcgcaaatatgcccgaccccactcaggacgaggtgcggggagatggggaggaaggcgaaagaaagccactggaagccgctttgcctagtgaggatttgacagatctcaaggagttgacggaagagtcagacttgctgtcggacattttcgggctcgacctgaaacgcgagggaggtcagtacaaactaatccctcacaatcctaacgcaggattgagcgacttaatgtcaaatcccgtgcccatgcctgaggtgcaagagaagtttcaggagcagaaggcaaaggaggaagaaaaagaggagaaggaggagaccaagtccgaacccgagaaagccgaaggtgaagatggcgagaaggaagagaaagctaaggaagataagggaaagcaaaagctccgacagcttcacacgcaccgctatggcgagcccgaagtcccagaatccgccttttggaaaaagattatcgcctatcaacagaagttacttaattattttgcccgcaacttctacaacatgaggatgttagctctgtttgtggctttcgcaatcaatttcattctgctattctacaaggtatccacctcaagtgttgtcgaaggcaaggaattgcctacccgctccagtagcgagaatgcgaaggttaccagcctggattcttcttcacatagaatcatcgccgtgcattacgttttggaggaatcttccggctacatggagcctaccctcaggatcctggccatcctgcacactgtaattagtttcttctgtattataggttactattgcctgaaggtccccctggtgatttttaaaagagagaaggaggtggcccgcaaactggagttcgacggcctctacataaccgaacagcccagcgaggacgacatcaaaggacaatgggaccgccttgtcatcaatacgcagagcttcccgaataactattgggacaaattcgttaaaagaaaagtgatggacaaatacggggaattttacggcagggatcgaattagcgagttgttgggaatggacaaagcagccttagattttagtgacgcccgcgagaagaagaaacctaagaaagactcaagcctgtctgcagtgctgaattcaatagacgtgaaataccagatgtggaagttgggcgtcgtgttcaccgacaactcttttttatatcttgcctggtacatgacaatgtccgtgctagggcactacaacaattttttttttgcagcccacttgttggacatcgcaatgggcttcaagacactcaggacaattctatcatccgtcacacacaatggaaaacaactagtgctcaccgtcgggctgcttgctgttgtagtttacctgtatacagttgtggcgttcaactttttcagaaagttctacaataaatcagaagacggcgacactccagacatgaaatgcgatgacatgcttacctgctatatgttccatatgtacgtgggcgtgcgagcagggggggggataggcgatgagatcgaggatcctgcaggcgacgagtacgagatttacaggattatttttgacattactttttttttctttgttattgtgattctgcttgcgattatccaagggctcattattgacgcgttcggggaactgagagatcagcaagagcaagtgaaagaagatatggagacaaagtgcttcatttgcgggataggaaatgactactttgacaccgtacctcatggcttcgaaacccacaccctgcaggaacataacctggcaaattacctattcttccttatgtatctaataaataaggatgaaacagagcacacgggtcaggagagctatgtttggaagatgtaccaagagagatgctgggagttttttcccgcaggagactgtttccgcaaacaatacgaagatcagctcaattag

SEQ ID NO: 204106 - DNA, 14904 bp, Artificial Sequence
  Description of Artificial Sequence: Synthetic coding sequence
atggccgacggcggcgagggcgaggacgagatccagttcctgcggaccgacgacgaggtcgtgctccaatgtactgccactatacataaggagcagcagaaactatgtcttgcggcagagggcttcgggaatcggctgtgctttctggagtcaacctctaatagcaagaacgtcccacctgacttgtctatttgcaccttcgttctcgagcagagcctctcggtacgtgcactccaagaaatgcttgctaatacagtggagaaatccgaagggcaagttgatgtggagaaatggaagttcatgatgaagaccgctcagggggggggccatcgcacccttttgtacggccatgctatacttctccgacactcttattccgggatgtacctatgttgcctctccacatcccgctcctcaaccgacaagctggccttcgatgtgggcctgcaagaggacaccaccggcgaagcttgttggtggactattcatcccgcatccaaacagcgctccgaaggagagaaggtccgggtaggagacgaccttatcttggtatccgtctcgtctgagcgatatcttcatctgagttacggcaacggatccctacacgtcgatgcagcgtttcagcagactctctggtctgtggcccccatcagttccgggtcagaggccgcccaggggtacctcatcgggggagatgtattaaggctgctgcacgggcatatggatgagtgtttgaccgtaccctctggtgagcacggcgaggagcaaaggcgaactgtacactatgaaggcggagcagtgtctgtccacgccaggtccctttggagacttgagaccctgcgggttgcttggagcggttctcacatccgttggggccaaccttttcgcctgcggcatgtgacgactggcaagtacctgtccctcatggaggacaagaacctgctgctgatggataaggagaaggcagatgttaagtcaacggcattcactttcagatcatccaaggagaaactcgatgttggggtgagaaaggaggtagacggcatgggcacaagcgagatcaagtacggtgactcagtgtgttacattcaacacgtcgataccggtctgtggctgacatatcagtccgtggacgtaaagtctgtgcgcatgggatccatccaacgaaaagccatcatgcatcatgaggggcatatggacgacggaatttctctaagtaggagccagcacgaagaatcacgaactgcaagagtgatccggagcactgtattccttttcaacaggttcatccgcgggttagacgctttgtcaaaaaaagccaaggcatcaactgtcgatcttcccatagagtcagtgtccttgagcctgcaggacctgatcgggtacttccacccaccggatgaacatttggaacatgaagacaagcagaaccggttacgtgcccttaaaaaccggcagaacttattccaggaagaagggatgattaatcttgtcctcgaatgtatcgaccggctccatgtgtattcatccgctgcccacttcgctgacgtggccggaagggaagccggggagtcgtggaagagcatcctgaactccctgtacgagctcctggcggccctgattcgcggcaaccgcaagaattgtgcccagttctcaggctccctcgattggctgattagtcggctggagagactggaggccagcagcggcattctggaagtcttacattgtgttctagtggagtctcctgaggctctcaacataataaaggagggccatatcaagagtatcatcagtttgcttgacaagcacgggaggaatcacaaagtcctcgacgtactgtgctccctctgtgtgtgtcacggagtagcggtgcggtctaaccagcatctcatctgcgataacctgctcccaggccgcgatttgctcctacaaaccagacttgtcaaccatgtgagtagcatgcggcccaacatcttcctgggagtctctgaaggttcagcacagtacaagaaatggtattatgaattgatggtcgaccacacggagccgttcgtcaccgccgaagccacccacctgcgcgttggttgggcttctaccgagggttatagtccataccctggtggaggggaagaatggggtggcaacggggttggtgacgatctctttagttacggattcgacggactacacctgtggtcaggatgtatcgcacgcaccgtttccagcccaaatcagcatctgctccgcaccgatgacgtcatctcatgttgtctagacctgagtgctccttcgattagctttcgcataaacggacagcctgttcaagggatgttcgagaattttaatatcgacggacttttcttcccagtagtctccttctcggcggggatcaaggtccggtttctccttggggggcgccacggtgagttcaaattcctccctccgcccgggtatgctccatgttacgaagccgtcctgccaaaagaaaaattaaaagtggagcactcccgcgaatacaagcaggagaggacatatacgcgagatctcctcggccccaccgtgtctcttactcaggccgcgtttaccccaatcccagtcgacacatctcaaatcgtgttgcctccgcacctggaacggattcgcgagaagctggccgagaacatacacgagctgtgggtgatgaacaagattgaactaggctggcagtacggtccagtgcgcgatgataacaagcggcagcacccgtgcctggtcgaattttctaaattaccagagcaggaacgtaattataatctgcagatgtcccttgagacactgaagacgctgctagccctcggctgtcatgtgggtatctccgacgaacatgccgaagacaaagtgaaaaagatgaagctgcctaagaattaccagctgacgagtggttataagcctgcccctatggatctgtctttcatcaaactcaccccctctcaggaggccatggtggataagcttgcagagaatgctcataacgtgtgggcccgggatcggatcagacagggatggacctatggcatccagcaggatgttaaaaatcgacgtaatccaagactggtcccctatacccttttggacgaccgcacaaagaagtcaaacaaggacagccttagggaggccgtgagaactttactaggatatggctacaacctggaggctcctgaccaggaccacgcagctcgggctgaagtgtgctctggaacaggggaacggttccgcattttccgggctgagaaaacctacgcagtgaaggctgggcgctggtactttgaatttgagaccgtgaccgccggggacatgcgcgttgggtggtcccgcccaggctgtcagccagatcaggaactgggttccgatgagcgagccttcgccttcgacggcttcaaagcccagcggtggcaccaggggaatgaacattacggcagaagttggcaggccggcgatgttgtgggttgcatggtggacatgaacgaacatactatgatgtttaccctgaacggagagatccttctcgatgattccggctctgaattggccttcaaagatttcgacgtgggtgacggcttcatccccgtgtgcagtctgggggttgctcaagtcggacgcatgaacttcgggaaggatgtgagtaccctgaagtacttcacaatatgtggtctgcaggaagggtacgagccttttgccgtcaataccaacagagacataacaatgtggctcagcaagagacttcctcagttcctgcaggtaccctcaaatcacgaacacatcgaagtgactcgtatagatggtaccatcgattccagcccctgtctgaaggtgacccagaagtcattcggaagccagaatagcaatactgacatcatgttttacaggctgtccatgccaatagagtgtgcggaagtgttttccaagacggtcgccggaggcctgccaggcgccggactcttcggacccaaaaacgatctagaggattatgatgctgacagcgattttgaagtgctcatgaaaacagcccacggccatcttgtgcctgacagagtagataaggacaaggaagccactaaacctgaattcaacaatcacaaggactatgctcaagagaaaccatccagactcaaacaaagattccttctcaggcgtacaaaacctgattattctactagccattccgcgagattgactgaagacgttttagccgacgaccgcgatgactatgattttctcatgcagacttcaacttattattactctgtgcgtatttttcccggtcaggaaccagccaacgtgtgggttggatggattactagcgattttcatcagtacgacacaggcttcgatctggatcgggttagaactgtgacagtgacccttggcgatgaaaagggaaaggtgcacgagagtatcaagcggtccaactgctacatggtctgcgccggggaaagcatgagccccggccaggggcgaaacaacaacggattagagattggctgcgtcgtagacgctgccagtggacttctgacatttatagccaacggcaaggagctatccacatattatcaggttgaacctagtaccaagctgtttcccgctgtattcgcgcaagctacttcgcccaacgttttccaatttgagctggggcgcattaaaaacgtaatgcctctgtccgcaggtctgtttaaaagcgaacataaaaacccagtgccacagtgcccacctcgcttgcatgtgcagtttctgtctcacgtgctctggagtaggatgccgaaccagtttctcaaagtggacgtgtcaagaatctcagagcgacagggctggttggtacagtgtctggatcccctgcaatttatgagtctgcatattccggaggaaaaccgctctgtggacatcctggagcttaccgagcaggaggaattgctgaaattccactaccataccctgaggttatactcagccgtctgtgccctggggaaccatagggtggcgcatgctctgtgcagtcacgttgatgagcctcagctgctctacgctattgaaaataagtatatgcctggcctcctccgggccggatattacgacttgcttatagacatccatttgtcttcctacgccacagctagactgatgatgaataacgagtacattgtgcctatgacagaggagactaagtccataactcttttcccggacgagaacaagaaacatggcctcccagggatcgggctgtctacctctcttaggccccgcatgcagttctcctctcctagtttcgtgagcataagcaacgagtgttatcaatactctccagaattccccctggatattctcaaatctaaaactattcagatgctgaccgaagccgtcaaggaaggctccctacatgctcgcgatcccgtcggcggaactaccgagtttctgtttgtgcctctcatcaagcttttctacacgcttctgattatgggcatcttccacaacgaagacttgaaacacatcctgcagcttatcgaaccctctgtttttaaggaggccgccacacctgaagaggagagtgatacccttgaaaaggagctgtctgtagatgacgccaagttacaaggagcaggggaagaggaagcgaaggggggtaagaggccaaaagaagggctactgcagatgaaactccccgaaccagttaaattgcagatgtgtttactgctgcaatacctgtgcgactgccaggtcagacatcgcattgaggctatagtagctttcagcgatgattttgtagccaagctgcaggacaaccagcgcttcagatacaacgaagtaatgcaggccttgaatatgtcagctgcactgacggcccgcaagaccaaagagttcagaagccccccccaggagcagatcaatatgttgctgaacttcaaggacgacaagtccgagtgcccctgtccagaggagataagagaccaattgctggactttcacgaggatctcatgacacactgtggaattgagttagatgaggacggatcactcgacggaaacagtgatcttacaatacggggaagactgctgagccttgtggaaaaagtaacctatctgaagaaaaagcaggccgaaaagcccgtggagagtgattctaagaagtccagtaccctccaacagttgattagtgagaccatggtgaggtgggcacaggaatcggtgatcgaggaccccgagctagtccgagcaatgttcgtgctcctccaccgacagtatgacggaatcgggggactggtcagagcccttccaaagacctacaccataaatggagtgagcgtggaggatacaattaaccttctggcctcactcggacagatcaggagcctcctgagcgtgcgcatgggcaaagaggaagagaagctcatgattcggggactcggagatatcatgaacaataaggtgttctatcagcatcccaatctgatgcgggcactgggaatgcatgaaaccgtcatggaagttatggtcaacgtgctgggaggcggggaatccaaggagatcactttcccaaaaatggtggcaaactgctgccgtttcttgtgttacttttgtcgaatctccaggcagaaccagaaggctatgttcgatcacctgagctaccttctggagaatagcagtgtcggactagcatctccagcgatgcggggcagtactcctctggacgtggctgccgccagcgtgatggacaacaacgagcttgcattggccctgagggagccggacctggagaaagtggtgcgttatctggctgggtgtggtcttcagtcatgccagatgctcgttagcaagggatatccagatatcggttggaatccagtggagggtgaacgttatctggacttcctccgttttgctgtcttttgcaacggggagtctgtcgaagagaatgccaatgtggtcgtgaggctcctgatccggaggcctgaatgcttcggacccgctctgcggggagaggggggcaatggtcttctcgccgcaatggaggaggccattaaaattgccgaggacccttcacgcgacggcccctcccctaattctggtagctccaagacccttgacactgaagaggaggaagacgataccatccacatgggcaatgccataatgacgttttattctgctctgatcgatctgctgggtcgatgcgcccccgagatgcatctaatacacgcgggaaagggggaggctattcgcataagaagcattctgaggtcccttatacccctgggagatctcgttggcgtgatttccatcgcctttcaaatgcccacaatcgccaaggacggaaacgttgtcgagcccgatatgagcgcaggtttctgtccagatcataaggccgccatggtcctgttcctggacagagtgtacgggatagaggtgcaggacttccttctccaccttctcgaggtgggatttttgcctgatctaagagccgcggcttccctggataccgcagcgttgagtgccaccgatatggctttagccctcaatcggtatttgtgcacagctgtcctacctcttctgaccagatgcgcgcctctttttgccgggaccgaacatcatgcgtcattgatcgactcccttcttcacacggtgtatcggttatcgaagggatgctccctgaccaaggcccagagagacagtatcgaggtgtgtctgctttctatttgtgggcagttgagacccagtatgatgcaacatctccttcggcggctggttttcgacgtgccactgcttaatgaacatgctaaaatgcccttaaaactgctcacaaatcattatgaacggtgttggaagtactactgcctccctggaggctgggggaactttggtgcagcttcagaggaagaactccacctaagtcgaaagctgttctggggcatctttgatgccctttcacaaaagaaatatgagcaggaactctttaagttagcattaccctgcctctctgccgtggcaggagctttacctccagactatatggaaagcaattacgttagcatgatggagaagcaaagttcaatggactctgaggggaatttcaatccgcagccagtcgatacatccaatattacaatcccagagaagctggagtatttcatcaataaatatgccgagcattctcacgataaatggtccatggataagttggccaacggctggatttacggcgaaatttacagcgatagttcgaaagtgcaacctctcatgaagccttacaagcttctgagcgaaaaggagaaggagatttatcgatggccgatcaaagagagcttaaagactatgctcgcttggggatggcgtatcgagcggacccgggagggtgattccatggctctttacaacaggaccaggcgcatctcgcagacctcccaggtttccgtggacgcagctcacgggtatagtcctcgcgctatcgacatgtcaaatgtgaccctcagtagagacctccatgctatggccgagatgatggcggagaactatcataacatatgggccaagaagaaaaaaatggagttagagtcaaaggggggcggaaaccaccccctgctggttccatatgatactctgaccgctaaggagaaagctaaggaccgagagaaggcccaggacatcctcaagtttctccagattaacggttatgcagttagcagaggttttaaggacttagaacttgacaccccatcaatcgaaaagagattcgcttattccttcttgcaacagttgatccggtacgttgacgaggcccatcaatatatactcgagttcgacggtggaagccgaggaaaaggggaacacttcccatacgaacaggaaatcaaattctttgctaaggtggtgctcccacttatcgaccagtatttcaaaaaccatcgactgtactttctctccgcagcgtcccgcccactgtgctccggtgggcacgctagcaacaaagagaaggaaatggtgacttctctgttttgcaagctgggcgtgcttgtgagacatcgcatttcactatttggcaacgacgccaccagcattgttaattgcctgcatattctgggacagaccctggacgctcgaacagttatgaaaaccggactggagtcagtgaagagcgcgctgcgagccttccttgacaatgccgccgaagatttggagaaaactatggaaaatctcaaacagggacagtttactcatactcgtaatcagccgaaaggtgtcactcaaataatcaactacactaccgtggccttactgccaatgttatccagtcttttcgaacacattggtcagcaccagtttggggaggatctaatcctggaagatgtgcaggtctcctgctatagaatactaactagcctgtatgccttgggcacttctaagtcaatatatgttgaacggcagagatcagccctgggggagtgcctggccgctttcgctggggcgttccccgtcgcctttctggagactcacctggataaacacaatatatacagcatatataatactaagtcttcacgcgagcgcgctgccctgtctctgcctaccaacgtggaggatgtatgccctaacatcccgagcctcgagaagttaatggaagagatcgtggaattagccgagtctgggattcgctatactcagatgccccatgtcatggaagttattctccctatgctgtgtagttacatgtccagatggtgggagcacggaccggagaataaccccgagcgggcggaaatgtgttgtactgcattgaactcagaacatatgaacacccttctgggaaatatcctaaaaatcatttataataaccttggtattgatgagggagcctggatgaagcgtctcgctgtgttctcccaacccatcatcaacaaagtcaaaccccagctgttgaagacccatttcctccccctgatggagaaactcaaaaagaaagcagccacagtcgtgtcagaggaggaccatctcaaagcagaagcccggggagacatgagcgaggcggagctccttattctggatgagtttacaacattggcccgggatctgtatgccttctatcccttgctaatcaggtttgttgactacaaccgggccaaatggctgaaggagccaaatcctgaagctgaggagctgtttagaatggtggcagaagtattcatatattggagtaaaagccacaactttaaaagggaggaacagaactttgtcgtgcagaatgagatcaacaacatgagcttcttgattacagatacaaagtctaaaatgtccaaggcagcagtttccgatcaggagaggaagaaaatgaagcgcaaaggcgatagatactccatgcagactagtctgatcgtggcagcactcaaaaggctactccctattggactcaatatctgtgcccccggagatcaggagctcattgccctggcaaagaatcgattttctcttaaagataccgaggacgaagtgagggacatcatcaggtcaaacatccatctgcagggaaagttggaagatccagctattcggtggcaaatggcactctacaaagatctcccaaaccgaaccgatgatacctctgaccccgaaaaaactgtagaaagagttctggatatcgcaaatgtgctgtttcacctcgagcagaaatctaagagagtggggcgtagacattattgcttggtggaacacccccagaggtctaagaaagcggtctggcacaagctgttgtctaagcagcggaagagagccgtggtcgcatgtttccggatggcccctctttataatctcccgagacaccgggccgttaacttgttcctacaagggtacgaaaaatcatggatcgagacagaggaacattatttcgaagataagcttatcgaggacctcgcgaaaccgggggctgagccccccgaggaggacgagggaaccaaacgggtggatccactccatcagctaattctgctttttagccgcacagcactgacagaaaagtgtaagctagaagaagatttcctgtacatggcttatgccgacattatggctaaatcttgccatgatgaggaagacgatgacggggaagaggaagtcaaatctttcgaggaaaaggagatggagaagcagaagctcttgtaccagcaggctaggctgcatgaccgaggcgccgcagagatggtactgcaaaccataagcgcctctaaaggagagacaggccccatggttgccgcaaccctgaaacttggcattgcgattctcaacggcggaaacagcacagtgcagcaaaagatgctggactatttgaaggaaaagaaggacgtaggattcttccagagcctcgcaggattgatgcagagctgtagcgttcttgatctgaatgcctttgagaggcagaacaaggccgagggattaggtatggtgactgaggagggatctggcgagaaagtgctccaagatgacgaatttacctgtgatctctttcgcttcctgcagcttctgtgtgaggggcacaattccgacttccagaattaccttaggactcagaccggaaacaatacaactgtaaacattatcattagcactgtcgactatctactgcgcgttcaagagagtatctctgacttttactggtactattctggtaaagacgtcatcgacgagcagggccaaaggaatttttccaaagctattcaagtggcgaaacaggtattcaacaccctgacagagtacattcaaggaccttgcactgggaaccagcagagcttggcccattcacgcctttgggacgcagtcgtcggatttctgcacgtatttgctcatatgcagatgaaactctcacaggacagtagtcaaatcgaactgttaaaagagctcatggatctacagaaagatatggtcgttatgctgctctccatgctggagggtaacgttgtcaatggtaccataggcaagcagatggtggatatgctcgtggaaagctccaacaatgtggaaatgatccttaagtttttcgacatgttcctcaagctgaaagacttgacgtcaagcgacacttttaaggagtacgatcctgacggaaagggcgttatctccaaaagggactttcacaaagctatggagagccacaaacactacacacaatccgaaaccgaattcctactgtcatgcgcagaaaccgacgaaaatgagaccctcgattatgaggagttcgtgaaacgtttccatgagcctgccaaggacatcggctttaacgtggccgtgctcctcaccaatctgagcgaacacatgcctaatgataccagacttcagaccttcctggagctagctgagtccgtcctgaattattttcagcctttcctcggccgcatcgaaatcatgggcagtgctaagagaattgaaagggtctacttcgagattagcgagtcctcaagaacgcaatgggaaaagcctcaggtaaaggaatcaaagcgtcagtttatttttgacgtggtgaacgaggggggtgagaaggaaaagatggaactctttgtgaatttctgtgaagatactatttttgagatgcaattagccgcccagattagcgaaagtgacctgaacgaacgctcagctaacaaagaagaatcagagaaggaacgccccgaggagcagggaccgagaatggcattcttcagtatccttactgttcgatcagccctgtttgctctccgttacaatattttgaccctcatgcgaatgctgtcactgaaaagcctgaaaaagcagatgaagaaggtgaagaagatgaccgtgaaagacatggtgaccgcattttttagcagttactggtccatcttcatgactctccttcattttgtggctagcgtgttccgcgggttctttaggattatatgcagccttctgctgggaggctctctcgttgaaggagccaaaaaaattaaggttgccgaactactggcgaacatgcctgaccccacacaggacgaagtgaggggtgatggcgaagaaggggaacgtaaacccctggaggctgctctgccctctgaggacttgaccgacttaaaggaactgacagaggagagcgatttacttagcgatattttcggccttgacctcaagcgggaagggggccagtacaagctgatcccccataatccgaacgccggcctctccgatctgatgtctaacccagtaccaatgccagaggtgcaggaaaaattccaggagcagaaggccaaggaagaagagaaggaagaaaaggaagagacaaagagcgagcctgagaaagccgaaggagaggacggtgaaaaggaggaaaaggccaaggaggacaagggaaaacagaaactgcgacaactacacacacaccggtacggagaaccagaggttcctgagtccgccttttggaagaagatcatcgcgtaccagcaaaaattattgaactatttcgcaagaaacttctacaacatgaggatgttagccctcttcgtggccttcgctatcaatttcattttgctcttctataaagtttcaaccagtagcgtggtcgaggggaaggaactgccaacccgttcctcatctgaaaacgcaaaggtgacctctctggatagctcctcccacagaataatcgcagtacactacgtcctggaggagagtagtggctacatggaaccaacactgcgtattcttgccattctgcatacagtgattagcttcttttgcatcatcggctactactgccttaaggtcccactggtcatcttcaaaagagagaaagaggtggcccgcaagctggaattcgatggtctgtacatcacggaacagcctagcgaggatgacataaagggacagtgggatcgcctggtgattaatacccaaagtttccccaataactattgggacaagtttgtgaaaagaaaagtgatggacaagtacggggagttttacgggcgggataggattagcgaactcctgggaatggataaggctgcccttgacttctccgatgcaagagagaagaagaagcccaagaaggattcttcgctgtccgctgtgttgaattccatcgatgtgaagtatcagatgtggaagctcggcgttgtgtttactgacaatagcttcttatatcttgcttggtatatgaccatgagcgttctgggacactataacaatttcttcttcgcggcccacctcctggatattgccatgggcttcaaaactctgcgcactatacttagttccgtgacgcacaatgggaagcagctagtgcttaccgtaggcctcttggctgtcgtcgtatatctctatacagtggtagcctttaatttcttcaggaagttttacaacaaatccgaggatggggacactccagacatgaaatgcgatgacatgttgacctgttacatgttccacatgtatgtgggcgtgagggccggtggcggcattggtgacgaaatagaggatccagccggcgacgaatacgagatatacaggattatcttcgatatcacttttttctttttcgtcattgtcattttgctggcaattattcagggcctgatcattgatgcctttggggagcttagagatcagcaagagcaagtgaaggaagacatggaaactaaatgctttatctgcggtattgggaatgattacttcgatacagtcccacacggcttcgaaacgcatacactgcaggagcacaacctggccaattacttatttttcctgatgtatttgatcaataaagatgaaaccgaacacacagggcaggagtcatacgtgtggaagatgtaccaggaacggtgctgggaattttttcccgcaggtgattgtttccgtaagcagtatgaagatcagttgaattag

SEQ ID NO: 204107 - DNA, 987 bp, Artificial Sequence
  Description of Artificial Sequence: Synthetic coding sequence
atggagcccaccctgcggatcctggccatcctgcacaccgtgatctcatttttctgcatcattgggtactactgcctgaaagtcccactcgtgatctttaaacgcgagaaggaagtggcccgtaaactagagttcgatggtctgtacattactgagcaaccaagcgaagatgatataaaaggacaatgggacagacttgttatcaatacccagtctttccctaataactattgggacaaattcgtgaagcggaaagtgatggacaaatacggcgagttctatgggagggatcgcattagcgaactgttgggaatggataaggcagcacttgatttcagcgatgcgagggaaaaaaaaaagccaaagaaggactcttccctgtccgccgtcctcaactctattgacgtaaagtatcaaatgtggaaactgggtgtggtctttacggataactcatttctctatctggcttggtatatgactatgtccgtcctcggtcattacaataatttcttctttgcagcccatttattggatattgccatgggcttcaagacactgcgtaccattctgtcctccgtgacacataacggcaagcaattggttttaactgtaggactccttgccgtcgtggtgtacctgtacaccgtggtggcattcaatttcttccggaagttttacaacaaatcggaagacggggacactcccgatatgaagtgcgacgatatgctgacttgttacatgttccacatgtacgttggcgtgcgcgcaggcggtggtatcggcgatgaaattgaagacccggcaggcgatgaatatgagatatatcgcattatcttcgatattacattttttttcttcgtgatcgtaattctactcgccattatacaggggcttatcatcgatgcgtttggcgaactgcgagatcagcaggagcaggtgaaagaagatatggaagtattctctgacgtgtcgtataagcagcgctag

SEQ ID NO: 204108 - DNA, 645 bp, Artificial Sequence
  Description of Artificial Sequence: Synthetic coding sequence
agcctgttctgcaagctgggcgtgctggtgcggcaccggatcagcctgttcggtaatgacgccacctcaattgttaactgcttgcatattttagggcaaactctcgatgcccgcactgttatgaaaactgggctggaatccgtcaaaagcgccctaagagctttcctagacaatgcggccgaggacctagagaagaccatggaaaatctgaagcaaggacagtttacccacacccggaaccagccaaaaggggtgactcagatcattaactatacaacagttgccctcctgcccatgctgtcttccctgtttgaacatattgggcagcaccagtttggagaggatctgattctggaggatgtgcaggtctcctgctaccggatcctcacaagcctctatgctctgggaacctctaaaagcatctatgtcgagaggcagcggagcgccctcggagaatgccttgccgcttttgccggggcttttcccgtcgcatttctcgagacacacctggataaacacaatatctatagtatttataacactaagtcgagtcgggagcgcgcagccctgtcactgccgacaaacgtggaggacgtgtgccctaacatcccatccctcgaaaaactgatggaggaaatcgtgtag

SEQ ID NO: 204109 - DNA, 4266 bp, Artificial Sequence
  Description of Artificial Sequence: Synthetic coding sequence
atgaagaccggcctggagagcgtgaagagcgccctgcgggccttccttgataatgcggctgaggatttagaaaagactatggagaacctcaagcagggacagttcacacatacaaggaaccaacccaagggagttacacagatcattaactatactaccgtggctctgttgccaatgctcagtagcctattcgagcatatcggccaacaccaatttggcgaggatctcatccttgaggacgtgcaggtttcttgttacaggatcctcacctcgctctacgccctcggcacctctaaatccatttacgtcgaacggcaaaggtcagccctcggggaatgtttggcagcttttgctggagcttttcccgtagctttcctggagacgcatctggacaaacacaacatttatagcatttataatactaaatctagtagggagcgagctgcactgtcactcccaaccaatgttgaagacgtctgcccaaatatcccatccttagagaagctgatggaggaaatcgtggagctggccgaaagcgggattcggtatacgcaaatgcctcatgtaatggaggttattctccctatgctttgctcgtacatgagtcgatggtgggaacacggcccagagaacaatcccgaaagagcagaaatgtgttgcacagcattgaactccgaacatatgaacacactgctcggcaatattctcaaaattatctacaataacttaggcattgatgagggcgcttggatgaaaagattggccgtgttttcccagcctattatcaataaggtcaagccacaacttttgaagacccatttcctgccattaatggaaaagctgaaaaaaaaagctgctaccgtggtttctgaggaggaccatctgaaggccgaggccaggggcgatatgtctgaggctgagctcctcattctggatgagttcactacactcgcgagagatttatatgccttttatccactgctgattaggtttgtcgactacaacagagcaaagtggctgaaagaacccaatcccgaagccgaagaattattccgaatggtggccgaagtgttcatttactggtctaagtcccacaatttcaagcgggaagagcaaaacttcgtggtgcagaacgagataaacaacatgagctttctcattacagataccaaaagtaaaatgtctaaggcagctgtctctgatcaggagagaaaaaagatgaagagaaagggagatcggtatagcatgcagacttccctgatagtcgcagcacttaagcgattgctacccatcggcttgaacatttgtgcacccggagaccaggagttgattgccctagccaaaaatagattttccttgaaggatacagaggacgaggttcgcgatattatccgctcgaatatacacttgcagggaaagctcgaggatcccgctatccgctggcaaatggccctctacaaggaccttcccaacagaacggatgacacttccgacccagagaaaactgtcgaacgcgtgttggacatcgctaatgtgttgtttcatctggagcaaaagagtaagcgtgtggggaggcgccactactgtctggttgagcacccccagcggtccaaaaaagctgtatggcacaagctgctgagcaaacagagaaaacgggcagtcgttgcctgcttcagaatggcccccttgtacaatttacccagacacagggctgttaatctgtttctccagggctatgagaagtcgtggatcgaaaccgaggagcactattttgaggacaaattgatagaggatctggcaaagcccggggctgagcctcctgaagaggacgaaggtacaaagagggtcgatccactacaccagctcatcttactctttagcagaaccgctctcaccgagaagtgtaaactcgaagaggatttcttatacatggcctacgcggatatcatggctaaaagctgccacgatgaggaagatgatgatggagaggaagaggtcaaaagttttgagcacgacattattaaggacttacgcaacaagttcgcctcgttgggcgaaaacagtctggagaaggagatggagaagcagaagctgctgtatcagcaagcccgcctgcacgataggggggcggccgagatggtccttcaaacaataagcgcttcgaaaggagaaaccggtccaatggttgcagccacactcaagctgggtattgccatcctgaacgggggcaacagtacggtgcagcagaaaatgctcgactaccttaaggaaaaaaaggacgtgggcttcttccaatcactcgcagggctgatgcagagctgcagcgtgttggatctgaatgcattcgagcgccaaaacaaagcagaagggctgggaatggtgaccgaggaaggctccggagaaaaggttttacaggatgacgagttcacttgtgacttgtttcgttttctgcaactgttatgtgaggggcacaattcagactttcagaactatttgcggacacagaccgggaacaacaccaccgtcaacataatcatcagcactgtggattatttgctcagggtgcaggaatccattagtgacttctattggtattacagcggcaaagacgtcattgatgagcagggacagaggaatttctccaaggctatccaagtcgctaagcaggtcttcaacacactgactgaatacatacagggtccgtgtacagggaaccagcagagtttggcccactcgcggctgtgggacgctgtagtgggctttttgcacgtatttgcacacatgcagatgaagttatcgcaggacagctcacagattgaactgctgaaagagctgatggaccttcagaaagatatggtcgtcatgctgctgagtatgctggaagggaacgtcgtgaacggcactatagggaagcagatggtggatatgctggtagagtcctcaaataacgttgagatgattctgaagttttttgatatgtttctcaagctaaaagatctgactagctcagacaccttcaaagagtatgatcccgatggcaagggggtcatttctaagcgggattttcataaggcgatggagagccataaacactatactcagtccgagaccgagttcctattgagttgtgcagaaacggacgaaaacgaaacacttgactacgaagaattcgttaaacgcttccatgaacccgctaaagacatagggttcaatgtcgctgtacttctgactaacctatccgaacacatgcctaacgatacccggctccagacttttcttgagcttgcggaatcagtcttaaactatttccagccgttcttgggtcgcatagagattatgggctcggcaaaacggatcgagcgggtgtacttcgaaataagtgagtccagcagaactcagtgggagaaacctcaagtgaaagaaagcaagcgtcagttcatattcgacgtggtaaatgagggaggggagaaggagaaaatggagctctttgtcaacttttgcgaggacactatcttcgaaatgcagcttgcagcccagatcagcgaatcagacctaaatgaaaggtccgccaataaagaagagagcgagaaagagcgccctgaggaacaaggaccccggatggccttcttcagtatcctgacggtaagatccgccctcttcgcccttcgctacaatattttaaccttgatgaggatgctgagtctgaagagcttgaagaagcagatgaagaaagtgaagaaaatgacagtcaaagacatggtgaccgcctttttttcctcctattggtcgatattcatgacccttctgcactttgtcgcctcagtgttccgaggattcttcaggataatctgctccctgctgctaggtggttccctcgtggagggagctaaaaaaataaaagtagccgaactgttggccaacatgcccgaccctacccaggatgaagtcagaggcgatggagaagagggagagcgcaagcccctggaggctgccttgcccagtgaagacctcaccgatcttaaggagctgactgaggagagcgatttactgagcgacatctttggtttagacctgaagcgcgaggggggacagtacaaactaatcccacacaatcctaacgcgggcctgtctgacctcatgtcgaaccctgtgcctatgccagaagtgcaggaaaaattccaagaacagaaagccaaagaagaagaaaaggaagagaaagaggagacgaagagcgagccagagaaagccgagggcgaggacggctag

SEQ ID NO: 204110 - DNA, 14856 bp, Artificial Sequence
  Description of Artificial Sequence: Synthetic coding sequence
gacgacgaggtggtgctgcagtgcaccgccaccatccacaaggagcagcagaaactgtgtctcgctgcggaagggtttgggaaccgactgtgtttcctggaatcaaccagcaattccaagaatgtgccacctgatctgtctatttgcacctttgtgttggagcagagcctcagcgtgcgggccctacaggaaatgctcgccaacacagttgaaaagtcagaaggtcaggtggacgtggagaagtggaaattcatgatgaaaaccgcccaagggggggggcaccggactcttctgtacggccatgctatcctgctgcggcactcgtattccggaatgtacctatgctgcctctccacttctaggtcaagtaccgataagcttgcttttgacgtgggcctgcaggaggacaccaccggagaggcctgctggtggacaattcaccctgcgagcaaacagcgcagcgaaggtgaaaaagtgcgcgtgggggacgacttaattctggtgtccgtaagtagtgaaaggtacctccacctaagttacggcaacggctccttgcacgtcgatgctgcttttcagcagaccctctggagtgttgctccgatttccagcggctcagaggccgcgcaggggtacctgattggcggagacgtgcttcggctgctccatgggcatatggacgagtgcctgacagtgccctctggcgagcacggtgaggagcagcggcggactgtgcattacgaaggcggcgctgtcagcgtgcatgctcgcagcctatggcgcctggagaccctgagagttgcgtggtcagggtcacacattaggtggggccagccgtttaggctgcggcacgtgactaccgggaagtatctaagcctgatggaagataaaaatttgctgctgatggataaggagaaagcagacgtaaaaagcactgcatttacctttagaagctccaaggaaaaactggatgtcggggtccgtaaagaagtggacggaatgggcacttctgagataaaatatggcgacagtgtgtgttatatccaacacgtggacacgggactatggcttacctatcaatctgttgatgtcaagtcagtaagaatgggcagtatccagcggaaggctatcatgcaccacgagggccacatggacgatgggataagtctgtcaaggtcacaacatgaggaatcgcgtacagcgagggtgatccgttctactgtcttcctgttcaaccggtttattcgggggcttgacgctctgtccaaaaaagccaaggcttcaacggttgacctgccgattgagtcagtctcccttagtcttcaagacctgatcggctacttccatcctccagatgaacacttagaacatgaggacaaacaaaatcgactcagggccttgaaaaaccgccagaatctgttccaggaggaaggcatgatcaacctggttctggagtgcatcgatcgtctgcacgtttacagttccgcggcacacttcgccgacgtggccggcagggaagccggagagtcatggaagtctatcctcaattctctttacgaacttctcgccgccctgattagaggcaaccgcaaaaattgtgcgcaattttcaggatccctggattggcttatcagtcgtctcgagaggctagaggcgagctcaggaatcctggaggttctgcactgcgtactcgtggagagccccgaggctctgaacataattaaagagggtcacatcaagtctataatcagccttcttgataaacatgggagaaatcataaggtgctagacgtgctctgttctctgtgcgtgtgtcacggcgttgcagtgaggtctaaccagcacctgatatgtgacaacctgctgcccgggagggacctgcttttacagacgaggctggttaaccatgtttcttcgatgagaccgaatatttttttaggcgtgtcagaaggctccgcccaatataagaagtggtattacgaattgatggtggaccacacggaaccattcgtgactgcagaggccacacatttaagagtgggttgggcctccaccgaaggctattctccctacccaggcggcggagaggagtggggtggaaatggagttggggatgacttattcagttacgggtttgacggccttcatctctggagcggctgcatagcccgcacagtgagttctcccaaccaacacctcttgcgaacagacgacgtgatctcctgttgcctggacctatccgcgccatcgatcagttttcggataaacggacagcctgtccagggcatgttcgagaatttcaacattgatggccttttcttccctgtagtatccttttcagctggtataaaggtcaggtttctcctcggcggccgccatggcgaattcaagttcctgcctccccccgggtacgccccttgttacgaagcagtcctacccaaggagaagctcaaggtggaacattcaagggagtacaaacaggagcggacctatacccgcgatctcctcgggcccacggtgagcctgacacaggcggcttttacccccattccggttgacacatctcagattgtgctccctccccatctcgagaggatccgggagaaactggctgagaacattcatgagttatgggtgatgaacaaaattgagctgggttggcagtatggccctgtgcgcgacgacaacaaacgccagcacccatgtctggtggagttcagtaaactacccgagcaggagaggaattataaccttcagatgtcattggagactttgaaaactttgctcgctctgggttgtcatgtcgggatctccgacgaacacgcagaagataaagtgaaaaaaatgaaactacccaagaattaccagctgactagcgggtataaacctgcacctatggatctgtcttttatcaaactgaccccctcacaggaagctatggttgacaaattagcggaaaatgcccacaatgtgtgggcccgtgaccgtatccgccaaggttggacttacggaatccagcaagacgtcaagaacaggcgcaatccccggttagtcccctataccctgttggatgatcgcaccaagaaatcaaataaggattctttgcgcgaagctgtgcggaccctgctcggctatggatacaatctcgaggcaccagaccaggatcacgctgcccgagctgaagtgtgtagtggcactggcgagagatttagaatatttcgagctgagaagacgtatgcggttaaggcaggacggtggtattttgagttcgagacggtgacagccggcgatatgcgtgtcggctggtccaggcccggctgccaacccgatcaggagctggggtcagatgaacgtgcgtttgctttcgatgggtttaaagcgcaaagatggcatcagggtaatgagcactatggtagaagctggcaggccggcgacgtggtaggctgcatggtggacatgaacgagcacacaatgatgttcaccctgaacggggaaatactgctggacgacagtggttctgagctcgctttcaaggatttcgatgtgggggatggattcattcccgtgtgcagcctcggggtggcacaggtcggacgcatgaacttcggaaaggatgtgagcacactgaaatatttcactatctgtggcctgcaggaagggtatgagccttttgcagtcaatactaatcgggacattaccatgtggttgagtaaacggttaccgcagttcctacaggtgccatctaatcacgagcacattgaggttactcgaatcgatggtactattgacagctccccttgcctgaaggttactcagaagtcgtttgggagccaaaactcaaatactgatatcatgttctacaggctcagcatgccgattgagtgtgctgaggttttttctaaaactgtggctggggggctaccgggcgccggcctctttggacctaaaaacgacctcgaggactatgatgctgattctgatttcgaagttttaatgaaaaccgctcacggacatctggtgcccgaccgggtcgataaagataaagaggccactaaaccggaatttaacaaccacaaagattacgcacaggagaaaccctcccgcttgaagcagcgttttctgctccgacgaactaaacccgattactcaaccagccactctgcccgattgacggaagatgtcctagccgatgatcgcgatgactacgactttctgatgcaaacatctacatattattattccgtgcgtatctttccaggccaggagcccgctaacgtctgggtgggttggattacttctgacttccatcagtatgataccggatttgacctggaccgagtgcgtacagttaccgtgaccctgggcgacgaaaagggcaaggtccatgagagtattaagcgctcaaattgttacatggtttgcgccggtgagtcaatgtcccctggacaggggcggaataataatggacttgagataggatgtgttgtggacgcagccagcggactgctcacttttatcgccaatggtaaagagctgagtacttactaccaggtggaacccagcaccaagctgttccccgcagtgttcgctcaggcaacctctcccaatgtgttccaattcgagctcgggcgcatcaagaacgtcatgcccttgtccgccggtctgtttaaaagcgaacataagaaccctgtgccacagtgtcccccccgactccacgtgcaatttttgtctcatgttctgtggagtcgtatgcccaatcagtttcttaaggtggacgtgagtcggatctccgagaggcaagggtggctcgtccagtgcttagaccctcttcagtttatgagtctgcacattcctgaagagaatagaagtgtggatatcctcgagttgacagagcaggaagaattgctcaaatttcattaccacacccttagactgtacagcgcagtatgcgcactgggcaatcacagagtagctcatgcactgtgctcccacgttgacgaacctcaactgctgtacgccattgagaacaagtacatgcccggtcttctgcgagcaggctactatgacctgctcatagatatccacctgtccagctatgcaaccgcccgacttatgatgaataatgagtacattgtgcccatgacagaggagacaaagagcataaccttgttccctgatgagaacaagaaacacgggctccctggaatcggcctgtcaacgtcattgaggcctcggatgcagttttcaagcccctcctttgtcagcatcagcaacgaatgctatcagtactctcctgagttccctctggacatcctgaaatcgaagacaattcaaatgctgacagaggccgttaaggaaggtagcttacacgcaagggaccctgtcggtggcaccaccgagttcttgttcgtcccactgattaaactgttctatactctgctcattatgggaatttttcacaatgaggaccttaaacatattctccaattgattgaaccaagcgtgtttaaagaggcagctacacctgaagaggaatcagataccctcgagaaagaattgagcgtcgacgacgccaagctgcagggggccggagaggaagaggccaaagggggcaagagaccgaaagagggactactccagatgaaattgcctgagcctgtcaagttacagatgtgcctgttgctgcagtacctctgcgactgtcaggtccgccatcgtattgaagccattgtagctttctccgacgactttgtcgctaaactacaagacaatcagcggtttcgatataacgaggttatgcaagcgctgaatatgtctgcggcacttacggccagaaagacaaaggaatttcggtcgcctccgcaagaacagattaacatgctactaaattttaaggatgacaagagtgagtgtccctgtccggaggagataagggatcagctattggacttccacgaggacctcatgacccactgcggtatcgagctggatgaggacggcagcctagatgggaactctgacctgaccataaggggaaggcttttgagccttgtcgagaaagtgacctacctgaagaaaaagcaggccgagaaaccagtggaaagtgatagcaaaaaaagtagtactttgcaacagctaatttcagagaccatggtacgatgggcccaagagagcgtgattgaggaccccgagctggtgagggcgatgtttgtgctgctgcaccgtcaatacgatgggataggaggcctggttagggccttaccaaagacctacactatcaatggagttagtgtggaggacacgattaatctgcttgcttctcttggtcagatccgctctttgttatccgtcaggatgggcaaggaggaggagaagcttatgataagaggactcggggacattatgaacaataaagtcttttatcagcaccctaatctcatgagagccctgggtatgcacgagacagtgatggaagtgatggtcaatgttctgggagggggagagagtaaggagatcaccttccctaaaatggtggccaattgttgccggtttctctgctacttctgtcgcatctccaggcagaatcaaaaggctatgttcgatcacctgtcgtatctgctggagaactctagcgtgggcctggcatcccccgcaatgcgcggtagtacgccgctggatgtggccgcagcgtccgtaatggataataacgaactggctctggcactgagggaacccgatctggagaaggtagtgcggtatcttgccgggtgtggtctgcagtcatgtcagatgcttgtgtctaaagggtatcccgacattggatggaacccagtcgaaggtgagaggtatctggatttcttgcgcttcgccgtgttttgtaacggcgagtcagtcgaagaaaacgcaaacgtggtggtaaggctgttgattcggcgcccagagtgtttcggaccagcccttaggggagaggggggtaacgggttactggcagcaatggaggaagcaattaagattgcagaggatcctagccgggatggcccctcccctaattcgggtagttcaaaaaccctggatacggaagaggaggaagacgacactatccacatgggaaacgcaatcatgacattctactcagcattgatagacttactgggtcgatgcgctcctgaaatgcatctcattcacgccggaaaaggcgaagctatcaggatccgctctattttgcgctcccttatacctctgggggacctggtgggggtcatttccatcgcgtttcagatgcccaccatcgctaaggacggcaacgtggtcgagccagatatgagcgccggattttgtcctgaccataaggcagcaatggtgctgtttctagacagggtctacggcatcgaagttcaggatttcctccttcaccttcttgaagttggttttctgccagacttaagggcagccgcgtccctggacacagccgccctgtctgctacagatatggccctggccctgaatcgatatctatgcacagccgtccttccactcctcactagatgtgcacccctgtttgctgggactgagcaccacgccagcttgattgacagtttgttacacactgtctacagactgagtaaggggtgctctctgaccaaggcgcagcgcgacagtatcgaagtatgcctgctttctatctgcggacaactcaggccatccatgatgcagcatctgctgcgtagattggtgttcgacgttccactcctgaatgagcacgccaagatgcccttaaaattgctgacaaaccattatgaaaggtgctggaaatattattgccttcccggtggctggggcaactttggtgctgcatccgaggaggaactgcatctgagtagaaagcttttctggggaattttcgacgcactttctcagaagaaatatgagcaggagctgttcaaactagcccttccatgtcttagcgccgtggccggggcgcttccccctgactacatggagtctaactatgtcagtatgatggaaaagcaatcatcaatggattctgagggcaacttcaatccccagcccgtcgatacatccaatatcacaattcccgagaaactcgagtactttatcaataagtatgccgagcattctcacgacaagtggagcatggataagttggccaatggctggatttacggggaaatttatagtgactctagtaaggttcagcccctcatgaagccttacaagctcctatctgaaaaagaaaaggagatttacagatggcctatcaaagaaagtcttaaaaccatgttggcatggggttggagaattgagaggactcgggaaggcgacagcatggccctgtataaccggaccaggcgtatcagccagaccagccaagtgtcagtggacgccgcacacggatatagtcctcgggcaatcgatatgagcaatgtgaccctcagcagggacctgcacgccatggccgagatgatggccgaaaactaccataacatctgggccaaaaagaaaaagatggagctggaatccaaagggggggggaatcatccccttctggtaccctacgatactctaaccgctaaagagaaagctaaggatcgggagaaggcccaggatatcctaaaatttctccagatcaacggttatgctgttagccgaggatttaaggatctcgagcttgataccccgtccatcgaaaaaagatttgcctattcctttctgcagcagctgatcagatatgtagatgaagcacatcagtacattcttgagtttgatggcggttcccgaggcaagggggaacactttccctacgaacaggaaattaaattcttcgctaaggttgttttacctctgatcgatcagtatttcaaaaatcaccggctctactttctcagtgccgcaagccggccattatgcagtggcggtcacgcttcaaataaggagaaagagatggtgactagcctattttgcaaattaggcgtcttagtcaggcatcgcatctcactgttcggcaatgatgcgaccagcatcgtcaattgtctgcacatcttggggcagacgctcgatgcacggaccgttatgaaaactgggctcgagtccgtcaaaagcgccctgcgggcattcctcgacaacgcagcagaggatctcgagaagacaatggagaatctaaaacaagggcagtttacccatacgaggaaccagcctaagggggttacacaaatcataaattacacaacagtggcattactgcccatgctgagttctctttttgagcacatcggccagcatcagtttggtgaggatctcattctggaagacgtgcaagtgagctgctatcggatccttacctctctctatgccttgggcacgagcaaatctatttacgtcgagcgacaaaggtctgctctcggggaatgtcttgccgctttcgcaggtgccttccctgtagcattccttgagactcaccttgacaaacataatatttactcaatctataatactaaaagttcgcgcgaacgggccgccctctctctgcctaccaatgtggaggatgtctgcccaaatataccctccctggaaaaactgatggaggaaattgttgaactagccgaaagtggaattcgctatacacagatgcctcatgtgatggaggtgatcctcccaatgctttgttcctatatgagccggtggtgggagcatggtccagagaacaacccggaaagggcagagatgtgttgcacagcactcaacagtgagcacatgaacaccctcttagggaacatcctgaagatcatctataataacctgggaattgatgaaggtgcctggatgaagcggctggccgtcttctcccagcctataatcaataaagtgaagccccagctgcttaagacacacttccttccgcttatggaaaaactgaaaaagaaagcagccactgttgtgagtgaagaggatcatctgaaggctgaagcccgaggtgatatgtctgaggctgagctccttatcttggatgagttcacaactttagcccgtgacttatacgctttttaccctttattgattcgtttcgtcgactacaaccgggcaaaatggctgaaggagccaaaccccgaggccgaagaactttttaggatggtggctgaagtgttcatttactggtctaagagtcataactttaaaagagaggagcagaacttcgtcgtccagaatgagattaataacatgtctttcctgatcaccgacaccaaatctaagatgtcaaaggccgctgtatctgatcaagagagaaagaaaatgaagagaaagggcgacaggtactccatgcagacaagcctgatcgtggccgccctgaagcgtttgctccctatcggccttaatatctgtgcacccggagaccaggagctaattgccttagccaaaaaccgttttagtctgaaggacacagaggacgaggttagggacataattaggagcaacatacatcttcagggcaaacttgaagatcctgctatacgatggcagatggcactatacaaagacttgcctaatcgcacagacgatacttctgatccagaaaagaccgtggagcgggtgctggatatcgccaatgtcctgtttcatctcgaacaaaaatcaaagcgggttggacgccgccactattgcctagtggaacacccccaaaggagtaagaaggctgtgtggcacaaactattgtccaaacagcgcaaacgcgccgtggtcgcctgtttcagaatggcaccattgtacaatctgccccgacaccgggctgtgaacctctttttgcagggctacgagaagagctggatcgagacggaagaacactattttgaagacaaactgatcgaggacctcgctaaaccaggagcggaaccccctgaggaagatgagggcacgaagcgcgtagaccccctccaccaacttatcctgctgttttctagaactgccctgacggagaagtgtaagctggaagaggacttcctctacatggcttacgctgacattatggctaaaagctgccacgatgaagaagacgacgatggggaagaggaggtaaaaagtttcgaagagaaagagatggaaaagcagaagctcctttaccagcaagcgaggcttcacgacagaggggctgcagaaatggtgctccagactatttccgctagcaagggcgagacaggtcctatggtagccgccactttgaagttgggaattgcgattctgaacggcgggaatagcacagtccagcaaaagatgctcgattatttgaaagaaaagaaggatgtgggcttcttccagtcactggccggattgatgcagagctgctcagttttagacctgaacgcatttgagcgtcaaaacaaagctgaaggactgggtatggtgacagaggagggaagcggagagaaggtcttacaagatgacgagtttacttgcgatctgttccgctttctgcagctgctgtgtgagggccacaattccgacttccaaaactatctcagaacacagaccggtaataacaccactgtcaatattattataagcacagtggactatcttctgagagtccaagagagtattagtgatttctactggtactacagtggcaaggatgtcatcgatgaacagggccagcgcaatttttccaaagccattcaagtggcaaaacaggtgttcaacacgttgacagagtatattcagggcccctgcaccggaaatcagcaatcactggctcactcgcgtttgtgggatgctgtcgttgggttcctgcacgtcttcgcccacatgcagatgaagctgagccaggattcatctcagatcgagctcctgaaggaattgatggatctgcagaaagatatggtggtgatgcttttgtctatgctcgaggggaacgtagtgaatgggaccatcggaaagcagatggtggacatgctggtggagagttctaataacgtcgagatgattctgaaatttttcgatatgtttctgaaattgaaggatctgacaagctctgatacatttaaggagtacgatccagatgggaagggagtaattagcaagagagactttcacaaagcaatggagagccacaaacattacactcagagcgagactgagttccttctgtcttgtgccgaaacggatgagaacgagaccttggactacgaagagtttgttaaacggtttcacgagcctgcaaaagatattggtttcaacgtcgcagttctgctgacaaatctgtctgagcatatgccaaacgacacccggctgcagacgttcctggaactcgcggaaagcgtgctcaactatttccagccatttctaggacgaattgagatcatgggaagcgcaaaacgcatcgagagagtgtacttcgaaatttccgagtcgtcgcggactcaatgggagaaacctcaggtcaaagaatcaaagcgccagttcatcttcgacgtagtaaatgaaggtggagaaaaggagaagatggaactctttgtcaatttttgtgaggacactatctttgagatgcaactggctgcacagatatctgagtcggatctgaacgaaagatcagccaacaaagaagagagtgaaaaggagagacccgaggaacaaggaccccgaatggcctttttctctatcctgacagtccgatccgcgctgttcgctctgaggtacaacatattgaccctcatgagaatgctgtccctgaagagcctaaaaaagcagatgaaaaaggttaaaaagatgacggtcaaggacatggtgaccgccttttttagcagctactggtccattttcatgaccttgctgcattttgtggcttcggtctttcggggcttcttcaggatcatttgctctctgctcctcggtggcagtctcgtagaaggggccaagaagattaaagtggccgagctccttgcaaatatgccagaccctacccaggatgaggttcgtggtgatggagaagaaggggagagaaaacctttagaggccgccctgccttccgaagacttgacggatcttaaggaattgaccgaagagtccgatttactgtctgatatttttggcctggatctgaagcgtgaagggggacagtataaactcatcccccacaatcctaacgccggcctgagtgatctcatgagtaacccagtaccgatgccagaagttcaggaaaaatttcaggagcaaaaagcgaaggaggaagaaaaagaagagaaggaggagaccaaatcagaacccgaaaaggcggaaggggaagacggcgaaaaggaggagaaagcgaaggaagacaagggtaagcagaaactgagacagcttcacacccacaggtatggagagcccgaagtgccggagtccgccttttggaagaaaattattgcttatcagcagaaattgcttaattactttgctagaaacttttacaacatgagaatgctggccctatttgtagcttttgccattaatttcattctcctcttctacaaggtgtccacctcatccgtcgtcgaaggaaaggaactgccgacaagaagcagcagtgagaatgccaaagtcacatccctagactcatctagccacagaatcattgccgtccactatgtcctcgaggaaagcagtggctatatggagcccactctgagaatccttgcgatacttcacaccgtgatcagcttcttttgcatcatcggatactactgcctgaaggtgcctctggtcatctttaagcgcgagaaggaagttgctcgaaaacttgagttcgatggcctgtacattacagagcagcccagcgaggatgacattaagggacagtgggatcggctcgtgattaacactcaatcctttcctaataattactgggacaagttcgtcaaacgaaaggtgatggataagtatggggaattttacggtcgagacaggattagcgaattgctgggcatggacaaggccgccctggattttagtgacgccagagagaaaaagaagcctaagaaggactcaagtctgtccgctgtcttaaattctatcgatgttaaataccagatgtggaagttaggggtggtcttcacagacaattctttcctttatctggcctggtacatgacaatgtccgtcctcgggcactataacaactttttctttgcagctcacctgctagacatcgccatgggttttaaaactctccggacaatcctgtctagcgttacccataacgggaagcaactcgtgctaacagtgggacttctcgcagttgtggtgtacctgtatacagtcgttgcctttaatttctttcggaagttttataacaagagtgaggacggggacacgcccgatatgaaatgtgacgatatgcttacatgttatatgttccacatgtacgtaggcgttagagcaggaggcggaatcggcgacgaaattgaggaccccgccggggacgagtacgagatctaccggatcatcttcgatatcaccttctttttcttcgtcattgtgatcctcttggccataatccaggggctcatcatcgacgccttcggggagcttcgcgatcagcaggaacaggttaaagaagacatggagaccaagtgctttatctgtggaatcggcaatgattactttgatacagtgccacacggattcgagactcacacgctgcaagaacacaatctcgccaactacttgtttttcctcatgtacttaataaacaaggacgaaaccgagcacacaggccaagagagctacgtctggaaaatgtaccaggagcggtgttgggagttttttcctgcaggtgactgctttcgaaaacaatatgaggatcagctgaactag

SEQ ID NO: 204111 - DNA, 14601 bp, Artificial Sequence
  Description of Artificial Sequence: Synthetic coding sequence
atggccgagctgggcggcggcggcgaggaggacgcccggtggtacagaaaagaggacgaagttgtgcttcagtgcatagctaccatccacaaggaacagcggaagttctgtctggctgctgaaggccttggcaaccgactttgttttctagagccaactagcgaggcaaagtatatcccgcccgacctgtgtgtatgcaatttcgtccttgagcaaagcctgtcagttcgcgctttgcaggagatgctggcgaatacaggtgaaaacggcggggagggagctgctcagggagggggacacaggaccctgctgtatgggcatgccgtcctgctgcgccacagtttttcagggatgtatcttacctgcctgacaacttcgaggagtcaaacagataaactcgctttcgatgtggggctccgcgagcatgccacaggcgaagcgtgctggtggactatccaccccgcatcaaagcagcgatccgagggcgaaaaggtcagaattggagatgacctgatcctggtgagtgtgtcatccgagcgttatctgcacttgagcgtatcaaatggcaacatccaggtcgacgctagctttatgcagacattgtggaacgtgcaccccacgtgttctggcagctccatcgaagaggggtacttattagggggtcatgtcgtgaggctctttcatggtcatgacgagtgcttgacgatacccagtaccgaccagaatgattcacagcacagacgcattttttacgaagcagggggcgccgggacccgagctagaagcctctggcgcgtcgagccactgaggatcagttggtctggctcgaacattcggtgggggcaagcgttcaggttacggcacctgactaccggtcattacttagcattgacagaggatcagggcctgattctgcaggaccgagctaagtcggataccaagagtacagctttcagctttagggcctccaaagagctcaaggagaagctggattcttctcacaaaagggacattgaagggatgggggtgccagaaatcaagtacggcgactccgtttgctttgtgcagcacatagcttcagggctgtgggtcacatacaaagcacaggatgcaaagacttctaggctgggtccccttaaaaggaaggtgattctgcatcaagagggacatatggatgatgggttgacactccagcgatgtcaacgagaggagtcacaggctgctagaattatacgcaatacaacagccttattttctcagtttgtgtccggcaacaacaggaccgcagccccgattaccttacccatagaagaggtactccaaacactgcaggacttaatcgcatactttcagcctcccgaagaggaaatgagacatgaggataagcagaacaagctgaggtcccttaagaacagacagaacttgttcaaagaagaaggcatgctcgctttggtgcttaactgcattgataggttgaatgtgtacaatagcgtcgcacacttcgcaggaatcgcaagggaggagagcggcatggcctggaaagagattctcaatctcctgtataagctcctggccgccctcatacgcggtaaccgaaacaattgtgcacagttctctaacaacctggactggcttatctcaaaactggacaggctcgaatcctcaagtgggatcttggaggtgcttcattgcatcctaaccgagagccctgaggccctgaatctcattgcagaaggccacatcaaatccatcatatccctcttggacaagcacggcagaaatcataaggtcctggacattttgtgttctctatgtctgtgcaacggggtcgccgtcagagccaatcaaaatctgatttgcgataatttgctgccccgccgaaacctcctgttgcagactagactgatcaacgacgttacctccatccgtcccaatatcttcttaggagtcgccgaggggtccgcacagtataagaagtggtactttgaacttatcatcgaccaggttgacccttttctcacagctgagcccactcacttgcgggttggttgggcctcctcttcaggctatgcaccttaccccggtggcggggagggttggggagggaatggcgttggggatgatctgtactcctatggttttgacgggttacacctctggtcaggccgcatcccacgggcagtggcaagtattaatcagcatctgcttaggagcgatgacgtggtgagctgttgcctggacctcggcgtcccgtccatctcatttagaatcaacggtcagcctgttcaggggatgtttgaaaatttcaatacagacggtttgttctttcccgtcatgtcgttctcagccggagtcaaggtgaggtttttaatgggcggcagacacggtgaatttaagtttcttcctcccagcggatacgccccttgttatgaggctctactgccaaaggagaaaatgaggctcgagccagtgaaagaatataaacgggacgctgacgggattcgggacttactggggaccacccaattcttgtcacaggccagctttatcccctgccctgttgatactagtcaagtgattctccccccccatcttgagaagatacgggaccggcttgcggaaaatattcacgaactctggggcatgaacaaaatcgagctggggtggactttcgggaaaattagggatgataataagaggcagcacccgtgtcttgtggaattttcaaaattaccagagacagagaagaactataatctgcaaatgtccaccgaaacacttaaaacactgctggccctgggatgccacattgcacatgtgaacccagctgcagaggaagatttaaaaaaagtcaaactgccaaaaaattacatgatgagcaacgggtataagccggctccgctcgatctgagtgacgtaaagttgctccctccacaggaaatcctggtggacaaactggcagagaacgctcataatgtgtgggcgaaggaccggattaaacaagggtggacatacggtatccagcaggacctcaaaaacaagcggaaccctcgattggtcccatacgctcttctggatgaacgtaccaaaaagtctaatagggattctttacgagaggccgtgaggacttttgtgggttatggctacaatattgaaccctccgaccaggaactcgctgattcagccgttgagaaagtgtcaatcgacaaaattcgattcttccgagtggaacgtagctacgctgtgcgcagtggaaaatggtacttcgaattcgaggtagtgactggaggagacatgcgggtaggctgggcacgccctggttgccgcccagacgtcgaactcggggcagacgaccaggccttcgtgtttgagggcaatcggggtcagaggtggcaccaaggcagcggctactttggacggacctggcagcccggtgatgtggtcggttgcatgattaatctcgacgacgcctcaatgatattcaccctgaatggggaactgttaattacgaataaaggttcagagctagcttttgctgactatgaaattgagaatggttttgtaccaatctgctgcctggggctgagccagattggacgcatgaatcttgggaccgacgcatccacctttaagttttatacaatgtgtggtctgcaggagggctttgagccatttgccgtgaacatgaatcgcgacgtcgctatgtggttctcaaaaagattgccgaccttcgtgaacgtgcccaaagatcacccccacattgaagtcatgcgcattgatggcacaatggatagcccaccgtgcctgaaggtgacccacaaaacgttcggcacacagaattcaaacgcagatatgatttattgccgtctgagtatgccggtcgaatgccactcatcattttcacacagcccttgcctcgacagtgaggcattccagaagagaaagcagatgcaggaaatactctcacatacaactactcagtgctattacgccatccggatctttgctggacaggatcctagctgcgtctgggttgggtgggtcacccctgattaccatctgtatagtgaaaagtttgacctcaataagaattgtaccgtcaccgtgaccctcggcgacgagagaggacgagtacatgagagtgtgaagcgctccaattgttatatggtttggggcggagacatagtggctagttctcagcgcagcaaccggagcaatgtcgacctggagatcgggtgtctagtggatttagctatgggtatgctgtccttttccgccaatggtaaggagcttgggacatgctaccaggttgaacctaacacaaaagtcttcccggctgtgttcctgcagccgacttccactagcttgtttcagtttgagctgggaaagctaaaaaacgcaatgccactgagtgctgctatattcagatccgaggaaaaaaaccccgtgccccagtgtccccctaggctcgatgtgcagaccatccagcctgtgttgtggagcagaatgcccaattcatttttgaaagtagaaacggaacgggtttccgagcgccacggatgggtggtccagtgcctggagcctctgcagatgatggccctacatatcccagaagagaacaggtgcgtggacatactcgaactttgcgagcaggaggacctgatgcggttccactatcatacactcagactgtattctgctgtctgcgctctggggaatagtagagtggcgtacgcattgtgctctcacgtcgacctgagccaattgttctatgccatagataataagtacctgcctggactgctacgatccgggttttacgatctgttgatcagcattcacctggcatcagcgaaagaaagaaaactgatgatgaagaacgaatatattatccccatcacttctaccacgcgcaatattcgcctttttcctgacgaaagcaaacggcatgggctcccaggtgtgggactgcggacttgcttaaaacccggattcagattcagtaccccttgcttcgtcgtgaccggcgaggaccaccagaagcagtcgccagaaattcccttggagtcccttaggaccaaggctcttagtatgcttactgaggctgtgcagtgcagcggagcccacatcagggatccagtcggaggcagtgttgagttccaattcgtgcctgtgctaaaactcataggtacactactggtgatgggcgtatttgacgacgacgacgttaggcagattctccttttaatagatccttccgtgtttggcgagcactcagccggaaccgaggagggggccgagaaggaggaagtgactcaggttgaagaaaaggccgtggaggccggcgaaaaagcgggaaaggaggcacccgtgaagggccttcttcagacacgcttaccggaatccgtaaagctgcagatgtgtgaactcctttcctacctatgtgactgtgaattgcaacaccgagttgaagctatcgttgcttttggcgatatctatgtatctaaactacaggccaatcaaaaattcagatataacgaattaatgcaggctcttaatatgagtgcggcactcactgctaggaagaccaaagagttccggagcccgccacaggaacagatcaacatgcttcttaattttcagttgggcgagaattgcccttgtccggaagaaattcgggaagaactctatgatttccatgaagatttgctcctgcactgtggggtccctttggaagaggaggaggaagaagaggaggacacttcttggaccggaaagctgtgtgccttggtgtataagataaagggccccccaaagccagaaaaggagcagcctactgaagaggaggagcggtgcccgacaacgcttaaggagttgatttcccaaacaatgatctgctgggcacaagaggaccagatacaggactccgaactggtaagaatgatgttcaacctgctgaggagacaatatgactccatcggagaactgctgcaggctttgaggaagacctacaccattagtcatacaagcgtcagtgacaccattaacctgctggcagccttgggccagatcaggtcattgctctcagtacgcatggggaaggaggaggagttattaatgattaacggcctgggcgacatcatgaataacaaagtcttctaccagcatcctaacctcatgcgcgtgctgggaatgcatgagactgtgatggaggtgatggtgaacgttctcggaaccgagaagtctcagattgcattccccaagatggttgcgagctgctgcaggtttctgtgctatttctgtcgcatctctagacagaatcagaaggcaatgtttgaacacttgagttaccttctggagaatagctccgtggggctagcgtcacctagcatgcggggttctactcccttggatgtcgctgcatccagcgttatggataataacgagctggccctgagcctggaggagcccgatctggagaaggtcgtgacgtacctagccgggtgtggtcttcagtcatgtccaatgctgctggccaaggggtaccctgatgtgggctggaatccaatcgaaggtgagagatacttgtcattcttacggttcgctgttttcgtcaattcagagagtgtggaagaaaatgctagtgtcgtggttaagctgctgattagacgaccagagtgcttcggccccgccttgcgcggcgaaggcggtaacggtcttctcgcggcaatgcagggcgccataaaaatcagcgaaaatcctgcgctcgatctgccatctcagggctataagagggaagtgagtacaggggatgacgaggaagaagaagagatcgtgcatatgggaaatgccattatgtcattttacagcgcgttaatagacctcctgggaaggtgcgcccccgaaatgcacctcattcagaccggcaagggcgaagctatccggatcaggagcatcctgagaagtctcgtccccaccgaggacctggtggggatcatttccattcctttaaaactcccctcccttaataaagatggtagcgtgtccgagcccgacatggctgccaacttctgccctgatcacaaggcacctatggtactgttcctcgaccgggtttacggcattaaggaccagacattcctcctccacctccttgaggtcggtttcctgcccgacctgcgtgccagcgcgtccctcgatacagtttcactgtcaacaacagaagccgcactggcccttaatcgctatatatgctctgctgtgctcccactgttgacacggtgcgcccccctgttcgcaggcacagagcactgcacatccctgatcgactctacccttcagactatatatcgcctgtccaagggacgttcacttaccaaagcccagagggatactattgaggagtgcctgctcgcaatctgtaatcacttgaggcctagtatgctccaacaactgctaaggagactcgtgttcgacgtgccgcagctgaatgaatattgcaagatgccgttgaagttacttacaaatcactacgagcaatgctggaaatattactgcctaccgtccggttgggggtcgtacggactggcagtcgaggaggagcttcaccttacagaaaaacttttttgggggatctttgactccttgtctcacaaaaagtatgaccccgatctgttccgcatggctcttccttgcctctccgcaattgcaggggccctgcctcccgactacctagatacaagaatcacggccactctcgaaaaacaaatttcggtggacgcagatggaaacttcgaccccaagcctattaacaccatgaatttttctctgcccgagaagttggagtacatcgttaccaagtacgccgagcattcccacgataagtgggcatgcgacaagagtcaatctgggtggaagtatgggatcagcttagatgaaaatgttaagacccatccccttatacgcccctttaaaaccctgactgaaaaggagaaagaaatctaccggtggcctgctcgggagagcctcaagaccatgttagccgtgggttggaccgttgaaaggacgaaggaaggcgaagctctggtccaacagagggaaaacgaaaagctgaggtctgtttcccaggctaaccaagggaatagctactctcccgcaccactcgatctctcgaatgtcgttttgtctagggagctgcagggcatggtcgaggtggtggctgaaaactaccacaacatctgggctaagaaaaagaaactggagcttgagtcaaagggaggtgggtcacatcccctgttggtgccatatgacacacttaccgccaaggagaaattcaaggacagagagaaagcgcaggatctctttaagtttctacaggtgaatggaataatcgtgtcacggggcatgaaggatatggaactcgatgcttcgagcatggagaagagattcgcatataagtttctcaaaaaaatattgaaatacgtagattctgcgcaggaattcatagcccatctcgaagccatcgtcagttcgggaaagacggagaaaagcccacgggaccaggagattaaattttttgccaaggtactgctccccctggtggatcagtacttcacaagccactgcctgtattttctttcttctcctctgaagccgttatcaagctccggttatgcctcccacaaagaaaaggagatggtcgccggtttgttttgcaagctcgctgctctggtacgacaccggatatctctgtttgggtccgattctacaacaatggtaagctgcctccacattttggctcagactcttgacactagaacggtgatgaagagcggttctgaactggtcaaggctggcctgagggccttcttcgagaatgcagcggaggacctggaaaaaactagtgaaaacctgaaactaggtaaatttacccacagccggactcaaataaagggcgtgagccaaaacatcaactataccaccgtggctctgctaccgatccttacctctatcttcgagcatgttacccaacaccagtttggaatggatctcttgctgggcgacgtccagataagttgttaccatatactctgctctctgtactccctaggcacagggaagaacatttacgtggagaggcagagaccagcactcggggaatgcttggcgagtttagcagctgccatcccagtggctttccttgaacccacactgaaccgttataacccgttaagtgtgttcaacactaaaacacctcgcgaaagaagcatacttggaatgcccgacacagtagaagacatgtgccctgatataccccaactggaaggtttgatgaaggagataaatgatttggccgagtccggggccaggtacacagagatgccacatgttatagaggttatcctgccaatgctgtgtaactacctgagctactggtgggagcggggccctgagaatttgccgccctcaactggtccatgttgcacaaaggttaccagcgagcacctctctctgatcttgggaaatatactcaagatcataaataacaatttgggcatcgatgaagccagttggatgaaacgaatcgctgtctacgctcaaccaattattagcaaggccagacctgacctgctgaggtcccatttcatcccaactcttgagaagctgaaaaagaaagcggtcaagaccgtacaggaagaagaacagttaaaagctgatggcaaaggcgatacccaggaggccgagctcctcatcctggacgaatttgcggtgctctgtagagacctttacgccttctaccccatgctgattagatacgtggataacaaccgctccaattggcttaagtccccagatgccgattcagaccaactgttccgcatggtggcagaggtgtttattttgtggtgcaagagccacaactttaaacgagaagagcaaaatttcgtcattcaaaatgaaattaataatctagcattccttactggtgacagcaagtctaagatgtctaaatccggcggccaggaccaggaaagaaagaagacaaagcgtcggggagatctgtattccattcaaacctcgcttatcgtggctgccttgaagaagatgttgcccatcgggctcaatatgtgcactccgggcgatcaggagctgatcagcttggccaagtccagatactcacacagggatacagatgaagaagttagagaacacctgcggaacaacctccacctgcaagagaagtccgacgaccctgctgtcaagtggcagttaaatctgtacaaggacgtgctgaaatctgaggagccgttcaaccctgagaaaacagttgagcgcgtccagagaattagcgccgccgtttttcatctggagcaggtggagcagcccctccgctcaaagaaagcagtgtggcataagttactttccaaacaaagaaagcgagcagtggtggcctgttttagaatggcccccctttacaacctaccccggcacagatccatcaacttgttcctccacggataccaaagattctggattgaaaccgaagagtattcttttgaggaaaagttagttcaagacctggcaaagtctccaaaggtggaagaggaggaagaggaggagaccgagaagcagcccgacccactgcatcagatcattctgtactttagccgcaatgcacttacagaaaggagtaagctggaagacgacccactatatacctcctatagctccatgatggcaaaaagctgtcagtcaggcgaagacgaggaagaggacgaagacaaagagaagaccttcgaagagaaagagatggagaagcagaaaacgctttaccaacaagcccgtctccacgagcgcggagccgccgagatggtgttgcagatgatctctgccagcaagggggagatgagtccaatggtagtcgagaccctcaagctgggtattgctatcctcaatggtgggaatgcaggggtgcagcagaaaatgcttgactatctgaaagagaaaaaggacgccgggttcttccagtccctgagcggactgatgcagtcatgccggtcagtcttggacctgaatgcgtttgagcgccagaacaaagccgaggggctgggtatggtgacagaagagggcaccctgatcgtaagagagcggggagaaaaagtgctgcagaatgatgaatttactagagacctgtttcgctttctgcagctgctttgcgagggccacaattccgactttcagaattttcttagaacacagatgggcaatacaactactgtcaatgtcatcatcagcactgtcgattacctgctccgattacaggagtccatctcggacttctactggtactactctggcaaggacatcattgatgagagtggacagcacaacttctcgaaagcgcttgcagtgaccaagcagatctttaacagcctgactgaatatatccagggcccctgcattgggaaccagcaaagccttgcgcattcccgactgtgggatgccgtggtaggtttccttcacgttttcgcaaatatgcagatgaagttatcccaagactcatcccaaatcgaattgctgaaggagctcttagacctacttcaggatatggtggtgatgctgctttcattactagagggcaacgttgtcaacggaacgatagggaaacaaatggtagacacactggtagaatcctcaactaacgtcgaaatgatcttgaagttttttgatatgtttctgaaactaaaggacttgacgagtagcgacacctttaaggagtatgatcccgacggtaagggaataatctcaaagaaagaattccagaaagccatggagggtcagaagcagtacacccagagtgaaattgatttcctgctttcatgtgctgaggccgacgagaacgatatgttcaattatgtggatttcgtggaccgatttcacgaacccgccaaggatatcggttttaacgtagctgtgttgctgactaacctgagcgagcatatgccgaacgattcgcgactgaagtgcctgctggaccctgcagagagtgtgctgaactacttcgaaccctacctgggaagaattgagataatgggtggcgccaaaaaaattgagcgggtgtacttcgagatcagcgaaagcagtaggactcagtgggaaaagccacaagtgaaggaatccaaaaggcaattcatattcgacgtcgttaatgaggggggcgaacaggaaaaaatggaactattcgttaatttttgtgaggacactatctttgagatgcagcttgccagtcagatcagcgaaagcgatagcgccgacagaccagaggaggaagaagaagatgaggattcttcttacgtgcttgaaatcgccggagaagaggaagaggacggtagcctcgaaccggccagtgcattcgcaatggcctgcgcttcagtaaaacgtaacgtcacagatttcctgaaacgggccacactcaaaaacctgaggaaacagtacaggaatgtgaaaaaaatgactgctaaagagttggtgaaagtgctgtttagtttcttctggatgttgttcgtgggcttattccagctccttttcactatcctcggtggaatatttcagattctctggtctactgtgtttggaggcgggctggtagagggcgcgaagaacattagggtgactaaaattctgggagatatgcctgacccgactcagttcggaattcacgatgacaccatggaggcggaacgcgcggaggtgatggaacccggaatcaccacagagctcgtgcactttatcaagggcgaaaagggagacacggatatcatgtcggacttatttgggctccatccaaagaaagagggatctcttaaacatggaccggaagtcgggttgggggacctgtcagaaattatagggaaagatgagccacccaccctagagagcactgtacaaaaaaagcgcaaagcgcaggctgcggaaatgaaggcggccaacgaggctgagggaaaagtggagtccgagaaggctgacatggaagatggggaaaaagaggacaaagataaagaagaagaacaagcagaatatctgtggaccgaggtgactaagaagaagaaacgacggtgcggtcagaaggtcgagaaaccagaagcatttaccgcaaacttcttcaaaggcctcgagatttaccagactaaactgctccactacttggcccgtaatttctataatctgaggtttctcgccttattcgtggcctttgcaataaacttcatcttgctgttctataaagtcacggaggaacccctggaagaggaaactgaagatgtggcaaacctttggaatagctttaatgatgaagaagaggaagaggcgatggttttcttcgtcctgcaggagtccacaggctatatggccccgaccctgcgggccctcgccatcattcatacgatcatttcgctggtgtgtgtggttggatattattgcctcaaggtaccacttgtggttttcaaacgggagaaagagatcgccagaaaacttgaattcgacggcctatacataaccgagcaacctagtgaggatgatattaagggccagtgggaccggctagttattaatactcctagtttcccaaacaattattgggataaatttgtaaaacggaaggtgatcaacaagtacggcgacctttacggggctgaacgaatcgcagaacttctgggactcgataaaaatgcactagatttcagtccggtggaagagaccaaggccgaggcagccagcctggtcagctggttgtcaagcatcgacatgaagtatcacatatggaaattgggagtggtgttcactgacaactcctttctgtatttagcctggtatactacgatgagtgttctggggcattataacaatttcttctttgccgcccacctcctggatatcgcaatggggttcaagaccctgagaacgattctgagctcagtgacacacaatgggaaacagttggtgctaactgtcggacttctggccgttgttgtttatttgtacacagtggttgctttcaacttcttccggaaattctataataagtctgaggacgacgatgaaccagacatgaaatgcgacgatatgatgacttgttatctttttcacatgtatgttggagttcgagctggcggagggattggcgacgaaatagaagatccagcaggagacccctacgaaatgtatcgtattgttttcgatatcacatttttcttctttgttatcgtcatcctcctggctatcatccagggattaatcattgatgcctttggcgagctgagagatcagcaggaacaggtccgtgaggatatggaaaccaagtgtttcatttgcggtattggcaatgattacttcgacacgaccccgcacggttttgaaactcacacgctccaagagcataatctagcgaactacctgttcttccttatgtaccttattaataaagacgaaacagaacatacaggacaggagagctatgtttggaaaatgtaccaggaaagatgctgggacttttttcccgccggtgattgctttaggaagcagtatgaagaccagctcggatag

SEQ ID NO: 204112 - DNA, 14613 bp, Artificial Sequence
  Description of Artificial Sequence: Synthetic coding sequence
atggccgagggcggcgagggcggcgaggacgagatccagttcctgcgcactgaggatgaggtggtgttgcagtgtatcgccactattcacaaagaacagaggaagttctgtctggcagcggaggggttgggcaacaggctgtgtttcctggaacccacctccgaagccaagtacatccctccagatctgtgcgtgtgcaactttgtattggaacagtcgctcagcgtccgggcactccaggagatgctggccaacactggggagaacggcggtgaaggcgccgcccagggcggcggtcaccggactctgctgtatggacacgcagtgctgcttcgccactcatttagtggcatgtatcttacgtgtctgactacttcccgctcgcaaacagacaagctggctttcgacgttggcctgagagaacacgccacaggggaggcgtgttggtggaccattcatcctgccagtaagcagcggagcgaaggggagaaagtgcgcatcggcgatgacctgatcttagtgagcgtgagtagtgaacgctacttacacctgagcgtatccaatggcaacatccaggtggacgcgagtttcatgcagacgttgtggaatgttcacccaacgtgctcagggagttccatcgaggagggctatctgttggggggacacgtcgtgcgtttattccacggtcatgacgagtgcttaactattccttccactgatcagaacgattcccagcataggcgtattttttatgaggccggcggcgccggtacgagagcacgctcactctggagggttgaacccctgcgaatctcatggtcaggctccaatattaggtggggacaagccttcaggctgcggcaccttacgacagggcattatcttgcactgacagaggaccaaggcctaatcctgcaggatagagccaagtccgatactaagtctacggccttctccttccgcgcctcaaaagaactgaaggagaagctggattcttcccataagcgagacattgaaggcatgggggtccctgaaatcaaatatggagacagtgtgtgctttgttcagcacattgcctctggcttgtgggttacctataaggctcaagacgctaaaacatctagattagggcccctaaagagaaaggttattctgcaccaggagggccatatggacgacggcctcacattacagcgatgtcagcgggaggaatcccaggccgctaggatcatccgcaatacgacagcactttttagtcaattcgtctctggaaataataggacggccgcacccatcactctcccaatagaggaggtgctgcagactttgcaagacctgatcgcctactttcagcctcctgaggaggaaatgcggcatgaagataagcagaataagctgagaagccttaagaatcgccaaaaccttttcaaggaagagggcatgctcgcgctggtattgaactgcatcgatagactaaatgtgtacaactccgtggctcattttgcaggcattgctagagaggagtctggaatggcatggaaagaaattctcaacttactttacaaactgcttgccgcgttaattcgtgggaaccggaacaactgtgcccagttcagcaacaatcttgattggctcatttccaagctcgatcggcttgagtcctcatcgggaatactggaggtgctgcactgcatattaaccgagtccccagaggccttgaaccttattgcggagggacacataaaaagtattattagccttctggacaaacatggccggaatcacaaagtgctcgatattttatgctcactctgcctgtgcaacggagtggcagtacgcgccaatcagaaccttatctgcgacaatctcctgccgcgccgcaatttactcttgcagacacggcttattaacgacgtgactagtatcaggcctaatatcttcctcggcgtcgcagagggcagcgcccagtacaaaaagtggtatttcgagttgatcatagaccaggtcgacccgtttctgacagctgagccaacgcatctccgggtaggctgggcttcttcatccggctatgccccttaccccggaggcggggagggctggggcggcaacggggtgggcgacgacctgtactcatacggttttgacgggctgcacctgtggagcggacgaattccgcgagcggtagcctctattaaccagcatcttttgagatcagacgatgtggtgagctgttgtctcgatctcggtgtgccaagtataagtttccgcatcaatggccagccagtccaaggaatgttcgagaactttaataccgacggcctgttctttcctgtcatgtcttttagcgctggggttaaagtccggtttctgatgggcggccggcatggtgaatttaaattccttcccccatcaggatacgccccctgttacgaggcgctgctccctaaagagaaaatgcgactggagccagtgaaagaatataagcgtgatgccgatggaataagggatctgctgggtacgacacaattcctatcacaggcctcgtttatcccatgccccgtggatacgtcacaggtgatactgcctcctcacctggaaaagatccgggataggctggccgagaatatccacgaactctggggcatgaacaagatagagctcggatggacgttcggaaagatccgggacgacaataaaagacaacatccctgcctcgtcgagttttctaaactccccgagactgagaagaattacaacctgcagatgtccaccgaaaccctgaaaactctattggccctcggctgtcatattgcgcatgttaaccctgctgccgaggaggacctcaaaaaggtgaagctgccgaaaaactacatgatgtcaaacgggtacaaacccgcgccattagatctgtcagacgtcaaactcctaccaccacaggagatacttgtggataaacttgctgaaaatgcccataatgtctgggcaaaggaccgcattaagcaaggatggacctacgggattcaacaggacctgaaaaacaagcgaaatccacgcctcgtcccttacgccctgctggatgaaagaactaagaagtccaaccgagattccctgagagaagccgtccggacatttgtcggatatggctacaacatcgagccaagcgatcaggagctggccgactctgccgtggaaaaagtctcgattgataagattagattttttcgagtggagaggtcatatgccgttcgatccggaaaatggtacttcgagtttgaggtcgttaccggaggggacatgcgcgtgggctgggccagacccggttgtaggcctgacgtcgagctaggggcagacgaccaagcattcgtgttcgaggggaatcgaggccagagatggcaccaggggagcggatatttcggcaggacatggcagccgggagatgtcgtcggatgtatgatcaacttagatgatgccagtatgatcttcactctgaacggggagctactgatcactaacaaaggatccgagcttgccttcgccgattacgaaattgagaatgggtttgtcccaatttgctgtctcggcttatctcagattgggcgcatgaacctaggtacagatgccagcacatttaaattctacaccatgtgcggactacaggagggtttcgaaccttttgccgtcaacatgaaccgtgacgtcgccatgtggttttctaagcgccttcctactttcgttaatgtgcctaaggaccacccgcacatagaggtgatgagaatcgacggaacaatggactcacccccgtgcctgaaggtcactcacaagaccttcggtacccaaaatagtaatgctgacatgatttattgtagactgtccatgccggtcgaatgccattcctctttctcacacagcccttgtctggacagcgaggcatttcagaagaggaagcagatgcaagagatcctgtcgcacaccactacacagtgttattatgcaattagaatattcgctggccaggacccttcatgtgtctgggtgggttgggtaacccccgactaccacctgtactcggaaaagtttgatctcaacaagaattgtactgttaccgtgacccttggagatgaaagagggcgagtgcacgagtccgtaaaaaggtccaattgctacatggtttggggcggtgatatagtagcctcttcgcagcgtagcaatcggtccaatgtcgaccttgaaattggctgcttggtggatctagccatggggatgttaagcttcagcgcaaatggaaaggaattaggaacatgttaccaggtcgagcctaacacaaaggtgttccctgccgttttcctgcagccaactagcacctcactgttccagttcgaactcggcaagcttaagaacgctatgccactgtctgctgctatattccggtcggaagaaaagaatcccgtaccccaatgtccacctagacttgatgttcagacgatccagcctgtcctttggagccgtatgccaaatagttttctgaaagtggaaactgagagggtttccgagcggcacggttgggtggtacagtgcctggaaccactgcagatgatggctctgcacattccggaggagaatagatgtgtagatatactggaactctgtgaacaggaagatctgatgaggttccattatcacacactcaggttgtattctgcagtgtgcgctttgggtaacagtcgagtggcatacgccctgtgcagtcacgtcgacctcagtcagctattctacgcaatcgacaataagtacctgcccggccttttacggagcgggttctacgatcttctcatctcaatccatttggctagtgcaaaggagaggaaactcatgatgaaaaatgaatatataataccaataacgtctactactaggaacatcaggctgttcccagacgagtcgaagcgccatggtctgcccggcgtgggcttgaggacatgcctgaagcctggatttaggttttctaccccatgcttcgttgtgaccggtgaggatcatcaaaaacaaagccccgaaatccctctcgaaagcttaagaactaaggccctcagcatgctaactgaagccgttcaatgcagtggagcccatattcgcgatccggtgggtggctcggtggagttccagtttgttcccgttctgaagctgataggcacgctactagtgatgggagtgtttgacgacgatgatgtccgccagattcttcttctgatcgacccgtccgtgttcggcgaacactcagccggaaccgaggagggagcagagaaagaagaggtcacccaggtcgaggagaaagccgtcgaggcaggcgaaaaagccgggaaggaagcccccgtcaaggggttactgcagacacgactcccagagagcgtaaaactgcagatgtgcgaattactgtcttacctgtgtgactgtgagcttcagcaccgcgtggaggctatcgttgcttttggggatatatatgtttcaaagctgcaggccaatcaaaagttccgatacaatgaactgatgcaggcactgaacatgtccgccgcgctcacagccagaaagacgaaggagttcaggtcgcctccccaggaacagataaacatgctgctgaacttccagctgggcgagaactgcccctgtcctgaggaaatcagggaagagctgtatgacttccatgaagatctcctcctccactgcggcgtgcctctcgaggaagaagaggaagaagaagaggatacctcctggaccgggaagctttgcgccctcgtctataagattaagggcccacccaagccagaaaaagagcagcctaccgaggaggaagaaagatgtcctacaacactgaaagagctgatatcacagacaatgatttgttgggcccaagaggaccagatccaggattccgaactggttcggatgatgtttaatttgctcagaaggcagtatgacagcatcggggagctgctgcaagctctcaggaaaacatacactatcagtcacacatcagtctccgatacgatcaacctgttagccgcattaggtcagatccggtcactgctgagcgtgcgaatgggaaaggaggaggaactgctgatgataaatggtctcggcgacattatgaacaacaaggtattttatcagcaccctaatctcatgcgggtgctggggatgcacgagacggtgatggaagttatggtcaatgtcctgggaacagaaaaatcacagatcgcctttcccaaaatggtggcctcttgttgccgctttctctgctacttctgcagaatttcacgacagaatcagaaggctatgttcgagcacttaagctacctgctggaaaattcctccgtgggactggcctccccttctatgagagggtcaacaccccttgatgtcgccgcctctagtgtgatggacaacaacgaactggcattatccttggaagaaccagatctggaaaaagtcgtgacttatctggctggctgtggactgcagtcgtgccctatgttgctggcaaagggctacccggacgttggctggaatcccatagaaggcgagcgatacctgtctttcttgagattcgccgttttcgtgaattccgagtctgtggaagaaaatgcaagtgtggtcgtgaagctgttaattcgtaggcccgaatgttttgggccagcactccgaggcgaaggggggaacggcctacttgcagctatgcagggtgccatcaagatctctgaaaaccccgctctggacctacctagtcagggttacaagagagaggtcagcactggcgatgatgaggaggaagaggagattgtccacatggggaatgccatcatgagtttctactctgccctaatcgacctgctaggcaggtgcgccccagagatgcacttgatacagacaggtaaaggcgaggccatcagaatccgcagtatcctgcgttccctggtccccactgaggacctcgtcggcattatctccatcccactgaagctgcctagtctcaataaggacggcagtgtctcagagcctgacatggcggcaaacttttgccctgatcacaaagcccctatggttctcttcctggacagggtgtatggcattaaagaccagacattcctgttgcaccttcttgaagtgggatttttgccagacctacgagcttctgcgtccctggacaccgtttccctgagcaccaccgaagctgccctggcgttgaatcggtatatatgttcagccgtgctgcccctcctgaccaggtgtgccccgctcttcgccggcactgagcattgcactagtcttatcgatagtaccctgcaaaccatctaccgtttgagcaagggccggagtctcacaaaagctcagagagatacaatcgaggaatgcttgctcgccatctgtaaccacctgagaccttctatgctccaacagctcctccgaaggcttgtgtttgacgtcccccaactcaatgagtactgtaaaatgcccctcaagcttttgacaaaccactacgaacagtgttggaaatactactgtctgccctccggatgggggagttacgggctcgcggtggaagaggagctgcatctcaccgagaagctcttctgggggattttcgattcactgtcgcataaaaaatatgatcccgacctctttcggatggctctgccgtgtctgtccgcaatcgccggcgctctgccccccgactacctagacacccggatcaccgcgactctcgagaaacagatttctgtcgacgccgatgggaattttgatcccaagccaattaacacaatgaatttttctctaccagagaaattggaatatattgttactaagtacgccgagcactcacatgataagtgggcctgtgataagtcccaatccgggtggaagtacggtatctccctggacgaaaacgtgaaaacgcatccactgatccgcccgttcaaaactctcactgagaaggagaaggaaatatatcgttggcccgctcgtgagagcttaaagacaatgctagcggtgggttggacagttgagagaaccaaggaaggcgaggctctggtacagcaaagagagaatgagaaattgcggagcgtatcccaggcaaatcaggggaactcatactcacctgcgcctctggacctttccaacgtggtgttatctagagagctacaggggatggtggaggtggtggcagagaattatcacaatatttgggcaaagaaaaaaaaattggagctagaaagcaaaggaggtggaagccaccccttactagtcccgtatgatactctgacagcaaaggagaagttcaaggaccgcgagaaggcccaagacctgttcaagttcctgcaagtgaacgggataattgtcagtagggggatgaaagatatggaattggacgcgagttcaatggagaaacggtttgcctataagttcttgaagaagattctgaagtatgtggatagtgcccaggagttcattgcccatctcgaggcaatcgtgtcaagcggcaagacagaaaagagccctcgtgaccaggaaatcaagttctttgcaaaggtactcctgccacttgtggaccaatacttcacctcccattgcctctacttcctgtcctcaccgctcaagcctttgagctcgtctggttatgcctctcacaaggaaaaggagatggtggctgggctgttctgtaagcttgctgcccttgtgcggcatagaatctcattgtttggcagcgatagtaccaccatggtttcctgcctgcacatactggcccagacactcgatacacgtacggttatgaaaagcggatcagagttggtgaaagccggactccgcgcctttttcgagaatgccgccgaagatctggagaagactagcgagaatctgaagttgggtaagttcacccactcacggactcaaattaagggagtcagccaaaacattaactatactaccgtggcccttctgccaatcctcactagcatttttgaacatgttacacagcaccagttcggcatggacctgctacttggggacgtccagatttcttgctatcatattttgtgttcactgtatagccttggcacaggaaagaatatttatgtagagagacagcggccagcgcttggtgaatgtttggcatcactcgcggccgctatacccgttgcctttctggagcccaccttaaaccgatacaaccccctttcagtctttaatacaaagactccccgggagcgttccattctgggaatgccagatacagtcgaggatatgtgcccagacatccctcaattggagggactgatgaaggaaatcaatgaccttgcagaatccggcgctaggtatacggagatgccccatgtgatagaagtaatccttcctatgctgtgtaactaccttagctattggtgggagcgcggacccgaaaacttgcccccttccacagggccttgctgtactaaagtgacctccgagcatttgagcctcatactcgggaatattctgaagattattaataacaacctggggatagatgaggcatcctggatgaaacgcatcgctgtgtatgcgcagcccatcatctcaaaagctcgacccgatttactgagatcccattttattcctaccctggaaaagctgaaaaagaaagctgtgaaaaccgtccaggaagaggagcagctgaaagctgacgggaagggtgacacccaagaggccgagctccttatcctggacgagttcgctgttctatgtcgcgacctatacgccttctacccgatgttgattcgatatgttgacaacaataggagtaattggctaaagtccccggatgccgactcagaccagttgttccggatggtcgctgaagtttttattctctggtgcaaatcccacaattttaagcgcgaggaacagaactttgtgatccagaacgaaatcaataacttggctttcttaacaggagacagtaaatcaaaaatgtctaaggcaatgcaggtgaagtccggcggccaagatcaagaacggaaaaaaactaaacgacgtggcgatctctattctatccagacaagcttaatagtggccgccctgaaaaaaatgcttcccattggactcaacatgtgcactcccggagatcaggaacttataagtctggctaagtctaggtatagtcaccgggatacggacgaggaagttagggaacacttacgtaacaatctgcaccttcaggaaaagtctgacgatccagccgttaaatggcagctcaacctctacaaggatgtcctgaagtctgaggagcctttcaaccctgaaaaaaccgtggagagggtccaaaggatatccgcagctgtcttccacttagagcaggtggaacagcctcttagaagcaagaaagccgtgtggcacaaattactttctaagcagcgcaagagggctgtcgtggcgtgctttcgaatggcgccgctttataatttgcctcggcatcgaagcataaatctttttctccacggctatcagaggttttggatcgagaccgaggagtacagcttcgaggaaaaacttgtgcaagatcttgctaagtctcctaaggtggaagaggaggaggaagaagaaacagaaaagcaacctgacccccttcaccagatcattttgtatttcagcaggaatgcactgactgaacgtagcaagctggaagacgatcccctgtacacatcttatagtagcatgatggccaagagttgtcagtctggcgaggatgaagaagaagatgaagataaggaaaagaccttcgaggagaaggaaatggaaaaacagaaaactctctaccagcaggcacgactgcatgaaagaggcgcagctgaaatggtcctgcagatgatctcagcctctaagggcgaaatgagtcctatggtagtggaaacactgaaattggggatcgctattctgaacggcggcaatgctggagtgcaacagaagatgttagattacctcaaggaaaagaaagatgctggctttttccagtcactgtcgggtttaatgcaatcttgttctgtgctagacctaaatgcttttgaacgacagaacaaggctgaggggctaggcatggttacggaagagggcactctgatcgttagagagcgtggagaaaaagtgcttcagaatgacgagtttactcgggacttattcaggttcctccaactattgtgcgaggggcataattcagactttcaaaatttccttcgaactcaaatggggaacaccactacagtcaacgtgatcataagcacagtggactatctcttgaggcttcaggagtcaattagcgatttctactggtactactctggcaaagatattatcgacgaatcaggccagcacaattttagtaaagcactcgcggtgacaaagcagatcttcaattccttaaccgaatatatacagggaccatgtattggcaatcagcagtccctagcgcatagtcggctttgggacgcagtggttggcttcctgcatgtgtttgcaaatatgcagatgaagttatctcaggattcctctcagatcgaactgctcaaggaactcctggacctgctacaggatatggtggtcatgctgctgagcctcttggaagggaacgtggtgaatggaacaatcggcaagcagatggtcgacactctcgtggagtcctccaccaacgtagaaatgatactcaagttctttgacatgttcctgaaactgaaagacctgacttcctcggacacttttaaggaatacgatccagacggcaagggcattatttccaagaaggaatttcaaaaggctatggagggacagaaacaatacacacagtcagagatcgattttctcctgtcctgcgctgaagctgacgagaacgacatgttcaattatgtcgacttcgttgatagattccatgaacccgcaaaagacataggatttaatgtggcagtcctgcttaccaatctgtccgagcatatgcccaatgactcccgattaaagtgcctgctggacccagcagagagcgtgctgaactattttgaaccatatttgggccggatcgaaatcatggggggggccaagaagatcgaacgcgtgtactttgagatctccgagagctcgcggactcaatgggagaagccccaggtaaaagaaagcaaaagacagtttatttttgacgtagtcaatgagggtggcgaacaggaaaagatggagctgttcgttaacttttgcgaggacaccatttttgagatgcagttggctagccagatctctgagagtgattctgccgatagacccgaggaagaggaggaagatgaagactcttcgtatgtgttggagatagcgggcgaagaagaggaagacggatccctagagccggcctctgcttttgctatggcatgtgcctcggtgaaacgaaatgtcaccgactttctcaaaagagcaactttgaaaaatctgagaaaacagtacagaaatgtgaagaagatgaccgcaaaggaactcgtgaaggtcctgttttccttcttctggatgttgttcgtaggactgtttcagctattattcaccatccttggcggaatttttcaaatcttgtggtctacagtctttggcggagggctggtagaaggcgccaagaatattcgggtgaccaaaatcctcggcgacatgccagatccaacacagttcggcatccacgatgataccatggaagccgagagagcggaggtgatggaaccggggattacaacagaactggtccatttcatcaagggcgaaaagggtgacaccgacatcatgagcgatctctttggattacaccctaagaaggaaggcagtttgaaacacggaccagaggtgggactcggcgatctcagtgaaataataggtaaggacgaaccacctaccctggaatctactgtgcagaagaagcgcaaggcacaggccgccgagatgaaagctgcaaatgaggctgaggggaaagtggaaagcgagaaggctgacatggaggatggtgagaaagaggacaaggataaggaagaagaacaggctgaatatctgtggacagaggtcaccaagaaaaagaagcgccgatgcggtcagaaggtggagaagccagaggccttcactgccaatttcttcaagggacttgagatctatcagaccaagcttctgcattacttagctcgcaacttctacaatttaaggttcctggcattgttcgtggctttcgccatcaattttatactgctattttacaaggtgacagaggaaccactggaagaggaaaccgaggacgttgccaacttatggaacagctttaacgatgaagaagaggaggaagccatggttttctttgttcttcaggaaagtaccggttacatggccccaactctcagggccctcgcaataatccatacaattatatcactggtgtgcgtggtcggctactattgcctcaaagtgccactggtcgtgttcaagagagagaaagagatcgcacgcaaactggaatttgacggactttacattactgaacagcccagtgaagacgatatcaaaggccaatgggatcggctcgtgattaacaccccatcgtttcctaacaactattgggataagtttgttaaacgaaaggtaattaataaatacggtgatctgtacggcgctgaaagaattgctgagctcctgggcctggacaagaatgccttagatttctctcccgtggaagaaacaaaggcagaggcagcttccctggtctcctggctgagttccatcgatatgaaatatcacatttggaaattgggcgtggtctttacagacaattcatttctttaccttgcttggtacacaactatgtctgtgcttgggcactataacaatttcttcttcgctgctcatttgctagatatagctatgggattcaaaacgctccggaccatcttgtccagcgtaactcataatgggaaacagcttgtgctgacagtcgggctgctcgcggttgtggtgtacctgtataccgtggtagcctttaacttcttcagaaagttttacaacaagtccgaggatgacgatgagcctgatatgaagtgtgacgatatgatgacctgctacctttttcacatgtacgtgggtgtgagagccgggggcggcatcggggatgagattgaggatcctgccggtgacccatacgagatgtatcgtattgtgtttgatataacattcttttttttcgtcatcgttattttattggcgattattcagggcctcatcatcgacgctttcggagaactgcgggatcagcaggaacaggtcagggaagacatggaaactaagtgctttatctgtggaattggcaacgattactttgataccacaccgcacgggtttgagacccatacgcttcaggagcacaacctagccaactatctattcttcctgatgtatctaatcaataaagatgagacagaacacaccggccaggagtcctatgtatggaaaatgtaccaagaacggtgttgggatttctttcccgctggagattgctttcgaaagcagtacgaggaccagttggggtag

SEQ ID NO: 204113 - DNA, 14598 bp, Artificial Sequence
  Description of Artificial Sequence: Synthetic coding sequence
atggccgagggcggcgagggcggcgaggacgagatccagttcctgcgcacagaagacgaagttgtgctccagtgtatcgcaactatccacaaggagcagcgcaagttttgtctggccgcagagggattaggcaatcggctgtgttttctggaaccaacatctgaagcaaaatacatcccaccagatctctgcgtgtgtaatttcgtgctggagcagagcctgtcagtgagagccctgcaggagatgctcgctaacactggagagaatgggggagagggggcagcccagggaggaggacatagaacacttctttatggacacgcagtcctcttgagacattctttttccggaatgtatctcacatgcctcaccacctctcgatcccagacggacaaactcgctttcgatgtcggcctaagagagcacgcaactggtgaagcatgctggtggaccattcatccagcgtccaagcagcggagcgagggtgagaaagtgcgcattggagatgatctgattctggtcagcgtgagctcagagcgatacctgcacctgtctgtaagtaacggcaatatccaggtggatgccagcttcatgcagactctttggaacgtgcacccgacatgctccggctcatctatcgaggagggctacctgctgggcgggcacgtagtgcgtctcttccacggccacgacgagtgcttgacaataccctcaaccgaccagaacgattctcagcacagacggatattctacgaggctggcggagcaggaactagagcaagatcgctgtggcgagtcgagcctctgcggatctcctggtctgggagcaatatcaggtggggccaggcgttcagactacgacatctgactaccggtcattatctggccctgaccgaggatcaggggttgattctgcaggatcgggccaaaagcgacactaagagcaccgccttttcatttagagcgagcaaggagcttaaggagaagttagattcttcccacaaaagggacatcgaagggatgggcgttcctgaaatcaaatatggggatagcgtgtgctttgttcaacacatcgcttccgggctctgggtgacatataaggcgcaagacgcaaagacatctaggttgggtcctcttaaaagaaaggttatattacaccaggaagggcacatggatgatggccttacgctgcagcgctgtcagcgagaggaatcccaagcagcaaggatcatcaggaacactaccgcactattctcacagttcgtgtctggcaacaatcgtaccgctgcaccgataacgctccctatagaagaggtcctgcaaacgctacaggaccttatcgcctactttcagccacccgaggaggaaatgaggcacgaggacaagcagaataaacttcggtcattgaaaaatcggcaaaacctgtttaaggaggagggcatgctagctctggttctaaattgtattgataggctaaacgtatataattcagtcgctcatttcgcgggaattgctcgcgaggaatcaggaatggcatggaaagaaatcctgaatttgctctataaactcttggccgccctgattcggggaaatagaaataactgtgctcagttcagcaacaatcttgactggttaattagtaagttagatagactcgagagctcctccggcatactggaggtactgcactgcattttgaccgagagtccggaagctctgaatttgattgccgagggtcatatcaagtccatcatatcactcttggataagcacggacggaaccataaagtattggatatcctgtgtagcttatgtctctgcaatggcgtggccgtgagggctaaccagaatttgatctgtgataacctgctgcctcgcaggaacctgctgttacagacgcggttgatcaacgatgtgacttcaatccgcccaaacatctttcttggtgtggctgaaggttctgcacagtacaagaagtggtacttcgagcttattattgaccaggtcgaccccttcctgaccgcagagcccacacaccttcgagtcggctgggcctcgtcgtcaggctacgctccttaccccggcggtggcgagggctgggggggcaacggggtgggagatgacttatacagctacggctttgacggtctccacttatggagcggccgtatccctcgggctgtggcctctatcaaccagcacctgctgagatctgacgatgtggtgtcgtgctgcctggaccttggagtgccttccatttctttccggatcaatgggcaacctgtgcagggcatgttcgaaaactttaacactgacggcctgttctttcccgtgatgagctttagtgccggggttaaagtacggtttctgatgggtggtaggcacggcgagttcaaatttctgccacccagcggatatgccccctgttacgaggcactactgccaaaagaaaaaatgaggctggagcctgtgaaggaatacaagcgagacgctgacggtattagagacttgctgggcacaactcagtttcttagccaggccagcttcataccttgccctgtcgatactagccaggttatcttgcctccgcatttagagaaaatacgagatcgtctggccgagaacattcacgagctgtgggggatgaataaaatcgagttaggatggaccttcggcaagattagagatgataataagcgtcagcatccctgtcttgtcgaattctctaaattgccggaaacagaaaaaaactataatctgcaaatgagcacagaaactcttaaaactttgctggccctcgggtgccatattgctcatgttaaccccgcagcggaggaagacctcaagaaagtaaaattgcctaagaattacatgatgagcaacggctataagccagcacccttggacctgagtgatgtcaagctgcttcctccacaggagatcctggtcgataaacttgctgagaacgcgcacaatgtgtgggcaaaggaccgcatcaaacaaggttggacttacggcattcagcaggatctgaagaacaaacggaatccgcggttggtgccttatgcactcctggacgagaggacaaaaaaatcaaatagggattcgctacgtgaggctgtgcgaacatttgtgggctacggttacaatatagagccctcagaccaagaattggccgacagtgctgttgagaaagtgagcattgataaaatccgcttcttcagggttgagcggtcatacgcagtgcgaagtggaaaatggtactttgagtttgaggtcgtgacaggcggcgatatgcgcgtcggttgggccagacctggatgtcgccctgacgtggagctgggcgcagacgatcaggcattcgtcttcgaagggaaccgcggccaacggtggcaccagggcagcggatattttggtcgaacgtggcagcccggagatgtggttggctgcatgatcaatctggatgacgctagcatgatctttacccttaatggagaattactgatcactaacaagggcagtgaactggcattcgccgactatgagatcgaaaacggcttcgtgccgatttgctgtttggggctgtcccagattggtcgaatgaacctcggcactgatgctagcacatttaagttctatacaatgtgtggccttcaagaaggtttcgaaccttttgcggtgaacatgaatcgcgacgtggccatgtggtttagcaagcgactgccgacctttgtaaatgttccaaaggaccacccacatattgaagtgatgcggatcgatggcacgatggattctcccccttgtctgaaggtgacacacaaaacatttggaacacagaacagcaatgccgatatgatctactgtcggctatcgatgccagtggagtgccatagttcattctctcatagcccgtgtcttgatagcgaggcgtttcagaagcgcaagcagatgcaggaaattctgtctcacacaaccactcagtgttactacgccatcaggattttcgcaggtcaggatcctagctgtgtctgggttggctgggtaacgccagactatcatctttatagtgaaaaatttgacctcaacaagaattgtactgtcacggtcacactaggcgacgagcgggggcgggtgcacgagtcggtgaaaaggtcaaactgttatatggtatggggcggcgacattgtggcttcttcacagcgaagtaaccgttctaacgtggatctggagatcgggtgtctggttgatcttgctatgggcatgctgagcttcagcgccaacggaaaggagctgggtacttgctaccaggtggaaccgaatactaaggtctttccagccgtctttctgcagccgacaagtactagcctatttcagtttgagttaggcaagctgaagaacgccatgcccttatcggctgccatttttcgcagtgaggagaaaaaccctgttccgcagtgccctccgcgtctggacgtgcaaaccatccagcccgtactgtggtccaggatgccaaattctttcttgaaggtggaaaccgaaagggtgagtgagaggcatggctgggtggtccagtgcctcgaaccactgcagatgatggccctgcacattcccgaggagaatcgatgcgtggacattctcgagctgtgtgaacaggaagacctgatgaggttccattatcacacactcaggctgtactccgccgtgtgcgcccttgggaacagccgcgtcgcgtatgcattatgttcacatgtcgatctctcccagctattctacgccattgacaataagtatttgccaggactcttgcgcagcggtttttatgatctgctcatttctatccacctggcttctgctaaggaaagaaagctcatgatgaaaaacgagtatatcattcctattactagcacaactagaaatatcaggctgttcccagacgagtcgaaaagacacggcttacctggtgtcggcctgaggacatgcctaaagccaggatttcgcttcagtaccccatgctttgtggtcacaggagaagaccaccagaaacagagtccagagatccccctcgagagccttaggaccaaggccttgtccatgctcaccgaagcggtccaatgctctggagctcacataagagaccctgtcggaggatctgtcgagttccagttcgtgcccgtcctgaagctgatagggacactgctcgtgatgggtgtgttcgatgacgacgatgtccggcagattctcctgctcatcgatccaagcgttttcggagaacactctgctggaacagaggagggcgccgagaaggaagaggtgacacaggtcgaggagaaggcagtggaggcaggagaaaaagccggcaaggaggcccccgtgaagggtctcctccagacacgtctgcctgagtctgtgaaacttcaaatgtgcgaattgctgtcttatctgtgcgactgtgagctccagcaccgggtggaggctattgtcgcctttggggatatatacgtttcgaagctgcaggccaatcagaagtttcgatataatgagctcatgcaagccctcaacatgtccgccgccctgaccgcccggaagaccaaggagttcagaagccctcctcaagaacaaataaatatgctgctgaatttccagctcggagaaaattgcccttgccccgaggagattagggaagaactttacgacttccatgaagacttgctccttcactgcggcgtccctttggaagaggaagaagaggaggaagaagatacctcatggacaggtaagctttgtgccctcgtttataagattaaaggaccacccaagccggagaaagagcagccaaccgaagaggaggaaagatgccccacaacactcaaagagctgatctcccaaactatgatctgctgggctcaggaggaccaaatccaggattccgaattagttaggatgatgtttaatctgctaaggcgacagtatgactccattggggaacttttacaggcgctgagaaaaacatacacaataagccacacatccgtttccgatacaatcaatctgctggccgctctgggccagattcggtcacttctgtcggtgcgcatgggcaaggaggaggagctgttgatgatcaatgggcttggagacatcatgaataacaaggtgttctaccagcaccccaacctcatgagggtcctgggcatgcatgaaacagtgatggaagtcatggtgaacgttctcgggaccgaaaagtcccaaatcgcgttccctaagatggtggcttcgtgctgcagatttctgtgctacttttgcagaatctctcgccaaaaccaaaaggctatgttcgagcatttgtcttacctcctcgagaattcatcagtgggccttgccagcccaagcatgagggggtcaacccctcttgatgtcgctgcttcatccgtaatggacaataacgagttagccctatctcttgaggaacccgatttggagaaggttgtgacttatctggcaggctgtggacttcagagttgtccaatgcttcttgcaaaagggtatcccgatgtgggatggaatcctattgaaggcgaacgctacttgtcatttctgagatttgcagtgttcgttaactcagaaagtgttgaagagaatgcaagtgtcgtcgtgaagctccttatcagaaggccggaatgtttcggaccggccctccgcggtgaaggaggtaatgggctgctggcagccatgcagggagctattaaaatcagcgagaaccccgcacttgatctgccttcacagggttataaacgggaagtgagtaccggagacgatgaagaagaggaagaaattgttcacatggggaatgctattatgagtttttatagtgcactgattgatctattgggacgttgtgcaccggaaatgcacctgattcagaccggtaaaggcgaagccattagaattcgctctatcctacggagtctggtaccgaccgaggacctcgtgggcatcattagcatacctctaaaactcccttccctgaataaggatggctcagtgagcgagcctgacatggccgccaatttctgccccgaccataaggccccgatggtcttattcctcgatcgcgtgtacgggataaaagaccaaacgtttctgctgcacctcctggaagttggattcctaccagacctgagggcctccgcatcattagatactgtgtcactatccacgaccgaggctgcccttgctcttaaccgatacatttgttccgccgttctgccacttctgactagatgtgctcccctgttcgctggaaccgaacactgtacatctttgatcgatagcactttgcagaccatttacagactatccaagggccggtctctaacaaaagcccagcgggacaccatagaggagtgcctcctggcaatctgtaaccacttgaggccatccatgttacaacaacttctcaggcgactggtattcgacgttcctcaactgaacgagtactgcaagatgccactgaaactgctaacaaaccattacgagcagtgctggaagtactattgtttgcccagtggttggggatcatacggcttggcggtggaggaagagttgcacctaacggagaagcttttctggggcatttttgatagcctgagtcataagaagtacgatcccgacctcttccgaatggccctgccttgtttgtctgctatcgccggagcactgcctccagattaccttgatacccgaattaccgctaccctcgaaaagcagatcagcgtcgacgcggacgggaacttcgaccccaagcccattaacactatgaatttttcactgccagaaaagctggagtacatcgttactaaatatgccgagcattcacacgacaaatgggcttgcgacaagagccagtctggttggaaatatggcatctccttggacgaaaatgtaaagacccatccactgatccggccgttcaaaacattgaccgagaaggagaaagagatttatcggtggcccgctagggaatccctgaagaccatgcttgcggtgggctggaccgtggagagaactaaagaaggggaggccttggtccaacagagagaaaacgagaagctcagatctgtgtcccaagcaaaccagggtaatagttacagtcctgctccactggatttgagcaatgtggttctaagccgggaactgcaaggaatggtcgaggttgtggcagaaaattatcataatatttgggcgaaaaaaaaaaagctggagttggaatccaaaggaggcgggagccaccccctgcttgttccttacgacacgttgaccgcgaaggagaagtttaaagaccgagaaaaggctcaggatctgtttaaattcctgcaagtgaacggcattatagtgtctcggggcatgaaggacatggaactggatgcttcgtccatggaaaagcgatttgcctataaattccttaagaagatccttaaatatgtagacagcgcccaagagtttattgcgcatctggaagcaatcgtaagtagcgggaagactgagaagtctccacgcgaccaagaaatcaaattcttcgccaaggtcctgctgccgctcgtcgaccaatatttcactagccactgtctctatttcctctctagtccattgaagcctctctcctcttcaggctacgcctcccacaaagagaaggaaatggtcgcaggactcttctgcaaactggctgctttggtgcggcataggatatctctctttggctcagacagtacaacaatggtctcttgtcttcacatattggcccagactctggacactaggaccgtcatgaaaagcggatcagaacttgttaaggcagggctgcgcgcgttcttcgaaaatgctgcagaagacctcgagaaaacctctgagaatctaaagctgggcaaattcactcattcccgcactcagattaaaggtgtgtcccagaacattaattatactacagtcgcattactgcctatcctgaccagcatatttgagcatgtaacccaacaccagttcggcatggacctgctcttgggagacgttcaaatttcatgctaccacattctgtgttctttgtacagcctcggaacaggcaagaacatttacgtcgagcgtcagaggcctgctctgggggaatgcttagctagcctggctgccgcaatccctgtggcctttctggagcctactctgaatcggtataaccccctgagcgtgttcaataccaaaacacctcgtgaacgaagtatcctggggatgccagacactgtcgaagacatgtgtcctgatatcccccagttagagggcctaatgaaggaaattaacgatctggctgagagcggcgcacggtacacggagatgccacatgttattgaagtcatcctgcccatgctctgtaactatctgtcctactggtgggagcgcggaccagaaaacctgccgccttccaccggaccctgctgtaccaaagtgacttctgagcacctgagcttgatcctcggaaatattctgaaaattataaacaacaatctgggcatcgatgaagcaagctggatgaaacgtatagccgtatacgctcagccgataattagcaaagccaggccagaccttctgaggtcgcatttcatacctactttggagaagctgaaaaaaaaggcggtgaagactgtgcaggaagaagagcaattgaaggcagacgggaagggtgacacgcaggaggccgaactgctgattcttgacgaatttgccgtcctctgtcgggacctgtatgcgttctatccaatgctgatccgttacgttgacaataaccggagtaactggcttaagagtccagatgctgatagcgatcagctatttcgcatggtagccgaagtgttcatactatggtgcaagagtcataactttaaaagggaagagcagaactttgtgatccagaatgagatcaataatctcgcgtttcttacaggagattcaaagagcaagatgtccaagagtggcggccaagatcaggagaggaagaaaacaaagcgccggggggacctctattctattcagaccagcctgattgtggctgcgctgaaaaaaatgctgcccatcggacttaatatgtgtactccaggagatcaggagctaatcagcttggccaaaagtaggtattcccatagggacactgatgaagaggtacgggagcacctcaggaataacctgcacttgcaagaaaagagcgatgatcccgccgtcaaatggcagctgaacctttacaaagatgttctcaagtctgaagagcccttcaacccagagaagacagtggagcgggtccagagaattagcgcagccgtttttcatctggagcaggttgaacaaccactgaggtccaaaaaagcagtctggcacaaactcctctccaagcagaggaagagggcggtggtggcttgtttccgaatggctcctctctacaaccttcccaggcatcggagcatcaatttgttcctgcatggatatcagaggttttggatcgagaccgaggaatattcttttgaagagaagctggtacaggatttagccaaaagcccaaaagtcgaggaagaagaggaggaggaaaccgagaaacagcctgatcctctccaccagatcatcctttatttttctaggaacgctttaaccgagaggtctaaactagaagatgatcccctgtatacctcttactcctctatgatggccaagtcctgccagtctggagaagacgaggaggaagatgaagacaaggagaaaacgttcgaggagaaggaaatggagaaacagaaaaccctctaccaacaggcacgcctgcatgaaagaggcgccgcagagatggtgctgcagatgatttctgcctcgaaaggtgagatgtcaccaatggtggtggaaactctgaaacttggcattgccatcttaaacggaggcaacgccggagtgcaacagaaaatgttagactacctgaaagaaaaaaaagacgccggcttctttcagtccctaagcggtctcatgcaatcttgctctgttctggacctcaacgcattcgagcggcagaataaggctgaagggttaggcatggtaaccgaggaggggacgttaatagtgcgggagcgcggcgaaaaggttttgcagaacgacgaattcactagagatctcttccgtttcttgcaacttctgtgtgagggccacaactctgattttcaaaacttcttaaggacccagatgggcaacacgactactgttaacgtgataatctctaccgtggactatctgttacggttgcaggagtccatttctgacttctactggtactatagcggcaaggatattattgacgagagcggccagcacaacttttccaaagctctggccgtgaccaagcagatctttaacagtcttacagagtacattcaaggaccatgtattggtaatcagcagtccctcgcgcactctcgcctgtgggacgccgtcgtgggattcctgcacgtgtttgccaatatgcagatgaaactcagccaggatagctctcagattgaactacttaaggagcttctcgatctcctgcaggacatggtcgtcatgctgttgagtctgctagaggggaatgtggtgaatgggaccataggaaaacaaatggtggacacattagtggagagcagcactaatgttgagatgatcctgaagttctttgatatgtttctcaagcttaaggacttgacttctagcgacacatttaaggaatacgaccccgatggaaagggcatcattagcaaaaaggagttccagaaggccatggaagggcagaagcagtatacccagagcgagattgatttcctcctctcctgtgctgaagcagacgaaaatgacatgttcaactacgtagacttcgtggatcgattccacgaacctgccaaagacattggctttaatgttgcagtcctcttaacaaacttgagcgagcatatgcccaatgactctcgattaaagtgtttgctggacccggccgaatcagtgctgaactactttgagccttacttgggaaggatcgaaattatgggtggcgccaaaaagatcgagcgcgtttacttcgagatttctgagtcgtctagaacacagtgggagaagccccaagtcaaggagtcaaaaagacaattcattttcgatgtcgttaatgaaggaggcgaacaagaaaaaatggagctctttgtgaatttttgtgaggatacaattttcgagatgcagctggcaagtcaaattagcgaaagtgactccgccgatagacccgaggaggaggaggaggacgaagattcgtcatatgttctggagattgccggggaggaggaagaggacggttctctcgaacccgcctcagcttttgccatggcctgtgcaagcgtcaaacggaatgtgactgattttctgaagcgggcgacactcaagaaccttcggaagcagtacaggaatgtcaaaaaaatgactgctaaggagctggtgaaggtcctgttcagtttcttttggatgctgttcgtgggcctttttcaactactgttcactatcctgggaggcatctttcagattctttggagtaccgtgttcgggggaggactggtggagggcgccaagaacatccgggtgactaaaatcctcggtgacatgccagaccctacccagtttggaattcatgacgacaccatggaggctgagcgggccgaagtcatggagcctgggattaccactgaattagttcattttataaagggagaaaagggtgataccgatattatgagcgacttatttggcctccatccaaaaaaagagggttctttgaaacatggaccagaggtcggcctgggggatctgtcagaaatcatcgggaaagatgagcccccaacattggaaagtactgtccaaaaaaagagaaaggctcaggcagcagagatgaaagcagctaacgaggccgagggcaaagtggagtcagaaaaggcagatatggaggacggcgagaaggaggataaagacaaggaggaggaacaggcagaatacctgtggactgaggtcaccaagaaaaagaagcgccggtgcggtcagaaggtcgaaaaaccggaggcttttaccgctaacttctttaagggactggaaatctatcagactaaactgctacattacctagccaggaatttttacaacttaaggttcctagctctgtttgtggcctttgccattaattttatcctcctgttttacaaggtgaccgaggagccgctggaagaggagaccgaggatgtcgctaacctgtggaattccttcaatgatgaggaagaagaagaggccatggtgttctttgtccttcaggagagcaccggatacatggcccctacactgcgcgccctcgcaatcatccatactattatcagtctagtttgcgtagtgggatattattgcctgaaagtgccactggtggtattcaaacgcgaaaaagagatcgcaaggaagctcgaattcgatggcctgtacatcacagaacagccatcggaggatgatattaaaggacagtgggaccgtctggtgatcaataccccctcctttcctaacaattactgggacaagtttgtaaaacgcaaagttattaataaatacggcgacctttacggtgctgaaaggattgctgagctcctggggctggataaaaacgccctcgatttcagccctgtggaggaaaccaaagccgaggcagcgagtttggtatcctggctttcgtcaattgatatgaagtaccatatctggaaactcggtgtggtctttactgataacagcttcctttacctggcctggtacactactatgagtgtgttaggtcactataacaatttttttttcgccgcccacctcctggacattgccatgggctttaagactttgcggactattctgagctccgtgacacataatgggaagcagttggtcctgacagtcggtctgttggctgtcgttgtctatctgtatactgttgtagcattcaattttttccgcaagttctacaacaagagcgaggatgacgacgagcctgacatgaaatgcgacgatatgatgacctgttatctttttcatatgtatgtgggcgtgagagctggcggcggtatcggtgatgaaattgaagaccctgccggggatccctacgagatgtaccggatcgtgtttgacattacctttttcttttttgtgatcgtgatattgctggcaattatccagggtctgatcattgatgccttcggggagctgcgcgatcagcaggagcaggtgagagaggatatggagactaagtgcttcatttgcggaattggcaatgactactttgatacaacaccacacggttttgagacccacacactgcaggaacataacctggccaattatctgttcttccttatgtatttaattaacaaagatgaaacggaacacactggacaagagagctatgtctggaagatgtaccaggaaaggtgctgggacttcttccctgccggcgattgcttcagaaaacagtatgaggatcagctggggtag

SEQ ID NO: 204114 - DNA, 285 bp, Artificial Sequence
  Description of Artificial Sequence: Synthetic coding sequence
atgggcagcgagctggagaccgccatggagaccctgatcaacgtgttccatgctcattccggtaaagaaggagacaaatataaactgtctaaaaaggaattaaaggagctactgcagaccgagcttagtggctttctcgacgcccagaaagatgtggatgctgtcgacaaggtgatgaaagaactggatgagaatggggatggagaggttgactttcaggaatacgtggtgctggtggccgcgcttaccgtcgcctgtaacaactttttttgggaaaatagttag

SEQ ID NO: 204115 - DNA, 162 bp, Artificial Sequence
  Description of Artificial Sequence: Synthetic coding sequence
atgggcagcgagctggagaccgccatggagaccctgatcaacgtgtttcacgcacatagcggcaaggagggggataagtataagctgagtaagaaggagctcaaggagctcctgcaaaccgagctgtcaggcttcctggacgttaaggaactcatgctttag

SEQ ID NO: 204116 - DNA, 444 bp, Artificial Sequence
  Description of Artificial Sequence: Synthetic coding sequence
atggaggagccccagaccaagacccccagcgccgagttccccccctatcgggctcagccagcacagccagccaccgcccccgccgctacattcgccaccctagcaatctgtcctgagcccgctcccacttcagggcctggacagccctgtactgccgccatgggctctgagctggaaactgccatggaaaccctgataaatgtgtttcacgcacacagtggcaaggaaggggataagtacaaattgagcaagaaagaattaaaagaattgttgcagactgaactgagcggctttctcgacgcacagaaagatgttgatgcagtggacaaggtcatgaaagagttagacgaaaatggggatggtgaagtagatttccaggagtacgtcgtccttgtagctgccctgaccgtcgcctgtaataatttcttctgggagaactcttag

SEQ ID NO: 204117 - DNA, 105 bp, Artificial Sequence
  Description of Artificial Sequence: Synthetic coding sequence
atgggcagcgagctggagaccgccatggagaccctgatcaacgtgttccatgcccattctgggaaagaaggggacaagtacaaattgtctaagaaggaactatag

SEQ ID NO: 204118 - DNA, 294 bp, Artificial Sequence
  Description of Artificial Sequence: Synthetic coding sequence
atgcccagccagatggagcacgccatggagaccatgatgttcaccttccacaaattcgctggggacaagggttatcttactaaggaggaccttcgcgtgctgatggagaaggagtttccaggattcctggaaaatcagaaggaccctcttgctgtggataaaattatgaaggacctggaccagtgtagagacggaaaagtggggttccaatccttttttagtcttattgccggtctcacaatagcttgcaacgactacttcgttgtgcacatgaagcagaaaggcaaaaagtag

SEQ ID NO: 204119 - DNA, 294 bp, Artificial Sequence
  Description of Artificial Sequence: Synthetic coding sequence
atgcccagccagatggagcacgccatggagaccatgatgttcaccttccacaagtttgctggcgacaaaggctatttgaccaaagaagacctgagggtgctcatggagaaggaattccccggctttctggaaaaccagaaggatccactcgccgtggacaaaatcatgaaggacttagaccagtgccgagacggcaaggtgggcttccagtcatttttctctctgattgcaggcctgacaattgcctgtaacgattactttgtcgtacacatgaaacagaagggcaaaaagtag

SEQ ID NO: 204120 - DNA, 318 bp, Artificial Sequence
  Description of Artificial Sequence: Synthetic coding sequence
atggccaagatcagcagccccaccgagaccgagcggtgcatcgagtcccttatcgccgttttccaaaaatatgcggggaaagatggatacaactatacattatctaaaaccgagtttctcagctttatgaacacagaattagcagcgttcaccaaaaatcagaaagatccaggagtgcttgatcgcatgatgaagaagttagataccaactcagatgggcagctggactttagtgaattcctgaacttgatcggcggcctggccatggcctgccatgacagttttctcaaggcggtgccatcccaaaaacgcacctag

SEQ ID NO: 204121 - DNA, 252 bp, Artificial Sequence
  Description of Artificial Sequence: Synthetic coding sequence
gccggcaagatgaccaagctggaggagcacctggagggcatcgtgaatatcttccaccagtactcagtgagaaaaggccactttgacactctgtccaagggagaattgaaacagctccttacaaaggaactcgccaacactatcaagcgtcccaaaaagggctcctccgtgattgacgaaatctttcagggattggacgcaaaccaagacgagcaggtggatttccaagaatttatctcactggttgcatag

SEQ ID NO: 204122 - DNA, 279 bp, Artificial Sequence
  Description of Artificial Sequence: Synthetic coding sequence
atgaccaagctggaggagcacctggagggcatcgtgaacatcttccatcagtatagtgtgaggaaaggtcatttcgacactctcagcaaaggcgagcttaagcaactgctgaccaaagagctggctaacacaattaagaacatcaaagataaagctgtcattgacgagatcttccaaggccttgatgccaaccaagacgaacaggtggactttcaagaatttatctccctagtcgcgatcgcactcaaagctgcccactatcacacccacaaggagtag

SEQ ID NO: 204123 - DNA, 297 bp, Artificial Sequence
  Description of Artificial Sequence: Synthetic coding sequence
atggccgccgagcccctgaccgagctggaggagagcatcgagaccgtggtcacgacctttttcaccttcgcacggcaggaaggccgaaaagactctctctcggttaacgaatttaaggagctggtgacccaacagttgccccacctgttaaaggatgtgggatctctagatgagaaaatgaagagccttgacgtaaatcaagattctgagctgaaatttaacgagtattggagactgattggcgagctggcaaaggagattagaaagaagaaggatttgaaaattcgcaagaagtag

SEQ ID NO: 204124 - DNA, 297 bp, Artificial Sequence
  Description of Artificial Sequence: Synthetic coding sequence
atggccgccgagcccctgaccgagctggaggagagcatcgagaccgttgtgacaacgtttttcacattcgcgcgacaggagggtcgcaaagattcgctgtccgtcaatgagtttaaagagttagttacacaacagctcccacatctgctgaaggacgtcggatcgcttgacgagaaaatgaaatccctggatgtgaaccaagattcagaacttaaatttaacgaatactggcgcttgatcggtgagctggcgaaagaaattcgaaaaaaaaaggacctgaaaattcggaaaaagtag

SEQ ID NO: 204125 - DNA, 297 bp, Artificial Sequence
  Description of Artificial Sequence: Synthetic coding sequence
atggccgccgagcccctgaccgagctggaggagagcatcgagaccgtagtgacgaccttcttcacattcgcccgccaggagggacggaaggatagcctgtctgttaacgagttcaaggagctggtgacacaacagctgccgcacctgctcaaggacgtcggcagtttggatgagaaaatgaaatcgctcgatgtgaatcaggactctgagctcaagttcaatgagtattggcgtttgattggagagttggccaaggaaatcagaaaaaagaaggacttgaagattcggaaaaaatag

SEQ ID NO: 204126 - DNA, 297 bp, Artificial Sequence
  Description of Artificial Sequence: Synthetic coding sequence
atggccgccgagcccctgaccgagctggaggagagcatcgagaccgtcgtcacaacgttcttcacgttcgctcgacaagagggtcgcaaagatagtctgtccgtgaatgagttcaaggaactggttacccagcagctaccccatcttctcaaagatgtgggctcactcgacgagaaaatgaagagccttgacgtgaaccaggattccgagttaaagttcaatgagtactggagactaatcggggagctggccaaagaaattagaaagaagaaagatcttaagattaggaagaagtag

SEQ ID NO: 204127 - DNA, 297 bp, Artificial Sequence
  Description of Artificial Sequence: Synthetic coding sequence
atggccgccgagcccctgaccgagctggaggagagcatcgagaccgtggtaaccacattctttacatttgctcgacaggaagggaggaaggattcactgagtgtgaacgagttcaaagagcttgtaactcagcagctgccgcacctactgaaggatgttggttcccttgatgagaagatgaagagccttgacgttaaccaagactccgaactcaaatttaatgagtactggaggttgattggcgaacttgctaaagagattaggaagaagaaggacctgaagatcaggaaaaagtag

SEQ ID NO: 204128 - DNA, 315 bp, Artificial Sequence
  Description of Artificial Sequence: Synthetic coding sequence
atgggccagtgccggagcgccaacgccgaggacgcccaggagttcagcgatgtcgaacgtgccattgagactttgatcaaaaacttccatcagtacagtgtcgaggggggcaaagagactctcactccctcggagctcagagacttggtgacacaacagctccctcacctcatgccttccaactgtgggctcgaagagaagatagccaatctgggatcatgcaatgatagtaagctcgagtttcgtagtttctgggaacttattggagaagctgcaaaaagtgtcaaactcgagcgccccgtgagaggccactag

SEQ ID NO: 204129 - DNA, 315 bp, Artificial Sequence
  Description of Artificial Sequence: Synthetic coding sequence
atgggccagtgccggagcgccaacgccgaggacgcccaggagttctctgacgtcgaacgggctatcgaaactctgatcaaaaacttccatcaatacagcgtcgagggaggaaaggaaactctgaccccttctgaactgagggatctcgtgacacagcagttgccccatttaatgccctcaaactgcggcctggaggagaagattgcaaacttgggatcctgtaatgattccaaactggaatttcgcagtttttgggagctaatcggagaagcggctaaaagcgttaaattggagcgaccagtgagaggtcattag

SEQ ID NO: 204130 - DNA, 315 bp, Artificial Sequence
  Description of Artificial Sequence: Synthetic coding sequence
atgggccagtgccggagcgccaacgccgaggacgcccaggagttcagtgatgtagaaagagctatcgagaccctgataaaaaatttccatcaatactcggtcgagggaggcaaagagacgctgacaccaagtgaactcagggacttagtcacccagcagctacctcacttgatgcccagtaactgcggactggaggagaagattgccaacttgggatcctgcaatgactccaagctggagttcaggagtttctgggaactcattggagaagccgcaaaatcagtgaaattagagcgccccgtgcgtggtcattag

SEQ ID NO: 204131 - DNA, 315 bp, Artificial Sequence
  Description of Artificial Sequence: Synthetic coding sequence
atgggccagtgccggagcgccaacgccgaggacgcccaggagttcagcgacgtggaacgggcgattgaaaccctaatcaagaacttccatcaatattctgtggaaggaggaaaggaaacactgaccccttccgagctgcgcgatctagtgacacagcaactccctcatttgatgccctcaaactgcggcttagaagaaaagatcgcaaaccttggcagctgtaacgactccaaactggagtttcgtagtttttgggagctgatcggcgaggccgcaaaatcagtgaaactggagcgccctgtccgtggtcactag

SEQ ID NO: 204132 - DNA, 417 bp, Artificial Sequence
  Description of Artificial Sequence: Synthetic coding sequence
atgtgcagcagcctggagcaggccctggccgtgctggtgaccacctttcacaagtatagctgccaggagggagataagtttaaattatcaaagggtgagatgaaggagctgctacacaaggaactcccaagctttgttggccactcaagggagccttgcgccgtgcgggcatttagagtgcacctgttcaatccagtgatcggggatctgaggaatcaatcccctgaaggaaagagcgattgtcctaaaattacccaacactgggagaaggtagacgaggaaggtctgaagaagctgatgggctctttggatgaaaattccgaccagcaggtggacttccaggagtatgccgtatttctggccctgattacggtgatgtgcaacgattttttccaaggttgtccggaccgcccttag

SEQ ID NO: 204133 - DNA, 294 bp, Artificial Sequence
  Description of Artificial Sequence: Synthetic coding sequence
atgtgcagcagcctggagcaggccctggccgtgctggtgaccacctttcacaagtactcttgtcaggaaggagacaagttcaaactgagcaagggcgagatgaaggagcttctacacaaagaacttccatcatttgttggagagaaagtggacgaagaaggattgaagaagctcatggggtcactagatgagaactctgaccagcaggtagactttcaggagtacgccgtttttctagcattgatcacagtgatgtgtaacgactttttccagggatgtccggatcggccgtag

SEQ ID NO: 204134 - DNA, 294 bp, Artificial Sequence
  Description of Artificial Sequence: Synthetic coding sequence
atgtgcagcagcctggagcaggccctggccgtgctggtgaccacctttcacaagtattcttgccaggagggtgacaagttcaaactttcgaagggggagatgaaagaactgctgcacaaagagctcccatcgttcgtaggagaaaaggtagatgaagaagggctgaaaaagctgatggggtcactggatgagaacagcgatcaacaagttgatttccaggagtacgccgtatttctggcccttattaccgtcatgtgtaacgatttcttccagggatgcccagaccgaccatag

SEQ ID NO: 204135 - DNA, 294 bp, Artificial Sequence
  Description of Artificial Sequence: Synthetic coding sequence
atgtgcagcagcctggagcaggccctggccgtgctggtgaccacctttcacaagtacagctgtcaggaaggggacaaattcaagctatcgaaaggcgagatgaaagaactactccacaaagagctgccttcttttgtgggagaaaaggttgatgaagaagggcttaaaaaattaatgggttccctggacgagaactcggaccagcaggtggactttcaggaatatgccgttttcctggcgttgattacagtgatgtgcaatgactttttccagggatgcccagatcgcccctag

SEQ ID NO: 204136 - DNA, 306 bp, Artificial Sequence
  Description of Artificial Sequence: Synthetic coding sequence
atggcccggcccctggagcaggccgtggccgccatcgtgtgcaccttccaggaatacgccggaagatgtggagacaagtataagctttgccaggccgagctaaaggagctgctgcagaaggaactggcaacttggacacccaccgaattccgagagtgtgactacaataagttcatgtccgtgcttgacacaaataaagactgcgaagttgatttcgtggagtatgtgagatccctggcgtgtctatgcctctattgccatgaatactttaaggactgtccaagtgaaccaccttgctcacagtag

SEQ ID NO: 204137 - DNA, 306 bp, Artificial Sequence
  Description of Artificial Sequence: Synthetic coding sequence
atggcccggcccctggagcaggccgtggccgccatcgtgtgcaccttccaggaatacgccggacgatgtggagacaagtacaaactgtgccaggctgagctcaaagagctcctgcagaaagaactggcaacatggaccccaaccgagtttagggagtgtgattataataaattcatgagcgtcctggacacaaacaaggattgcgaggtggactttgtagagtacgtgcggagcctggcgtgcttatgtttgtactgccacgaatattttaaagattgcccaagcgaacccccttgctcacagtag

SEQ ID NO: 204138 - DNA, 306 bp, Artificial Sequence
  Description of Artificial Sequence: Synthetic coding sequence
atggcctgccccctggagaaggccctggacgtgatggtgagcaccttccataagtactctggtaaggaaggagataagtttaagttaaacaagtccgagcttaaggaactcctcactcgcgagctgcctagttttcttggcaagaggacagacgaggcggctttccaaaaactaatgtccaatctcgatagtaatagagataatgaagtggacttccaggagtactgcgtgttcctcagttgtattgccatgatgtgtaatgaatttttcgagggcttcccagataagcaaccgcgaaagaaatag

SEQ ID NO: 204139 - DNA, 306 bp, Artificial Sequence
  Description of Artificial Sequence: Synthetic coding sequence
atggcctgccccctggagaaggccctggacgtgatggtgagcaccttccacaaatacagcggcaaggaaggcgataagttcaaattgaataagtcagagctgaaagagctacttactcgcgagttgcctagcttcctaggcaagaggacagatgaagcagcatttcagaagctcatgtctaatttagattcaaatcgagataacgaggtcgatttccaggaatattgcgttttcctttcttgtattgcgatgatgtgtaacgaatttttcgaggggtttcccgacaagcagccaaggaaaaagtag

SEQ ID NO: 204140 - DNA, 306 bp, Artificial Sequence
  Description of Artificial Sequence: Synthetic coding sequence
atggcctgccccctggagaaggccctggacgtgatggtgagcaccttccataagtacagcgggaaggagggcgataagttcaaactgaataagtctgagctgaaggagttacttaccagggagctcccaagctttttagggaaaaggaccgacgaggctgcttttcaaaagctgatgagcaacctggactcgaatcgagataacgaagtggatttccaggaatactgcgtattcctgagctgtatcgcaatgatgtgtaacgaattttttgaagggttcccagataaacagccccgaaagaaatag

SEQ ID NO: 204141 - DNA, 306 bp, Artificial Sequence
  Description of Artificial Sequence: Synthetic coding sequence
atggcctgccccctggagaaggccctggacgtgatggtgagcacctttcacaaatatagtggaaaagaaggggacaagtttaaattgaataagagcgagcttaaagagctgctcactagagaacttccatcctttctaggcaagcgcacggatgaagcggcttttcagaaacttatgtctaatttggatagcaatagggataacgaggtcgatttccaggaatactgcgtgttcctgagttgcattgccatgatgtgcaacgagttctttgaaggctttccagataaacagcctcgaaaaaagtag

SEQ ID NO: 204142 - DNA, 273 bp, Artificial Sequence
  Description of Artificial Sequence: Synthetic coding sequence
atggtgagcaccttccacaagtacagcggcaaggagggcgacaagtttaagctcaacaagtctgagcttaaggaattgttgactcgcgagcttccttcgtttcttggcaagaggactgacgaagctgcctttcagaagctcatgtccaatttggattcgaacagagataatgaggtagacttccaggaatattgcgtttttttaagttgcatagccatgatgtgtaacgagttctttgagggcttccctgataagcagccccgaaagaaatag

SEQ ID NO: 204143 - DNA, 333 bp, Artificial Sequence
  Description of Artificial Sequence: Synthetic coding sequence
atgcccgccgcctggatcctgtgggcccacagccacagcgagctgcataccgtcatggagactcctctggaaaaggccctgacaactatggtgacaaccttccacaagtacagcgggcgcgagggaagcaagcttaccctgagtagaaaggaacttaaagagctcatcaagaaggaactttgtttaggtgaaatgaaagagagttcaatagatgatttgatgaaatccctggataagaactccgaccaggaaatcgatttcaaggaatattcggtgttcttgactatgctctgcatggcctacaatgatttctttcttgaggacaataagtag

SEQ ID NO: 204144 - DNA, 279 bp, Artificial Sequence
  Description of Artificial Sequence: Synthetic coding sequence
atggagacccccctggagaaggccctgaccaccatggtgaccaccttccacaagtactctggccgcgagggctcaaaactgaccttgtccaggaaagagctgaaagaactgataaagaaagagctctgtctgggcgaaatgaaggagtctagcattgatgacctcatgaagtctctcgacaaaaactcagatcaggaaattgacttcaaggagtactcagtgttcctcaccatgctctgtatggcctataatgatttctttctagaagataacaaatag

SEQ ID NO: 204145 - DNA, 279 bp, Artificial Sequence
  Description of Artificial Sequence: Synthetic coding sequence
atggagacccccctggagaaggccctgaccaccatggtgaccacctttcacaagtacagtggacgcgaggggtccaagttgacactgtctcgcaaagagttaaaagaactgatcaagaaagagttatgcttgggagaaatgaaggagtcttctatcgatgacttgatgaagtcattggacaagaacagtgatcaagaaatcgactttaaggagtattccgtgttcctgacaatgctgtgcatggcatacaacgattttttcctcgaggataacaaatag

SEQ ID NO: 204146 - DNA, 273 bp, Artificial Sequence
  Description of Artificial Sequence: Synthetic coding sequence
atggcctgccccctggaccaggccatcggcctgctggtggccatctttcataaatactcgggcagagaaggggataagcatactctgtctaaaaaggagttgaaagaactgattcagaaagagctgaccattggatccaagcttcaagatgctgagattgcccgcttgatggaggatttagacagaaataaagaccaggaggtgaacttccaggagtatgtaaccttcctgggagcattggcattgatttataacgaggctctcaaaggatag

SEQ ID NO: 204147 - DNA, 273 bp, Artificial Sequence
  Description of Artificial Sequence: Synthetic coding sequence
atggcctgccccctggaccaggccatcggcctgctggtggccatctttcataaatattccgggagggaaggagacaaacacactctgtccaagaaagagctcaaagaattaattcagaaggaattaactattggaagtaaattgcaggatgcagagatcgctcgcttgatggaagatcttgaccgcaataaggaccaggaagtgaacttccaagagtacgttacctttctcggggctctggcactgatctataatgaggctttgaaggggtag

SEQ ID NO: 204148 - DNA, 306 bp, Artificial Sequence
  Description of Artificial Sequence: Synthetic coding sequence
atgagcaacacccaggccgagcggagcatcatcggcatgatcgacatgttccataagtatacaagacgggatgataaaattgaaaaaccttctctgctcaccatgatgaaagaaaattttcccaatttcctcagcgcttgtgataaaaaaggaacaaactatcttgccgatgtgtttgagaaaaaagataaaaacgaggataagaaaattgacttttctgagttcctgtcacttctaggcgatatagcaactgactaccataagcagtctcacggagctgctccttgttcgggaggtagccagtag

SEQ ID NO: 204149 - DNA, 306 bp, Artificial Sequence
  Description of Artificial Sequence: Synthetic coding sequence
atgagcaacacccaggccgagcggagcatcatcggcatgatcgacatgttccacaagtacacccgtcgagatgacaaaattgaaaagccgtccttgctgacgatgatgaaggaaaatttcccaaattttcttagcgcctgcgacaaaaagggaactaattacttagcagacgtgttcgaaaaaaaggacaaaaatgaggacaaaaaaatagattttagcgaattcctctctctgcttggcgatatagccactgattaccacaagcagagccacggggccgctccttgttctggtggctcgcagtag

SEQ ID NO: 204150 - DNA, 282 bp, Artificial Sequence
  Description of Artificial Sequence: Synthetic coding sequence
atgctgaccgagctggagaaggccctgaacagcatcatcgacgtgtatcataaatactccctgatcaaaggaaactttcacgcagtctaccgtgacgacctgaagaaattgctcgaaaccgagtgtccccagtatattcgaaaaaaaggcgctgatgtgtggtttaaagagctggatattaatacggacggagcagttaactttcaggagtttctcatcctcgtcataaaaatgggcgtggctgcccataaaaagtcgcacgaggaatcacataaggaatag

SEQ ID NO: 204151 - DNA, 282 bp, Artificial Sequence
  Description of Artificial Sequence: Synthetic coding sequence
atgctgaccgagctggagaaggccctgaacagcatcatcgacgtgtatcacaagtattctctcataaaggggaacttccacgcggtgtaccgagatgacctgaaaaaactactggagacagaatgcccacaatacatcagaaagaagggggcggacgtttggttcaaagagttagacatcaatacagatggcgccgttaacttccaggagtttcttatcttagtgataaagatgggagtggcggcccacaagaaaagccacgaggaaagtcataaggagtag

SEQ ID NO: 204152 - DNA, 345 bp, Artificial Sequence
  Description of Artificial Sequence: Synthetic coding sequence
atgacctgcaagatgagccagctggagcggaacatcgagaccatcatcaacaccttccaccagtactctgtgaagttgggccatcccgacacgctcaatcagggggaattcaaggaactggtcaggaaagacttgcagaatttccttaaaaaagagaacaaaaacgaaaaagtaatagagcatataatggaggatctcgacaccaacgccgacaaacaattaagcttcgaggaattcattatgttgatggcccgtctcacttgggcctcccacgagaagatgcatgagggagacgaaggcccgggtcaccaccataagcccggattgggggagggaaccccctag

SEQ ID NO: 204153 - DNA, 279 bp, Artificial Sequence
  Description of Artificial Sequence: Synthetic coding sequence
atgagcgagctggagaaggccatggtggccctgatcgacgtgttccaccagtacagcggccgtgagggcgacaaacacaaattgaaaaagtccgagctcaaggagctcattaacaatgagctgagtcattttctggaagaaatcaaggaacaagaagtcgtggacaaggtcatggagaccctggacaacgatggcgacggggaatgcgattttcaagaatttatggccttcgtagcaatggtgaccacagcctgccatgaatttttcgagcatgagtag

SEQ ID NO: 204154 - DNA, 279 bp, Artificial Sequence
  Description of Artificial Sequence: Synthetic coding sequence
atgagcgagctggagaaggccatggtggccctgatcgacgtgttccatcagtattccgggcgagagggggacaaacacaagctcaagaaaagcgaactgaaagaacttatcaacaatgagctgtcacactttttggaggagatcaaggagcaagaggtggtggataaggtgatggagacccttgacaatgatggagacggagagtgcgactttcaggaatttatggcctttgtagcaatggtcaccaccgcttgtcatgaatttttcgagcacgagtag

SEQ ID NO: 204155 - DNA, 288 bp, Artificial Sequence
  Description of Artificial Sequence: Synthetic coding sequence
atgaccgagctggagaccgccatgggcatgatcatcgacgtgttcagcaggtactccgggtctgaagggtcgacccagacactgaccaagggtgagcttaaggttctgatggagaaagagctacccggattcctccagagcggcaaagacaaggacgcggtggacaaactcctcaaggatctcgatgccaatggcgatgctcaggttgatttcagcgaattcatagtctttgtcgccgctataacatcggcatgccataagtacttcgaaaaggccggactcaagtag

SEQ ID NO: 204156 - DNA, 300 bp, Artificial Sequence
  Description of Artificial Sequence: Synthetic coding sequence
atgcccacccagctggagatggccatggacaccatgatccggatcttccatagatattccggcaaagaacggaaacggttcaaactgtctaagggcgagttaaaactactgctgcaaagagaactcactgagttcctctcatgccagaaagagacccagctcgtggacaagatagttcaagatctggatgccaacaaagataacgaagtggatttcaacgagtttgttgtgatggtcgcagccctcacggtggcctgcaacgactacttcgtggagcagttaaaaaagaaggggaagtag

SEQ ID NO: 204157 - DNA, 300 bp, Artificial Sequence
  Description of Artificial Sequence: Synthetic coding sequence
atgcccacccagctggagatggccatggacaccatgatccggatcttccacaggtacagtggtaaagaaaggaagagatttaagcttagtaagggcgagctgaaattgctcctgcaaagagaattaaccgagtttctgagctgtcagaaggaaacacagctggtggataaaatcgtgcaggacctcgacgctaataaggacaatgaagtagatttcaacgagttcgtcgtgatggtagcggccctgacggtcgcctgcaatgactacttcgttgagcagctgaagaagaaaggtaagtag

SEQ ID NO: 204158 - DNA, 1029 bp, Artificial Sequence
  Description of Artificial Sequence: Synthetic coding sequence
atgatgtgcagccgggtgcccagcgagcagagcagcggcaccagcctgttacccaaagacggggccccgtttagctgggatagcctcgacgaagacggtctggacgactctcttctggaactctccgagggagaagaagacgacggagacgtgaactatactgaagaggaaatcgatgccttactgaaagaagacgacccctcttatgagcagtccagcggagaggacgacggtggtcatgtcgaaaaaggcgagcggggttctcaaatcctgctcgacacaccaagagaaaagaactcttcatacagcctgggacctgtggcagagactccagacctctttaagctcccacaactaagtacttccagcggccacggaccggcccacacgaaaccactgaacaggcgcagcgtccttgagaaaaacctaatcaaggtgacagtagcaccattcaatccgaccgtttgtgacgcactgctggataaggacgaaactgatagtagcaaagataccgagaagctatcgtctttaggggaggagatgcgggaagatggccttagcccaaatgagtctaaactgtgcacggagagcgaaggaatctcccccaataactcagcttggaacggcccacaactttctagcagcaacaacaacttccagcagacagttagcgacaagaatatgcctgactccgaaaacccgactagcgtgttttctaggataagcgaccattccgagacaccgaacatggaattatcttgccggaacggtggcagccataagtcatcttgcgagatgcgcagcctcgtcgtaagtaccagtagtaacaagcaagacgtactgaacaaagattctggtaagatgaagggacacgaacgccgtctaggaaaggttattcccgtgctgcagactaagacccgcaccaacgtccccactttctcgcaaagcaaccttgagcagcagaagcagttatacctgcgttccgttattgcccatatagaagacccagaggatacgaatcaaggctag

SEQ ID NO: 204159 - DNA, 1227 bp, Artificial Sequence
  Description of Artificial Sequence: Synthetic coding sequence
atgatgtgcagccgggtgcccagcgagcagagcagcggcaccagcctgcttcctaaagatggcgcgcccttttcctgggatagccttgacgaggacggcctggatgattcactcttagagctctccgagggtgaggaggatgatggtgatgtgaattacacggaggaagagatcgatgctctcctgaaagaggacgatccaagttacgagcagtcaagcggagaggatgacgggggccacgtcgaaaagggcgaaaggggtagccagatcctcttggacacccctcgtgagaaaaatagctcatactcactcggccccgtggccgagactcccgatctgtttaaacttccccagctgtctacgtcctctggtcatggccctgcgcacacaaaacctctgaatcggcgaagtgtgttagagaagaatctgataaaagtgaccgtggctccatttaaccccacggtctgcgacgcgctccttgataaggacgaaacggatagcagcaaagacacggagaagcttagcagtctcggggaggagatgcgcgaggatggattgtcgccaaacgagagcaagttatgtaccgaatcggaaggcattagccccaacaactcagcctggaatggccctcagttgtcttcgagcaataataatttccaacagacggtgagtgacaagaacatgccagattccgaaaatccaacttctgtgttctcccgcatttcagatcactcagagacgccaaacatggaattgagttgccggaacggcggatctcacaagagttcatgcgaaatgaggagcctagttgtctcaacctcttcgaataagcaggacgttttgaataaggacagtgggaaaatgaagggacacgaaagaagattggggaaggttatacccgtactccagaccaagactcgaacaaacgttcccacttttagccagtctaacctggagcagcaaaagcagttgtacttgaggagcgttatcgcccacattgaagacccagaagataccaaccaggggataagcggggagctctgcgctctgatggatcaggtgcaccatatgcagcacagtaagtggcaacatccttccgacttgactacgaggaattacgccaggagacagaaacacctccagcggtattctctcactcagtgggtggatcgaaatatgcgatcccatcaccgcttccagagactccctgacttctcctacagttag

SEQ ID NO: 204160 - DNA, 1227 bp, Artificial Sequence
  Description of Artificial Sequence: Synthetic coding sequence
atgatgtgcagccgggtgcccagcgagcagagcagcggcaccagcttgctccccaaggacggcgccccgttcagctgggacagcctggacgaagatgggctcgatgattccctgctcgagttatcagaaggagaggaagatgatggggacgttaattatactgaagaagaaatcgacgcactgcttaaagaagacgatccatcctacgaacaatcaagcggggaagacgatggtggccatgttgaaaagggggaaagaggtagtcagatactgctggatacccctcgcgagaagaactcctcgtattccctgggccctgtggccgagactcccgatctatttaagttaccacaactgtctacctctagcggacacggcccagcccacactaagcccctgaataggcggtctgtgttggagaagaacttgatcaaggtcacagtcgctccctttaaccccaccgtctgcgatgcgctattagataaggatgagacagactccagcaaggataccgagaaactgagctcattaggcgaggagatgagagaagacggactcagccctaatgaaagtaagctgtgcacagagtcagaaggaatttcccccaataacagtgcctggaacgggccccagctgagttcaagcaacaacaattttcagcagacagtgagtgataaaaatatgcccgactcagaaaaccctacctcagtgttctcgcgaatttccgaccattcagaaacaccaaatatggaactttcatgcagaaacggaggatcccacaagtctagttgcgaaatgaggagcttggtggttagcacctcctccaacaagcaggatgttcttaataaagattcgggcaaaatgaagggccatgaaagacgcttagggaaagtgattcccgtgctccagactaagacaagaaccaacgtgcctaccttttcccagagcaacctggagcagcagaagcagctgtatctccgaagcgtcattgcgcacatagaggaccctgaagataccaaccaaggaataagtggcgagctgtgtgctctgatggatcaggtccaccatatgcagcactccaaatggcaacacccctctgacctcactacaagaaattatgcaaggaggcagaaacacctacagcggtactcactgacacagtgggtggatcgaaatatgcgttctcaccacaggtttcagagattacccgattttagctattcttag

SEQ ID NO: 204161 - DNA, 1026 bp, Artificial Sequence
  Description of Artificial Sequence: Synthetic coding sequence
atgatgtgcagccgggtgcccagcgagcagagcagcggcaccagcctcctgccgaaggatggcgctcctttttcgtgggacagtctcgacgaggacggccttgacgattctctgctggagctgagcgagggcgaagaggacgacggtgatgtcaattatactgaggaggaaatagatgcactcctcaaggaagacgatccatcatatgagcagagctcaggagaagatgacggtggtcacgtggaaaaaggggagaggggtagtcagattcttctcgacactccacgagaaaagaactcatcttatagcctcggccccgtcgctgagacaccagatttgttcaagttaccccagctttccaccagctctggccatgggcctgctcacacaaaaccactcaataggaggtcagtcttagagaagaatctgatcaaagtgaccgtagccccctttaatcctactgtatgcgacgcactgctggacaaggacgagaccgatagctcgaaagatactgagaaactgagctccctgggagaagaaatgcgagaggacggcctgagtcccaatgagtccaagctctgcactgagtctgaaggaatcagtcctaataattccgcatggaacggcccccaattatccagctcgaataacaatttccaacagaccgtgagtgataaaaacatgccggacagcgagaacccaacctctgtcttctcgcgaatctccgatcactcagagacaccaaatatggagctctcttgtcggaatggcggctcgcacaagtctagctgtgagatgcggtctctggtggtgtccacttcttctaacaaagacgtgttgaacaaagactctggcaagatgaaaggacacgaacgccgtctcggaaaggtcatcccagtgcttcagacaaaaacacggaccaacgtgccaacctttagccagtctaatctggaacagcaaaaacaattatatctgaggtcagtgattgctcatatcgaagaccccgaggacaccaatcagggatag

SEQ ID NO: 204162 - DNA, 441 bp, Artificial Sequence
  Description of Artificial Sequence: Synthetic coding sequence
atgatgtgcagccgggtgcccagcgagcagagcagcggcaccagcctgctgccgaaagatggtgctcctttctcatgggattctctggacgaggatggtctcgacgatagtctcctcgaactctccgagggcgaggaggatgacggagacgtgaactacaccgaagaggaaatcgatgctttgctgaaagaggatgacccatcgtacgagcaatcctcaggggaagacgacggcggccatgtcgaaaagggagaaagaggatcccagattttactagataccccccgggaaaagaacagctcctactcactcggacctgtcgctgagacacccgatctgtttaaactgccgcaactctcgacctcttctgggcacgggcccgcccacaccaaacctttaaatcgcaggagtgtactcgagaaaaatctgataaaagtttag

SEQ ID NO: 204163 - DNA, 363 bp, Artificial Sequence
  Description of Artificial Sequence: Synthetic coding sequence
atgatgtgcagccgggtgcccagcgagcagagcagcggcaccagcctgctgcccaaggacggggcccccttctcatgggattctttggatgaagatgggctggacgatagtctcctggagctcagcgagggcgaggaggacgacggtgacgttaattacactgaggaagagattgacgccctccttaaggaggatgatcccagttacgaacagtcatctggtgaagacgacggcggccatgtcgagaaaggagagaggggcagccagatcctcttggacactccccgtgagaagaattcttcatactctctcggccctgtggcagagacacccgatctgtttaagctgccccagctctcctag

SEQ ID NO: 204164 - DNA, 126 bp, Artificial Sequence
  Description of Artificial Sequence: Synthetic coding sequence
atgatgtgcagccgggtgcccagcgagcagagcagcggcaccagcctcctcccaaaggatggggcccctttttcatgggatagcttggatgaggacgggttggacgatagtctgcttgagctgtag

SEQ ID NO: 204165 - DNA, 18 bp, Artificial Sequence
  Description of Artificial Sequence: Synthetic coding sequence
atgatgtgcagccggtag

SEQ ID NO: 204166 - DNA, 393 bp, Artificial Sequence
  Description of Artificial Sequence: Synthetic coding sequence
atgatgtgcagccgggtgcccagcgagcagagcagcggcaccagcctcctgcctaaggatggcgcacccttttcctgggacagtctggatgaggacggcttagatgatagcctcctcgagttatctgagggggaggaagatgatggagatgtgaattacacagaggaagagatagacgccctcctcaaggaagacgacccctcctatgagcagtcctccggcgaagacgacggggggcacgtcgaaaaaggggagaggggatcacaaattctgctcgacaccccacgcgagaaaaactcttcatattcactcggtcccgtagccgaaaccccggacttgttcaagctaccccagctgagcacgagttctggacacgggccggcccacacgtag

SEQ ID NO: 204167 - DNA, 1026 bp, Artificial Sequence
  Description of Artificial Sequence: Synthetic coding sequence
atgatgtgcagccgggtgcccagcgagcagagcagcggcaccagcctcctcccaaaggatggagcaccattttcctgggatagccttgatgaggacggcctggacgatagcctcttagagctgagtgagggcgaagaggacgatggcgacgtgaactataccgaagaagagatagacgccttactcaaagaagacgacccgagctatgaacaatccagtggagaggatgacggcgggcacgtcgagaagggcgagcggggtagtcagatactcctggacaccccacgagagaagaattcttcttacagccttggccctgtcgccgaaacaccagacctcttcaaactccctcagctgagcacttcatccggccacgggcctgctcacaccaagccattgaaccgaagatccgtgctagagaagaatctgatcaaggttacagtggcacctttcaatcctaccgtctgcgacgccttgctcgacaaggacgaaacagattcttcgaaggatactgagaaattatcgtctcttggagaagagatgagggaagatggactgtccccaaacgaaagtaagctgtgtaccgagagtgaaggcatctcccccaataattcagcgtggaatggtccccagctgagtagcagtaacaataattttcagcaaactgttagcgacaagaacatgcctgattccgagaaccctacgagcgtgttctcccgaattagcgaccactccgagacgcctaacatggagctaagttgcagaaacggggggtcccacaagtcgtcatgtgaaatgcgctctctggtggtatcgaccagctctaacaaggacgtactcaataaggactcggggaaaatgaagggacatgagcgcagactgggaaaggtgattccggttctgcaaaccaaaacccggacgaatgtgcctacgttctcccagagcaaccttgagcaacaaaaacagctctacctgagaagcgtcattgctcacattgaggacccagaggataccaaccagggttag

SEQ ID NO: 204168 - DNA, 516 bp, Artificial Sequence
  Description of Artificial Sequence: Synthetic coding sequence
atgatgtgcagccgggtgcccagcgagcagagcagcggcaccagcttgctcccaaaggatggggcacccttttcttgggatagcctcgatgaggacggcctggacgacagtttacttgaactgtccgaaggggaggaggacgatggcgatgtgaattacacagaagaggagattgatgcactgttaaaggaagatgatccctcatacgaacagagtagcggtgaggacgacggagggcacgtcgagaaaggcgaacgcggcagccaaattctgctcgatacaccacgggagaaaaattcttcctacagtctgggtccagtcgctgaaacccccgatttatttaaattaccacagctgagtacctcttccgggcacgggcctgctcacacaaagccacttaataggcggagtgtccttgagaaaaatctgatcaaagtgaccgtagcaccgtttaaccccaccgtctgcgacgcgctgctcgataaagatgagaccgactctagtaaagacacatag

SEQ ID NO: 204169 - DNA, 1764 bp, Artificial Sequence
  Description of Artificial Sequence: Synthetic coding sequence
atggccaccgccgcctacgagcagctgaagctgcacatcacccccgagaaattctacgtggaggcctgtgatgacggagctgatgatgtattgaccatcgaccgggtgtcgactgaggtcacactcgcggtgaagaaggacgtgccgccaagtgccgtgaccagaccaatctttgggattctgggaactatccacctagtcgcggggaactacctaatcgtcattacaaagaaaattaaagtcggggaatttttcagccacgtggtgtggaaggctactgattttgacgtactttcatacaaaaagactatgctccatcttaccgatattcagctccaggataataagactttcctagcgatgctgaatcacgttcttaatgtggatggcttttatttctctacaacttatgacctcactcataccctccagcgactcagtaacactagtcccgaattccaggagatgtccttacttgaacgagctgatcagcgattcgtgtggaacgggcatctcctcagagaactgtctgctcaaccagaagtgcaccgctttgccctgccagttctgcacggattcatcaccatgcattcctgctccattaacgggaaatacttcgactggatcctgatcagtcggcgctcttgcttccgcgcgggggtccgttactatgttcgcggcattgattctgaggggcacgccgccaactttgtcgagactgaacaaatcgtgcattacaacggatccaaagcctcgttcgttcagactcggggatccattcccgtgttttggagtcagaggccgaatctaaaatacaaacctttgccccagatatcaaaggttgcaaatcatatggatggatttcagcggcattttgatagccaggtcatcatctacggcaagcaggtgattattaaccttatcaatcagaaaggctcggagaagcctctggaacagaccttcgcaaccatggtatcctctctcgggtccggaatgatgcggtacatcgcgtttgatttccataaagagtgcaaaaacatgcgctgggatagactatcaatcctgttggaccaggtggcggagatgcaagacgaactctcgtactttcttgtcgatagtgccgggcaggtcgtcgccaatcaggagggcgtgttcagatctaattgtatggactgtttggacagaacaaacgtgattcagagtttgctcgcaaggagaagcctgcaagcccagctccagcggttgggcgttctgcacgtcgggcagaagctggaagaacaggatgaatttgagaagatctataaaaatgcttgggccgacaatgctaacgcatgtgctaagcagtacgcgggcactggggctctcaagacagatttcacaagaacgggcaaaagaacccaccttgggctgatcatggatggatggaacagcatgatcagatattataaaaataactttagcgacggatttcgacaagattctattgatctctttctcggtaattactccgttgacgagctcgagagtcattcacctctgagcgtaccgcgcgattggaaatttctcgcgttacctataattatggtggtcgcattttctatgtgtattatctgccttctcatggctggcgatacatggacagagacattggcctatgtcctcttctggggcgtggccagcatcggcactttcttcatcatcctttacaatggaaaagattttgtcgacgccccacggctcgttcagaaagagaagatcgattag

SEQ ID NO: 204170 - DNA, 1581 bp, Artificial Sequence
  Description of Artificial Sequence: Synthetic coding sequence
atgtggaagctggtgatgatggagcagatgacctacctgcccctgaccgtgtgtccgcagcggctgccgctccagagcagaaagatgttcctgttgcaactctctcaggatcagtatctcgtctactgggcccagtcaatttggtggcagctccaggacaataaaacctttctggccatgctcaaccatgttctcaatgtggatggtttctatttctcaactacatatgacttaacccatacactccagcggctcagcaacacatcccctgagttccaggaaatgtctctcctggaacgcgctgaccaaaggtttgtgtggaatggccacttgctgagagagttgagtgctcaacccgaggtacatcggtttgccctgccagtgctgcatggctttattaccatgcactcttgcagcatcaatggtaagtacttcgattggatcctgatttcacggcggtcttgctttcgggctggtgtgcgatactacgtcagagggatcgactctgagggccacgcggctaactttgtcgaaaccgagcagatcgtgcattataacggtagtaaagcttcgttcgtccagaccaggggatctatccccgtcttttggtcacagcggcccaacctgaagtacaagcctctccctcagatctccaaagtggccaaccacatggacgggttccaaaggcattttgacagtcaggtgattatctatggtaagcaagtaataattaatctcattaaccagaagggctctgagaagccgcttgagcagacctttgctacaatggtgagcagtctgggcagcgggatgatgcgatatatcgctttcgattttcacaaagagtgtaagaacatgaggtgggaccgcctcagtatactgttggatcaggtagcagaaatgcaggatgagctcagctattttctggtggatagcgctggccaggtggtggctaatcaggagggggtcttccgcagcaattgtatggactgccttgacagaaccaatgtcatccagtctctcctggcccgccgttccctgcaagcacaattacagagactcggtgtgctgcatgtcgggcaaaagttggaagaacaggacgaatttgaaaagatttataaaaatgcctgggccgataacgccaacgcatgcgcaaagcagtacgctggtacgggagccctgaagaccgatttcacgaggacggggaaacgcactcacttaggcctaatcatggacggctggaactctatgattagatattacaagaataatttcagcgatggttttagacaggatagtattgatctttttctcggcaactattcggtcgatgagcttgaaagccactcgccactctcggttccccgtgattggaaatttctggccctgcctattatcatggttgtggcgttcagcatgtgcatcatttgtctgttaatggctggagatacgtggactgaaactctcgcctatgtcctgttctggggggtggcctccattggaacattctttattattctgtacaacggtaaagacttcgtcgatgctccgagactggtacagaaagaaaagatcgattag

SEQ ID NO: 204171 - DNA, 2901 bp, Artificial Sequence
  Description of Artificial Sequence: Synthetic coding sequence
atgttctggaagttcgacctgaacaccaccagccacgtggacaagctgctggataaagaacacgtgacccttcaggaactgatggacgaggatgacatcttgcaggagtgcaaggcccaaaaccaaaagctgctggattttctgtgtagacagcagtgcatggaggaactggtatcactgatcacgcaggatccccctctcgacatggaggagaaggtccgctttaaatatccaaatacggcctgcgaacttctaacgtgtgatgtgcctcagattagcgatcgcttgggcggggatgagtcgttgctgtctctgttatatgacttcctggatcacgaacccccacttaatcccttgttggcaagttttttctcaaaaaccatcgggaatttgattgcccgaaagacagaacaggtgatcaccttcctgaagaagaaagataagttcattagcttagtgcttaagcatatcggcaccagcgccctcatggacctgcttttgcgcctagtgtcttgcgtagaacctgccgggctccgccaggatgtgctgcactggctgaatgaagagaaagtcatccagagactggtggagctcatccatcccagccaagatgaagataggcagtcaaacgcttcccagacactgtgcgacatcgtaaggctaggtcgtgatcagggctcacagctccaggaggcactggaacctgaccccctgctgactgccctggaaagtcaggattgcgtggagcaactgttaaagaatatgttcgacggcgaccggacagagtcttgccttgtcagtgggacacaggtcctgcttaccttgctggagacacgaagagtaggcacagagggcttagtcgattcgttttcacaggggttagagaggagctatgccgtttcgtcttcagtgctacacggaatcgaacctaggctcaaggattttcaccagctcctgctcaatcctccgaaaaagaaagccatcctgacaacaatcggagttctggaggagccgctgggtaatgcaagattacatggtgctcgcctcatggccgccctcctacatacaaacaccccctcaattaaccaggagctatgcagattgaacaccatggacctcctgcttgacctgttttttaagtatacctggaataattttctgcactttcaggtggagctttgtattgcagccattctttcccacgcggctcgcgaagagcggactgaggccagcgggagcgagagccgggtggagccaccccatgagaatggaaaccgctcattggagaccccacaacccgcagcctcccttcccgacaacaccatggtgacacacctgtttcagaaatgctgtcttgtgcagcgaatcctcgaggcctgggaggccaacgaccatacacaggctgccgggggaatgcgtcggggaaacatgggacatctgacacgaatcgccaacgcagtggtacagaatctggagaggggcccagtgcaaacacacatttctgaagtgatacggggcttgcctgctgattgccgcggcagatgggagtcctttgttgaagaaactctaaccgagaccaaccgaagaaacaccgtggacctagtgtccacacatcacctccatagcagctctgaggacgaagacatcgaaggagctttcccgaacgagctgagcctacagcaggctttttctgactaccagatacaacaaatgacagccaatttcgtggaccaatttggatttaacgatgaggaatttgcagaccaagatgataatattaatgcacctttcgatcggatagccgagattaactttaatatcgacgccgacgaagatagtcctagcgccgcactgttcgaagcatgctgttctgatagaatccagccctttgatgacgatgaagatgaggatatctgggaagactcagatactcgctgtgctgctcgtgttatggcccgtccccgattcggagctcctcacgccagcgagtcatgttctaagaatggaccggagcggggtggacaggacggaaaagcctccctggaagcacacagagacgctcctggcgcaggagctccccctgccccaggcaagaaggaagcacctccagtagagggggattcagagggagccatgtggaccgccgtgtttgacgagcccgcaaatagcactcctactgctccaggtgtggtgagggatgtgggctcttcagtctgggctgcagggacctccgcccccgaagagaaaggatgggccaagtttactgatttccagcctttttgttgttcagaatcaggaccacgatgttcaagtcctgtggatacagaatgttcccatgctgagggttcacgatcccagggcccagaaaaggcatcccaagcctcatatttcgctgtatcacccgctagcccctgtgcatggaacgtctgtgtcacaagaaaggctcccttactcgcaagcgatagctcatctagcggaggcagtcacagcgaggacggagatcagaaagcagctagtgcaatggatgccgtgtcacggggcccagggagggaggccccaccactacctacagttgctcgaactgaggaggctgtgggccgggtgggctgcgctgatagtagactcctaagtccagcctgtccagctcccaaagaggttacggcagctcccgctgtagcggtcccacccgaagccactgtcgctattacaacagctctgtcgaaggccggccctgctatcccgacacctgctgtctcctcggcactggccgtggcggtgcctttagggcccattatggcagtgaccgcagccccagccatggtggctactttaggcactgtgaccaaggatgggaaaaccgatgcaccacctgaaggagcggcactgaatggaccggtatag

SEQ ID NO: 204172 - DNA, 2217 bp, Artificial Sequence
  Description of Artificial Sequence: Synthetic coding sequence
atgagccggcggagccagcggctgacccggtacagccagggcgacgatgacggcagttcatcttctggtgggagctctgtggcgggctctcagtcaaccttattcaaggactcacccctcaggaccctgaagcggaaaagctccaacatgaagaggctctcccccgcacctcaactgggccctagtagcgatgcccatacgtcttactatagcgagtccctggtgcacgaatcttggtttcctccccgaagctctctcgaggagttacacggcgacgcaaattggggagaggacttacgcgtgcgacggcgcagaggcaccggaggctctgagagcagccgtgctagcggactggttggccggaaagctaccgaggactttcttggctcctcaagcggatactcatccgaggatgactatgtggaggactcagaaggtcgcgggtcaaaggtcacggagaccgaacccgtctcctctttccctgcaggctacagtgacgtggaccaacagtcttcatcgtcaagattgcgctctgctgtcagccgtgccggttccttactgtggatggttgctacaagccccggacggctgttccgcctcctatattggtgggcgggaaccacctggtatcgcctaacgacagccgcctcattgctggatgtatttgtcctcactcgccgattctcctcgctgaaaacatttctgtggttccttctccctctactgctgctgacctgcctgacctatggagcttggtacttctatccttatggtctgcaaaccttccatcctgctcttgtgagctggtgggccgcgaaggactctagaagaccagacgaagggtgggaggctagggattcttcgccacactttcaagccgagcagcgagtgatgagccgcgtccactcattggaacgccggcttgaggcgctcgcagctgagttctcttctaattggcagaaggaggctatgaggctggagcgattggaactccgccaaggagctccgggtcagggcggaggcgggggtctttcccatgaggacaccctggccctgttggaaggcctggtatccaggcgcgaagcagccctcaaggaagactttcggcgggagacagccgcccggattcaggaggagctctctgcgttgcgcgccgagcatcagcaggactctgaggatttgtttaagaagattgtgagagcaagtcaggagtctgaggctcggatccaacagcttaaatcagagtggcagagcatgacccaggagtcctttcaggaaagttcagtgaaagaactacggcgtctggaggaccagctggcggggttgcagcaggaattggccgcactggccttgaagcaatctagcgtggcagaggaagtcggactcctcccccagcagatccaggcggtcagagatgatgtagaatctcagtttccagcttggatatctcaattcttagccagagggggcggggggagagtgggattactccagcgagaggaaatgcaggctcaactgagggaactggagtctaaaattctaacacacgtcgccgagatgcagggaaaatcggctcgtgaggcggctgctagcctctcactgacactacagaaagagggagtcataggagtaacagaggagcaggttcatcatatcgtgaaacaggcgctccagagatactcggaagatcgcatcggactcgccgactacgctctggagtccggcggagcctccgtgatctctacacgctgttctgagacctatgaaacgaagacagccctgctgtccctgttcggcatccccttgtggtatcatagccaatccccgcgtgtcattcttcaaccagacgtgcatccaggaaactgttgggcattccagggaccacagggttttgccgttgtgcggctctcagcaagaattcggccgactgcggtgactttggagcatgtgccaaaagccctttcccccaattccacgataagcagtgcccccaaggacttcgcaatattcggatttgatgaagacctgcagcaggagggcactctcctgggtaagttcacctatgatcaagacggcgagcctatccagaccttccattttcaggccccgaccatggctacttatcaggtagtggagctgcgcattctcactaattggggccatccagagtacacgtgcatttaccggttccgcgttcacggagagccagcgcattag

SEQ ID NO: 204173 - DNA, 2154 bp, Artificial Sequence
  Description of Artificial Sequence: Synthetic coding sequence
atgagccggcggagccagcggctgacccggtacagccagggcgacgacgacggctccagttcaagcggaggctcttccgtggccgggtcccagagcacactcttcaaggattcaccgctgagaactttgaagcgtaaatcttctaatatgaagcgattaagtcccgcccctcagctgggtcctagtagcgatgcgcacacatcttactactctgagagcctcgtgcacgagtcctggtttccccctcgcagctcactggaagaactgcatggtgacgcaaattggggagaggatctgcgggtgcgacggaggaggggtacagggggatccgagtcttcacgggcttctgggttggttggccgtaaagccactgaggatttcttgggtagctcttccggctacagttcagaggatgactatgttgggtatagcgatgtggatcaacagtcttcctcctccaggcttcgctcggcagtctcccgagctggcagtctgctgtggatggtcgctacgtcacctggacgactctttcgcctgttgtattggtgggccggcactacctggtatagactgacaaccgccgccagtctgctcgacgtctttgtgcttactcgtagatttagttcactgaaaacattcctctggttcctgctgccgttgctcttactcacgtgcttgacctacggggcctggtatttctacccttatggcctgcaaacattccaccccgcgttggtatcctggtgggcggccaaggatagtaggcgaccggatgagggatgggaagctcgcgattcgagtccacactttcaggccgagcagagagtgatgagtcgcgtgcactctttagagcgaagactcgaggccctagcagcggaattctcctctaactggcagaaagaggcgatgcggctggagcgcctcgaacttcggcagggagcccccggccagggcggcggaggtggtctgtcacatgaggacacgctcgctcttctggaagggctggtctcaagacgcgaggctgctttgaaagaggatttcaggcgcgaaaccgccgctcgtatccaggaagagttatcggcacttagggcagaacatcagcaagacagcgaggacctgttcaaaaaaatagtgagggctagccaagaatccgaggctcgcattcaacagctcaaatccgaatggcagagcatgacccaggagtcattccaggaatcatccgtgaaggaactacggaggctcgaggaccagctagctggcttgcaacaagagctggccgctctagctcttaaacagtcctctgtcgctgaggaggttgggctgctcccccagcagattcaagccgtgagggacgatgtggagtcacagtttcccgcatggatcagtcagtttctcgccagaggaggcggggggcgtgtcggactgctgcagcgagaagaaatgcaggcacagctccgagaacttgagagtaagatcctcacccatgtcgcggagatgcagggaaaaagcgctcgcgaagccgccgctagtctctctctgacattgcagaaggagggtgtcattggggtgacagaagaacaagtgcatcacatcgtgaaacaggccctgcagcgctactctgaagaccgcataggtctcgcggactatgcacttgagtctggaggcgctagcgtaatttctacgagatgctcagagacatatgagaccaagactgctctgctgtccctattcggtattccactgtggtatcactctcaatcaccgcgcgtgatactccagcctgatgtgcaccctggtaattgttgggctttccaagggccacaaggctttgcggtggtgagattatccgcacgcatcagacccaccgctgtcaccctggagcacgtgcccaaggccctgagccccaactcaaccatctctagcgcccccaaagatttcgcgatcttcggtttcgacgaagatttacagcaagaaggaacgcttctgggcaagttcacttatgatcaggatggtgagcccatccagacttttcatttccaagctcccactatggcaacctatcaggtggtcgaactccgtatcttgacgaactgggggcaccctgaatacacatgtatctaccgctttcgggttcacggggagcccgctcactag

SEQ ID NO: 204174 - DNA, 2154 bp, Artificial Sequence
  Description of Artificial Sequence: Synthetic coding sequence
atgagccggcggagccagcggctgacccggtacagccagggcgacgacgacggctcctctagttccggcggctcctctgttgctggaagtcagagtactttgtttaaagattctcctctgcgtacactgaaacgtaaatcctctaacatgaagagattgtccccagccccacagcttggcccttcatcggacgcacacacgtcttactactccgaatctctggtccacgaatcctggtttccacccagaagttccctggaggagctgcatggggatgcaaactggggtgaggacctccgtgtgaggcgcagacgtggaactggtgggagtgaaagcagccgggcctcaggcttagtcgggcgcaaggccacagaggactttttaggatcctcttccggttactctagcgaagatgattacgtgggatattctgatgtagaccagcagagcagttcaagccggttgcgttccgccgtctcacgtgccggtagcctgctatggatggttgcaacttctcccggtcgtctgtttcgattattatactggtgggccggcacaacctggtacagactgacgactgctgcatcacttctggatgtcttcgtcttgacccgcaggttttcaagcctgaaaacatttctctggtttctcctcccacttttactcctaacctgcttgacctacggagcgtggtacttctacccatatggcctgcaaacattccatcctgctcttgtttcctggtgggctgcaaaagattccagaagacccgatgaggggtgggaggcccgcgactcatcccctcacttccaggcggagcagagggtgatgtctagggtccatagtctggagaggagacttgaggcactagcagccgagtttagctctaactggcagaaggaggcaatgcggttggaacggttagagctgcggcagggcgcgcccggacaaggggggggaggtgggctctctcatgaagataccttagcactcctggaggggctggtttctagacgcgaagcagcccttaaggaggactttcgtcgggagactgctgcaaggattcaagaggagctgagcgcccttagagccgagcatcagcaagacagcgaggacctgttcaagaagattgtaagagcttcacaagaaagcgaagcccggattcagcaattgaagtccgagtggcagtctatgactcaggagtcattccaggaaagttcagtgaaagaactcaggagattggaggaccagttggccggtctccagcaagaacttgccgccctcgcccttaaacagtcatcagtggcagaggaagtggggttacttccacagcaaatccaggccgtgagggacgatgtcgagagtcaattccctgcatggatcagccagtttctcgccagaggggggggaggacgggtgggtttgctccagagagaagagatgcaagcccagctgagggagctcgaatcaaagatcctgacccacgtcgctgagatgcagggcaaaagcgcgcgggaggcagccgccagtctctcccttacactgcagaaagaaggcgtgattggtgttactgaggaacaagttcaccacatagttaagcaggcattgcagcggtacagtgaggatcggattggcttagcagactacgccctggagtctggaggggcgtctgttatatccacgcggtgtagcgaaacctatgagacaaagactgcattgctcagcctgtttggcatacccctttggtaccattcacagtctccgcgcgtaatcttgcagcctgacgtgcaccccggtaattgttgggccttccagggtccacaggggttcgcggtggtgcgtctgagtgcgcgcattcgaccaacagcagtgacgctcgaacatgtaccaaaggccctgagtcccaattccaccatctccagtgcacccaaggattttgcgatattcggattcgatgaggatctgcagcaggaaggaactctgctcggcaagtttacctacgaccaagatggcgagcccatccagacttttcattttcaggccccaacaatggccacgtatcaggtcgttgaactcagaatcctgactaattggggacaccctgaatacacctgcatatatcgcttccgcgtgcacggagaacccgcccactag

SEQ ID NO: 204175 - DNA, 2121 bp, Artificial Sequence
  Description of Artificial Sequence: Synthetic coding sequence
atggtgagcccccccagcgccggccagcggctgcggggcgtgcccgtttgggccgcaggagctttcagattttcaagcggggaagagagtacaagccatctgattatgagtcgccgatcccagaggctgacgcgctatagccagggtgacgacgacggcagctccagtagcggaggaagctcggtagctggaagtcagtccaccctgttcaaggattctccacttaggactctcaagcgaaaaagctctaacatgaagcgtctcagccccgctcctcagctagggcctagctccgatgcgcacacatcatattacagtgagagtctcgtgcacgagtcttggttcccacctcggtcatcgctcgaggaactgcacggcgacgctaactggggctattctgacgtagaccagcaatcgtcatcaagcaggttaaggtctgcggtttcaagagctggctctctgctctggatggtcgctacatctcccggaagactgtttagactgctatattggtgggcagggaccacttggtaccgactgacaactgcggcctctctgctcgatgtgttcgtcctgacccgcagattctcttcactgaagacgttcctctggtttctgctgccacttcttctgctgacttgcttgacctacggcgcctggtacttttatccgtatggtctccagacgtttcatcccgccctggtcagctggtgggctgcgaaggattcacggaggcccgatgaaggctgggaggccagagactcgagccctcacttccaggccgagcagcgggtaatgtcgcgggtacactctcttgagagacgacttgaagctttggcagctgagttcagctcaaactggcagaaagaggccatgaggctcgagaggttggaattgagacagggtgctcctggccagggcgggggaggcgggctgagccacgaggacacattagcgctcttagaaggcctcgtttcacgccgcgaggcagccctcaaggaggactttcggcgcgaaaccgctgcaagaatacaggaggaactgtcggctctaagagccgaacatcagcaggattctgaggatctattcaagaagatcgttcgggccagccaggagtccgaggctaggatccagcagctgaaatcagagtggcaatctatgacgcaggagagtttccaagaaagttccgtaaaggaattaagacggctggaggaccaactggcgggacttcagcaggaactggctgccctggccctaaaacagtctagcgtcgcagaagaggtgggattactcccccagcaaatccaggccgtgcgggatgacgtagaatctcagttcccggcatggatctctcaatttttggctcgtggtggaggaggccgggttggtctactgcaaagagaagaaatgcaagcccagctgcgagaattagagtctaagatcttaacccacgttgccgaaatgcaaggaaagagcgccagagaggcggccgcaagcctgtccctcactctgcagaaggaaggtgtgattggggtgactgaggaacaggttcaccatatcgtgaaacaagcccttcaacgctacagcgaagatagaattggcctggctgattacgcattggagtctggaggggcgtccgtgatcagcacgaggtgtagcgaaacctatgagaccaaaacagcactgctttccctcttcgggatcccactctggtatcattcccagtcgcctagagtgatcttgcaacccgacgtacaccctggaaattgttgggcctttcagggcccccaaggatttgctgtggttagactcagcgccaggattcgtccaacggcagtaacactggaacacgtccccaaagccctgtctcctaactcgacaattagcagtgccccaaaagattttgccatatttggctttgacgaagacttgcagcaggaaggtacactcctcggtaaattcacctatgatcaagacggggaaccgatacagacgtttcattttcaggcccccactatggctacctaccaggtagtggagctgcgtatattaactaactgggggcatcccgagtatacctgcatctaccgtttccgggtgcatggagagcccgcccattag

SEQ ID NO: 204176 - DNA, 375 bp, Artificial Sequence
  Description of Artificial Sequence: Synthetic coding sequence
atgagccggcggagccagcggctgacccggtacagccagggcgacgatgacggttcatctagcagtggagggagctccgtcgccggatcccagagtactctgttcaaagacagccccctgcgcacactgaagcggaagagctccaacatgaaacgtcttagtcctgcaccacagcttggcccctctagcgacgcccacacaagctactactcagagagcctcgtgcacgagtcatggttcccccccagaagctctctagaggagttgcacggagacgccaactgggatcccacattccagaagctgctagaggcacagaaatcgccttggtttttccccgcccaagtccggacatgtggatgtgggggaggttag

SEQ ID NO: 204177 - DNA, 384 bp, Artificial Sequence
  Description of Artificial Sequence: Synthetic coding sequence
atgagccggcggagccagcggctgacccggtacagccagggcgacgacgacggaagttcgtcatccggaggttcatcagttgcgggctcacagagcaccctgtttaaagattcccccttacggaccctcaagaggaaaagctcaaacatgaaaagactgagccctgcaccccagcttggaccatcatccgacgcacatacctcttactacagcgagagtcttgtgcacgaaagctggttccccccaaggagttctcttgaggaattacacggggatgccaactggggttattcagacgtggaccagcaatcttctagcagcaggctgcggagcgccgtgagtcgcgcaggctctctgttatggatggtcgcaaccagcccctag

SEQ ID NO: 204178 - DNA, 333 bp, Artificial Sequence
  Description of Artificial Sequence: Synthetic coding sequence
atgagccggcggagccagcggctgacccggtacagccagggcgacgacgatggatcatctagttcgggggggtcctctgttgccgggtctcagtcgacactctttaaagactcgcctctgaggacactaaagaggaagagttctaacatgaaacgacttagccctgccccgcaactgggaccgagcagcgacgcccacacctcatattacagcgaatcccttgttcatgagagttggtttccgccaaggagcagcttggaagagctccacggtgatgcaaattggggggaggacttaagggtgagaaggcgacgcggcacgggaggatcttag

SEQ ID NO: 204179 - DNA, 675 bp, Artificial Sequence
  Description of Artificial Sequence: Synthetic coding sequence
atgagccggcggagccagcggctgacccggtacagccagggcgacgatgatggctcatcctccagtggcggaagcagtgttgctgggtcacagtcgaccctcttcaaagattctcctctccgcacattgaagagaaagtcttcaaacatgaagagattgagccccgctccacagctgggcccatcgtcagatgcgcatacctcatactactccgagtccctggttcacgagtcttggttcccacccaggagcagtctggaggaactgcatggcgacgcaaattgggggtactccgatgtggaccagcagtcctcatctagccggttaaggtccgccgtctcacgcgccggaagtctgctgtggatggtggcaacctcgccagggcgactatttagactcctttactggtgggccgggaccacatggtaccgactcactacggcggctagtctgctggacgtgtttgtgctaactaggcgattctcttctcttaagactttcctttggttcttgctcccactattgctacttacatgccttacatatggtgcctggtatttttatccttacggcctacagaccttccaccccgctctggtgtcgtggtgggctgcaaaagattcccggaggccagacgaaggctgggaggctcgcgatagtagtccacatttttag

SEQ ID NO: 204180 - DNA, 306 bp, Artificial Sequence
  Description of Artificial Sequence: Synthetic coding sequence
atgagccggcggagccagcggctgacccggtacagccagggcgacgacgacggctcttcaagcagtggggggtcctcagttgccggcagtcagtcaacactgtttaaggattctcccttacgaacccttaaacggaagtcttctaatatgaaaaggctaagccctgcacctcagctggggccttccagcgacgctcacactagttactactcagaaagcctcgtgcacgagagttggttccctccgagatcaagcctagaggaacttcatggggatgctaactggggcgaagacttaagggtctag

SEQ ID NO: 204181 - DNA, 435 bp, Artificial Sequence
  Description of Artificial Sequence: Synthetic coding sequence
atgagccggcggagccagcggctgacccggtacagccagggcgacgatgacggcagctcatctagtggtggatcctccgtcgctggctcgcagagcacactgtttaaggacagccctcttagaactctcaagagaaaatctagcaacatgaaaaggttgtctcccgcaccacagcttggtccctctagtgatgcccacacatcttactattctgagtccctagtgcatgaaagttggttcccaccaagatcttcccttgaagaactccacggggatgccaactggggggaagaccttagggtgcggaggcgaaggggtacgggaggaagcgagagctctcgagcctcagggttagtgggacgcaaggccacagaagatttcctgggatcaagtagtggctattcctctgaggatgattacgttgggagaaggtag

SEQ ID NO: 204182 - DNA, 618 bp, Artificial Sequence
  Description of Artificial Sequence: Synthetic coding sequence
atgagccggcggagccagcggctgacccggtacagccagggcgacgacgacggatctagcagttcaggaggaagttccgtggcaggtagtcagtccacattattcaaggactcgccccttagaactttaaaacggaaatcttctaacatgaagcgcctgtcacctgcaccccagctcggcccttcgtcagatgctcatactagctactactctgaaagtctcgtccacgagtcatggttcccgcccaggtcctcccttgaggaactgcacggagacgctaattggggtgaggacctgcgagtccggagacgcagggggacaggcggttctgaatcttcaagggcatcaggcttggtgggccgcaaggccactgaagatttcttgggttcctcatcaggatacagttctgaagatgactatgtaggatattccgacgtagaccagcagtcctcctcctcacggctcaggtccgctgtgtcacgggccggatccctgctttggatggtagcaactagtcccggcaggctctttcgtttgctgtactggtgggccggcacaacttggtatagattaactactgcagcaagtctactggacgtattcgtgctgacgaggtag

SEQ ID NO: 204183 - DNA, 1140 bp, Artificial Sequence
  Description of Artificial Sequence: Synthetic coding sequence
atgccccggagcagccggagccccggcgaccccggcgccctgctggaggatgtggcccacaacccgcgtcctaggcgcatcgcgcaaaggggaagaaacacttccaggatggccgaggatacaagccccaatatgaacgataatatcctgctgccagtacgcaacaatgatcaagccctcgggctgactcaatgtatgctggggtgcgtgtcttggtttacatgtttcgcttgcagtttacgcacgcaggcgcaacaagtgttgttcaatacctgtaggtgcaaactgctctgtcagaagctcatggagaagaccggcattttgcttctatgcgcatttggattctggatgtttagtatccacctaccaagcaagatgaaggtgtggcaggatgactcgattaatggacctttgcagagcctgagattgtatcaggaaaaagtgaggcatcacagtggagaaattcaggatctgcggggatccatgaaccagttaattgcaaaactgcaggaaatggaagcgatgagcgacgagcaaaaaatggcccaaaagatcatgaaaatgatccacggcgattacatcgagaagcccgactttgccttgaagtcaatcggtgcctccattgactttgagcatacatccgtgacttataaccacgagaaggcccatagttattggaactggatccaactatggaactatgcccagccaccagatgtgattttagagcctaatgtaaccccggggaactgttgggcgtttgagggcgatcgcggccaagtgaccatccagcttgcgcagaaagtgtacctttctaacctgaccctgcagcacattccaaaaactatttccctgagcggcagccttgacacagcacccaaagacttcgtgatttatggcatggaggggtcccccaaggaagaggtttttcttggagccttccagttccagcccgagaacatcatccagatgttccccctccaaaatcaacctgcccgggcattctctgcggtcaaggtcaaaatcagcagtaactggggcaaccccggattcacatgtctgtatcgcgtgagagtgcatgggtctgttgcgcctccaagagagcaaccacaccagaatccttatcctaagcgtgactag

SEQ ID NO: 204184 - DNA, 369 bp, Artificial Sequence
  Description of Artificial Sequence: Synthetic coding sequence
atgccccggagcagccggagccccggcgaccccggcgccctgctggaggatgtcgcacacaacccacgtccacgacggatcgcgcaacgaggcaggaatacctcacgtatggctgaggatacatcccccaacatgaacgacaacattctgctgcccgtgaggaataatgaccaagccctgggtttgactcaatgcatgctggggtgcgtctatgcgtcatgctgtgcccgctctagctggcggcgtcaggcattttgttcgagcgtgttatccgtctgcccacgggcactgccgtctccccgatggcgatatccatgggctcttgctctgatcatagggcattgggcacgtcactgtactgcaacttag

SEQ ID NO: 204185 - DNA, 1065 bp, Artificial Sequence
  Description of Artificial Sequence: Synthetic coding sequence
atgccccggagcagccggagccccggcgaccccggcgccctgctggaagacgtcgcccataatccaagaccccgcagaattgcacagaggggcaggaataccagtcggatggcagaggatacctctccgaatatgacctggttcacttgcttcgcgtgcagccttagaactcaggcgcagcaggtgctgttcaatacctgtaggtgcaagctgctttgtcagaagctgatggagaaaaccgggattctgctgttgtgcgcatttgggttctggatgttcagcatccacctcccttccaagatgaaggtttggcaggacgactccatcaacgggcccttgcaatccctcagactgtaccaggaaaaggtgcgacaccactctggggaaatccaggatctgagagggtcaatgaatcagctgatcgcaaagttacaggaaatggaggctatgtccgatgagcagaaaatggcgcagaaaatcatgaaaatgatccatggggattacattgagaagcctgactttgccctgaaaagcataggtgccagtatcgactttgaacatacttcggtgacctacaaccacgagaaggcccactcttactggaactggattcagctgtggaattacgcccagccaccagatgtcattttggagcctaacgtaactccgggcaattgttgggcttttgagggagatcgtgggcaggtgaccatccaacttgcacagaaggtttacttatcaaacctgaccctgcaacacattccaaagactatctccctatctggctcgctggatactgcccctaaggattttgtgatctacggtatggaaggctctccgaaggaggaagtttttctcggcgcctttcaatttcaacccgagaacattattcaaatgtttcccctgcagaaccagcccgcacgggcatttagcgccgtcaaggtcaaaatctcctctaattggggcaatcctggctttacctgcctttaccgtgtgagggtgcatggaagcgtggcgcctccgcgagagcagccccaccagaatccttaccctaaaagagactag

SEQ ID NO: 204186 - DNA, 459 bp, Artificial Sequence
  Description of Artificial Sequence: Synthetic coding sequence
ggcgccctgctggaggacgtggcccacaacccccggccccggcggatcgcgcaaagggggagaaatacatcacggatggccgaagatacttcacctaatatgaacgacaacatcttactgcctgtcaggaataacgatcaggctctgggattaacacagtgtatgttgggatgcgtcagttggtttacttgttttgcctgttccttgcggacacaggcacagcaggtcttgttcaatacatgcagatgtaaacttctgtgccagaagctgatggagaaaaccgggattctgctcctctgcgccttcggcgtgtcacaaggcccggcacagagtcaggtagaagtctccctgggacccggcactgattacagaacattgggtaaaacactccattgtcatgtgacacaatttccccacttgccagacggctgctgctgcgaaaactacgagatgaagtag

SEQ ID NO: 204187 - DNA, 387 bp, Artificial Sequence
  Description of Artificial Sequence: Synthetic coding sequence
atgagcgagggcggcggccaggtgagctgcatcttcgccgcccccacaaggctgtgcagatggcccgctttaattgaatgcggggttaatcttacccagcccctgtgtgagtggatgatccaggttgcacgagaccgcaccctcagtcttgcttgggaagttgcaagccttctgacactctcatccagcgaagtggggctcgaaggcgtagggaccatttggccctcgtcctacagttcggaggagtctagccgtaacggcgctgagcaggggcggcagctgagcatcgaaggcccatttcagggacaaaattgcccgagccacccagccgccgccctaccattgcccatgcggggtgaatcacaggctacctcatgccaggtttag

SEQ ID NO: 204188 - DNA, 3975 bp, Artificial Sequence
  Description of Artificial Sequence: Synthetic coding sequence
atgagccggcggaagcaggccaagccccagcacttccagagcgacccggaagtggcaagcctccctagaagggatggggacacggaaaaggggcaacccagcagaccgactaagagcaaggacgcacatgtgtgcggtcgctgctgtgccgagttctttgaattaagtgacctgctgttacacaagaaaaattgtactaagaaccaattggtgctgatcgtcaatgaaaacccggcgagtccacccgagacgttcagcccttcacctccccccgacaacccagacgaacagatgaatgacaccgtcaacaaaactgatcaggtagactgttcggatttgagcgaacacaacggtttagaccgcgaagagagcatggaggtcgaggcgcccgtggctaacaagtctggctccggaacctcaagcggttctcattcgtccacggctccgtcatccagcagcagcagcagttccagctccggcgggggcggcagtagctctaccggaaccagcgcaataacaacatccttgccccaactgggagacttaacgacactaggaaacttctccgtgataaactccaacgtgattattgagaatctccagagtacgaaggtcgcagtcgctcagtttagccaggaagctcgttgtggaggtgctagcgggggaaagctggcagtgcctgcactcatggagcaactgctggccctgcagcagcagcagattcatcagctccagctgatagaacaaattaggcatcagattttactgctggccagccaaaatgcagacctccccacgagctcctcaccaagccaggggaccctccgcacctctgcaaaccccctgagtacgctgtcttctcacctgagccagcagctggctgccgccgccggacttgcccagtctcttgcatcgcagtcggcatctatttccggggtgaagcaactgccccctattcagctcccccagtctagttccgggaatacaattatcccctccaactccggtagttcccctaacatgaatatcctcgccgctgctgtgactacgccgtcaagcgagaaggtggcctcctcagctggagcttctcatgtgagcaatcctgctgtcagcagctcaagcagccccgcatttgcaatttctagtctgcttagccccgcctcgaaccccctcctaccccagcaagcctctgcaaattctgtgtttccttcaccactgcctaacatagggactacagcagaagacttgaactctctcagcgctctggcccagcagcgtaaaagcaagccccctaacgtgactgctttcgaggctaaatccacaagcgacgaggctttcttcaaacacaaatgccggttttgtgcaaaggtattcggatccgactccgccctacagatccaccttcggtcccatactggtgagcgcccctttaagtgtaacatctgcggcaatcgcttcagcactaaagggaacttaaaagttcattttcagagacataaagaaaaatatccgcacatccaaatgaacccttatccggtccctgaacacctcgacaatatcccaacatctacaggcatcccctacggcatgagtattccacctgagaaacccgtgacatcttggctggacaccaaacctgtgttgccaaccttgaccacttctgtgggactccccctcccccctaccttaccatcactgatccccttcatcaaaaccgaggagccagctcctatccccatctcacactcggccacatcgcccccaggtagcgtgaaaagcgatagtgggggaccagagtcggccacacggaatctgggggggctgcccgaggaggccgagggctccaccctccccccttcagggggtaaaagcgaggagtctgggatggttactaactccgtacccacggctagcagcagcgtcctttcttccccggccgccgattgcgggcctgctggctccgccacaacatttacaaatcctctgctcccacttatgtcggaacagtttaaggcaaaatttccctttgggggactgctggactctgctcaggccagtgaaacttcgaagctccagcaactcgtggaaaatatcgataagaaagctacagatcccaacgagtgtattatttgccacagagttctgtcctgccagtccgcactgaagatgcactaccggactcacacaggggaacgcccctttaagtgtaaaatatgcggacgagctttcaccaccaagggaaaccttaaaactcattattccgtgcatagagcaatgcccccgctgcgagtccagcactcctgccctatatgtcagaaaaagtttactaatgccgtggttttgcaacagcatatacgtatgcatatgggtggccaaatacccaatactcccgttcccgatagctactccgagagcatggaatccgataccgggagctttgatgaaaaaaacttcgatgatctggataacttctctgacgagaatatggaggactgccccgagggaagcatcccagatacgccaaaaagcgctgacgccagtcaggattccctgtcctccagcccactccctctggagatgtccagtatcgccgcactagagaatcagatgaagatgattaacgcgggcctggcggagcagcttcaggcttcccttaaatctgttgaaaacggaagcattgaaggcgacgtgttgaccaacgatagcagttccgtgggaggagacatggagtcacagagcgccggttctccagcaatctctgagtccacatcttcaatgcaggctttgagccctagcaacagcacccaggagtttcataaatcaccatccattgaagaaaagccacagagagcagttccatccgagttcgccaatgggctgagcccaacaccggtgaacgggggagcccttgacctaacgtcttctcacgccgaaaaaataatcaaggaagactcgctggggattctgtttcccttcagagatagaggaaaatttaagaatacggcctgtgatatctgtgggaagacttttgcttgtcagagcgcgctcgacattcattacagatcgcataccaaagaacgacctttcatctgtaccgtgtgcaaccggggttttagcaccaagggaaacttgaagcaacatatgctgacgcaccagatgagggacctgccaagccaattgtttgaaccatcgtcaaacttggggcccaaccagaactccgccgtcatccctgctaactctctgtcctctttaatcaagaccgaggtcaatggcttcgtgcacgtttcacctcaagactcaaaagatacccccacctcacatgttccatctggtcccctgagctcctcagcgacaagcccggtgctgcttcccgctttaccgaggaggacccctaaacagcattactgtaacacctgcgggaagactttttcttctagcagcgcactacagatccatgagaggacacacactggggagaagccattcgcttgtactatctgcggaagggcatttactactaaaggaaatctgaaagtccatatgggtactcatatgtggaactccacacccgccaggcgaggacgcaggctttctgtcgacggcccaatgacctttctgggcgggaatcctgtcaaatttccggagatgttccagaaagacctcgccgcacgatcggggtccggtgatccatcctctttttggaatcagtacgctgcagcactgagcaacggactagcaatgaaagctaatgagatttccgtaattcagaatggtgggattccccccattcccgggagtctgggttcagggaattcctcacctgtgagcggcctgactggaaacctggagagactgcagaacagcgaacccaatgcacccctggcaggccttgagaagatggctagtagcgaaaacggaactaacttccggttcacccgttttgtggaggactctaaggagatagttacaagttag

SEQ ID NO: 204189 - DNA, 3684 bp, Artificial Sequence
  Description of Artificial Sequence: Synthetic coding sequence
atgaacgacaccgtgaacaagaccgaccaggtggactgcagcgacctgagcgaacataacggcctggatcgggaggaatcgatggaggtcgaggctcccgtcgcgaataagtcaggcagcgggacaagctctggcagccatagctccacagcccccagcagtagtagtagtagttcttctagcagcggcggcgggggttcaagttccacagggacgtctgctatcacaacgagcctgcctcagctgggagatttgacaaccctcggtaactttagtgtgatcaactctaacgtgattatcgaaaatcttcagagcacaaaagttgccgtggcgcagttcagtcaggaagctcgatgtggcggggcgtctgggggcaaattagccgtgcccgccctaatggagcagctgctcgccttacagcagcaacaaatccaccaactgcagttaattgagcaaataagacaccagatcctgctgctggcctctcagaacgctgatctcccaacatcaagctctcctagccagggcacactgcggacgagcgccaaccctctgagcaccctaagctctcacctttcccaacagcttgctgctgcggccggtcttgctcagagtctggcttctcaaagcgcctccattagcggtgttaaacagctgcctcccatccagcttccgcagtcatcttcaggcaacacaatcatccccagcaattccgggtcaagccctaatatgaacattctggcagccgccgtcactaccccttccagcgagaaagttgcttcgagtgctggggcgagccacgtgagtaatccagctgtgagttcctcatctagcccagcctttgccatctcatcgctgctgtccccagcctctaaccccttgttgcctcagcaggcttcagccaacagtgtattcccttcccctttgcccaatatcgggaccacagcagaggacctcaacagcctgagcgccctggcccagcagaggaaatcaaaaccgcccaatgtcacggcgttcgaggctaagagcacctccgacgaggccttcttcaaacataaatgcaggttttgtgccaaggtctttggatcggacagtgccctccagattcacctgaggtctcacaccggggaaagaccctttaagtgtaacatttgtggtaaccggtttagtacgaaaggaaatctgaaggtgcacttccagcgccacaaagagaaatatcctcatattcagatgaacccataccccgtgccggagcatttagacaacatccctactagtaccggaattccatatggaatgtccattcccccggagaagcccgtgacctcctggcttgatactaaaccagtgctgcccaccctcaccacctcagttgggttaccactcccacctaccctgccaagtctcatcccctttatcaaaaccgaggaacctgcccccatccctatctcgcacagcgccactagccccccaggctcagtgaagtcagatagcggagggcccgagtccgccacacgtaacctcgggggcctcccagaagaagctgagggctctactttacctcctagtgggggaaaatccgaagaatccggcatggtgactaactcagtcccgacagcctcgtcctctgtactttcaagcccggcggctgactgcggtccagccgggagtgccaccactttcactaacccccttctgccactgatgagcgaacagttcaaagcgaagttcccatttggaggtctgcttgattctgcacaagcctccgagacctcgaagttgcagcagctggtagagaatattgataagaaggccacggatccaaacgaatgtattatatgtcatagggtgttgagttgtcagtctgctttaaaaatgcattacaggacccataccggggagcgcccatttaaatgtaagatctgtggccgcgcctttacaacaaaaggtaatcttaaaacacactacagcgtgcaccgtgctatgcccccgttacgtgtgcagcattcttgccctatctgccaaaaaaagttcacaaatgccgtggtcttacagcagcatatcaggatgcatatgggcgggcagattcccaacacacccgttcctgacagctatagcgaatctatggaaagcgacacaggctctttcgacgagaagaatttcgacgacctagacaattttagcgacgaaaacatggaagactgccctgagggttctattccagataccccaaagtctgccgatgcttcacaagattccttgagttcatccccactgcccctggagatgtccagcatcgcggctctcgaaaatcaaatgaagatgattaacgcagggttggcggagcaactgcaagcaagcctaaagtccgtggagaacggcagtattgagggagatgtattaaccaatgatagctcaagtgttggcggcgatatggagagtcagtctgccggatctcctgcgattagtgagtccactagtagtatgcaggctctgagtcctagcaattctacacaggaatttcataaaagcccctcaattgaagagaaacctcaacgcgcggttccctctgaattcgccaacggcctgagcccgacccccgtgaatggcggggccctggatctcacttcctcccatgcagaaaagattattaaggaagattctctggggattttattcccattccgggacagaggaaagtttaagaacaccgcgtgtgacatctgcggcaaaacttttgcctgtcagtcggccctggatatccactacagatctcacacgaaggaacgccctttcatctgcacagtgtgtaaccggggattctctacgaaaggaaatcttaagcaacacatgttaacacatcagatgagggacttaccctctcagctcttcgaaccctcatccaaccttggacctaaccagaattcagctgtgatccctgcaaatagtctgtcatcactgatcaaaaccgaggtgaatggatttgtgcatgtgtccccgcaagactcaaaagacacgccgacctctcacgtgcctagcggtccactgtcgtcctcagccacttcccctgttctgcttcctgctctacccagaaggacgccaaaacaacattattgtaatacatgcgggaagaccttcagcagttcttcagccctgcagatacatgagcgcactcacaccggtgagaagccatttgcttgtacgatctgtggtagggctttcacaactaaagggaaccttaaagttcatatgggcacgcatatgtggaactccaccccagcccgcagaggccgcagactttcagtcgacggtcccatgaccttcctcggaggaaatcccgtcaagttcccagagatgtttcaaaaggaccttgcagctaggagcggcagcggcgatccgtcatcattttggaatcaatacgccgccgccttgagcaacgggcttgccatgaaggcaaatgagataagcgtcattcagaatggggggatcccacccataccagggtctttgggctcgggaaactcctctccggtgtctggcctcaccggcaacctcgagaggttgcagaatagtgaacctaacgcaccgttagccggactagagaagatggcctcgtccgagaacgggaccaattttaggttcacacgttttgtcgaggatagtaaggagattgtgacctcatag

SEQ ID NO: 204190 - DNA, 3867 bp, Artificial Sequence
  Description of Artificial Sequence: Synthetic coding sequence
atgagccggcggaagcaggccaagccccagcacttccagagcgaccccgaagtagcctcattaccgcgacgagatggcgataccgaaaagggtcagccaagtaggcccactaagtccaaggacgcacacgtatgtggacgatgttgcgccgaatttttcgagctttctgatcttctcttgcacaagaaaaactgtacaaaaaaccaactcgtcctaatcgtgaacgagaatcctgcgtcgccccccgagacctttagccccagccctcctcctgacaaccccgacgaacagatgaatgatacagtgaacaagaccggtagtcacagcagcactgcaccctcgtccagctcctcatcctcctcttctagtggtggcggtggatcgagttccacggggacaagcgcgataacaacgtctctcccacaactgggtgatctaaccaccctggggaatttttctgtgataaacagcaatgtaataatagagaacctacagagcactaaagtggccgttgcacagttctcccaggaggccaggtgtggcggcgcctctggcggcaagctggccgtgcccgctctaatggagcagcttttagctctgcagcagcagcagattcaccagttgcaactgatagaacagatccgtcaccagatcttgctgcttgcctcccaaaatgccgatttgcctaccagtagtagcccgtctcaaggtacactcaggactagcgcaaatccactgagtaccctgagttcgcatctgagtcagcagcttgctgcggccgcagggttagcccagtcccttgcatcccagtctgcttcaatatctggagttaagcagttaccaccaatccagctgccgcagtcatcctcaggcaataccattatcccatctaatagcggttcaagccctaacatgaatattcttgcagcagctgttaccactccttctagcgaaaaagtggcaagctctgcaggagcatcacatgtcagcaaccctgcagtttcttccagcagctcccctgccttcgccatttcctcactcctgagtccagcaagcaatcccctgcttccccagcaggcctccgctaatagcgtgtttccgagcccactacccaacattgggacaactgcagaggatctgaattccctttcagccctcgcgcagcagagaaaaagtaaaccgcccaacgttaccgccttcgaagcaaaaagcacatcggatgaagctttcttcaagcacaagtgcagattttgcgcaaaagtgttcgggagcgattcagcactgcaaatccacctcaggtctcacacgggggagagaccattcaagtgcaacatctgcgggaatcgtttcagcactaaaggtaatcttaaagtgcatttccagagacacaaggagaagtatcctcatattcagatgaacccctacccagtacccgagcacctggataatatccccacctccaccgggatcccttacggtatgagcatacctccggagaagccagtgacctcatggctcgacactaagccagttctgcccaccctcactacatccgtgggccttccacttcccccaacactcccatccctgattccattcatcaagaccgaggagccagcacctattccaattagtcacagtgccactagtccacctgggtctgtgaaatctgattcagggggcccagagtctgctaccagaaatctaggaggcttacccgaggaggccgaagggagtaccctgccaccatccgggggaaaatctgaagagagcggcatggtcaccaacagcgtgcctacagccagcagcagcgtgctgtccagccccgccgcagattgcgggcctgctggctccgccacgacgtttacaaaccctcttctgccgcttatgagcgaacaattcaaggccaagttccccttcggcggactgcttgatagtgcacaagcttcagaaacgtctaagttgcagcaactcgttgagaacattgacaaaaaggccaccgatcccaatgagtgcatcatctgccatagggtcctttcttgccagtccgccctaaagatgcactacagaacccacaccggcgaaaggccctttaaatgtaaaatatgtgggcgcgcttttacaaccaagggcaatctgaaaacacactattcagtgcacagagccatgccgccgcttcgcgtgcaacattcgtgccccatatgccaaaagaaattcacaaatgccgtcgttctgcagcagcacatccgcatgcacatgggtggacaaattcctaacacacctgttcccgacagttattcagaatctatggagagcgatacaggcagctttgatgaaaaaaacttcgacgacttggacaactttagcgatgaaaacatggaagactgccctgagggcagtatacctgacacccccaaatcagccgacgcttcacaggattcgctttcctcctcaccgctgcctctggagatgtcgtccattgccgctctggagaaccaaatgaagatgattaacgccggccttgcagagcaacttcaggcctcactgaagagcgttgagaacggctcaatcgagggcgacgtactgaccaatgacagttcaagcgtggggggcgatatggagtcccagtcagcaggctcgcctgccatctctgagagcacatcctccatgcaagctctgtccccgagcaatagcacacaggaatttcacaaaagtccctccatcgaggagaaacctcagcgcgccgtgccgtcagaattcgcgaacggacttagcccaacccctgtcaatggaggcgccctggacctgaccagtagccacgctgagaagatcatcaaggaagattcactgggtatcctcttcccttttcgggatcggggcaaattcaagaacaccgcctgcgatatctgcggcaaaacttttgcttgtcagtccgccttggacatccattatcgctcccatactaaagagcggccattcatatgcaccgtgtgcaaccgcgggtttagcacaaagggtaatttgaaacaacatatgttgactcaccagatgcgggacctgccttcccagctttttgagccttccagcaatctcggacccaaccagaattctgcagtcatacccgcaaattcactgagttcgctcattaagactgaggtgaacggatttgtccacgtatccccacaggattccaaagacacaccaacctcacacgtcccaagcggacccctgtcatcctcagctactagcccagtactactgccagcccttcctcgccgcaccccaaagcagcactactgcaatacgtgcggaaagactttttcctcgagtagcgccttgcagattcacgagaggacccacacaggtgaaaagcctttcgcctgcaccatctgtgggagagcctttaccaccaagggaaatctgaaggtgcacatgggaacccacatgtggaactccacacctgcacgacggggtaggcgtctcagtgttgatggtccaatgaccttcctgggcggcaatccggtgaaattccctgaaatgtttcaaaaggatctggccgcacgttctggcagtggcgacccaagctcgttttggaaccagtacgccgctgcattgtcaaacggcctcgccatgaaggccaatgagatttcagtcatccagaacggggggatcccccctattccagggtctctgggctccggtaatagctctccagtgagcggccttactgggaatcttgaacggttgcagaatagcgaacccaatgcaccgttggcgggactggagaaaatggcctcaagcgagaatgggactaattttcgtttcaccagatttgttgaggattcaaaggagattgtgaccagctag

SEQ ID NO: 204191 - DNA, 444 bp, Artificial Sequence
  Description of Artificial Sequence: Synthetic coding sequence
atggtgcacatgggcacccacatgtggaacagcacccccgcccggcgggggagaaggcttagcgtcgatggcccaatgacttttctcggggggaacccagtcaaatttccagagatgttccagaaagaccttgctgccaggagcggcagtggcgacccgtcctctttttggaatcagtacgcagcggcattgtctaacgggctcgcgatgaaagccaacgagatcagtgtcatccagaacggcggaatccctccaattcctgggtctctcggctccgggaatagcagccccgttagcggcctgaccggtaacttggagagactgcaaaactcagagcccaatgcaccactcgctggcttggagaagatggcctcaagtgaaaacggaacaaattttcgttttaccagattcgtggaggattctaaggagatcgtgacctcatag

SEQ ID NO: 204192 - DNA, 3024 bp, Artificial Sequence
  Description of Artificial Sequence: Synthetic coding sequence
atgagccggcggaagcagcggaagccccagcagctgatcagcgactgcgagggcccctctgccagtgagaacggagatgctagcgaggaggaccacccccaggtctgcgccaagtgttgcgcccagttcacagatccaaccgagttcctcgcccaccagaacgcgtgtagtacagatccccccgtgatggtcatcatagggggccaagaaaatccgaacaattcatctgcctcgagcgaaccccgccctgagggccacaacaatccacaggtgatggacactgagcacagtaaccctccagacagcggatcgtcagtgccgacggaccctacatggggtcccgagcgtcgaggcgaagagtcgcctgggcacttcctggtcgcagctactggtacagctgccggcggtggagggggcttgatcctagctagcccaaagctgggggcaacacccttgcctccggagtcaacccctgcccctcctcctccccctccgccacccccgccccccggggtcgggtccggtcacttgaacatcccactgatattagaggagctgcgggtactacagcagcgccaaattcaccaaatgcaaatgacagaacaaatctgtcgccaggtgctgctcctggggtctctaggacaaaccgtcggagcaccagcctctccttctgagttaccaggtactgggacagcatcctcgactaagccactgctgcctctcttctcacccatcaagcccgtgcaaacgagcaaaacactcgctagttctagcagcagcagctcaagctccagcggcgcagagaccccgaaacaggcctttttccatctgtaccatcctctgggctctcagcaccctttttctgcggggggagttggccgtagccacaagccaacacctgcccctagccctgccctgcccgggagcacggatcaactgattgctagcccgcatcttgctttcccatcgaccaccggtctgcttgccgcccagtgcctcggcgctgctcggggcttggaagcaaccgcctcccccggactcctgaagccaaagaatggttcgggagaactgagctatggggaggttatgggcccccttgaaaagccagggggccgacacaaatgccgattttgtgccaaggtgttcggctcggactcagcattacagatccacctgagaagtcacacaggagaaagaccttataagtgcaacgtatgcgggaaccgcttcacgacccgaggcaatctaaaggtccacttccaccgacaccgcgaaaaataccctcatgtccaaatgaaccctcatcctgttccagagcaccttgattacgtgattactagctccggcctcccctacgggatgtcggtgcccccggagaaggccgaggaagaagctgccactccaggtggcggtgtagaaaggaagcctctcgtagccagcaccactgcactgtctgcaacagagtccttgactctcctttccacttctgcgggtacggccactgctcccgggctgccagcattcaacaaatttgttctgatgaaggccgtggaaccaaagaacaaggcagatgaaaataccccccccggatccgaggggtccgctattagcggggtagctgaatcttccactgccacccgaatgcaattatcaaaactcgtaactagcctgcccagctgggcacttctgaccaatcattttaaaagcacaggtagcttcccttttccctacgtactggagccgctgggggccagtcctagtgagacttccaagttacagcaactcgtggaaaaaatcgatcgccagggtgccgttgcagtcacaagcgctgcctccggggcgcccactacaagcgccccggccccgtcttcctctgcatcatctggacccaatcagtgcgtgatctgcttgcgtgtgctgagttgccccagggccctcaggctccactacgggcagcacggaggagagcgacccttcaagtgcaaagtgtgcggcagagccttcagcacccgcggcaacctccgggcacatttcgtgggtcacaaggcatccccggctgctagggcccaaaatagttgccccatctgtcagaagaagttcacaaacgctgtcacattacagcaacacgtgcggatgcatctgggagggcaaattcctaatgggggaactgccctgccagagggtggtggggccgctcaggaaaacggcagcgagcaaagcacggtgtctggcgctggcagcttcccccagcagcagtcacagcagccatcgcccgaagaggaactgtccgaggaagaggaggaggaggatgaggaggaggaagaagacgtaacagacgaggacagcttagctggacgaggaagcgaaagcggaggagaaaaagccatctctgtgaggggcgattccgaagaggcaagcggggccgaggaggaggttggaactgtggcggccgcagcaaccgctggaaaagagatggattcaaacgaaaaaaccacacaacagtcctcgttgccacccccccctcctccagatagcctggaccagcctcaacctatggaacaggggtcgtccggcgtcctgggaggcaaggaagaaggaggtaagcccgagcgcagctcctctccagcctcagcactcaccccagagggagaggccacctccgtgaccctggtggaggagctatctctgcaagaagctatgcgcaaggagccaggcgagagcagctcccgtaaggcatgcgaagtgtgcggccaggcgttcccgtcgcaggctgctctggaagaacatcaaaagacacaccctaaggagggcccgctcttcacctgcgtgttctgtcggcaaggctttctggaaagggcaactctcaaaaagcatatgctgcttgcccatcatcaggtgcagcctttcgccccccatggaccccagaacattgccgcattgtctttggtgccaggttgtagtccttcgattacctccaccggactgagcccctttcctaggaaggatgatccaacaataccttag

SEQ ID NO: 204193 - DNA, 1827 bp, Artificial Sequence
  Description of Artificial Sequence: Synthetic coding sequence
atgagccggcggaagcagcggaagccccagcagctgatcagcgactgcgaagggccgtccgcgtccgagaacggcgacgcttcggaggaagatcacccccaggtttgcgccaagtgctgtgctcagttcacagaccccaccgagttcctagcacaccaaaacgcgtgctccaccgatccacccgtaatggtcatcatcggaggccaggaaaacccaaacaacagctccgcgtccagtgagcccagacccgagggccacaacaaccctcaggtcatggatacagaacacagcaatccacccgactccggctcatcagtgcccaccgatccaacatggggacccgagcgaaggggggaggaatctcccggacactttttagtggccgccacagggacagctgcaggtggcggtggcggactgatcctggcgagcccaaaacttggggctaccccactgccacccgaatcaacccccgcaccccctcctcctcccccaccccctcctccccctggggtgggttctggccatctaaacatacccttgattcttgaggagctgagggtcctgcaacaacgccagattcatcagatgcaaatgacagaacaaatctgcagacaagtgctgttactcggcagtctggggcaaacagttggcgcgcccgcaagtccatccgagttacccggaactggtactgcctccagcaccaaaccgctacttcccctcttctcaccaattaaaccagtacagacttctaagactctggcatcctcttccagttcatcttcctcttcttcaggtgccgaaacacccaaacaagcttttttccacctgtaccacccacttggtagccagcacccattctcggcagggggcgtcggcagatcccacaaacccactccagcaccctctcctgctctgcccggcagcacagatcaactcattgcctccccccatctcgctttcccctctacgaccggattgttggccgcacagtgtcttggagctgcacgcggtctggaggcgactgcttctcctggccttttgaagccaaaaaatggctccggtgagctctcatatggagaagtgatgggcccactcgagaagcccggcggccggcataaatgccggttttgcgctaaggtctttggatcagattctgccctgcagatccacctacgctcccacacgggagagagaccttataagtgcaatgtgtgtggtaataggtttacaacaaggggtaatttgaaggtgcactttcataggcatagagaaaagtacccccacgtccagatgaatcctcaccctgtgccggagcacctggactacgtgataacttcgtccggattgccttatggaatgagcgtgcctccagaaaaagccgaggaagaagctgccacacccggggggggcgtggagcggaaaccacttgtcgcatccacgacagccctgtcagccacagagtccctgaccctattgtcaacatctgctggcaccgctaccgccccggggctaccggcattcaacaaatttgtacttatgaaagccgtggagccaaagaacaaggctgatgagaataccccacccggaagcgaggggagcgcaatttccggcgttgctgagtctagtaccgccacccgtatgcagttgtcgaagctggtgacaagtttacctagctgggcgctgcttacaaaccacttcaaatccactggaagctttccatttccctacgtgcccgaagaggtgcaccagtgttgccacagtgccgccgcttgccctgatgcacccggcgggcctgacccacaacgctggtactgcactccctag

SEQ ID NO: 204194 - DNA, 3687 bp, Artificial Sequence
  Description of Artificial Sequence: Synthetic coding sequence
atgagccggcggaagcaggccaagccccagcacctgaagagcgacgaggaactgctgcccccagacggcgcaccagaacacgccgcccccggggaaggcgcggaagacgcagacagcgggcctgagtctcggagcgggggggaagaaacatcagtgtgcgaaaagtgttgtgctgagttcttcaaatgggccgacttccttgagcatcaaaggtcgtgcactaaattaccacccgtgcttatcgtccacgaagatgcccctgcacccccccccgaagatttcccagaaccctcccccgcctccagtccgtctgaacgggctgaatccgaagccgcagaagaggccggagctgagggcgcggaaggtgaggcgagaccagttgagaaagaagcagaacccatggatgccgagcccgccggtgatacacgcgccccaagacccccccctgccgctcccgcaccacctaccccggcctacggcgcccccagcacgaatgttacgctggaagctcttcttagcactaaggtcgctgtcgcgcagttttctcagggagccagggccgccggtgggtctggagccggaggaggcgtcgcggcggccgccgtgcccttgattttggaacaactcatggcccttcaacagcagcagattcaccagcttcagctgatcgagcaaatccgaagtcaggtagccttgatgcagagaccacctcctcgccccagcctctcaccagccgcagcgcccagcgctccagggccagcgcccagccagctgccaggcctggctgccttacccctgtcggccggtgccccggccgcagcaattgccggtagcggtccagccgcccccgcggctttcgagggcgcccagccactatctaggcccgaatcaggggccagcacacccggaggtcccgccgagccaagcgcaccagccgcaccctccgccgcccccgctcccgccgcaccagccccagctcctgccccccagtcagctgcttcttctcagccccagtccgcaagtaccccccccgcacttgcaccaggctccttgctgggagcagccccgggtcttccaagtccactcctcccgcagacaagcgcctccggtgtgatttttcctaatcctctggtgtctatagctgccacagcaaacgctctagacccgctaagtgcacttatgaagcacaggaaaggcaaacccccgaacgtgagtgtctttgaaccaaaggcatccgctgaggatccattcttcaagcataaatgccggttttgcgccaaagtgtttggttcagactctgctcttcagattcacttgagaagccataccggcgagcggccctttaagtgtaatatctgtggcaataggttcagtacgaaaggcaacctgaaggtgcattttcaaagacacaaggagaagtatccccatatacagatgaatccttaccctgtacctgagtacctagataacgtgcctacctgttcaggcatcccatacggcatgtccctcccgcctgagaaaccagtgaccacttggctcgactcaaagcctgtgttgcccactgtacccacctctgttggactgcagctgccaccaactgtgccaggagcccacgggtacgctgatagtccctctgcaacgcctgcatctcgcagtcctcagagacccagtccggcatcttctgaatgtgcatccttgtctcctggattgaaccatgtggagtctggcgtctctgccactgcggagagcccccagagcctgctgggggggcctccgctgacgaaagcagagcccgtctctctgccttgtacgaatgcccgggcaggcgacgcacccgttggggctcaggcttcagctgcccccacgagcgtagacggggccccaacatcgctgggctccccggggcttccggccgtgagtgagcagttcaaagcccaattcccgttcggaggactcctggactccatgcaaactagcgagacctctaaactgcagcagctggtggaaaatattgataagaagatgacagatcccaatcaatgtgtgatctgtcatagagtcctcagctgccagagtgcacttaaaatgcattaccgcacgcacactggcgagagaccctttaagtgcaaaatttgcggtcgagctttcactaccaagggcaatttgaaaacccattttggtgtgcaccgcgccaagcctcctctccgcgtgcaacactcctgccctatctgtcagaagaaatttaccaacgccgtcgtgctgcaacagcacataaggatgcacatgggaggacagattcctaacacacccctgccggaggggtttcaggacgcgatggattctgagctcgcatacgacgataagaatgccgagaccctgtctagctacgacgatgatatggacgagaactccatggaggacgatgccgaactgaaggatgccgcaaccgatccagctaagccacttctcagttatgccgggagctgcccaccttccccaccatctgtgatttcgtccatcgcggcccttgaaaaccagatgaaaatgatagattccgttatgtcgtgtcagcagctgactggattgaaaagtgtggagaacggctccggggagtctgaccgcctgtcaaatgactccagctctgcagtgggagatttagaatcaaggtccgcaggctcaccagccctttctgaaagctctagtagccaggcactaagcccagctccctcgaatggcgagtctttcaggtcaaagtcacctggactaggggcaccggaagaaccgcaggagatacccctgaagactgaacgtccagactcacctgcggccgctcccggtagcggaggcgcccccggccgagcgggcattaaggaagaggcccccttctccttactgttcctctctcgggagcgagggcctagccagagtacgccaagtttgattagttccgcggctcccactatgatcaaaatggaagtgaatggacatggaaaggcaatggctctgggagaaggaccaccccttcccgccggcgtgcaggtgcctgcaggcccccagactgtcatgggccccgggttggctcccatgcttgcccccccgccccgtcggacaccaaagcagcataactgtcagagctgtggtaaaacattttctagcgcctccgccttgcagatccatgagcgcacccacacaggggaaaagccatttggctgtaccatatgcggaagagcttttacaaccaagggcaatctgaaggttcatatggggacgcacatgtggaacaacgccccagctcggaggggaagaagattgtcagtcgagaatccaatggccctgctcgggggggatgccctcaagttcagtgaaatgtttcagaaggatctggctgctcgtgcgatgaacgtggacccgagtttttggaaccaatacgctgccgcaatcacaaatggtctcgctatgaagaacaacgagatctccgtcatccaaaacggaggcattccgcagctccctgtcagcttaggcgggagtgccctgccccccttggggtcaatggctagcggaatggacaaagcccgcaccggaagctctccacctattgtctcccttgacaaggctagtagtgaaacggcagctagccgccccttcaccagattcatagaggataacaaggaaataggaattaactag

SEQ ID NO: 204195 - DNA, 3903 bp, Artificial Sequence
  Description of Artificial Sequence: Synthetic coding sequence
atgagccggcggaagcaggccaagccccagcacctgaagagcgacgaagaactgcttcccccggatggcgcccccgaacacgccgcccctggggagggggccgaggatgccgatagcgggcctgaaagtcgcagtggcggcgaagaaacctcagtctgtgaaaagtgctgcgccgagttttttaagtgggctgactttctggaacaccagagaagttgtactaagcttccccctgtgttgattgtccacgaggatgcgcccgccccaccaccagaagatttccctgaaccgagtcccgcttcctctcctagtgagagagctgaatctgaagctgccgaagaagcaggcgcagaaggagcggagggtgaagccagacctgtggagaaagaagcagaacctatggacgccgagcctgctggtgatacccgcgcgcccaggcccccccctgcagctccagcgcctccaacacctgcttatggagctccttcgactaacgtcacgctggaagcactgctcagtacaaaggtagccgttgcgcagttttcacaaggggcacgagcggccgggggctcaggagcagggggcggcgtagcagctgctgccgttcctctcatcttagagcagctgatggccctgcagcagcagcagattcaccaactgcagttgatagaacaaattaggagccaagtggccctgatgcagcgcccccccccgagaccctcattatcccccgccgcggctccttccgctccgggacccgctccttcacagctacccggtctggccgcgctgcctctctccgctggagcccccgcggctgccatcgccggctccggccctgccgcccccgctgcatttgagggagctcagccgttatctcgaccagagtccggcgcatccacacccggaggcccggcggagcctagcgccccagccgcaccaagcgctgcacccgctcctgcagctcccgctccagccccagctccacaatcggccgctagctcacagccccagtccgcttccactccccctgcgctagccccgggttccctcctgggcgcagcaccaggactgccctcacccctgctaccccagaccagtgcatctggggtgatcttccctaaccccctagtgtcgatagctgctaccgccaacgccctggatcctttgtccgcattgatgaagcacagaaaaggaaaacctccgaatgtgtcagtgttcgagcccaaggcctctgcggaggaccccttctttaagcataagtgcaggttctgcgcaaaagtgttcggtagcgacagtgccctgcagattcacttgcggagccatacaggagagagaccatttaagtgtaacatttgtggtaatcgtttcagcaccaagggtaacctgaaggtgcacttccaacgtcataaagaaaaataccctcacattcagatgaatccctaccctgtccctgagtatcttgacaacgtgcccacttgctctggaattccgtatggcatgagcctgccacccgaaaagcccgtaacaacctggctggactcgaagccggttctgccaaccgtgccaacatctgtaggccttcagcttcctcctaccgtgccaggagctcacggttatgctgacagtccatcagctacccctgccagccgctctccacaaagaccatctcctgcctcaagcgaatgcgccagtttgtctccagggctcaatcacgttgaatctggtgtgtccgcaaccgccgaaagcccccagtcactgctgggcggcccacccttgacaaaggccgagcctgtatcgcttccgtgcacaaatgctagggcaggagacgccccggtaggtgcccaagctagtgccgctcctacttccgttgacggagcacctacttcccttggatcaccagggctgcctgcagtttccgagcagttcaaagcccaattcccctttggtggtttacttgacagcatgcagacgtctgaaacttctaaactgcagcagctcgtggagaatatcgacaaaaaaatgacagatcctaatcagtgcgttatctgtcatcgagtgctatcgtgccagtccgccctcaaaatgcattaccggacccataccggcgagagaccattcaagtgtaaaatctgtggcagggctttcacaaccaaggggaacctaaagacacacttcggcgtccatcgggcaaagcctcccctcagggtacagcactcttgtcctatctgtcagaaaaagtttaccaatgctgtggtactgcagcagcacattagaatgcacatgggcggacagatacccaatacgccacttcctgaggggtttcaggacgctatggacagcgagcttgcatacgacgacaagaatgccgaaactctgtctagctatgatgacgatatggatgagaactccatggaggacgacgccgaacttaaagacgctgccaccgatccggccaaaccgctcctcagctatgccgggtcttgccccccatctccacctagtgtgattagcagtattgcagccctggagaatcagatgaaaatgattgactctgtgatgagctgtcagcaacttacaggactcaagagcgtcgagaacggaagcggtgaatccgaccggctgagcaatgactcatctagcgcagttggggacctggagtcccggtccgcgggctccccagccctgtccgagagttcatcaagccaagcgctgagcccagcgccatccaatggcgagtcttttcggtctaaatctccgggactcggcgctcctgaagagccgcaggaaattccactgaaaacggagagaccggactcacccgcagctgccccaggatccggaggcgcccccggtcgtgcaggtattaaggaagaagcacctttctcgctgttattccttagcagagagcggggaaaatgcccctccaccgtgtgcggtgtgtgtgggaagccattcgcttgcaagtctgcgctggagattcactaccgctctcataccaaggaaaggccatttgtctgcgccctctgcaggcgcggctgtagcaccatgggtaaccttaaacagcacctcctgactcatcggttaaaggagctgccttcccagctatttgaccctaactttgccttaggacctagccagtctacaccaagtctcatctcatccgcggcacccacgatgatcaaaatggaggtgaacggccacggcaaagctatggcactcggtgagggaccgcctctccctgccggggtccaagtacccgctggaccccagacagtaatggggcctggactggctccgatgctcgctccccccccacggcgaaccccgaagcaacacaattgtcagagctgcggcaaaacatttagtagtgcctcagctctccagattcacgagaggactcacaccggcgagaagccttttggttgtaccatttgcggtagggcattcaccactaaggggaacctgaaagtgcacatgggaacacacatgtggaataatgctcctgcaagacgggggcgcaggctgtctgtcgaaaatcccatggccctcttagggggtgatgcattaaagttctctgagatgttccagaaggatctcgccgcccgcgcaatgaacgttgacccgtcgttttggaatcaatatgcagccgcgattaccaacgggctggcaatgaaaaataatgaaatctccgtgatacagaatggaggcattcctcaacttccagtaagtctcggaggctccgctctgcctcctctggggagcatggctagtggcatggataaagccagaaccggaagtagcccaccaatagttagcttggacaaggctagttctgaaacggccgccagccgccccttcacacggtttatagaggacaacaaagagatcggcattaactag

SEQ ID NO: 204196 - DNA, 2883 bp, Artificial Sequence
  Description of Artificial Sequence: Synthetic coding sequence
atgagccggcggaagcaggccaagccccagcacctgaagagcgacgaggagctgttgcctccggatggcgccccagagcacgcagccccgggggagggggcagaagatgctgacagtgggcctgagtcaaggtccggcggggaagaaactagcgtctgcgagaagtgctgcgcagaattctttaagtgggccgattttctggagcaccaacgctcatgtacaaagctaccccccgttttgattgtgcatgaagacgcaccccctgggctgccctcaccactgcttcctcagacatcagctagcggggtgatatttccaaaccccctagtaagtattgcagccaccgccaatgccttagatccgttgtccgccctgatgaagcaccggaaggggaaaccccctaacgtatctgtgtttgagccaaaagcatctgccgaagaccctttctttaagcataagtgccgattttgtgcaaaggttttcggatcggattctgctttacagatccatcttcgttctcacaccggtgagaggcctttcaagtgcaacatatgtggtaatcgctttagtaccaagggcaacttgaaggtgcattttcagcgccacaaagagaagtatcctcacatacagatgaacccctaccccgtacccgaatacttagataacgtacccacatgttctggtattccctacggaatgagcctgccccctgagaagccggtgaccacttggctcgactcaaaaccagtccttccaacagtgcctacaagcgtcggccttcaacttccacctacagtgcctggggcccacggctatgctgactctccttccgcaactccagcctcccgctccccccaacggccaagtcccgcttcatctgagtgcgcatccctatctcccggactgaatcacgtcgagagtggcgtatcggccactgccgaatccccccagtctcttcttggggggcccccactgacaaaggctgagccggtgtcactaccctgcacgaacgcccgggctggcgatgccccagtgggagcacaagctagcgctgcaccgactagcgtcgatggtgccccaacttcactgggatcccccggactaccagccgtctccgagcagtttaaggcgcaatttcctttcggtggattgctggactctatgcagacctcggagacttctaaacttcaacagctggtggagaatatcgacaagaagatgacggatccaaatcagtgcgttatctgccatcgggtgttaagctgccagtccgcgttaaagatgcattaccgaacacacacaggcgagcggccgtttaagtgtaagatctgcggcagggcctttaccacaaaaggtaatctgaagacccactttggtgtgcaccgagcaaagccacccctgagggtccagcatagctgccctatttgtcagaagaaattcaccaatgccgtggtgttgcaacagcatatacggatgcatatgggcggacagattcccaacaccccgctgcctgaaggcttccaggatgcaatggattctgaactcgcttatgatgacaagaatgccgaaacactttcatcttacgacgacgatatggacgagaacagtatggaagatgatgcagaactgaaagacgcagccaccgacccagctaagcctttactaagctatgccggttcctgccctccttctcccccctctgtgatcagtagtattgcagctctggagaaccagatgaaaatgatcgatagtgtcatgagctgccaacagttaactggcttaaagtctgtagagaacggctctggggagtccgatcgcctctcaaacgatagctcctccgcagtgggggatcttgagtcacggtccgcgggctctcccgctttgtcagagtccagtagcagccaggcacttagcccggctccgagcaacggagaatcattccgcagtaagagtccagggctaggtgccccggaagaaccgcaggaaattccattgaaaactgagcgtccagactcacctgctgcagctcccggatcagggggcgctcctggaagggcaggtatcaaagaggaggccccgttttccttgttatttctgtcacgagagagaggacccagccagtccacccctagtcttatcagcagcgccgctcccaccatgatcaagatggaagttaacggacacggcaaagcgatggccctgggcgagggccctcccctgccggcgggggtgcaggtgccggcagggccccaaacagtgatgggccctggactggcacctatgttggcccctcctccgaggagaacccctaagcaacataattgccagtcttgcggcaaaactttctctagtgcttctgcgctccaaatccacgagcgcactcataccggagaaaaaccttttgggtgcactatttgtggacgtgcctttaccacaaaaggcaatctgaaggtgcatatgggcacacatatgtggaacaacgctccagctagacgggggcggcgactcagcgtggagaacccaatggcattgctgggaggagacgcactcaaatttagcgaaatgtttcagaaagatctggccgcccgggctatgaatgtggaccccagcttctggaatcagtacgccgctgctatcactaatgggctcgccatgaaaaataatgaaatttcggtgattcagaatggcgggatcccccagttaccggtttctctgggtggctcggccttaccgccactggggagcatggcttccggtatggataaggctcgaactgggagctcccctcctatagtttctctggacaaggcgtcttcagagacggctgcaagtcggccgttcacaagattcatcgaggacaacaaggaaatagggatcaactag

SEQ ID NO: 204197 - DNA, 516 bp, Artificial Sequence
  Description of Artificial Sequence: Synthetic coding sequence
atggtgcggccccccgtggtgccccggcggccccccgcccacatcagtagcgtgcggcaggcttctactcaggtccctcgtacggttccccacacacagagggtggccaacatagggacccagactactggcccttctggcgtgggatgttgtacccctggaagacctcttttgccttgcaagtgcagttctgcagcccattccacgtatagggttcaggaacctgcggtgcatattcccggccaagagccactcaccgcctccatgctcgcagctgctcctttacacgaacagaaacagatgatcggggagcgcctttacccgctcatccacgacgtgcatacgcagttggccggtaagataaccggtatgctgttggagattgacaatagcgagctactgttaatgctagagtctcctgaaagcctgcacgctaaaaagcggaaatcaagtctcccttggctcccaaagggccagtgcttctggcttagcgcgttgcggccatgtaaactttag

SEQ ID NO: 204198 - DNA, 831 bp, Artificial Sequence
  Description of Artificial Sequence: Synthetic coding sequence
atgagccggcggaagcaggccaagccccagcacatcaacagcgaggaggatcaaggcgagcaacagccccaacagcagactcccgaatttgcagacgcagcccctgccgctcccgccgccggtgaactaggccggagttcccttccaagcacctttatcagggcaccccccacatacgtcaaggtggaagtgcccggtactttcgtgggcccatccacactttctccgggcatgacccctttacttgccgcccagcctcgccgacaagccaagcagcacggctgtactcggtgcgggaaaaatttctcctcggcgtctgcactacagattcatgaaaggacgcacacgggggaaaaaccctttgtttgtaacatatgtgggagggcgtttactactaaagggaatctgaaggttcattacatgacccacggggctaacaataattcagctcgacgaggccgaaagctagctatcgaaaacaccatggctttactggggacagacggtaaacgcgtgtctgaaatttttcccaaagaaattctcgccccatctgtgaatgtggatccagtggtgtggaatcagtatactagcatgctgaacggcggtctggccgtgaaaacgaacgagatctctgtgatacaaagcgggggggttccgactctgccagtgtccttaggtgccacatcagtggtcaacaatgccacggtcagcaaaatggatgggtctcagtcggggatcagcgctgatgtggaaaaaccttccgccacggatggagtacccaagcaccaattccctcactttttggaagaaaacaagatagccgtgtcctag

SEQ ID NO: 204199 - DNA, 1851 bp, Artificial Sequence
  Description of Artificial Sequence: Synthetic coding sequence
atgagccggcggaagcaggccaagccccagcacatcaacagcgaggaggaccagggcgagcagcagccacagcagcagactccggagtttgcagacgcggcgccggcagccccagcggcgggggaattgggagctccagtgaaccatcccgggaacgatgaagtcgcatcagaagacgaagccaccgttaagagactccggcgggaggaaactcatgtgtgcgagaagtgctgcgccgagtttttttccatctccgagttcttggaacataagaagaattgtacaaaaaaccctcccgtgctgattatgaatgacagtgagggccctgttccctcagaggacttttccggcgccgtgctgagccatcagcccacatcacctgggtccaaggactgccacagagagaacggcggatcatcagaagacatgaaagaaaagcccgacgcagagagtgtggtctacctgaagacagagactgcactgccccccaccccacaggacatcagctacctcgccaaggggaaagttgctaataccaatgtaacgctccaggcactgcgtggcacaaaggtcgccgtgaaccagcgctcagccgatgctctgcctgcaccagtgcctggagccaattccatcccatgggtccttgagcagattctgtgtctgcagcaacagcagttgcagcagattcagctcacagagcaaattagaatccaggtcaatatgtgggcctctcacgcccttcactctagtggcgcaggcgccgacacactgaaaactttgggatcacacatgtcccagcaggttagcgcagccgtggctctgctgtctcagaaagcagggtcacagggactttctctcgacgcactcaagcaggccaaactgccccatgccaacatcccctccgccacctccagcctgagtccaggattggcccctttcacactcaaacctgatggtactagagttctgcctaacgtgatgtcccgtctgccgagtgccttacttccacaagcccctggcagcgtgcttttccaatccccattcagcaccgttgcgttagacacgtccaagaagggcaagggaaagccaccgaatatatcggccgtggatgtcaagcccaaggacgaggcagctctgtataaacacaaatgtagatcatccctcccatcaacttttattagggctcccccgacatatgtaaaagtggaagtgcccggcaccttcgtgggaccatcaactctcagtcctgggatgacccccctcctggccgctcagccgcggcggcaagccaaacagcacggatgcaccagatgcggaaagaacttctcgtctgcttccgctctgcagattcatgaaagaacacacaccggtgagaagccattcgtgtgtaacatctgtggacgtgccttcacaactaaaggaaacttgaaggtgcactacatgacacatggcgccaataataattccgctcgacggggaagaaagctggccattgagaacactatggccctgttgggtaccgacggcaagcgcgtttccgagatctttcctaaggagattctagcccctagcgtcaatgtggatcctgtcgtctggaatcagtacactagcatgttgaatggaggcttggcagttaaaaccaatgagataagtgtgattcagagcggcggggtgcctactttaccagtgtccctgggcgccacttctgtggttaataacgctacagtgtctaagatggatggcagtcagtcaggaatctccgccgatgtggagaagccatcagcaaccgacggcgtccctaaacaccagtttccccatttccttgaggagaacaagattgcagtctcatag

SEQ ID NO: 204200 - DNA, 2781 bp, Artificial Sequence
  Description of Artificial Sequence: Synthetic coding sequence
atggtgatggccgacggcccccggcacctgcagcggggccccgtgagggttggattttatgatattgagggcactttaggcaagggcaactttgccgtcgtgaagctgggtcgccacagaattaccaaaaccgaagtggccatcaagataatagacaaatcgcagctggatgctgtcaacttggagaaaatctacagagaggtgcagattatgaaaatgctggaccatccgcacattataaagttataccaggtgatggagacaaagtccatgctctacttagtaactgagtatgcgaagaatggagagatttttgactatcttgctaatcacggcagacttaacgaatcagaagcaagacggaagttttggcaaatcctgtccgctgtagattactgtcatgggcgcaaaatcgtccaccgcgacctgaaagccgaaaatctcttactcgataacaacatgaacatcaaaatcgctgactttgggttcggtaacttcttcaaatccggggagttgctggcaacttggtgtgggagcccaccttatgcagcccccgaggtcttcgagggtcagcagtacgagggaccccaacttgatatatggtcaatgggcgtcgttctttatgttcttgtatgtggagccctgccttttgacggtcccaccctgcccattttgcgccagcgggtgttggaaggcaggttccgtatcccctattttatgtcggaagattgcgaacatctaatccgtagaatgttggtgctcgacccttctaagcgcctgacaatcgcgcaaatcaaggagcataagtggatgctcatcgaggttccggtgcagcgtccagtactgtacccacaggaacaggaaaacgagccaagtattggcgaattcaacgagcaagtactgaggttgatgcatagcctcggcatcgatcagcaaaagactatcgaatcgctgcagaacaaatcatataatcatttcgctgccatctacttcctgctcgtggaaagactcaaatcacatcgctcctcattccccgtggagcagagactagatgggagacagcggagacccagcaccatcgccgagcagaccgtagcaaaggctcagaccgtgggcttgcccgtcaccatgcactcccccaatatgcggttactgaggtcagccctgctgccacaggctagtaacgtggaggccttttcgtttccagccagcggctgtcaagccgaagctgcgtttatggaggaagaatgtgttgacacccctaaggtgaacggatgcctacttgatccggtgcctcccgtgctcgtccggaagggctgtcagtcactgccctcaaacatgatggagaccagtatcgacgagggactggagacagagggggaagcggaggaggatcctgcacacgctttcgaggcgtttcagagcacgcgttccggacagcggaggcacaccctgtccgaagttactaaccagctggtagtgatgcccggcgccggcaaaatcttttctatgaatgactccccaagcctggattccgtcgattcggagtacgacatgggttccgtccagcgggatctgaacttccttgaggataatccaagtttgaaagatatcatgcttgccaaccagccctcacctcgcatgaccagcccattcatatctctccgccccaccaaccccgccatgcaggctctatctagtcaaaaacgtgaagtgcataaccgatccccagtatctttcagagagggccgacgcgcctcagatacatccctcacacagggcatcgtagcttttagacagcacctccagaatctagctcggaccaagggaatccttgagctgaacaaggttcagctcctctatgaacagattggacctgaagctgatcctaatcttgcacccgctgctccacagctgcaggatttggcttcttcttgtccgcaggaggaggtttcacagcaacaggagtccgtcagcaccctgcctgcttcggtccacccccaactctccccaaggcaaagcctcgagactcaatatttgcagcaccgactgcaaaagcccagtttgctgagcaaagcccagaacacttgtcagttgtactgcaaagaacctccacgcagcctcgaacagcagctgcaggaacacagacttcaacagaagcgtctctttctgcagaaacagtcccagctccaggcatacttcaaccagatgcagattgctgagagctcttaccctcaaccctcacagcagttaccactacctaggcaagagaccccaccaccctcccagcaggcccctccattctcccttacccagccactctcgccggtcttagaaccgtcatccgaacagatgcaatattcacctttcctgagccaatatcaggagatgcagttacagccactgccaagcacgagtggccccagggccgcaccacccctccctacacaactccagcagcagcaacctccccccccacctccaccccctcctccccgacagcccggggccgcccccgctccactgcagtttagctatcagacctgtgagctgccgtccgccgcgagccccgcgccagactaccctacaccatgccagtacccagtggatggcgcccagcagtccgatctgaccggaccggattgcccgcgatcacctggcttgcaagaagcaccctcctcatacgatcccttagctctgagtgaactccccggtctgtttgattgcgagatgcttgatgcagtcgatcctcagcacaacggctacgtgctggtgaattag

SEQ ID NO: 204201 - DNA, 1881 bp, Artificial Sequence
  Description of Artificial Sequence: Synthetic coding sequence
atgcagcgggccgacagcgagcagcccagcaagcggccccggtgcgacgatagcccgcgaactccgtctaataccccatctgccgaggccgactggtctccgggactggaactgcaccctgactataaaacttggggtccggagcaggtgtgttcttttctccggcgtggtgggttcgaagaaccggtcttacttaagaacatacgggaaaacgaaattacaggagctttgctcccttgtctcgatgaatcacggttcgagaacctgggggtgagttctctcggcgaacgcaagaagcttctcagttatatacaacgcctagtccaaatccacgtggataccatgaaggtgatcaacgaccctatacatgggcatattgagctacaccccctccttgtacgaatcatagataccccacaattccaaagattaaggtatataaaacagctgggtggcggctattatgtatttcctggggcttcccacaataggtttgaacacagtttaggcgtaggctatctggctggatgcttagtgcatgccctgggggagaagcagccggagcttcaaatcagcgagcgcgacgttctgtgcgtgcagattgcagggctgtgccacgatcttggacatgggccctttagtcatatgttcgatggccgcttcattcccctggcccgacccgaagttaagtggactcacgagcagggcagtgtgatgatgtttgaacatctcatcaattccaatggcatcaaaccagtaatggaacaatatggtctgatccctgaggaagatatctgctttatcaaggaacagattgtaggaccactggaatcacctgttgaggatagtttatggccttataagggccgcccagagaacaaaagcttcttatatgagattgtttctaataagaggaacggtatcgacgtcgacaaatgggattactttgcccgggactgtcaccacctggggattcagaacaatttcgactacaaaaggttcatcaagtttgctcgggtgtgtgaagtggacaatgagctcagaatctgtgctcgcgacaaagaagtcggcaacctgtatgacatgtttcacactcggaattctctccatagaagggcataccagcacaaggtgggcaacatcattgacaccatgattacagacgcatttttgaaggctgatgattatattgagattaccggcgctggcggtaagaagtacagaatttccaccgcaattgatgatatggaggcctacacaaagctcactgataatatctttctggagatcctttattccactgatcctaagttaaaggacgctcgcgagattctgaaacaaatcgagtaccgaaacttattcaagtacgtcggcgagacgcagccaactgggcagattaagataaaacgggaggactatgaatcactgcccaaggaggtagcgtctgcgaagcccaaggtgctgctggacgtgaagctcaaggcggaggatttcattgtggacgtgataaatatggactatgggatgcaggaaaaaaatccgatcgatcatgtgtctttctactgtaagaccgctcccaatagggcaattagaatcaccaagaatcaggtttcacagctgttacccgaaaagttcgccgagcaactgatccgggtctactgcaaaaaggtagataggaagagcctctacgctgcccgccagtactttgtgcagtggtgtgccgacagaaacttcaccaagccgcaggacggagatgtcatagcccctcttattacacctcagaagaaagaatggaatgactcaacctccgtacagaatccaacacgtttgagggaagccagcaaatcaagggtacagctgtttaaagacgatcctatgtag

SEQ ID NO: 204202 - DNA, 513 bp, Artificial Sequence
  Description of Artificial Sequence: Synthetic coding sequence
atgttcgacggccggttcatccccctggcccggcccgaggtgaagtggacacacgaacaaggctccgttatgatgttcgagcacctcattaactccaatggaattaagcccgtcatggagcagtacggtttgatacccgaagaggacatttgctttataaaagaacaaattgtcggacctctggaatctcccgtagaggactccctgtggccttacaagggccgaccagagaacaagagctttttatatgagattgtctccaataaacgaaatggcattgatgttgataagtgggattattttgctagagattgccaccatctgggcatccagaacaattttgactataagcggttcattaaattcgcaagggtgtgcgaggtggacaatgagctgcgcatatgcgcacgcgataaagaggtgggaaacctgtatgatatgtttcacactcgcaactctttgcacaggcgcgcctatcaacacaaagtgggaaacatcatagataccatgtag

SEQ ID NO: 204203 - DNA, 1326 bp, Artificial Sequence
  Description of Artificial Sequence: Synthetic coding sequence
atggagatccggctggacaccctgagcgccagcctgggccggagcagtaccctgaataattgtaatctagaggataaactggcatggtatgaaggcgaggcctatatgtggcaccactggaagccttttcctgagaaccctttatggacctgtctggatttccagatcgcgcaggtgggtccctgggatcattgctcttcttgcatcaggcatacccggctgaagtcatcctgttcagatatggatttgctgcatagttggcggtcgtcatctttcgggaatttcgatcgctttcgcaataacagcctgtccaaacccgacgacagtacagaagcacatgaaggggaccctaccaacgggagcggcgaacaaagcaagacaagtaataacgggggcgggttagggaagaaaatgagggcaattagttggaccatgaaaaagaaggtggggaaaaagtacattaaggctctttctgaggaaaaagacgaggaggacggcgagaacgcccacccataccgcaactccgaccccgtcatcggcacacacaccgaaaaggtctctctgaaggcttctgatagcatggactcactgtattcaggtcagagcagctcctccggaataaccagctgttctgacggcacctccaaccgggattcattccgcctcgacgacgacggtccgtattcagggcccttttgcggacgtgcccgggtgcacactgacttcactccatcaccctatgatacagatagcctcaaaatcaaaaaaggggacatcattgacattatatgcaaaacccccatgggaatgtggacagggatgctgaacaataaagtcggcaactttaaattcatatatgtggatgtcattagcgaggaggaagctgctccaaagaaaatcaaggctaaccgccgaagcaattctaaaaagtctaaaacacttcaggagttcctggagcggattcacttacaggagtatactagtactctgctgttgaatggatatgaaaccctggaggatctgaaggacatcaaggaatctcacctcatcgagcttaacatcgaaaaccccgacgatagacgtagattactctccgcagccgagaattttctggaggaggaaattatccaggaacaggagaatgagcccgaacctctgtctctgagtagcgatatttctctgaacaagtcccaattagacgactgcccacgcgactcaggctgctacatttcctcaggaaactcagataatggaaaagaagacctggaatctgaaaatttgtcagacatggtgcacaagatcatcataaccgagccaagcgattag

SEQ ID NO: 204204 - DNA, 618 bp, Artificial Sequence
  Description of Artificial Sequence: Synthetic coding sequence
atgctgaagcggaagcccagcaacgtgagcgagaaggagaagcaccagaaacccaaaaagggggacatcattgatattatctgcaagaccccaatgggcatgtggaccgggatgcttaataacaaggtaggcaatttcaagtttatatacgtggacgtgatttcagaggaagaagctgcgcctaaaaagatcaaggcgaacaggagatccaatagtaagaaatccaagaccttgcaggagtttctcgaacggattcacctgcaggagtacacttcgaccctgctcctgaacggttatgagactttggaagacctcaaagatatcaaagagtcacatctcattgagcttaacattgagaatcctgacgaccgaagacggctcctctctgccgccgaaaatttcctcgaagaggaaatcattcaggaacaggagaacgaaccagaaccactgtctctctccagcgatatctctctgaataaaagccagctggacgattgcccaagggatagcggatgttacatttccagtggtaactctgacaacggtaaagaggaccttgaatcagaaaatctgagcgatatggtccacaaaataatcataacggaaccaagcgactag

SEQ ID NO: 204205 - DNA, 1122 bp, Artificial Sequence
  Description of Artificial Sequence: Synthetic coding sequence
atgctgaagcggaagcccagcaacgtgagcgagaaggagaagcaccaaaaacccaaacgctccagctcctttggcaacttcgatcggttccgcaacaactcactcagcaagcccgacgactcaaccgaagcacatgagggcgaccctaccaacggttccggggaacagagcaagacaagcaataacgggggcggtttgggaaagaagatgagagctatcagctggacgatgaagaaaaaagtgggcaagaagtatatcaaagccctttctgaagagaaagacgaggaggacggagaaaatgctcacccctacaggaacagtgatcccgtaattggaacccacaccgaaaaggtttcactcaaagcatctgactctatggatagcctctattctggccaaagttcatcctctggcatcacgtcttgttccgatggtacttcaaatagagattccttccgcctcgacgatgacgggccgtactccgggcctttttgtggccgcgcaagagttcatacagacttcacgccatccccctacgatactgattcactgaaaataaagaaaggtgacattatcgacattatctgtaagactccaatgggaatgtggaccggcatgctgaacaacaaagttggcaacttcaaattcatctacgtggacgtgatttcagaagaagaagccgcccctaaaaagatcaaagctaaccgtcgatccaactccaagaaatcgaagacactgcaggaattcctggagcggatccatctgcaggagtatacatctacgctgcttttgaacggctacgaaaccttggaagacctgaaagatattaaggagtcacaccttatcgaacttaatatcgagaaccccgacgaccggagacggttgctgtcggccgctgaaaacttcctggaagaggaaatcatccaggagcaggaaaacgagcctgagccactgagcctctcatcagatatctctctcaataaatctcagctggacgattgccctcgggactccggctgctacatcagctccggtaacagcgataatgggaaagaagacctggagagtgagaacttaagcgacatggtgcacaagattataatcactgagcctagcgactag

SEQ ID NO: 204206 - DNA, 1008 bp, Artificial Sequence
  Description of Artificial Sequence: Synthetic coding sequence
atgggcagcgccagccccggcctgagcagcgtgagccccagccacctcttgctgcctccagacaccgtgtcacgtacaggtttggaaaaagctgctgccggagcagtcggtctcgagaggagggattggagccccagtcctcccgccacgccggagcagggactgagcgctttctaccttagctattttgatatgttatatccggaagatagctcctgggcagcaaaggctccgggcgccagcagtcgggaggaaccgccagaggagccagaacagtgtcctgtcatagacagtcaggcccccgcagggtcccttgacctggtgcctggcggtcttaccctcgaggagcatagcctcgagcaggtccagtcgatggtggtcggggaggttctaaaagacattgaaactgcgtgtaagcttctgaacatcaccgcagatcccatggactggtctccttcaaacgtgcaaaagtggctcttatggaccgagcatcaatatagacttcctccgatggggaaagcctttcaagaactggccggaaaagaactgtgcgctatgtctgaagagcaatttcggcagcggtcacccctaggcggcgacgtgttgcacgcccaccttgacatatggaagtctgcagcctggatgaaagaaaggacgagcccaggcgccatccattactgcgcatccacttcagaggagtcctggaccgattctgaagtggactcctcttgctccgggcagcctattcacttatggcagttcctgaaggaactcctgctgaagccgcattcctacggcaggttcattaggtggcttaacaaggaaaagggcatcttcaaaatcgaggatagcgcacaggtcgcccgactctggggaattcgtaaaaacaggcctgctatgaactatgacaaactgtcacgatctatcaggcagtactataagaagggaatcataaggaaacctgacatttcgcagcggctggtgtaccaattcgttcacccaatctag

SEQ ID NO: 204207 - DNA, 960 bp, Artificial Sequence
  Description of Artificial Sequence: Synthetic coding sequence
atgggcagcgccagccccggcctgagcagcgtgagccccagccacctcttactccccccagacacagtgagtaggaccggcctcgagaaagcagctgccggcgcagtcgggctagagcgccgtgactggtcgccctcgccccccgcaacccctgaacagggtttgtctgccttctatttatcctatttcgacatgctttacccagaggattcctcctgggccgctaaggcccccggagcaagcagccgtgaggagccccctgaggaaccagagcaatgccccgtgattgactcacaggcaccagcaggatccctcgacctcgtacccggcgggctaactctggaagaacactccctggaacaggttcagtccatggtggtgggcgaggttctgaaggacatcgagaccgcgtgtaagctgctcaacatcacagccgaccctatggattggtccccatctaacgtgcaaaaatggctgctttggactgaacaccagtatcgattgccacctatgggcaaggcttttcaggaactggcaggtaaggagctatgcgcaatgtccgaggagcagtttcggcagagaagtccccttggaggtgacgtgctgcacgcccacctcgatatatggaaatcagcctccacgtcggaggagtcttggactgactccgaggtcgatagttcttgttcaggacaacccatacacctctggcagttcctgaaggaacttctgctgaagccacactcttatggccgattcattcgatggttaaataaggagaaaggtattttcaagattgaggactccgcccaagtggctcgtctgtggggcattaggaagaatcggccggccatgaactacgacaaattgtctcgcagcattagacagtattacaagaaaggtattataaggaagcctgacatctcccagagattagtctatcagtttgttcacccaatttag

SEQ ID NO: 204208 - DNA, 1218 bp, Artificial Sequence
  Description of Artificial Sequence: Synthetic coding sequence
atggccgccagcggcaagaccagcaagagcgagcccaaccacgtgatcttcaaaaagatctcacgtgacaaatctgtaaccatctatctaggaaaccgcgattacatcgaccacgtctcccaggtccaacccgtcgacggcgttgtacttgtcgatccagatctggtcaagggcaagaaggtctatgttacactgacctgtgctttccggtacggccaagaggacatcgatgtgattggactgacattcaggcgggacctatactttagtcgcgttcaagtgtacccacctgtgggcgcagcctccactccgacaaagctgcaagagagcttgctgaagaaattgggctcaaacacataccctttcttgctgacgttccctgattacctgccctgctctgtaatgctgcagccagccccccaggattcagggaaatcgtgcggtgtagacttcgaagtcaaggctttcgccacagattctaccgacgcggaggaagacaaaatccccaaaaaatcatcggtgagattgctaatcaggaaagtacaacacgcccctctggagatggggccacagccacgggctgaggccgcctggcagttcttcatgtctgataagcctctgcatctcgctgtgtcgctcaacaaagagatctactttcatggagaaccaatcccagtcaccgtgacggtcactaataatacagaaaagacagttaagaaaattaaggcctttgtcgagcaagtagccaatgttgtcctctactcttcagattactacgttaagccagtagcaatggaggaggcacaggagaaagtccccccaaatagtaccctgactaaaacactgaccttgctacctcttcttgccaacaatcgagagcgccggggcatcgctctcgatggtaagataaagcatgaggatacaaacctggctagctccaccataattaaggaaggcatagaccggaccgtgctggggatattagtgtcttaccaaataaaagtgaaactgaccgtgtctggaatgaccggtcgtcaaaaagcatcagaagtggctactgaagtgccattccgactgatgcacccacagcctgaggatcccggtcaattcagttaccaggacgccaacctggtctttgaggaattcgccaggcataatctcaaagacgccggcgaggctgaggaaggaaagcgcgataaaaatgatgtcgatgagtag

SEQ ID NO: 204209 - DNA, 1218 bp, Artificial Sequence
  Description of Artificial Sequence: Synthetic coding sequence
atggccgccagcggcaagaccagcaagagcgagcccaaccacgtgatatttaaaaagatctcacgcgataaatccgtcacgatatatcttggtaatcgggactacattgatcatgtttcgcaggtacagccagtggacggcgtcgtactggtcgacccagacctggtgaagggtaagaaggtctatgtcaccctaacgtgcgcattccgatatggacaggaggatattgacgtgatcggactcacctttcggagggatctctatttctcccgtgtccaggtctaccctccggtgggcgcagccagtacgcccacaaagctccaggaatctttactgaaaaagctcggcagcaacacttacccatttttgctgacctttcccgactacctgccttgtagtgtgatgctgcaacccgcaccacaagattctggcaaatcttgtggcgtggatttcgaggtgaaggctttcgccacagactcaacggacgccgaggaggacaaaatacctaaaaagagcagcgtcaggcttctgattcgtaaagtgcaacacgcccccctagagatggggccacagccacgggccgaggcagcatggcagttctttatgtctgataagcctctgcatcttgcggtctcattgaacaaagagatttatttccacggagaaccaatccccgttacggtgaccgtaaccaacaataccgagaagacggttaagaagataaaggcttttgttgagcaggtggccaatgttgtactgtactctagcgactattacgtgaagcctgtagcgatggaggaggctcaagaaaaggtgccacccaattccacattgactaagacacttacgctcctcccgctgctcgcgaacaatcgcgaaaggcgcggcattgcccttgatggaaaaatcaagcatgaagacactaatcttgccagctcgaccataataaaagaaggcatagaccgaactgttttggggatcctggttagctatcagatcaaggttaaattgaccgtttccgggtttctgggcgaacttacctcgagcgaggtagctactgaggtcccttttaggctgatgcaccctcaacctgaggatcctgccaaggagagctaccaagacgccaacctggtgttcgaggagtttgctcggcacaatcttaaggacgctggggaagctgaggagggaaaacgagacaaaaacgacgtggacgaatag

SEQ ID NO: 204210 - DNA, 510 bp, Artificial Sequence
  Description of Artificial Sequence: Synthetic coding sequence
atggccgccagcggcaagaccagcaagagcgagcccaaccacgtgatcttcaagaagatctcacgagacaaatccgtgaccatttatttaggcaatcgcgactacatcgatcacgtctcacaagttcagcccgtcgacggtgtagtgctcgtcgatccagatctggttaagggaaaaaaagtctacgtaacactcacttgtgcctttcggtacggccaggaggacatagacgtgatcggcctaaccttcagaagagatctgtacttttctagggtacaggtctatccacccgttggcgccgcctccacccctacaaagctgcaggaatctctgctgaagaaacttggctccaatacctaccccttcctcctcacttttccggactacctgccctgtagtgtgatgcttcaacctgccccacaagattcaggaaagtcttgcggggtcgacttcgaggtgaaagctttcgcaaccgattctaccgacgctgaagaggacaagatcccctag

SEQ ID NO: 204211 - DNA, 708 bp, Artificial Sequence
  Description of Artificial Sequence: Synthetic coding sequence
atgctgcagcccgccccccaggacagcggcaagagctgcggcgtggatttcgaagtaaaggctttcgcgactgatagcaccgatgcagaggaagataaaattcccaaaaaatcaagtgtgcgcctgctgatccgaaaagtccagcacgctcctctcgagatgggcccccagccaagggccgaggccgcctggcaattctttatgtctgacaaacctcttcacctggctgttagcctgaacaaggagatttacttccacggcgaacctatcccggtcaccgtgactgtgacaaacaacacagaaaaaaccgttaaaaagatcaaagccttcgtcgagcaggtcgcaaacgtggtcttgtattccagcgattactacgtgaagccagtggccatggaggaagcacaggagaaagttcctccaaatagtaccctaacgaaaacgctgacactcttgccattgcttgccaacaaccgggaacgacgaggtatcgcattagacggaaagatcaagcacgaggacactaatctggcgtcctccacaatcattaaagagggcattgatcggacagttctaggaattctagtgagctatcaaatcaaggttaaattgactgtttccggatttctgggggagctgacgagtagcgaggtagcgaccgaggtaccatttcggttaatgcacccccagcctgaggacccaggaaagtag

SEQ ID NO: 204212 - DNA, 204 bp, Artificial Sequence
  Description of Artificial Sequence: Synthetic coding sequence
atggccgccagcggcaagaccagcaagagcgagcccaaccacgtgatttttaagaagatttcgagagacaaatccgtctccggagcacaagtgacgatatatctcgggaaccgggattatatcgaccatgtgagccaggttcagcctgtcgacggggtagtcctggtcgaccccgatttggttaagggaaaaaaggttagttag

SEQ ID NO: 204213 - DNA, 633 bp, Artificial Sequence
  Description of Artificial Sequence: Synthetic coding sequence
atggccaccgagaccgtggagctgcacaagctgaagctggccgagctgaagcaggaatgtctggccaggggactcgaaaccaagggcatcaagcaggacctgatccaccgcctgcaagcatacctcgaggaacatgccgaggaggaagcgaacgaggaggatgtcctcggcgatgaaacagaagaagaagaaaccaagccaattgaactaccggtgaaagaagaggagcctccggaaaagacagtggatgtggctgcggagaagaaggtggtcaagattacgtctgagattcctcagaccgagcggatgcagaaaagagccgagaggtttaacgtcccagtgtcgctcgaaagcaagaaagcagcaagagctgctcggttcggtatctccagcgtgccaacaaagggcctgagttcagacaataagcctatggtcaatcttgacaaactgaaagaacgagcacaaaggtttggactgaacgtatcctccatcagccgtaagtccgaagatgatgagaaactcaaaaagaggaaggagaggtttggcatcgttacttcctctgctggaacggggactacagaggatacggaagcaaagaagagaaagcgagctgaaagatttggcatagcctag

SEQ ID NO: 204214 - DNA, 453 bp, Artificial Sequence
  Description of Artificial Sequence: Synthetic coding sequence
atggaggaggagaccaagcccatcgagctgcccgtgaaggaggaggaaccccctgaaaagaccgtagacgtggcagctgaaaagaaggttgtaaagatcacaagcgagatacctcagacagaaaggatgcagaaaagagcggaacgcttcaacgtcccggtctcacttgagagcaagaaagccgcccgggccgcccgttttggcatttccagcgtccctaccaaagggctgtctagcgataataagccgatggttaacttggacaagctaaaagagagagcccaaagattcggtctcaatgtgagctctatcagccgcaaaagtgaggacgacgaaaaactcaagaaacggaaagagcgcttcggcattgtgacctctagcgcaggcaccggcaccacagaagatacagaagcaaaaaagagaaaaagagctgagagatttggcatagcatag

SEQ ID NO: 204215 - DNA, 633 bp, Artificial Sequence
  Description of Artificial Sequence: Synthetic coding sequence
atggccaccgagaccgtggagctgcacaagctgaagctggccgagttaaaacaggagtgccttgctagaggcctggaaacaaaaggtatcaagcaggacctgatccatcggcttcaggcttatctcgaggagcacgccgaagaagaggcaaacgaggaagatgtgctcggtgacgagaccgaggaggaagagactaagcctattgaacttcctgtgaaagaagaggagcctcctgaaaaaactgtagacgtagccgctgagaagaaggtcgttaagatcacatcagagattccgcagaccgagaggatgcaaaaaagagcggagcggtttaacgtgcccgtgagcctggagagtaaaaaggccgctcgcgccgcacggttcggcattagtagcgtgcctactaagggcctgtcatctgataataagcctatggtcaacctggataagttgaaagagagagcccagcgcttcggcctgaacgtttcatccataagtcggaagagcgaagacgacgaaaagttaaaaaaacggaaggagcgttttggaatcgtgacaagtagcgcaggcactggcactacggaagacacagaagctaagaaaaggaaacgggccgaacgctttgggattgcttag

SEQ ID NO: 204216 - DNA, 879 bp, Artificial Sequence
  Description of Artificial Sequence: Synthetic coding sequence
atggccggcaagaagaacgtgctgagcagcctggccgtgtacgccgaagatagtgagcccgagagtgacggcgaagccggcattgaggccgtgggctccgccgcagaggagaaaggcggcttagtatctgacgcctatggtgaggacgatttctctcgcctgggcggcgacgaggatggctacgaggaggaagaggatgagaattcgagacagtccgataacacagaggcagagaagcgtgatcctcaagagttggtggctagtttttctgaaagagtacgtaacatgtcccccgacgagattaaaatcccccccgagccacctggcaggtgctccaatcatctgcaggataagattcaaaaactttacgaacgcaagattaaggaaggcatggacatgaactacattatccaacggaagaaggagttcaggaacccatctatctacgagaaattaatacagttttgtgctatagacgagttgggcacaaattaccctaaagacatgtttgatccacacggttggagcgaagattcctactatgaggccctcgccaaggcccaaaaaatagagatggacaaattggagaaggccaaaaaggagagaacaaagatcgaattcgtgaccggcacaaagaagggaactaccaccaacgccaccagcaccacaaccactacagcttctactgcagtcgccgacgcacaaaagcgaaaatctaagtgggatagcgccattccagtgactaccattgcccagccgaccattctgactactacagccacccttccagccgtcgtcacggttacgacgagcgcttcgggctctaaaacaaccgtgattagtgctgtgggcacaattgtcaaaaaagctaagcagtag

SEQ ID NO: 204217 - DNA, 927 bp, Artificial Sequence
  Description of Artificial Sequence: Synthetic coding sequence
atggccggcaagaagaacgtgctgagcagcctggccgtgtacgccgaagactccgaacccgagtctgacggcgaagccggcattgaggccgtagggtcagccgccgaagagaagggaggcttggtcagcgacgcgtacggagaagacgacttttccaggctggggggggatgaggacggctacgaggaggaggaggacgagaattccaggcagtctgaagatgacgactccgagaccgagaaacctgaggccgatgaccctaaggacaatacagaagcagagaaacgtgaccctcaggaactggtggccagtttctccgagagagtgagaaacatgagcccagacgagatcaaaataccaccagagccgccaggcagatgcagtaaccacttgcaggacaagatccaaaaactgtatgagaggaagattaaggaaggcatggatatgaattacattatccagcgcaagaaagagtttagaaatcccagtatctacgagaaactcattcagttctgtgccattgatgaactgggaaccaattatcccaaagacatgtttgaccctcacggctggagcgaagattcgtactacgaggcactggctaaggcacaaaagatcgagatggataaattagaaaaggcaaagaaagaacgtactaaaattgagtttgtgactggcactaagaaaggcactaccactaacgccacatccactactaccaccaccgctagcactgcggtcgctgacgcccagaaacgaaagagtaaatgggattccgccattcctgtaactaccatcgcacagcccaccattctgactacaaccgcgaccctgccagcggtggtgactgtgacgacaagtgcctcagggtcgaagacaaccgttatctccgcagtcggaacgatcgtgaaaaaagccaaacaatag

SEQ ID NO: 204218 - DNA, 507 bp, Artificial Sequence
  Description of Artificial Sequence: Synthetic coding sequence
atggccggcaagaagaacgtgctgagcagcctggccgtgtacgccgaggattccgagcccgaatccgatggagaggcaggtattgaagccgtgggatcagcagctgaggaaaagggaggactggtcagcgatgcttacggtgaggatgatttttctcggctcggtggcgacgaggatggctacgaagaggaggaggatgagaattccaggcagtccgaggacgatgactctgagacagagaagcccgaggccgatgaccctaaggataacactgaagcagaaaaaagggatcctcaggaattagtggcgagcttctccgaacgggttaggaacatgagccctgatgagataaagattcccccggaacccccggggaggtgttccaaccacctgcaggataaaatccagaaactgtatgagagaaagattaaagaaggcatggatatgaactatattatacaaagaaaaaaagaattccgaaaccccagccaggggcctgagaactag

SEQ ID NO: 204219 - DNA, 927 bp, Artificial Sequence
  Description of Artificial Sequence: Synthetic coding sequence
atggccggcaagaagaacgtgctgagcagcctggccgtgtacgccgaggactccgaacctgagtccgacggagaagccggaatcgaagccgtcgggtctgctgctgaggaaaaaggcgggctcgtgtccgacgcctatggcgaggatgatttcagccgcctcgggggagatgaagatggctatgaggaggaggaggacgagaattctcgacagtccgaggatgatgatagtgagactgaaaagcccgaagccgacgatcctaaggacaacactgaggccgagaaacgcgatccccaggaattagtagcgagcttttctgagagagtacgcaacatgagccccgatgaaatcaagattccaccagaaccgcccggaaggtgtagcaaccacctacaggataagattcagaagctgtacgagcggaaaatcaaagagggaatggacatgaactacatcatccagcggaagaaggaattccggaacccaagcatctatgagaagctcatccagttttgcgcaatcgacgagctggggactaactacccgaaggatatgtttgaccctcacggctggtcagaggacagctactacgaggctctagcgaaagctcaaaaaatcgagatggacaagctggaaaaagctaaaaaagagaggacaaaaatagagtttgtaacaggcactaaaaaagggaccaccaccaatgctacctctacaacaaccaccacagctagtacggctgtggccgacgcccagaagcgcaagtcgaaatgggattccgccattcccgtgacaactattgcacagccaactatactcacgacaacagccacactgccagctgtcgtgaccgtcacaacgtccgcctccggcagcaagacgaccgtcatatccgccgtggggacgatcgtgaaaaaggcgaagcagtag

SEQ ID NO: 204220 - DNA, 366 bp, Artificial Sequence
  Description of Artificial Sequence: Synthetic coding sequence
atgagcttcatcttcgagtggatctacaacggcttcagcagcgtgttgcagttcctgggtctttacaagaaatctggcaaactcgtgttcctgggccttgacaacgccggtaaaaccacactgctgcacatgctaaaagatgatcgactcggtcaacatgtcccaacgctgcaccctacgagcgaggaactgaccattgcaggcatgacctttacaactttcgatctgggagggcacgaacaggcccgccgtgtgtggaagaattacctacctgccatcaatgggatcgtcttcctggtcgactgcgccgaccactcaagacttgtcgaaagtaaggtggaactgaatgtgtgttttgtgctctag

SEQ ID NO: 204221 - DNA, 597 bp, Artificial Sequence
  Description of Artificial Sequence: Synthetic coding sequence
atgagcttcatcttcgagtggatctacaacggcttcagcagcgtgctgcagtttctggggctatacaaaaagtcaggaaagctcgtgtttctgggcctcgacaatgccggtaagacgactctactgcacatgctgaaggacgaccgactgggccagcacgtcccgacactgcatccaacatctgaagagttaacaatagcagggatgaccttcacaacctttgacctaggcggccatgagcaggctcggcgggtgtggaaaaactatctccctgctatcaatggtatcgtttttctggtcgattgcgcggatcattcaagacttgtcgagagtaaagtggagctgaatgccctaatgaccgacgagacaattagtaacgtccctatcttgattcttggcaataaaatcgacaggaccgacgccattagcgaggagaagttgagggaaatattcggtctttacggacaaactaccggaaaggggaatgtgacattgaaggagcttaacgcacgacctatggaggtctttatgtgtagcgtgttgaaacggcaaggatatggggaaggattccgatggctgtcccagtatatcgattag

SEQ ID NO: 204222 - DNA, 597 bp, Artificial Sequence
  Description of Artificial Sequence: Synthetic coding sequence
atgagcttcatcttcgagtggatctacaacggcttcagcagcgtgctgcaatttctggggctgtacaaaaagtccggtaagttggtgttcctgggcctggataacgccggaaagaccaccctgctccatatgctgaaggatgacaggctgggacagcacgtgccaaccctgcatcctacaagtgaggagctaacgattgcaggaatgacgttcaccaccttcgacctgggaggccacgaacaagctcgtcgagtgtggaaaaactatctgcccgcaattaacggtatagtatttctagttgattgcgcagatcacagcaggctcgtggagagcaaggtagagctgaacgccctcatgaccgatgaaaccatctccaacgttcctattcttatcctggggaataaaatcgacaggactgacgctataagtgaggagaaactgcgcgagatcttcggtctttatggtcagacaacaggtaagggcaatgtgaccttgaaagaactcaacgcgaggcccatggaggtatttatgtgctctgtactcaaacgacagggctacggagagggcttccgatggctgagccagtacatagactag

SEQ ID NO: 204223 - DNA, 597 bp, Artificial Sequence
  Description of Artificial Sequence: Synthetic coding sequence
atgagcttcatcttcgagtggatctacaacggcttcagcagcgtgctccaattccttggtttatataagaaaagcggcaaactagtatttctggggttagacaacgccggcaagaccacacttctgcatatgctaaaggacgaccggctgggccagcacgtgccaacactccatccaacttcagaagagctaactattgctgggatgacgtttacaacgttcgacttaggaggtcacgaacaggcaagacgagtgtggaaaaactacttgccggccatcaacggcattgtatttctggtagattgtgctgatcactctagactggtcgagagcaaggtagagttaaacgcattgatgacggatgagaccataagtaacgtgcctattctcatcctgggcaacaaaatagatcggaccgatgcgatcagtgaggaaaaactgagagagatattcggactgtacggacaaacaacgggtaaaggtaacgtgaccctcaaggaattaaacgccaggccaatggaagtcttcatgtgttccgtcttgaaacgtcagggttatggggagggctttcggtggcttagtcagtacatcgactag

SEQ ID NO: 204224 - DNA, 597 bp, Artificial Sequence
  Description of Artificial Sequence: Synthetic coding sequence
atgagcttcatcttcgagtggatctacaacggcttcagcagcgtgttgcagtttctcggactttacaaaaaaagcgggaagctggttttcctcggcctggacaatgcagggaagacaacgctgttgcacatgctgaaggacgatcgcttgggacagcatgtcccaacgctccatccgacgtcagaggaactgactattgcgggcatgacattcaccacatttgatctgggtggccatgaacaggccagacgcgtgtggaaaaactacctaccagccataaacggcatagtattcctggttgactgtgctgatcactcgaggctggtagagtcaaaagtggagctgaatgcactcatgaccgatgagacaatctcaaatgtgccaatcctgatactgggcaacaagattgaccgaaccgacgccatctccgaggaaaaacttcgggaaattttcggcctctatggtcagaccaccggcaaagggaatgtgactctaaaagagctaaatgccagaccgatggaggtatttatgtgcagcgtgttgaagcggcagggttacggagaagggttccgatggctctcacagtatatcgactag

SEQ ID NO: 204225 - DNA, 354 bp, Artificial Sequence
  Description of Artificial Sequence: Synthetic coding sequence
atgggcctgagcttctggtggaccgtgcagatcatcctggccagctggaatccgaagctgtcacttatgatctattgttcttcgctcttgactcttgccccaaatgctcttatgacagacgaaacaatcagcaacgtgccaatactgatacttggaaacaaaatagatagaacagacgccatctccgaagagaaactccgagagatctttggcctgtacggacagaccacgggaaagggtaacgtgacgcttaaggagcttaatgcccgtcccatggaggtgttcatgtgttctgtcctgaaacgccagggctacggtgagggattcaggtggctgagccaatatatcgattag

SEQ ID NO: 204226 - DNA, 597 bp, Artificial Sequence
  Description of Artificial Sequence: Synthetic coding sequence
atgagcttcatcttcgagtggatctacaacggcttcagcagcgtgctacagttcctgggtctgtataagaaatcaggtaagctagttttcctcggcctggataacgccggtaagaccaccctgcttcacatgttgaaagacgacagactcggccagcacgtgcccactctccaccccacctccgaggaattaacaatcgccggaatgaccttcacaaccttcgatttgggcgggcacgagcaggctagacgtgtgtggaagaactacctgccagctatcaacgggatagtgtttttggtggattgcgctgaccacagccgtctcgtcgaaagcaaagtcgagcttaatgccctgatgacagacgagaccataagcaacgtgccaatcttgatcctgggaaataaaatcgatcggactgatgctatctcagaggagaagcttagagagatcttcggactctacggccagacgacaggaaagggcaacgtcaccctaaaggaattgaatgcacggcccatggaggtctttatgtgttctgtgctgaaaaggcaaggatatggtgaaggattcaggtggctttcacagtacatcgattag

SEQ ID NO: 204227 - DNA, 348 bp, Artificial Sequence
  Description of Artificial Sequence: Synthetic coding sequence
tgaagcttctggtggaccgtgcagatcatcctggccagctggaaccctaagctaagccttatgatctactgctcctccctactaacgctcgcacctaatgcccttatgactgatgagaccatttctaatgttcccatcctgatactcggcaacaaaatagatagaacagatgcgattagtgaagaaaaactccgggagattttcggcctgtacggccagacaaccgggaaggggaatgtaacccttaaagagttgaatgccaggcctatggaggtgtttatgtgcagcgtcctgaagaggcagggttacggtgaaggattccgatggctgtctcagtacattgactag

SEQ ID NO: 204228 - DNA, 468 bp, Artificial Sequence
  Description of Artificial Sequence: Synthetic coding sequence
atgctgaaggacgaccggctgggccagcacgtgcccaccctgcacccaacatctgaagaactgactatagccggtatgacctttactacatttgacctcggagggcacgagcaagcaagacgggtatggaaaaactacctccccgcaatcaatggtatagtgttcctcgtagattgcgccgatcactctagattggttgaaagtaaagtggaacttaacgccttaatgacagacgaaacgatatccaacgtgcccatcttaattctcggtaacaagatcgatcgtacagatgctatctccgaagaaaaactaagggagatctttggcctctacggacagactacaggcaagggcaatgtgacacttaaagagctcaacgcgagaccaatggaagtgtttatgtgctcggttctcaagaggcaggggtacggcgaagggtttcgctggctatctcagtacatcgattag

SEQ ID NO: 204229 - DNA, 393 bp, Artificial Sequence
  Description of Artificial Sequence: Synthetic coding sequence
atgaccttcaccaccttcgacctgggcggccacgtgcaggcccggagggtatggaaaaactatctgcctgctatcaatggaatcgttttcctggtcgattgtgccgaccacgagcgactactagagtccaaggaagagctggacagtctcatgacagatgagactatcgctaatgtcccgatcctcatcctcgggaataagatcgataggccagaggctatcagcgaggaaagactcagagagatgtttgggctctacggccagacaaccggcaaggggtcaatctccctgaaggagttgaacgcgagacctctggaggtctttatgtgttctgtgctcaagagacagggatatggtgagggctttcgctggatggcacagtatattgattag

SEQ ID NO: 204230 - DNA, 597 bp, Artificial Sequence
  Description of Artificial Sequence: Synthetic coding sequence
atgagcttcatcttcgactggatctacagcggcttcagcagcgtgcttcagttcttgggcctgtacaagaagactggaaaactggtgttcctggggttagacaacgctggtaagaccactctactccacatgctgaaggatgacagactcggccagcacgtccctactctgcacccaacatccgaagaacttaccatcgcaggtatgacattcactacgttcgacctggggggacacgtacaggcccgcagggtgtggaaaaattatcttccggccatcaacggcatcgtgttccttgtggactgcgcagaccacgaaaggctgcttgaatctaaagaggaactggactcactcatgactgatgaaacaattgccaatgtccccatcctcatcctcggcaacaagattgatcgtcctgaggccatctccgaggagaggctgagagagatgttcggactctatgggcagactaccggtaagggatccatatccctgaaggaattgaacgcgcgcccactggaggtctttatgtgcagcgttctgaagcggcagggatacggagaaggatttcggtggatggcccagtacatcgattag

SEQ ID NO: 204231 - DNA, 597 bp, Artificial Sequence
  Description of Artificial Sequence: Synthetic coding sequence
atgagcttcatcttcgactggatctacagcggcttcagcagcgtgctccaatttttgggattgtataagaagacaggtaaactggtgtttctgggactggacaacgccggtaagacaacacttctgcacatgctcaaggatgaccgactgggacagcacgtacctaccttgcaccctacatcagaggagctcactatcgccggcatgactttcaccacatttgatctgggcgggcacgtacaggccagaagggtgtggaagaactacctccctgcaatcaatgggatcgtcttcctggtcgactgcgccgaccatgagcgattgttggaaagtaaggaagagctggatagtttaatgacagacgaaactatcgcaaacgttcccatccttattctgggtaacaaaatcgaccgacctgaggccatatcagaggagcgtcttcgcgaaatgttcggtttatacgggcaaacaactggcaaaggatctatcagccttaaagagttgaatgcgcgaccactggaagtattcatgtgttctgtgctgaagcgtcaggggtatggtgaggggttccgatggatggctcagtacattgattag

SEQ ID NO: 204232 - DNA, 312 bp, Artificial Sequence
  Description of Artificial Sequence: Synthetic coding sequence
atgagcttcatcttcgactggatctacagcggcttcagcagcgtgcttcaatttctaggcctttacaaaaagaccgggaaactggtatttttaggactggacaacgctggtaagaccacccttttgcacatgctgaaagacgaccgcttgggtcaacacgtgcctacactccatccaactagcgaggaattgaccatcgcaggcatgacttttactacatttgatctcgggggccatgtgcaggcacggcgcgtctggaaaaactacctgcccgcaataaatggcattgtattcttggtggattgcgcttag

SEQ ID NO: 204233 - DNA, 393 bp, Artificial Sequence
  Description of Artificial Sequence: Synthetic coding sequence
atgaccttcaccaccttcgacctgggcggccacgtgcaggcccggagagtgtggaagaactacctgccggctattaatggcatcgtcttccttgtggactgcgctgaccacgagcgcctactggagagcaaagaggagctagatagcctgatgactgatgagaccatcgccaacgtccctattctaatcctgggaaacaagatagaccgacctgaggccattagcgaagaaaggcttagagagatgtttggactgtacggacaaactactgggaagggctccatttctctcaaggagcttaacgccagacccctggaggtgttcatgtgttcagtgctgaagcgacaggggtatggtgaaggctttagatggatggcacagtacatagactag

SEQ ID NO: 204234 - DNA, 513 bp, Artificial Sequence
  Description of Artificial Sequence: Synthetic coding sequence
atgagcttcatcttcgactggatctacagcggcttcagcagcgtgctgcagttccttgggctgtataaaaagaccggaaagctcgtttttcttggcctcgataacgctggcaagaccactctgctgcatatgctcaaagatgatcgtctggggcagcacgtgcccaccttgcatccaacaagcgaggaactcacaatcgctgggatgacgtttactacatttgacctcggtggccacgtgcaggcacgacgcgtgtggaagaattatctccccgcaattaatggcatcgtattcctggtggactgtgccgaccatgagagacttttggagagcaaagaggaactcgactcgctaatgactgatgagacaattgctaatgtgcctatcctgattctgggaaacaaaatcgacaggcccgaagccattagcgaggagaggctacgggagatgtttgggctctatggccagacgactgggaaaggctctatcagcttaaaagaactgaatgcctag

SEQ ID NO: 204235 - DNA, 393 bp, Artificial Sequence
  Description of Artificial Sequence: Synthetic coding sequence
atgaccttcaccaccttcgacctgggcggccacgtgcaggcccggcgtgtgtggaagaattacctgcctgccatcaatgggatcgtattcctcgtagattgtgctgaccacgaaaggctgctcgagagcaaggaagagctggactccctaatgaccgatgaaacgatagcaaatgtgcctatactcatcctcggaaacaaaatagataggcccgaggcgatctccgaagagagattgcgggaaatgtttgggctatatggccaaacaacaggcaagggatcaattagccttaaggagctgaatgccagaccattagaggtgtttatgtgtagcgtgctgaaaagacagggctacggagaaggttttagatggatggcccaatatattgactag

SEQ ID NO: 204236 - DNA, 393 bp, Artificial Sequence
  Description of Artificial Sequence: Synthetic coding sequence
atgaccttcaccaccttcgacctgggcggccacgtgcaggcccggagagtttggaaaaattacctgcctgccattaatggcatagtctttctagtcgactgcgcagatcacgagcggttacttgagagcaaagaggagctcgatagtctcatgaccgatgagacaattgctaacgtgcctatcttgattctcggcaataagatcgaccgccctgaggcgatcagcgaagaaagacttagagagatgtttggcttgtacgggcagacgactgggaagggctcaatcagtctaaaagaattaaatgccaggccacttgaggtgttcatgtgcagcgtgctgaagcggcagggatatggcgaaggattccgatggatggcacagtacatagactag

SEQ ID NO: 204237 - DNA, 2796 bp, Artificial Sequence
  Description of Artificial Sequence: Synthetic coding sequence
atgcgggccctggtgctgctgggctgcctgctggccagcctgctgttctctggccaggccgagctgcaggtctctgcttcaggcggcactgaagacgtgggaaacttgctcgaaaatcatttttcagcgggggatgcctcccttgaagaaaaagaaagagccctgtacgctgacaccgccccacaagataaaaaactcttactgcactatccagacggtagggaggctgaatctcctaaaaagacccccgcctccgccgcatccgctggcccggatcccgaggcttctctgagcaatgccagcgccaccgagtctccccctcctggagagagggacgacagagatgctgcgggacccggcgaggagaaaaatggaccacctgtcgctagcgcccttcctcccggaggagcaaaagggccagttgaagaggagtggccagaaccctccagcggagaaggtcaaggcgaggaggaaaccggatttggactccctaccgagggtacggcctctggggaagctggggggcaggccgggggacacgagttaccagaggaagtgcaagaagtccagggcgacagtctcgtgcagggcgccgtggctggtacagccgagccaaaggcagagggcgccagtccacatagcgagggggatggcgtagggccactgaacgcggaagcggaaggcagccctgggccaggcgaggagcctgccgtccctgagggagccccagacgttgccgctgttggcggagagtccgaaccagacatcgatacccaggcttctgagggaacagaagatcagggagagccaggccccgccgctgaggcttctgccgaacccggaggtgcccagagcgtcaaggccggcgataccgaggagaaccagtcccccgaaatgacagaagaggacgccgatgaggcgagcagcgaggaggagagcggcgacggatctgggtcagaggaggagggtggcgttccatccgaggaggaatcggaggaagattcaggtgacggcgcatcatctgaagaggccgaaggcgcttccgaggaggcgactgagccacaggaagcaggagagccgcaggaagcccgagagccccaggaaggaggcgacctacaggaggctgaagagtcccaggaaggcggggatccccaggaggcagaggagccccaagagggcggcgcaccgcaggagggcggcgagccccaagaggggggggaccctcaggaggcaagagagccacaggaggcgcgcgagccccaggaaggggccgagcttcccgaggctaccggcacgaccagccatagagatcgcggcgcccagcccggacctgaggaactgaacaccgagtctatgggaagcgagaccctggatatgaaggcagaagagccagaagagggacaccagcgcgagagcccgataatcgttgcccaagaagaaacagaagatgcaaatgaagaggcgccactaagggataggtctcatatcgaaaaaacgctgatgttgaatgaggataagccaagtgatgattatagcgcggtgctgcagcgattaagaaagatataccatagcagcattaagcctctggaacagtcatataaatataatgagctgcgccagcatgaaattacggatggagagatcacctccaaacccatggtcctcttcttggggccctggagtgtaggcaagtccaccatgatcaactacctgctgggtctggagaatacgaggtaccagctatacaccggtgccgagcccacaaccagtgagtttacagtcctgatgcacggaccgaagttgaaaaccatagagggcatcgtcatggccgccgactcagcacgtagctttagccctttggagaaatttggccagaacttcctcgaaaaactgattggaattgaggtcccccacaagttgcttgagcgagtgacctttgttgacaccccggggatcatcgaaaatcggaaacaacaggaacgaggataccctttcaacgacgtgtgccagtggttcatcgaccgcgctgatcttatcttcgtagtattcgacccaacaaaactggatgttggattggaactggagatgttgttcagacaacttaaggggcgggaatcccagatcagaatcatattgaacaaggccgataacctggcaactcagatgctaatgcgtgtgtacggtgccctgttctggagtctcgcccccttaattaatgttacggagccccctcgggtgtatgtgagtagcttctggcctcaggaatataagcccgacacccatcaggaacttttcctgcaggaagaaattagccttctggaagatctgaatcaagtcatcgagaatcgccttgaaaacaagatcgcttttattcggcagcatgccattagggtccggatacacgcactcctggtggatcgctacctccaaacttacaaggacaagatgaccttcttttctgacggagagctagtgttcaaggatatcgttgaagatccagataaattctacattttcaagacaatcctcgccaagaccaacgtgagcaagttcgacctaccaaatagagaggcatacaaggacttttttggaattaatcccatttcttcctttaaactgttgtcgcagcagtgtagctatatgggcggatgctttctagaaaagatcgagcgggccataactcaggaactgcctggactactcggttctctagggctgggaaagaatccaggggccctgaactgcgacaagacagggtgtagtgaaacccctaagaatcgatacaggaagcactag

SEQ ID NO: 204238 - DNA, 1422 bp, Artificial Sequence
  Description of Artificial Sequence: Synthetic coding sequence
atgcgggccctggtgctgctgggctgcctgctggccagcctgctgttttctgggcaggcggaggagaccgaggacgccaacgaggaagctccactgcgggatcgatcccacatcgagaaaacccttatgctaaacgaagataagccttcagatgactatagtgctgtcctccagaggctaaggaagatataccactcatctattaagcctctggagcaatcttataaatacaatgagctgcgacagcacgagatcaccgacggcgaaataacctcaaagcctatggtcttgtttctcggcccctggtcagttgggaaatccaccatgattaactatctgttaggcctggagaacactcgctatcaactctacacgggcgcagagcctacaactagcgaatttacagtgctcatgcacggccccaaactcaaaaccattgaaggcatcgtgatggccgcagactccgccaggagctttagcccactggagaaatttgggcagaactttctggagaagctgatcgggatcgaggtgcctcacaaattgctcgagcgggtgacttttgtggacactcctggcattatcgaaaatcgaaagcagcaggagagaggatatccgttcaacgacgtttgccagtggttcatcgatagggccgatcttatctttgtagtattcgatccaaccaaattggacgtgggcctcgaactcgaaatgctctttcgccagctcaaggggcgggagtcccagatccgcatcatcctgaataaagctgacaatctggcaacgcagatgctaatgcgcgtgtacggcgcactcttctggtctctcgcacccttgatcaatgtgaccgagcctccaagagtttatgtcagctcattttggcctcaggagtataagccggatacccaccaggagcttttcttgcaggaggagataagtctcctggaggacttgaatcaggtgattgagaatagactggaaaacaagattgccttcataaggcagcacgccatcagagttagaattcacgctcttctggtggatcgctacctccagacctacaaagataagatgacatttttctccgacggcgaacttgtttttaaagacattgtggaagacccagataaattttatatctttaaaaccatcctggcaaaaaccaacgtaagtaaattcgacctgccaaatagggaggcctataaagacttttttgggatcaacccaatctctagtttcaagcttctcagtcagcagtgtagctacatgggagggtgcttcctggagaagattgagcgggccataacgcaggagcttccagggctgctcggctctctgggcttggggaagaatccaggcgcactgaactgcgacaagaccggctgcagcgagaccccaaagaatagatataggaagcactag

SEQ ID NO: 204239 - DNA, 1296 bp, Artificial Sequence
  Description of Artificial Sequence: Synthetic coding sequence
atgctgaacgaggacaagcccagcgacgactacagcgccgtgctgcagcggctccgtaagatttatcattcgtctatcaagcccctggaacagtcatataagtacaatgagttgagacagcatgaaattacagatggagagatcacctcgaaacccatggtgctgttcctgggtccttggtccgttgggaagagtactatgatcaactatttgcttggtttggaaaacaccagatatcagctgtacacaggagccgagcccactactagcgagttcaccgttctgatgcacgggcccaaacttaagactattgaaggcattgtgatggcagctgatagcgctcggtctttctctcccctggaaaaatttgggcagaattttctagagaagctgatcggcatcgaagttcctcataaattactcgaacgtgtgacttttgtcgacacccctggtattatcgagaaccggaaacagcaggaacggggctacccctttaacgatgtgtgtcagtggttcattgatagagctgatctgatcttcgtggtattcgatcccactaaactcgacgtaggcctcgagctcgaaatgctctttcgccagctaaaggggcgcgaatctcaaatcagaattatattaaataaagccgacaacctcgcaacccagatgcttatgcgggtttatggagctctcttctggagcctggctccactcattaacgtgactgaacccccccgcgtgtacgtttccagcttttggccacaggaatacaaaccagatacccaccaagaactgtttctgcaggaggagatttccctactggaagatctcaatcaggtaatcgagaacaggctggaaaataaaattgccttcatcagacagcacgctattcgagtgcgcatacatgcgctgctagttgatcgctacctccagacttataaagataagatgacctttttttcggatggagagctggtattcaaggatatcgtggaggatcctgataaattctatattttcaagaccatcctggctaaaaccaacgttagtaagttcgacctgcctaaccgggaggcttataaagacttttttgggattaacccaatcagttcctttaaactgcttagtcagcagtgctcttacatggggggttgcttcctcgagaagatcgagagggccattacccaggagctgcctggtctgctgggtagtctgggtctgggcaaaaatcccggagctctgaactgcgataaaactggatgttccgagacacctaagaaccgctacagaaaacactag

SEQ ID NO: 204240 - DNA, 1164 bp, Artificial Sequence
  Description of Artificial Sequence: Synthetic coding sequence
atggccgagaccctgttctggacccccctgctggtggtgctgctggctggactcggcgacacagaggctcagcagacaaccctccatccactcgtcggaagagtatttgtacatacattggaccacgagaccttcttgtctctccccgagcacgtggctgtcccaccagctgtgcatataacttaccacgctcatctgcaaggacatcccgatttgcctcgttggcttaggtatacacagcggagtccccatcaccctggctttttatatggctcagctacccccgaagacaggggtctccaggtgattgaggtcaccgcctacaatcgggatagtttcgacaccacaaggcagagattggtgctcgagatcggcgacccagaaggaccattgctgccatatcaagccgaatttcttgtgcggagtcacgatgccgaggaagtactgccctctacccctgcttctagattcctatctgcactgggcggcttgtgggaacctggcgagctgcagctactgaacgtgactagcgccctcgacaggggagggagagtgccactgccgattgaaggacgaaaagaaggtgtctacattaaagtgggatccgccagtccattctcaacgtgtctgaagatggtggcttcaccagatagtcacgcccgatgcgcccaaggtcagccacctctgctctcgtgctacgacacactagcaccgcacttccgagtggactggtgcaacgtaacacttgttgacaaatccgttcccgaaccagcagatgaagtgcctacaccgggagatggaatcctggagcatgatccattcttttgcccgcctacagaggctcccgatagagatttcctggtggacgcgctggtcactttgcttgtccccctcctggtggccctgctcttgacattgctcttggcctacgtgatgtgttgccggcgggagggtcgcctcaaacgggaccttgcgacctcagacatccagatggtccaccattgtacaattcatggaaataccgaggaactgagacagatggcagcctctcgcgaagttcctcggccactctcgacactcccgatgttcaatgtgcataccggtgagagacttccacctagagtggattcagctcaggtgcccctgatcctggaccagcactag

SEQ ID NO: 204241 - DNA, 792 bp, Artificial Sequence
  Description of Artificial Sequence: Synthetic coding sequence
atggccgagaccctgttctggacccccctgctggtggtgctgctggctggactcggggacactgaggcacagcagacaaccctgcacccactcgtgggtcgggtgtttgttcacaccctcgaccatgaaacatttctgagccttccagaacatgttgctgtgcctccagcagtccatattacttatcatgctcatctccagggacacccagatttgcccagatggttaagatatacacagcgaagtccccaccatccagggtttctctatggctctgctacacctgaagaccggggcctccaggtaatcgaggtgaccgcttacaaccgagatagttttgataccacaaggcaacgtctcgttcttgagataggcgatcccgagggaccactgctaccataccaggccgagttcctcgtaaggtcacacgatgctgaagaagtcctccctagtacccctgcctcccgcttcctgagcgcactcggaggcctttgggagcccggcgagcttcagcttctcaatgtgacaagcgcactggacaggggaggaagggtccctcttcctatcgagggaaggaaagaagggctgaagagggatctggcaacttcagatattcagatggtgcaccattgtactattcacggaaacaccgaggaactgaggcaaatggcggccagcagggaggtgcctcgcccgcttagcacactgccaatgttcaatgtgcacacaggcgaacgtctgcctcctcgggtggacagcgcccaggtgcccttgatcctagaccagcactag

SEQ ID NO: 204242 - DNA, 537 bp, Artificial Sequence
  Description of Artificial Sequence: Synthetic coding sequence
atgagcgtgaccgcctacaaccgggacagcttcgacaccacccggcagcgcctggtgcttgaaattggtgaccccgaagggccactcttgccctaccaggccgagtttctggtaagatcacacgacgccgaggaagtcctaccttctacccctgcctcgagattcctgtccgctcttggcgggctttgggagcctggcgagctacagctacttaacgtgacaagtgcactggacagaggaggaagagtccccctgcctattgagggacggaaagaaggagtttatataaaggttggttcagcgagcccattcagtacatgcctcaagatggttgcatcccccgattcccatgcgaggtgtgcccagggccaaccaccgctgctctcttgttatgatactctagcaccgcacttccgcgtggactggtgtaacgtgacactcgtgcggcgggaccccggatccggcggaggcgtaggccatggtccccacccttcacctccttccctgccttgctgcttcctgagtccttcattgtag

SEQ ID NO: 204243 - DNA, 792 bp, Artificial Sequence
  Description of Artificial Sequence: Synthetic coding sequence
atggccgagaccctgttctggacccccctgctggtggtgctgctggcaggactgggggacaccgaagcacagcagaccacgctccacccactcgtcgggagagtgtttgtccacacactagatcatgagacattcctgagcttgcctgaacatgtagctgtgccaccagcggtgcatattacataccatgcacatctgcagggacatcccgatctgccacgctggctccggtatacacagagaagccctcaccacccggggttcctgtacggatctgctactcccgaggatcggggcctgcaggtaattgaagtcacggcctataaccgggacagctttgacacaacccggcagcgccttgtgctggagattggagaccccgaaggccccctcctgccataccaggccgagttccttgtgcgctcccacgacgctgaagaagtgctaccttccacgcccgcatcacgatttttgtctgcgctgggtgggctttgggagcccggtgaactgcagctgcttaatgtcaccagcgccttggaccgggggggacgggtgcctctgccaatagaggggcggaaagaagtcctgctcagacacctgggaacacccctcatccagatggtgcaccattgtaccatccacggcaatactgaagagttgcgacagatggctgcttcccgggaggtcccccggcctctgagcaccctcccaatgtttaacgtgcacacaggagagagactccccccgcgggtggacagcgcacaggtgcccctgatactggaccaacactag

SEQ ID NO: 204244 - DNA, 957 bp, Artificial Sequence
  Description of Artificial Sequence: Synthetic coding sequence
atggccgccgccgccgccgccgccgccgagcagcagagcagcaacggtccggtgaagaagtctatgagggagaaggccgtggagagaagatctgtcaataaagaacacaattctaactttaaggccggttatatccccatcgatgaagatcgactccacaaaacaggcctgcgaggaagaaaagggaacttagctatttgcgtgatcatcttactgttcatactagctgtaatcaacctcattatcaccttagtcatttgggcagtgattcgcatcggccctaatggctgcgactcaatggaattccacgagtccggtttgttgcgattcaaacaggtttccgacatgggagtgatccatccattgtacaagtctaccgtagggggtcgtaggaacgagaacctagtgattaccggtaataaccagcccattgtgtttcagcaggggacgacaaagctgtcagtagagaataataagacctccattaccagcgacattggaatgcaattctttgacccccgcacccagaacatcctcttttctactgactacgaaacccacgaattccatctgccctccggcgtcaaaagcttgaacgtacaaaaggcctctacagagagaatcacatccaacgcaacttccgacctgaacattaaggtggacggtagggccattgtgcggggaaacgaaggcgtgtttatcatggggaaaacgatcgagttccacatggggggcaacatggaacttaaagcagaaaatagtattatattgaatgggagcgttatggtcagcactacgaggcttccatctagtagctccggtgatcaactgggctccggggactgggttcgttataagttgtgtatgtgcgcggatggaactctgtttaaagttcaggtgacgagccagaacatgggctgccaaatatccgacaacccctgcgggaacactcactag

SEQ ID NO: 204245 - DNA, 747 bp, Artificial Sequence
  Description of Artificial Sequence: Synthetic coding sequence
atggccgccgccgccgccgccgccgccgagcagatcaccctggtgatttgggcggtgattcgcatcggacctaatgggtgtgatagcatggagtttcacgagtctggcctgctgcgtttcaagcaggtctccgacatgggtgtgatccacccactgtacaagtccactgtaggtggacggcgcaacgagaaccttgtcattaccggaaataaccagccaattgtgttccagcagggcacaactaagctgagcgttgaaaacaacaagacttcaatcacttccgatataggcatgcagtttttcgatcccagaacacagaacatcctcttctccacagactatgagacccatgagtttcacctgccgtcaggagtaaagagtctcaacgtgcaaaaagcctcaaccgaaagaattacaagtaatgccacctccgacttgaacatcaaggtggatggccgtgccatcgtgcggggaaacgagggtgtctttattatggggaagacgattgaattccacatgggcggcaatatggaactgaaagccgagaattccatcatcctcaatgggagtgtcatggtgtccacgacaagattgccaagtagttcgagtggggatcagctgggatcaggtgattgggttcggtataagctgtgtatgtgtgccgacgggaccctttttaaggtgcaagtgacgtcccaaaatatgggttgccagatctctgacaatccctgcggaaatactcattag

SEQ ID NO: 204246 - DNA, 873 bp, Artificial Sequence
  Description of Artificial Sequence: Synthetic coding sequence
atgatgccccaggagcagtacacccaccaccggagcaccatgcccggctctgtcgggcctcaggtgtataaagtgggcatctatggctggcgcaaaaggtgtctgtattttttcgtgttacttttgatgatcctcatccttgtcaacttggcaatgacgatctggatccttaaggtaatgaattttaccattgacgggatggggaacctgaggatcaccgagaaagggcttaaactagaaggggactccgaatttctgcaacctctttatgcaaaagagatccagtcgcggcccggcaacgccctgtacttcaaaagtgccaggaacgtgactgtgaatatcctcaatgatcaaacgaaagttctgacccaactcataactggtcctaaggcagttgaggcatatggaaagaagttcgaagttaaaaccgtctccggaaagttgcttttctcggccgacaataacgaagtggtggtgggggcagagcggctgcgagtactcggggcagagggcacagtctttcccaagagtattgagactccgaatgttagggcagacccttttaaggagctcaggctggagtcccccacaaggtctctggtaatggaggcccccaagggagtcgagattaacgccgaggccggtaacatggaggcaacctgtcgcactgaactgcgactggaatccaaggacggagaaatcaagctcgatgctgcaaaaattagactccccaggctgccccacggttcctatactcccactgggacccgccagaaggtgtttgaaatctgtgtgtgcgccaatggcagactctttttgagccaagccggagccgggtcaacatgtcagattaacacgagcgtgtgtctgtag

SEQ ID NO: 204247 - DNA, 870 bp, Artificial Sequence
  Description of Artificial Sequence: Synthetic coding sequence
atgccccaggagcagtacacccaccaccggagcaccatgcccggctcagtcggaccccaagtctacaaggtcgggatttatggatggagaaagagatgtctatacttcttcgttctgttactgatgatactcattctggtgaacttggccatgacaatatggattcttaaggttatgaacttcacaatagacggcatgggaaacttgcgtataactgagaaagggctgaagctcgagggcgactctgagtttttgcagccactttacgccaaagagatacaaagcaggcctggaaatgcactgtactttaagagcgccaggaacgtgaccgtcaatatactgaacgaccaaacgaaggtgctgacacaactcatcactgggcccaaagctgtcgaagcttatggcaaaaagtttgaagttaaaactgtgtccgggaaactcttgttctccgctgacaataacgaagtagttgtaggggctgaacggcttagggtcctgggagcagaggggactgtgttcccgaaaagcatagagacacctaatgtgagggctgacccctttaaagaactgcgcctggaatcgccaactcgctcactggtgatggaggcccctaagggcgtggagataaatgctgaggccggaaatatggaggcgacctgccgtactgaactgcgcctggagagcaaagacggggagatcaagctggatgctgcaaaaatccgccttcctcgtctaccccatggttcctacactcccaccgggactcgccagaaggtattcgagatttgtgtgtgcgcaaacggaaggctctttttgagccaggctggggccggaagcacctgccagattaacacgagcgtgtgtctctag

SEQ ID NO: 204248 - DNA, 771 bp, Artificial Sequence
  Description of Artificial Sequence: Synthetic coding sequence
atgatgccccaggagcagtacacccaccaccggagcaccatgcccgggtcggtgggaccgcaggtctacaaggttggcatctatggctggagaaagcggtgtctgtacttttttgttctactgcttatgattctgatactggttaatttagcgatgaccatttggattctcaaagtcatgaacttcacaatcgatggtatggggaacttgcggatcacagaaaagggtttaaaactagagggagactccgaatttctgcagcccctatatgccaaggaaatacagtccaggcctgggaatgctttatattttaagagcgcgcggaatgtcacagtgaatatcctgaacgatcagaccaaggtccttacccaacttataacagggccaaaagcagtcgaggcctacggcaaaaagttcgaagtcaagaccgttagtggcaaactgctgtttagtgctgacaacaacgaagtcgtggtgggcgccgagcgtctgcgcgtgctgggagccgagggaaccgtgtttccaaagtcaattgagactccgaatgtccgggctgatcccttcaaagagctgcggcttgaatcacccacgcggtctctggtgatggaagctcctaagggcgtggaaatcaacgccgaggcaggcaacatggaggccacctgtaggacagagctgcgcttggagtcaaaggatggggaagtcagggacgagaaggaccggagtagcaagtcctactccttcaatcggcctacgctccccatcaccgggtag

SEQ ID NO: 204249 - DNA, 771 bp, Artificial Sequence
  Description of Artificial Sequence: Synthetic coding sequence
atgatgccccaggagcagtacacccaccaccggagcaccatgcccggttcggtcgggcctcaggtgtacaaagtagggatttatgggtggcgaaagagatgtctgtatttctttgtgctcctgttgatgatcctgatcctcgtgaacctagccatgacaatatggattttaaaggtcatgaacttcactatcgacgggatggggaatctgcgcattacggagaagggcctgaagctggagggtgatagcgagttcctccagccgttgtacgcgaaagaaatccagtctcggcccggaaatgccttgtatttcaagagcgctagaaatgtaactgtcaacattcttaatgatcaaactaaagtgctgacccaactgattacggggcctaaagctgtggaagcatatggaaagaaatttgaagttaaaacagtctcagggaagctcctgttctcagccgataataacgaagtcgttgtgggggcggaaagactgagggtcctaggggctgaaggaaccgtcttccccaaatctatagaaacgcctaatgtcagggctgaccctttcaaggagctccgccttgaaagtcccactagatccttggtgatggaggccccaaaaggagtcgagattaatgccgaggccggcaacatggaggctacttgccgtacggagctgcggcttgaatctaaggacggagaagtgagggacgagaaagaccgctcaagcaaatcttattcattcaaccggccaacattacctatcactggatag

SEQ ID NO: 204250 - DNA, 1314 bp, Artificial Sequence
  Description of Artificial Sequence: Synthetic coding sequence
atgcagctgccccggtggtgggagctgggcgacccctgcgcctggaccggccaaggtcggggaaccagaagaatgagtcccgcaacgacaggtacctttttgttgacagtgtactccatcttttctaaagtgcactccgaccggaacgtgtatccctccgccggtgtcttgtttgtccacgtactggaaagggagtactttaagggcgagttccctccatatccaaagcctggagagatctccaatgatccgatcaccttcaataccaatcttatgggataccccgaccggcctggctggctgcgttatattcagcgcaccccttattctgatggagtgctgtatggttccccgaccgctgaaaacgtcggtaagcctacaatcatcgaaatcaccgcctataatcggcgaaccttcgaaaccgcacggcataacttgattataaatatcatgtccgccgaggacttcccactgccctaccaggcagagttttttataaaaaatatgaatgtcgaagagatgttggcctccgaggtgcttggcgactttctgggtgccgtgaagaatgtgtggcaaccggaacggctcaacgcaataaatatcacatccgcactcgaccggggtggccgcgtccctcttcccattaacgatctaaaggaaggggtgtacgtgatggtgggtgctgatgtccccttttccagttgtctcagagaggttgaaaatccgcagaatcaactccgatgtagccaagaaatggagcctgtgatcacctgcgataagaagtttcgtacccagttttacatagattggtgcaaaatttctctggtcgacaagacaaagcaggtgtcgacctatcaggaagtgatccggggtgaaggcattctacccgacggcggggaatataaaccaccttcggactccttgaagagcagagattactatactgattttttgataaccttagctgtgcccagcgctgtggctctggtgctgttcttgatacttgcctacataatgtgttgcaggagggagggagtcgaaaagaggaacatgcagactcccgacattcagctggtgcatcactccgctatccagaagtctacaaaagaattacgggatatgtctaagaatcgtgagatcgcttggcccttgtcaacactgccggttttccatcccgtcacgggcgagattatcccacctctgcatactgataactacgattctacgaatatgccgctgatgcagactcagcagaatctgccgcaccaaactcaaattccccagcaacagaccacgggcaaatggtatccttag

SEQ ID NO: 204251 - DNA, 1416 bp, Artificial Sequence
  Description of Artificial Sequence: Synthetic coding sequence
atgcagctgccccggtggtgggagctgggcgacccctgcgcctggaccggtcagggacgcgggacccgccgcatgagtccagcaaccactggaactttcctgttgacagcatttttgctctcatgcgccgatggcattaacggtactgtcaattggaaaacacgccaggccaacaactttatcatttcccgcaaaatggcagcgggcatgaaggatgtgtactcgattttttccaaggtacattccgatcgaaacgtgtatccctccgctggggtcctctttgtacatgttctggagagggaatattttaaaggcgagttccctccttaccccaaacccggcgaaattagcaatgacccaatcacctttaacactaacctgatgggatatccagatagaccagggtggctgcgttatatccagagaacgccgtacagcgacggcgtgctgtacggcagtccaactgcagagaatgtaggcaaacccaccattatcgaaatcactgcttataatagacgcaccttcgaaaccgctcgccataacttgattattaacattatgtcagctgaggactttcccctaccataccaggcagagttcttcatcaagaacatgaatgtcgaggaaatgctagcatccgaagtgcttggcgactttctcggtgcagttaagaacgtctggcaacccgagaggctcaacgctatcaacattacttccgccttggacagaggaggtagagtgccattgcctataaatgatctgaaagagggagtgtacgtgatggtaggcgcggatgtccctttttcttcatgtctcagagaggtcgagaacccccagaaccagctgcgatgctctcaggagatggaacccgtgatcacttgtgacaagaaattccgcacacagttttacatcgactggtgtaagattagtctggtggacaagaccaagcaagtgtcaacctaccaggaagttatccgcggggagggcatcttgcctgatgggggcgaatataagcccccctcggacagcctcaaatcacgcgactactataccgatttccttatcaccttagcagtcccctccgcagtggccctggtgctgttcttgatccttgcctatattatgtgctgccgtagagaaggggtggagaaacgcaacatgcaaactccggacatacaactggtccaccattccgctattcaaaaatcaacaaaggagttgcgggatatgtcaaagaaccgagagattgcatggcccctctccacattacccgtgttccaccccgtcaccggagagataattccgcccctacacaccgacaattatgattctaccaatatgcccctgatgcagacacagcaaaacctcccacaccagactcaaattccacagcagcagacgacgggcgaatgttag

SEQ ID NO: 204252 - DNA, 1356 bp, Artificial Sequence
  Description of Artificial Sequence: Synthetic coding sequence
atgcagctgccccggtggtgggagctgggcgacccctgcgcctggaccggccaggggagaggaactcgccgcatgtctccagcaacaactggcacctttttgctcacggtctattcaattttttcgaaggtgcactcagaccgaaacgtctatccgtccgctggcgtgttgtttgtacatgtgttagaaagagagtactttaaaggcgagtttccaccgtatcccaagccgggcgagatcagcaacgatccaattactttcaacaccaatttaatggggtatcccgatcgaccgggatggcttagatacatccagcgaacgccgtatagcgatggtgtgttgtacggaagtcctactgcggagaatgtcggtaaacccaccattatcgagatcaccgcatacaatcggcgtacgttcgaaacggctaggcacaatctgattattaacataatgtccgccgaagatttccctctcccataccaagctgagtttttcattaaaaatatgaacgtggaggaaatgctggcttcagaagtactgggtgacttcctgggcgctgtgaagaacgtctggcaacctgaacgcttaaacgctattaacattacatcggctctggatagaggaggacgagtacctctgcccatcaacgacttgaaagagggtgtgtatgtgatggtcggagcggacgtaccatttagttcttgcctcagagaggtcgagaacccccagaaccagttgagatgttcccaagaaatggagccagttattacttgcgacaaaaaatttaggacgcagttctatatcgactggtgtaaaatttctcttgtggataagactaagcaggtcagtacataccaagaggtgattcgaggggaaggaatactcccggacggtggtgaatataaaccaccttcagatagcctgaagtcaagggactattacaccgattttttgattaccctggccgtgccttccgccgtggctcttgtgctttttctaattctggcctacatcatgtgctgtcggagggaaggcgtcatacagctcgtgcatcactctgccatccaaaagtctaccaaggaactgcgggatatgagtaagaatagagagattgcctggcccttgagcacacttccagtttttcatcccgtcacaggagagatcattccgcccctacataccgacaactatgatagtactaatatgcctctgatgcagacacagcagaatttgccccaccaaacgcagatcccccagcaacagacaactggcgactttcgccttaccacctttcagcgatttgaggtcaatgggatacccgaagagcgaaaattgaccgaagccatgaatctgtag

SEQ ID NO: 204253 - DNA, 1389 bp, Artificial Sequence
  Description of Artificial Sequence: Synthetic coding sequence
atgcagctgccccggtggtgggagctgggcgacccctgcgcctggaccgggcagggcaggggcacgaggaggatgagccctgctacaaccggaactttcttgctgaccgtatattccatcttcagtaaggtgcattctgacaggaatgtgtacccaagcgctggggtgctgttcgttcacgtgcttgagcgggagtatttcaagggcgaatttcccccctaccccaagcccggtgaaatcagcaacgatccaataacattcaacactaatctaatgggctatcccgacagacctggatggctgaggtatatccagcgcaccccatatagcgacggtgtactgtatggcagccccacggcagagaatgtaggaaagcccaccatcatcgagattaccgcatataaccgaaggacatttgaaactgcgcgtcacaacttaattattaacattatgtcggcagaggactttcctcttccatatcaggcggagttcttcataaaaaacatgaatgtcgaggaaatgttggcctctgaagtgctgggcgactttctcggcgccgtgaaaaacgtgtggcaaccggagaggctgaatgccatcaacattacaagcgccctggaccggggcggccgagtgccactccctattaacgacctcaaagaaggggtctacgtgatggttggagccgatgtgcccttctcttcctgtctgagggaggtggagaacccccagaaccagcttaggtgcagccaggagatggagccggtgataacttgtgataagaagtttagaactcagttttacatcgattggtgtaagatctccttggtggacaaaaccaagcaggttagcacatatcaggaggttatcaggggagaaggtatcctcccagatggaggtgaatacaagccaccatccgacagtctaaaatcgcgcgattactatacagactttctcatcacgttggcggttcctagcgcggtggccctggtactgttcctgatcctcgcatatattatgtgctgcagaagagagggcgtggagaaaagaaatatgcagactcctgacatccaattggtgcatcatagtgccatccagaaatctactaaagaacttcgggatatgagcaagaacagagaaatcgcctggccactgtccaccctgccagtctttcacccagtgacaggggaaattattccccccttgcacacagataactacgactccacgaacatgccactgatgcagactcaacaatggagctttgcccctgttgctcaagccggggtgcagtggtctgacctggggtcactgcaacctcccccgccacgtaatctccctcaccagactcagattccccagcaacagaccaccggcaaatggtatccgtag

SEQ ID NO: 204254 - DNA, 2118 bp, Artificial Sequence
  Description of Artificial Sequence: Synthetic coding sequence
atgaccgacaacagcaacaaccagctggtggtgcgggccaagttcaactttcagcaaactaacgaggacgagctgagtttcagtaagggggacgtcattcatgttacccgggtggaagagggggggtggtgggagggaaccttgaacgggaggacagggtggttcccttccaactacgtgagagaggtgaaggcctctgagaagccagtgagtccaaaatcaggcaccctgaaaagcccaccaaaggggtttgataccacagctataaataaatcctactacaacgtggtgcttcaaaatattctcgaaactgagaacgagtatagtaaggagctccagacagtgctgtcgacctatctcaggcccctgcagacctccgaaaaacttagcagtgctaatatcagctatcttatgggaaatctggaggagatttgttcttttcagcagatgctggtgcaaagtctggaagaatgcaccaaacttcccgaggcccagcagagagtggggggttgcttcctcaatcttatgcctcagatgaaaaccctttacttgacatactgtgcaaatcacccatccgctgtgaacgttctgaccgagcatagcgaggaactcggcgagtttatggagactaagggggcgtcctcccccggcattctcgtgcttacaaccgggctgtccaagcccttcatgaggttggataagtatccaaccctactgaaggagcttgaaaggcatatggaggattaccacaccgataggcaagatattcaaaagtcgatggccgccttcaagaatctctccgcccagtgtcaggaagttagaaagcgcaaagagctggaactgcagatcttgacagaagctatcaggaattgggagggcgacgatatcaaaaccttagggaatgtgacctatatgtctcaggttctgatccagtgcgctgggagtgaggagaaaaatgagaggtatctgcttttattccctaatgtgctgttgatgctttcagcctccccacggatgtcaggcttcatttaccaaggaaagctacccacaacaggaatgaccattacaaagctcgaagactctgagaatcataggaatgccttcgaaatatcaggatccatgatagagcgcattctggtgtcctgcaataaccaacaggacctgcaggagtgggtcgagcacctgcagaagcagacaaaggtcacctctgtgggcaatccgaccattaaaccacatagcgtcccttctcacacactcccatcccatcctgttactcctagctccaaacacgctgactcaaaacccgcccctctcacccccgcgtatcatacattgccacacccgagtcatcatgggacgccccacacaactataaattggggccccctggaacctcccaagacacctaaaccttggagcctttcctgccttaggcctgctccacccctgcgtccttccgccgccctctgttacaaggaagatttgtctaaaagcccaaaaaccatgaaaaagctgttgcccaaacgcaagcccgaaagaaagcctagtgatgaggaattcgcgtctaggaaatccactgcagcccttgaagaggatgcacagattctgaaggttatcgaggcctactgtacatcagcaaaaacccggcagaccctcaatagcacttggcagggcactgatctgatgcataatcacgtactcgccgatgacgatcagccaagtttggatagtctcggccggaggtcctctctctcacgtctcgagcctagtgatctgtccgaagatagcgactacgatagtatctggactgcgcattcatatcggatggggtccacctcgagaagcagaaaagagtctgcaccgcaagtcctcctccctgaagaggagaaaatcatcgtggaggagactaaaagcaatggacagaccgtcattgaagaaaaatctctcgtcgacactgtctacgccctgaaagacgaagtgcaggagctgcggcaggataataaaaagatgaagaagtccctggaggaggaacagcgggcccgcaaagacctcgagaagctggttcggaaagtcttaaagaatatgaatgaccccgcctgggatgagacaaacctgtag

SEQ ID NO: 204255 - DNA, 876 bp, Artificial Sequence
  Description of Artificial Sequence: Synthetic coding sequence
atggtgcgggagcagtacaccaccgccaccgagggcatctgcatcgaaagacctgagaaccagtacgtttataagatcggaatttacggatggaggaagaggtgcctgtacctgttcgtgctgctgctcctgataatcctggtcgtaaatcttgcgttaactatatggatccttaaggtaatgtggtttagccccgccggcatggggcacctgtgcgtgacgaaagacgggcttagactggagggggaatcggagttcctcttccccttgtatgcaaaagaaatccatagtcgcgttgattcgtccctcctcctccagtctacacagaatgtaacagtgaacgcccggaactctgagggcgaagtcactgggcggctgaaggtcgggcccaaaatggttgaagtccagaatcagcagtttcagattaactccaacgatgggaaacctctgtttacagtggatgagaaagaagtggtagtgggcaccgataaactaagagtgacaggaccagagggggccctattcgagcatagtgtggagacacccttagtacgcgccgaccctttccaggaccttcggctggaatctcccactcggtcactcagcatggatgcaccgaggggagtgcatatccaggcccatgctggaaagatcgaagcactgtctcaaatggatattctatttcatagtagtgacgggatgctggttctagatgcagagaccgtgtgtctgcccaagctcgtgcaggggacctggggaccttcagggtcaagtcagtctctctacgagatctgcgtttgccccgatgggaaactgtacttatcagtggccggtgtctccactacctgccaggaacacaaccacatctgtctctag

SEQ ID NO: 204256 - DNA, 876 bp, Artificial Sequence
  Description of Artificial Sequence: Synthetic coding sequence
atggtgcgggagcagtacaccaccgccaccgagggcatctgcatcgagagaccagagaaccagtacgtttacaaaataggcatctacggatggcggaagcggtgcctatatctcttcgttttgttgctgcttattatcttggtagtaaatctggcactgaccatttggatcttaaaggtaatgtggttcagccccgctggcatggggcatctatgcgtcactaaagacggattgcgtttggagggcgagtccgagtttctgtttcccctatatgccaaggagatccatagtagggtggattcttcgctgctgctgcaatctactcagaacgttaccgtgaatgccaggaattctgaaggcgaagtgactggaagactgaaagtcgggcccaagatggtcgaagtgcaaaatcagcaattccagatcaacagcaacgatggcaaaccactcttcaccgtggacgaaaaggaagtagtcgtcggcacagataaattaagagtcaccgggccagagggggctctcttcgaacattctgtggaaacccccttagtgagggctgacccatttcaggaccttcgccttgagtcaccaactcgcagcctgagcatggatgcgccccgaggagtccacatccaggcacatgctggaaaaatagaggctcttagccagatggacattttgtttcactccagcgacgggatgctggtcctggacgcagaaacggtctgtctgcctaagctggtgcagggcacttggggcccttccggttccagtcaaagcctctacgagatctgcgtgtgtccagacggaaagttatacctctccgttgctggcgtatccaccacctgccaggaacataatcacatctgcttgtag

SEQ ID NO: 204257 - DNA, 96 bp, Artificial Sequence
  Description of Artificial Sequence: Synthetic coding sequence
atgggcatcaacacccgggagctgttcctgaacttcaccatcgtgttgataaccgtgatccttatgtggttacttgtgcgctcatatcagtattag

SEQ ID NO: 204258 - DNA, 96 bp, Artificial Sequence
  Description of Artificial Sequence: Synthetic coding sequence
atgggcatcaacacccgggagctgttcctgaacttcaccatcgtgctgataactgtgatcctcatgtggctcctcgtgcggagctaccagtactag

SEQ ID NO: 204259 - DNA, 96 bp, Artificial Sequence
  Description of Artificial Sequence: Synthetic coding sequence
atgggcatcaacacccgggagctgttcctgaacttcaccatcgtgctaatcaccgtgatattgatgtggctgctggtgaggagttaccagtactag

SEQ ID NO: 204260 - DNA, 732 bp, Artificial Sequence
  Description of Artificial Sequence: Synthetic coding sequence
atgggcaagaacaagcagccccggggccagcagcggcagggcggcccacctgctgctgatgccgctgggccggacgacatggagccaaagaagggcaccggcgcgcctaaagagtgtggggaggaggagcctcgcacctgttgcggatgtagattccccttactgctggcccttttacagttggcactggggattgccgtgactgtcgtgggcttcctaatggctagtatcagcagttccctgctcgtacgagatacccctttctgggcaggcataatcgtatgtctggtggcttatctgggcctgttcatgctctgcgtcagttaccaggtggatgaacgcacctgcattcaattctctatgaagctcctctattttttgttgtcggctctcggactgaccgtgtgcgtgctcgcggtcgcctttgctgcccatcactacagtcaactcacccagttcacttgtgagaccactttagactcctgtcagtgtaagttgccttcttctgagccccttagtcgcactttcgtgtacagagacgtgacggattgtacatcagttacagggaccttcaaattatttctcctgatacagatgatcctgaacctcgtctgcggcttggtttgcttgttggcttgttttgtcatgtggaaacacagatatcaagtattctatgtcggagtgcgcatttgtagtttgaccgcctctgaagggccccagcagaaaatctag

SEQ ID NO: 204261 - DNA, 423 bp, Artificial Sequence
  Description of Artificial Sequence: Synthetic coding sequence
atgctgtgcgtgagctaccaggtggacgagcggacctgcatccagttcagcatgaagctgctttacttcctgttatccgctctggggcttaccgtctgtgtcctggcagtggcatttgccgcccaccactactcgcagctgacacaattcacatgtgaaacgacactcgactcgtgtcagtgcaaactcccctcttccgagcccctctctaggacgtttgtgtatcgtgatgtcacagattgtacctcagtaaccggtacttttaaactgtttttgctgattcagatgattttgaatctggtatgcggcttggtgtgtctgctagcctgtttcgtaatgtggaaacatagatatcaagtattctacgttggcgttaggatctgcagtcttaccgcttccgaaggacctcagcagaagatttag

SEQ ID NO: 204262 - DNA, 654 bp, Artificial Sequence
  Description of Artificial Sequence: Synthetic coding sequence
atggagcccaagaagggcaccggcgcccccaaggagtgcggcgaggaggaaccccgaacttgttgtggttgtagattccctttgcttttggcgctgttgcaactggctctaggtatagcagttacagtggtgggctttttgatggcttctattagtagttccctgcttgtgagggatacccccttttgggccggcatcattgtgtgtctggtggcctacctggggctctttatgctgtgtgtgtcatatcaggtcgacgaaagaacctgcatccagtttagcatgaagctgttatacttcctgctgtctgccctggggttgacagtttgcgtgctggcagtggcctttgcagcccatcactattctcagttaacacagttcacctgtgagacaacactggattcttgccaatgtaagttgccctcttccgagcccctttctaggaccttcgtgtaccgcgacgttacagactgcaccagcgtgacggggacctttaaactgttcctcctcatccagatgatcctcaacctggtgtgcggtctggtgtgtctgctggcctgcttcgtgatgtggaagcaccggtaccaggttttctacgtaggagtcagaatatgttccctgactgcgtccgaaggccctcagcagaaaatttag

SEQ ID NO: 204263 - DNA, 387 bp, Artificial Sequence
  Description of Artificial Sequence: Synthetic coding sequence
atgggcaagaacaagcagccccggggccagcagcggcagggcggccctcccgcagccgacgcagccgggccagatgacatggaacccaagaagggaacaggcgctcccaaagaatgcggcgaagaggagcccaggacttgttgtggatgcagattccccttactcctggcccttctgcagttggctttggggatcgccgtcaccgtggtggggtttctcatggccagcattagctccagcctgctggtcagggacacccctttttgggcaggcatcatcgtctgtttggtggcctatctgggcttattcatgctttgtgtgtcttatcaggttgacgagcgaacatgcatccaatttagtatgaagattcactgtcacgacttctag

SEQ ID NO: 204264 - DNA, 363 bp, Artificial Sequence
  Description of Artificial Sequence: Synthetic coding sequence
atgctgtgcgtgagctaccaggtggacgagcggacctgcatccagttctcaatgaagcttctgtatttcctcctgtcagctctcggcctgactgtatgtgtgctagcagtggccttcgctgcgcaccattatagccagctgactcaatttacctgtgaaaccacgctggattcttgccagtgcaagctgccctcttcagagccactatctcggacattcgtttaccgggatgtgactgattgtacaagcgtgactggcacgtttaagctgttcctattaatacagatgattctgaacctagtttgcggtctggtgtgtttactggcgtgctttgttatgtggaaacatcgctatcaggtttag

SEQ ID NO: 204265 - DNA, 423 bp, Artificial Sequence
  Description of Artificial Sequence: Synthetic coding sequence
atgctgtgcgtgagctaccaggtggacgagcggacctgcatccagttttcaatgaagcttctgtacttccttctgagcgccctgggcctcacagtctgtgtgctggctgtggcctttgccgctcatcactactctcagctgacccagtttacttgtgagacaacactggattcctgccaatgtaaattgccaagcagcgagccactctctaggaccttcgtgtatcgggacgttacagactgtacttctgtcaccgggaccttcaagctgttcttgctgatccagatgattctgaacctagtgtgcgggctagtttgtcttcttgcctgtttcgttatgtggaaacaccgctatcaggttttttacgtcggagttcggatatgctccttaaccgcgtctgaaggccctcagcaaaaaatttag

SEQ ID NO: 204266 - DNA, 2292 bp, Artificial Sequence
  Description of Artificial Sequence: Synthetic coding sequence
atggaccacctgaacgaggccacccagggcaaggagcacagcgagatgtcaaataacgtgagcgatccaaaaggacctcccgccaaaatagctcgcctggagcagaatggcagtcccctgggacgcggaaggctgggcagtactggagccaagatgcagggtgtccctctcaagcattccggacacctgatgaagacaaatttacggaaaggtacgatgctgccagtgttctgcgtggtggaacattacgaaaatgcaattgagtacgactgtaaagaggagcatgcagaatttgttcttgtgcgcaaggatatgctatttaaccagctcatcgagatggcactcttatctctggggtactcgcattcttcagctgcacaggctaaggggctcatacaggtgggcaagtggaatccagttccactgtcctatgttacagatgcccctgatgctactgtggcggatatgctccaggatgtgtatcacgtggtgacacttaagattcagttgcatagctgtccgaaactagaagacctgccaccggaacagtggtcccacacaaccgtccggaacgccctgaaagatctgttgaaggatatgaaccagtcttctctggcaaaggagtgcccactctcccagagcatgatcagttctatcgtgaactctacctactatgctaatgtttcagccgccaaatgccaggagttcggaaggtggtacaagcacttcaagaaaactaaggacatgatggtagagatggacagtcttagtgagcttagccagcagggcgccaaccacgttaacttcgggcaacagccagtccccggaaacactgcagagcagcctcctagccctgcccagctgtcccacggctcccagccgtcggtgcgaacccccctaccaaaccttcaccctggactcgtgtctactcccatcagtcctcagttagtgaaccagcagcttgtgatggcccagcttcttaaccaacagtacgctgtgaatcgtttgctggcccagcaatccctgaatcagcaatacctcaatcacccccccccagtgtctagaagtatgaacaagccactggaacagcaggtgtcaacaaataccgaggtttcgagcgagatataccaatgggtgcgcgatgaactcaaacgggccggcatttctcaggccgtgttcgccagagtggcgttcaataggactcagggacttctgagtgagatcctgcgtaaggaggaagacccaaaaacagctagccagtcactgctggtcaacctgcgcgccatgcagaacttccttcagttgccagaagccgaacgggacaggatctaccaagatgagcgcgaacgatccctgaacgcagcctctgccatggggcctgcccctctgatcagcaccccaccaagcagaccacctcaggtgaaaaccgcgacaatcgctaccgaaaggaatggaaaacctgagaataataccatgaatataaacgcgtcaatatacgatgaaattcaacaggaaatgaagcgggcgaaagtctcacaggctctgttcgcaaaagtcgcagcaactaaatcccaggggtggctatgtgaactcctccggtggaaggaggatccgagtcctgaaaataggacactatgggagaacctgtctatgattaggaggttcctctcactaccccagcctgagcgagacgccatttatgagcaagaaagcaatgcagtacatcaccacggcgaccgaccacctcacatcatccatgtgccggccgagcagatccagcagcaacagcagcagcaacagcagcagcagcagcagcagcaggctccaccccccccccagccgcagcaacagccccagactggccctaggctcccaccacggcagccaactgtcgcatctcctgcggagtcggacgaggaaaatcgacagaagacgagacctagaacaaaaattagcgtagaagctctcggcatcttgcagtccttcattcaagatgtgggtttataccctgatgaagaggctatccagaccctcagcgcacagttggatctcccaaagtacaccatcatcaaatttttccaaaaccaacggtattacctaaaacatcatgggaagctcaaagataattcaggactagaggtggatgtcgctgaatataaggaagaggaactcctgaaagatttagaagaaagtgtgcaggacaaaaacactaataccttattctccgtgaagttggaggaagagttgagcgttgagggcaataccgacattaacacggacttgaaggattag

SEQ ID NO: 204267 - DNA, 351 bp, Artificial Sequence
  Description of Artificial Sequence: Synthetic coding sequence
atggaccacctgaacgaggccacccagggcaaggagcacagcgagatgtctaacaatgtgagcgatccaaagggaccaccggcaaaaatcgcacggctcgagcagaacggctcccctctgggccgcggtagactcggttctacaggcgctaaaatgcagggggtacctctcaagcacagcggacatcttatgaaaaccaatttgaggaaagggacaatgttgccagtgttctgtgtcgtggagcactacgaaaatgccatcgagtatgactgcaaggaggagcatgccgagtttgtgctggtgaggaaagacatgctgtttaaccaacttatcgaaatggcgctgctttag

SEQ ID NO: 204268 - DNA, 675 bp, Artificial Sequence
  Description of Artificial Sequence: Synthetic coding sequence
atggaccacctgaacgaggccacccagggcaaggagcacagcgagatgagtaataatgtaagtgatccaaaggggcccccagccaagatagcacggcttgagcaaaacgggtctccactgggtcgcggcagactgggttcaactggtgccaagatgcagggggtaccactgaagcattccggacatcttatgaagaccaacctccggaaagggactatgctgccggtgttctgtgtggttgagcactacgagaacgccatcgagtacgactgtaaggaggaacatgccgaatttgtgctggtgcgaaaggacatgttgttcaaccagctcatagagatggccctgctgtccctgggctactcccactctagcgctgcgcaagctaaaggcctaattcaggtcgggaaatggaaccccgtgcccctaagctacgttaccgacgcccccgatgccaccgtggccgatatgctacaggacgtataccacgtcgttactctgaagattcagctgcactcatgcccaaaactggaggatttgccccctgagcagtggtctcatacgacagtgcgtaatgccctgaaagatctgctgaaggatatgaatcagagttcccttgctaaggaatgccccctgtctcagtcaatgatctcatccatcgtgaattctacttactag

SEQ ID NO: 204269 - DNA, 216 bp, Artificial Sequence
  Description of Artificial Sequence: Synthetic coding sequence
atggaccacctgaacgaggccacccagggcaaggagcacagcgagatgagtaataatgtatcagaccctaaggggcccccagccaaaatagcccgtcttgagcagaatggaagccctctagggcgcgggcgtctcggatctaccggggctaaaatgcagggggtgcccctgaagcattctggacatctcatgaagacaaatctccgcaaggggtag

SEQ ID NO: 204270 - DNA, 27 bp, Artificial Sequence
  Description of Artificial Sequence: Synthetic coding sequence
atggaccacctgaacgaggccacctag

SEQ ID NO: 204271 - DNA, 519 bp, Artificial Sequence
  Description of Artificial Sequence: Synthetic coding sequence
atggaccacctgaacgaggccacccagggcaaggagcacagcgagatgagcaataatgtttcggatccgaagggtcccccggctaagatcgcgcgccttgagcagaacggtagcccgttgggcaggggacgactggggtcgaccggcgctaagatgcagggcgtgcctttgaagcactccgggcacttaatgaaaaccaatctgaggaagggtactatgctgccggtgttctgcgtagtggaacactatgagaacgccatagagtatgattgcaaagaggagcacgcagagtttgtgctcgtcaggaaggacatgttgtttaaccagctcatcgagatggctcttttgtcactgggttatagccacagttcggccgctcaagctaaagggctgatccaggttggcaagtggaaccctgttcccctgagctatgttaccgacgctcctgacgcgacagttgccgatatgttgcaggacgtgtaccacgtggtgacactcaagatacaactgcacaggtag

SEQ ID NO: 204272 - DNA, 2292 bp, Artificial Sequence
  Description of Artificial Sequence: Synthetic coding sequence
atggaccacctgaacgaggccacccagggcaaggagcacagcgagatgtcgaacaatgtgagtgaccccaagggaccccctgctaaaattgcacgacttgagcagaacggatcccctctgggtcgcgggagactgggatcaaccggagctaagatgcagggggtgcccctgaagcacagcggccatcttatgaaaaccaatctgcgaaaaggaacaatgctgcccgttttttgcgtggtggagcattatgaaaatgctatcgaatatgactgcaaggaggagcatgccgaattcgtgttggtccggaaagatatgctattcaaccagctcattgagatggccctgctgtccctggggtattcacatagctcggcagcccaggccaagggattgattcaagtggggaaatggaaccccgtgccgctgagttacgtcaccgacgcccccgacgcgacagtcgctgatatgttgcaggacgtgtaccacgtagtcacattaaaaatccagctgcacagttgccccaagctagaagatttgccacccgagcagtggtctcacacaaccgttcggaatgccctaaaagatctgcttaaggacatgaatcaatcctccttggctaaagagtgcccactgtcccaatccatgatttccagtattgtcaacagcacgtattatgcgaatgtgtccgcagccaaatgccaagagtttgggagatggtataagcatttcaaaaagaccaaggacatgatggtcgagatggatagcttaagtgagctgtcacagcagggggcgaatcacgtaaattttggccagcaaccggtccccggcaatacagccgagcaacccccgagccctgcacagctgtcccacggttcccagccatccgtgcggaccccgctgcccaacctgcatcctgggctggtgtcaaccccaatatccccgcagttggtaaaccaacaactggtcatggcccagcttttgaaccaacagtatgctgttaacagacttttggcccaacaatcactgaatcagcagtacctgaaccatccacctcccgtcagccgctccatgaacaaacccctcgaacaacaagtttcaactaataccgaggtgtcttctgagatttatcagtgggtgcgggacgagctaaagcgcgccggtatcagtcaggcagtttttgcgcgggtcgcgtttaaccgaacccaggggctcctgtccgagattttacgcaaagaggaggatccaaagactgccagccagagcctactggtgaatctgcgggccatgcagaacttccttcagctgcccgaagccgagcgggaccgaatttatcaagacgaaagggaacgttctcttaatgctgcgtccgcaatggggcccgccccactaatttcaacacctccatctaggccccctcaggtaaagaccgcaacgatcgccacagaacgaaacggaaagcccgagaataacactatgaatatcaatgcttcgatttacgacgagatccaacaggagatgaagcgcgcaaaagtgtcccaagccctgttcgctaaagttgctgctactaaaagccaaggctggctttgtgaactcttgaggtggaaggaagatccctctcctgagaaccgaacactatgggaaaaccttagtatgatacgccgattcctctctcttcctcagcccgaacgggacgccatctatgagcaagagtcgaacgcagtccaccaccatggtgacaggccacctcacatcatccatgtgcccgcagagcagatccagcagcagcaacagcaacagcagcagcagcagcaacaacagcaagccccccctcccccccaaccacagcagcaaccgcagaccggtccacgcctacccccacgccagcctacagtcgccagccccgctgagagcgatgaggagaatcggcaaaaaacccggcctaggacgaaaatcagtgtcgaggctttaggtattctgcagagctttatccaagatgtgggcctgtatccggatgaagaggccattcagacgttgagcgcgcagctcgacttgccaaagtataccattatcaagttcttccagaatcaaaggtattacctcaagcatcacggcaagttgaaagataacagcgggcttgaggtggatgtggctgaatataaagaagaggagttactgaaggaccttgaagagtcggttcaggacaaaaataccaacacactgttcagcgtcaagcttgaggaggagctttcagtggaaggcaatacagacataaataccgatctgaaggactag

SEQ ID NO: 204273 - DNA, 393 bp, Artificial Sequence
  Description of Artificial Sequence: Synthetic coding sequence
atggaccacctgaacgaggccacccagggcaaggagcacagcgagatgagcaataacgtgtcggatcccaagggaccccctgcaaagattgcgaggctcgaacaaaacggatccccactggggcgaggcaggctggggagtactggagcgaagatgcagggtgttccactcaagcactctggccacctgatgaagacgaatctgagaaagggtactatgctcccggtcttctgtgtggtggaacactacgagaacgccattgaatacgactgtaaagaagagcatgcggagtttgtgctagtgcgcaaagatatgttattcaaccaactcatcgaaatggccttgcttagcctcggatactctcatagctcagcagctcaagccaagggctag

SEQ ID NO: 204274 - DNA, 2388 bp, Artificial Sequence
  Description of Artificial Sequence: Synthetic coding sequence
atggaccacctgaacgaggccacccagggcaaggagcacagcgagatgtctaataatgtctccgaccctaagggacccccggctaaaatcgcccggctcgagcagaacgggtcaccgctgggcagggggcggctcggttcaaccggggctaagatgcagggcgttcctctgaaacattcggggcacctgatgaaaaccaatttaaggaagggcacgatgctgcccgtcttctgcgtagttgagcactatgaaaacgccattgagtatgactgcaaagaggaacacgccgaatttgttctcgtgcggaaagatatgctttttaaccagcttatcgagatggctctactgagcctgggatactcccattcttccgcggcacaggccaaagggcttatccaggtcggaaagtggaaccctgtgcccctgtcctatgtgactgatgcacctgatgcaactgtagcagacatgctgcaggatgtttatcacgttgtcactctgaagatccaattgcatagttgccctaagcttgaagacctccctcctgaacaatggagccatacaactgtccggaatgccttgaaggatcttctgaaggatatgaatcagtcatccctggccaaagaatgtccattgagtcagtcaatgatatcctctatcgtcaattccacctattacgctaatgtttcggccgcaaagtgccaggaattcgggcgatggtataaacactttaagaagactaaagacatgatggtggagatggattctttgtcagaactttcccagcagggggcgaaccacgtaaattttggccagcagccggtcccaggaaatactgccgagcagccacctagcccagcacaattatcacacgggagccagccgtccgtgcggacgccactgcctaacctccacccagggctggtgtccacacctatctcaccacagctggttaatcagcagctggttatggcccaactactcaaccagcagtatgcggttaatcgccttctggcacagcagagcctcaaccagcagtacttgaatcatccacctccggtgtctcgttcaatgaataagccgttggagcagcaagtgagtacaaacactgaagtaagctctgagatctaccagtgggttcgagacgagttgaagagggcagggatttctcaggctgtcttcgcccgagtggcctttaacagaacacagggcctattgtcagaaatactccgaaaggaggaggatcctaaaacagcttcacagtcccttctggtgaacttgagggccatgcagaactttctgcagttgcctgaagcagaaagagatcgaatctaccaagatgaaagagaacgctcacttaatgcagcctcagccatgggccctgcccccctgatttccacaccccctagccgacccccccaggtgaaaaccgctaccatcgctacagagagaaacggaaaaccggaaaacaataccatgaatatcaatgcctctatctacgatgagatccagcaggagatgaaaagagctaaggtgagtcaagcgctgttcgcgaaagtggctgccacaaagtcccaaggctggctttgtgagctcctgaggtggaaggaggacccttcgccagagaaccgcacgttgtgggaaaatctgtcgatgataagacggttcctgtccctgccccagccagagcgcgacgcgatctacgagcaagaatcaaacgctgtccaccaccatggggaccgccctccccatattatacacgttcccgcagaacagatacagtcaccttctccaactacacttggcaagggtgagtctaggggcgtgttcctccctggattaccgactccagctccctggctcggagccgccccccagcagcagcagcagcagcaacaacagcagcaacagcagcagcaggcaccacctccacctcagccccagcaacaaccgcaaaccggaccacgcttacctcctagacaacctaccgtcgcttcccccgcagagtccgatgaggaaaacaggcagaaaaccaggcccaggacaaagataagcgttgaggctctcggcatcctacagtctttcattcaggacgtagggctgtatccggacgaggaggcaatccagactctctccgctcagcttgatctccccaaatacacaatcatcaaatttttccaaaaccaacggtactatcttaaacaccacggcaagcttaaagacaatagtgggctggaagtcgacgtggccgagtacaaagaggaggaactcctgaaggacctggaagagagtgttcaggataagaacaccaatacactgttcagcgtgaaactcgaagaagagctgtccgtggaggggaatacagacatcaacacagacctcaaagactag

SEQ ID NO: 204275 - DNA, 2202 bp, Artificial Sequence
  Description of Artificial Sequence: Synthetic coding sequence
atggagcggcggagcgagagcccctgcctgcgggacagccccgaccggaggtccggctccccagatgttaaaggcccccccccagtgaaagtggctcgactcgaacagaacgggtcccctatgggtgctcggggccgcccaaacggggccgtcgcgaaggccgtcggaggcctgatgatcccggtgttttgcgtcgtcgagcaactcgacggctcattggagtatgacaatagggaagaacatgccgaattcgtgctagtcagaaaagacgtgctgtttagccagctcgtcgagacagcattacttgccttggggtattcccactcgagcgccgcccaggcgcaaggcatcatcaaactaggccggtggaacccgctgccattgtcgtacgtgacagatgcgcccgatgctacagttgccgatatgcttcaggacgtctatcacgtggttactctgaagatccagctgcaaagttgttccaaactggaggatttgcctgctgagcagtggaatcacgctactgtccggaatgctctgaaggagcttctcaaggaaatgaaccaaagtactctcgcaaaggagtgcccactgtcccaaagcatgatttcttccattgtgaactctacctattacgccaacgtatctgctacaaaatgtcaggagtttgggcgctggtataagaaatataagaaaatcaaggtggagagggtggaacgcgagaatctgtcagactattgcgtgctcggccaaagacccatgcacctacccaatatgaatcagttggcctcattgggtaaaactaacgagcagtctccacactctcagatccaccacagcacgcctattcgcaaccaggtgcccgctttgcaacccattatgagccctggtctgcttagcccgcagctgagccctcagctcgttagacagcaaattgcgatggcccatcttataaaccagcagatcgcggtgagtcgactgttagcacatcagcaccctcaggctatcaatcaacagttcctgaatcacccgcctatacctcgtgcagtgaagccagagcccaccaactcatctgtggaggtgtcccctgacatctaccagcaggttagggacgaactgaaaagggctagtgtgtcacaagccgtgtttgccagagttgcgttcaataggactcaggggcttctatcggaaatacttagaaaagaagaagatccgcggactgcatcccaatcgctgctagtaaacttgcgagccatgcaaaacttcctgaacctgccggaggtggagagagatagaatctatcaggatgaacgggaacgctccatgaaccccaatgtgtctatggtcagttccgcctcttcatcccccagttcttctaggacgccacaggccaagaccagcacccctacaacagatctgcctataaaagttgacggcgctaatattaacattaccgccgccatttatgatgagattcagcaggagatgaagagggccaaggtgagtcaggcgcttttcgcgaaggtcgccgccaataagtcccagggctggttgtgcgagctgcttaggtggaaagagaatccttccccagagaaccgtaccctgtgggaaaatttgtgtactattcgtaggtttcttaacttgcctcagcacgaaagggacgtcatctacgaagaagagtcaaggcatcaccacagcgaacgcatgcagcacgtcgtgcaactgcctccggagccagtacaagtgctgcaccgtcagcaaagtcagcccgctaaagaaagtagcccacccagggaggaagcgcctcctcctccaccacctactgaagactcctgcgcaaaaaagcccagatcccgaaccaaaatttccctcgaagcactgggcattttgcagtccttcattcatgacgtgggtctgtatcctgatcaggaggccatccacaccctgagcgctcagctcgatctgcctaagcacaccatcataaaatttttccagaatcaacgctaccacgtcaagcaccatggcaaactgaaagaacacttgggttccgcagtagacgttgctgagtataaggacgaggaacttctcaccgagagtgaggagaacgattctgaagaggggtctgaggagatgtataaggtcgaggcggaagaggaaaacgcggacaagagtaaggccgcccctgctgagatcgaccagagatag

SEQ ID NO: 204276 - DNA, 2202 bp, Artificial Sequence
  Description of Artificial Sequence: Synthetic coding sequence
atggagcggcggagcgagagcccctgcctgcgggacagccccgacaggcgctcagggagcccagacgtgaagggcccaccccctgtgaaagttgcgagattagaacaaaacggcagtcctatgggcgccaggggccggcccaatggggctgtagctaaggccgtgggcggcctgatgatacctgtattttgtgtcgtggaacagctggacggatctctggagtacgacaatagagaggagcatgccgaattcgtactggtacggaaagacgtgctcttcagccagctggtggaaactgcactgctggcgctcggttatagccacagcagtgccgcccaggcccaaggtataataaaactcggtagatggaatcctcttcccttaagctacgtgactgatgccccagatgctactgtggctgatatgttgcaagacgtgtatcacgtggtcactcttaagatccagctgcaatcctgcagtaaactagaggatctccccgccgagcagtggaaccacgctacggtgcggaacgctcttaaagagctcttgaaagaaatgaaccaatctaccttagccaaggagtgcccactgtcgcaatctatgatctcttctatagtgaattcaacatattatgctaatgtgtctgccactaagtgccaggagttcgggaggtggtataagaaatacaaaaagatcaaggtggaaagggtagaacgagagaacctcagcgattattgtgtgctgggccaacgaccaatgcacttacctaacatgaatcagcttgcttctctgggaaagacaaatgaacagagcccacactcacagatccatcactccacccccattcggaaccaggtcccagcactccagccaataatgtctcctggactgttatcccctcagctgagtccacagctggtgaggcagcaaattgctatggcacacctgattaatcagcagatcgccgtgtctaggctcctggctcaccagcacccacaggccattaaccaacagtttctgaaccaccctcccataccccgggccgttaagcctgagcccaccaatagttcggtggaggtttcgcctgatatctatcagcaggtccgggatgaactaaagcgagcttctgtgtcacaggcagtgttcgcacgggtagctttcaacagaacacaggggctcctctctgagattctgcgtaaagaagaggatccccggaccgcctcgcagagcttgctcgtcaacctgcgggccatgcagaattttctgaatctgccggaagtggagcgagaccggatctaccaggacgagagggagcggagcatgaaccctaatgtcagtatggtctcctcagccagctcgtcccctagcagctcccggacacctcaggctaagacgagcaccccaacaaccgacttgcccataaaggtggatggcgcaaatataaatatcacggccgccatttatgacgaaattcaacaagagatgaaaagggccaaggtatcccaggctttgtttgccaaggtcgcagcaaataagtctcagggctggttatgcgaacttctcaggtggaaggagaacccaagcccagagaatcgtactttgtgggagaatctgtgcacgattaggcgattcctgaacctgccccagcacgaacgggatgtaatttacgaagaagagagcaggcaccaccacagtgaacggatgcagcacgtggtgcagctgcccccggagcccgtgcaggtcctacaccggcagcagtcccagcccgctaaggaaagcagcccacccagggaggaggcacccccaccccctcctccgacggaggatagctgcgcaaaaaagcctcgcagtcgaacgaagatctctcttgaggcactgggcatcttacagagcttcattcatgatgtgggtctttaccccgaccaggaggccatccacaccttgagcgctcaactggatctcccaaagcacactataatcaaatttttccagaatcaacggtaccatgtcaagcaccatggtaagttgaaagagcaccttgggtccgcagtggacgtggctgagtataaggatgaggagctgcttacagaaagcgaagagaacgacagcgaagaaggatcagaggagatgtataaggtggaggccgaggaggagaacgccgacaaatcaaaagcagctccagccgaaatagaccagcggtag

SEQ ID NO: 204277 - DNA, 1848 bp, Artificial Sequence
  Description of Artificial Sequence: Synthetic coding sequence
atggagcggcggagcgagagcccctgcctgcgggacagccccgaccggagaagtggatcacctgacgtaaagggtccaccacccgtgaaagtggcacgcttggagcagaacgggagtcccatgggcgccagagggaggcctaacggcgcagtcgccaaggcggtaggtggcttgatgatccccgtattttgcgtggtggagcaacttgatgggtctttagaatatgacaatagagaggagcacgcagagttcgtcttggttcggaaagatgtgctgttctctcaattggtggaaactgcactgctggctcttggatactcacacagttccgcagctcaggcccaggtggagagggtggaaagggagaatctttcggactactgcgtactgggacagcggcccatgcatctgccgaacatgaatcagctcgcatctctcggcaaaacaaacgagcagtctcctcattcacagattcaccacagcaccccgattcggaaccaggtccctgctttacaacctataatgtctcctggtctcctgagtccccaactgtctccacaacttgttcgtcagcagatagcaatggctcatctgatcaatcagcagatcgctgtttcccggctcctcgctcatcagcacccccaggccattaatcagcaatttctgaaccaccccccgatcccacgcgccgtgaagcctgagccaacaaactcatcagtggaggtgtctccggacatctaccagcaggttcgcgacgagttgaaacgcgccagtgtgagccaagcagtcttcgctcgggttgcctttaatcggactcagggactcctgtccgagatcctgcggaaggaagaagaccctcggacagcaagccaaagccttctcgttaatttgcgggcaatgcagaatttcctgaatttacccgaggttgaaagagatcggatataccaggatgaaagggaaaggtctatgaaccctaacgtcagtatggttagcagcgcctcttctagcccctcctctagtagaacaccacaggccaaaactagcacgcccactaccgacctaccaattaaggtagacggtgccaatatcaatatcaccgcggctatctacgatgaaattcaacaggaaatgaagcgagccaaggtgtcacaggccctctttgctaaagtcgcagcaaataagtctcagggctggctatgcgaactcctaaggtggaaggaaaacccaagccctgaaaataggacactgtgggagaatttatgcactatcagaagatttctcaacctccctcagcacgagagagacgtgatatacgaggaggagtcaagacatcaccattctgaacgcatgcagcatgttgtgcaactgcctcccgagccagtgcaggttttgcaccgccaacagtcccagccagccaaggagtcttcaccacctagggaggaggccccacctccccccccacctactgaggactcttgtgccaagaagccgcgtagccgcacaaagattagtctcgaggctctcggcattctgcaatccttcatccacgacgtgggcctttatccagaccaggaagcaattcacacactgagtgcacaattggatcttccaaagcacactatcattaagttcttccaaaatcagaggtaccacgtgaaacaccatggaaagctgaaggagcacctgggatcggccgttgacgtagcggaatacaaagatgaagaactcctgaccgagagtgaggaaaatgacagtgaagaaggctccgaggaaatgtataaggtggaagctgaagaggagaatgctgataagtccaaagctgcccctgccgaaatcgaccaacgctag

SEQ ID NO: 204278 - DNA, 2202 bp, Artificial Sequence
  Description of Artificial Sequence: Synthetic coding sequence
atggagcggcggagcgagagcccctgcctgcgggacagccccgacagacggtccggtagccctgacgtgaaaggcccgcccccagtcaaggtggctagactggagcagaacggctcccccatgggggcacgcggcagaccaaacggtgcagtggctaaagcggtgggcggcctgatgatccctgtgttctgtgttgtggaacaattggatggaagcctcgaatacgacaatcgcgaggaacacgctgagtttgtcttggtcagaaaggatgtgctgttctctcagctcgtcgagacggccctccttgcacttggctattcccacagctctgccgcacaagcccagggaattatcaagttaggccgctggaaccctcttcccctatcttacgtgaccgacgcaccggacgccacagtcgccgatatgctgcaggacgtctaccacgtcgtgacactgaaaatacagctacaatcatgcagtaagcttgaggacctgcccgctgagcagtggaaccatgcaacagttcggaacgcgctcaaggaactgctgaaggagatgaaccagagtaccttagccaaagagtgccctctgtcacagtcaatgatttcgtctattgtaaactctacatactacgcgaacgtctctgccacgaagtgccaggagtttggccgatggtataagaagtataaaaaaatcaaggtcgaaagggttgaacgggaaaatttgtcagattactgcgtgttggggcagcgccccatgcatctgcctaacatgaatcagctggctagcttgggaaaaactaacgagcagagcccccactcacaaatccaccatagtactcctattaggaaccaggtccctgccttacagcccataatgtcgcccggtctgctgtctccacaattgtcaccccaacttgtccggcagcaaatcgccatggcccatctaattaatcagcaaatagctgtaagcaggctgctggctcaccagcacccgcaagctatcaaccagcagttcctgaaccaccccccaattccacgggcagtgaagcctgaaccaaccaactcaagcgtggaggtgagccccgatatctatcaacaggtgcgcgatgagctcaaacgtgcaagcgtgagtcaggccgtcttcgcacgagtagcttttaatcggactcaaggcttactatcagagatcctcagaaaagaagaagatccccggaccgcttcgcagtctctgctggtgaacttacgcgcaatgcagaactttttgaacctgccagaggtggaacgagaccgtatctatcaggatgaacgcgagagatcaatgaacccgaacgtctctatggtctctagtgcttccagtagcccatcatccagccggaccccccaggctaagaccagcaccccaaccactgacttgccaataaaagtagacggtgctaacatcaacatcaccgctgccatctacgatgaaatccagcaggagatgaaacgagctaaggtgagtcaggccctctttgcaaaagtggcagctaataagagtcaggggtggctctgcgaactgctaaggtggaaagagaatcctagccccgaaaatcggacactttgggaaaatctgtgtacaattcgtcgatttctgaacctcccccagcacgagagagacgtgatatacgaggaggaaagccgacaccatcattccgagagaatgcagcacgtcgtgcagctgcctcccgaaccggtgcaagtcttacacaggcagcagagccagcccgccaaggaaagttctcctccccgagaggaggcaccccccccaccccccccaaccgaggactcctgtgctaaaaagccgagaagtcgcacaaaaatttcactggaagccctagggatactccaaagttttatccacgatgttgggctgtaccccgaccaggaggccatccatactctgagcgcgcagctcgacttacctaagcacaccattatcaaattttttcaaaaccagaggtatcacgtaaaacaccacggaaagctcaaggagcacctcggcagtgcagtcgacgttgcagagtacaaagatgaggaactgcttaccgagtccgaggagaacgactcagaggagggcagcgaggagatgtacaaagtggaggccgaagaggaaaacgctgacaagtcaaaggccgcccctgccgagattgatcaacgatag

SEQ ID NO: 204279 - DNA, 2748 bp, Artificial Sequence
  Description of Artificial Sequence: Synthetic coding sequence
atggccgagaccctgagcggcctgggcgacagcggcgccgccggcgcagccgccctgtcttccgcatcatcggagactgggacaagaaggctgtccgacctgagggtgatcgatcttcgcgccgaattaaggaagcggaacgtagatagttcaggcaacaagtccgtcctaatggaaagattgaagaaggcgatcgaagatgaggggggcaatcctgacgaaatcgaaattacctctgaaggcaataagaagacatccaaacggagctcgaagggaaggaaaccagaggaagagggtgtcgaagataatggtcttgaagagaactcaggcgatgggcaggaagatgttgagacaagcttagaaaacttgcaggatattgatataatggatattagcgtccttgatgaggccgagatcgacaacggttctgtcgccgattgtgtagaggacgatgatgccgacaacctacaggaatccttgagcgacagcagggagctggtagagggcgaaatgaaagaactccccgaacagctacaagagcacgccattgaagacaaggaaacgatcaacaacctggataccagtagttccgactttaccatacttcaagagattgaggagccatccttggagcccgagaacgaaaagatcctggacattctgggagagacctgcaagagtgaaccagtgaaggaagaaagttccgagctcgaacagccttttgcccaggacactagctcggttggacctgaccgaaagttggccgaagaggaagacctgttcgatagtgctcatcccgaggagggagacctggatcttgccagcgagtccacagcacacgcccagagctccaaggcagacagtctcctggccgtggtgaaacgggaaccggccgagcaacccggcgacggagagcggacagactgtgagccagtgggcctggaaccggccgtggaacagtcttcagctgccagcgagctggcagaagcctcatccgaagaacttgcagaagcccctacagaggctccgagccctgaggcacgtgacagcaaagaagatgggcgcaagtttgattttgatgcgtgtaacgaggtccccccagctcccaaggagagttccacatctgaaggtgcagaccagaagatgagtagtcccgaggatgacagtgacaccaagaggttgtccaaggaagaaaaaggtagatcctcctgtggtcgaaatttttgggtgtctggtctgagctcaaccactagagccactgacctgaagaatctcttctccaaatacgggaaagtagtgggagctaaagtggtgacaaatgctcggtctcctggcgcacgatgttatggctttgtgaccatgtcgacagctgaagaagctaccaaatgtatcaaccatctgcacaaaacggaattgcatgggaagatgattagtgtcgaaaaggctaaaaatgagcctgtgggcaagaaaactagcgataagcgcgattcagacgggaagaaagaaaagtcttccaatagcgatcggagtaccaatttgaaacgagacgataagtgtgatcgtaaagacgatgcaaaaaagggcgatgacgggtcgggggagaaaagtaaggaccaggatgatcagaaaccagggcctagtgagcgatcgagggccaccaagtctggctcccgaggcaccgagagaacagtcgtcatggacaaatccaaaggagtccccgtaataagcgtcaaaacttcaggctcaaaagagcgtgcttctaagagccaagaccgcaaaagtgcctctcgcgagaaacggagcgtggtttcgtttgataaagtcaaggaacctcgcaagagccgggattcagaatctcatagccgggttcgcgagcgtagtgagcgcgagcagcgcatgcaggcgcagtgggaacgcgaggagagggagaggctggagatcgcacgggagcggctcgccttccagcgccagaggctcgaaagggagaggatggaacgcgagcgtttagagagggagcgcatgcacgtagaacacgagcggagacgggagcaggaacggatccatcgagagcgcgaagaactcagacgccaacaagaactgaggtatgaacaggagcggcggccagctgtcagacgaccctacgacctagatcgccgggacgatgcttactggcctgaggctaaacgtgcggccctcgatgagcgatatcacagcgattttaatcggcaggaccggttccacgactttgaccatcgtgatcggggtcgataccccgatcactctgttgacagaagggagggaagtcgatccatgatgggagaacgggaggggcagcattatcctgaacggcacggtggtccagaaagacacggtagagactcccgggacggctggggagggtacggcagtgacaaacgcatgtcagagggccgcggactcccaccaccacctcgcagggattggggagatcatggaagaagagaggacgaccgttcatggcagggaacagccgatggcggaatgatggaccgcgatcataaaaggtggcagggaggagagaggtcgatgagtggacactcaggtcctgggcatatgatgaaccgcggaggaatgagtggcagaggtagctttgcgcctgggggcgcctcacggggacacccaattccgcacggaggcatgcaaggaggctttggtggccagtcccggggttctcgcccttccgacgctcgattcacacgtcggtattag

SEQ ID NO: 204280 - DNA, 2244 bp, Artificial Sequence
  Description of Artificial Sequence: Synthetic coding sequence
atgaaggagctgcccgagcagctgcaggagcacgccatcgaggacaaagagaccatcaataaccttgacactagctcttcagattttacaattcttcaggagatcgaagagccctctcttgaacccgaaaatgaaaagatactggatatccttggtgagacctgcaagtctgaacctgtgaaagaggaatcttccgaactggaacagccctttgcgcaagatacttcctccgtgggaccggatcgcaaactggccgaagaggaggatctgttcgattcagctcatcctgaagagggcgacctggacctggcctcagaatccaccgcccatgcccagagcagtaaggccgattctctgcttgccgtcgtgaagcgcgagccagccgagcagccaggggacggggagaggactgattgtgagcccgtgggcctcgagccggctgttgaacagtcttcggccgcgtccgaactggctgaagcctccagcgaagaactggcagaggctcccacagaggcaccttctcctgaagctcgggacagcaaagaggacgggcgaaagttcgattttgacgcatgcaatgaggtcccgccagctcctaaggaaagcagcacaagcgagggagcggaccagaagatgagctcccctgaggacgactcagacaccaagagattgtccaaagaggagaaggggaggtccagctgcggacggaacttttgggtctccgggctgagtagcactaccagggccaccgatctcaaaaacttgttttcaaagtatgggaaagttgttggagctaaggtcgtgactaacgcaagatcacccggtgccaggtgctatggttttgtcaccatgtctaccgcagaagaagcaactaagtgcatcaatcacctgcataaaaccgagctgcacggcaagatgatttcagttgagaaggccaagaacgaaccagtgggaaaaaaaacgtcagacaaaagggactccgatggcaagaaagagaagtccagtaacagcgatcgcagcacaaatctcaaaagggacgataagtgcgacaggaaggacgatgccaagaagggcgacgacgggtctggcgagaagagcaaagaccaggatgaccaaaaacccgggccgtcagagcgctctcgggcaacgaagagcggctctaggggcacagagcgcactgttgtcatggataagtctaaaggagttccagtcataagcgtcaagacaagcggttcaaaggagcgcgccagcaaaagccaagataggaagagcgcctccagagaaaaaaggtctgttgtgagtttcgacaaagtcaaagagcctcggaaatcacgcgattccgagtcccactcccgagtgcgtgagcgaagcgagagggagcagcggatgcaggcacagtgggaacgggaagaaagagagaggctcgagatcgctagagagcggttggcattccagaggcagaggttggagcgcgagaggatggagcgggagaggctggaacgggaaagaatgcacgtggaacatgaaagacggcgggaacaggagagaattcacagagaacgagaggagcttcgacgacaacaagaacttcggtacgaacaggagcgacgccctgccgttcgcaggccctatgatttggacaggagggatgacgcttattggccggaggccaagcgggcggcgctggacgagaggtaccacagtgacttcaacagacaggaccggttccacgatttcgaccatagggatcgtggcagataccccgaccactcggttgacaggcgagaagggagccgcagtatgatgggggagagggagggtcaacattatcctgaaaggcacggtggtcctgaaaggcacgggcgggattctagggatgggtggggcggatatgggagcgataaacgcatgagcgaaggccgcggcctcccccctccaccgagaggacgacgggattggggagaccatggacgacgcgaagacgatcggagctggcagggtaccgcagacggaggtatgatggacagagatcacaaacgctggcaaggtggcgagcgttcgatgagtggtcatagtgggccaggacacatgatgaaccgaggaggcatgtccggccggggcagctttgcccccgggggagctagtagagggcacccaatcccacacggcggcatgcagggtgggtttgggggacaatctcggggctcccggccctctgacgctcgttttacgcgtaggtactag

SEQ ID NO: 204281 - DNA, 2547 bp, Artificial Sequence
  Description of Artificial Sequence: Synthetic coding sequence
atggccgagaccctgagcggcctgggcgacagcggcgccgccggcgcggctgcactcagctctgcatcctctgagaccgggacccggagactgtcagacctcagggtgattgatctgcgcgccgaactcaggaaaaggaacgtggactcatctgggaataagagcgtgctgatggaaagactcaagaaggctatagaagacgagggcgggaaccctgacgagatcgaaatcacctcagagggcaataaaaaaacctccaagcgctccagcaaagggcgaaaaccagaggaggaaggcgtggaggataacggtcttgaagagaatagcggcgatgggcagatcgaggataaggaaaccatcaataatctggacacatcatcctccgactttaccatcctccaggagatcgaagaaccctcactcgaacctgagaatgaaaaaattctggatatacttggggaaacttgtaaaagcgagcccgtgaaggaagagagctccgaattggagcagccattcgcccaggataccagctccgtggggccagaccggaaacttgcagaagaagaagatctgtttgacagcgcacatccagaagaaggggatctggacctggccagcgagagcaccgcccatgcacagtcatctaaagcagatagcttgctcgcggtcgttaaacgagagcctgccgaacaaccaggggatggggaaagaaccgactgcgaacctgttggactggagcctgcagtagagcagtcatccgccgcatcagagctcgccgaagcctcttcggaagaactggccgaggccccaacagaggccccctctccagaggcgcgtgacagtaaagaggatgggaggaagtttgactttgatgcttgcaacgaggtgcccccagccccgaaagagtccagcacatcagagggggcagatcagaagatgtccagtccggaggatgattctgacactaaacggttgagtaaagaagaaaagggtcggagctcctgtggaagaaatttttgggtgtctgggttgtcatcgacaacaagagccaccgatctgaaaaacctgttttctaaatacggcaaggtggtgggcgcgaaggtggtgaccaacgcacggtctccaggggctagatgttacggattcgtgacgatgtcaacggccgaggaggccactaagtgcattaaccacctccataaaacagagctgcatggtaagatgatatccgtggaaaaagccaaaaacgagccagtaggcaagaagacatccgacaagcgagactccgacggcaagaaggaaaagtccagcaattctgaccggagcactaaccttaaaagagatgataaatgcgatagaaaagacgacgccaagaaaggcgacgacggatcaggcgaaaagagcaaagaccaggacgaccagaagcctggcccctcagagagatccagggccacaaaaagcggctcacgtggaacagaaaggactgtggtgatggataagagcaaaggggttcctgttatcagtgtcaagaccagcggctccaaggaacgagctagcaaaagccaggataggaagagcgcatcccgcgaaaaaagatctgtggtttcatttgacaaggtgaaggagccccgcaagagccgcgactctgagagccatagtagggtcagggagcggtcggaaagagaacagcggatgcaggcccagtgggagcgggaggagcgcgaacgtctggaaatcgcaagggaaaggctagcattccaacgacagagactggaacgggagcggatggagcgcgaacggctcgagcgagagagaatgcacgtcgaacacgaacgccgcagggaacaggaaagaattcatcgggagagagaggaactaaggcgccagcaggagcttaggtacgagcaggagaggagaccagccgtgagacgtccttatgatctggatcggagggatgacgcatactggccagaggccaagagggctgctctcgacgagcgttatcacagcgacttcaaccggcaggaccggttccacgacttcgaccaccgggaccgggggcggtatccagatcactccgtggaccggagagagggaagccgctccatgatgggcgaacgagaggggcagcactaccctgagagacacggaggtccagaaaggcatggccgggacagccgtgatggctggggggggtacgggagtgacaagcgaatgtcagagggtcgggggttgcctcctccccctcgaggacggcgggattggggggatcatgggcgtcgcgaggacgatagaagctggcagggcactgcagacggcgggatgatggacagggaccacaagagatggcaaggcggagaacggtccatgagcgggcattctggccccggccacatgatgaataggggagggatgtcagggcgaggatcttttgcccccggcggtgcctctcggggccacccaatacctcatggcggaatgcagggcggctttggagggcagtcgcgcggcagccggccttccgatgccaggtttactcggagatactag

SEQ ID NO: 204282 - DNA, 2280 bp, Artificial Sequence
  Description of Artificial Sequence: Synthetic coding sequence
atgaaggtggtgatcctgaccaagctgaagctgcccccccgggagacgcgcaaacaccagagagggctggcaaaaattgaggataaggaaacaattaacaacttggatacctctagcagtgacttcacaatacttcaggagattgaggagcccagcctggagcccgaaaatgagaagatcctcgacattctgggagagacatgcaagtccgaacccgtgaaggaggagtcctccgagcttgagcaaccctttgcacaggatacatcttcagtaggacccgatcgcaagctggccgaggaggaagaccttttcgattcggctcaccccgaggaaggtgacctggacctcgcctcggaaagcaccgcccatgcccagtcgtcaaaggccgattcattacttgccgtggtgaagcgggagcctgcagaacaacccggagacggcgagcgcacagattgcgagcccgttggactggaacctgcggtggagcagtcctcggcagcctccgaactggcggaggcctcttctgaggaactagcggaggcaccgactgaagccccatcaccagaagcaagagactctaaggaggatggcagaaaattcgactttgacgcctgcaacgaggtccccccggctccgaaagaaagttcaacttccgaaggagccgaccagaagatgtcatcccccgaggatgactctgatacaaagcggctgagcaaggaggagaaaggtcgttccagctgcggtcggaacttctgggtgtccggcttaagcagtaccactagagccactgatctgaagaacctgttctccaaatatgggaaagtagttggtgcaaaagtggtgacaaacgcccggagccctggagcacgctgctacgggtttgtgactatgtctactgccgaagaagcaaccaagtgtatcaatcacctccacaagactgaactgcacggaaaaatgatctccgtggaaaaggccaaaaacgagcccgtgggtaagaagaccagtgacaaaagggattctgacggcaaaaaagagaagagcagtaactccgaccggagcactaatctcaaacgcgatgataagtgtgataggaaggacgatgcgaagaaaggcgacgatggcagcggagagaagtccaaggatcaagatgatcagaaaccggggccctccgagcgctcacgggcaaccaagagcggatctagaggaacagagaggaccgtggtgatggacaaaagtaagggggtgcccgtcataagcgtgaagactagcgggtcaaaagagagggcaagtaaatctcaagacagaaagtccgctagcagagaaaagagaagtgtggtgtcttttgataaggtcaaagaaccacgtaagtcacgtgattctgagtcacatcgggtaagagagcgatccgaacgtgagcagagaatgcaggcccagtgggagcgcgaagaaagggagagattggagattgcccgggagcgccttgctttccagagacagaggctggaaagagaaagaatggaacgtgagaggctcgaacgcgagaggatgcacgtggagcacgagagacgacgggagcaggagcggattcaccgtgagagagaggaactccggaggcagcaggaacttcgctatgaacaggaaaggcgaccagcggtgaggagaccctatgatttagatcggcgcgatgacgcctattggcccgaggctaagagggcggctctcgacgaaagatatcattctgatttcaaccgccaggaccgctttcacgacttcgaccacagagatcggggccgctatccggaccatagtgtagatagaagggagggaagcaggtccatgatgggcgaacgcgaaggtcagcactaccctgaacggcacggaggccccgagcgccatggccgtgattcgcgcgatggttggggtggttatggcagtgataaacgaatgagtgaggggcgaggtctgcccccaccccctcgggggcgcagggactggggcgatcacggaaggagagaagatgaccggtcatggcagggcaccgccgatggagggatgatggatagggatcacaagagatggcaaggaggcgaacgctccatgtccgggcattccggacccggccacatgatgaaccggggcggaatgtccggtagaggctccttcgccccaggaggcgcttcccgcggtcaccctatcccacatggcggtatgcagggggggtttggcgggcaaagcaggggatccagacctagcgacgcccgttttacccggagatactag

SEQ ID NO: 204283 - DNA, 2439 bp, Artificial Sequence
  Description of Artificial Sequence: Synthetic coding sequence
atggccgagaccctgagcggcctgggcgacagcggcgccgccggcgcggctgccctctcctcagcaagttcggagacaggcacaagacgactcagcgatctgagagtgattgatttacgcgccgaactgcgcaaaaggaatgttgacagttcagggaataagtccgttctgatggaacgcttgaaaaaggctattgaagatgagggtgggaacccagacgaaatcgagattacttccgaaggcaacaagaagactagtaagaggagcagcaaagggcgcaagccggaggaggagggggtcgaagataacggactagagcccgaaaacgagaaaattttagatattctcggggaaacatgtaagagtgagcctgtgaaagaggagtcctcggaactggaacagcctttcgcacaggatacctcttctgtggggcccgacaggaagctggccgaggaggaggatctgtttgattctgcacatcccgaagagggggatttagatctagcgagtgagtctacagcccatgctcagtcaagcaaggccgacagtctgttggcggtcgtgaaaagagaacccgcagagcagcctggcgatggtgagcgaacagattgtgaacctgtggggcttgagccagccgtggagcaatcatctgcagccagcgaactggcagaggcatcctcggaagagttagccgaggcacctaccgaggcccccagtcctgaagccagggatagcaaagaagatggcagaaaatttgacttcgatgcatgtaacgaggtccctcccgcacctaaagagtcaagcacaagcgagggagcagaccagaagatgagtagtcccgaggacgattccgacacaaagcgtttgtcaaaggaagagaaagggcgtagctcttgtggaaggaacttctgggttagtggtttgtcctccactactagggccacggatcttaaaaacctgttctccaaatatggaaaggtggtcggagccaaagttgttacaaatgctcggagcccaggagccaggtgttacggtttcgtaacgatgtcaacggctgaggaagcaacaaaatgtattaatcacctccataagacggaacttcacgggaaaatgataagcgtggagaaggctaaaaatgaaccagtcggaaagaagacttccgataagcgcgatagcgatggcaagaaggaaaaatcatcaaatagcgaccggagcaccaacttgaagagagacgataaatgcgataggaaggatgacgccaagaagggtgacgacgggtcaggcgagaagtccaaagaccaggatgaccaaaaacctgggccaagcgaacgcagtcgagccacgaagtctgggtctagaggaaccgagagaactgtggttatggacaagtccaagggcgtgccagttatctccgtgaagacgtcagggagtaaggagcgcgccagcaaatctcaggaccgaaaaagcgcctcaagggagaagcgatctgtggtctcattcgacaaggtgaaagagccgaggaagtctcgcgacagtgaaagccactcgcgggtgcgtgagcgctccgaacgggagcagcgcatgcaagcccagtgggaacgggaggaacgggagcgcctggagattgctcgcgagagactcgccttccagagacagcgattggagagggaaagaatggaaagggaacgattagaacgggaaaggatgcacgtggaacatgagcggagacgggagcaggaacggattcatcgggaacgcgaggagcttcgacgtcagcaggagctgcggtatgaacaggaacggagacccgccgtgagaaggccttatgacctggaccgtcgagatgacgcctactggcctgaagcgaaacgggctgcattagatgaaaggtaccatagcgatttcaatcgccaagaccgtttccatgatttcgaccaccgggaccggggaaggtaccccgatcactcagtggaccgcagagagggatctcgcagcatgatgggggagcgtgaaggacagcactatcccgagcggcacggtgggccagaacgacacggtcgcgactctcgggacgggtggggcggatacggatcagacaagagaatgtctgaaggtaggggactgccacctccccctagaggcagacgagattggggagaccatggaagaagagaggacgacagatcctggcagggaactgctgatggagggatgatggacagggaccacaagcgctggcagggcggcgagcgtagtatgtccggtcactcaggccccggccacatgatgaatagaggggggatgagcggaagagggtcctttgcccccggcggagcatcccgcggccatcctatcccccacggtggaatgcagggcggtttcggaggacaaagtaggggcagtcgaccctcagatgcgcgctttaccaggcggtattag

SEQ ID NO: 204284 - DNA, 2862 bp, Artificial Sequence
  Description of Artificial Sequence: Synthetic coding sequence
atggccgagaccctgcccggcagcggcgacagcggccccggcaccgcctccctggggcccggcgtggcggaaaccggtactaggaggctgagcgagctgcgtgtgatcgacctgcgagcggagctgaagaagcggaacctggacaccgggggtaacaagagtgtgctgatggaaaggctaaagaaggcagtcaaagaggaagggcaggacccggacgaaattggaattgagctcgaggctacctctaaaaagtcagccaagcgctgcgtgaagggcctaaaaatggaggaagaaggcaccgaagataatggcctagaagacgactcaagggacggccaggaagatatggaggctagtttggaaaatctgcagaacatggggatgatggacatgtctgtgctggacgagactgaggtagccaatagttcagccccagacttcggcgaagatggaactgatggcctgcttgactctttctgcgatagcaaagaatacgttgcagcacagctgcggcagcttcccgcacagccccctgaacacgccgtggacggggaggggtttaaaaatactctcgaaacgtcatccctgaatttcaaggtgactcccgatatcgaagagtcactcttggagcctgaaaacgaaaagatcctggacattctgggagagacatgtaagtcggagccagtgaaggaagaatcctcagaactcgaacagccctttgcccaggacacgagttccgtcggccctgaccggaaattggccgaggaagaggaccttttcgacagtgctcatcccgaggagggagacttggatttagcaagcgaatccaccgctcatgcccagagtagtaaagccgactctttgctcgccgtcgtcaaacgcgagcctgctgaacagccaggcgacggggaacggactgactgcgagcctgtgggcctggagcccgccgtggagcagtcttctgcggcctctgaattagccgaggcttcctctgaagaactggccgaggccccaacagaggcaccctcaccagaagcaagggattctaaggaggacgggaggaaatttgacttcgacgcatgtaacgaagtccctcccgcccctaaggagagcagtacgtcagaaggggcggatcagaagatgagctcgttcaaagaagaaaaggacatcaagcccatcattaaagacgagaagggcagagtcgggagtggctccgggaggaacctatgggtcagcggactctcgtccaccaccagagctaccgatctgaaaaatctattcagcaagtatgggaaagtggtgggggcaaaagtagtcactaatgctagatcgcctggtgcacgctgctatggctttgtaaccatgagcacgtcggatgaagctacgaagtgcattagccacctgcaccgtacagagctgcacgggcgaatgattagcgtcgaaaaagccaagaacgaaccagccggtaagaagctttctgaccggaaggaatgtgaggttaaaaaagaaaagctcagttccgtagatagacatcactcagtggaaattaaaatagagaaaacagtgattaaaaaagaggaaaaaatcgaaaaaaaggaggagaagaagcccgaggatatcaagaaggaagaaaaagatcaggacgaactcaaaccaggcccaaccaaccggtcccgcgtcactaagtcgggttctcgtggaatggagcggactgtggtcatggacaaaagcaagggagaacccgtcatctccgtcaaaacgacctcgagaagcaaagaacgatcgtccaagtcccaggacagaaaatccgagtctaaagagaagcgggacattctcagttttgacaagataaaagagcagagggagcgggagagacagagacagcgggagcgagagatccgagaaactgagcgacggagagaacgagaacaaagagagcgggagcagaggcttgaggccttccacgagcggaaggaaaaagccaggctacaaagagagcggttacagcttgagtgtcagcgccagcggctggagagagaaaggatggagagagaaagactcgagcgggagcggatgcgagtggagcgcgaaagaagaaaggaacaagaaagaatccaccgagagagagaagagttgcgaagacaacaggagcaacttaggtacgaacaggaacgccgacccgggcgccggccctacgacctcgacaggcgggatgacgcttactggccagaggggaaaagggtagctatggaggatcgttaccgcgctgactttcctagacctgaccatcggttccatgacttcgatcacagagaccggggtcagtatcaggatcacgctatcgacaggagggaggggtctcgtccaatgatgggggatcacagggatgggcaacactacggggacgatcgccatggacatggtgggcccccagagagacacggacgggatagccgtgacggctgggggggctacgggagcgacaaaagacttagcgaagggcgaggactacctccaccccctaggggtggccgggactggggtgagcacaaccagaggctcgaagagcaccaagctcgcgcctggcagggcgctatggacgctggggccgcttctcgggaacacgctagatggcagggcggcgagcgcgggctgagtgggcctagcgggccaggacatatggcctctcgcggaggagtcgccggacggggtggtttcgcacagggcggccatagccagggccacgttgtcccaggcggcgggctggagggtggaggtgttgcaagccaggatagagggtctagggttccgcatccacaccctcatcccccaccataccctcatttcacccgacggtactag

SEQ ID NO: 204285 - DNA, 1533 bp, Artificial Sequence
  Description of Artificial Sequence: Synthetic coding sequence
atggccgagaccctgcccggcagcggcgacagcggccccggcaccgcttctctcggcccaggtgtggcagagaccggaacccggaggctgagtgagctgagggttatcgacctgcgtgcggagttaaaaaagaggaatcttgacacaggaggtaacaagtcagttctgatggaacgactgaagaaggctgttaaagaagaaggacaagacccagatgagataggcatagaacttgaggcgacttcaaaaaaaagcgccaagagatgcgtgaagggccttaagatggaggaggaaggcacggaggacaatgggctggaagacgactcacgcgacggccaggaggacatggaggcttcccttgagaatctgcaaaacatgggcatgatggatatgtccgtgctggacgaaacagaggtagccaattcctctgctcccgatttcggcgaagacggtactgacgggttgttagactctttttgtgacagcaaggaatatgtggccgctcaactcagacagctcccagcccagccccctgagcacgccgtgggcaacctggagaccaggcaagatgtcccgacgtcttcctcactgagagtgagcgtggcggcggtgccagtgccacacctgtctgtcgagaacgagaaaatcctggatattctgggcgaaacctgtaagtccgagcctgtgaaagaagagagtagcgaactcgaacagccatttgcccaggacacatcctcagtcggcccggaccgtaaactggccgaggaggaggatctatttgactcggcccacccagaagagggggatctggacctcgcatctgagtccaccgcgcacgcacagagctctaaagcagactctttgctagcagtggtaaagcgcgaaccggctgagcaacctggagatggagaaagaactgactgtgaacccgtggggctggagcctgccgtggagcagagttccgcagcctctgagctggcggaggctagctcagaggagttggcagaagccccgactgaggctcccagcccagaggcccgtgactcgaaagaggacgggaggaaatttgattttgacgcatgcaacgaagtgccacccgcccctaaagagtcctctaccagtgagggggctgaccagaagatgtcttcatttaaggaagagaaagatattaagcctattattaaggatgagaaaggacgtgtgggctcgggttccggccgcaacttgtgggtttctggcctgtcatccaccacaagggccaccgacctgaaaaatctgttcagcaagtacggcaaagtggtcggagctaaagttgtgacgaacgctcggtcgcctggagcgaggtgttatggctttgtcaccatgagtaccagtgatgaggccacaaaatgtatatctcatctccacagaactgaactccatggtaggatgatttccgtcgaaaaagccaagaatgaacccgccgggaaaaaactctccgaccgcaaggaatgcgaagtgaagaaagagaaactgtcatctgtggatagatag

SEQ ID NO: 204286 - DNA, 786 bp, Artificial Sequence
  Description of Artificial Sequence: Synthetic coding sequence
atggccgagaccctgcccggcagcggcgacagcggccccggcaccgccagcctgggccctggagtggctgaaaccggcacgaggcggttgagtgagttgagggttattgatctcagagcagaacttaagaagcgaaacttggacactggggggaacaaaagtgtcctgatggaaaggttgaaaaaggctgtgaaggaggaaggtcaagatccagatgagatcgggatagaactggaagcaacatcaaaaaaaagcgccaagcgttgtgtgaaagctccttcccctgaggcacgggactctaaagaagacgggcgcaagttcgacttcgacgcctgcaatgaggtcccccccgctcccaaagaatcaagtaccagtgaaggagccgaccagaaaatgtcttcattcaaagaagagaaggatatcaaacccataataaaagacgaaaaggggcgcgtcggctccgggagcgggcgtaacctctgggtgtctggactgtcttctacaacgagagccaccgacttgaaaaatcttttcagcaaatacggaaaggtggttggggcaaaagtggttactaatgctaggagtccaggcgccagatgttatgggtttgtcacaatgtctactagcgatgaagcgacaaaatgcattagtcacctgcaccgaacagagctccatggcagaatgatcagtgtggaaaaggcgaaaaacgaacccgctggcaagaagctgagcgatcgcaaagagtgcgaggtaaagaaggaaaagctgtcaagtgtcgatagatag

SEQ ID NO: 204287 - DNA, 1221 bp, Artificial Sequence
  Description of Artificial Sequence: Synthetic coding sequence
atggccgagaccctgcccggcagcggcgacagcggccccggcaccgccagtctcggaccaggagtggcagaaactggtacgagacgcctcagcgaactaagagtaatagacctgcgggcagaactgaagaagagaaacctggatactggtggaaataaaagcgtgctcatggaaaggttaaaaaaagccgtcaaggaggagggccaggatcctgatgaaattgggatcgagttggaagcgactagtaaaaaatccgctaaaaggtgtgtcaaaggtctgaaaatggaagaagaagggaccgaggacaacggtctggaggtggaaaacgagaaaatcctcgatatcctgggagaaacttgtaaaagtgagcctgtcaaagaggagtcctcggagctggagcagcccttcgcacaggatacctcttccgtaggacctgaccggaagctggccgaggaagaggacctctttgattccgcccaccccgaagagggcgatctcgacctagcttccgagagtacagcccacgcacagagctctaaagccgatagcctgcttgctgttgttaagcgcgagccggcggagcagccaggcgatggcgaaagaacagactgcgaacccgtgggcctcgagccggcagttgagcagtccagcgctgcctcggaactggctgaggcttcgtccgaggagctggccgaagcccctacagaggctcccagccccgaggcccgagactccaaggaggatggccgcaaatttgacttcgacgcctgtaacgaggtgccacccgcacccaaggaatccagcacgagcgaaggcgctgaccagaaaatgagcagctttaaggaagagaaggacatcaagcccatcattaaagacgagaaaggcagggtggggtctgggagtgggcggaatttgtgggtatcaggtctgagctctaccacgcgagcgactgacctcaagaatctattcagcaaatacggcaaggtcgtgggggccaaggtagtaacaaacgccaggtctcctggggccaggtgctatggttttgttaccatgtccacttccgatgaggccacgaaatgtatttcccacctccacagaacggagctgcatggtcgcatgatttccgtggagaaagcaaagaatgaacccgctggtaaaaaactgtccgacaggaaagaatgcgaggtgaaaaaagagaagttgagctccgtggatcggtag

SEQ ID NO: 204288 - DNA, 606 bp, Artificial Sequence
  Description of Artificial Sequence: Synthetic coding sequence
atggccgagaccggcacccggcggctgagcgagctgcgggtgatcgacctccgtgctgagctgaaaaagaggaatctggatacgggcggcaacaaaagcgtacttatggagaggttaaaaaaagcagtgaaagaggagggacaggatccagacgaaatcggcatcgaactggaggctacaagtaaaaaaagcgcgaaacgatgcgtgaagggcctgaagatggaggaagagggtaccgaagacaatggcttggaagacgattcccgagacggacaagaggacatggaagcatccctggagaacttgcagaatatggggatgatggacatgtccgtgctcgacgaaaccgaggtagctaattcttccgcaccagatttcggtgaagacggaactgacggccttctggactctttttgcgactcaaaagagtacgtagctgctcagctgcggcagctgccagcccaaccacccgagcacgctgtagacggcgaagggtttaagaacacgctggagacttcgtccctgaactttaaagtgactcccgacattgaggagtctctgttggagcctggaaccgataaaagaaatacaacagttatggtgtag

SEQ ID NO: 204289 - DNA, 1821 bp, Artificial Sequence
  Description of Artificial Sequence: Synthetic coding sequence
atgaaggtgcggagcgccggcggcgacggcgacgccctgtgcgtgacagaggaggacctggccggtgatgacgaggacatgcctacattcccctgtactcagaagggccgccctgggccacggtgttcccggtgtcaaaaaaacctcagtctacacaccagcgttaggattctgtatctatttctagcactcctgctggtggccgtggcagttctggcttcccttgtgtttaggaaggtggatagcttgtctgaagacatttctctgacccagtccatttacgacaagaagctggtcttgatgcaaaagaacctacagggccttgacccaaaggcccttaacaattgttccttctgccatgaggcaggccagctcgggcccgagatcagaaagctacaagaggaactggaaggtatccagaaactcctcttggcacaggaagtccagctagatcagacactccaggctcaagaggtcctttccaccacctctcggcagatcagccaggaaatgggctcatgctcgttcagtatacaccaggtgaaccagagcctcggactctttctggcacaggtgaggggctggcaagccaccaccgcgggattggacctttctttaaaagatctgactcaggagtgttatgatgtgaaggccgccgttcaccaaattaactttactgtgggccaaacttcagagtggatccacggaattcaacggaagaccgacgaggagacgctgaccctgcagaaaattgtgaccgattggcaaaactacacacgcctcttcagcggcctccgcacgacttctacaaaaacaggcgaagcggtaaaaaacatccaggccacattgggcgcatcctctcagagaattagccagaacagcgaatcgatgcacgacctcgtgcttcaagtgatgggcttacagctccagctagacaatatttcgagtttcttggatgaccatgaggaaaatatgcacgatctccagtaccacacacactacgctcaaaataggaccgtagagcgtttcgaaagtctggaaggcagaatggccagccatgagatcgaaatagggaccatctttacgaatatcaacgcaactgacaaccacgtccattcgatgttgaagtatttggacgacgtgagacttagctgtacactcggcttccatacccacgcagaagagctttattatcttaataagagcgtttcaataatgctgggcacaacagacctgctgcgagaaagattttcactgctgtctgctcggcttgatttgaatgtgagaaacttgtccatgattgttgaggaaatgaaggctgtagatactcagcacggtgaaatactccgcaatgtcactatcctgaggggcgctcccggcccaccggggcccagaggctttaaaggagacatgggggtcaaagggcccgttgggggacggggacccaaaggcgacccgggctctctcggccccctgggaccgcagggtccgcaaggccagcccggggaagctggtcccgtcggcgagcgcgggccagtgggcccccgtggctttcctgggctgaaggggtccaaagggtcattcggtaccggagggcctcgcggacagccaggccctaagggcgacattggtccacctggcccagaaggcccccctggctcccctgggccaagtggtccccaggggaaaccaggaatcgccggcaaaacaggttcaccaggccaacgcggcgccatgggaccaaagggcgagcccggcatccagggaccccccggattgcccgggcctccgggcccacccggctcccagagcttttattag

SEQ ID NO: 204290 - DNA, 1401 bp, Artificial Sequence
  Description of Artificial Sequence: Synthetic coding sequence
atgaaggtgcggagcgccggcggcgacggcgacgccctgtgcgtgacggaggaagacttagctggcgacgacgaggatatgcctaccttcccctgcacccaaaagggtcgaccaggcccacgatgcagcagatgccagaaaaacctgtctctccacacatccgtgcggattttgtacttgtttctcgcactgttactggtcgctgttgccgtcctggcctcacttgtattcaggaaagtggattctcttagtgaagacatctcgttgactcaaagtatttacgacaaaaagctagtattaatgcagaagaatctgcagggccttgaccccaaggctctgaataattgttccttttgtcatgaagctggccagcttgggccagagatcagaaaactgcaggaggaactcgagggaatccagaaactgttgctggcccaagaggttcagctcgaccagaccctgcaggcccaagaggtgctgtccaccacctctcgccaaatttctcaggagatgggtagctgttcgttctctatccatcaggttaatcagtctctagggctgttcctggcccaggtgaggggctggcaggcaactacagcgggactcgacctgtccttaaaagatttgactcaagaatgttacgacgtgaaagctgctgtccaccaaatcaacttcaccgtggggcagacaagcgaatggatacatgggatccaacgcaaaactgatgaagaaaccctgaccttgcaaaagattgttacagactggcaaaactatacccgcctgttctcaggtcttcggaccaccagcaccaagaccggcgaagcagtgaagaacattcaggccacattgggtgcctccagtcagcggatttcgcaaaattccgagagcatgcacgatttagtgctgcaagtgatgggcctgcaactgcagcttgacaatattagcagtttcctggacgaccacgaagagaacatgcatgacctgcagtatcacacccattatgctcaaaatagaaccgtagagcgctttgaatccctcgaggggaggatggcctcccatgagatcgaaatcgggaccatcttcactaatatcaacgcaaccgataaccatgttcacagcatgttaaaatacctggatgacgtgcgcctgagctgtacactgggttttcatacccatgcggaagagctgtactacctgaataaatcggtcagcattatgctgggcaccactgatctcctgagggagagattctccctcctcagtgcaaggctggacctgaatgtcaggaacctgtccatgatagtggaagagatgaaggctgtggatacccagcatggcgagatcctgcggaacgtgacaattctgcgaggacacacactattcagccataatcgaatatag

SEQ ID NO: 204291 - DNA, 1008 bp, Artificial Sequence
  Description of Artificial Sequence: Synthetic coding sequence
atgggccggtgctgcttctacaccgccggcaccctgagcctgctgctgttggtgacatccgtgacattgttggtcgcaagggtttttcaaaaggcagtggaccagtccatcgagaaaaaaattgtgctgaggaacggaactgaggcgttcgactcttgggagaaaccacctctgccagtctacacacagttttacttctttaacgtgaccaaccctgaggaaatcttgagaggagaaacaccaagggtggaggaggtggggccatacacatataggagtctggactggtggattactgacaagtgtaacatgataaatggcacagacggagattcgttccatccactcatcaccaaggatgaggtcctctatgtctttccgagcgatttctgccggagcgtttacattactttctcagactacgagagtgtccagggtttgccggccttcaggtataaagtgcccgccgaaattctggcgaatacctcagataacgcaggattctgcatccccgagggcaattgcctcgggagtggggtcctgaacgtgtctatctgcaaaaatggggcccccatcatcatgagctttcctcacttctatcaagcagacgagcgcttcgtctctgccattgaggggatgcatcccaaccaggaagatcacgaaactttcgtagacatcaacccacttacagggattattctaaaggctgccaagcggttccagattaatatctatgtgaaaaagctagatgactttgtggaaacaggggatattcggaccatggtgttcccagtgatgtacttaaacgaatccgtccacattgataaagagactgcgtctcgactgaagtctatgatcaatacaaccctgattattacaaatattccctatataatcatggcactgggagtgttttttgggctggtgttcacctggttggcttgcaaaggtcagggcagtatggacgagggaacagccgatgagagggctcctctgatcaggacctag

SEQ ID NO: 204292 - DNA, 1530 bp, Artificial Sequence
  Description of Artificial Sequence: Synthetic coding sequence
atgggctgcagcgccaaggcccggtgggccgccggcgccctgggcgtggcaggtttgctctgtgctgtgctgggggctgtgatgatagttatggtcccctccctcattaagcagcaggtcctgaaaaacgtgcgaatcgacccttcgtctctgtccttcaacatgtggaaagaaatccccattccattttacctgtcagtttacttttttgacgtgatgaatccctctgagatcctgaaaggcgaaaagccacaggtgcgagagcgcgggccgtacgtttacagagagtttcgtcataagtctaatattacatttaacaacaacgatactgtctcctttttggaatatcgaaccttccagttccaaccatctaagtcgcatggttcggagtcagactacattgtgatgcccaatattctggtcctcggcgccgccgttatgatggagaataagcccatgacgctgaaattaatcatgaccctcgccttcaccacgcttggcgagagggcctttatgaatagaaccgtgggtgaaatcatgtggggttacaaggatcccctggtcaacctgatcaacaagtacttccccggtatgtttcccttcaaagataaattcggcctgtttgccgagctaaacaacagtgacagtggtttatttaccgtgttcaccggcgtgcaaaacatctcccggatccatttggtggataagtggaacgggctgagcaaggtcgatttttggcatagcgaccagtgcaatatgattaatggtacgagtggccagatgtggccaccatttatgacgccagagtctagtcttgaattctactctcccgaggcatgtagatcaatgaagctgatgtacaaggagagtggcgttttcgaaggcattccaacttaccggtttgtggcgccaaagacactgttcgccaacggctccatttatcctcccaacgaaggcttctgtccctgtctggagtctggaatccagaacgtgagcacttgtcgattttcagcaccactgtttctcagccatcctcactttcttaatgccgaccccgtcctcgccgaggcggttacgggcttgcatcctaaccaggaagcccattcactgttcctggatattcaccctgtaaccggtattcctatgaattgctctgttaaattgcaattgtctctttatatgaagtcagtagcaggtatcggacaaacaggcaagatcgagccggtggtccttcccctgctctggtttgctgagagtggtgccatggagggagagactctgcacacattctacacccagcttgtcctcatgcctaaggtgatgcattacgcccaatatgtcctgctcgcgctggggtgcgtgctgctcctggtgccagtcatttgtcagatcaggtcccaggagaaatgttatcttttttggagcagctctaaaaaggggtctaaggacaaagaggccattcaggcatactcagagtctctgatgacaagcgcgcccaaagggagcgtcctgcaagaggcaaaactgtag

SEQ ID NO: 204293 - DNA, 1521 bp, Artificial Sequence
  Description of Artificial Sequence: Synthetic coding sequence
atgggctgcagcgccaaggcccggtgggccgccggcgccctgggcgtggccggccttctctgcgccgttctgggcgccgttatgatcgtgatggtgccgtctctgattaaacagcaggtcctcaagaacgtccggatcgatccatccagcctcagctttaacatgtggaaggagatccccatccccttttatctgtccgtgtatttcttcgacgtgatgaatccctccgagatcttgaaaggcgaaaaaccccaagtgcgtgaacgggggccatatgtctaccgagagtttcggcataagtccaacatcacttttaacaataatgatacggtgtcattcctggagtacaggacattccagttccagcctagtaagagccacgggagcgaatctgactatattgttatgccgaatatactcgttcttggcgctgctgtaatgatggaaaacaaaccaatgacgcttaaattgataatgacacttgctttcactaccctcggagagagggccttcatgaaccgcacggtcggcgaaataatgtggggttacaaggaccccctggtcaaccttattaataaatattttccaggaatgtttcctttcaaggacaagttcggcctttttgctgagctgaacaattctgatagcgggctcttcacagtgttcactggagtccagaatatttcaaggatccatctggttgataagtggaatggactgtctaaggtcgatttttggcattcagaccaatgtaatatgataaatgggacctccgggcagatgtggccgccattcatgaccccagagagctccctggagttttattccccagaggcctgtaggtcaatgaagttaatgtataaggagtctggggtctttgaaggtatccccacgtacaggtttgttgcccccaaaacgctgtttgcaaatgggagcatctaccctccaaatgaggggttttgtccttgtctggaaagtggcatccagaacgtgagcacctgcaggttctccgctcctctgttcctatcgcatccgcattttctcaatgcggatccagtcttggccgaggccgttactggcctgcacccaaatcaggaggcgcatagcctgttcctggatattcatccagtaaccggaatacctatgaactgcagcgtgaagctccagctctctctttatatgaagagcgtggcaggcatcggacagacaggaaagattgagcccgtggtgctccctctgctttggtttgcagagtcaggcgcaatggaaggtgagaccttacacactttctacacgcagctggtgctcatgcccaaggtgatgcattatgctcagtacgtcctattagccttaggttgtgtgctgctcctggtccccgtaatttgtcagattcgctcgcaggggccagaggacacggtgtctcagccaggtctggccgcaggaccggaccggccgccatctccctatactccactgctgccagacagtccgagcggccagccaccctcccccacagcctag

SEQ ID NO: 204294 - DNA, 1230 bp, Artificial Sequence
  Description of Artificial Sequence: Synthetic coding sequence
atgggctgcagcgccaaggcccggtgggccgccggcgccctgggcgtggctgggctgctctgcgccgttttgggcgctgtgatgatcgtgatggtcccctctctgatcaagcagcaggtactgaagggagccgccgtcatgatggagaacaagcccatgacattaaagctaataatgactctcgccttcaccacacttggtgagagagccttcatgaacaggacggtgggagaaatcatgtggggttacaaagaccccttggtcaacttgatcaataaatattttccagggatgtttccttttaaagacaagttcggactcttcgctgagctcaataattcggattccggcttatttacagtgtttacaggcgttcagaacatttcccggatccatctggtggataagtggaatgggctgagtaaggtggacttctggcactctgaccagtgcaacatgattaatggaacgagcgggcagatgtggccaccattcatgacccctgagagcagccttgaattctacagtccagaggcctgccggtctatgaagctgatgtacaaggaatctggcgtatttgagggaattcccacttacaggtttgtcgcacccaaaaccttgtttgcaaacggttctatttacccccctaatgagggtttttgcccctgtcttgagtccggtattcagaacgtgtccacatgtcggttcagcgctccgcttttcttatcacacccccacttcctgaatgccgacccagttctggccgaggccgtgaccggcctgcatcccaaccaagaagcgcatagcctgtttcttgacatccaccctgtaacagggatccctatgaattgctcagtgaaactgcagctcagcctctatatgaagagtgttgctgggattggccagaccggaaaaattgagcctgttgtgctccccttattatggttcgcagagtccggcgccatggaaggcgaaactctgcataccttttatacccaattggtcttgatgcccaaagtcatgcattatgcgcaatatgttttgctggcacttggctgtgttctactgttggtgccagtaatctgtcagattcgctcacaggaaaaatgctatctcttctggagttcctcaaagaagggatctaaggataaagaagctatccaggcgtattccgaatccttgatgacatccgcaccaaagggatcagtgctgcaggaagccaagttatag

SEQ ID NO: 204295 - DNA, 1659 bp, Artificial Sequence
  Description of Artificial Sequence: Synthetic coding sequence
atgggctgcagcgccaaggcccggtgggccgccggcgccctgggcgtggctggcctcctttgcgctgtccttggagcagttatgatcgtgatggtgccaagcctgattaagcagcaggtattgaagaatgttcggattgatccctcaagcctctcctttaacatgtggaaagaaatccccataccgttctatctgtcagtgtatttctttgatgtcatgaatccaagtgagatcttaaagggagagaaaccccaggtccgcgaacgtgggccttacgtgtacagagagttcagacacaaaagcaacattacattcaataacaatgacacagtgagctttctggaatatcggacctttcaatttcaacccagcaagtcccacggcagcgagagcgattacattgtcatgcccaatatccttgttctaggcgcagcagtcatgatggaaaacaaaccaatgaccctgaagctgattatgaccctggccttcacaacccttggagagcgcgcattcatgaacaggactgtcggagagatcatgtggggatacaaggaccccctggtaaaccttattaacaaatacttccccgggatgtttcccttcaaggataagttcggtctgtttgccgagcttaataattccgatagcgggttgttcacagtatttaccggggtacagaatatctcaagaatccacctggtcgacaaatggaacggcttaagtaaggtagacttttggcacagcgaccaatgcaacatgatcaacgggaccagcgggcagatgtggccacctttcatgacccccgagtcttccttggaattctactccccggaggcctgtagatccatgaagctgatgtataaagagtccggagtgtttgaaggcatcccaacatacagatttgtggccccaaaaacactattcgccaacggctcgatttatccgccaaatgagggcttttgcccatgccttgagtcaggaatccagaacgtctctacctgccgcttttccgcccctctcttcttatctcatccgcactttttgaatgccgaccccgtgctggccgaagcagtcactggcctgcatcctaatcaggaagcccattctctcttccttgacatccatcccgtaacgggtatccccatgaactgttccgtcaagctgcagctgtctttatacatgaaaagcgttgcgggcattggtcagactggcaaaatagagccagtggtgctgccactgctttggtttgcggagtcgggcgccatggagggtgagacgctgcataccttttacacccaacttgtgctaatgccaaaggtaatgcactatgcccagtacgtgctgctcgcactgggctgcgtgctcctgttggttcccgtgatttgccaaattcggtctcaagttggcgccggacagcgagccgccagagcagactctcactcgctcgcctgctggggaaaaggggccagcgacagaaccctgtggccaacagccgcttggtctccgccacccgctgctgtgctgaggttgtgcagatcaggtagcggtcactgctggggcttaaggagcacactggcatccttcgcttgccgcgtggcgaccacgttacctgtcctcgaagggctgggtccatccctgggcggaggaacggggtcctag

SEQ ID NO: 204296 - DNA, 1551 bp, Artificial Sequence
  Description of Artificial Sequence: Synthetic coding sequence
atgtgcgccgtgggcaacgtgcggatcgaccccagcagcctgagcttcaacatgtggaaagaaattcccatacctttctacctttctgtgtactttttcgacgtgatgaatccgagtgaaatcctaaagggggagaagcctcaggtaagagaacggggcccctacgtgtatagagaattcagacacaaatccaatatcacctttaacaacaacgacacagtgagtttcttggagtatcggacttttcaattccaacccagcaaaagtcatgggagtgaatcggactacatcgtcatgccaaatatactcgtgctgggggccgccgtcatgatggagaataaacccatgactctgaagctaatcatgacgttggccttcacaacgctgggtgaaagagccttcatgaaccgaacagtcggcgagatcatgtggggatacaaagacccacttgtgaatttaatcaataaatatttccccggtatgttcccgtttaaggataaatttgggctctttgccgaattgaataattctgatagcggactgttcacagtcttcacgggcgtccagaacatctcccggatccaccttgtggataagtggaatggcttgtccaaagtcgatttttggcattcagatcagtgtaacatgattaatggcacctcagggcaaatgtggcctccatttatgacccctgagtcctctctggaattctattcgcccgaagcctgtcgaagcatgaagctaatgtataaggaaagcggagttttcgaagggatccctacgtaccggttcgtcgctccaaaaacactcttcgcgaatggttcaatctatcctccaaatgagggattttgtccatgcttggaatccggcattcagaacgtatctacctgccgcttctcagcaccgctctttctttcacatccccattttctcaacgcagaccctgtcctcgctgaagccgtgaccggcttacatccgaaccaggaggctcactcactattcctcgacattcatcccgttaccggcatccctatgaactgctccgtgaagctgcagttgagcctctacatgaagtctgtagcaggaattgggcaaaccggaaagatcgaacccgtagtgctgcccctgctatggttcgctgagtccggagcaatggaaggagaaacattacatactttctacactcagctcgtacttatgcctaaggtgatgcactatgcacagtacgtactgctcgccctcgggtgtgtgctactgctagttcccgtgatttgccagattcgatcccaggttggggcaggacagcgtgccgcccgcgcagatagccattctctagcttgttggggcaaaggggcgtccgatagaacactttggcccaccgccgcatggagtccgccgcccgctgccgtgctcaggttatgccggtctgggtctgggcattgctggggtctcaggagtactctggcttcctttgcttgtcgggtggccacgactctgcctgttctcgagggcttggggccctctctcgggggtgggacgggtggcctgtag

SEQ ID NO: 204297 - DNA, 1539 bp, Artificial Sequence
  Description of Artificial Sequence: Synthetic coding sequence
atgaacgtgcggatcgaccccagcagcctgagcttcaacatgtggaaggagatccccattccgttctatctaagcgtgtacttctttgacgttatgaaccccagcgaaatcctgaagggggaaaaaccacaggtgcgggagagaggaccttacgtatatcgggagttccggcataaaagcaatatcacgtttaacaacaatgacaccgtctcgttcctggaatacagaacgttccagttccagccctcaaaatctcacggaagtgaaagtgactacatcgttatgcctaatatcctggtgctgggagccgccgtgatgatggagaataaacctatgaccctcaagcttattatgacactagcttttactacgctgggcgaaagagcttttatgaaccgtacagtgggggaaataatgtgggggtacaaggatccactggtcaaccttattaataaatacttcccgggtatgttcccttttaaagataaattcggacttttcgccgaactcaataattcagacagtgggctgttcacggtgtttactggagttcagaatatttctagaatccacctcgtggacaagtggaacggcctctccaaagtggacttttggcactcggaccaatgtaacatgatcaatgggacttccggacagatgtggcccccctttatgacgcccgagagctctttggagttctattctccggaggcgtgccgaagtatgaagttaatgtataaagaaagtggagtgtttgaagggattccaacctacagattcgtggcacctaagactctttttgctaacggttctatctatcctcctaacgaagggttctgtccttgtttggagagtgggatacagaatgtttcgacatgtagattctcggctccgctgtttctgtctcacccccacttcctgaatgccgatccagtgctggcagaagctgtcacaggactccatcccaatcaggaggcgcactctctcttcctcgatatccacccagtgacaggtatccccatgaattgctctgtaaaactccagctgtccctatatatgaagtccgtcgccgggattggtcaaaccggcaagattgaacctgtggttctcccactgctatggtttgcggaaagcggagccatggaaggcgagactttacatacattctacacacagttggtgctcatgcccaaggtgatgcactatgctcagtatgtgctgcttgccttagggtgcgttcttttgctggtacctgtaatctgccagattaggtcccaggttggggccggccagagagctgctcgggccgactcccattccctagcctgctggggcaaaggcgcttccgacaggaccctctggccaaccgccgcctggtccccgccgcctgccgccgtgctgcgcctgtgcagatccggttccggccactgttggggcctgagaagcaccctggccagcttcgcgtgtcgggttgccaccaccctgccagtactggaagggctgggtccgagccttggaggaggcacaggtggcctgtag

SEQ ID NO: 204298 - DNA, 441 bp, Artificial Sequence
  Description of Artificial Sequence: Synthetic coding sequence
atgggctgcagcgccaaggcccggtgggccgccggcgccctgggcgtggccggtctgctgtgtgctgtgttaggagccgttatgatcgttatggtcccatcgctgatcaagcagcaagtgttgaaaaacgtccgaattgacccctcaagtttgagcttcaatatgtggaaggagatcccaataccgttttacctgtcagtctacttcttcgatgtgatgaatccctccgagatcctgaaaggggaaaagccgcaggtgagagaaagggggccctacgtgtacagggagttccgacacaaatctaacatcacatttaacaacaacgacaccgtgtcatttttggagtaccggactttccagttccaaccttccaagtcccacgggtcagaaagtgactacatagtcatgcccaacatattggtccttgttaggctcccttag

SEQ ID NO: 204299 - DNA, 1446 bp, Artificial Sequence
  Description of Artificial Sequence: Synthetic coding sequence
atgggctgcagcgccaaggcccggtgggccgccggcgccctgggcgtggcaggacttctttgtgctgtgctaggcgccgtcatgatagtcatggtcccatctctaataaagcaacaggtgcttaagaacgtgagaattgacccaagctctctgtctttcaatatgtggaaagaaatccctatacccttttacctctctgtttacttcttcgacgtaatgaacccctccgaaatcctcaagggtgagaaacctcaggtacgagaaagaggtccttacgtgtatcgcgaattcaggcataagtctaacatcacatttaacaataacgatacagtgtctttcctggagtatcgaacttttcagttccaacctagtaagtcccacggaagcgaaagtgactacatcgtgatgcccaacatcctcgttcttggagccgcagttatgatggagaacaagccgatgaccttaaaactcatcatgactttagcatttacaaccttaggggagagggcttttatgaatagaacagtgggggagatcatgtggggatataaggatcctttagtcaacctgatcaacaagtactttccgggtatgttccctttcaaagataagttcggactcttcgctgagctcaataattctgattcaggtctctttacagttttcactggcgtccagaacattagtcggatccatcttgttgataaatggaatggcctgagtaaggtcgacttctggcactcggaccagtgtaacatgatcaacggcacctctggccagatgtggccaccctttatgactcccgaatccagtttggagttctacagccccgaggcttgtcgtagtatgaagcttatgtataaggagagtggagtttttgagggaatacctacctataggttcgtggcgcctaagacattgttcgctaatgggtccatttatccacctaatgaggggttctgcccctgtctggagtcaggaattcagaacgtctcaacctgccggttctcagcacctttattcctaagtcatccccatttcctcaacgctgatcccgttctggctgaagccgtcactggcctacaccccaatcaagaggctcacagtctcttcctggatatacatcctgtgacgggcatacccatgaattgctccgtaaagctccaactgtcactttatatgaagtcggtggcaggcatcgggcagacaggcaaaattgaaccggttgtgttacctctgttatggtttgccgagtctggtgccatggaaggcgaaaccctgcacactttctacacgcagttggtgttgatgccaaaagagaagtgttacctgttttggtccagttccaagaagggcagtaaagacaaggaagccattcaagcgtattcagaatctctaatgacctccgcccccaagggatccgtgctccaggaagccaaactgtag

SEQ ID NO: 204300 - DNA, 1437 bp, Artificial Sequence
  Description of Artificial Sequence: Synthetic coding sequence
atgggccggtgctgcttctacaccgccggcaccctgagcctgctgctcctggtaacaagcgtaacactactggtggctagggtgtttcaaaaggctgtcgaccagtctattgagaaaaaaatcgtgctgcgtaacggcacggaggcattcgattcatgggaaaaacctcctctgcccgtctatacccagttctatttctttaacgtgacgaaccccgaggagatcctcaggggtgagactccccgagtggaggaagttggaccttacacctatagagaacttaggaataaagccaacatccagttcggcgataatggaactacgatcagtgccgtgtctaacaaagcttacgtttttgaacgcgaccagtctgtgggcgacccaaaaattgaccttattaggacccttaatatcccggtgctgactgtgattgaatggtcccaggtccatttcctaagggagatcatcgaagccatgttaaaagcttaccagcagaagctttttgtcacacacaccgtggatgagctcttgtggggctacaaggacgagattctatccttaattcatgtttttaggccagacatctcgccctatttcggcttattctatgagaagaatggcaccaacgacggcgattatgtcttcctcactggcgaggattcttacctcaatttcaccaagatcgtcgagtggaacggcaaaacctcgttggattggtggattactgacaaatgcaatatgatcaacggcaccgatggggatagcttccacccattgataaccaaagacgaagtcttgtacgtgttccccagtgatttctgtcgctcagtatacatcacgttcagcgactatgagtccgttcagggcctacctgcctttagatataaggtgcccgctgagattcttgcaaacactagtgataacgccggcttttgcatccctgaaggcaattgtctgggatctggcgtgctgaacgtcagtatatgtaagaacggcgctccaattatcatgtcgtttcctcacttctaccaggctgacgaaagattcgtcagcgcgatagaaggcatgcacccgaaccaagaggatcatgagacattcgtggacatcaaccccctgactggaatcatcctcaaagccgctaagagatttcagattaacatttacgtgaagaaacttgacgattttgtcgagactggggatatacgcaccatggtttttcccgttatgtatctgaacgagtccgtgcatattgataaagaaacagctagccggctcaagtcaatgattaacaccactttgattatcacaaacatcccctacataattatggctttaggggtgttttttggcctcgtattcacctggctcgcatgtaaaggacagggctccatggatgagggtaccgccgatgaacgagcccctctcattaggacttag

SEQ ID NO: 204301 - DNA, 1710 bp, Artificial Sequence
  Description of Artificial Sequence: Synthetic coding sequence
atgggcctgggcctgctgctgcccctgctgctgctgtggacccggggcactcagggttctgaattggaccccaaagggcagcacgtgtgcgtcgcaagttcaccttccgcagagctgcagtgctgtgctgggtggcgccagaaggatcaggaatgtactattcctatttgcgaaggccctgacgcatgccagaaggacgaggtatgcgtgaaaccaggactctgccgctgcaaaccaggatttttcggcgcccattgctccagccgctgccccgggcagtattgggggcccgactgtagagagtcttgtccatgccaccctcatggccagtgtgagccagccaccggagcttgtcagtgtcaagcagaccgctggggtgctcggtgcgaatttccttgtgcttgtggcccacatggtcggtgcgacccagccactggcgtgtgtcactgcgagcccggctggtggtcaagtacatgccgccgcccctgtcagtgtaatacggccgcggctaggtgcgaacaagctactggtgcttgtgtgtgtaagccaggctggtggggccgacgctgttcctttaggtgtaattgtcacggtagcccgtgcgaacaggactcaggacgctgtgcctgcaggccaggttggtgggggccagaatgccagcagcaatgcgagtgcgtccgggggcggtgctcagccgcatcgggtgagtgtacgtgcccccccgggtttcgaggagcccgctgtgagctgccctgccccgccggatctcacggggtgcagtgtgcccactcatgcggccggtgcaagcataatgagccatgcagcccagacaccggttcttgcgagtcttgcgagcccgggtggaatgggactcagtgtcagcagccttgcttgcccggcaccttcggcgagtcctgcgagcaacagtgccctcactgcaggcacggggaggcttgtgagcccgacaccggccactgccagcgatgcgatcctggttggcttggaccgaggtgtgaggatccctgtccaactgggaccttcggcgaagattgtggcagcacatgcccgacatgcgtgcagggttcctgtgacaccgtgacaggagactgcgtttgttcggctggctattggggaccttcatgcaacgcctcctgccctgcgggattccacgggaacaattgcagcgttccatgcgagtgtcctgagggactctgtcaccctgtctctggcagctgtcaacccggctctggaagtcgagacactgctctgatagccggtagtctggttccactgctgttactgtttctcgggcttgcttgctgtgcctgctgctgctgggccccacgatccgacttgaaggatcgccccgcccgggacggggcaaccgtctccagaatgaagctccaagtttggggaaccctcacctcgctgggaagcacccttccctgccggtctctctcaagccataagcttccctgggtcacggcatcatcctctcgcccgctgcccgcaggacccttgatgacacctagccatccaatcctcagcttggagagacagatgaggttcttacccacggtttgtcatccaaagaaggggtggtctctttggccccggcagggacggcagaggcccgcgtggctgcaggtcctgtcacgaccgctgagaaccccaccacgccacagcccatctagagctccccctgcctag

SEQ ID NO: 204302 - DNA, 2613 bp, Artificial Sequence
  Description of Artificial Sequence: Synthetic coding sequence
atggagggcgccggcccccggggcgccggccccgcccggcggcggggggccggtggccccccgagtccactgcttccttcattgctcctcttgctcctactctggatgttgcccgatacagtcgccccacaggagctgaaccccagaggcagaaacgtatgccgggcgcctggatcccaggtgcccacatgttgcgccgggtggagacaacagggtgatgagtgcggaattgctgtttgtgaaggtaattccacctgctcggagaatgaagtgtgtgtccgccccggggaatgcagatgcaggcacggttattttggggcgaattgtgacacgaaatgtcctcgacagttttgggggccagactgtaaggaactgtgtagctgtcacccccacggacagtgcgaggatgtgacaggccagtgcacttgtcacgcacggaggtggggggcaaggtgcgaacacgcctgccaatgccagcacgggacttgtcatccacggtcaggcgcttgccgatgtgagccaggatggtggggagcgcaatgtgcatcagcctgctattgctccgccacttccagatgcgatcctcagaccggcgcatgcctatgccacgcaggatggtggggacgaagttgcaataatcaatgcgcttgtaactcttcgccatgcgagcaacaatccggtagatgccagtgtcgcgagcgtacattcggagccagatgcgacagatattgccagtgctttcgaggccgctgtcaccccgttgatgggacttgcgcgtgcgagcctggttaccgcgggaagtattgcagggagccctgccctgctggcttctacggcctcggctgtcgtcgccgatgtggccagtgcaagggacaacagccctgcaccgtcgccgagggaaggtgcctaacctgcgaacccggttggaacggtaccaagtgtgatcagccttgtgcgaccgggttttacggggagggctgcagccatagatgtcccccttgcagggacggacacgcctgtaaccacgtgacgggcaagtgcacaaggtgcaacgccggctggattggtgatcgctgcgaaaccaagtgctcaaatggcacatacggggaagactgcgcctttgtatgtgccgattgcggatcgggccactgtgactttcagagtggacggtgcctttgctctccgggggtacatgggccccactgcaatgtgacttgtccccccggcctacacggtgcagattgtgctcaggcttgttcatgccacgaggacacctgcgatccagttacaggggcctgccacttggaaactaatcaacggaagggcgtaatgggcgccggtgccctgctggtgctgctggtatgcctgttgctttccctgttagggtgttgctgtgcttgtagaggcaaggatcccactcggcgacctcgccccagaagagaactcagcttagggcgcaagaaagcacctcacaggctgtgtggaagatttagtagaatttccatgaaattacctagaatacctctgcgccgacaaaagctacctaaggtggtcgtcgcccatcatgacttggataatactcttaactgttctttcctggaaccacctagcggtctggagcagccctcgccatcttggtccagtcgggcatctttctcttcctttgacacaaccgatgaggggccggtgtattgtgtcccccacgaagaagcccctgcagagagcagggaccccgaggtgcctacagtgccagctgaagcccccgcaccgagccccgtgccgcttaccacacctgccagcgccgaggaggcaatccctctgcctgcaagcagcgatagcgaacggagtgcctcatccgttgaaggaccaggaggggcattgtacgccagggtggccaggcgagaggcaagacccgctcgagcacggggagagattggagggctgagcctgtctccaagtccggagcggcggaaaccgccacccccagatccggccacgaaacccaaagtaagttggatccatgggaagcactctgccgctgcagccggccgcgccccatctcctcccccacctggctctgaggccgccccatcaccaagtaagcgtaagcgcactccttccgataagtctgcgcatactgtcgaacacggatctcccaggacacgtgatcctaccccccggcccccaggccttcccgaggaggccactgcattagcggccccgtccccaccacgagcaagggcccgtgcagccccccgccccctaggcgcccacggacggcggcgatctccagctaagcgggccgaggcagcttctatgctggctgccgacgtgcggggcaaaacacgcagccttgggcgtgctgaggttgctctgggagcccagggcccaagggaaaaaccggcaccaccccagaaggccaagaggtcagtccccccagcgtcgcctgccagggcacctccagccaccgaaaccccgggccccgagaaggcggctacggatctgcctgctccggagactccccgcaaaaaaacacctatacagaagcctcctcggaagaaatcaagagaagctgccggagagcttgggcgggctggcgctcctactctctag

SEQ ID NO: 204303 - DNA, 2493 bp, Artificial Sequence
  Description of Artificial Sequence: Synthetic coding sequence
atgggcctgggcctgctgctgcccctgctgctgctgtggacccggggaactcaaggatcagagttggatccaaaagggcagcatgtctgtgtggccagctctccgtcagcagaactccagtgctgcgccggctggagacagaaggaccaggaatgcacaattcccatctgtgaaggtcccgacgcctgccagaaagatgaagtatgcgtgaaaccaggtttatgcaggtgcaagcccggattcttcggtgcccattgcagttctcggtgccccggccagtattgggggcccgattgcagggagagctgtccgtgccacccacatggacagtgcgagcctgccacaggggcttgccagtgccaggctgataggtggggcgcacgctgcgaattcccttgtgcctgcggaccgcacggcaggtgtgaccctgctaccggcgtctgtcattgcgaacccggctggtggagttccacctgccggcgtccttgtcagtgcaataccgccgcggcccgctgcgagcaggcaaccggagcatgtgtgtgcaaaccaggctggtggggccgccgttgttccttccgttgtaattgccacggcagtccctgcgagcaggactccggccgttgcgcttgtcgcccagggtggtggggtccagagtgtcagcagcagtgtgagtgtgtacgcggtcggtgtagtgcagcctccggagagtgtacttgcccccccgggttcagaggggctaggtgcgagctcccttgtccagcgggttctcacggagtgcagtgtgcgcatagttgcgggcggtgtaaacacaatgaaccatgctctcctgacaccggcagctgcgaaagttgcgaacctggatggaatggcactcagtgtcaacagccatgcctgccaggtacgttcggtgaaagctgcgagcagcagtgccctcactgcagacatggcgaagcttgcgagcctgacacagggcactgccagagatgtgacccgggctggctcggtccgcggtgtgaggacccctgcccaactggcacttttggagaggactgcggctctacgtgtcccacctgtgtacagggaagctgcgataccgtcacaggagattgcgtgtgctctgcgggctattggggtcccagctgtaatgcatcatgtcctgccgggtttcatggaaacaactgtagcgttccttgtgagtgcccagaagggctgtgtcatccagtgtctggatcttgtcagccagggtccggcagccgggataccgcactgattgccggttcacttgtgccactgttgctcctattcctgggtctcgcttgctgtgcttgttgttgctgggctccccggtctgatctgaaggatcgtcccgcccgagatggcgccactgtgtcccggatgaagctccaggtctggggaaccctgactagtttaggctctacgctaccatgccgcagcctgtctagccacaagctcccatgggtcaccgtaagccaccacgatcctgaagtcccattcaaccactcttttatcgaaccccccagtgccggatgggctactgatgatagcttctcctccgatcccgagtctggggaagccgatgaagtccctgcttattgcgtgcccccccaagagggtatggtgccagtggcccaagccgggtcctccgaagcatcactggctgccggcgccttccctccacctgaagacgcctctactcctttcgcaatccctcgaactagctccctcgctcgcgctaaaagaccatcagtgtcctttgccgagggaaccaagttcgccccccagtcacgcaggtcaagcggcgaactctcttcacccctgagaaaacccaagcgcctgtccagaggcgcccaatcagggccagagggcagagaagccgaggaaagcacagggcctgaggaggccgaagcacccgagtctttccccgcggccgcgtcacccggagactccgcgacagggcatcggcgtccccccctgggtgggcgcaccgtggctgaacacgtcgaggcgatcgaagggagtgtgcaagaaagtagcggacctgtgacaacaatctacatgcttgccggcaagccccgcggctctgagggaccagtgaggtctgtgtttaggcactttggatctttccagaagggacaggcagaagctaaagtaaaacgcgcaatcccaaagcctccccggcaggccctgaataggaaaaaagggtctcccgggctggcatctggatcagtcggacaatcgcccaacagtgcccctaaagccggattgccaggggcgactggacctatggccgtgaggcccgaggaagcagtccgcggtctgggggccggtaccgaatcctcacgtcgtgcacaggaaccagtctctggttgcggcagtccagagcaggatccacagaagcaagccgaggaggagcgacaggaagagccagagtacgaaaatgttgtgccaatctctcgacctcctgagccttag

SEQ ID NO: 204304 - DNA, 2235 bp, Artificial Sequence
  Description of Artificial Sequence: Synthetic coding sequence
atgggcctgggcctgctgctgcccctgctgctgctgtggacccggggaactcagggttcagaactcgaccccaaaggccagcacgtttgtgtagcatcatccccgagtgcagaacttcaatgttgtgctggatggcgacagaaagatcaggagtgtaccatcccaatatgtgagggtccggacgcctgccaaaaggatgaggtgtgcgttaagccagggctgtgtcgttgtaagcccggtttctttggcgcacactgctctagtcggtgccctggccagtattgggggccagactgtagggagtcttgcccatgccacccgcatggccaatgcgagcccgctacaggtgcttgccagtgccaggcggataggtggggagcacgttgtgagtttccatgcgcgtgcggcccccacggtaggtgtgaccccgctaccggagtctgccattgtgagcccggatggtggagttctacttgtcgtcgaccttgccagtgcaatacagctgccgctaggtgtgaacaggcaaccggcgcgtgtgtgtgcaagccaggctggtgggggcgccgctgtagctttcggtgtaattgtcacggaagtccttgtgaacaggacagtgggcggtgtgcatgccgcccgggctggtggggacctgagtgtcagcagcaatgtgaatgcgtacgcggtaggtgtagcgctgcaagcggcgagtgcacttgtccaccagggttcaggggggcccggtgcgagctaccgtgccctgccggctcccatggggtgcagtgtgctcatagttgcgggcgatgtaagcacaatgaaccctgtagtcctgacactggctcctgtgaaagttgtgagcctggatggaacggaactcagtgccagcagccctgtctacctggaacctttggagaatcatgtgaacaacagtgtccacattgtcgccacggtgaggcctgtgaacctgacaccggtcactgccagcgatgctccggcagccgtgacacagcattgatcgcagggagccttgtcccgctgcttcttctgttcctgggcttggcctgttgcgcatgctgctgctgggcacccaggtccgacctgaaggataggccggcacgagacggagccacggtgagcaggatgaagctccaggtgtggggcacgctgacgagcttgggctcaaccttgccctgccgctccctctcctctcataaactgccctgggtgaccgtgtcgcaccacgatccagaggtacccttcaatcatagcttcattgagccaccttcggccggctgggccaccgacgattcgttttcctcggatcccgaatctggcgaagctgatgaagtcccagcctattgcgttcccccccaggaaggaatggttccagttgcacaggctggctcctctgaggcgagtctggctgcaggcgcttttcccccccccgaagacgcttcaacgccatttgccatcccaaggacaagctcgctggctcgcgccaagagaccctccgtcagctttgcagagggcacaaaatttgcaccgcaatctaggcgaagttcaggcgagctctctagccctttgaggaagcccaagcgtcttagcagaggcgcgcagtccgggcccgagggacgggaagccgaggaaagtacgggacccgaagaggccgaagcccccgaatctttccctgcagccgcctcccccggggacagtgccaccggccaccgcaggcctccgctgggtggcaggacagtggccgaacatgtggaagcaatcgaggggtccgtccaggaatcctctgggccagtgaccactatttacatgctggccgggaagccccggggatctgagggccccgtgagaagcgtgtttcgccattttggcagcttccaaaaggggcaggctgaggctaaggtgaaaagggccatccctaagcccccaaggcaggcactgaatcgcaagaaaggctctccgggcctggcaagcggtagtgtgggacagagtccaaacagcgctcccaaagcagggctgccaggtgctaccggccctatggccgttcgtccggaagaagccgtgcgtggcctcggagcaggtaccgaaagcagtagaagggctcaggaacccgtctctggctgcggcagcccggaacaggatccacagaagcaggctgaagaggagcgacaggaagaaccagaatacgagaatgtcgtgccgattagccgcccgcccgagccgtag

SEQ ID NO: 204305 - DNA, 1710 bp, Artificial Sequence
  Description of Artificial Sequence: Synthetic coding sequence
atgggcctgggcctgctgctgcccctgctgctgctgtggacccggggaacccagggaagcgagcttgatcctaaaggtcagcacgtctgtgtggcctcctctcctagcgctgagctacagtgctgtgccgggtggcgccagaaagatcaggagtgtacgatccccatctgtgaagggcctgatgcgtgccagaaggacgaggtgtgcgtcaagcctggactgtgccgctgcaagccaggattttttggtgcgcactgtagctctaggtgtccgggccagtattggggtccagattgcagggagagttgcccatgtcacccacatgggcaatgcgagcctgctaccggcgcatgccagtgccaggcggatcgctggggcgcaagatgcgaattcccctgtgcctgtggccctcacgggcggtgtgaccctgccaccggagtctgccattgtgagccggggtggtggtcgagcacctgtcggcggccttgccaatgcaacaccgcggcggcacgctgcgagcaggctacaggggcctgtgtgtgtaagcctggctggtggggacggaggtgtagcttccgatgcaattgccacgggagtccctgcgaacaggattccggacggtgtgcttgtcgccctggctggtggggccccgagtgccaacagcaatgcgagtgtgtgagaggacgctgctctgccgcatccggcgagtgcacatgccccccaggctttcgcggcgcccgctgtgagctcccctgtcctgccggatcccacggtgtccagtgcgcccattcctgcgggcgctgcaagcacaatgagccctgttcacccgatacggggagctgcgagtcttgcgagcccgggtggaacggcacacagtgccaacagccctgcctcccgggaaccttcggtgaaagctgcgagcagcagtgtccacattgtcggcatggtgaagcctgcgaacctgatactggacactgccaaagatgtgatccagggtggctggggcccaggtgcgaagacccttgtccgaccgggacattcggcgaggactgtgggagtacttgccccacatgtgtgcagggctcatgtgatactgtgaccggcgactgtgtctgctccgcaggctactggggtcctagctgcaacgccagttgtcccgctggcttccacggcaacaactgcagcgttccttgcgagtgtcccgagggactctgccatccagtaagcgggagctgtcagccaggaagtggatcacgggacaccgcattgattgctggcagtttagtacctcttctgttgcttttccttgggttagcttgctgtgcatgttgctgctgggcacctaggtctgatctgaaggataggccagcccgcgacggcgccacagtgtcgcggatgaaactgcaggtgtggggaactctgacttccctgggctccacactgccctgccgttctctctcttctcacaagttgccctgggtgacggccagctcctcccgtccccttcccgccggtccgttaatgaccccttcccatcctattctcagccttgagcgccagatgcgcttcctgcctaccgtctgccaccccaaaaagggctggtctctatggccacgacagggcaggcaacgcccagcctggctccaggttctgagccgtcccctgcgtacgcctcctagacattcccctagccgggcaccgcctgcttag

SEQ ID NO: 204306 - DNA, 2595 bp, Artificial Sequence
  Description of Artificial Sequence: Synthetic coding sequence
atggagggcgccggcccccggggcgccggccccgcccggcggcggggagcaggaggacccccaagtcccctgctgccttccttgttactgttacttttgctgtggatgctgccagacacagtggcacctcaggaactcaacccaagagggcgcaacgtttgccgcgcccccggcagtcaagttcctacttgctgtgctgggtggcgtcagcagggggatgaatgtgggatcgcagtttgtgagggaaactccacctgctctgagaacgaggtctgtgtgcgccctggggagtgtaggtgcaggcacggttatttcggggccaattgtgacacaaaatgtcctagacagttctggggaccggactgcaaggaactctgcagctgtcatccacacggacagtgcgaggacgttaccggccagtgcacatgtcatgctcgtcgatggggcgcaaggtgtgagcacgcctgccagtgtcaacatggcacatgtcatcctaggtccggggcttgccgatgcgagcccggatggtggggcgctcagtgcgccagcgcttgttattgtagtgccacctcacgatgcgacccacagacaggggcctgcctatgtcatgctggttggtggggccgctcctgcaataaccagtgcgcctgtaactcgtcaccctgtgagcagcaatccggccgttgtcagtgtagagagcgcacctttggagccaggtgcgatcgatattgccagtgctttcgtggcaggtgccatccagtcgacggcacctgcgcgtgtgagccaggataccgcggaaaatactgtagagagccgtgcccagcaggcttttatggtttagggtgccgtcggcgctgtgggcaatgcaaaggccagcagccctgcaccgtggccgagggccggtgcctgacctgcgagcccgggtggaatggcactaagtgtgatcagccgtgcgcaacgggattctatggcgagggctgttcccaccggtgccccccttgtcgggatgggcacgcttgcaaccatgttacagggaagtgcacgagatgcaatgccggatggatcggggacagatgcgaaacgaagtgttcaaacggcacgtacggggaggactgcgcctttgtgtgcgctgattgcggaagcgggcattgcgatttccaaagtggccgatgcctctgttcacccggggtccacgggcctcattgtaacgtgacatgcccacctggattacatggagcagattgcgcacaagcctgcagttgccacgaggatacctgtgatcctgttaccggggcttgtcatctggagaccaatcaaaggaagggcgttatgggcgctggagctctgctggtgctactggtgtgcctgcttctgagtttgcttggctgctgctgcgcatgccgtgggaaagatccgacccggcgggagttatccctgggtcgaaaaaaggcaccccacagactgtgtggccgtttcagcaggatcagcatgaagttgccgagaatccccctgcggaggcagaaactgccaaaagtggtagttgcccatcatgacctggataatacacttaattgttcattcctggaacctccaagtggcttggagcaaccctcaccatcttggtcaagccgggctagtttttcctccttcgatacaaccgatgaaggacctgtctactgtgtacctcacgaggaagctccggccgaatctcgggaccccgaagtccccactgtgcctgctgaggctccagctccttcacccgttccccttacaactcccgccagcgcagaggaggcgattccactgcccgcatcaagtgactcagagcgcagcgctagctccgtcgaaggcccaggtggcgcactctacgctcgcgtcgcacgccgggaagcgcggccagctagagccaggggcgagatcgggggcttgtctcttagcccctcccccgaacgacgaaagccaccacctcccgacccggctactaagcccaaagtcagctggatccatggtaaacactctgctgctgctgccggccgtgcgccatctccaccaccgcctggaagcgaggcagccccctccccatccaagagaaagcgtacgccatcagacaagagtgcgcacacggtggagcatgggagcccaagaacccgcgaccccacgccgaggcctccagggttgcctgaggaagccactgccctggccgcgccgagtcctccacgcgcccgcgcccgtgcaaggccaggtctcctcgagcctactgatgctggggggccccccagaagtgcacctgcagcttcgatgttggcagccgacgtgcgcggtaaaacgcggagcctcggccgcgccgaggttgctttgggagcgcagggcccaagagagaagcccgcccctccccagaaggccaaacgctccgtccctccggcatcgcctgccagggctccacccgctactgaaacgcctgggcccgaaaaggcggccaccgaccttcccgccccagaaaccccaaggaagaaaacccctatacagaaaccccccagaaagaagtcccgggaggccgcgggagagttgggccgcgcaggtgcccctacattatag

SEQ ID NO: 204307 - DNA, 2598 bp, Artificial Sequence
  Description of Artificial Sequence: Synthetic coding sequence
atggagggcgccggcccccggggcgccggccccgcccggcggcggggagcaggagggccccccagccctctcctcccctcactcttgctgctgcttttgttgtggatgctgcccgatacagtcgctcctcaggagctgaatccccgtgggcgtaacgtttgtcgggctcctgggtctcaggttcccacctgttgcgctggatggcggcagcagggcgatgagtgtggtatagctgtgtgcgagggaaattctacatgctccgagaacgaagtgtgcgtgagacccggggagtgcagatgcagacacggatacttcggggccaactgcgacacgaagtgcccacgtcagttttggggcccagattgtaaggagctctgctcatgtcatccgcatgggcagtgcgaggatgtaactggtcagtgtacctgccacgccaggcgctggggggccaggtgcgaacacgcctgtcagtgccaacacggcacatgtcacccacggagcggagcttgcaggtgcgagccaggatggtggggggcacagtgtgctagcgcatgctattgctccgccacttcgcgctgtgatccgcagacgggcgcttgcttgtgccatgcaggctggtggggtaggtcttgtaacaaccagtgcgcttgcaactctagtccttgtgaacagcagagcggtagatgtcagtgtagggaacgtaccttcggggcaagatgtgaccgttattgccagtgcttccggggaagatgccacccagtggacgggacttgtgcctgcgagcccggataccgaggcaagtactgccgagaaccttgtccagctggattctacggcttaggttgtcggcggcgttgcgggcaatgcaaagggcaacagccgtgtacagtggctgagggccgctgtctaacctgcgagcccggatggaatggcaccaagtgtgaccagccctgcgctaccggattctacggcgagggctgttcccacagatgtcccccttgcagggacgggcatgcatgcaatcacgttacaggcaagtgcacaaggtgcaatgccggttggattggtgacaggtgtgagaccaagtgctccaatggcacatacggagaagactgcgcattcgtgtgcgcggattgtgggtctggtcactgcgacttccagagcggaagatgtctctgttcccccggagtccacggacctcattgtaacgtcacatgcccccccggtttacacggcgccgattgtgctcaggcctgcagctgccacgaagatacctgcgacccggtaacgggtgcgtgtcaccttgaaacaaaccaacggaagggggtcatgggagcaggggcactcctggtacttttggtgtgtctcctgttgagcttgcttggatgctgttgcgcttgccgaggaaaggatccaactagaagagagctgagcttgggtcgcaaaaaagccccccatcgactgtgtggccggtttagccgcattagcatgaagctaccccgcatcccattgcgcaggcagaaattaccaaaagtggtcgtggctcaccatgatcttgacaacacacttaattgctcttttctggagcccccatctgggctcgaacagccttccccctcctggagctctagggccagcttcagcagcttcgatacaactgacgaggggccagtgtactgcgtgccgcacgaggaggccccagccgagtctcgagatcctgaagtacccacagtgcctgcggaagctcctgctccctcacccgtgcctctgaccactcccgcaagtgcggaagaggccattcctctccctgctagtagcgactccgagagaagcgcatctagcgtcgagggacccggaggagctttgtacgcccgagtggcaaggagagaggcaaggccggctcgcgcaagaggagagattgggggcctgagcctgagtccctcccctgagagacggaaaccccctcccccagacccagcgacgaaaccaaaagtctcatggatccacgggaagcactcggcagctgctgctggccgtgccccatcgccaccacctcccggttcagaagccgcacctagcccatctaaacgtaaacggacaccttctgataagtcggctcacaccgtggaacacggaagccctaggactcgcgaccctactccacgtccaccaggactccccgaagaggctactgcactagctgcacctagcccaccccgcgctcgcgccagagcagcgccccggcctctgggcgctcacgggcgccgaaggtctcctgccaagagggcagaagccgcctccatgctcgctgctgacgtgagaggcaagaccaggagccttggacgtgcagaggtggcactgggcgcacaggggcctcgggaaaagcctgcacctccccagaaggccaaacgctccgtgcctcccgcctcccctgcgcgtgcccctccagccaccgagacccctggccccgagaaggctgccaccgacttacctgccccagaaacaccccggaaaaagacgccgatccaaaaacccccacgcaaaaagagtagagaggcagctggggagctcggtagggcaggcgcccctaccttgtag

SEQ ID NO: 204308 - DNA, 1728 bp, Artificial Sequence
  Description of Artificial Sequence: Synthetic coding sequence
atgcacaaggaggccgagatgctgatcggcccccagctggacgagaagaggtggggatggagactgggtgacgggtcagcggcacctccattcttaccacaggccttatccttccttctgcttctccctctggcctctgccttgcagccaaccccactgccctttcaggaacttaggctagtggggggccctagtcgatgccggggaaggctcgaggtcatgcacggcggaagctgggggagcgtttgtgacgacgactgggatgtggtggacgctaacgtggtctgccggcagctcggatgcggcctcgcgctgcctgttcctagaccactggcctttgggcaagggaggggtcccatactgttggacaacgtcgagtgccggggccaggaagcagctctctctgaatgcggctctagagggtggggcgtccacaattgtttccattatgaagatgtagcagttctgtgtgacgagttcctcccaactcaaccaccgaccaggaagatgttgacatcacgagcgcccccgactaccctgccgaatggtaagtccgaaggttcagttaggttggtaggcggggcgaacctttgccaaggcagggtggagatactgcatagtggcctctggggcacagtttgcgacgacgattgggggcttcccgacgccgccgtggtgtgccgacagctggggtgcggagcagcaatggccgccacaaccaacgccttcttcgggtatggcaccggacacattttgctagataatgtgcattgtgagggaggggagcccaggctcgcagcctgtcaaagtctgggctggggagtccacaattgtggccaccacgaagacgcaggcgctctctgtgccggacttggccctcccacccttacagcactcccctcttcggccactagggaagattgggcttggcagacagatcccagcgctaccggagtgggcccacagcctagccgagaaactgctttgttgacaacggctgcttgggcagccggtaaaaaaagtgggagattacgcttggtaggggggcctggcccatgtcggggccgcgtggaagtcctccatgctggtggttggggcactgtgtgtgatgatgattgggacttcgctgacgccagagtggcctgccgggaagctggatgtggtcctgctcttggtgctacaggcctggggcacttcggctatggaagagggccagtcctcctggataacgtgggttgcgccggaaccgaagctcgcctcagcgattgtttccaccttggctggggtcaacataattgcgggcatcacgaagacgctggcgctctatgtgctggccccgaagagctgggcttacaggtccagcaggacggctctgagacaaccagagtacccactccacgccctcgggatggccacctcagactggtgaacggtgctcaccgatgtgagggcagagttgagctgtatctgggccaacggtggggcaccgtgtgtgacgacgcatgggacctaagagccgccggcgtgctgtgtagacagttaggatgtggtcaggcactcgctgctcccggcgaggctcatttcggcccaggccgtgggcccatcctccttgataacgtgaaatgccgcggggaagaatctgctctcttactctgctcacatattcggtgggacgcgcacaattgtgatcattcggaggacgcctcagtgctgtgccagccttcttag

SEQ ID NO: 204309 - DNA, 849 bp, Artificial Sequence
  Description of Artificial Sequence: Synthetic coding sequence
atgagcaacgtgaccctgcggaagatgagccccaccggcaacgagatgaaaagtaccacccagggaacaactagaaagcagcaggactttcatgaggttaacaagcgtcgcactttcttacaagataactcatggatcaagaagcggcctgaagaagagaaggatgagaactatggaagagtggttctgaatagacacaatagccacgatgcactggacaggaaggtgaatgaacgggatgtgcctaaggctaccatttctcgttactcatccgatgataccctagaccggtccatgagcatgttcagatctctggaagtgaccaagctgcagcccggtggtagcctgaatgctaatacatctaatacaatcgcttccacgtcagcaaccactcctgtgaagaagaagcgacagagctggttcccgccaccaccccccggatataacgcctcaagcagcaccgggactcggagaagggaacctggcgtccatccccctatcccacctaagccaagctctcctgtgtcctcacccaaccagcttaggcaggacaataggcagattcatccacccaagcctggggtgtatacagaaacaaatcggtctgcagagagaaatattagcgaggagctggataatctgattaaaatgaacaaatcccttaataggaatcagggcctggactccctatttcgggctaacccaaaagtggaagagcgcgaaaaaagagccaagtcactggagtccctgatctatatgagtacgaggacagacaaggacggcaagggtattcagagcctgggctcgccaatcaaagtgaaccagcgtaccgacaagaacgaaaagtag

SEQ ID NO: 204310 - DNA, 2067 bp, Artificial Sequence
  Description of Artificial Sequence: Synthetic coding sequence
atgagcaacgtgaccctgcggaagatgagccccaccggcaacgagatgaagtccacaacgcagggcaccacgcggaagcagcaagactttcacgaggttaacaagaggcgcacatttctccaggataacagttggattaagaaaaggcccgaggaggagaaggacgagaactacggacgcgtcgtcctgaataggcataactctcacgacgccctggatcggaaagtgaacgaaagagacgttccaaaagccacgattagtcgctactcctccgacgataccctcgaccggatcagtgatcgtaatgacgcggccaagacctacaaagcaaacactctggataaccagctgaccaataggtcgatgtcaatgttccggtctctagaggtcaccaagctccagccaggcggatcgctgaacgctaacactagcaatacaatcgcctcaaccagtgctactacaccagtcaagaaaaagcggcagagctggtttcccccccctccccccggatacaacgcctcctcatcaactggaactcgcagaagagaaccaggtgtgcaccctccaataccgcctaagcctagctctccagtaagttcacccaatcagctcagacaagacaatcggcagatacatcccccgaagcccggcgtttataccgaaaccaataggagtgcagaaaggaatataagatctcaggacctggataacatcgtgaaggtcgctacctccctgcagcgcagcgacaaaggggaggaactggacaatctgattaaaatgaataaaagcctgaatcgcaaccagggactagactctctgttcagggccaatccgaaggtagaggaaagagagaagcgggctaaatcactagaatccttgatatatatgtccactcggaccgataaggatggcaagggaattcaaagcctcggctcgcccattaaagtcaatcagaggactgacaagaatgaaaaaggtaggcagaacttagagtctgtggccaaggtcaacgcgcgaatgaataaaacgagtcgtcgctccgaggacctggacaacgcaacagaggtaaaccccaaaggccatgagaataccactggtaagaaagatctagacggcctcatcaaggtggaccctgagacgaataagaacattacgaggggccaaagtcttgataatcttatcaaggtgaccccagaggtcaaacggtctaatcagggcagcaaagacctcaacaatttcatcaaggtgtaccctggtactgaaaagagtacagagggaggacagtctctggattctctcatcaaagtaactccagagcgtaaccggacaaaccaaggtaatcaagatctggagaacttaatcaaggtgattcctagcgcaaacaagtcgagtgagcagggcctggacgaacatattaacgtgagcccgaaagctgtcaagaacaccgatggcaaacaggaccttgacaagctgatcaaggtcaatcctgaaatctttactaacaaccagcggaatcaagatcttgccaatctgatcaaagtgaacccggccgtaattaggaacaaccaatctcaggacctcgataaccttattaaagtgaagccgtcggcattgagaaacaccaaccgggaccagaaccttgaaaacctcatcgaggtgaacagtcatgtgtcagagaacaaaaacggctcttcaaatacaggggccaaacaggcaggacctcaggataccgtggtctacacaaggacttacgtggagaattcaaagtctcccaaggatgggtatcaggaaaatatatctggtaagtacattcagaccgtttacagtaccagtgatcgctcggtcatcgagcgggatatgtgcacctactgtcggaaacccctcggggtcgaaacaaagatgattctggacgaactacaaatctgctgccattcaacgtgcttcaaatgcgagatctgcaaacagcctctggaaaacttgcaggccggtgatagcatttggatctataggcaaacaatccattgtgaaccttgctattccaagatcatggccaagtggatcccgtag

SEQ ID NO: 204311 - DNA, 2007 bp, Artificial Sequence
  Description of Artificial Sequence: Synthetic coding sequence
atgagcaacgtgaccctgcggaagatgagccccaccggcaacgagatgaagtctacaacgcagggtaccacacgaaagcagcaagattttcacgaggtaaacaagcggagaacctttctccaggataactcatggattaaaaaacggccagaagaggagaaggacgagaattacggtcgcgtggtgctgaacaggcataatagccacgacgccctcgacaggaaggtgaatgaacgagacgtgccaaaggccaccatttctaggtattcgagcgatgatacccttgaccgaattagcgaccggaatgacgccgccaaaacatacaaggcaaacacacttgataaccaacttaccaaccgatccatgtctatgttccggagcctcgaggtgaccaagctccagccaggcggtagcctgaacgccaatacatctaacaccatcgcttcaacgtcggccaccacccctgtgaaaaagaaacgccaatcatggttccccccacccccaccaggctacaacgcgtccagctccaccggaacccgtagaagggaacctggcgtccatccacccataccccctaagccatccagccctgtgtcctcccctaaccagctgaggcaggataatagacaaatacatccaccaaaacccggcgtctataccgagactaacaggtcagcggaacgaaacatatcagaggagctcgataacctgatcaagatgaacaagagtctcaatcgaaatcagggactcgatagccttttcagagctaatcctaaggtggaggagcgcgaaaagcgagcaaagagcttggagagcctaatctacatgtccactcggaccgataaagatggcaaaggtatacagagccttggttccccaatcaaggtgaaccagagaacggacaagaacgagaaagggcgccagaatctggagtcagtggccaaggttaacgcccggatgaataaaacaagtaggcggtccgaggacctggataatgctactgaagtgaaccccaaaggacatgagaacactacaggcaagaaggatcttgatggtttgataaaggtggatcccgagacaaacaagaacattaccagagggcagagcctggacaacctgataaaagtcacaccggaggtgaagagatctaatcaggggagcaaggacctgaataacttcataaaagtataccccgggacagagaaatccactgagggggggcaatctcttgattcactcattaaagtgactccggagcgcaaccgcaccaatcagggaaaccaggacctggagaacttgattaaggttatccccagcgctaacaagagctctgagcagggactcgatgagcacataaatgtatccccaaaggccgtgaaaaacacagacggcaagcaggaccttgacaaactgatcaaggtcaaccctgaaatctttactaacaaccaacgcaaccaggatctggcaaatttaatcaaggtgaaccctgccgtcatacggaataaccagtcccaagacctagacaatctgatcaaagtgaagccaagcgccctgcgtaacactaatagggaccagaatctggaaaacctgatcgaggtcaattctcatgttagtgagaataagaacggatcatccaatactggcgcgaagcaggcaggcccacaagatacagttgtgtacacgcgaacctatgtcgagaatagcaaatctccgaaggatggataccaggagaacatctctggcaaatacatccaaacggtgtactctacttccgataggagcgtaattgagcgcgatatgtgcacttactgtagaaagccgctgggggtagagacgaagatgatcttggacgagctgcagatctgctgccatagtacctgtttcaaatgtgaaatttgcaagcagcccctggagaatttgcaagcgggcgattccatttggatctaccgacagaccattcattgcgaaccctgttatagcaaaatcatggcgaagtggatcccatag

SEQ ID NO: 204312 - DNA, 1941 bp, Artificial Sequence
  Description of Artificial Sequence: Synthetic coding sequence
atgagcaacgtgaccctgcggaagatgagccccaccggcaacgagatgaagagcactacccagggaacaacacgcaaacagcaggactttcacgaggtaaacaagagaaggacattcctgcaggacaatagctggataaagaagaggcctgaagaggagaaggatgagaattacgggagggttgtgcttaacagacacaattcccatgacgcccttgatcggaaagtgaacgagagagatgttcccaaggccactatcagtaggtatagttccgacgataccctcgatagaatctccgacagaaacgatgccgccaagacctacaaggctaacaccttggacaatcaacttacaaatcgctccatgagcatgtttagaagcctggaggtgacaaaactacagccaggcggtagccttaacgccaatacttctaatactatcgcatcaacaagcgccaccactccagtcaaaaagaaaagggaacccggagtgcaccccccaatccctcctaaacctagctctccagtttcatctcctaaccagctgcggcaggataacagacagatccatccacctaaaccaggcgtgtacactgagacaaatcggtccgccgaaaggaatatcaggtctcaggatctcgacaatatcgtcaaagtcgctacatctcttcaacggagcgacaagggcgaagaactagacaatctgatcaagatgaataaaagtctgaacaggaatcagggattggattctctcttccgggctaaccctaaagtggaagagagggagaagcgagctaagagcctggaatcgttgatttatatgtcaactcggactgacaaagacggtaagggaatccagagtctaggaagtcctattaaggtgaatcagcggacagataaaaatgagaaaggtcgccagaatctggaaagcgtcgcgaaggtcaacgcaagaatgaacaagacgtctcggaggtcggaggacctggacaatgcaaccgaggtgaaccctaaaggacacgaaaataccacaggtggccagtcactggacaatctaatcaaggtcactcctgaggtgaagcgaagcaatcagggttccaaagatctgaataatttcatcaaagtctaccctggaacagagaaatccaccgagggagggcagtccctagacagcctgatcaaggtcacccccgagagaaacagaactaatcaagggaaccaagatcttgagaatctcatcaaagtgataccctccgcaaataaaagtagtgagcagggcctggatgagcatatcaacgtaagtccaaaggcagtcaaaaatacagacggaaagcaggatcttgacaagctcatcaaagtgaaccctgagatcttcaccaacaaccagcgcaaccaggacttagcaaatctgataaaagtcaatcccgcagtgattcgcaacaaccagtcacaggatctcgacaacctgataaaggtgaagccatctgcattaaggaacaccaatcgagatcagaacctggaaaatttgattgaggtcaactcacacgtgtcggaaaacaagaacggctcctcaaacacaggggctaaacaggctggcccgcaggataccgtcgtttatacccggacttacgtggaaaacagcaaatctcctaaggatggataccaagagaacattagtgggaagtatatccagacagtgtactccaccagcgatcgatccgtgatcgagagggatatgtgtacatactgtagaaagcccttaggcgtggaaacaaagatgatcctagatgaactccaaatttgctgccacagtacttgcttcaaatgtgagatttgtaaacaaccccttgagaatctgcaggcaggcgacagcatatggatatacaggcagactatccattgtgaaccatgctattcgaagattatggccaaatggataccctag

SEQ ID NO: 204313 - DNA, 2148 bp, Artificial Sequence
  Description of Artificial Sequence: Synthetic coding sequence
atggcccgggagctgtaccacgaggagttcgcccgggccggcaagcaggccggtctgcaagtttggcgcattgagaaactggagctagtccccgttcctcagtctgctcacggggatttctacgtcggtgacgcttacctcgttctgcatactgctaaaacatcgagagggtttacttatcatcttcacttctggctgggaaaggagtgctcccaggacgagagcaccgccgctgcaatctttactgtccaaatggatgactatctggggggaaagccagtccagaaccgcgaactgcagggctacgagtcaaacgactttgtctcatatttcaagggaggattgaagtacaaggctggaggagtggcgagcggccttaaccatgtattaaccaatgatttgaccgccaagcgcctgttacatgtcaagggccgacgcgtggttcgtgccacagaggttcctctaagctgggactcctttaacaagggcgactgttttatcatagacctagggaccgagatttatcagtggtgcggatcatcctgcaacaagtatgagagactgaaggctaaccaagtagctaccggaatcagatacaatgaacgcaagggtagatccgagctgatcgtggtggaggagggatcggagccaagtgagctcattaaagtgcttggagagaagccagagttgcctgacggtggagacgacgatgatattattgccgatatctctaaccgcaaaatggcgaaactttacatggtgagtgacgcaagcggctctatgagggttacggtggtggccgaggaaaacccattcagcatggccatgttgttaagcgaggaatgcttcatcctggaccacggcgcggcgaagcaaatatttgtctggaagggtaaagatgcaaatccacaggaacgtaaagccgctatgaagaccgccgaggaatttcttcagcagatgaattacagcaagaatacgcagattcaagtgttacccgaaggaggagaaacacccattttcaagcagttcttcaaagactggcgggataaggaccaatctgatggttttggtaaggtgtacgtcactgagaaggttgcacagattaaacaaatcccctttgatgccagcaagctgcacagctcaccacagatggccgcccaacataacatggtagacgatggctccggcaaggtggagatctggcgcgttgagaataacgggcggattcaggtggatcaaaattcctacggggaattctatggtggcgactgttatatcatactctacacatacccgcgcggccagataatttacacatggcagggagccaatgctactcgggatgagttgacaacatcagccttcctgacagttcaacttgaccggtccttaggcgggcaggctgtgcagattagagtgagccagggcaaggaacccgttcacctactgtctctgtttaaagataagcccctgataatttacaagaacggcactagcaaaaagggaggccaggcgcctgcaccccccacgaggcttttccaagtgcggcgtaatctggcctcaattacccgaattgttgaggtcgatgtagacgcaaatagcctgaactcgaatgatgtgttcgttctcaagctgcctcagaacagtggctacatatgggttggcaagggcgcttcacaagaagaggaaaagggcgcagaatatgtggcttcggtgctgaagtgcaagacattgcgcatccaggaaggagaagaacccgaggaattttggaactctctgggcggcaagaaggattatcagacttcccctcttcttgagacccaggccgaagatcacccacccagactgtacgggtgtagcaacaaaaccgggaggttcgttatcgaggagatccctggcgaatttactcaggacgacctcgccgaggatgatgtgatgttactcgatgcatgggaacagatatttatttggatcggaaaggacgctaacgaggttgagaagaaagaatccctaaagtccgcaaagatgtacctcgagacagacccttccggacgagataagcggacacctatagtgatcatcaagcagggccacgagccccccaccttcactgggtggttcctgggttgggactcgtccaaatggtag

SEQ ID NO: 204314 - DNA, 1407 bp, Artificial Sequence
  Description of Artificial Sequence: Synthetic coding sequence
atggccaagctgtacatggtgagcgacgccagcggcagcatgcgggtcaccgtcgtggcagaggaaaacccattttcaatggctatgctgttaagcgaggagtgcttcatcctggaccatggagccgccaaacagatctttgtatggaagggtaaggatgctaatcctcaggagcggaaggcagccatgaagaccgccgaagaatttttacaacagatgaactacagtaagaatacgcagatccaagttctgccagaaggcggagagacgcctatcttcaaacagttctttaaagactggcgggataaggaccagtctgatggatttgggaaagtctatgttacagaaaaggtggctcaaatcaaacagattcccttcgacgcctctaaactgcattcaagcccccaaatggctgcacagcataacatggtagatgatggctctggcaaagttgagatctggagggtcgagaacaatggacgcatccaagtggaccagaattcatatggcgaattttacggaggggattgttacatcattctttacacatatccaaggggtcagatcatatatacctggcaaggagccaacgctactagagatgaactgacaacttctgccttcctgaccgtgcaacttgaccgttcccttggggggcaagcagttcagattcgagtttcccagggcaaggaacccgtgcatcttttaagcctcttcaaagacaaacctctgatcatttataaaaatgggaccagcaaaaagggaggccaagcgcccgcccctcccaccagactctttcaggtccggcgcaaccttgcctcaattaccagaatcgtggaagtggacgttgacgctaattcactgaactccaacgacgtgttcgtgctaaagcttccccagaattctgggtacatctgggttggaaagggagcttcacaagaagaggagaaaggggccgaatacgttgccagcgttctgaagtgcaaaactttgcggatccaggagggcgaggagccagaggagttctggaatagccttggtggcaaaaaagactaccaaacctctcccttactcgagactcaagctgaggaccacccaccaagactctatggatgctccaacaagaccggaaggtttgtgatcgaggagattcccggagagttcacacaggacgatctcgccgaagatgatgtcatgttgctggacgcgtgggaacagattttcatctggatagggaaggacgcgaatgaagtggaaaagaaagagtcgctaaagtccgcgaaaatgtacctggaaactgatcccagcgggagagacaaaagaacacccattgtaatcatcaagcaggggcatgagccaccaacatttacagggtggttcttgggttgggattcaagcaagtggtag

SEQ ID NO: 204315 - DNA, 1407 bp, Artificial Sequence
  Description of Artificial Sequence: Synthetic coding sequence
atggccaagctgtacatggtgagcgacgccagcggcagcatgcgggtgacagtcgtggcagaagaaaacccgttctcaatggccatgttgctgtccgaagagtgcttcatcctggatcacggagcagccaagcagatcttcgtctggaaaggtaaggacgctaatcctcaagagagaaaagccgccatgaaaacagctgaagaattcctgcagcagatgaactactccaagaatacacagattcaggtgctgcccgaaggaggtgaaacacccatctttaaacagttcttcaaggactggcgcgacaaggatcagtctgacggattcggaaaggtctatgttactgaaaaggtggcacagataaaacagattccttttgacgcctcaaaacttcacagtagcccccagatggcggcacagcataatatggtcgacgacggctcaggtaaggtcgagatctggcgggtcgaaaacaacgggcgtatccaagtggatcagaattcatatggggaattctacggcggagattgctacattatcctgtatacttatccaagggggcagattatatacacttggcaaggggctaatgctacacgtgatgagctaaccaccagtgccttcttgactgtgcaactggaccggagtttgggaggtcaggcagtgcaaatcagggtgtcacagggcaaagaaccagtgcacctcctgtccttattcaaggacaaaccactaattatatacaagaacggaacttccaaaaaaggcggccaagctcccgccccccctacacggctgtttcaggtccgaagaaaccttgccagcatcacaagaattgtcgaagtcgacgtagatgcaaactctttgaattccaatgatgtattcgtgcttaagctacctcaaaactctgggtacatttgggtggggaaaggcgcttcccaggaggaagaaaaaggggccgaatacgtagcctccgtgttaaaatgtaaaacactgcggatccaagagggcgaagagccagaagagttctggaactctttgggaggcaagaaagattatcagactagccccttgctcgagacccaagcagaggatcaccctccccgcctctacggctgtagtaacaaaacagggaggtttgtgatcgaagagataccgggtgagttcacccaggatgacttagcagaggacgatgtgatgctgttggatgcatgggaacagatttttatatggattggaaaggacgccaacgaggtcgaaaaaaaagagtctttgaaaagcgccaagatgtacctggagaccgatccttcaggccgtgataaacggacccctattgtgatcataaaacagggacacgaacccccaaccttcaccggctggttcctcgggtgggactcctccaagtggtag

SEQ ID NO: 204316 - DNA, 3864 bp, Artificial Sequence
  Description of Artificial Sequence: Synthetic coding sequence
atggagcccatctaccccttcgcccggccccagatgaacacccggtttccaagttcaaggatggtgccttttcatttccctccatcaaaatgtgcactgtggaaccccactcctactggtgactttatatacttgcacctatcttattaccgaaatccaaagctggttgtaaccgaaaagacgatacggttggcatatagacatgcaaaacagaataagaaaaattcgagttgctttctcctggggagcttaacggctgacgaagatgaggaaggagtaactctgaccgtggacaggttcgacccaggcagggaggtgcctgaatgcctcgagattactcccacggcgtccctgcccggtgatttcctgattccttgcaaggtccacactcaggagttgtgctcaagagagatgatagtgcatagtgtggacgatttttcctcagctttgaaagctctccaatgtcatatctgcagtaaagactcactcgattgcgggaagctcctgtcacttagggtacacatcaccagtcgagaatccctggacagcgtggagtttgatctgcactgggcagccgtgactctggcaaataatttcaagtgtactccagtgaaacccatcccgataatccccaccgcccttgccagaaacctgtccagcaatttgaacatttcccaggtgcagggcacctataagtatggatacttaaccatggatgaaacgcgtaagcttctgctccttctggagtcggacccaaaagtctatagtctacccctggtgggcatctggctttcagggatcacgcatatctatagtccgcaggtgtgggcatgctgtctgcgctatatctttaattcctccgtccaggaacgcgtgttttctgagagcggtaactttatcatcgttttgtattccatgacacacaaggagcctgaattttacgagtgcttcccctgcgatggtaaaatccctgactttaggttccagctgctcacatcgaaagagacactacacctgttcaaaaatgtcgagccacccgacaaaaaccccatccggtgtgagctctccgcagagagccagaacgcggaaacggagttctttagtaaggccagcaaaaatttctccatcaaaagatccagccagaaactgagctctggcaaaatgccaattcatgaccatgacagcggcgttgaggacgaagacttctccccgaggccgattccatctccacatcctgtttcgcagaagatttcgaagatccaaccaagcgtgccggagctgtctctggttcttgacggaaacttcattgagagtaacccacttcctacaccactggagatggtcaacaatgaaaatcccccactaattaatcacctggagcatctcaagccactccagccccagctgtacgacgaaaagcactcccccgaagtggaggctggtgagcctagcttgcgcgggatcccaaatcagcttaaccaggacaagcctgcactcctgcgccactgcaaggttcggcaaccacccgcttataaaaaggggaatccacatacccggaactctatcaagcctagtagccataatgggccctcgcacgatatctttgagaagctgcaaaccgtttcggcaggaaatgtgcagaatgaggagtaccctattcgtccttcaacactgaatagccggcagagcagtctggccccgcaaagtcaaccccacgacttcgtcttcagccctcacaacagcgggcgaccaatggaactgcagattcccactccccccctgcccagttactgcagcaccaatgtttgtcgatgttgccaacaccattcccatatccagtattcgcctttaaatagttggcagggtgcaaacactgtcggcagcatccaagatgtgcagagtgaggctttgcagaaacatagcttatttcatccctcaggctgccccgccctatactgcaacgctttttgttcctcttcaagccctattgccttgcggccccagggcgacatgggcagttgtagcccacactccaacatagaaccttcccccgtcgcaaggccccctagtcacatggatctttgtaacccacaaccctgcaccgtgtgtatgcatactccaaaaaccgaatcagacaatggcatgatgggactgtctcctgatgcatataggttcttgacagagcaggatcggcagctgcggctgctgcaggctcaaattcagcgccttttggaggcccagagccttatgccttgctccccgaagactaccgccgtggaggacactgtacaggcaggcagacagatggagctcgtgagtgtggaagctcagagctctcccggcctccacatgcggaagggagttagtatagcagtgagtacaggcgctagcttattttggaacgccgccggggaagaccaggagccagactcacagatgaagcaggacgatacaaagatctctagtgaggacatgaacttctctgtggatatcaataacgaggttacctcactccctggctcagccagcagcctgaaagcggtggatatccctagtttcgaggagtctaacatagccgtggaagaggaattcaaccagcccctgagcgtaagcaactcctcccttgtagttaggaaagagcccgacgtgccagtcttcttcccctccggccagttagccgagagcgtaagtatgtgcttgcagacagggcctactggcggcgcctctaacaactctgaaacttctgaagagcccaagatcgagcatgttatgcagccattgctgcaccagccctcggataatcagaagatctatcaggaccttctggggcaggtgaaccacctgctgaacagttcaagtaaggaaacagagcaaccctccacaaaagcagtcataatcagccacgagtgcacccgaacacagaacgtttaccacaccaaaaaaaagacccaccacagccgcctggtcgacaaggattgtgtgttaaatgctacgctaaagcaattgaggtccctgggtgtgaaaattgattcccccactaaagtgaaaaagaatgcgcataacgtcgatcacgcgtccgtgctcgcttgtatttctccggaggccgtgatctctgggcttaactgtatgtcttttgccaacgtgggcatgagcgggctttctcccaatggtgtggacctgtccatggaggctaacgccattgccctaaagtatctgaacgagaaccagctctcccaattgagtgtgacccgttcaaatcagaataattgtgacccattttctctgctgcatattaatacagaccgctctaccgtgggcctcagtctgatttctccaaacaatatgagtttcgccaccaaaaagtacatgaagcgctacggattgttgcaatcctcagataattctgaggatgaggaggaacctccagataatgccgatagcaagagtgaatacctgcttaatcagaacttgagaagcatccccgagcaacttgggggccagaaggaaccaagtaaaaacgatcatgagatcattaattgctccaactgcgaatccgtaggcactaatgctgacaccccagtgcttcggaatattacaaatgaagtgcttcaaacaaaggctaagcaacaattgacagaaaagccggcgtttcttgtgaagaacctcaagccaagccccgctgttaatctgagaacggggaaggccgaattcacgcagcatcccgagaaagagaacgaaggagacataaccatcttccccgagtccctgcagcctagcgagacgcttaagcagatgaacagcatgaacagcgtgggtacatttctagacgtaaaacgactgagacagctgcctaagttgttttag

SEQ ID NO: 204317 - DNA, 3864 bp, Artificial Sequence
  Description of Artificial Sequence: Synthetic coding sequence
atggagcccatctaccccttcgcccggccccagatgaacacccggttcccaagctctaggatggtgccatttcattttccgccatccaagtgcgcactgtggaacccaacgcccaccggcgacttcatttatttacacctctcatactacaggaaccccaaactcgtggtcacggaaaaaactattcgcctggcctacaggcacgctaaacagaataagaagaacagcagctgtttcctgttggggtccctcactgccgacgaagatgaagagggcgtgacacttacagtagaccggttcgatcccggaagggaagtccccgagtgtctggagatcactccgacagcctccctgcctggcgatttcttgattccatgcaaagtacacacgcaggagttatgctctcgggaaatgatcgtgcatagcgtcgacgatttctcgtcggcccttaaagcactgcaatgccatatatgctcgaaggatagcttagattgtggtaagctcctatctcttcgcgtgcacattacatctagagagtctctcgattcagtggagttcgatctgcattgggccgctgtaaccctggctaataacttcaagtgtacgccagtgaagcctattcccatcatccccacggccctggcaaggaatctctcctctaacctaaacattagccaggtgcagggcacttacaagtatggttatctaactatggacgaaacaaggaagctgctgctgctgctggagagcgacccgaaagtctattcactccctctggtaggcatttggttgagcggaatcacccacatctacagcccacaggtgtgggcttgctgtctccgctacatcttcaactcttctgtccaagagagggtcttcagtgaatcgggcaacttcataattgtactgtattcaatgacccacaaggagccagaattctacgagtgttttccctgcgacggcaaaatccctgacttcaggtttcagctcctgacatccaaagaaacattgcatctgttcaagaatgtggaacccccggacaagaaccccattcgctgcgagttgagtgcagagtctcagaacgctgaaaccgaatttttttccaaagccagcaagaactttagcatcaagcgatcgagccaaaagctgagctcgggcaagatgcctattcatgaccacgatagcggggtggaagatgaagattttagtcctcgtccgatcccatctccacaccccgtgtcccagaagataagcaaaatccagccatcagtacctgaattgagtcttgtccttgatggcaatttcattgagagtaatccactgccaacaccattggagatggtgaataacgagaatcccccattaataaaccacctggagcatttgaaacccctgcaaccacagctgtatgacgagaaacattcaccagaggtggaagcaggagaacctagcctcagagggatccccaatcaactgaatcaagacaagccggctcttctgagacactgtaaagtgcgccagccacccgcgtacaagaagggaaacccccacactagaaatagcatcaagcctagcagtcataatggacccagccacgacatttttgagaagttgcagaccgtgtccgctggcaacgtgcagaacgaggagtaccctatccgccccagcaccctgaattctcgccagtcctcacttgctccgcagtcgcagccccacgattttgtgttttcccctcataattctggccgaccgatggagctccagattcccaccccccccctgccgagctactgctctactaatgtctgccgctgctgtcagcatcacagccacatccagtactcaccactgaattcatggcagggtgctaacactgtcggaagcatacaggatgtgcagtccgaagccttacagaagcactcattgttccatccatctggatgtccagccctttattgtaacgccttttgctccagcagctctcctatcgcattgcgcccgcaaggagatatgggcagttgctcaccccactctaatatcgaacctagtcctgtggcgagacctccaagccacatggacctctgtaatccccaaccgtgtaccgtttgcatgcacacccctaagaccgagagcgacaatgggatgatgggcttgtcacccgacgcatatcgatttctgactgaacaagatcgccaactccggctcctacaggcccagattcagagattgctcgaagcacaaagccttatgccctgttcccctaaaactacagccgtggaggacaccgtgcaggctgggaggcaaatggaattagtgagcgtcgaggcacagtcatcaccgggcttacacatgagaaagggggtgtctattgctgttagcacaggtgccagcctgttttggaatgcggccggggaggatcaagaacccgactcccaaatgaaacaggacgatactaagatttcttcagaggatatgaacttcagcgtagatataaacaatgaggtgactagtctgcctgggagcgcaagttcgctgaaagctgttgatatcccaagctttgaggagagcaacatcgccgttgaggaagagtttaaccagccactgtcagtgtctaacagtagtctggtggtgcgcaaagagccggatgtaccggtgttttttccatcaggacagctggccgagtccgtctcgatgtgcctccagacaggtcccacagggggtgctagtaacaactctgagacatccgaggagccaaagattgaacatgtgatgcaaccgcttctgcatcaaccttccgacaatcagaagatctaccaggacctgctgggccaggtgaaccatctgctgaattccagctctaaagaaaccgagcagccttcgacaaaagctgtcattattagccacgaatgcactaggacacagaatgtctaccacactaaaaaaaagacccatcattcccggttggtggacaaggactgtgtattgaacgctactctaaagcaacttcggagtctcggagtcaagatcgattcacccaccaaagtgaagaaaaatgcccacaacgtggaccatgcgagcgtgctcgcatgtatctcaccggaagcagtgatttcaggacttaattgtatgagctttgccaacgtcggtatgtccggcctgagccccaacggtgtcgatctgagcatggaagcgaatgccatcgcacttaagtacctgaatgagaaccaactgtcacaactcagcgtcacccggtccaaccagaataattgtgaccccttctctttactgcatattaatacggaccggagtaccgtagggctcagtcttatctcccccaataatatgagttttgctactaagaagtatatgaaaagatacgggttactgcaatcgtccgataactcagaggacgaagaggagccgccagataatgcagattctaaaagcgagtatctgttgaaccagaacctgcggtctatcccggaacaactgggcggccagaaggagccaagtaagaatgatcacgaaattatcaactgtagcaattgcgagtcggttgggaccaacgctgatacgcctgtgctcagaaacatcacaaacgaggtgctgcagaccaaggccaaacagcagcttaccgaaaaacctgcatttctggttaagaacctcaagccttcaccagcggtaaacctcaggacagggaaggctgaattcacacagcaccctgaaaaggaaaacgaaggtgacattacaattttcccagaatcactgcaaccgtcggaaactttgaaacagatgaatagcatgaactcagtcggaacttttttggatgtgaagagacttcgccagcttccgaagttgttttag

SEQ ID NO: 204318 - DNA, 3864 bp, Artificial Sequence
  Description of Artificial Sequence: Synthetic coding sequence
atggagcccatctaccccttcgcccggccccagatgaacacccggttcccttcttctcgcatggtcccttttcactttcccccgtccaagtgtgcactctggaaccctacccccaccggagacttcatttatctgcacctgagctactacagaaatcctaaacttgtggttaccgagaagaccatccgcctggcatataggcacgcaaaacagaacaaaaaaaactcctcctgcttccttttggggtctctgacggctgacgaggatgaagagggggttactttaacagtggatagattcgatccaggccgcgaggttcctgaatgtcttgagatcacacccaccgcatcgctgcctggtgacttcttaataccctgtaaggttcacacccaagagctatgcagccgggaaatgatcgtccacagcgtagacgatttcagttccgcactgaaggctctgcagtgtcacatttgctcaaaagacagcctcgattgcgggaaactcctgagcctgcgagtccacataactagcagggaaagcctggactccgtcgagttcgacctccactgggcagcggtcacattagctaataacttcaagtgtacccctgtcaagccaatccctatcatcccaacagcgctggctagaaacctatcatcgaatctgaacatatctcaggtgcagggtacttacaaatacgggtacctgacaatggatgaaacaagaaagctgctgcttctacttgagtccgaccccaaggtttactcattgcctttagtcgggatatggctgtccggtatcactcacatctacagtcctcaggtttgggcctgttgcctgcgctacatcttcaatagcagtgtgcaggagagggttttttcggaatcagggaatttcattattgtcttatactctatgacccataaagaacccgagttttacgagtgcttcccctgcgatggtaaaataccagacttcagatttcagcttcttacctcaaaagaaaccttacatctgttcaaaaacgtcgagccacctgataagaaccctataaggtgcgagctgtcggcagaaagccagaatgccgaaacagagttcttcagcaaagcaagcaaaaacttcagcatcaagcgttcctcccagaaactatcttcaggcaagatgcccatccacgatcacgattcaggagtcgaggatgaagacttctccccgaggcccatcccctcaccacatccggtgtcacagaagatctccaaaattcaaccctctgtcccagagctaagcttggttctggatggaaattttattgaatcaaatccactgcccaccccgttggagatggttaataacgagaatccccccctcatcaaccacctcgagcatctgaagcctctgcagccacaactgtacgatgagaaacattcaccagaggtggaagccggagaacctagtcttagaggtatccctaatcaactgaaccaagacaaaccagctttgttgaggcactgcaaggtacggcagcctcctgcctacaagaaaggcaatccccacacccgaaactccattaagccctctagtcataatggacccagtcatgacatttttgagaaactgcagaccgtctccgctggcaacgtccagaatgaggaatatcctattaggcccagtactctgaactcaaggcaaagctctctggcccctcagagccagcctcacgacttcgtgttctccccacacaattccgggagacccatggagctccagattccaaccccacctctgccaagttattgttctactaatgtctgtagatgctgtcagcatcattcacacatccaatatagtcccctcaactcatggcagggcgccaacactgtggggtccatacaggacgtccagtccgaggctttacagaaacacagcctctttcatcccagcggatgccctgctttgtactgtaatgctttttgtagctcgtctagccctattgcgcttcgcccgcagggggatatgggctcttgttcaccccactctaacatcgagcccagtcctgtcgcgcgtcctccctcccacatggatttgtgtaatccacagccttgtacagtgtgtatgcacacacccaaaacagaatctgataacggcatgatgggcctatctcccgatgcctaccgatttctgaccgaacaggaccgccaactgagactcctgcaagctcagattcaacggttgcttgaggcacagtctttgatgccttgttctccgaagaccacagccgttgaagacacagtgcaggcaggccggcagatggagctagtgagtgtcgaagcccaaagctcgcctggcctgcatatgagaaagggagtgtccatcgccgtctcaaccggagcgtcccttttttggaatgctgcaggagaggatcaggagcctgactctcagatgaaacaggacgatacaaagattagttcagaggatatgaattttagcgtagatatcaacaatgaagtgaccagcctgccaggtagcgcatcatccctcaaagccgtggatataccatccttcgaagagtcgaatatagcggtggaagaggagttcaaccagccactcagcgtctccaatagctctctcgtggtgcggaaagaaccagacgtgcctgtgttcttcccgtcaggccagctggcagaatccgtgtccatgtgtttacaaactgggcccacaggtggggccagcaacaactcagagacaagcgaggagcccaaaatagagcatgtgatgcagccactcctgcaccagccctctgataaccagaaaatctatcaggaccttctggggcaggtcaaccacttattaaacagcagctcaaaggagaccgagcagccctcaacaaaggcagtgattatcagccacgagtgcactcgtacccaaaatgtatatcataccaagaagaagacccatcactcaagactagtggataaggattgcgtattgaatgctacactcaagcagctgcggtctctcggcgtaaagattgatagcccgacaaaagtcaagaagaatgcccataacgtagaccacgcctctgtgctggcctgtatctctcccgaggccgttatctccgggctgaattgcatgtctttcgctaatgttggcatgtcagggcttagcccaaacggtgtcgacctctccatggaggcgaatgccatagcattgaaatacctcaatgaaaatcaactcagtcagttgagtgtgacgaggtcgaatcagaataactgcgaccctttttctctgcttcatataaataccgaccggtcaacagtgggactgtcccttattagtccgaacaacatgtcttttgcgaccaagaaatatatgaaacggtacggactgctgcagagcagcgacaatagtgaagacgaggaggaaccacctgataacgcagacagtaaatccgagtatttgctgaatcagaatttgcggtcaatccctgaacaactgggcgggcagaaagagcctagtaaaaatgatcacgaaataattaactgcagcaactgcgagagcgtgggaactaatgccgacactccggtgcttaggaatattacaaacgaggtgctgcagactaaggcaaagcaacagctgactgagaagccagccttcttggtcaaaaatctgaaaccctcacctgcggttaatctgagaaccggtaaggcagagtttactcagcatccagaaaaggaaaatgagggagacataactatattccccgaatccctgcagccttcggaaactctgaagcagatgaactccatgaattccgtgggaacatttctggacgtcaaaagactgcgtcagttacctaagttattctag

SEQ ID NO: 204319 - DNA, 633 bp, Artificial Sequence
  Description of Artificial Sequence: Synthetic coding sequence
cagctgtacgacgagaagcacagccccgaggtggaggccggcgagccttccttgcgcgggatacccaatcagctgaatcaggataaacctgcgctgctgaggcattgcaagccttgcaccgtgtgtatgcatacaccgaaaaccgagtctgataatggcatgatgggcctctcgccggacgcttaccggttcttgaccgagcaggataggcaattacgattgctacaggctcaaatccagcggctgctggaggcacaaagtctgatgccatgttcacctaagactaccgcagtcgaagataccgtccaggctggaagacaaatggaactggtcagcgtggaggcccagagcagcccaggcctccacatgcgcaagggggtgagcatcgcagtcagcaccggtgcgtccttgttctggaatgcagccggagaggatcaggagcctgattctcaaatgaagcaggacgacacaaagatctcttcagaagacatgaatttcagcgtcgacatcaacaacgaggtgacttctttgcctggcagcgcaagcagcttaaaggccgtggatatcccatcattcgaagagtcaaacattgcagttgaagaagaatttaatcaaccactctctgtgtcttag

SEQ ID NO: 204320 - DNA, 3867 bp, Artificial Sequence
  Description of Artificial Sequence: Synthetic coding sequence
atggagcccatctaccccttcgcccggccccagatgaacacccggtttccatcatctaggatggttccttttcattttcctcccagcaagtgcgctctgtggaatccaaccccgaccggggatttcatatatctgcatcttagctactaccggaaccccaaactggtggtcactgaaaagacaatcaggctcgcgtacaggcatgcaaagcaaaacaagaaaaacagtagctgctttcttctgggatccctcactgccgacgaagacgaggagggggtgaccctgacagtcgacagattcgatccgggacgcgaggtccccgagtgtctagagatcactccaacagcttccctgccaggagattttctgatcccttgtaaggtccatacgcaggagttatgttctcgggaaatgatcgtacattccgtcgacgattttagcagcgccctgaaagccttgcagtgccatatctgtagcaaagacagcctggactgcggtaagcttctgtctttaagagtgcacatcacctcccgagagtctttggactccgtggagttcgatcttcactgggccgccgtgacactggccaataacttcaagtgcacccccgtaaagcctatcccaatcatccctaccgctctggcccgtaacctgagctcaaatcttaacatttcacaggtccagggcacatacaaatatggctacctgaccatggacgaaacccgaaagctgctgctgcttctggagtccgacccaaaggtgtactccctgcccctggtgggaatctggctgagcggcattactcacatttactctccccaggtgtgggcctgttgtctccgctatatttttaattcaagcgttcaggaacgtgtctttagcgagagcggcaactttatcatcgtcttgtactctatgacacacaaggaacctgagttttacgaatgctttccatgcgacggcaagatccctgactttcggttccaactgctgactagcaaagaaactctgcacctgtttaaaaacgtggaaccgcccgataaaaatcccatcagatgcgagctgagcgcagagagccaaaatgcagaaaccgagttcttcagcaaagcttccaaaaatttctcaattaagaggagtagccagaagctgtcctccggaaagatgccaattcacgaccatgactcaggggtggaagatgaggacttctctcccaggcccatcccaagccctcaccctgtctcacagaaaatctccaagatccagccaagtgtgcccgaattgtcacttgtcctggatgggaactttattgaaagtaaccccctcccaacccctctggagatggtgaacaacgagaatccaccactgatcaatcacctggagcatttgaagccgttgcagcctcagctctacgatgaaaaacactctcctgaggttgaagcaggggagccttctctaaggggtatccccaaccaattaaaccaggacaagcctgcgctgctacgacattgcaaggtgcgccagccaccagcctacaaaaagggaaatcctcatactagaaattccatcaagccatcaagccacaatggcccaagccacgatatttttgagaaacttcagacagtgtcagccggaaacgtccagaatgaggaatatcccattaggccctcaacactcaactctagacaaagttcacttgctccacagtcacagccacacgacttcgtcttcagtccccacaatagcggccggccaatggaactccaaattcctaccccccccttaccctcttactgctccactaacgtgtgtcgatgctgccagcatcacagtcacattcagtattcacctctgaattcttggcaaggggctaatactgtgggatccatccaggacgtccagagtgaagccctgcaaaagcactcacttttccacccgtccggatgccccgccctttactgtaatgctttctgcagctccagtagcccgatcgccttgcgcccacagggtgacatgggatcttgctcccctcattctaatatagagccttccccggtggcacggccaccatcacatatggatctttgcaatccccagccgtgcacagtttgcatgcacactccaaagaccgaaagcgacaatggcatgatgggtctttcacctgatgcgtatagattcctgactgaacaggaccgacagttacgcctgctccaggcacagattcagcgtctgctcgaggcccagagcctgatgccttgctccccaaaaaccaccgctgttgaagatactgtgcaggcaggccgacagatggaacttgtgagcgtggaggcacagtccagccctgggctccacatgcgcaaaggcgtttcaatagcagtgtcaactggggcttccctgttttggaacgctgccggtgaagatcaagagcccgacagtcaaatgaaacaggatgacaccaagatttcttcagaggacatgaatttctcagttgacatcaataatgaggtaacaagccttcctgggtcagcctcctctctcaaggcagtagacatcccatcctttgaagagtctaatattgcagtggaggaggagttcaaccagccactgtctgtttcaaattctagtagcctggtcgtgaggaaagagccagatgtgccggtgttttttccgtcaggccagcttgctgagagtgtcagcatgtgcctgcaaacagggcccactgggggagccagtaacaacagcgagactagcgaggaacccaaaatcgagcatgttatgcagcccttattgcaccagccctctgataatcagaaaatctatcaagatttactagggcaggtgaaccatctgttaaattcttcttctaaagagaccgaacagcctagcacaaaggccgtcattatttcacatgaatgtacaaggacacagaacgtgtatcatacgaaaaaaaagacacaccactctcggcttgtggataaggactgtgtccttaatgccacactcaaacagctgaggagtctgggagttaagatagatagcccaacaaaggttaaaaagaatgcacacaatgtggatcatgcttccgtgcttgcttgcatctcaccggaggcggtgatcagtggactgaattgcatgagcttcgctaacgtgggcatgtcagggctaagtcccaacggtgttgatctgtctatggaggcaaacgcaattgcactgaaataccttaatgagaaccagctgagtcagctaagtgtgacaaggtccaatcagaataattgtgacccattctcactgctacatatcaacaccgacagatcaactgttggcctctccctgatctcccctaacaatatgtcatttgccacgaaaaaatacatgaaacgctacggcctcttgcagtccagcgataattccgaagacgaagaagaaccaccagacaacgcagattccaaaagcgaatatctgttgaatcagaaccttcgctctatccctgaacagttggggggccagaaggagccgagcaaaaatgaccacgaaattataaactgctctaattgtgagtcagttggtactaatgccgatacccctgtcctccgtaatattaccaatgaggtgttacagaccaaagcaaagcagcagctcaccgagaagccagcctttctggtcaagaacttaaaacctagccctgccgtgaatctgcgaactggcaaggctgaattcacccaacacccagaaaaggaaaatgaaggggatattaccattttcccagagagcctacaaccctctgagacacttaaacagatgaacagcatgaactctgtgggaacttttttggacgtgaagaggctgcggcagcttccaaagttgttctag

SEQ ID NO: 204321 - DNA, 606 bp, Artificial Sequence
  Description of Artificial Sequence: Synthetic coding sequence
atgagcttcgccaccctgcggcccgccccccccggccggtacctgtaccccgaggtatctcctctgtccgaagatgaggatagaggatcggactcatcgggatccgatgagaagccctgtcgcgtgcacgctgcaagatgcggccttcagggcgcccgaagacgagccggcgggcggcgggccggaggaggagggccagggggtaggccaggaagggaacccaggcagcgtcacaccgcgaacgctcgcgagagagaccgaaccaatagcgtgaacacagccttcacagcgctccgcacactgattcccacagagcccgcagacagaaagttaagcaagattgaaacccttaggctagctagcagctacatatcccacctgggcaatgttctactggcaggcgaggcctgtggcgatggacagccgtgccacagtggtccagctttctttcacgccgcacgcgcaggttctcccccgccacctccccctcccccacccgcacgcgatggcgaaaatactcagcctaaacagatctgtacattctgtctgagtaatcagagaaagctttccaaagatcgcgatcgcaagactgccatcagaagctag

SEQ ID NO: 204322 - DNA, 642 bp, Artificial Sequence
  Description of Artificial Sequence: Synthetic coding sequence
atgcagctgcccctggccctgtgcctggtgtgcctgctggtgcacaccgcttttcgcgtggttgagggccaggggtggcaggccttcaaaaacgacgcgacagagataatacccgagctgggagaatatcccgagcctccccccgaactggaaaataataaaacaatgaatcgggccgaaaacggcggaagaccacctcaccacccgttcgagaccaaagacgtgtcagagtactcatgcagggagctgcattttaccagatatgtgactgatggtccttgcagatctgcaaagcccgtgacggagctggtgtgtagcggccaatgtgggcccgcgcgccttcttccaaacgctatcggcaggggtaagtggtggaggccaagtggacccgacttccgatgtattccagatcgctacagagcccagagagtccagctgctgtgcccaggtggtgaggctcctagagcccgcaaggtgcgtcttgtagcgagttgtaaatgcaaacgactgacccgctttcataaccagagtgaactgaaggacttcggcacagaggccgcacgcccgcagaaaggtcgaaaacccagaccacgtgcccggtctgcaaaggcaaaccaggccgagttagagaacgcctattag

SEQ ID NO: 204323 - DNA, 906 bp, Artificial Sequence
  Description of Artificial Sequence: Synthetic coding sequence
atggccatgctggtgctggtgcccggccgggtgatgcggcccctgggaggccaactgtggcgatttctaccaagaggtctagaattctggggtccggcagaaggaaccgcgagagttctcctgcgtcaattctgcgcacgccaggccgaggcatggcgtgcctcagggaggcctggctattgcctgggaacgaggcctctgtcaactgctagacctcctcctccatggtctcagaaggggcctggcgacagtacaagacccagcaagccaggtcctgtgagctggaaatcccttgcaattacctttgccatcggcggtgcattattagctggtatgaaacacgtgaaaaaagaaaaggctgagaaactggagaaagagcggcagaggcacattgggaagccgcttctcggggggcccttttccctgacgacacacaccggtgagagaaagaccgacaaggattacctcgggcagtggttactcatttactttggcttcacccactgccccgatgtatgtccagaagaactggagaaaatgatccaggtagtggacgagatagactccatcactacactgcctgaccttacgcccttatttatttctatcgaccctgagcgcgataccaaagaagctatcgccaattatgttaaggaattttccccaaagctagtcgggctgacagggacacgggaggaagttgatcaagtagcccgggcatatagggtgtactactctcctggcccaaaggacgaggacgaagattacatcgtcgaccacaccataatcatgtatttaataggacctgacggggaattcctggattactttggtcagaataagcgtaaaggagaaatagctgcttcaattgcaacccacatgcgaccatatcggaagaaaagttag

SEQ ID NO: 204324 - DNA, 813 bp, Artificial Sequence
  Description of Artificial Sequence: Synthetic coding sequence
atggccatgctggtgctggtgcccggccgggtgatgcggcccctgggcgggcaattgtggagatttctgccccgcggtctggagttctgggggccagccgaaggcacagcccgggttctgctgagacagttctgcgcgagacaagctgaggcttggagagccagcggccgtcccggctactgtttgggaactaggcccctgtccactgcccggcccccaccaccctggtctcagaaggggcccggtgactcgacccggccaagtaagcctggcccggtgagctggaaatccctcgcgatcaccttcgcgattggaggggctctgttagctgggatgaagcacgttaagaaagagaaggctgaaaagctggaaaaggaaagacagcgtcatattggcaaacccctgttggggggccctttttccctgactacccacaccggggaacgaaagacagataaggactacctcgattcgatcaccactttgccagatctgacaccccttttcatttctatagaccccgagagagatacgaaggaggcgatagctaactatgtgaaagagttttctcctaagctggtcggtctcaccggtactcgggaggaagtggaccaggttgccagggcctaccgggtatactactcccctggccctaaggacgaagacgaggactatatcgtggaccataccattataatgtacttaatcggaccagatggggaattcttggactatttcgggcagaataagcggaagggagagattgccgcctccatagctacgcatatgaggccttatcggaaaaagtcttag

SEQ ID NO: 204325 - DNA, 801 bp, Artificial Sequence
  Description of Artificial Sequence: Synthetic coding sequence
atgctgctgctgacccggagccccaccgcctggcaccggctgagccaacttaagccgcgtgtactgcctggcacccttggcggccaagcattgcacctgagatcttggctcctgagcaggcagggcccagccgagacgggggggcaagggcagcctcaaggcccagggctgcgcactaggttactgataacggggctttttggggccgggctcgggggtgcctggttggctttgcgcgccgaaaaagagcgcttacagcaacagaagaggacggaggctctgaggcaggccgccgtgggccagggcgattttcacttgttggaccaccggggacgagctaggtgcaaggcagatttccggggacaatgggtgctgatgtacttcggttttacacactgcccggacatatgccccgatgagctggaaaagctggtgcaggtcgtgcgccagttagaagctgagcctgggttgccacctgtgcagccagtgtttataaccgtggacccggaacgtgacgacgtggaagctatggcacgatatgtgcaagactttcatccaagactgctggggcttaccgggtctacgaaacaggtggcacaggcctcgcattcctacagggtatactacaacgccgggcctaaagatgaggaccaggattacatcgtcgatcattctatagcaatctacttgctaaatccagacggcttgttcactgactactacgggcggtcccgctcggccgaacagatctccgattctgttcgccgccatatggccgcttttaggtccgtcctgtcatag

SEQ ID NO: 204326 - DNA, 801 bp, Artificial Sequence
  Description of Artificial Sequence: Synthetic coding sequence
atgctgctgctgacccggagccccaccgcctggcaccggctgagccaactaaaaccacgggtgctgccgggaacactggggggccaggccctacatctccgctcctggctgttgtcccgccaggggcccgcagaaacaggagggcaaggccagccgcaggggccggggctgcgaaccaggttattaattacagggctcttcggcgccggcctgggtggcgcttggctggccctcagggccgaaaaggagcgcctccagcagcagaagcggacagaggctctgcgtcaggctgctgtggggcagggtgattttcacttgctggaccaccggggaagagcaagatgtaaggccgactttcgtggacagtgggtgttaatgtacttcggctttacacattgcccagacatctgccccgacgaactggagaaattggttcaagttgtgcggcaacttgaagcagagcccggattaccacctgtgcagccggtgttcattacagttgacccagagagagatgacgtcgaagcaatggcccgctatgtgcaggatttccaccctagacttctcggacttacagggtctactaagcaggtggcacaggcctcccacagttacagggtgtactacaacgccgggcccaaagacgaggaccaggactatattgtggaccactctatcgctatttaccttcttaaccctgacgggctttttacagactactatggaagaagtcggtccgcagagcagatttccgacagcgtgcggcgacacatggcagcctttagatccgtcctgtcctag

SEQ ID NO: 204327 - DNA, 411 bp, Artificial Sequence
  Description of Artificial Sequence: Synthetic coding sequence
atgctgctgctgacccggagccccaccgcctggcaccggctgagccagctaaaacctagggtattacccggcacactgggtggacaagctttgcacctgagaagttggctgctgagcaggcaaggccctgcagagacgggaggccagggacagcctcagggtccgggcctgcggacacgtttgcttatcactggcctctttggtgcaggcctgggaggcgcctggctggctctgagagcggaaaaagaaagactgcaacagcagaaaaggaccgaagcacttcgtcaggccgctgtgggtcagggagatttccatttgctggatcatagagggcgagccagatgcaaagctgactttcgcggacagtgggtgttgatgtacttcggctttacccattgtcctgatatttag

SEQ ID NO: 204328 - DNA, 411 bp, Artificial Sequence
  Description of Artificial Sequence: Synthetic coding sequence
atgctgctgctgacccggagccccaccgcctggcaccggctgagccaacttaaaccacgggtgctgcctggaacgttaggtggccaggccctacacttgcgcagctggctcctgagtaggcaggggcctgccgaaacaggcggtcagggtcagccacagggccctggccttcgcactcgtctgctcattactggcctcttcggcgcagggcttggcggagcttggctcgctctgcgggcagaaaaagagcgcttgcagcagcagaagcgcacagaagccctgaggcaagccgcagtgggccaaggagacttccacctgcttgaccacagagggcgggctagatgcaaagctgattttagaggacagtgggtcctcatgtactttggcttcacccattgccccgatatatag

SEQ ID NO: 204329 - DNA, 801 bp, Artificial Sequence
  Description of Artificial Sequence: Synthetic coding sequence
atgctgctgctgacccggagccccaccgcctggcaccggctgagccagttaaagcctagagtgctgcctggaacgcttgggggacaggctcttcacttgaggtcatggttattgtcccgacagggccccgcagaaacagggggtcagggccagccacaaggacccggcttgcgtaccagactgctgataaccggcctgttcggagccgggctcggcggagcctggcttgccttgcgcgctgagaaggaacgactccagcagcagaagcggactgaagccctcaggcaggccgccgtcggccagggagatttccatcttctcgaccacaggggtcgagctagatgtaaagccgacttccgtgggcagtgggtgttaatgtacttcggttttacacattgtcccgacatctgtccagacgaactagagaagctcgtgcaggtggttagacagctcgaagcggagcctggcctccctcccgtacagccggttttcataaccgtcgacccggagagagatgacgtggaggccatggctcgctacgtgcaggactttcatccaagactgttaggactaactggatccacaaaacaggttgcacaggcctcccattcataccgggtatattacaacgccgggcccaaggatgaggaccaggattatattgtggatcactcaatcgctatatatctcctcaatcccgacggcctgttcaccgactattatggccgtagccgcagcgcagagcagatttcagatagcgtgcgcaggcacatggccgcctttcgctccgtgttgtcatag

SEQ ID NO: 204330 - DNA, 801 bp, Artificial Sequence
  Description of Artificial Sequence: Synthetic coding sequence
atgctgctgctgacccggagccccaccgcctggcaccggctgagccaactgaagcctcgcgtgctgccaggaaccttgggggggcaggccctccacctgcggagctggttgttaagccggcaggggccagcggaaactggcggacaaggccagccgcaaggacctggtttgcgaaccagattgttgattactgggctgttcggggccggattaggaggagcatggttggcactgcgcgcggagaaggagaggctccagcaacagaagcgaacagaagccttaaggcaagcggcagtcggacaaggggacttccacctgctcgatcacaggggcagagcacggtgtaaggctgatttccgcggtcagtgggtactgatgtacttcggtttcacacattgccctgacatttgcccagatgaactagaaaagttggtgcaggtcgtaaggcagctcgaagctgaaccaggcttgccccctgttcaacctgtgttcatcactgtcgatccagaacgggacgatgtcgaggccatggccagatacgtacaagactttcacccacggctgttgggtctcaccgggagcacgaaacaggtggctcaggcatcgcactcctaccgagtttactacaatgctggccctaaagacgaggaccaggattacattgtggaccactctattgctatttatctgttgaacccggatggactcttcacggattattacgggcggagcagatccgccgagcaaatatccgacagcgttcgacgccatatggccgcttttaggagcgtgcttagctag

SEQ ID NO: 204331 - DNA, 1047 bp, Artificial Sequence
  Description of Artificial Sequence: Synthetic coding sequence
atgccccggagcttcctggtgaagaaggtgaagctggacgccttctcatccgctgatttggagagtgcatatgggagggcccggtcagatcttggagcccccttgcatgacaaggggtatttgagcgattacgttggcccctcttctgtctatgatggagacgctgaggcagcgctcctgaaaggaccctcccctgaacccatgtacgccgctgccgtccgcggggagctgggcccagcagctgcaggaagcgcacctccgcctactccacgtcctgagcttgcaacagcggccgggggttacataaatggtgacgccgccgtgagcgaggggtacgcggcggacgcttttttcatcactgacggtcgctcaaggcgaaaggcctctaatgccggatctgccgccgccccatcaactgccagcgcagccgcaccagatggcgatgctggggggggcgggggtgccggcggccggtccttgggctccgggccgggaggacgggggggcacacgtgctggcgctgggaccgaagcccgcgcaggccctggcgccgccggcgccggcggcagacacgcttgtggagagtgtgggaaaacctatgcaacaagcagtaatctatcacgccacaaacagacacatcggtccttggattcacagctagccagaagatgtcctacttgtggcaaggtttacgtctcaatgccagctatggcaatgcacctcctgacccacgaccttagacataagtgtggcgtctgtgggaaggcattttccaggccttggctcctgcagggccacatgagaagtcacactggagagaaacctttcggatgtgcccactgtggtaaggctttcgccgacaggtccaatctgagggcacatatgcagacccacagcgcttttaaacatttccagtgcaagaggtgcaagaaatcgtttgctcttaagagttacctcaataagcactacgagtctgcatgtttcaaaggaggagcaggtggtcctgcagctcctgcccccccacagctgtcgcccgttcaagcttag

SEQ ID NO: 204332 - DNA, 4893 bp, Artificial Sequence
  Description of Artificial Sequence: Synthetic coding sequence
atgctgaagtgcatccccctgtggcggtgcaaccggcacgtggagtcagttgacaagaggcactgttccctgcaagccgtcccagaggagatctaccgctacagcaggtctctggaggaactgctactggacgccaatcaattaagagagcttccaaagcccttttttcggcttctgaatctgcgaaaactgggattgtccgataacgaaattcaaaggctccccccggaagtcgccaactttatgcagcttgtagaattggacgtgagcaggaacgatatccccgagattccagagtcaattaaattctgcaaggccctcgaaattgccgatttcagcggtaacccattgtctagattgccagacggttttactcagctgcgctccctggcccaccttgccctcaatgatgtgagcctccaagcattgcctggtgacgtcggaaatctggctaatctagtgacgctcgagctgcgagagaacctcctcaagagcttgccagcaagcctgagcttcctagtcaagctagagcaactcgatcttggaggaaatgatctggaagtgctccctgatactcttggcgctttacccaatctccgggaactctggctggataggaaccagctgagtgccttgccgccagagctgggaaatctgaggcggttggtatgcctagacgttagtgagaatagactagaggagctgcccgccgaactgggggggctagtgctgctgactgatctgcttctgagccagaatctgctccggagactgccggacgggataggccaattaaaacagctgtctatcctgaaggtggaccagaacagactttgcgaagtgaccgaagctattggcgactgtgagaacctctccgagctgattctgaccgagaaccttcttatggcattacccaggagcttgggaaaactaaccaagctcacaaacctgaatgtggaccgtaatcacttagaggcccttccacccgaaataggcgggtgcgtggcattatccgttcttagccttcgtgacaatagattggcggtcctgccccctgagttagcgcatactactgagctgcatgtgctggatgttgccgggaataggctccaaagcctcccttttgccttgacccacctaaatctgaaggccttgtggctggccgagaaccaggcccaacctatgctcaggttccaaacagaggacgacgctcgtacaggcgaaaaggttctcacctgttaccttttgccccaacagccccctccttctctagaagatgccggacagcagggcagcctttcagagacttggtctgacgctcctcctagtcgggtttcagtcatccaattcctggaggcgccaattggtgacgaggacgcagaagaggcagctgccgagaagagaggtcttcagagaagagcgactccgcacccttccgaattgaaggttatgaagaggagtattgaggggaggagatctgaggcatgcccgtgccagccggacagcggatctccattacccgccgaggaggagaagcggctttcagcagagtcaggattgtctgaggactctcggccttcggcctctactgtgagcgaagctgaaccggagggtcctagcgctgaggcccagggtgggagtcagcaggaggctaccaccgcgggaggggaggaggacgctgaggaagactaccaggagcctactgttcattttgcagaggatgcactgctgccgggggacgacagggagattgaagagggccagcctgaagctccttggaccctgcccggtggacgccagcggttgatacgaaaagataccccgcattacaagaaacactttaagatcagcaagttgccccagcccgaggccgtggtggcactactccaggggatgcagccagatggagagggccccgttgccccgggcggctggcacaacggaccacacgctccgtgggcacccagggctcagaaggaggaggaggaggaagaggaggggtccccccaggaggaagaggtggaagaagaggaggagaacagggccgaggaggaggaagcatcaactgaggaggaggacaaggagggggctgtcgtgtccgctccaagtgtgaaaggagttagcttcgaccaggctaacaaccttctgattgagccggcccgcatagaggaggaggaactaactctgactatcttaagacagaccggtgggctggggatctccatcgccggaggcaaagggagtaccccctacaagggagatgatgaagggattttcatttcaagagtgtcagaagagggccctgccgctcgcgctggggtacgggtgggggataagttacttgaagtgaacggcgtcgctctgcagggcgccgaacatcacgaggccgtcgaggctctgagaggcgccgggactgccgtccaaatgagggtgtggcgggagaggatggtggagcctgaaaacgcagtcaccattacgccacttcggcctgaggacgattactcccctcgcgagaggagggggggcggcctgagactgccgcttttgccacctgaatccccaggcccactgcggcaaaggcacgttgcctgtctggcaaggagtgaaagggggctcggctttagcattgcagggggaaaaggctctacgccttacagagcgggtgatgccggcatcttcgtctcccggatcgccgaagggggcgccgcacatagggcaggtaccctgcaggtgggcgacagagtgctttctattaacggagtagatgtgaccgaggccaggcatgaccatgccgtttccttgttgacagctgcatcacccacgatcgccctgctcctggagcgagaggctggcggacctctgcccccaagcccacttcctcactcttcaccaccaaccgcggcagtggccactacgagtattactaccgccacgcccggcgtgcctggcttgccttcactggcaccatctctcctcgcggccgccctggaaggcccttaccccgtcgaagagatccgccttccaagagccggaggtcccttgggtctgtccattgtgggcggctccgaccactcgtctcacccattcggtgttcaggagcccggtgttttcatttccaaagtactgcccaggggtcttgccgctcggagcggactccgggtgggagaccgcattttggccgtgaatggccaagatgtgagggacgccactcatcaggaggccgtgtccgctttgctccggccctgcctggagctgtcactgctcgtgaggagagatcccgcccccccaggactgagggagttgtgtatacagaaagccccaggagaacggcttggtatttctataagaggcggcgcacgcggccacgccggaaatccgagagatcctaccgatgagggcatttttatctcgaaggtgtcacccaccggagctgctggacgcgatggtaggttgagagttggcctacggctgctggaagtcaaccagcagagtttgttaggtctgacccacggcgaagccgttcagctgctcaggtcagtaggagacacactgacagtgctggtctgcgatggctttgaagcctctaccgatgcagccctcgaagtgagccccggcgtgatcgctaatccatttgccgctgggatcgggcaccggaacagccttgagtccatatccagtatcgatagggagctgagcccggaaggccccggcaaagaaaaagagctgcccgggcagacccttcattggggcccagaggctacagaggccgctggacgaggtcttcagcccctcaagctggattatagagctctggctgcggttccatctgccggatctgtgcagcgggtaccgagcggtgcggccggtgggaagatggcagagagcccatgctctccatctggccagcaacccccttcgcctcccagccccgatgaacttcccgctaatgtaaaacaggcctaccgtgcctttgccgcagtgcccacatctcacccccctgaagatgccccagctcagccccccacacccgggcctgctgccagcccagaacagctatccttccgagagaggcagaaatacttcgagctcgaggtgcgtgtccctcaggcagaggggccacctaaacgagtgtctctcgttggtgccgatgacctgcgcaaaatgcaggaggaggaggcccggaagctccagcaaaaacgagctcagatgctgcgggaagcagccgaggcgggggccgaagcccgtctggctctcgacggggagacattgggcgaggaggaacaggaagatgagcagcccccttgggcatctccttctccgacgtcccgccagagccctgcgtctcctcccccattgggaggtggagccccagtcagaaccgctaaagcggaacggaggcatcaggagcgtctgagagtacagtcacccgagccgccggcaccagaaagagccctctcacctgccgaacttagggctctagaagccgagaaacgagcattgtggagagcagccaggatgaaatcccttgagcaagatgccctgagggcacaaatggttctgtctcggagccaggaaggccgcggaacgcgcgggcccctggaaaggctggctgaagcccccagcccagctcccacaccaagtccaactcctgtagaagacctggggcctcaaacatcaacaagtcctggcagacttagccctgactttgctgaagaactgagatccctggagccatcgccttcacccggccctcaggaagaggacggtgaggttgccctcgtcctcctcggaagaccctccccgggcgccgtggggcctgaagacgtggcgttgtgttcttctcgtcgacccgtgagacccggacggcgggggctgggccccgtcccaagctag

SEQ ID NO: 204333 - DNA, 4650 bp, Artificial Sequence
  Description of Artificial Sequence: Synthetic coding sequence
atgcagctggtggagctggacgtgagccggaacgacatccccgagattcccgaatccatcaaattctgcaaagcactcgagatcgcagatttcagtggcaatcccctgagccggctgcccgatggatttacacagctgaggtctctcgctcatctggccttaaatgacgtgagtctgcaagctctgccaggtgacgtgggaaatttggccaacctggtgactctggagttgagggaaaacctcctaaagagcttgcctgcatctctaagtttccttgtcaagctcgagcaattggacctgggaggaaatgacctggaagtgctcccagacaccctgggcgcgctccccaatcttagggaattgtggcttgaccgtaaccaactaagcgccctaccgcctgaactaggcaatcttagaagactagtgtgcctcgacgtgtccgagaaccgacttgaggagcttcccgcggaacttggtggactggtgttactgaccgatttactcctgtctcaaaatctgctgagacggctccctgacggcatcggacagctgaaacagctgagtattctcaaggtggaccaaaaccggctgtgtgaggtcacggaggcaatcggcgattgtgagaacttgtccgagctgatcttgacggagaatctgctaatggctctgccccggtctctgggtaagttgacaaagctaaccaacttgaatgttgacaggaatcatctggaagctctccctcccgaaatcggaggatgcgtggcgctatccgtgctgtctctgagggacaaccggttagccgtcctgccccctgagcttgcgcatacgacagagttacatgtgctcgatgtagccggtaaccgcctacaatctttgccctttgccctaacccacttgaaccttaaggctctgtggctcgccgagaatcaggcacagcctatgctccggtttcagactgaagatgatgctcggaccggggagaaggttctgacctgctacctcctgccacagcagcctcctccaagtctcgaagacgcaggtcaacagggcagcttgagtgaaacttggagtgacgctccccctagtcgggtgtccgtgatacaatttctcgaggcaccaattggggacgaagacgcggaagaagctgccgccgagaaaaggggcctccagagacgagccaccccgcacccaagcgagctcaaggtaatgaagcgcagtattgaaggcaggcggtctgaggcttgtccctgccagcctgattcaggatcacctctgcccgcagaggaggagaagcggctatcggcggagagtggcttgtccgaggactctagaccatctgcctccaccgtatctgaggccgagcccgagggcccatctgcggaggcacaggggggtagccagcaagaagccaccaccgccgggggggaggaggacgcagaggaggattaccaggagcccacagtgcactttgcagaggatgctctgctcccaggggacgatagagagattgaggaggggcaacccgaggccccttggactttgccaggcggtaggcagagattgatcaggaaggacactcctcattacaagaaacatttcaaaatttcaaagctaccccagccagaggctgttgtggctttactacaggggatgcagcccgatggtgagggacctgtcgcgcccggtggctggcacaacggcccccacgcgccctgggccccccgcgcacagaaggaggaagaagaggaggaagaagggtccccacaggaagaagaggtggaggaagaggaagagaatagggcagaagaggaggaagcctctacggaagaggaagacaaggagggcgccgtggtgtcagccccatcagtaaaaggggtaagcttcgaccaggccaacaaccttctgatcgagccagctagaatcgaagaggaagagcttactttaacaatactgcgccaaacgggtggcctaggaatctccattgcggggggcaagggcagcactccctataaaggcgatgatgaggggattttcatctcaagggttagcgaggagggcccggcagcgcgggccggcgtaagggtaggagacaagttacttgaagtgaatggagtggcactgcagggagccgagcaccacgaggctgtggaagctctgcgaggcgctggcaccgccgtacagatgcgtgtctggagagaaagaatggtggagcccgagaacgccgttactataacgcccttgcgccctgaggatgactattcacctagagaacggcgaggtggtggactgaggctgcctctgctgccacccgagtcccccggaccactgagacaacggcacgtcgcatgcctagcccgttctgagaggggactcggctttagcattgctggaggcaaaggcagtactccgtatagggcaggcgatgcaggcattttcgtatctagaatagcagaaggtggcgccgctcacagagcagggacacttcaggtcggtgatcgggtgctctctatcaacggcgttgacgtgacagaggcacggcatgatcacgccgtatccttgctgactgcagccagtccaaccatcgcgctgttgctggaaagggaggctggcggccccctccctccatctcccctgccgcatagttctccccctaccgctgctgtggccactacgagtattactaccgccacacctggggtgccggggctgccaagcctggcacctagcctactggccgcagcactggaggggccttaccctgtggaggaaattagactgccgcgggctgggggaccccttggcctgtccatcgtggggggttcagaccactcctcgcacccattcggagttcaggaaccaggagttttcatatctaaggtgttacctaggggactggccgctcggagtggactacgagtgggcgatcgaatcctggctgtcaatggtcaggatgtccgggacgctacacaccaggaggctgtgagtgctttactgaggccgtgcctggaactgagcctactggtccgacgtgaccccgccccacctggtttacgcgagttatgtattcagaaagcccctggcgagagactgggcatatcgattcgcggtggagcccgcgggcatgccggtaaccccagggacccaaccgatgaaggcattttcattagcaaggttagcccaacaggcgccgcagggagggatgggcgcctgcgcgtcggtctccggctgttagaagtgaatcagcagagcttgctgggtctgactcacggcgaggccgtgcagttactaaggagcgtcggcgacaccctgacagtcctggtctgtgatggctttgaggcctcaactgacgcagcactggaggtgagcccgggcgtcattgccaacccattcgctgctggcatcggacaccgcaatagcttagagtctatctcatccattgatagagagctgtcgcccgagggccccggaaaagagaaggaactcccaggccagaccttgcactggggaccagaggcgaccgaggcagccggaagaggtttgcaaccattgaagttggactaccgggccctggcagccgttccttcggccggcagcgtgcagagggttcccagtggggccgccggcggcaagatggccgaatccccatgctctccatccggacagcagcccccaagcccaccctctcccgatgagctgcctgctaatgtgaagcaagcataccgggccttcgcagctgtcccgacgagtcacccacccgaagacgccccagctcagccacccacacctgggcctgccgcttctcccgaacagctaagttttcgcgagaggcagaaatacttcgagttagaagtccgagtgccccaagccgaagggccccctaagagggtaagccttgtgggtgctgatgatctccgcaaaatgcaagaggaggaggctaggaagctgcagcagaagagggcccagatgttaagggaggcggctgaggccggcgctgaggctagacttgctctggatggagagaccttaggagaggaagaacaggaggacgaacagccaccatgggcttctccttctccaacctcgcgccagtctccagcctcaccacccccactcggaggtggggctcctgtgagaactgccaaagcagaaaggcgccaccaagagcggctcagggtgcagtcccccgaaccccctgcacctgagcgcgctctatccccagcagaacttagagcattagaggccgagaagcgggccctatggcgggcagctagaatgaagagcctggagcaagacgctttgagagctcaaatggttttatcccgttctcaagaagggcggggcacccgcggtcccctggaacggctggcagaggcacctagtccagctcctacaccgagtccaactccagtcgaggacctcgggccacaaacttccacctcgccaggtcgcctttccccagattttgcagaagagctgcgctccctcgaaccatccccctcgccaggacctcaggaagaagatggggaggtggctctggtactgctgggtcggccttcaccaggtgcagtgggcccagaagatgtggcgttatgttcttcccgccggccagtgcgtccgggccgcagagggctgggccccgtgccgtcatag

SEQ ID NO: 204334 - DNA, 2268 bp, Artificial Sequence
  Description of Artificial Sequence: Synthetic coding sequence
atgcagcccgacggcgagggccccgtggcccccggcggctggcacaacgggcctcacgccccatgggcgccccgagcccagaaagaagaggaagaagaagaggaagggagcccacaggaagaggaggtggaggaggaggaagagaatagggccgaggaggaggaagccagcacagaagaagaagacaaagagggggccgtggtctccgccccctcagtgaagggcgtttcttttgaccaagctaataacctgctgattgagcctgctcggattgaagaggaagagctgactctcaccatcctgcggcagaccggaggactggggatttccatcgctggaggaaaaggttctacaccatacaagggcgacgatgaaggaatcttcataagtcgtgtgtcagaagagggtcccgccgctcgcgcgggggtgagggtgggggataagcttttagaggtgaacggggttgctttgcagggtgcggagcaccatgaggcggtcgaagctctaagaggagccgggactgctgtccagatgcgggtttggcgagaaagaatggtagagccagagaacgccgtgaccattacccccctgaggccagaggacgattatagtccgagggagcgaaggggaggcggtctcagattgcctctgctgcctccagagagccctgggccacttcgacagcggcacgtggcatgcttagccaggtccgagaggggcctcgggttttcaattgctgggggaaagggatcaaccccttaccgcgcaggtgacgcggggatattcgtctcacggattgccgaggggggcgccgctcatcgcgctggcaccctgcaggtgggagaccgcgtgctgagtattaatggtgtggacgttacagaggccaggcatgaccacgccgtttccctgttaaccgctgcatcccctacaatcgctttactcctggagcgggaggctgggggtcccttacctccaagtccccttccccacagctctccccctaccgcagcagtagccactacttcaatcacaaccgctacgccaggtgtgccagggctaccctccctggccccatcattactagcagccgccttggaggggccctatcctgtggaggaaatcagactccctcgcgcgggcggccctttgggcctgtctattgtcggcgggagtgatcactcttcccaccctttcggggtgcaggagcctggcgtgtttatctctaaagttctccccagaggtcttgccgcccgtagcggactccgggtaggcgatcggattctggccgtaaacggacaagatgtgagggacgcaacacaccaagaggccgtgagtgccctgctgcgcccctgtttggagctcagcctgcttgtgcgtcgggatcccgcccccccagggctgagggaattatgtatccagaaagcacccggtgaacggctgggtatcagcataagaggcggggcccgcggacacgccgggaatcctagggaccccactgatgaagggatcttcatttcaaaagtgtctcctactggagccgctggccgcgacggacgcttacgggtagggcttcgattattggaggtgaatcagcaaagcctacttggcctcacacacggtgaagccgtccaactgctgagatcagtcggcgacaccctgaccgtgcttgtgtgcgatggtttcgaagcctcaacagatgcagcactggaagtgagcccaggcgtcattgctaacccttttgcagctggcattggacaccgaaattccctggaatctatctcctctattgatcgagagctgtctcctgaaggcccaggcaaggagaaagagttaccggggcagaccctgcactgggggcctgaagcaacagaagcagctggcagaggactacagcctctgaagttagattaccgagcactggcggcagtgccaagcgctggcagcgtgcaaagggtgcccagtggggcagccggaggcaagatggcagaaagtccttgcagcccttctggtcagcaaccccccagtccacccagccccgatgagttgcctgccaacgttaaacaggcgtaccgtgcatttgctgccgtccctaccagccaccctcccgaggatgcgcctgcgcagcctcctaccccagggcctgccgccagccctgagcaactatctttcagagaacgacaaaaatacttcgaattggaagttagggtcccccaggcagaagggcctctgcggccagggcgcaggggcctgggccccgtgcccagttag

SEQ ID NO: 204335 - DNA, 4968 bp, Artificial Sequence
  Description of Artificial Sequence: Synthetic coding sequence
atgctgaagtgcatccccctgtggcggtgcaaccggcacgtggagagcgttgataaaagacattgctccttgcaggccgtcccagaggaaatttatcggtattcgagaagcctcgaggaactgctcctcgatgctaaccaactccgagagttacctaaaccgttctttagacttcttaacctgagaaagctggggctttccgataacgagattcagcgacttcctcccgaagtagccaatttcatgcagctggtcgagctggacgtttcgagaaatgacatccctgaaattccagagtccataaaattttgtaaagccctagagattgctgatttctcagggaaccctttaagtcgcttaccggatgggtttacccagctccggtcactggctcacctcgctctcaacgacgtaagtctgcaagcgctacccggcgacgtcggcaatttagccaatctcgttacactggagctgagagagaacctgctgaagtctctacccgcatctctcagcttcctggttaaactcgagcaactagatctgggcggaaatgacctagaggttctgcccgatacactgggcgccctgcccaacctgagagagctgtggctcgacagaaaccagttgtcggctctgccaccggaactggggaacttgagacgtcttgtgtgtcttgacgtgagcgaaaataggctggaggagctccctgcagaactcgggggactggtcctcctgactgatctcctgctgagccaaaatctgctgagacgcctacctgatggaataggacagctcaaacagttatccatactgaaggttgatcaaaatcgtctgtgcgaggtcacagaagcaatcggtgactgtgaaaatctgtccgagcttatacttacggaaaatctgctcatggcgctgccacggtccctcggaaaactgaccaaattaactaatctgaacgtggatcgcaaccacctggaagctttgccgcctgaaatcggcgggtgcgtagcgctaagcgttctcagtctgcgcgataatcgcctcgccgttctccctccagagctggctcacaccacagagcttcatgtgctggatgtggccgggaaccgtctacaaagcctgccattcgccttgacacatttgaacctaaaagccctgtggctggccgaaaaccaggcacagccaatgctgaggttccagactgaagatgatgccagaactggggagaaggtcctgacctgctatttgctacctcagcagcccccacccagtctcgaggacgctggccagcagggctctttatctgaaacctggtccgacgcgcccccctcacgcgtcagcgtgattcagttcctcgaagcccccatcggagatgaagacgccgaggaagctgccgccgagaagagggggctccagagacgcgcgacaccgcacccaagtgaactgaaagtcatgaagcgctccattgaaggtagacgctccgaggcctgcccatgccagccagacagcggatcccctcttccagccgaggaagaaaagcgtctgtctgccgagtctggtctctccgaggattcccggccgagtgcctccaccgtgagcgaagccgaacccgaaggacccagtgcagaagcccaaggcggctctcaacaagaagctaccaccgccggaggagaagaagatgctgaggaagattatcaggaacctacagtgcattttgccgaagacgcgctgcttcccggagacgaccgggaaattgaagaagggcagcctgaggccccttggactctcccgggtggtcggcagcggctcatccgaaaggatactccgcattacaagaaacatttcaagataagcaagctgcctcagccagaggcagtggtggcactgcttcagggcatgcagcccgacggtgaaggacccgtggcacccggtggctggcacaacggccctcatgccccttgggccccacgggctcagaaggaggaagaggaggaggaggagggctccccacaggaagaagaagtggaggaggaggaagaaaacagggctgaggaggaagaggcctcaaccgaagaggaagataaggagggcgcggtggtttccgccccatctgtgaagggggtgagttttgatcaagccaacaacttgttaatcgagccagccaggatcgaggaagaagagctgactctcaccattctgagacagacaggaggcctcggaattagtatcgccgggggcaagggatccactccatacaaaggcgacgatgaaggtatctttatctcgagggtctcagaggaaggcccagctgctcgggccggggtgcgcgtgggagataagttactggaggttaatggggttgctctgcagggggccgagcaccatgaggcggttgaagccttgaggggtgctggcaccgcagtgcagatgcgggtctggcgcgaacggatggtagaacccgaaaacgctgtcactattacaccattgagacccgaggacgactacagcccccgagagcgaagggggggcggtctgagattgcctctgctccccccagagtcaccaggtcctctacgacaacggcacgtcgcatgccttgcccggtcagagagagggctgggattcagtattgcaggaggtaaagggtccacgccataccgggccggcgacgccgggatctttgtgagccgcattgcagagggcggcgctgcacaccgagcggggaccctccaggttggggacagggtgctgtccataaatggcgttgacgtgaccgaagctagacacgaccacgctgtctccttgctcaccgccgcctcccccactattgccctgctgctggagagggaggctggcggacccctgcccccctctccactgccccattcgtcccccccaaccgcggctgtcgccacaacctcaataacaacagcgacaccaggggttcccggactgccaagtctggctccaagcttgctggccgcagcactggagggaccatatccggtcgaggaaattcgcctgcctcgcgcgggcggccccctcggacttagcatcgtaggagggagcgaccactcttcccacccctttggcgtccaggaaccaggagtcttcataagtaaagtgctgcctcgcggacttgcagcacgtagtggcctgcgggtgggagacagaatcctggctgtcaatgggcaggacgtgcgcgatgctacccatcaggaagccgtgagtgccctgctgagaccctgccttgagcttagtctcctggtcaggagggatcctgcaccacccggcctgcgtgaactgtgcatccagaaagccccaggcgaaaggctcggcatcagcatccgaggaggcgcaaggggccacgccggaaatccaagagatccaactgacgagggtatttttatcagtaaggtctcccccacaggggcagccggcagagatgggcgcctgagagtgggcctaagactgctggaagtgaatcagcaaagcctgttagggctgacccacggtgaggccgtccagctgcttcgatccgtgggtgacactctcactgttctcgtgtgtgacggatttgaggccagcacagacgccgcgctggaggtttctcctggtgtaatcgccaacccattcgccgctggcatcggccaccggaactcactggaatctatttcgtcaatcgatcgggaattgtcccccgagggacccgggaaggagaaagaattgcctggtcagacactgcattgggggcctgaggccacagaagcagctggtaggggtcttcagccactcaaactggattaccgcgcgctggccgccgtccctagtgcaggctccgtacagcgagttcctagcggcgctgctggagggaagatggctgagtcaccttgcagccccagcggacagcagcctccttcgccaccttctccggatgaactacctgccaatgtcaagcaagcgtatcgcgcctttgctgccgtgccgacctcccacccccctgaggacgctccagcgcagccccctacgcccggccctgccgcgagtccagaacagctcagtttccgggaaagacagaagtacttcgaactcgaggtcagagtgccacaggccgagggcccccccaagagggtctccctggttggcgctgatgatctccgaaagatgcaggaagaggaagctcgcaagcttcagcaaaagagggcccagatgctgcgcgaggctgccgaagctggggctgaggcccgcctggccctggacggggagaccttgggagaagaggaacaggaggacgaacagcccccgtgggcctccccatccccaacctcacgccaatctcccgccagcccccctcctttaggagggggcgcccccgtacggactgctaaggctgagagacggcatcaggaaagactccgggttcagagcccagagcccccagcccctgaaagagccttatcacccgctgagctacgcgctctggaagccgagaagagagccttatggcgcgctgcgaggatgaagagcctagaacaggacgcactgcgggcccagatggtcctgagtagaagtcaggagggacgcggtacacggggcccactcgagcgcttagccgaggcaccaagtcccgctcctacaccaagccctactcctgtggaagatctggggccccagacctccacatccccgggcaggctccccctgagcgggaaaaagttcgactatcgcgccttcgccgccctgccaagttctagacccgtatatgacattcagagcccagattttgccgaggaactccggagtttagagccatcaccttctcctggcccacaggaggaagacggggaggtggccttggtgctgcttggacgtccatctcccggagctgtcgggccagaggacgtggccctgtgcagcagtagaagaccagttcgccccgggagacgggggttgggccccgtaccgtcctag

SEQ ID NO: 204336 - DNA, 2427 bp, Artificial Sequence
  Description of Artificial Sequence: Synthetic coding sequence
atgtggttcttcgcccgggaccccgtgcgggacttccccttcgagctcatcccagagccgcctgagggcggtctgcctggaccttgggctctccaccgcgggcgtaaaaaagccactggcagtccggtcagcattttcgtttacgacgtcaagcctggggcggaggagcaaacccaagtggcaaaggccgcgtttaagaggttcaagacattgaggcaccccaacattctcgcttatattgacggtcttgagactgagaaatgccttcacgtcgtcaccgaggccgtcacaccgttgggtatatatctcaaagcccgggtggaagccggcggcttgaaggagctcgagatctcctggggccttcaccaaattgtgaaagcgctgtctttcctcgtgaacgactgttccctgattcacaacaatgtctgtatggccgccgttttcgtggacagggccggggagtggaagctgggcggcttggactacatgtacagcgctcagggtaatgggggcggccccccacgaaaggggattcctgaactggaacagtatgacccccccgagctcgcggatagctccggcagagttgttcgggaaaagtggagtgccgatatgtggaggctgggatgtctcatttgggaggtgtttaacggtcctctgccgcgcgctgctgctcttcgcaatcctggcaagattcctaagacactggtccctcattattgcgagctggtgggagcgaaccccaaggtgagacctaatccggcccgtttcctccaaaattgcagggctcccggtggattcatgtcaaataggttcgtagaaaccaacctgttcttagaggaaatacaaatcaaagaacccgccgagaaacagaagttcttccaggagctgtccaagtctctggacgcgttccctgaagatttttgccggcataaagttctaccccagctgctcacagcatttgagttcggaaacgctggagcagtggtgcttacccccttgtttaaagtgggcaagtttttgtccgcagaagaataccagcagaaaatcatccccgtggtggtgaaaatgttcagttcaacggacagagcaatgagaatccggttgctacagcaaatggaacagttcatccagtatctggatgaacctactgtgaacactcagatctttccccacgtggtccacggattcttggacaccaatcctgccattagggagcagaccgtgaagtcaatgcttttgttggcccctaaactcaacgaggccaacctgaacgtcgagctcatgaagcacttcgcacggttacaagcaaaagatgaacaagggcctatccggtgcaatacaactgtgtgtttgggcaagatcggttcgtacttatcagccagtactcgtcaccgggtattgactagcgcattctctcgggcaactcgcgatcccttcgctccatcccgagtggccggggttctggggtttgcagccacccacaatctgtactccatgaatgattgcgcccagaaaatcctgcccgtgctatgtgggctcacggtggaccctgagaagtctgtgcgtgaccaggcattcaaagctattaggtccttcctcagcaaactggagagcgtgtctgaggaccctacccagctggaggaagttgagaaggacgtgcacgccgcctcctcccctggaatgggaggggcggccgcttcttgggcggggtgggctgtgaccggggtaagcagcctgacctccaagctaatcaggagccatcctacgacggctcctacagagacaaacatcccccagagaccaacgccagaaggcgtcccagccccagcccccactccagtgcccgccacacctacaaccagcggtcattgggaaactcaagaagaggacaaagatacggcagaggacagctcaaccgcagacagatgggacgacgaggactgggggtcactggaacaggaggctgaaagcgtcctcgcccagcaagatgactggtccacagggggacaagtctcacgtgcctcacaggtgtcgaatagcgatcataaatccagtaaatcccctgagtcagactggtctagttgggaagcggaaggaagttgggagcagggatggcaggaaccatccagccaggagccacccccagacggtacacgcctggcatctgagtacaattggggaggccccgaatcgtccgataaaggtgatcctttcgctactctgtctgctagacctagcacacagccaagacctgacagttggggcgaagacaattgggagggactcgagaccgacagtcgacaagtgaaagctgaactggcaaggaagaaaagggaagaacgccggcgggagatggaggcaaaacgtgccgaaagaaaggtcgccaagggcccaatgaagttaggagcacgaaaacttgactag

SEQ ID NO: 204337 - DNA, 2346 bp, Artificial Sequence
  Description of Artificial Sequence: Synthetic coding sequence
atgtggttcttcgcccgggaccccgtgcgggacttccccttcgagctcattccagaacctcctgagggtggtctccctggaccctgggctttgcaccgggggcggaagaaggctaccggcagccccgtctccatattcgtgtacgatgtaaagccaggagccgaagagcagacccaggtcgctaaagctgctttcaagcggttcaaaacgttgcggcacccaaacatccttgcttatatcgacggactagagacagaaaagtgtttgcacgtcgtgacagaagctgtcacccctctagggatttatctcaaggctcgagtggaagccggcggactgaaggagctagaaatctcctgggggttacatcagattgtgaaagctctcagctttttagttaacgattgctccttgatccacaataatgtctgtatggcagcagtcttcgtggaccgcgcaggagagtggaagcttggcggtctcgactacatgtactctgctcagggtaatggcgggggtcccccaaggaagggcattccagagcttgagcagtatgatccccccgaactcgcggactctagtggccgcgtcgtgagagagaagtggagtgccgatatgtggcgcctgggctgcctgatttgggaagttttcaatggtcccctcccacgagccgctgccctcagaaaccccggaaaaattccaaagaccttggtcccacactattgcgaacttgtgggcgctaatcctaaggtccgccctaatcccgctaggttcttgcagaactgtagggctccggggggcttcatgagtaaccgtttcgttgaaaccaacctgtttttggaagaaatccagattaaagaaccggccgaaaaacaaaagttttttcaggagctgagcaagtcgctggatgcattccccgaggacttttgtaggcataaagtacttcctcaactgttgacagcctttgagtttgggaatgccggtgccgttgtcctgacgccactctttaaggtcggaaagttcctgagcgccgaggagtatcagcagaagatcataccagtggtcgtaaagatgttctcttccacagatcgggccatgaggatacggctgctgcagcagatggaacagttcattcagtatctcgatgagcccactgtcaatacccagatcttcccccatgtggtgcatggttttttggacaccaatccggcaatcagagaacagactgttaagtccatgttattactcgcgccaaagctgaatgaagcgaatttgaatgttgagctgatgaaacatttcgctcgcctccaggccaaggatgagcagggccctataagatgtaataccaccgtgtgcctgggcaaaattggctcgtacctcagcgcttcaactcgccatcgggtcttaacctcagccttttctagagctacacgagaccccttcgctccttctcgagtggccggggtgctgggctttgccgcaacgcacaatctgtacagtatgaatgactgcgcacagaagattctcccagtactgtgcgggctgaccgttgaccccgaaaaaagcgtgcgtgatcaagcctttaaagcaattcgttcatttctgagcaagctcgaatcagtgagcgaggatcctacgcagctagaagaggtagaaaaagatgtgcatgcagctagctctcctggcatgggtggagccgcagcaagttgggcaggctgggctgtgaccggcgtgtcgtcacttacctctaagctgattcgcagtcatccaactaccgcgcccaccgaaaccaatattccccagcgacctacccccgaaggcgtgcccgcccccgccccaacaccagtccccgcaacacctacaacttctggtcattgggaaactcaggaggaagacaaagacacagccgaggactcctctacagctgaccgctgggacgatgaggactggggcagcctggagcaggaggccgagtcagttctggctcagcaggatgactggtctacaggcgggcaggtgtcccgagcttcccaggtctctaatagtgatcacaaatcctcgaaatccccagagagcgactggtcctcatgggaagcggaagggtcttgggaacaggggtggcaggaaccctccagccaggagccaccacctgatgggacaaggttggcctccgaatataattggggagggccagagagcagcgacaaaggcgacccgttcgctacattgtcggccaggccctccacacaagaccgatctcgtctaagctggcccggcagatccgcccggtccggggggggccgttggcgcccaaacgcccctagaggccgatggccccgcgcaccctag

SEQ ID NO: 204338 - DNA, 2124 bp, Artificial Sequence
  Description of Artificial Sequence: Synthetic coding sequence
atgtggttcttcgcccgggaccccgtgcgggacttccccttcgagctgatccctgagccacccgaaggcggtctgcccggcccctgggcactacataggggtcgcaagaaggccaccggctctcctgtctcgatcttcgtgtacgatgtcaagccaggggccgaagagcagactcaagttgcaaaagctgctttcaagaggtttaaaacgctccgccatcctaatatcttggcttacatcgatggtctggaaacagaaaagtgcctccacgtggttacagaggctgtaaccccactggggatctatctgaaagcgagggtggaagcaggcggactcaaagagctcgagatctcatggggactccaccagattgtgaaagctctgtctttcttggttaacgattgttccctgatccacaataatgtgtgcatggctgccgtgtttgtcgacagggccggggaatggaagcttgggggtcttgattacatgtactcagcacaggggaacggtggcgggccacctcgaaaggggatcccagagttggaacagtacgaccctcccgaactagcggattcttctggtcgagtcgtgcgcgagaagtggagcgccgacatgtggagactgggctgtttaatatgggaggtgtttaatggcccccttccgcgagcagcggccctacgcaatccaggaaaaatccccaagaccctggtgcctcattactgtgagctggttggtgccaatcctaaggtgcggccaaatccagcacggtttctccagaactgtagggcccccggcggcttcatgagcaatcgcttcgtcgagacaaatctttttttagaggaaattcaaataaaggagcccgccgagaaacagaaattttttcaagaattatcaaagtccctagacgcatttcccgaagatttttgtagacataaagtgcttccacagctgctaactgccttcgaatttggaaacgccggcgcggtcgtgttgacgcccctcttcaaggtcggaaagttcttaagcgccgaggaataccagcagaagattatccctgttgtggtgaagatgttctccagtacggatcgcgccatgcggatacggctgttacaacagatggagcagttcattcagtacctcgatgaacccactgtaaatacacagatttttcctcatgtggttcatgggttccttgataccaatccagccatccgggaacagactgttaaaagcatgctgttgctggctcctaaactcaatgaggccaatttaaacgttgaactgatgaagcactttgcaagattgcaagctaaggacgaacagggacccattagatgtaacaccacggtgtgccttggaaaaataggctcatatctgtctgccagcactcgacaccgcgtccttacatcggctttctctagggcaacaagggatccatttgctccaagtcgcgtggcaggtgttttaggtttcgccgcgacacataatctctactcgatgaatgattgtgcacaaaagattctgcccgtcctctgcggactgaccgtagatccagaaaaaagcgtgcgcgaccaagctttcaaggcaatccggtcttttctttctaagctagaatcagtatcagaggatccgacccagttggaagaagtcgaaaaagatgtgcacgcggcctcttccccaggaatgggaggtgctgctgcttcctgggcgggttgggccgtaactggagtgagcagcctgacctctaagcttatccggtcccatcctaccacggcacctacagagaccaacatacctcagaggcctactccagagggacactgggagacccaagagccaccccctgacgggacacgactggcttccgaatacaattgggggggtcccgaaagcagtgataagggcgatccctttgccacccttagcgctcgtcctagtacccagccaagacccgattcctggggagaggacaactgggaggggctggagacagatagccgccaggtcaaagccgaactagctaggaagaaacgggaggaacgccgaagagagatggaagcaaaacgggccgaaagaaaggtggcgaaggggccgatgaagctgggcgcgcgcaaactcgattag

SEQ ID NO: 204339 - DNA, 1071 bp, Artificial Sequence
  Description of Artificial Sequence: Synthetic coding sequence
atgtggttcttcgcccgggaccccgtgcgggacttccccttcgagctgatccccgagcccccggaaggcggattacctggcccctgggctttgcatagaggcagaaagaaggccacgggaagccctgtgtctatctttgtgtacgacgttaagcctggagccgaagagcagacacaggttgctaaagcggcgtttaagcggtttaagaccttgcgccatcctaacatactcgcctacatagacgggttggagactgagaagtgtttacacgttgtcaccgaggcggtgacccctctcgggatctacctgaaggccagagtggaagccggaggcctgaaagagctagagatatcatggggcctgcatcagatcgttaaagcccttagttttctggtcaatgactgttccctcattcataataacgtctgtatggctgctgtatttgtggacagagcgggggagtggaagctcggcggtttggactacatgtactcggcgcaaggcaacggaggaggaccccctcgaaagggtattcccgagttagagcaatatgatcctccagagttggccgactctagcggtcgcgtggttcgagaaaaatggtctgctgatatgtggaggcttggctgtctcatctgggaggtattcaatggacctctacctagggcagcagcactgaggaatcccgggaagattcccaagactctcgtgcctcactattgtgaactggttggcgccaaccccaaggtgaggccgaaccccgctagatttctgcagaactgcagggcccccgggggcttcatgagcaatagattcgtggagactaatctgtttcttgaagaaattcagccgaaggaccccaggttaaaggaattcctcccacagcctcccccactgttcctaccacccttgcagcctcaagctaccgggcggaggcgccgcagaactcggacccagcagcgaactgctgcccttctgactgatgggactaccaagactggcgccgcgtggtctcggcggccctccctgtgttggccctctagaaccacgggagcgcctggagcaaaatag

SEQ ID NO: 204340 - DNA, 2376 bp, Artificial Sequence
  Description of Artificial Sequence: Synthetic coding sequence
atgtggttcttcgcccgggaccccgtgcgggacttccccttcgagcttataccagagccccctgagggcggcctgcccggcccctgggcgcttcataggggaagaaaaaaggcaacaggcagccctgtttcgatatttgtatacgatgtgaagccaggggccgaagaacagacgcaggtcgccaaggctgctttcaaaaggttcaaaacacttagacaccctaatattctggcctacattgacggtctagaaaccgagaaatgcctgcacgtcgttaccgaggcggtcacccctctggggatatatctgaaagcaagggttgaggcgggaggattgaaagaactggaaatctcttgggggcttcatcagatcgtgaaggccctatcatttttggtcaacgattgttcccttatacacaacaacgtgtgtatggcagctgtttttgtggatagagccggagagtggaagctgggcggccttgactacatgtattcagcccagggaaacggcggtggtccaccgagaaagggaatacctgagctggaacagtacgaccctccagagttagctgacagttcagggcgcgtggttagagaaaaatggagcgccgatatgtggagactgggatgcctgatttgggaggtgttcaacggaccactgccaagggccgcagccttacggaatccaggaaagattcccaagacattggtaccccattactgtgagctggtcggtgccaatcccaaggtgagacctaaccctgcacgctttcttcagaactgtagggcccctggcggatttatgtctaatcggtttgtggaaactaatttattcctcgaggaaattcagataaaagaacccgccgagaaacagaagttcttccaagagctgtctaagtccctcgacgcctttcctgaagacttctgcagacacaaagtgctcccccaactgctgactgcctttgaatttggcaatgctggggcggtggtgctgacacctctcttcaaggttgggaagttcctgagcgctgaggagtaccagcaaaagattattcctgtggtggtaaagatgttctcttcaacagatcgcgccatgcggattcgacttttgcagcagatggagcagttcattcaatacctggatgaaccaaccgtgaacacccagatattcccacacgtggtgcatggattcctggacaccaaccccgccatcagggagcaaaccgtgaagagcatgcttctgctggcaccaaaactcaatgaggccaacctaaatgttgagttgatgaagcatttcgcgcggcttcaggcaaaagatgagcagggacctatccggtgtaataccacggtgtgccttggaaagattggctcttacctgtcggcgtcaacacggcaccgagtgttgactagtgcattcagcagagccacacgggacccattcgccccatcaagagtggcaggcgttttaggtttcgccgccactcataacctatactccatgaacgactgtgcacaaaaaattctccccgtgctgtgtggtctgactgtggatcccgaaaaaagcgtgagagaccaggcatttaaagccattcgctccttcctgtccaaactggagagtgtgagcgaggaccccacacagttggaagaagtcgaaaaggacgtccacgcagcctccagccctggcatgggcggggccgctgcaagctgggccggttgggcggtgactggagtgagtagcctgaccagcaagctcatcaggagtcaccccactacagcccccacagagaccaatatccctcagcggcctacccccgagggccactgggagacccaggaagaggataaggacaccgctgaagacagtagtaccgctgatcgatgggatgatgaggactggggaagtcttgaacaggaagctgaaagcgtcttagctcagcaagacgattggtcaacaggtggtcaggtctcacgcgctagtcaagtaagtaactcagaccacaagagtagtaaaagccccgagtctgattggagctcttgggaggccgagggatcatgggagcagggctggcaggagccctcctcccaggagcccccccccgacggcacccggctcgcctcagagtacaactggggtggccccgaaagcagtgataaaggtgaccccttcgctactctgtccgcccgccctagcacacagccccgccccgattcatggggggaagacaattgggaaggattggagacagactcaaggcaggtgaaggccgagttggcccggaagaaacgagaggagaggagacgggagatggaggctaaaagggcagagaggaaggttgccaagggcccaatgaagctcggggcacgcaagttagattag

SEQ ID NO: 204341 - DNA, 2343 bp, Artificial Sequence
  Description of Artificial Sequence: Synthetic coding sequence
atgtggttcttcgcccgggaccccgtgcgggacttccccttcgagcttatccctgagccccccgagggcggcctacccggcccttgggccttgcaccgggggcgaaaaaaggccaccggttcacctgtgtcaatctttgtctacgatgtcaagcctggtgccgaggaacagacacaagtggcaaaggctgccttcaagcgattcaagacattgagacaccctaatattctggcttatattgatgggctagaaacggaaaagtgtctgcacgtggtgaccgaagcggtgacaccactcggcatctatttgaaggctagagtggaagccggcggtttaaaggaattagagatcagctggggactgcaccagattgtgaaggcattgagcttcttagtgaacgactgctcattgattcataacaatgtgtgtatggctgccgtgttcgtcgacagggctggcgagtggaaactcggaggacttgactacatgtactcagcccagggcaatggtgggggaccgcctagaaagggcatccccgaacttgaacagtacgaccctcccgaattggccgattcttccgggagagtcgttagggagaaatggtcagcagatatgtggagattggggtgcctgatctgggaggtatttaacgggccgctgccccgagctgccgccttgcggaatccaggtaaaattcctaagacactggtgccccactactgtgaacttgtaggcgcaaatcctaaagtccggcccaacccagcccgattcttacagaattgtcgggccccgggaggcttcatgagtaataggtttgtggaaactaatttattcctggaagagatccagatcaaggaacccgcagagaaacagaagtttttccaggaactcagcaagagcttagacgcctttcctgaagatttctgccgccataaggtgctccctcaactccttacagcttttgaatttggcaatgccggcgccgtggtgctcacgcctcttttcaaggttgggaaattcttaagcgccgaggaataccaacagaagatcattcctgtggtcgtcaagatgttcagctcaaccgaccgcgccatgcgcatcaggctgctccaacagatggaacagttcattcagtatctggacgaacccacagtgaatacccagatatttccccatgttgtgcacgggttcctggacaccaacccagcaatcagagagcaaaccgtgaagagcatgctcctgctggcgcctaagctaaacgaggccaacctgaatgtggagcttatgaagcattttgctcgactccaggccaaagatgagcagggtccaatccgctgtaatacaaccgtttgcctcggcaaaattggctcctatctgtcagcaagtacccggcaccgagtactgacctcagctttttcacgggccacccgggaccccttcgccccatctcgggttgccggggtgttgggattcgctgccacccataatctgtactccatgaacgattgcgcacaaaagatcttgccagtgctctgtggactgactgtggatcctgagaagtcggtacgcgatcaggccttcaaggccattaggtctttcctgtccaagctagagagcgtctccgaggacccaacccaattagaggaggtggaaaaggatgtgcatgccgcctcttcgcctggcatgggcggcgcagccgcttcatgggctgggtgggccgtgacaggtgtcagctcactaaccagcaaattgatccgaagtcaccctactaccgcccccaccgaaacgaacatcccacaaaggccaactcccgaaggagtgccagctccagcacctacacccgtccctgccacgcccacgacctccggtcactgggaaacccaggaggaggataaagacaccgctgaagattcttccacagccgaccgctgggatgacgaggactggggtagcctggaggaagccgagagtgtcttggctcaacaggatgattggagcacaggaggccaggtgtctcgcgccagccaggtcagcaatagcgatcataagtcatctaagtctccagagtcagattggagttcctgggaggccgagggcagctgggagcagggatggcaggagccttcgtctcaggagcccccacccgatggaacacgacttgcttccgagtacaactggggagggcctgaatcctctgacaaaggagatccattcgctaccttatcagcgcgcccatctacacaggaccggtcacgtttgagctggcctgggcgttcagcccgcagcggcggtggaaggtggcggccgaacgctccaaggggtcgttggcctagggctccttag

SEQ ID NO: 204342 - DNA, 2124 bp, Artificial Sequence
  Description of Artificial Sequence: Synthetic coding sequence
atgtggttcttcgcccgggaccccgtgcgggacttccccttcgagttaattcccgagccccccgaaggagggctgcctgggccttgggctcttcataggggaagaaaaaaagctacggggagcccagtcagcatattcgtttatgacgtgaaacccggggccgaagaacagactcaagttgccaaagccgccttcaaacggtttaaaactctgcggcatccaaatattctcgcatacatcgatgggcttgagaccgagaagtgtcttcacgtggttaccgaggcagtaactcctctcgggatataccttaaagcccgggttgaagcaggcgggttaaaggaactggagattagttggggacttcaccaaattgtaaaggcgctgagttttctggtcaacgattgttccttaatacacaacaacgtgtgtatggccgccgttttcgttgaccgggccggcgagtggaaactcggagggttagattatatgtacagtgcgcagggcaatggcggcggccccccgcgtaaagggatacccgaactggagcagtacgacccccccgaactggcagactcctccggcagggtcgtgcgggagaaatggtcagctgacatgtggagactagggtgcctcatttgggaggtttttaacggcccccttccccgggccgctgccttgagaaatcccgggaagattccaaagactctggttccccactactgcgagttggtcggcgccaatcctaaggtccggcccaatcccgcccgattcctgcagaactgtagagcacccggggggtttatgtccaacagattcgtggaaactaacctgtttctggaggagatacaaattaaagaacctgcagagaagcagaaattctttcaggaactcagcaaaagcctcgatgcctttcctgaggatttctgtcggcataaagtgctcccccagcttctaactgccttcgaattcgggaatgccggcgccgtcgtccttacacccctattcaaggtggggaagttcctttcagctgaagagtatcagcagaagatcatacccgttgtggttaaaatgtttagctccacagatagggccatgaggattcggctgctgcagcagatggaacagtttatacagtacctcgacgaacccactgtgaatacacagatcttcccccatgtggtgcacgggtttctagacactaatccagccatcagggagcagacagtaaaaagtatgcttttgctggcacccaagttaaacgaggccaacttgaacgtggaactgatgaaacacttcgctcggctgcaggcaaaggatgagcagggccctataaggtgtaacaccaccgtgtgtctcggaaagataggatcttacctcagtgcgagcactaggcaccgggtgctcacctcagccttttcccgggcaactcgtgacccctttgcgccaagccgggtggccggcgtcctcggctttgctgctacacataacctctattcaatgaacgactgcgcccaaaagatccttcccgtgctgtgtggcctcacagtcgaccccgagaagagcgtgagggaccaggcctttaaagccatccgctcttttctctccaaactagaaagtgtcagtgaggatccaacgcagctggaggaggtagagaaagacgtccatgctgcctcttctcctggcatgggtggcgctgctgcatcttgggctggatgggccgtcacaggcgtatcctccctgactagcaagttaattcgaagccatcccacgaccgctccaacggagactaacatcccacagaggccaacccccgagggccattgggaaacccaggaacctccccctgatggaacacgcctggccagcgagtacaactggggagggcctgagtcttcagataaaggggatccgttcgctactctgtcagctcggccgtccacgcagccccggccagattcctggggcgaagacaattgggaggggctcgagaccgatagccgacaggtgaaagctgagctggcccgcaagaaaagggaggagaggaggcgcgaaatggaagccaaacgcgccgaaaggaaagtcgctaaagggccaatgaagctgggtgcccggaaactggattag

SEQ ID NO: 204343 - DNA, 2364 bp, Artificial Sequence
  Description of Artificial Sequence: Synthetic coding sequence
atgtggttcttcgcccgggaccccgtgcgggacttccccttcgagctgatcccagagccccctgaggggggcttgcctgggccgtgggctctgcatagaggccgcaagaaagctacaggatctcctgtgagcatttttgtgtacgatgtgaagcctggcgccgaggagcaaacgcaggttgccaaagctgctttcaaaagattcaagaccctaagacaccctaatatactcgcatacatcgatggattggagactgagaaatgcttgcatgtcgttacagaagcggtaactccattaggcatctacctcaaagcccgggttgaagccggggggctgaaggagctcgaaataagctgggggctccaccagatcgtgaaagcactcagttttcttgtcaatgactgtagcctgatccataataacgtgtgcatggccgcagtgtttgtggatcgcgccggagagtggaaacttggcggtttggattacatgtacagcgcccagggaaacggaggcggcccgccacgcaagggcataccggagctcgagcagtacgatcctcctgagttagccgactcctcaggccgcgttgtgagggagaaatggtcagccgatatgtggcggctggggtgtcttatttgggaagtgtttaatggtccccttccaagggcggccgccctcagaaacccaggtaagattcctaaaactctggtaccccactattgcgagctggtgggagctaacccgaaggtcagacctaatcctgctcgctttctgcagaattgtcgagctccgggcggattcatgagtaatcgctttgtggagacaaaccttttccttgaagagatccagattaaggaacccgccgaaaagcaaaagtttttccaggagctaagcaagagtctggacgccttcccggaggacttctgcagacacaaggtgctgccgcagctgctgaccgcgtttgagttcggaaatgccggagccgtcgtgctgactcctctgtttaaggtgggtaaatttctctctgctgaggagtaccagcagaaaattataccagtagtcgtgaagatgtttagttcaacggatagggcaatgcgcatccggctgctgcagcagatggagcagttcatccagtacctggatgagcctacagtgaacacccagatattcccacacgttgtgcatgggtttctggacactaatccggccatccgcgaacagactgttaagtcaatgctgttgttggcccctaagctgaacgaggccaatctcaacgtcgaactcatgaaacattttgcacggcttcaggcaaaggacgagcagggtcctataaggtgcaacacaaccgtgtgccttggcaaaattggctcatatctttccgcttctaccaggcatcgtgtgctcacgtccgccttttccagggctacacgggacccatttgcaccttcacgggtggccggtgtcctggggtttgccgccactcacaacctgtatagtatgaacgactgcgcacaaaaaatactgcccgtgctttgcgggctgaccgtggacccggaaaaatccgtgagggaccaggccttcaaggccattaggtcttttctgtctaagttggaaagcgtcagtgaagatccaacacagctggaagaggtcgaaaaagacgtccacgctgcaagttctcccggaatgggaggagccgccgccagttgggctggctgggcagtgacgggcgtgagctctctcacaagtaagctgatccgctcacatccgactacggccccgaccgagaccaacatcccccaaagacccaccccagagggggttcccgcacctgcacccactccagtccctgccaccccgaccacctcggggcactgggagactcaagaagaagataaggatacagcagaggactctagcactgctgatcgatgggacgacgaggactggggcagcttagagcaggaggccgaatcagttttggcccagcaggatgattggagcaccggagggcaggtgtctagggcctcccagtcccctacaggcgccgccggtaaactgagagcccctggcaacagggctgggcggtcacaagcccccaggagtcacctcctcacagtccacggctggcccgcctctataacaggagtggcccaatcccccgctactagagctacccccagcctgccttgtctgcacgtgccggcgccctcacggggccagactctgggagttcgaaccacaggccgcgcctcgaggttaacagtagatagaagcaggctcagctggccgggtcgctccgcccgctcgggcggcggacgttggaggcccaacgctccccggggaagatggcctagggccccttag

SEQ ID NO: 204344 - DNA, 663 bp, Artificial Sequence
  Description of Artificial Sequence: Synthetic coding sequence
atgatcaagcccaagtggggcggcctggtgtgggcccagtggcacggcccactcgccaggccctccggaaccctgccatttgccagcagtatgccatccccagtcgatgcctcctctgccgatggaggttccggcctcggctcccatcgcagaaaacgaacaactttctcaaagggccagctgcttgaactggagcgggccttcgccgcgtggccctatcccaatatcagcacacatgagcatctggcctgggtgacctgtctccccgaagccaaagtccaagtgtggttccagaagagatgggcgaaaattattaagaatagaaaatccggcattctgtccccggggtcagagtgcccccagtctagttgtagcttgcccgacacgctccaacagccttgggacccgcaaatgccaggtcagccaccgccgagctcagggacaccccaaagaacgtctgtatgccgacacagctcttgccctgcccctggtctctccccgcgccaaggctgggaaggagcaaaagccgtcgccccgtggggtagcgcaggggcatccgaagttcacccctcacttgagcgggctacccctcagaccagcctggggtcactttctgatcttatctatgcactggccattgtggtcaacgtagaccacagctag

SEQ ID NO: 204345 - DNA, 651 bp, Artificial Sequence
  Description of Artificial Sequence: Synthetic coding sequence
atgggcggcagcggcgtgggcaccgcctggcacggccccctggcccgacccagtggaactcttccgttcgcgtctagcatgccatccccagtggacgcatcctctgccgacggcggcagtgggttagggtcccaccgaaggaaaaggaccaccttctctaaaggccagctgctggaacttgagagggcgtttgcagcctggccttatcccaacatcagtactcacgaacaccttgcttgggtgacctgccttccggaggccaaagtccaagtgtggttccaaaagcgctgggcaaaaatcatcaagaaccgcaagtcaggaattctcagtcccgggagtgaatgtcctcagtcaagctgttccttacctgacaccctgcagcagccttgggatccacagatgcccggacaacccccaccatctagcggcacccctcagagaacctcagtttgccgtcattcttcatgcccagccccaggattatcccctcgacaaggctgggagggcgcaaaagcagtcgcaccatgggggagcgctggggcctcagaggtgcacccatcactcgagagggccactcctcaaacatctctggggtccctttccgaccttatatacgcgttggccatcgtggtcaacgttgatcacagctag

SEQ ID NO: 204346 - DNA, 648 bp, Artificial Sequence
  Description of Artificial Sequence: Synthetic coding sequence
atgatgaccaccggctggaccggcctgtgcctgccccccgtgaacccaagtcgtgtgtcctctagcagcttggaaacctctacaacagagagtatctttgctcacgatggaggctcgggcctgggaagtcacaggaggaaaaggaccacatttagcaagggccaacttctcgagttagaaagagcttttgcggcatggccataccccaacatcagcacccatgagcatctggcctgggtcacatgtctccctgaggccaaggtgcaggtttggttccaaaagcgttgggccaagatcataaaaaaccgcaaatcaggcatcctgagtcctggcagcgaatgtccccaatcttcatgtagcctccctgacacactgcaacagccttgggacccacagatgcctgggcagccgcctccatccagtggcacgccccaaagaacctctgtgtgccgacacagctcctgcccagctccagggctttcacctaggcagggatgggaaggggcgaaagctgtcgcaccatggggtagcgcgggcgcgtcggaggtgcatcctagcttggaaagggccaccccacagacatcactcgggtctctgtctgacctaatttacgcactcgccatcgtggtgaacgtggaccattcttag

SEQ ID NO: 204347 - DNA, 648 bp, Artificial Sequence
  Description of Artificial Sequence: Synthetic coding sequence
atgatgaccaccggctggaccggcctgtgcctgccccccgtgaacccatccagagtgagctcatcgtctctggagacctccaccacagaaagcatcttcgcccatgatggcgggagtggcctcggatcccaccgacgaaaaaggactacctttagcaaaggacaactgctggagttagagcgcgcttttgccgcatggccttatccgaacataagtactcacgagcatctcgcctgggtgacatgtctgcccgaggccaaagtacaggtttggttccagaagcgctgggccaagattatcaagaaccggaagtctgggatcctctcacctgggagtgagtgcccacaaagttcatgtagcctgcctgatactctccagcagccctgggacccacagatgccagggcaaccccctccttcaagcggtactcctcagaggacgtcagtctgccggcattcctcatgccccgccccgggcctgagcccccgccagggatgggagggcgctaaggcagtggccccctgggggagcgctggggcatccgaagtccacccatctctcgaaagagccactccacagacgagcttgggaagtctgtcagaccttatctacgcattggctatagtggttaacgtagatcactcatag

SEQ ID NO: 204348 - DNA, 1212 bp, Artificial Sequence
  Description of Artificial Sequence: Synthetic coding sequence
atgagcggccgggtgggcgacctgagcccccggcagaaggaggcccttgccaaattccgcgagaatgtgcaagacgtccttccagcattacccaaccctgacgactattttctccttaggtggcttagggcgaggtcttttgatctgcagaagtccgaggctatgttgcgtaagcatgtggaattccggaaacagaaagacattgataacatcatctcctggcagcctccagaagttatacagcagtatctttcgggcggtatgtgcggttacgatctggatggctgccctgtttggtacgatattattggacccctcgacgcgaaaggcctcctcttcagcgcctccaagcaggaccttctgaggacgaagatgagagagtgcgagctgttgctgcaggagtgcgctcatcaaacaaccaaactgggcagaaaggtggaaaccatcacaattatatacgactgcgaaggtctgggattgaaacacttatggaagccagccgtcgaagcctacggagaatttttgtgcatgtttgaggaaaattacccggagaccctcaagcggctcttcgttgtcaaggcccccaagctgttccctgttgcctataatctgatcaagccttttctctccgaggacactaggaaaaaaatcatggtgctcggggccaattggaaagaggttttgctcaagcacatcagtccggaccaggtacctgtggaatacggaggcacaatgacagatcccgacgggaatcctaaatgtaagagtaaaattaattatggtggtgatatcccccgcaaatattacgtgcgggaccaggtgaagcagcaatatgaacactctgtgcaaattagtagaggcagctctcaccaggtcgagtatgaaatcctgttcccagggtgtgtcctgagatggcagtttatgtcggatggtgctgacgtggggttcgggattttcctcaaaacgaaaatgggagagaggcagagagctggcgagatgaccgaggttttaccaaaccagcgctacaatagccatttggtcccagaagacggaaccctcacttgttcagacccaggaatatacgtacttcggttcgacaacacctattcattcattcacgcgaagaaggtgaatttcacagtggaggtacttcttccggataaggcgtcagaagagaagatgaaacagctgggagcaggaacacccaagtag

SEQ ID NO: 204349 - DNA, 963 bp, Artificial Sequence
  Description of Artificial Sequence: Synthetic coding sequence
atgagcggccgggtgggcgacctgagcccccggcagaaggaggccctggctaagtttagggagaatgtccaggacgtacttcccgccttgcctaacccagatgactacttcttactgcggtggctgagagcaagatctttcgacctgcagaaaagcgaagccatgctccgaaaactggggcgaaaagtggaaactattacaataatttatgattgtgaggggctcggccttaagcatctgtggaagccagcagtcgaggcatatggcgagtttttgtgcatgttcgaagagaactatccggagaccctgaaacgactcttcgtggtgaaggctccgaagctctttcccgtggcgtataacctaatcaaacctttcctaagtgaggacactagaaaaaaaattatggttttaggcgccaactggaaagaagtgctgctgaaacatatctcgccagaccaggtgcccgtggagtatggaggcaccatgacggatcccgatggaaatccaaaatgtaaatcaaaaatcaattacggcggcgacatcccacgcaagtactatgttagagaccaggtgaagcagcagtacgaacactcagtgcagatatccaggggctcttcacatcaggtcgaatacgagatactgttccctggttgcgtgttaagatggcagtttatgtccgacggggctgatgttggcttcggtatttttctgaagacaaagatgggagagaggcagagagccggggaaatgaccgaggttctcccgaatcagagatacaattcccacctggtacccgaagatggcacactcacatgtagcgatcctggcatttacgtcctacgttttgataacacttactcctttatacatgccaagaaagtgaattttacagtagaagtacttcttcctgataaggcctctgaggaaaagatgaaacagttgggagcggggacgcccaaatag

SEQ ID NO: 204350 - DNA, 990 bp, Artificial Sequence
  Description of Artificial Sequence: Synthetic coding sequence
atgctgcggaaggtgatccagcagtacctgagcggcggcatgtgcgggtatgacctggacggatgtcctgtatggtacgacatcatcggtccgcttgatgcaaaggggctgctgttttccgcttcaaagcaagacttgttgcggaccaaaatgcgggaatgcgaacttctactccaggagtgtgcccaccagacaactaaactggggaggaaggttgagacgatcacaatcatatacgactgtgagggtcttggcctgaagcacctttggaaacctgcggttgaagcctatggggagttcctgtgcatgttcgaagagaattaccctgagaccttaaagcgcctctttgtggtgaaggcccctaagcttttcccagtggcctacaaccttataaaacctttcctgagcgaagatactcgtaagaaaatcatggttttgggcgcaaactggaaggaggtcttgctgaagcacattagtcccgaccaggtgcccgttgaatacggaggtactatgacggatcccgacgggaatcctaaatgcaagagcaagatcaactacggcggcgacatcccacggaagtactatgttagggaccaggtcaagcaacagtacgaacattcagttcagataagtaggggttcaagccaccaggtggagtatgaaattctttttcctggctgtgttctcagatggcagtttatgagtgacggcgccgatgttgggttcggaatcttcctgaagactaagatgggagagaggcagagagccggggagatgacagaagtcctgccaaatcagcggtataatagccacttggtcccagaggacggtacactgacctgctccgatccagggatctacgtcttgcgcttcgacaatacttacagctttatccacgcaaaaaaagttaatttcacagttgaggtccttctacctgacaaagccagcgaggagaaaatgaaacagcttggagcgggaactccaaaatag

SEQ ID NO: 204351 - DNA, 1179 bp, Artificial Sequence
  Description of Artificial Sequence: Synthetic coding sequence
atgagcggccgggtgggcgacctgagcccccggcagaaggaggccttagctaagttccgtgagaacgtgcaggacgtcctcccagcactacccaaccccgacgactatttcctgctgaggtggctgcgtgctcgcagttttgatcttcagaagagcgaagcgatgcttagaaagcacgtggagtttaggaaacaaaaggatatcgacaacataataagctggcaaccaccggaggtgattcaacagtaccttagcggtggaatgtgtgggtacgacctggatgggtgtcccgtatggtacgatatcatcggtcccctggacgccaaaggactgttatttagcgctagcaagcaggatctgctgcgtacaaagatgagagagtgtgagctcctgttgcaggaatgtgcgcatcagactacgaagttgggccgtaaggttgaaactattaccattatctatgactgcgagggcctgggccttaagcacctgtggaagccggccgtagaagcatacggagaattcctgtgtatgttcgaggagaactatcccgagactttgaaaagactatttgttgtaaaggcacccaagctcttcccagtggcctacaatcttattaaacctttcctcagcgaggataccagaaagaagatcatggtactgggggctaactggaaagaagtcctgttgaagcacatttcaccagaccaggtcccagtggagtacggcggtactatgactgatccagacggaaatcccaagtgtaagtctaagataaattacggcggcgacattcctaggaagtactacgttcgcgaccaggtaaagcaacagtacgaacatagcgtgcaaatttctcgtggcagttctcatcaggtagaatacgagattttattccccgggtgtgtccttagatggcaatttatgtctgatggagccgacgtaggattcggcatcttcctgaagacaaagatgggcgagaggcagagggccggagagatgactgaggtgctgccgaaccagcgctacaactctcacctcgtcccagaggatggaaccctgacctgcagcgatccaggcatttgcaaatacttgtgcctcggcaacgccctcaagccccacgtacagctttctgcttgtgaggttcctcttccaccatggattttcggcagtgagtgctag

SEQ ID NO: 204352 - DNA, 1119 bp, Artificial Sequence
  Description of Artificial Sequence: Synthetic coding sequence
atgagcaaggccttcggcctgctgcggcagatctgccagagcatcctggccgagagttctcagagtccagccgacttggaagagaagaaggaagaggattctaatatgaaacgcgagcagcccagagagcggcctcgggcctgggactatccccatggcctagtaggtctgcacaatattggccagacctgctgcttaaacagccttatccaagtctttgtaatgaatgtggatttcacacgcatattgaagaggatcaccgtcccacggggcgcggacgagcagaggaggtcagttcctttccaaatgctgctgctgctcgagaaaatgcaggacagccgccagaaggcggttcggcccctggagctcgcttattgcctgcaaaagtgtaatgtacccctattcgtgcagcatgatgccgcccagctctacctgaagctgtggaacctcatcaaagaccaaattactgatgttcacttagtggagcgcctccaggccctttacacaattcgggtgaaggacagcctgatatgtgtcgattgtgcaatggagtcatctcggaattcctccatgctgaccctgccactgtctctgtttgatgtggactctaagcccttaaagactctggaggatgcgttgcactgcttctttcagccgcgggagttatcaagtaaatctaagtgcttctgcgagaactgtggtaagaaaacccgcggcaagcaggtcctgaagcttacgcacctcccccagaccctaacaatacatctgatgcgattctctatcagaaactcacaaacacgaaagatttgccatagcctctattttccacagtccctggacttctcacaaatcctgcccatgaaaagagagagctgcgatgccgaggagcagtctgggggacaatacgagctgtttgcagtcatagcacacgtgggtatggcggacagcggacactactgcgtttacatccgcaacgctgtggacggaaaatggttctgtttcaatgatagcaacatctgtcttgtatcttgggaagatattcaatgcacctatggaaatcctaactaccattggcaggaaactgcgtatctcctggtgtacatgaagatggagtgctag

SEQ ID NO: 204353 - DNA, 1062 bp, Artificial Sequence
  Description of Artificial Sequence: Synthetic coding sequence
atggagttccggaagaccatggacatcgaccacatcctggactggcagcctcctgaggtaatccagaagtatatgccggggggactctgtgggtacgatcgggatggctgtcccgtgtggtacgatatcatcggcccacttgatcccaaggggctcctgttttctgtgacaaagcaggacttactgaagaccaagatgcgggattgtgagcgcattctgcatgagtgcgacctccagactgaaagacttgggaaaaaaatcgaaactattgtcatgatattcgactgtgaggggttgggacttaagcatttctggaaacccctggtggaggtataccaggaattttttggccttctcgaggagaattatccagaaactctcaagtttatgctcattgtgaaggctactaagctattcccagtgggttacaacctcatgaagccattcctgtctgaggatactagaaggaaaataatcgtgctagggaataactggaaagagggcttgctgaaactgatttcaccggaagagctgcctgcgcagttcggaggtacgctgaccgatccggacgggaacccaaagtgtctgactaagatcaattatgggggagagatccccaagagcatgtacgtgagggatcaggtcaagacccagtacgagcattctgtgcagataaatcgcggcagcagccaccaagtggaatacgaaattctttttcccggctgtgtgttgcgctggcagtttagctcagacggggccgacattgggtttggggttttcctgaagactaaaatgggcgaacggcagagggctggagagatgaccgacgttttgcctagccagcgatacaacgcccacatggtcccggaggatggaaatcttacttgcagcgaagccggagtgtacgtggagagcgagagtggcaagagttgctgccacttgcctgtcatcatctgcagccacgagctgcagaactcccatagcaatagccaggttatggcctaccagatggtgagaaagtgtaagctgagtaggcccctccctctcccggcgagtaactag

SEQ ID NO: 204354 - DNA, 1026 bp, Artificial Sequence
  Description of Artificial Sequence: Synthetic coding sequence
atggagttccggaagaccatggacatcgaccacatcctggactggcaacctccggaggtgatacagaagtacatgcctggcgggttatgtggttatgacagggatggttgcccagtctggtacgacattattggccctctggatcctaaaggactgctgttttcagtgacaaagcaggacttgcttaaaacgaaaatgcgggactgcgagaggattctgcacgagtgtgacctgcagacggagagactcggcaagaagattgaaacaattgtcatgatttttgattgtgaaggcctaggactgaaacacttttggaaacccctcgtggaagtatatcaagaattctttggcttacttgaagaaaattaccccgagaccctgaagtttatgttaatcgtaaaagctactaagctgttcccagtgggctacaatctcatgaagccgtttttatctgaggatactcgtaggaaaatcatcgtgctgggcaataactggaaggaaggccttctcaaattaattagcccagaggagctgccagctcagttcggcgggactcttacagaccccgacggtaaccccaaatgtctgacaaagatcaactatgggggtgagattcctaagtcaatgtacgtcagagaccaggttaaaacacagtacgagcactccgtccagatcaaccgcgggtcatcacatcaggtcgagtacgagatactgtttcccggatgcgtgttgcgatggcagttcagtagtgatggcgcagacatagggttcggagtgttcctgaagaccaagatgggtgagcgccaacgcgccggggaaatgacggacgtcctgcctagccagagatacaacgcccatatggtgccagaggatgggaaccttacttgcagcgaggccggggtatatgtgctgcgatttgataacacatacagtttcgtccatgctaaaaaggtgtcttttaccgtggaggtgttactccccgacgaagggatgcagaaatacgataaagagctgactccagtgtag

SEQ ID NO: 204355 - DNA, 972 bp, Artificial Sequence
  Description of Artificial Sequence: Synthetic coding sequence
atggtgatccagaagtacatgcccggcggcctgtgcggctacgacagagacggctgccccgtatggtacgatatcattggccctctggatccaaaggggctgctattctctgtaacaaagcaggacctcctaaaaacaaaaatgcgggactgcgagcggattctgcatgagtgtgacttgcagaccgagcgtcttggcaagaagattgagacgatcgtcatgatattcgactgtgagggattgggcctgaaacatttctggaagccgctggtggaggtgtatcaggagttttttggattgctggaagagaactaccctgaaacattgaagttcatgctgatcgtgaaagccaccaagttatttccagtggggtacaacctgatgaagcctttcctctccgaggacactaggcgaaagattatcgtgctcggaaataattggaaagagggattgctgaagctcattagtcccgaagagttgcctgctcagttcgggggaacactgacagatcccgatggaaacccaaaatgtctgactaagatcaattatgggggcgagatccccaaatctatgtatgtgcgcgaccaggtgaaaacgcaatacgagcattccgtgcagatcaacagaggcagctctcatcaggtggagtacgagattctgttcccaggttgtgtgttaaggtggcagttctcctccgatggagcggatattggctttggagttttcctcaaaacaaagatgggtgaaaggcaaagagccggcgagatgacggatgtgcttccaagccagcgttataacgctcatatggtgccggaagacggcaacctgacgtgttccgaagctggggtgtacgtgctaaggtttgacaacacatacagcttcgttcatgctaaaaaggtgtctttcacggtggaagtgctcctgcccgacgagggaatgcagaagtatgacaaggagttgaccccagtgtag

SEQ ID NO: 204356 - DNA, 972 bp, Artificial Sequence
  Description of Artificial Sequence: Synthetic coding sequence
atggtgatccagaagtacatgcccggcggcctgtgcggctacgaccgagacggctgtcctgtctggtacgacattattggccctctggacccaaaggggcttcttttctccgtcacaaaacaggacctgttaaagactaaaatgcgcgactgcgaaagaattctgcacgaatgtgacctgcaaactgagcgcctcgggaaaaaaattgagactatcgtgatgatttttgactgtgaaggactaggtctaaaacacttctggaaaccattagtagaggtgtaccaggagtttttcggtcttctggaagaaaattatcctgaaactttgaaattcatgttgatagtaaaagcaacaaagctgttcccagtcggatacaacctaatgaagccatttctctcggaagatacaagacggaaaattattgtcttggggaacaattggaaggagggcctgctcaagctgatcagccctgaggagctcccagcacagttcggaggcacccttaccgacccagacggaaatcccaaatgtttgaccaaaataaattatggcggcgaaatccccaagtcgatgtatgtgagagatcaggttaaaacccagtacgaacactcagtgcagattaacagagggagttctcaccaggtggaatatgagatactgttccccggatgcgtactgagatggcagtttagtagtgatggcgcggacatcggctttggagtctttctgaagaccaaaatgggggagcgacagcgagccggcgaaatgaccgacgtcctcccttctcagagatacaatgcccacatggtccccgaagacggaaatctgacctgcagtgaggccggtgtgtacgtgctgcgctttgataatacttattcttttgtgcacgcaaagaaggtgagctttactgtcgaagtgctcctccccgacgagggcatgcaaaagtacgacaaggagcttacacccgtgtag

SEQ ID NO: 204357 - DNA, 1221 bp, Artificial Sequence
  Description of Artificial Sequence: Synthetic coding sequence
atgagcagccgggtgggcgacctgagcccccagcagcaggaggcccttgctagatttcgtgagaacttgcaagacctgctgcccatcttaccgaacgccgatgattattttttacttcgctggcttcgcgctagaaacttcgatctgcagaagagcgaggatatgttgcgacgccacatggaatttcggaagcagcaggacctcgataacattgttacctggcagccccccgaagtgatccagttgtacgattctggtggcctctgcggatacgattacgaaggctgtcccgtttatttcaacatcatcggatcactagatccgaagggcctgttgctgagtgcaagcaagcaggacatgatccggaagaggattaaggtttgtgagctgcttctccatgaatgcgagttacagacacagaagctaggtcgaaagattgagatggctttgatggtttttgatatggaagggctttctttgaagcacctgtggaaaccagctgtggaggtgtaccagcaattcttcagcattttagaagccaactatcctgagactctcaagaatctcatcgtgattagagcccccaagctcttcccagtggcgttcaatttagtcaagtcattcatgtccgaggagacaagacggaagatagtgattctaggcgataactggaagcaggagctaacaaagtttatttctccagatcagctccctgtggaatttgggggtactatgactgaccctgatggaaatcctaaatgtctgaccaaaatcaactacggcggggaggtgccaaagtcatactatctgtgcgagcaggtacgattacaatacgagcacactaggagcgtgggacgtggttcaagtctgcaagtggagaatgagatcctcttccccggttgtgtgctgaggtggcagtttgcgtccgatggaggtgacatcgggtttggagtgttccttaagactaagatgggtgagcagcagagcgccagggagatgacggaggtgctcccatcccagaggtacaacgcccacatggtcccagaggatgggtctctcacatgcctgcaagccggggtttacgtgctgcgctttgacaatacatacagccggatgcatgctaaaaagttgagttacaccgttgaggtgctcctgccagacaaggcaagtgaggagacactgcagtcacttaaggccatgcgcccgagtcccactcagtag

SEQ ID NO: 204358 - DNA, 1083 bp, Artificial Sequence
  Description of Artificial Sequence: Synthetic coding sequence
atgagcagccgggtgggcgacctgagcccccagcagcaggaggccctggccaggtttagagagaatctgcaggatctactacctatcctgcccaacgctgacgactatttcttgctccggtggctccgagcacgcaacttcgatctacagaagagcgaagacatgctccgccggcacatggaattcagaaaacagcaagacctagataacattgtgacctggcagccccccgaggtgatccagctgtatgattcagggggcttatgcggttacgattacgagggttgtcccgtctacttcaacatcatcggatccctggaccctaaaggactgctactgtctgctagtaagcaggatatgatcagaaagcggatcaaggtctgcgagctgctgctccacgagtgtgaactgcagacacagaagctcggtaggaagatcgagatggctctgatggtgttcgatatggaagggctgtcacttaagcacctgtggaagccagcagtcgaggtataccaacagtttttctctattctcgaggccaactatcctgagacactcaagaatttgatcgtgataagggcaccaaaactctttccggtcgctttcaaccttgtgaaatcatttatgtcagaagagactcgcaggaaaatcgtgatcctcggcgacaactggaagcaagagctgacaaagttcatttccccagaccagttgccggttgaatttgggggcaccatgaccgatccggacgggaatccgaagtgcctgacaaagataaattatgggggggaggtccccaagagctactatttatgtgagcaagtccgcctgcagtatgaacacactcgatctgtgggacggggaagctctctgcaggtggaaaacgagatcctgttccctggctgtgtgcttagatggcagtttgccagcgacgggggtgacatcgggtttggggtgtttctgaaaactaagatgggtgaacaacaatcggcccgggaaatgacagaggtgttgccttcacagcggtacaacgcccatatggttccagaggacggaagtttgacttgcctgcaggccggagtctag

SEQ ID NO: 204359 - DNA, 1083 bp, Artificial Sequence
  Description of Artificial Sequence: Synthetic coding sequence
atgctgcggcggcacatggagttccggaagcagcaggacctggacaacatcgtcacgtggcaacctccggaggttatacaactctacgatagcggcgggctatgcgggtacgactacgagggatgccctgtatacttcaatatcattggctctctagacccaaaagggctgctgctgtccgctagcaagcaggacatgatccgtaagagaattaaggtgtgtgagttgctgttgcatgaatgtgagctgcagactcaaaaacttggtaggaaaatagaaatggcattgatggtcttcgatatggaaggtctcagtctgaagcacctgtggaaacccgccgtcgaagtctatcagcagtttttctccattctggaagccaactacccagagacacttaagaaccttatcgtcatccgcgcccccaaactgttcccagtagccttcaatctagtgaaaagcttcatgtccgaggagacccgcaggaagattgtgatacttggagataactggaaacaggaactgacaaagttcatctctcctgatcagttacccgtggagttcggcggcacaatgacagatcccgacggcaacccaaaatgtcttactaaaataaattatgggggagaagtgcctaagagctattatctatgcgagcaggtgcgactgcagtacgagcataccaggtccgtgggccggggatcatccttacaggtggagaacgagatcctgttcccaggatgtgttctgaggtggcagttcgcttccgacggtggggatattggcttcggtgtttttttaaagaccaaaatgggagagcaacagtctgcccgcgagatgacagaggtgctgccctcacagagatataatgcacacatggtgccagaggacgggagtcttacctgtctacaggcaggtgtgtacgttcgaggattgtgttccctaatcacctctccctccctgcaaatgagttgcgctagcacaactcccacagctggatgcatgccacgtagcagtgccacgctctggcgctgctgttttccgacgaggcctctccgccgcagatgtagagtcagtcgccgatag

SEQ ID NO: 204360 - DNA, 1176 bp, Artificial Sequence
  Description of Artificial Sequence: Synthetic coding sequence
atgctgatgaccaccagcagctgcgccggctgcgagctggagaccttgacgtgccgcaatcccaagacttgtagcgaaggccccaagagcccccagcccacctcatgcccacacgcactgagagcatggcacatggaatttcgaaagcagcaggacctggataatatcgtaacatggcagccgcccgaagtaatacagctgtatgatagtgggggcctgtgcgggtatgactacgagggatgccctgtgtactttaacattattggatccctggatcccaaggggttgctgctatcagcctctaagcaagacatgatacggaaacggatcaaagtgtgtgagttgctgctccatgagtgcgagctgcaaacacaaaagcttggccgaaagattgagatggcgttgatggtctttgatatggaaggattgtctctcaagcatctctggaaaccagcagtcgaagtgtaccagcagtttttctccatattggaggccaattacccggagacactcaagaacttgatcgtcatacgcgcacctaagttatttccggtggccttcaatctcgtaaagtcttttatgtctgaagaaactcgcaggaagattgtgattcttggtgataactggaaacaggaactaacaaagtttataagcccagatcagctcccagtggaatttggcgggacgatgacagaccccgacggcaatccgaaatgtttaaccaaaatcaattacggaggtgaggtgcctaagtcatactatctctgtgagcaggttcggttacagtacgaacatacccgttccgttggcagggggagctccttgcaggttgagaacgagattctgtttccgggatgtgtgctgcgctggcagtttgcatctgacgggggcgacatcggattcggagtgtttctgaagacaaagatgggggagcagcaatctgctcgggagatgaccgaggtgcttccttctcagcggtacaacgcacatatggtgcccgaggacggaagtttgacttgtctgcaggcgggcgtctacgttctgcgttttgataacacttatagcaggatgcatgctaagaagttatcttacactgtggaggtgttattgccagacaaggcttccgaagagacactgcagtctttgaaagccatgagaccatcccctactcagtag

SEQ ID NO: 204361 - DNA, 2256 bp, Artificial Sequence
  Description of Artificial Sequence: Synthetic coding sequence
cccgccgccgccgccagcagcctggagcgggagaccgagcggttcagagagctgttattgtatgggaggaagaaggatgcactggagtccgccatgaaaaacgggctttggggtcacgccttattactggcttcaaagatggattcgcgcactcacgcgagggtaatgacgaggtttgctaactctctgccgattaacgaccccctgcagaccgtctaccagctgatgtctggtcgcatgcccgccgcttctacatgttgtggggatgaaaaatggggcgattggcgacctcatctcgcgatggtgctttctaacctgaataataatatggacgtcgaatccagaactatggccacaatgggcgataccctggcatcccgaggtcttctcgacgcggcacatttttgctacttgatggcacaggccgggttcggcgtgtatacaaagaaaactaccaagttagtgctgattggcagcaaccactctctgcctttcctgaaattcgcgacaaatgaggccattcagagaacggaggcttatgaatacgctcagtccctgggggctgaaacttgtcccctgccttcctttcaggtgtttaagttcatttatagctgccgacttgccgagatgggactggcgacacaggctttccattattgcgaagccatcgcgaagtccattttgacacagccacacctctactctccggtgttgatttctcaacttgtacaaatggccagtcagctccgcctgtttgacccacaattgaaggagaaacctgaggaagagagtctggctgcgcccacttggctggtgcacttgcaacaggtggagaggcagatcaaggaaggggccggcgtgtggcatcaggacggggcactgccgcagcagtgccccggaacaccatcaagtgaaatggagcagctcgatagacctggcctgagtcagccaggcgccctcggaatcgccaacccgctgttggcagtgcctgcaccaagcccagaacatagttcaccatcagtgagattgcttcccagcgccccacagacactgcccgacggccctctcgcgagccccgctcgggttcccatgtttcccgtacccctgcccccggggcccctggagccagggccaggatgtgttacccctggccctgccttgggttttttggagccctccggtccaggactgccccccggagtcccccccctacaggaacgccggcatctgttacaggaggccaggtctcccgaccctgggatagtgcctcaagaggcccccgtgggcaacagtctgagcgagctcagcgaagagaattttgacggtaaattcgcgaaccttacgccctcccgtactgtacctgattccgaagctccccctggatgggatcgcgcagattcgggccctactcagcctccactcagtttaagtccggcgcctgagactaagagacctggacaggctgccaagaaggaaaccaaagagcctaaaaagggcgagtcttggtttttcagatggcttcccggaaaaaaaaaaaccgaggcctatttgcccgatgataagaacaaatccatcgtctgggatgagaagaaaaaccagtgggtaaacctcaatgaacctgaagaggagaaaaaggcacctcctccacctcccactagtatgccgaagaccgtgcaggctgcccctcctgccctgcctggacctccaggtgcaccggtaaacatgtattcccggagagcagcaggcactcgagcccggtacgtggacgtgctgaatcccagcggtacacagcggtccgaacctgccttagcgcccgctgatttcgttgccccactcgctcctttaccaattccttccaatctttttgtgcctacgccagacgccgaggagccccagctcccagacggaacaggccgggagggccccgctgcagcaaggggtcttgctaatccagaacctgcccccgagcctaaagtgcttagttcagcagctagccttcctggcagcgaactgccgagctctcgcccggaagggtcacaaggtggagaactctcacgctgcagttcaatgtccagcttatctcgcgaagtcagccagcatttcaaccaggcaccgggggacttgcccgctgccggcggacctccttcgggtgctatgcccttctataaccccgcccagctggcacaggcctgtgcaacctccggaagcagtcggctcgggagaatcggtcagcgcaaacatcttgttctgaactag

SEQ ID NO: 204362 - DNA, 6480 bp, Artificial Sequence
  Description of Artificial Sequence: Synthetic coding sequence
atgcccggcctggaccggcccctgagccggcagaacccccacgacggagtagtaacccccgccgcaagccctagtcttcctcagcctggactgcagatgcctggacagtggggcccagttcagggtgggccacagccgtccggtcagcacagaagcccttgccccgagggtcccgtacccagtggagtaccttgtgccacaagtgtcccccacttccccacccccagcattcttcaccaaggccctggccatgagcagcactcccctctcgtggcccccccagctgcgctacctagcgacggaagggatgaggtctcccatttacagagcggttcacacctagcgaataactcagacccggaatcaactttccggcaaaacccccgcatcgtgaaccactgggcgtcacccgagctccgacagaatcccggagtcaagaatgagcatcggccagcttccgcactggtcaaccctctggcaagaggggattctcctgagaatcgcacacaccatcccctgggcgcgggggcgggctccggctgtgccccattggaggcagactccggcgcatccggtgcgcttgccatgttttttcaagggggggaaactgagaatgaggagaatttgtccagcgagaaggcgggtctttcggggcaggccgatttcgacgatttctgcagcagtcccggcctagggaggcccccagcaccaactcatgtgggtgcaggaagcctgtgtcaggccctgttgcccggcccatcgaacgaagccgctggtgatgtgtggggagataccgcctccaccggagtccctgacgcctctggcagccagtatgagaacgtagagaacctcgagtttgtccagaatcaggaagtcctcccgtcagagcctctgaatctggacccctcatctccctcagaccaatttagatacggccctctgccaggccctgccgttccacgccacggagcagtgtgtcataccggtgctcccgacgctaccctccacaccgtccacccagactctgtgagctcatcctactcctcaaggagtcatgggaggttgagcggcagcgccaggcctcaggagctggtgggcaccttcattcagcaggaagtggggaagccagaagacgaagcctcgggttccttcttcaaacagatcgacagttcccccgtcggtggagaaacggatgagacgaccgtctcacaaaactatcgcggcagtgttagccaacccagtacaccaagccccccgaagcctacaggtatttttcagacctctgccaactctagctttgagcccgttaaaagccacttagtcggggtcaagcccttcgaggctgatcgagccaatgtcgtcggtgaggtgagagaaacctgtgtgagacagaagcagtgtcgaccagccgccgctctcccagatgccagcccaggtaatcttgaacagcctcctgataacatggaaaccctctgtgctccacaggtgtgtcctctcccactgaattccacaaccgaggcagtccacatgttgccccatgccggggcgcctccccttgacaccgtctatcctgcgcctgagaagcggcccagtgcgaggacccagggtcccgtgaagtgcgaatcgccggctaccactctgtgggcacagagcgaactgcctgactttggcgggaatgtcctgctggccccagccgctcctgcgctgtacgtctgtgcaaagccccagcctcctgtggtccaacctcccgaggaagcaatgtcaggccaacagagccgtaacccctcttccgcagcccccgtgcagtcccgcggcggtattggcgcttctgaaaacctggagaacccaccgaagatgggggaggaggaggcattgcagagccaagcctctagcgggtatgctagcctactgagctccccacccaccgagtctctacagaacccaccagttctgatcgctcagcctgatcactcatacaacctggcgcaaccaattaatttttctgtgtccctgtccaactcacatgagaagaaccagagttggcgcgaagccctcgtcggagatcggcctgccgtgagctcatgggccttagggggtgatagcggggaaaataccagcctttcaggtattcctacatcctccgtactgagcctctcgctgccatcctcagttgcccagtcaaacttcccccaaggctcaggagcttccgaaatggtctctaaccagccagccaaccttttggtgcagcctccaagccaacctgtccctgagaacttagtgcctgagtctcaaaaggatcgcaaggccgggagcgctctgccaggcttcgccaactcaccggccggttccactagcgtggtgcttgtacctcccgcccacgggaccttggtccccgatggcaataaagcaaaccattccagccatcaggaggacacatacggagcactcgactttacgctgtcaagaacccttgaaaatccagtgaatgtgtacaacccctcccactcggattccctcgccagtcaacagagtgtcgcaagtcatccgcggcagtcaggaccgggcgcgcccaacctggaccgcttttaccagcaagtaactaaggacgcacagggacaacctggcctggagcgggcccagcaggagctggtcccaccacagcagcaggcgtccccacctcaactccccaaggcaatgtttagcgaactatcgaatcctgaaagcctccctgcccaggggcaggctcaaaactccgctcagagtcctgccagtctcgtactggtcgacgccgggcagcagttgccccctagaccccctcaatcctcttcggtgtctctcgtgtcttcaggtagtgggcaagcagctgtgccctccgaacagccttggcctcagccagttccggctctcgcccctgggccaccaccgcaggacttggctgcctattactattaccgccctctttatgacgcttatcaaccacagtacagtttgccctatcccccagagcctggcgcagccagcttgtattaccaggacgtgtacagcctgtatgaaccacgatatcgcccctacgacggcgccgcaagcgcctacgcacagaactatagataccccgagccagagcgtccatccagtcgtgcctctcacagctccgagcgcccgccacctcgtcagggatatcccgagggatattatagttctaagagtgggtggtcttcgcagtcagactattatgcttcttattattcaagccagtatgattatggggaccccggccattgggatagatatcattactcagcccgcgtgagagatccgaggacctatgaccgaagatactggtgcgacgcagagtatgacgcctacaggcgggagcattctgcctttggtgataggcccgagaaacgcgataataactggagatatgatcctcgctttaccgggtctttcgacgatgaccccgaccctcatcgggatccttacggcgaggaagtcgatagacgtagcgtccactcggagcacagtgcccggtccttgcacagcgcacattcattggcttcccgccgatcaagcctgagttctcactcgcaccagtcacaaatctataggagccataatgtggccgcaggttcttacgaagctccattacctcctggatcatttcatggggacttcgcctatggcacataccgctcaaattttagctctggaccgggctttccagagtatggatacccagccgataccgtgtggcctgctatggagcaggtgtctagtagaccaactagccccgagaagttttctgtgccacacgtgtgcgcacgcttcgggcctggcggtcagttgatcaaagtaatccccaatctgccatcagagggccaacccgccttggtggaggtgcacagcatggaagctcttctccagcacaccagcgagcaagaagagatgagggccttcccaggccccctggctaaagatgacacgcataaggttgatgtcatcaatttcgcgcagaacaaggcaatgaaatgtctgcaaaacgagaaccttatagataaagaatctgctagccttctttggaattttattgtgcttctgtgcagacagaacggaactgtagttggtaccgacattgcggagcttctgttgcgagaccacagaactgtgtggttgccaggaaagagccctaatgaagcgaaccttatcgacttcacgaacgaggctgtagagcaggtcgaggaggaagagtctggcgaagcccagctttcatttctgaccgggggtccagcggccgcagctagctccctggaaagggagacggaacgcttccgcgaactccttctctatggccgcaagaaggatgctctggaaagcgctatgaaaaacggtctgtggggccatgcacttctgctcgcttccaaaatggactctcggacccatgccagagtaatgacccggttcgccaattccctgcctatcaatgacccccttcagactgtgtatcaactgatgagcggacgtatgccagcagcaagcacctgttgcggcgacgagaagtggggagactggcgaccccacctggctatggttctttcaaatctcaataataatatggacgtcgagagtagaaccatggccaccatgggcgataccctggcttcgcgggggctgctcgatgcggcgcacttctgctatctgatggcgcaggccggatttggggtctataccaagaaaactaccaagctcgtgctgattgggtccaatcattccctgccatttctgaagttcgccaccaacgaagccatccaacggaccgaagcttatgagtatgcccagtccctcggcgcagaaacatgccctctcccctccttccaggtctttaaattcatttacagttgccgcctagctgaaatgggtttggctacccaagctttccattactgcgaggccattgccaagtctattttgacacagccacacctttactcaccagtgttaatatcacagctggtccagatggcaagccagctgcggcttttcgatccacagttgaaggaaaaacctgaggaggaatcactggcggctcccacctggctggtgcacctgcagcaggtggagcgacagatcaaggagggcgccggtgtatggcaccaggatggcgctctgccacaacagtgcccgggtacaccctcctccgagatggaacaactggatcgcccgggtctgagtcagccgggcgctctcggcatcgcaaatcctctcctggccgtgcccgctccgagccctgaacattcttctcctagcgtcaggcttctccccagcgccccccagacattgcctgatggccctctcgcatctcctgcccgagtgcctatgttccctgtgcctcttccaccaggcccgcttgagccgggccccggatgtgtaacacctggtcctgcattgggctttcttgaacctagtggacccggactcccccctggtgttccgcctctccaggaaagaaggcacttgctgcaagaggctcgcagtccagacccaggcatcgtccctcaggaagcaccagttggcaattccctgagcgaactcagtgaggagaacttcgacggtaagtttgctaatttaacaccatcccggactgtcccagattccgaagcccctcccggctgggaccgcgccgactccgggcccacacagccgcccctgagtttatcgcccgcccctgagaccaagcgccctggccaggccgccaaaaaggagactaaagaacctaaaaaaggtgagtcatggttctttagatggctcccaggcaagaagaaaacagaggcatatttacctgacgacaagaataagtctatagtgtgggacgaaaaaaagaaccaatgggttaatcttaatgagccagaggaagagaaaaaagcacccccaccgcccccgacaagtatgcctaaaaccgtgcaggcagcgccccctgcgctgcccggtccaccgggggccccagtgaatatgtattctagaagggctgcggggactagggctcgatacgtcgacgtcctgaacccgtctgggacccaaagatcagaaccagccctcgccccggccgatttcgtggcaccactcgccccgctcccaattccgtctaatctcttcgttcccactccagacgccgaagaaccccagttgcccgacgggaccggtcgagaggggcccgctgccgcccgaggcttggctaatccggagcctgcccctgagccaaaggtactgagcagcgccgcttcgctgcctggaagcgaactaccctcaagcagaccagagggtagccagggaggggaggccccaggagatctgcctgctgctgggggaccgccatctggcgctatgccattttacaacccggcccagttagctcaggcatgtgctacgagcggctcatcgcgcctaggcagaattggtcagagaaaacatctcgtattaaactag

SEQ ID NO: 204363 - DNA, 7074 bp, Artificial Sequence
  Description of Artificial Sequence: Synthetic coding sequence
atgcagccccccccccagaccgtgcccagcggcatggccggcccccccccggccgggaaccctagatctgttttctgggcttcgtcaccgtacagaaggcgcgcgaataataacgccgccgttgcccccaccacctgtcctctgcaacctgtgacagaccccttcgccttctccaggcaggcccttcagagcaccccccttggaagttcctctaagagcagccctcccgtgttgcaggggccagctccggccggattctctcaacaccctgggttgttggtgccccatacccacgccagggattcttcgcagggaccctgcgaaccacttcctggccccctaacgcaaccacgggctcacgcatctcctttctcaggtgcactcacgccaagtgcgcccccaggccccgagatgaacaggtccgccgaagttggtccgtcctcagagcctgaagtccagaccctcccttatctgccacattacattcccggggttgaccctgaaacatctcatggcggacaccctcacggcaacatgcccggtctggaccgcccactaagtcgccaaaaccctcacgatggcgtggttacacccgcagcgtccccatctctgccgcagcctggcttacaaatgcccggacagtgggggcctgtccagggtggcccgcagcccagcggccagcatcgcagcccatgtcccgagggccctgtaccaagtggagtgccatgcgccacttcggtcccccactttccgacgccatccattctgcaccagggacccggacatgagcagcactcccccttggtggccccacctgccgccctacctagcgacggcagggacgaggtctcccacttacagtccggctctcacttggccaacaatagtgaccccgaatctacctttcgacaaaacccgcgcatcgttaaccattgggcctcccccgagctcaggcagaatcccggggtaaagaacgagcaccgaccagcgtcagcgctggttaacccactcgcccggggggacagccccgagaatcgtacacatcatccactgggggcaggggccggcagtgggtgtgcgcctctggaagcagattctggcgctagcggagctctggccatgttctttcagggtggcgagaccgagaacgaagaaaatcttagctccgaaaaagcagggctttcaggacaagctgacttcgatgacttttgcagtagtccggggctgggaagaccaccagcaccaacgcatgtaggggccggcagcctctgccaggccctgctcccaggtccatctaatgaagcagcaggcgatgtatggggcgatacagcctccactggagttcctgatgcatcgggttcccagtatgagaatgttgagaatctggaattcgtacagaatcaagaagtacttccatcagaaccactcaacctcgatccatccagtcctagcgaccagtttcgatatggacctctcccaggaccagccgtaccccggcacggcgctgtctgtcacacaggcgcgccggacgccactctgcataccgttcatcccgatagtgtcagttcctcctattcctcgcgttcccacggtcgactctctggttctgcaagaccacaggaattagttggcaccttcatccaacaggaagtcgggaagcctgaggacgaagcaagcggatcattctttaagcagatagactctagccccgtgggcggcgaaacagacgagaccacggtctctcagaactatcgtggatctgtgagccagccatccaccccctccccccccaagcccaccggaatattccagacgagcgctaacagttctttcgaacccgtcaagtcacacctagttggcgtcaagccatttgaggctgaccgtgccaatgtggtgggagaggtacgagaaacttgcgtcaggcaaaaacagtgcaggcctgccgccgccctgccagatgcaagtccagggaacttggagcaacccccagacaacatggaaacactctgcgcgccccaggtctgccctcttcctctcaactccaccaccgaagccgttcacatgttgcctcatgctggggctccgcctctggacactgtgtaccccgcccccgagaaacggccatccgcccggacccaggggcccgttaagtgcgagagcccagcaacaaccctatgggcgcagtccgagctccctgactttggagggaacgttcttttggcacccgctgccccagcactgtatgtctgcgccaagccacagccccccgtggtgcaaccccctgaggaggcaatgagcgggcagcagagcaggaatccatcttcagctgcgcctgtacaatcaaggggaggaataggggcgagcgaaaatctcgaaaatccacccaaaatgggcgaagaagaggccctccagtcgcaggcgtctagcgggtatgctagcctgctctcctccccacctacagaaagcctgcaaaatccaccagtgctgattgcacagccagaccacagctacaatcttgctcaaccaattaatttcagcgtcagcctctctaattcccacgagaaaaaccagtcgtggcgggaggcactcgttggagacaggcccgcagtaagctcctgggccttaggcggcgactctggtgagaacacaagcctttccggaattccaacaagcagcgtactgagcctcagcctgcctagctccgtggctcaatccaatttcccacagggctcaggcgcctccgagatggttagcaatcaacccgcgaacctacttgtgcagcccccttctcaacccgtccccgaaaatctggtccccgagtcacagaaggatcggaaggctggatccgcgctgccaggctttgctaattcccctgccggcagtacaagcgtagtcctggttccaccagctcacggaacccttgtccctgacggaaataaagccaatcattcatctcaccaagaggatacctatggggctctagattttaccctgagtaggaccctcgagaaccccgtcaatgtgtacaacccatcccacagtgactctttggcgagtcagcagagcgtggctagccatccgcgccagagtggtccaggcgcacccaatctcgataggttttatcagcaagtgacgaaggatgcgcaaggacagccgggcctcgaacgcgctcagcaggaacttgtgcctccccagcagcaggcttcccctccacagctgcctaaggccatgtttagcgaactatcaaatcccgagagtcttcccgcgcagggccaggcccagaactccgcccagtcacccgccagcctggtcctagtggacgccggtcaacagttgccacctcgcccgccacagtcaagctctgtctctctggtctcttcaggatccggccaggctgctgtgcctagtgagcagccatggcctcagcccgtccctgctctggccccaggccctccccctcaggacttggccgcgtactattattatcggcccttatatgatgcttaccagccgcagtactcccttccatacccaccagagcctggggctgcctccctatattatcaggatgtgtactctttatacgaacccagataccgaccctacgacggagccgcgtccgcatatgctcagaattatagataccccgaacccgagaggccaagttcaagagccagccacagtagcgagcgcccccctccgcgccaaggatacccagaaggctattattctagtaagagcggctggagcagccagtcagactactacgccagctattatagctcccagtacgactacggcgatcctggtcattgggataggtaccattattccgccagggtgagggatccccgtacatacgatcgcagatattggtgcgatgccgagtacgacgcttataggagagaacattctgcgttcggagatcgccccgagaagcgagacaacaactggcgatacgatccacgatttacaggcagttttgacgatgacccagaccctcacagggatccttacggggaggaagtagatcggagaagcgtgcacagcgagcactcagctcgctccctgcactccgcccatagtcttgcttctcggcggtcctcacttagttcccactcgcaccagagccaaatttatcgttctcacaacgtagccgcgggctcttacgaagcaccgctgccacctggcagctttcatggtgatttcgcctacggtacataccgcagcaacttttcctcgggccccgggtttcccgagtacggatacccggctgacaccgtctggccagcaatggagcaggtttcctcacggcccacatcccctgaaaagttttctgtgccacacgtgtgcgctcggttcggtccaggtggccagctcataaaagtgatccccaatttgccatccgaggggcagccagcgctggtggaggtgcatagcatggaggccttgttgcagcacaccagtgagcaggaggagatgcgggcgtttcccggaccgttggccaaagatgatacgcataaggtggacgtaataaacttcgcacagaataaggccatgaaatgtctgcagaacgagaatctgatagacaaagagagcgcctccctgctgtggaacttcattgtattgttgtgccgccagaacggcaccgtggttggtaccgatatcgcagagctgttgctcagggatcacagaacagtctggctcccaggaaagagcccaaatgaagccaatctgatcgactttaccaatgaggcagttgaacaggtggaggaggaggagtctggggaagcacagctgagttttctgacaggagggcccgctgctgcggccagctccttggaacgcgaaaccgagcggtttcgggaacttcttctctacggaaggaagaaagatgccctcgagagcgcaatgaaaaacggcctgtgggggcatgcgttactcctcgcgtccaagatggactcaagaacgcacgctagagtgatgactaggttcgctaacagccttcctattaatgatcccctgcagactgtgtatcaactaatgtccggtaggatgcctgccgcttctacatgttgtggagacgagaagtggggcgactggcggccgcatttagccatggtccttagtaatctcaataacaatatggatgttgagagtcgaacaatggctacaatgggagatactctcgcctctaggggcttgctcgatgccgcacatttttgctacctcatggctcaggccggctttggcgtgtatacgaaaaaaacaaccaaattggtgcttataggttctaaccacagtctgccatttctgaagttcgccaccaatgaggcaatacagcggactgaggcctacgagtatgctcagagtttgggcgctgagacgtgtccacttccatccttccaggtcttcaaatttatttactcttgtcgccttgcagaaatggggctggcaactcaagccttccactattgcgaagctatagccaaatctatcttgacacaaccacacttgtattctccggtgctgatttcacaactggttcagatggctagccaactgaggttgtttgacccgcaactgaaggaaaagccggaggaagaatcactcgccgcaccaacgtggctggtgcacttgcagcaggttgagagacaaattaaggagggagcaggcgtgtggcaccaggacggcgccttgcctcagcaatgcccaggcaccccaagctccgagatggagcaacttgatagaccaggcctttcccagcccggggccctaggtatcgctaatcccctcttagctgtgccggccccctcgcccgagcactcaagcccctccgttcgactgcttccctccgcaccccaaacccttccagatgggcctctggctagtccggcaagggtccccatgttccctgtcccactcccaccaggacccttagagccgggacccggatgtgtcacccccggacccgcgctcggcttccttgagccctccggaccaggactcccacctggtgtgccgccacttcaggagcgtcggcatctcctgcaggaagccaggtctccagatccagggatagttcctcaggaagcaccagtggggaacagtctgtctgagctgtcagaggaaaacttcgatggtaagtttgcaaatctgacccctagtaggaccgttccggattcagaggctccacccggctgggatagagccgatagtgggcccactcagcctcccctaagcctgagcccagcccccgagaccaagcgacccgggcaagcagcaaagaaggagacaaaggagccaaaaaaaggagagagttggtttttcaggtggctgcctggcaagaagaagactgaggcttacctccccgatgacaagaataagtcgatcgtgtgggacgagaagaaaaaccagtgggtaaatcttaatgagcccgaggaagaaaaaaaagcaccgccccctccaccaacttctatgccaaagacagtacaagctgctccccctgcgctgcctggccccccaggggcaccagtcaatatgtactccaggcgggctgcagggacacgcgcccgctatgtagacgtgctgaacccatccgggacccagcgctctgaacccgccctggctcccgctgattttgtggcccctctcgcaccactgcccattccgagcaacctcttcgtacccactcccgatgccgaggagccgcagctccccgacggtaccgggagagaaggccctgcagcagcccgcggattggccaatcccgagccggctccagagccaaaggtgctgtcctctgccgcatcactccccggctccgaactcccaagcagtcggccagaaggctctcagggaggtgaattaagtcggtgctctagcatgtcctcgctgtcacgcgaggtgagccaacatttcaaccaggcccctggggacctgcccgccgctggcggccccccatccggcgcgatgcctttttacaacccggcccaactggctcaagcgtgcgcgacttcgggctcttcgaggctgggtcggataggccagcggaaacatctggtgcttaactag

SEQ ID NO: 204364 - DNA, 1158 bp, Artificial Sequence
  Description of Artificial Sequence: Synthetic coding sequence
atggacctgctgcccaccagcatcctgctggccagcctgtggatctgctcccatcttcacccacctggggtgtcggtcgatctaccccccaccagcatattgctggtctctctttggatctgctcccatttgcacccccccggagtgagtgtagatcgccctccacccccttcctcatggtgcttatgtggtagccctcctaccagcatactcctagttagcctctggatctgctctccccctccaagttcatggtgtctgtgcgggagcgcgcccaccagcattctccttgtttccctctggatatggagactgtggggcctgactgagggcgagtcttggttcttcaggtggctgcctggcaagaaaaagaccgaggcataccttcctgacgataagaataagtcaatcgtctgggatgagaagaagaaccagtgggtgaacctgaacgagcctgaagaggagaaaaaggctccacctccacctccaacctcaatgccaaaaactgtgcaggccgcccctccagcactgccagggccccccggggcccccgtgaatatgtatagtcgcagagccgccggcaccagggcaaggtacgtcgatgttctgaatcctagtgggactcagaggtctgagcctgctctggcacccgccgacttcgtggcccctctggcccccctcccgatccctagtaacctgtttgtcccgacgcctgttagctcggtccggcctcaagggcgttcaggtcgaaacgatggactactcgctctctccagccctgacgccgaggagccacagctgcctgacggcacaggcagggaggggcccgctgcagcaagggggctggcaaaccctgagcctgcgccagagcccaaggtgctttcatccgctgcgtcgctgccagggtctgagctgccttcttctagacccgagggatctcagggcggcgaattgtctcgctgctcttctatgtcgtcactgtctagagaagttagccagcattttaaccaagctcctggtgatctcccggctgccgggggccctcctagtggggctatgcctttttacaatccagcccagttggcccaggcctgtgcgacttccggcagctcaagactcgggagaatcgggcagagaaaacacctagttctcaattag

SEQ ID NO: 204365 - DNA, 6405 bp, Artificial Sequence
  Description of Artificial Sequence: Synthetic coding sequence
atgcccggcctggaccggcccctgagccggcagaacccccacgacggtgttgttacaccggctgcttcaccaagtcttcctcagcccgggttgcagatgccgggccagtggggtcccgtccagggtggacctcagccctctgggcagcaccggagtccttgtcctgagggtcccgtgcccagcggtgttccttgcgctacctctgtgcctcattttcccaccccaagtatacttcatcagggccctggccacgagcagcatagcccgctggtggcaccacctgccgccctgccttccgatggcagagatgaggtaagccatctgcaaagcggaagtcatctggctaataactccgatcccgagtcaacattccggcaaaacccccggatagttaatcattgggctagtcctgagctgcgacagaatccgggggttaagaacgagcacaggccagcctcggctttggtgaatcctttggctcgcggagactcaccagagaatcgcacccaccatcccctcggcgccggggccggctccggatgtgctcccctggaggccgactcaggggcctccggtgcactcgccatgttcttccaaggaggcgaaacagagaacgaggagaatctgtcctccgagaaggccggcctctcgggacaggccgacttcgacgacttttgctcatcacccgggttggggagaccaccagctcctactcatgttggagctggcagcttatgtcaggcattactcccgggcccgtccaacgaggccgcaggggatgtgtggggagacaccgcatctactggggtgcctgatgcatctggctcgcaatatgaaaatgtggagaatcttgagttcgtgcaaaatcaggaggtcctgcctagtgagccacttaacctagacccctctagcccttccgatcagtttagatatggtcctctccctggcccagctgtgcctcggcacggcgccgtctgccacacaggtgccccagacgcaacactgcacactgtccatccagattctgtgagctcatcatattccagcagatcgcatgggagactgagtggatcagctcgccctcaagaactggtaggcacattcatccagcaggaagtgggcaaacccgaggacgaggccagcggctcatttttcaaacagatcgactccagtccagtgggtggagaaaccgatgaaaccactgtcagccagaattatcgggggagcgtgtcgcaaccttcaacaccatctcccccaaaaccgactggaatctttcaaaccagtgccaattccagctttgagccggttaaaagccacttggtgggagttaagccatttgaagccgatcgcgccaacgtcgtaggcgaggtgcgcgagacttgcgtccgccagaagcagtgtcgccccgcagccgccctacccgacgcaagccctggaaatctggaacagcctcccgacaatatggaaaccctctgcgcaccgcaggtgtgccccctgccactcaattctactacagaggcagtgcatatgctcccccatgcaggcgcacctcccctagatacagtctaccccgctcctgaaaagagaccgagtgctagaacgcagggcccagtcaagtgtgagagtccagctactaccttatgggcccagagcgaactccccgactttgggggaaacgtcctgctcgccccagccgcacctgctttatacgtgtgcgcaaagcctcagccaccggtggtccagccacctgaggaggctatgtcaggacagcagtcaagaaatccaagtagcgcagcccccgttcaatccagagggggaataggggcatcggaaaacctggagaacccgcccaagatgggcgaggaggaggcactacagagccaggcctctagcgggtacgctagcctattgtcctcccctccaaccgagtctttacagaaccccccagtactgattgcccagcctgaccacagctataacttggcgcagcccattaacttttcggtgagcctgtcgaactcccatgagaaaaaccagtcttggcgcgaagccctcgtgggtgatcggcccgcggtgtcctcatgggctctcgggggcgactctggggaaaataccagcctcagcgggatcccaacttccagcgtgctatctctttctctgccatctagcgtggcccagtctaacttccctcagggttctggggcctctgaaatggtgtctaaccagcccgctaacctcctcgtgcaaccgccttctcagccagtgcccgagaaccttgtgccggaatctcagaaagataggaaagccggaagcgcgctcccaggctttgccaactctcctgccggatctacctcagttgttctcgtccctcctgctcacggcaccctggtgccagacgggaacaaagccaaccacagttctcaccaagaagatacctatggagcactggatttcaccttgtcaagaaccctggagaatcccgtgaatgtctataaccctagtcactccgactcattggcctcacagcagagcgtagcctcccacccaaggcagtccggtccaggcgctcccaacctcgatcgcttttaccagcaagtcacaaaagacgcccagggacaacccggactcgaacgcgctcagcaggagctcgtgccaccccaacagcaggcctctccacctcaactgcctaaggctatgttctccgagctgagcaacccagagtcgctgcccgctcagggccaggcccagaattcagcccagagccctgcctctttggtgctggtcgatgctgggcagcaacttccgcccagacccccccagagttcatctgtgtcactggttagttctggctcaggtcaggccgcggtgcccagtgagcagccatggcctcagcccgtgcctgcactcgctcctggtccacctccgcaggatctggccgcctattattactaccgcccactctatgacgcgtatcagccacagtactctcttccctatccacctgaaccaggtgctgcttctctctactatcaggacgtctactctctgtatgagcctcgctatagaccgtacgatggcgctgcttccgcttatgctcaaaactatcgctatcctgagccagaacggcccagctcaagagcctctcattcctctgaaaggcctccacctaggcaggggtacccagaggggtactactcttcgaagagtggctggagctctcagtccgactactatgccagttactattctagtcagtacgattatggagatcctggacactgggaccggtatcattacagcgcacgcgtgcgggatccaagaacatatgaccgacgatactggtgtgacgctgaatacgatgcctacaggagggagcattcagctttcggcgacaggccggagaagagagataataactggcggtacgatccccgatttaccggaagcttcgatgatgatcccgatccccacagagatccctacggcgaagaagtggaccgaaggagcgtgcatagtgagcacagcgcacgatccctacattctgcccactcactggccagccgacgtagctccctcagctctcatagccaccaatcacaaatttaccgttcacacaatgttgccgccggtagttacgaggctcccctaccaccggggagtttccacggcgatttcgcttacggcacataccgttccaactttagtagtggtccgggattccccgaatatggttatcctgccgacacggtgtggcccgcaatggaacaggtgtcatcaaggccaacctcccccgaaaagttcagcgtgccacacgtttgcgcaagattcggacccggaggtcagcttattaaggtgatcccaaatttgccctccgaggggcagccagctcttgttgaggtgcactccatggaggctttgctccagcatactagtgagcaagaggagatgagagcttttccaggacccctcgccaaagatgatacgcataaagtagacgtgattaattttgcccagaacaaagccatgaagtgtctgcaaaacgagaacctgattgacaaagagagcgcgagcctattatggaatttcattgtccttctctgccgccagaacggaaccgtggtagggaccgacattgctgagctcctgctcagagatcataggaccgtctggctccccggtaagtcaccaaatgaggcaaatctcatcgactttaccaacgaagctgttgaacaggtagaagaagaggagtcaggagaggcacagctttcgtttcttaccggaggcccagccgccgccgccagctctctcgagagagaaacagagcgctttagggagctcctgttgtacggtagaaagaaagacgcactggagtctgcgatgaaaaatggactgtgggggcacgcactgctgctggcgtccaagatggatagtcgtacccacgctagggtaatgacccggttcgccaacagtctgcctataaatgatcccttgcagacagtatatcagctaatgtctggcagaatgccagccgcgtctacgtgttgcggagatgaaaagtggggcgattggagacctcatttggccatggtcttgagtaatctgaacaataacatggacgttgaatcaaggactatggctactatgggtgataccctggctagcagaggcctcctagatgcagcgcacttttgctatcttatggctcaggcggggtttggggtttacacaaagaagacaaccaagctcgtgctaattggctccaaccattccctgccatttctgaaatttgccaccaatgaggccatccagcgtaccgaggcatacgagtatgcccaatcactaggcgctgaaacttgcccgttgccgtcttttcaggttttcaaattcatttattcctgtcgtttggcggaaatgggcctggctactcaggccttccattactgtgaagcaatcgcgaaatcaattctcacccagccacatttatattctcctgtcctgatcagccaactggtgcaaatggcttcgcaattgcggctgttcgatccccagttgaaggaaaagccagaagaggagtctctggcggctcctacctggttggttcacctccagcaggtagagcgtcagatcaaggagggagcaggagtgtggcaccaggacggagccttgccccagcagtgcccaggcactccgtccagtgagatggaacagcttgataggccaggattatcccagccaggtgccctgggtatagctaacccgctgctggctgtgcctgcccctagtccggagcactccagtccttctgtgcgactcctccctagcgcacctcagacactgccggatggcccactggcatcacccgcccgcgtgccaatgttccccgtgcctttacctccaggcccgttggagccaggccccgggtgcgtgacacccgggcccgctcttggcttcctggaacccagtggaccaggtctaccccccggcgtacctcctcttcaagagagaagacatctcttgcaggaggcccggagtcccgatcccggaattgtcccacaggaggcccccgtgggtaactctctaagtgagttaagcgaagaaaattttgatggcaagttcgctaaccttacccccagcagaactgtccccgacagtgaagctcctcccggctgggatcgggcggactctggtccaacccagcctcccctatcgctctcgccagcccctgaaacgaagcggcccggacaggcagctaaaaaggagaccaaagaacccaagaagggtgaatcctggttcttcagatggctgcctgggaaaaagaagacagaagcatacctgccagatgataaaaataaatccattgtatgggatgaaaaaaaaaatcagtgggtcaatctaaatgaacccgaagaggaaaagaaagcgcccccccctccaccgacttctatgcctaagaccgtccaggctgcgccaccagctctgcctggacctccgggcgcaccagttaatatgtacagccggcgcgccgctggaactcgagcaaggtacgtggacgtgctgaacccgagtgggacccagcgttctgagccagccctggcacctgcagactttgtcgccccactggcccccctacctatcccttctaacctgtttgttccaacccccgacgctgaagaaccgcagctgcctgatggaaccggccgggagggacctgcagccgcccggggcttggctaacccagagcctgctcctgaacccaaggcccccggggacctacctgccgctggagggcctccgtccggcgctatgcctttttacaatccagcacaacttgcccaagcctgcgccacgtccggatcatcgcggttgggacgaattggccaacgcaaacacctggtgctcaattag

SEQ ID NO: 204366 - DNA, 423 bp, Artificial Sequence
  Description of Artificial Sequence: Synthetic coding sequence
atggacctgctgcccaccagcatcctgctggccagcctgtggatctgctctcatctccatcctcctggtgtctccgtcgacctgcctccgacttcaattctgctggtgtccctgtggatatgctcccacctgcacccacccggggtatctgttgatcgccccccaccccccagttcatggtgcctgtgtggctctcctcctactagcatattattagtatctttgtggatctgcagccctcccccttccagttggtgcttgtgcggatctgctccaaccagcatcctcttggtctcactctggatttggagactctggggtcttacggaggtaggacatgtggagtttgtcttcctgccttggttgatctcctggaacataatgttttccaagctttttagctgcttcttgtacctgggctag

SEQ ID NO: 204367 - DNA, 2205 bp, Artificial Sequence
  Description of Artificial Sequence: Synthetic coding sequence
atgttcagcgagctgagcaaccccgagagcctgcccgcccagggccaggcacaaaacagtgcccaaagcccagcgtcattggtgctggtggacgccgggcagcagctgcccccaaggccaccacagtcatcttccgtatcattagtgagttccgggtcaggacaggcggccgtgccatcagagcagccatggccccagcccgtgccagctctcgctcccggcccaccaccgcaagatcttgctgcatactactattatcgccctctctatgatgcctatcagcctcaatattcactcccttatccccctgagccaggtgccgcatcattgtactatcaggacgtctattcactgtacgaacctcgctatcgaccatatgacggtgcagccagcgcctacgcccagaattataggtatcccgagcccgagagacccagctcaagagcatctcacagctctgagcgccccccgcctagacagggatatcctgaaggttactactcttctaaatctggatggagcagccagtccgactattatgcaagttactactcgtcccagtacgattatggtgatcccggacactgggaccgataccactattcagcccgcgtaagggacccaaggacgtatgataggagatactggtgtgatgcggagtacgatgcataccggcgcgaacacagtgccttcggagaccggcccgaaaaacgcgataacaattggagatacgacccccgcttcactggaagctttgacgatgacccagatcctcaccgagatccatacggagaagaagtcgaccgccggagcgtccattccgaacactccgccaggagcctccactccgcacacagcctggctagcaggagaagcagcctaagcagtcatagccaccagagtcagatttaccggtcacacaatgtagcagcgggaagctacgaagccccactccctccggggtctttccacggcgattttgcttacggcacataccggtcaaacttctcctcgggacccggatttcctgaatacggatatcgcccggccctgggcttcctggaaccaagtggccccggactgcctccgggcgtacctccactgcaggagaggaggcacttgcttcaggaggctagaagccccgacccaggcatcgtgcctcaggaggctcccgtcggcaatagtctgagcgaactctctgaggagaatttcgacggaaaattcgccaaccttacccctagtagaacggttcccgactcagaagcacctccaggctgggacagggcggactccggacccactcagccgcccctgtccctcagcccagcgccagaaactaaacgccctggccaagccgccaaaaaagagacaaaagagccaaaaaagggcgaatcatggttttttcgctggctgcccggaaagaagaagaccgaagcttacctgcccgacgataaaaacaagtctatcgtgtgggatgaaaagaaaaatcagtgggttaatctgaacgaacccgaggaagagaagaaagcccctcccccgcctcccacaagcatgccaaagacagtacaggccgccccaccggctctacctgggcctccgggagcccccgtcaacatgtatagccgaagagccgccggaactagagcacgatatgtagacgtgctaaacccttccggcactcagagatcagagccagccttggctccagcggattttgtcgctccactggcacctctaccaattcccagtaacttgttcgttccgacacccgtgagacctcaggggagaagtggacgcaacgacgggctacttgccttgtcgtccccagacgccgaagagcctcagcttcctgacggcactggaagagagggccccgccgccgcgagaggactagcaaatcctgaacctgcccccgagccgaaggtcttaagtagtgccgcgtctctgccggggtctgagttgccctcctccaggcctgaagggagccagggcggagaactgtcccgttgcagcagtatgtcttctttgtctagagaggtatcccagcattttaatcaggcgccgggggatctgccagcggctgggggtcctcctagcggagccatgcctttctacaatcctgcccaacttgctcaggcgtgcgccaccagcggctcctcgcgactcggcagaattggtcaacgaaagcacctggtcctcaactag

SEQ ID NO: 204368 - DNA, 5184 bp, Artificial Sequence
  Description of Artificial Sequence: Synthetic coding sequence
atgttcttccagggcggcgagaccgagaacgaggagaacctgagcagtgagaaggcggggctttccggccaagcagactttgacgatttttgctcttcccctggattgggacgcccccccgccccaacacacgtgggagcagggagtttgtgccaggcactgctgccgggcccttctaacgaggctgcgggcgatgtctggggcgatactgcctcaaccggtgtaccggacgcaagcgggtcgcaatacgagaatgttgaaaatcttgagtttgtccagaaccaggaagtgcttccctcggaaccactgaacctggatccctcatctccttccgaccaatttcgctatgggcctctgcctggacctgccgtgccccgtcacggagccgtgtgtcacacgggtgcccctgatgcgactctgcacactgtgcaccccgattccgtgtctagttcctatagttcgcgtagccatggacgcttatccggaagtgcacgcccccaggagcttgtgggaacattcattcaacaagaagtaggcaagcccgaggacgaggcttctgggtcgttttttaagcagatcgactcaagtcctgtgggaggtgaaacagacgaaactacagtgtcacaaaactataggggatcagtaagccagcccagtactccctccccccctaaaccaaccggaatcttccagaccagcgcgaattcttcctttgaacctgtgaaatcacatttggtgggtgttaaaccattcgaagctgacagagccaatgtcgtcggcgaggtacgagaaacctgtgtccgccagaagcagtgccgacccgctgccgccctacccgatgcctcccccggtaacctcgagcaaccacctgataatatggagacactatgtgctcctcaggtgtgtcctcttcccctgaatagtaccacagaagctgtacacatgctgccccatgccggggctccgccactggatactgtgtaccctgcccctgaaaagcggccgtcagctcgcacccagggccccgtgaagtgcgagagccctgctaccactctctgggcccagagcgagctcccagatttcggtggaaacgtactgctagcccctgccgctccagccctctacgtgtgtgccaaaccacagccccctgtggtgcagccccccgaagaggccatgtcaggccagcagagtcggaacccatctagcgcggcaccggtgcagagccgaggcgggattggagccagcgagaatctcgagaatccccccaaaatgggcgaagaagaagcactgcagtcccaggtgaccaaagacgctcaaggtcaacctggccttgagagagcccagcaggaacttgtgcccccgcagcaacaagccagcccccctcagctaccaaaggccatgttttcggaattaagcaatcccgagagtctccctgcccagggtcaggctcaaaactctgctcagtcacccgcctccctggtcctggtcgacgccgggcagcagctacctccaagacctccacagtcttcttctgtatctctagtctccagcggaagcggccaggccgccgtgccaagtgaacagccatggccacagccagtgcccgcactggctcctgggcctcctccacaagatcttgccgcctactactattatcgacctctgtatgatgcctaccaaccccaatactcacttccatatcctcctgagcccggggcagcttccctctattaccaggatgtgtactccctttacgagccaaggtatcgaccctacgacggcgccgcttcggcttatgcacagaactatcgataccccgagccagaaaggcctagtagcagagctagtcattcctccgaacgccccccaccaagacagggctaccctgaggggtattattcatccaagagcgggtggtccagccaaagcgattactatgctagttactacagtagccagtacgactatggcgaccccggacactgggacagatatcactactctgcaagggtcagggacccaagaacctacgaccggcgctattggtgtgatgcagagtacgatgcatacaggagagagcatagtgcattcggcgatcgtcccgaaaagcgtgataataattggcgctatgatccacgcttcactgggtcttttgacgatgacccagaccctcatagggacccttacggggaagaggttgaccgccgctccgtccattcagagcactccgcccggagcctacactcggcacactccctcgcaagcaggcgtagtagcctgtcttcacatagtcatcaaagccagatataccggagccacaacgtggcggcagggtcttatgaggcgcccctgccccctggctctttccatggggactttgcttatggcacttaccgcagcaatttctcatctgggcccggcttcccagagtatggatatcccgccgacactgtgtggcctgcaatggagcaggtgtcaagcaggccgacaagccctgagaagttttccgttccacacgtttgtgctcggtttggaccaggcggccaactcattaaggtcattccaaatctgccatcggaggggcaacctgcactggtggaggtgcacagcatggaagccctcctgcaacacacatccgaacaggaggaaatgcgtgctttccccgggccacttgcaaaggacgatactcataaggtggacgttatcaacttcgcacaaaataaagccatgaaatgtctgcaaaacgaaaacctcattgataaagagagtgcatccttgctgtggaatttcatagtgctactgtgtcgacaaaatggtacagtcgttgggaccgacatcgccgagctgctgctgagggaccatcggactgtctggctgcctggcaagtcccctaacgaggctaacctgatcgacttcactaacgaggcggttgagcaggtggaagaagaggaaagcggagaggcacagcttagtttcctgacaggcgggccagctgcggctgcctcttccttagaacgagaaacggagcggttcagagagcttctgctttatggtcgcaagaaagacgcccttgagagcgctatgaagaacggcctctggggccatgcactcctcctggctagcaaaatggactctaggactcatgcccgggttatgacccggtttgccaattccctgcctattaatgaccctctgcagaccgtgtaccaactgatgagtggaaggatgcctgcagcttccacgtgttgcggagacgagaagtggggagactggaggccccacctagccatggtgcttagcaatctcaacaacaatatggatgtggagagccgcacgatggctacaatgggtgacaccctggcctcaaggggcctgctagacgccgcccacttctgctacctcatggcacaagccggatttggggtgtacaccaagaagacgacaaaattagtgctcattggatctaaccacagcctgcccttcctcaagtttgcgaccaacgaggcaatccaaaggacagaagcttatgaatacgctcaatcccttggcgcagaaacttgcccgctgccttcgtttcaagtgttcaagttcatctattcctgcaggctggccgagatggggctcgcaactcaggcattccactactgcgaagccatcgccaaatccattttaactcagccccacctatactcacctgtgttaatctcacaactcgtccagatggcaagccagctccgtttgttcgatccccagctaaaagaaaaacccgaagaagagtcgctggcagcacctacttggctggtccatttacagcaggtggagagacagataaaggagggtgctggcgtctggcatcaggatggcgctctgccccagcagtgtcctggaacccccagtagtgagatggagcagcttgatcgcccgggcctctcacagccaggtgctctgggcatcgccaacccccttcttgcggtacccgccccctctcccgaacacagttcaccatccgtgaggttactcccttccgctccacaaacactgcctgatggtcctctggcctcccccgcacgggttcccatgttccccgtcccacttccaccaggaccccttgagcccggcccaggttgtgtaaccccaggtcccgccctggggtttctggaacctagcggtccaggcttgcctcctggggtccccccactgcaggagcgcaggcatcttctgcaggaagcgcgttccccagaccctggtattgtgcctcaggaagcccctgtgggcaactctctgagtgagttgtccgaagagaacttcgatggcaagttcgcgaaccttacaccatcccgcaccgtgcccgacagcgaggccccacccggttgggatcgagctgattcagggccaacccagccccccctatccctgtctccagcaccagagactaagcgcccaggacaggccgccaagaaagagacaaaagagcccaaaaaaggtgagtcttggttttttcggtggctgccaggcaaaaagaagacagaagcctatctgccagatgacaagaataaaagcattgtatgggacgagaagaagaaccaatgggtgaacctgaacgaacctgaggaggaaaagaaggcaccaccgccccctcccacttctatgcccaaaactgtgcaagctgcaccgcctgccttacctggaccaccaggggcacctgtgaatatgtattcccggcgggctgccggaacaagagcccgatacgtggatgtcctgaacccgtcaggcacacagagaagtgagcccgcccttgcgcctgctgacttcgtagcccctctggcaccactgcctataccctctaatctcttcgtgccgacacctgatgcagaggaaccacagttaccagatggcaccggcagggaaggcccagcagccgcccgcggattagctaatccagagccggcacccgaaccaaaggtgttgtccagtgccgcctcccttcccggatccgaactgcccagttctcgcccagaaggctcacaaggcggcgaggcgcccggtgatctccccgcggcaggggggcctcctagcggtgccatgcccttttacaatcctgcgcagctggcccaggcatgtgcaacgtctggatcgagcaggcttggtcgcataggacagcgaaaacatctagtcctgaattag

SEQ ID NO: 204369 - DNA, 6465 bp, Artificial Sequence
  Description of Artificial Sequence: Synthetic coding sequence
atgcccggcctggaccggcccctgagccggcagaacccccacgacggagtggtgacccccgccgcctctccgagtctccctcaacccggcttacaaatgcccgggcaatggggacccgtgcagggtggacctcaaccaagcggccagcaccgctccccatgtcccgaagggccagtgccctccggagttccatgtgctacatccgtgcctcactttccaacaccatcaatactgcaccagggacccgggcatgaacagcactctcccctggtcgcccctcctgcggccttgccaagcgacggaagggacgaagtaagccatctacaaagcgggagtcatctggccaacaatagtgatcctgagagtactttcaggcagaatcctcggatcgtgaaccactgggcaagtcctgaactaagacagaatccaggtgtcaaaaacgagcatcgcccagctagtgccttggttaacccattggcacgtggagatagcccagagaacagaactcaccatcctcttggcgctggcgccggtagtggctgcgcgcccttggaagctgacagtggagcgtccggggccctcgcgatgttctttcagggcggagagactgaaaacgaagaaaacctgtcctccgaaaaggcagggctgtcaggacaggcggatttcgacgatttctgcagctcacccgggttggggagaccaccagcgcctacacatgttggggccgggtctttgtgccaggctctcctgcccggtccctccaacgaagccgccggcgacgtctggggtgacacggcttccacgggagtcccagacgccagcggctctcagtacgagaatgtcgagaacctggagtttgtgcagaaccaagaggtcctgccaagcgagccactaaatctggatccttcatccccatctgaccagtttagatacggccccctcccaggccccgcagttccacgacatggcgcagtgtgtcatacaggagcacctgatgcgacactccacactgtgcatcccgacagcgtcagcagcagttactcttcacgttctcacgggaggctgagcggctccgctaggccccaagaactggtgggcaccttcattcagcaggaagtgggtaaaccagaggacgaggctagtggctcgtttttcaagcagatcgattcatccccagtcggaggcgagacagacgagactactgtgagccagaattaccgaggatccgtttcgcagccctccacaccatcccctcccaagcctacaggcattttccagacaagtgccaattcaagcttcgaaccagttaaatcgcatttggtgggtgtcaagcctttcgaagctgatagagctaatgtagtcggagaggtaagggagacttgcgttcggcagaaacaatgtagacccgctgccgcgctgcccgacgcatcccccgggaatttggaacagccaccggataatatggaaaccctttgtgctccccaggtttgtcccctcccattgaattcaacaacggaagcagtgcacatgttgccacacgccggcgctccacctctcgacacagtctaccccgcacccgagaaaaggcccagtgctcggacacagggacctgtgaaatgcgagagtcctgccaccactctgtgggcacagtctgagttaccggactttggggggaatgtcctgctggctcccgccgccccagctctgtacgtgtgcgccaagccacagcctcctgtggtccagcctcccgaggaggctatgtctggacaacagtctcgtaacccatcatcagctgcccctgttcagtcgcgaggcggtattggagctagcgagaacctggagaacccgcccaagatgggggaggaggaggcactgcaaagtcaggcctcctccggctatgcgagcctcctgtcgtctcctcctacagagagtctgcaaaatccgcccgtgctgatcgcccagcccgaccacagctacaaccttgcccagcccatcaacttttccgttagcctgtcgaattctcacgaaaaaaatcagtcatggcgggaagccctggtgggcgacaggcccgcagtgtccagctgggccctggggggagatagtggagagaatacttctctgtctgggatccctactagctcagttcttagtctctcactgcctagcagcgtcgctcagtcaaactttccacagggttcaggagctagcgagatggtctctaatcaaccggccaaccttctggtgcaaccaccttctcagcccgttcctgagaatctggttcctgagtctcagaaggaccgcaaggccgggtccgccctccctggctttgctaattcccctgccggctccacctcagtggtcctggtccccccagcacatgggacccttgtgcctgacgggaacaaggcaaaccactcaagtcaccaggaagacacctatggcgcactggacttcaccctgtcgcggactctggagaaccctgttaacgtatataacccaagccattccgacagcctggcaagtcagcagagcgtagcgtcgcacccgcgtcaaagcggacctggtgctccaaacttggacaggttttatcagcaggtgacaaaagacgctcagggacagcccggtctggagagggcccagcaagagctggtgcccccacaacagcaggctagccctccacagctgcccaaagctatgttctccgagctatcaaacccagagagccttccagcccaggggcaagcacagaacagcgcgcaaagcccagcatcattggtgcttgtcgatgccgggcagcagctaccacctcggcctccccagtctagcagcgtgtccctggtgagcagtggaagcggtcaggcggccgtgccgtcagaacagccctggccccagcccgtgccagctctggcccccggaccacctcctcaggatctggctgcttattactattacaggcccttgtacgatgcctatcaacctcaatatagcctgccttacccacccgaacccggcgccgcctcactgtactatcaagatgtttactctctgtacgaaccaaggtataggccttatgacggagccgcgagtgcctacgctcagaactatagataccccgaaccagaacggccgagttcccgggcatcacactccagcgaaaggccgccacctcgccaagggtaccctgagggctactactcgtcaaagtctgggtggagcagtcagtctgattattacgcgtcatactacagctcccagtacgattacggggacccaggacattgggatcggtaccattactccgctcgcgtcagagatcccaggacatacgatcggcgatactggtgtgacgcagagtacgatgcttaccggcgcgaacacagtgcatttggagatcgccccgaaaagcgcgacaataactggcgctatgaccctagatttacaggaagcttcgacgacgaccctgatcctcaccgcgatccgtacggagaagaggtcgatcgaaggtccgtccacagtgaacacagcgcgcgatcactccacagtgctcacagtctcgcgtcccggcggagcagcctaagcagtcattctcaccagtcacagatttatcgctcgcataatgtggccgcaggctcttacgaggcgcctctgccacctgggtcattccatggagattttgcctatgggacctacagatcaaacttctcttccggccccggattccccgagtatggctatcctgcggacacggtatggcccgctatggaacaggtctcatctaggcccacgagtccagaaaaatttagtgtgccccacgtatgcgccaggtttggcccgggcggccaactcattaaggtgatccctaatcttccgtccgagggacaaccagcgttagttgaggttcattctatggaggctttactccagcacacgtccgaacaggaagaaatgagggctttcccgggacctcttgccaaggacgacacccacaaagtagacgtgattaacttcgcccagaataaagctatgaagtgcctccagaatgagaacttgatcgacaaggaaagcgcttccttactctggaatttcatcgtgctcctatgcaggcagaatggcactgtggtcggcacagacatcgcagaactcctcctgagagatcataggacagtttggcttcctggaaaatcccctaatgaggccaacctcattgacttcacaaatgaggctgtggaacaagtggaggaggaagaaagcggagaagcccagcttagcttcttaaccggaggcccagccgccgctgcgagctccctggaacgtgaaactgaacggtttagagagctgctcctatacgggcgtaaaaaagacgcgctcgagtctgccatgaagaatggtctgtgggggcacgctctgttgctggcttccaagatggatagcagaacacatgccagagtgatgactcgatttgctaactccctccccatcaatgatcctctccagaccgtgtatcagttaatgagtggacgaatgcctgccgctagcacatgttgcggcgatgaaaagtggggtgattggcggcctcacttggctatggttctttctaacctgaataataacatggacgtggagtcaaggaccatggctacaatgggggatactctcgcttcaaggggccttttggatgccgcccatttttgttatctgatggcccaggccggctttggggtttataccaagaagaccaccaaactcgtcctgatcggatcaaaccacagcctgccgtttttgaagttcgccactaacgaagccatacagcggaccgaggcatatgagtacgcccagtccctgggggccgaaacatgtcccctgcctagttttcaggtttttaaatttatctactcatgccgcctggccgaaatgggcttggccacccaggctttccactactgtgaggcaatcgctaagagcatcctcacccaaccccacctttatagccctgtgctcatctcccagctggtccagatggccagtcagctccgtctcttcgatccgcagcttaaagaaaagcccgaggaggaatctcttgccgcccctacatggctggtgcacctgcagcaggtggaacgccagatcaaggaaggggcgggtgtgtggcaccaggacggcgccctgccacagcagtgtccagggacacccagttccgagatggagcaactggaccgaccaggactgagccagccaggtgcgcttggcattgctaacccccttcttgctgtgcccgccccttctcccgaacattcatcaccaagcgtaagactgttgcccagtgcaccgcaaaccctgccggacggccctttggcctctccagctagggtgccgatgtttccagtgccgttgcccccaggcccgctggagcctggcccgggttgtgttacaccagggccagctttgggctttttagagcccagcggtcccggactacctcccggagttccccccctccaagaaaggagacacctgctccaggaagccaggagccctgacccaggaatcgtcccacaggaagcccccgtcggcaatagcctgagcgaattgagtgaagaaaatttcgacggaaaatttgccaacctgaccccgagcaggacggtgccagattccgaagccccccctggctgggaccgtgctgatagcggtcctacacagcctccgttaagcctctctccagcccccgaaacaaaaaggccgggacaggcggcaaaaaaagagactaaggagcccaagaaaggagaatcctggtttttcagatggctgccgggaaaaaaaaagacagaggcttacttaccagatgataagaataaaagtatcgtctgggacgagaagaaaaatcaatgggtgaaccttaatgagcccgaggaggagaagaaggccccgccgccaccccctacatccatgcctaaaacagtgcaggccgccccacctgctctccctgggccaccaggcgcccccgttaatatgtactctcgcagagcggccggcacccgagcacgctatgtggatgtgttgaacccatccggaacccaacggtctgagccagcactcgcgccggccgacttcgtggcccccttagcgccactcccaatcccaagcaatctttttgtgcctactccggacgctgaggagccacagctccctgacggaaccggacgcgaaggacctgccgcggcaagaggattagccaacccagagcctgctccagagccaaagctgtctcggtgttcgagcatgtctagcctctcgcgggaagtgtcccagcactttaaccaggcgcccggcgatttgcctgcagccgggggcccccccagtggtgccatgcccttttacaatccagctcagctagcgcaggcttgtgcaacaagtggaagctcgcgacttggtcgcattgggcagcgcaaacatttagtcctgaattag

SEQ ID NO: 204370 - DNA, 1521 bp, Artificial Sequence
  Description of Artificial Sequence: Synthetic coding sequence
tgaagcgccttcggcgaccggcccgagaagcgggacaacaactggaggtatgatccccggtttacaggctcattcgacgacgatccagacccccacagggacccatatggtgaggaagtcgataggcggtctgtgcactccgagcacagtgcaaggtccctacacagtgcccatagcttggccagccgccggtcgagcctgtcaagccacagtcaccagagtcagatctaccggagtcataacgttgccgctggtagttacgaggctccactcccccctggttcttttcacggtgatttcgcctacgggacttacaggtcaaacttctcctcggggcccggctttccagaatacgggtaccccgctctgggattcctcgagccctctgggccagggttacccccaggcgtgccacccctgcaagagcggagacacttactgcaggaggcccgaagccctgatccaggaattgtcccacaagaagcccccgtcgggaacagcctgtccgagttatctgaggagaattttgacgggaaattcgccaatctgactccaagcagaaccgtgcccgactccgaggctccacctggatgggaccgagctgattccggtcctactcagcccccattgagtttgtcgcctgcccccgagaccaaaagacctggccaggcagcaaaaaaagaaactaaggaacccaaaaaaggtgaaagctggttcttccgatggctgcctggaaagaaaaagacagaagcgtatctgcccgatgataaaaacaagagtattgtttgggacgaaaagaaaaaccagtgggtaaatctgaacgaaccagaagaggaaaaaaaagcaccccctcccccccctactagtatgcctaaaactgtccaagcggcacccccagctctgccgggtccacctggagcccccgtgaacatgtattcccgtcgtgccgccggcaccagagccaggtacgtcgatgttttgaacccctccggaacacagcgcagcgaacccgccctggcacctgctgattttgtggccccactggccccgctgcccattccatcaaatctgtttgtgcccacccctgttcgaccccagggacgttctgggcgtaacgatggtctcttagctctctcctcccctgatgccgaggaaccacagctcccggacggtacaggcagagagggccctgcagcggccagaggcttagcgaaccccgagcctgccccagagcctaaggtgttgtcttctgctgcttccttgcccggctccgagctgccttctagcaggcccgaaggctcccaggggggagagttgtctcgctgtagttcaatgtcatccctgagtcgagaagtttcccagcatttcaaccaggctccaggggacctacccgctgctggaggaccaccatctggtgcaatgcctttctacaacccagcccagctcgcccaagcctgtgccaccagcggcagctctcgattggggaggattggacagcggaaacacctcgtcctcaactag

SEQ ID NO: 204371 - DNA, 3180 bp, Artificial Sequence
  Description of Artificial Sequence: Synthetic coding sequence
gcccgggtgcgggacccccggacctacgaccggcggtactggtgcgatgctgagtatgacgcatacaggcgggaacattcagcatttggggacaggccagaaaaacgggacaataattggcgatacgatcccaggtttacaggcagcttcgacgacgacccagacccacatagagacccctatggcgaggaggtcgaccggaggtcagtccattctgagcacagcgctagatccctgcactcagcacactctctggccagccgtcggagtagcctctcttcacacagccaccagtctcagatttatcgttcccacaatgtggccgccggcagttacgaggcacccttgccacccggaagtttccatggcgatttcgcatacggcacctaccgctccaacttcagcagtgggcccggattccctgagtacggctacccggctgacactgtgtggcctgccatggaacaggtaagttccagacctacatctcccgaaaagttctccgtgccacacgtctgcgcgaggtttgggcctggaggccaacttataaaagttatccctaacctcccttccgaggggcaacctgcactagtggaggtccacagtatggaagccctgcttcagcacacctctgaacaagaagagatgagggcgtttccaggtccgctcgccaaggacgatactcacaaggtggacgtgattaactttgcccagaacaaggcaatgaagtgtctgcagaatgagaacctcatcgacaaggagagtgcgagtcttctgtggaatttcatcgtgctcctctgccgccaaaatggaaccgtggtcggcaccgatatcgcagagctccttctgcgcgatcatagaactgtttggctgcctggaaaatctcccaatgaggccaacttaatcgacttcactaatgaagccgtagaacaggtggaagaagaggaatctggcgaggcccagctttctttcttgaccggcggcccagccgcggcagccagtagcttagagcgagagaccgaacgctttagagaattacttctctacgggagaaaaaaggatgctttggagagcgccatgaagaacggactatggggacatgcactgcttcttgcttcgaagatggatagtagaacccacgctcgggttatgactaggtttgccaacagcctacccattaacgatcccctgcagacagtataccagctcatgtccggacggatgccagccgcgagtacctgctgcggcgatgagaaatggggggattggcgcccccatcttgctatggtgctgtctaacctgaacaacaacatggacgtggagtcacggacgatggctactatgggagacacgctggctagccgcggcctgctggacgcggcacacttttgttacttaatggcacaggccgggtttggcgtatacaccaagaagaccactaagctggttctcatcgggtctaatcacagcctgccattcctgaagttcgccacaaacgaggccatccagcgaaccgaagcctacgagtatgctcagagtctgggtgccgaaacttgccccctgccaagcttccaagtgtttaagttcatctattcctgtagattagctgagatgggtctggctactcaggcctttcactactgcgaggccatcgccaagtcaatcctgacacagcctcatttgtattcacccgtgctgattagccaactggtgcaaatggctagtcagctccggctttttgatccccagctgaaagagaagccggaggaggaaagcctggcagcccctacatggctagtgcacctgcagcaagtcgagaggcagatcaaggagggggcaggagtctggcaccaagatggggctctgccacaacagtgccccggtactccctcttcagagatggaacagttagacaggcctggtctgagtcaaccgggagccctcggaatagctaatccactgttagccgttcccgcaccatccccagagcattcatctccctcagttcggctgcttcccagcgcaccccagaccctccctgatggccctctggccagtccggcacgagtcccaatgtttcccgtacctctgcctccaggccccctcgagcccggtccgggctgtgtaacccccggacctgccctgggcttcctggagccttccggtccagggctgccacccggggtgccgccactgcaggaaaggcgccacctcctgcaagaagctaggtcacctgaccctggtatagtccctcaggaggcccctgtggggaactctctgtcggagctgagcgaagaaaattttgatgggaaatttgcgaacttgacgccttcccggaccgtgcccgattccgaagctcccccaggttgggaccgggcagattccgggcccactcagccaccattaagcctgagccctgcacccgagacgaagagaccggggcaggctgccaagaaggaaaccaaggaacctaagaaaggagagagttggttctttcgatggcttcctggcaagaagaagacagaggcctatttgcccgatgacaagaacaaaagcattgtttgggacgaaaaaaaaaatcaatgggtgaatctgaacgaacctgaggaggagaagaaggcaccacctcccccccccacaagcatgcccaagactgttcaggctgcccctccggcccttcctggaccaccgggtgcgccagtcaatatgtactccaggagggcagctggaacccgagctcggtatgttgatgttctgaacccttccggcactcagcgcagtgagccagctctcgccccagcagacttcgttgcccccctggcccctttaccaatcccctctaatttatttgtccccactcccgatgcagaggaaccgcagctacccgacgggaccggtagagagggccccgctgcggcccggggcctagctaatcccgaacccgctccagaacctaaagttttatcctcagctgcaagtctgccgggaagtgaactgccgtcaagccgaccagaaggcagccagggcggcgaagctcctggggatctcccagctgctgggggtcccccgagcggggcgatgcccttctacaaccctgcgcaactggcacaagcttgcgccacaagcgggagctcaagattagggcggattggccagcgaaagcatttagtgctgaactag

SEQ ID NO: 204372 - DNA, 603 bp, Artificial Sequence
  Description of Artificial Sequence: Synthetic coding sequence
atgcccaagaccgtgcaggccgccccccccgccctgcccggccccccaggagcacccgttaatatgtatagtcgtagagctgctgggactcgcgcccgctatgtagatgtcttgaacccatcaggcacccagagatccgaacctgctctggctcccgcagattttgtggcaccactggcgccactgccgataccttctaacctgtttgtaccaacccctgtgtcatccgtgcgtccacaaggccggagtggtcggaacgatggcctgctcgccctgtcgagtccggacgcagaagaacctcagctcccggatggaaccggcagagaaggacctgccgccgctagggggttagccaatcccgagccagctccggagcccaaggtgttatcttcagcagcgtctctgcccggttccgagctgcctagttccagacccgaggggtctcagggtggcgaggcgcccggagatctgccagccgccggtggacctccttcaggggcaatgcccttttataatcccgctcaattagcccaggcctgtgctacttctggcagcagccgactggggcggattggccagaggaagcaccttgttcttaactag

SEQ ID NO: 204373 - DNA, 924 bp, Artificial Sequence
  Description of Artificial Sequence: Synthetic coding sequence
atgagcatgatcctgagcgccagcgtgatccgggtgcgggacggcctgccactgtctgccagcactgattatgagcagtcaaccggcatgcaggaatgcaggaagtacttcaagatgctctcccggaagctggctcagttgcccgatcgatgtaccctcaagaccggccattacaatatcaatttcattagctcccttggagtgagttatatgatgctttgcaccgagaattaccctaacgttctcgccttttcattcctcgacgaactccagaaggaattcattaccacctataacatgatgaagaccaataccgccgttaggccttactgttttattgagtttgacaattttattcagaggactaagcagcggtacaataatcctagaagtttatcaaccaaaattaacttaagtgatatgcaaacggagataaagctgcgccctccctaccaaatctcaatgtgtgagctcggctcagctaacggcgtgacctccgctttctcagtggattgcaaaggtgccggaaagatctcatctgcccaccaacgcctggagcctgcgactctttccggaatcgtgggcttcatcttatctttgttgtgtggcgctctcaatctcattagggggtttcatgccatagagtctctcctgcagtccgatggggatgacttcaactacataattgccttcttcctaggcacagctgcctgtctgtatcagtgttacttgctggtctactacactggctggcgcaacgtgaagagttttcttacctttggtctcatatgcctgtgcaatatgtatctctatgaactgaggaacctgtggcaactatttttccacgtcaccgtgggagctttcgtcacactccaaatatggctgaggcaggcccagggcaaagccccagactatgacgtatag

SEQ ID NO: 204374 - DNA, 330 bp, Artificial Sequence
  Description of Artificial Sequence: Synthetic coding sequence
atgagcatgatcctgagcgccagcgtgatccgggtgcgggacggcctacctctgtctgcttcgaccgactacgaacaaagtactggtatgcaggagtgtagaaagtatttcaaaatgctctcgcggaagctggctcagttgcctgaccgttgcaccctcaagactggacactacaatatcaactttatatcaagcctcggggtgtcttacatgatgctctgcaccgagaactatccgaacgtgttggctttctcctttcttgacgagttacaaaaagaattcatcacgacgtacaatatgatgaagacgaacaccgccgtacggccatag

SEQ ID NO: 204375 - DNA, 870 bp, Artificial Sequence
  Description of Artificial Sequence: Synthetic coding sequence
atgagcatgatcctgagcgccagcgtgatccgggtgcgggacggcctgcccttaagcgccagcactgattatgagcaaagtactggaatgcaggaatgtaggaagtactttaaaatgttgagtagaaagctggcacagctgccggacagatgtactctgaaaacgggccactataatattaactttatcagctccttgggagtgtcatatatgatgctctgcaccgagaactacccaaatgttctggcattttcttttctcgacgagctgcagaaggagttcatcactacatataacatgatgaaaacgaacactgctgttcggccatactgcttcatcgaattcgataactttatccagcggactaagcagagatataacaatcctcgtagcttgagcaccaaaattaacctctctgatatgcagacagagattaagttacggccaccgtaccaaataagcatgtgtgagcttggtagtgctaacggtgtaacgtctgccttttctgtggactgtaagggggcaggcaagatttcaagtgcccaccagaggctggaaccagcgaccctcagcggcatagtcggttttattctctccctgctgtgtggggctctgaatctgataaggggctttcatgcaatcgagtcattactgcagtctgacggcgacgactttaactatattatagcttttttcctagggacagcagcttgcctctaccaatgttacttattggtgtactatactggatggcgcaacgtaaaaagtttccttacatttgggctgatatgtctatgcaacatgtacctttatgagctgaggaatctgtggcaacttttttttcacgtcactgtgggggcttttgtctag

SEQ ID NO: 204376 - DNA, 417 bp, Artificial Sequence
  Description of Artificial Sequence: Synthetic coding sequence
atgagcatgatcctgagcgccagcgtgatccgggtgcgggacggcctgcctctatccgcatctaccgattatgaacagagtaccgggatgcaggaatgtcggaaatattttaaaatgttgagcagaaagcttgcacagctgccagacaggtgcacacttaagacgggacactataacattaactttattagctcgctgggtgttagttatatgatgctgtgtaccgagaattaccctaacgtgctggccttcagctttttagacgagctccagaaagaatttatcacaacctacaatatgatgaagaccaacacggccgtgagaccctattgctttatcgagtttgataattttatacagcgcaccaaacagcgatataataaccccagaagtctttccacaaagattaatctttag

SEQ ID NO: 204377 - DNA, 657 bp, Artificial Sequence
  Description of Artificial Sequence: Synthetic coding sequence
atgagcatgatcctgagcgccagcgtgatccgggtgcgggacggcttacccctctccgcttcaaccgactacgaacagtctacaggtatgcaagagtgcagaaagtacttcaaaatgctgtcaagaaagctcgcacagctccccgataggtgcacccttaaaactggtcactacaatatcaactttattagctcgttgggtgtaagctatatgatgctctgtaccgagaattatcccaatgtacttgcgttcagtttccttgacgaattgcagaaggagttcatcaccacgtacaatatgatgaaaacaaataccgcggttagaccgtactgctttatagaatttgataatttcatacagcgtaccaagcaacgttacaacaaccccaggtccctctccaccaaaatcaatctctctgatatgcagaccgagatcaaactgaggcccccctatcagatatctatgtgcgaactcgggtcagctaacggcgtaacatcagctttttctgtcgattgcaagggcgcaggcaagattagctccgcgcaccaacggctcgagccggccactctcagtggtatcgtgggatttatattatctttgttgtgtggcgccctgaacctgattcgcgggttccatgccatcgaatccctgctctag

SEQ ID NO: 204378 - DNA, 306 bp, Artificial Sequence
  Description of Artificial Sequence: Synthetic coding sequence
atgagcatgatcctgagcgccagcgtgatccgggtgcgggacggccttccactgagtgcatcaacggactacgagcaatcaaccggtatgcaggaatgtcggaaatacttcaaaatgctaagccgcaagctggcccagttgcccgacaggtgcacactgaagaccgggcattacaacatcaactttataagcagccttggggtttcctatatgatgctgtgcactgagaactatcctaatgtgctggccttcagcttcttggacgaacttcagaaagagtttattaccacatacaacatgatgtag

SEQ ID NO: 204379 - DNA, 924 bp, Artificial Sequence
  Description of Artificial Sequence: Synthetic coding sequence
atgagcatgatcctgagcgccagcgtgatccgggtgcgggacggcctgcccttatcggccagcacagattatgagcagagtacagggatgcaggaatgccggaagtacttcaaaatgctgagcaggaaactcgcccaacttcccgacagatgcacactgaagacgggccattacaacatcaacttcatcagctcactcggtgtatcctatatgatgttatgtacagaaaattatccaaacgtgctagccttctccttcctggacgagctccagaaagagttcatcactacatacaacatgatgaaaacaaacacagccgtcaggccttattgttttatcgagttcgataacttcatccagaggacgaaacagcgctataataatccccgcagtttgtctacaaagatcaatttgagcgacatgcagaccgagatcaagcttaggcctccctatcaaatcagcatgtgcgagctgggatcggcaaatggcgttactagcgcctttagcgtggattgcaagggcgctggaaagatttcaagcgcccaccagcgcctcgaaccagccactttgagcggcatagtaggttttatcttgagtctgctgtgtggggcactaaacctcatccgaggattccatgctatcgagtcacttctccaatctgatggggatgatttcaattacatcatcgcttttttcctggggactgctgcatgcctgtaccagtgctatctcctggtctactacaccggttggaggaacgttaagagttttctcactttcggtttgatctgcctgtgtaacatgtacctgtatgagctccgcaatctgtggcagcttttctttcacgtgactgtgggtgctttcgtcacactgcagatatggctgcggcaggctcagggcaaagcccccgactatgacgtgtag

SEQ ID NO: 204380 - DNA, 2298 bp, Artificial Sequence
  Description of Artificial Sequence: Synthetic coding sequence
atgaccacctacctggagttcatccagcagaacgaggagcgggacggcgtccggttcagctggaatgtttggccctcgtcacggttggaagcgacccggatggtggtgccggtagccgccctgttcacaccccttaaggagagaccagatctgccccccatccagtacgagccagttctatgtagccggaccacctgtcgcgcagtcttaaatcccttatgtcaagtagactatagggccaagctgtgggcttgtaacttttgttaccagagaaatcagttcccccccagttacgcaggaatctcagaactgaatcagcctgcagagctcctgccacaattctcctcaatcgagtacgtggtcctgaggggccctcagatgcctttgattttcctgtatgtggtggacacctgtatggaagacgaggaccttcaagccctgaaggaatccatgcagatgagcctgtcactgttgcccccaaccgccttggtgggtttgattaccttcggaaggatggttcaggtacatgaactggggtgcgagggtatctcaaaatcctatgtgtttcgaggtacaaaagatttatccgccaagcagctgcaggaaatgctcggtctgagtaaagtccccttaacccaggccacacgcggacctcaggtccagcagcctcccccctcaaatcggttcttacagccagtacaaaaaatagatatgaacttaactgatttattgggcgagctgcagcgcgacccttggcctgtgcctcaagggaagcgcccactccgcagctctggcgtggctctgagtatcgcagtcgggttactggagtgcacttttccaaacactggagcgagaattatgatgttcatcgggggccctgctacacaaggcccagggatggtagtgggggatgagctgaagaccccaatacggagttggcacgacattgacaaggataacgccaagtatgtgaagaaaggcactaaacactttgaggcactcgccaatagagccgcgacgactggacatgtgatcgatatctacgcctgtgcactggaccaaacagggctactggaaatgaaatgctgccccaacctgacaggcggctatatggtgatgggagactcctttaatacctcattattcaaacaaacttttcaacgggtattcaccaaggatatgcatggccagttcaagatgggtttcgggggcacactcgaaattaagacgtcccgggagattaagatctccggtgcaattgggccttgtgtgagcctgaacagtaagggcccttgtgtgtcagaaaatgagattggtaccggaggcacatgccaatggaagatttgtggactgagtccgaccacaacactggccatttatttcgaagtcgttaaccagcacaacgcacccatccctcagggtggaaggggcgccattcaattcgtcacgcagtaccagcacagtagcgggcagagaaggatcagggtgaccaccatagcccggaattgggccgacgcccagacccaaattcaaaatattgctgcctcttttgaccaggaggcggccgctattcttatggctagactggccatttatagagctgaaacagaggaaggcccagatgtgcttcgctggttggatcgacagctgataaggttgtgtcagaagtttggggaataccataaagacgacccatcctcatttcgcttctccgaaacttttagcctttaccctcaatttatgtttcacctcagaaggagctctttcctccaagtgtttaacaactctcccgacgaaagcagttactaccggcaccacttcatgcgccaagacttaacacaatctctgattatgattcagccaatcctgtatgcgtactctttctcggggccccctgagcccgtgctgcttgactcctctagtattttggctgaccgtattctgctgatggacaccttcttccagattttaatctaccacggcgagacaatcgctcaatggcggaagagcggctatcaggacatgcctgaatacgagaactttcggcatctgctccaagcccctgtcgacgacgcccaggaaatactgcactcaaggtttcctatgcccagatacatcgacacagagcacggtggctctcaggcccgatttctgctttcgaaggttaaccccagccaaacccacaacaatatgtatgcttggggccaagaaagcggtgcgccgatccttacagacgacgtgtcactgcaggtctttatggatcatttaaagaagctggctgtcagcagcgctgcatag

SEQ ID NO: 204381 - DNA, 1992 bp, Artificial Sequence
  Description of Artificial Sequence: Synthetic coding sequence
atgcccctgatcttcctgtacgtggtggacacctgcatggaggacgaggacctgcaggctttaaaggaaagtatgcagatgtccctgagtctattgccaccgaccgctctcgtgggcttaatcaccttcgggaggatggttcaggtgcatgagttggggtgcgaggggatctcgaaaagctatgtgttcagaggcaccaaagatctgagtgctaagcagctccaggagatgttgggcctctccaaagttccattgacccaggccacgagggggccacaggtgcagcaaccgccaccaagcaatcgcttcctacagccggttcaaaagatcgacatgaatctgaccgacctgctgggggagctgcagagggacccctggccggtcccacaagggaagaggcccctcaggagctctggcgtggccctcagtattgctgttggcttgctggaatgcaccttccctaacaccggcgcccgcatcatgatgttcatcggcgggccagccactcagggtcccggtatggtagtcggcgacgagctcaagacaccaattcgctcatggcatgatatcgacaaggacaatgcgaaatatgtgaagaaggggacaaaacactttgaggccctcgcaaatagggctgccaccacaggccacgtgatcgacatttatgcttgtgcgctcgaccaaacagggctcctcgagatgaaatgttgcccgaatctcactggtggttatatggtgatgggggactcctttaataccagcctgttcaagcaaacatttcagcgcgttttcacgaaggacatgcacggtcagttcaaaatggggttcgggggcacattggaaattaagacatcaagggaaattaagattagcggagctatcgggccctgcgtgagcctaaactcaaagggcccctgtgtttccgaaaatgaaataggcactggaggtacctgtcagtggaagatatgtgggttatcccccacaactaccctcgccatttatttcgaggtcgtgaatcagcataatgccccgattccccagggcggccgcggagccatccagttcgtgactcagtatcagcatagctccggccagaggagaatcagagtaactaccattgcgagaaattgggccgatgcccaaacccagattcagaatatcgccgctagcttcgatcaggaagctgcggctattcttatggcacgcctagccatctaccgtgcagagaccgaggaaggccccgacgtcttacgctggctggatcgacagttgataaggttgtgccagaaattcggcgaatatcataaagacgatccaagctcttttcggttctctgaaacattcagcctgtatccgcagaggcgagattttcccaagacaagcggcgagatcctggaaaatcaggaaaaagccaggtcagcctgtctgaagtttatgtttcatctgcgaaggtcctcgtttctgcaagttttcaataactcccccgatgagtcctcgtattatagacaccatttcatgcggcaagatctaacgcaatctcttattatgattcagcctatactgtacgcatacagcttctctggcccccctgaacccgttctgctagattcaagctctatactggccgatcgcatcctacttatggacactttttttcagatactgatctatcacggggaaaccatagcacagtggaggaaatcagggtatcaggatatgcccgagtatgaaaacttcaggcatctgcttcaggctccagtagacgacgcccaggaaatactgcatagccgcttcccaatgccgcggtacatcgatactgaacacggtgggtcacaggccagattcctgctctcaaaggttaacccatcacaaactcacaacaacatgtacgcttggggacaggagagcggcgctccaatcctgaccgatgatgtgagtttgcaggtgttcatggatcacctcaaaaagctcgcagtcagctccgcagcatag

SEQ ID NO: 204382 - DNA, 1692 bp, Artificial Sequence
  Description of Artificial Sequence: Synthetic coding sequence
atgctgggcctgagcaaggtgcccctgacccaggccacccggggcccccaggtccagcaaccaccacctagcaaccgattcctccagcccgtgcagaagattgacatgaacctcacagatctgttgggagagctccagcgggacccctggcccgtcccccaaggaaaacgaccgttgagatcttctggagtagcactcagcattgctgttggactgctcgagtgcacattccctaatacgggtgcgaggattatgatgttcatcggaggtccggcaacacagggacctggtatggtggtgggggatgagctgaaaactccaattaggagttggcatgatatcgacaaggacaacgccaagtatgtcaagaaaggcacaaagcattttgaagcactcgcaaaccgtgcagccacgaccggccatgttatagatatctatgcctgcgccctcgaccagaccgggctactggaaatgaagtgctgtcctaatctgacagggggatatatggttatgggcgacagttttaacacctccttgtttaaacagacattccaacgggtgttcactaaggatatgcacgggcagtttaagatgggattcggaggtactctggagatcaaaacatctcgcgagattaagatcagcggtgctattggtccatgcgtgagcttaaactctaagggaccatgcgttagtgaaaacgaaataggaacaggtggtacctgccagtggaagatctgcgggctgtcacctaccaccaccctagcaatttacttcgaggtcgtgaatcagcataacgccccgatccctcagggaggtagaggcgctatccagtttgtgacgcaatatcagcattccagtgggcaaaggcgcattagggtcaccacaattgccagaaactgggctgatgcccagactcagattcagaatatcgctgcttccttcgaccaagaggccgccgctatcctgatggccaggttagccatctatagggccgagacagaggaaggcccggacgtgctgagatggctggacagacagctgatcagactgtgtcagaaatttggcgagtaccacaaggatgatcccagctccttcaggttctccgagaccttcagtttgtaccctcagtttatgttccatttacggcggtcttccttcctgcaggtattcaacaattcacctgacgaatcatcatactaccggcaccactttatgagacaggacttgacacagtccctgattatgatccagcctattctgtacgcatactcattctccggccccccggagcccgttttactcgattcaagttcaattctggccgatcgcattttgcttatggatacgttctttcagatactcatttaccatggcgaaacaattgcccaatggcggaagagcggttaccaagacatgccagaatatgaaaatttccgccacctcctgcaggcgcctgtggatgatgcacaagagatcctccactctagatttcccatgcctcggtacatcgacaccgagcatggtggctctcaggccaggttcctcctcagcaaagtgaaccctagtcagactcacaataatatgtacgcctggggtcaggagagcggcgcccctattcttaccgatgatgtgtcactgcaggtgttcatggatcatctgaagaaacttgccgtgtccagtgccgcctag

SEQ ID NO: 204383 - DNA, 2211 bp, Artificial Sequence
  Description of Artificial Sequence: Synthetic coding sequence
atgaccacctacctggagttcatccagcagaacgaggagcgggacggtgtgagattcagctggaacgtctggcctagttcacggctggaagcaacacgcatggtcgtaccggtcgccgccctgttcacgcctcttaaggaacggcctgacttgcctcccatacagtacgaaccagttctatgttcacgaaccacctgtcgggctgtactcaaccccctttgtcaggtggactaccgcgcaaagctctgggcttgcaatttctgctatcagaggaaccagagggggccccagatgcccctgattttcctctatgtggtagatacctgtatggaagatgaggatctccaggcactgaaagagagcatgcagatgtctctgtccctcctcccgccaactgctcttgtcggcttaattacctttggaaggatggtgcaggtccacgagctgggttgcgaaggaatttccaaaagctacgtgttcagggggacgaaggacctgagtgccaaacagcttcaagaaatgctggggctatctaaagtccccctgacccaggctactcgcgggccccaggtgcagcaaccaccaccaagcaaccggttcctgcagcctgtccaaaaaatcgacatgaatctcactgacttgctgggggagcttcagcgagatccctggcctgtcccacaagggaagagaccattgcgctcctccggggtagcattatcaatagccgttggcctgcttgaatgcacgttcccaaacactggcgccagaatcatgatgttcatcggcggccctgccacccagggcccgggtatggtggtgggtgacgagttgaaaacccccatcaggtcctggcacgacatcgacaaggataacgcgaagtacgtcaaaaagggcactaaacatttcgaggcattagcgaatcgtgcagccactacaggccacgtgatcgatatatacgcttgtgccctcgaccagactggactactcgagatgaagtgttgtcctaacctgaccggcggatatatggtgatgggcgactctttcaatactagtctattcaaacagacttttcagcgagtgttcactaaagacatgcatgggcagtttaagatggggttcggcggcacacttgaaataaaaacttcgagagagattaagatcagcggcgctattggcccttgtgtgtccctcaattcgaaggggccttgtgtatctgagaatgagatcggtactggaggtacatgtcaatggaagatctgcggactctccccaacgaccacgctcgctatatacttcgaagttgtcaatcagcacaatgccccaatcccacagggaggccgcggggctattcagttcgtgacacagtaccagcattcttccggccagcgccggatcagggttacaaccattgctcggaattgggccgacgcgcaaacccaaattcagaatatcgctgcctcattcgaccaggaagccgccgccattcttatggcacgtcttgccatttatcgcgccgagactgaggagggaccggacgtcctacggtggctcgacaggcagctgatccggttatgtcagaaatttggggagtatcataaggacgacccttcctcatttcggttctccgaaacattctccctgtaccctcaattcatgttccacctgaggagatccagtttcctgcaggtgtttaataactctccagatgagagctcatactaccggcaccacttcatgaggcaagacctcactcaatccctcattatgattcagcccatcctgtacgcctacagttttagcggtcccccggaacccgtgctgctggactcttcaagcatcctggctgatagaatactcctcatggatacattctttcagattctgatttatcatggcgagacgatcgctcagtggcggaagagcgggtatcaggatatgccggagtacgagaacttcaggcacctgctgcaagctcctgttgatgacgcccaggaaatcctgcactcacggttccccatgccgaggtatatagacacagagcacgggggatcccaggccaggttcttgctgtcgaaggttaaccccagccagacacataacaatatgtacgcgtggggtcaggagagcggcgcccctatccttacggacgacgtgtccctccaagtgtttatggaccatctgaagaagctggcagtgtcttccgccgcctag

SEQ ID NO: 204384 - DNA, 510 bp, Artificial Sequence
  Description of Artificial Sequence: Synthetic coding sequence
atgaccacctacctggagttcatccagcagaacgaggagcgggacggcgtgagattctcttggaatgtatggccctcttcacgcctggaggcaacaaggatggtggtccccgttgccgctctttttacaccacttaaggagaggcctgatttgcctccaattcagtacgagcccgtactctgctctcgcaccacttgccgagctgtgctcaatcctctatgtcaggtcgactaccgggctaaactgtgggcttgtaacttttgttaccagcgcaaccaattcccccctagttacgccggcatttccgaactgaatcaacctgctgaacttctgccacaattttctagcatcgagtacgtcgtcctgcgcggcccccaaatgcctttgatctttctctacgtagtagatacttgtatggaagatgaagaccttcaggcactaaaagagtcaatgcagatgtctttgagcctgctgcctccaacggcattggtgggcttaattaccttctag

SEQ ID NO: 204385 - DNA, 285 bp, Artificial Sequence
  Description of Artificial Sequence: Synthetic coding sequence
atgaccacctacctggagttcatccagcagaacgaggagcgggacggtgtgaggttttcatggaatgtctggccatcttcacgactcgaagccaccaggatggtggtgcccgtcgcagctctgttcacgcctctcaaggaacgtcccgatctccctccaattcaatacgaacctgttctgtgctccaggaccacatgcagagccgttctaaacccactttgccaggtcgactatcgggcgaaattatgggcgtgcaacttttgttaccagcgaaatcaggtgtag

SEQ ID NO: 204386 - DNA, 423 bp, Artificial Sequence
  Description of Artificial Sequence: Synthetic coding sequence
atgaccacctacctggagttcatccagcagaacgaggagcgggacggagtgagattttcctggaatgtctggccatcttcacgcctggaggctacacgtatggttgtaccagtcgcagcactgttcacacccctgaaggagcgccccgatctgccccccattcagtatgagccagtgctctgttctcgcaccacgtgtcgcgccgtactgaatccactgtgtcaagttgactatagagcgaagctgtgggcttgcaatttctgttatcaaagaaatcagtttcctccgagctacgcagggatcagcgagctcaatcagccagcggagcttctaccacaattttcgagcatcgaatacgtggtactgagaggccctcaaatgcccctgatcttcctttatgtagtggacacatgtatggaatag

SEQ ID NO: 204387 - DNA, 123 bp, Artificial Sequence
  Description of Artificial Sequence: Synthetic coding sequence
atgaccacctacctggagttcatccagcagaacgaggagcgggacggagtgcggtttagctggaacgtgtggccttcttcccggcttgaggcgacgcgcatggtggttccggtggctgcctag

SEQ ID NO: 204388 - DNA, 2304 bp, Artificial Sequence
  Description of Artificial Sequence: Synthetic coding sequence
atggccacctacctggagttcatccagcagaacgaggagcgggacggcgtccgcttttcatggaatgtgtggccatctagtcggctggaggccacacgcatggtggttcccctggcctgcctgctgacccctctgaaagagcgtcctgatcttcctcccgtccagtatgagcccgtactttgcagccgcccaacctgtaaggcagttctaaacccactgtgccaggtcgattatcgcgctaagctgtgggcatgcaatttctgttttcagagaaatcagttccctcccgcgtacggagggatctccgaggtgaaccagcctgccgagcttatgccacaattctccacgattgaatatgtcattcaaagaggggcgcagtcaccattaatcttcctgtatgtggttgacacatgccttgaggaagatgatctacaggccctgaaggagtccctgcagatgtccttgtcattgcttcctcctgatgccctggttggtctgattacattcggcaggatggtgcaggtgcatgaactgtcttgtgaagggatcagtaaaagctatgtgtttcggggcactaaggacctcacagcaaagcaaatccaagacatgctgggcctaacgaaacccgcgatgccaatgcagcaggcccggcccgcgcagccccaggagcaccccttcgcttcaagtcgattcctccagcccgtgcataaaatcgatatgaacctgactgaccttctcggtgaactgcagcgcgacccctggcctgttacgcaaggtaaacgccccctgcgctcgaccggagtggcactctccatcgccgtgggtctcctggaggggacctttcccaatacaggcgccagaatcatgttgtttacaggtgggccgcccacccaaggacctggaatggtcgtcggagatgaacttaaaatcccaataaggagttggcatgatattgagaaggacaacgcaagatttatgaagaaagcgaccaaacactacgagatgctagccaacagaacagctgcaaatggtcactgcatcgatatctatgcttgtgccctcgaccagactggtctgcttgagatgaaatgttgcgcgaatttaaccgggggttatatggttatgggagattcgtttaacacttcactatttaagcagactttccagcgaatcttcaccaaggactttaacggcgacttccgcatggcttttggtgcaaccttagatgtgaagacgtcccgtgaactgaagattgcgggggccattggcccgtgcgtttccctgaacgtgaagggcccttgtgtgagcgagaacgaactgggcgtcggtggtaccagtcagtggaaaatttgcgggttagatccgacatctaccctcggtatttactttgaggtggttaatcagcacaataccccaattccccagggaggaagaggcgctattcagtttgtcactcattaccagcattcgtcgacgcagagaagaattcgcgtcaccacaatagcccggaactgggccgacgtccagtcccaacttagacacatcgaggcagcatttgatcaggaggctgcggccgtgctgatggctaggctaggcgtcttcagggccgagtccgaggaaggaccagacgttcttagatggctcgatagacagctgatccgactgtgccaaaagttcggccagtacaacaaagaggatcccactagcttcaggctgtctgattctttttccctttacccacagttcatgttccatctgaggcgaagccctttcctccaggtgttcaacaattcgcctgacgagtcgagctattacagacaccatttcgccagacaggatctgacccagtctctgataatgatccagcctattctttactcctactccttccacgggcccccagaacccgtactgctggacagcagtagcattctggccgaccgtatcctactgatggacaccttcttccagatcgtgatttacttgggggaaactatcgctcagtggaggaaagccggctaccaggacatgccggaatatgagaattttaagcatctgctgcaggcccccctcgacgatgcgcaagagattctgcaagccagattccccatgccccggtacattaataccgagcacggtggaagtcaggcgcgcttcctgctgtcaaaagtcaacccatcccagacccataataatctatatgcttggggtcaggaaactggcgcacctatccttaccgacgacgtatcccttcaggtgttcatggatcacctcaaaaaattggctgtgtcttccgcctgctag

SEQ ID NO: 204389 - DNA, 2304 bp, Artificial Sequence
  Description of Artificial Sequence: Synthetic coding sequence
atggccacctacctggagttcatccagcagaacgaggagcgggacggcgtcaggttttcttggaatgtgtggccctcttctaggctggaggctaccaggatggtggttcctctggcctgcctcctgaccccccttaaagaaaggccagacctccctcccgtacaatatgaaccagtcctgtgttcaagaccaacctgcaaggccgtgctgaaccccttatgtcaggtggactaccgggctaaactttgggcatgcaatttttgctttcaacgcaatcaattcccacccgcgtatgggggtatttctgaggtgaatcagccagcagagctcatgccccaattctccacaattgaatatgttatccagcggggtgctcagtctcctctaatattcctatacgtggtcgatacgtgcctggaggaggacgacctgcaggcgctcaaagagtccttgcagatgagcctcagcctcctgcctcccgacgcactggtaggactaattacgtttggaaggatggtccaggtgcatgaactctcctgtgagggtatctcaaagtcctatgtttttcgtggtacaaaggacctgactgccaaacagatccaggacatgctcggccttactaaacctgccatgcctatgcagcaagcccgcccagcacagccacaggagcatcccttcgcttcatctcgatttctgcagcctgtgcacaaaatcgacatgaacctcaccgacctgttaggggaacttcaaagagacccctggcctgtcactcaggggaagaggccgctccggtccaccggcgtagctcttagtattgccgtgggactgctggaaggaacctttcctaacactggagctaggatcatgctgttcacaggtgggccaccaactcagggaccaggaatggtcgtgggggatgagctgaagattcccattagatcgtggcacgacattgagaaggataacgctagattcatgaaaaaggctaccaaacattacgaaatgcttgccaatagaacagccgctaatggccactgtatcgatatttacgcctgtgccctggatcaaactgggctgctggaaatgaagtgctgtgctaaccttaccggtggctacatggtgatgggagatagctttaatacatcccttttcaagcaaacctttcagaggatctttacaaaagacttcaatggagactttcgaatggcctttggggctacgctcgatgttaagacaagcagagaattaaagattgcgggcgccattggtccctgcgtctccctgaacgtgaaggggccctgcgttagcgagaacgagctgggcgtcggaggaacaagccagtggaagatctgcgggcttgacccaacgagcaccctgggaatctacttcgaggtggtcaatcaacacaacactccaattccacaaggggggagaggagcaatccagtttgtgactcattaccagcactcctcgacccaacggcggattagggtgacaacgattgcaaggaattgggccgatgtccaatcccaactgcgccatatagaagccgcatttgaccaggaggctgccgccgttttgatggctagactgggcgtttttagagctgaatctgaagaaggtcctgacgtgctgagatggcttgacagacagttgatccgcctgtgtcagaaattcggtcagtataacaaagaggaccctacatccttcaggctgtctgacagcttctcactgtatccacaatttatgtttcacttacggaggagcccctttctgcaagtgtttaacaactcccccgacgagtcatcatattaccgacaccacttcgcaaggcaggatctgactcagagtcttattatgatacagcccatactgtacagctacagtttccacggtcctcctgaacctgtattacttgacagctcgtcaatactggctgatcgcattctgctgatggatactttttttcagattgtaatttatttaggagagactattgcgcagtggaggaaggcggggtaccaggatatgccagaatacgaaaattttaagcacttgctgcaagctccgttggacgatgcccaagagatcctccaagcgagattccccatgcccaggtacatcaatacagagcacggaggttctcaggcacggttcctcctgtccaaagttaatcccagccaaacccataacaatctatacgcgtggggacaagaaactggggcccctatcctgacggacgatgtctcgctccaggtctttatggaccacctgaagaaactggctgtgtcttccgcctgctag

SEQ ID NO: 204390 - DNA, 2304 bp, Artificial Sequence
  Description of Artificial Sequence: Synthetic coding sequence
atggccacctacctggagttcatccagcagaacgaggagcgggacggggtcagattcagctggaacgtgtggccaagctcacggctggaggcaacaagaatggttgtccctcttgcttgcctcctgacacccctgaaggaacggcctgacctcccgccggtgcaatacgagcctgttctgtgctctaggcccacgtgcaaggccgtcctgaaccccctgtgccaagtcgactacagggccaaactctgggcttgcaacttctgctttcagcgaaatcagttccctcctgcatatggaggaatttcagaggtaaaccagccggctgaactgatgccccagttttcaactatcgagtacgtcattcagagaggtgctcaatccccgctcattttcctgtatgtggtcgatacttgcctggaggaagacgacctacaggcgctgaaggaatccttgcaaatgtcccttagcctgctgccacctgacgccctggtgggcctaatcaccttcggccgcatggtacaggtccatgaactaagctgcgagggcatatccaagtcatacgtgtttagaggcactaaagacttgaccgctaaacagattcaggacatgctcggtctgacgaaacctgcaatgccaatgcagcaggccagacctgctcagccacaggagcaccccttcgctagctcacggtttctgcaaccagtccacaagattgacatgaacctgactgatctgctgggggaactgcaacgcgacccatggcctgttacccaaggtaagcgccccttacgcagcacgggagtagctctgtccatcgcagtgggtctgctagaaggtacctttccaaacaccggggctcgtatcatgctcttcacaggagggccacctacacagggccccgggatggtggtcggggatgagctgaaaattccgattcgcagctggcatgacatcgaaaaggataatgcaaggtttatgaagaaggcaactaaacactacgaaatgttagccaaccgaaccgccgccaatgggcactgtattgatatctatgcgtgcgcattggatcagactggtctgcttgaaatgaagtgctgcgctaaccttactggcggatacatggtaatgggagattccttcaacacttcacttttcaagcagacttttcagagaatctttactaaggattttaatggagactttcgtatggcattcggcgcaaccctggacgtgaaaacgtccagggagctcaagatcgcgggcgctatcggtccctgtgtctctttaaacgttaagggaccttgtgtgtctgagaacgagctgggtgtggggggtacgtcacaatggaagatctgcggcctggatcccactagtactctgggaatctacttcgaagttgtcaatcagcataacacaccaatccctcagggcggaagaggtgctatccagtttgtgacccattaccaacacagttcaacacaaaggcgtatccgtgtgacaacaatcgccagaaactgggccgacgtgcagtcgcagctgcgccatatcgaggcagcattcgaccaggaagctgctgcggtgttaatggcgcggctgggcgtgttccgagccgagtccgaggagggccccgacgtccttcggtggctggataggcagctcataagactttgccaaaaatttggccagtataacaaggaggaccccactagctttcggttatccgattccttctctctctatccgcagtttatgttccacctgaggcgttctcccttcttgcaggtgtttaacaacagcccagatgaatcaagctactatcgacaccatttcgcccgacaagacctcacccagagcctgataatgatccagcccattctctattcttatagctttcatggcccaccagagccagtcttgctggactctagctctatactggccgatcggatactgctgatggacacattttttcaaattgtgatataccttggagaaactatcgcccaatggcggaaagccggttaccaagatatgccggagtatgagaatttcaaacatcttttgcaggctcctctggacgacgctcaggagattctgcaggccaggtttccgatgcctaggtatatcaataccgagcatggggggtcacaggctaggtttctactgtcgaaagtgaacccatctcaaacacacaacaatctgtatgcctgggggcaggagactggggccccgattttgacggacgacgtgtcactccaagtattcatggaccatctcaagaagctggcggtgagtagcgcttgttag

SEQ ID NO: 204391 - DNA, 2304 bp, Artificial Sequence
  Description of Artificial Sequence: Synthetic coding sequence
atggccacctacctggagttcatccagcagaacgaggagcgggacggggtgaggttctcctggaacgtctggccatcctctcgccttgaggctactcgtatggtagttccgctggcttgtctgctgaccccactcaaggaacgacctgatctgccgccagtccagtatgagccagttctgtgttctcggccaacgtgcaaggccgtgctgaacccactgtgtcaggtggactacagagccaagctctgggcctgcaatttttgttttcaaaggaaccaattccctcccgcttatggcggtatttccgaggtgaatcagccagccgaactgatgccccagttctccaccattgagtatgtgatacagcgtggggcacagagtccacttatttttctctatgttgtggatacatgcctcgaagaagacgatttgcaggcgctgaaggagtccttgcagatgagcctgtctctcctgccacctgatgccctagttggccttatcacgttcggacgtatggttcaggttcatgaattgagctgcgagggaatcagcaagagttacgtctttagaggaaccaaggacctgactgccaaacagatccaggatatgcttggactcaccaagccagccatgccaatgcagcaagctagacccgcccagccccaggaacatccttttgcttcgagtagattcttgcagcccgtgcataagatcgacatgaaccttacggacctgctcggagaactgcaacgcgatccttggcctgttacccagggaaaaagaccgctgagatctaccggggtggcactgtcaatagccgttggtctcctggaagggaccttccctaatacaggagcccgcatcatgttgttcactgggggacctcccactcaagggcccggcatggtcgttggtgacgaactgaagatccccatccggtcttggcacgatattgaaaaggacaacgcccgcttcatgaaaaaggccaccaagcactacgaaatgctagcaaataggacagccgccaatggccattgcatagatatctatgcttgtgcgctggaccaaactgggctccttgagatgaaatgctgcgccaacctcaccggtgggtatatggtgatgggagattcctttaatacgtcgctcttcaagcagacttttcagaggatttttacaaaagatttcaacggagacttcagaatggcgttcggggccaccttagatgtcaagacctctagagaattaaaaatcgccggtgctataggcccctgtgtgagtctgaacgtgaagggtccctgcgtgtctgagaacgagttgggagttggtggaacatcgcagtggaagatttgcggcctcgaccccacctctacattaggtatctatttcgaggttgtgaaccagcacaacacaccaattccccagggcggcagaggagctatccagtttgtgactcattaccagcatagcagcacacagcggagaattcgggtgactaccatcgcacggaactgggcagatgtccagagtcagctgcgccacattgaagccgcattcgatcaggaagcagctgctgttcttatggcaagactcggcgtgttccgagccgagtctgaggagggccctgatgtgctgagatggctcgacagacagctgattcgtctttgtcagaagttcggacagtacaataaggaggaccccaccagcttccggttatccgacagcttctcgttgtacccccaatttatgttccacctgcgccgttccccattcctgcaagtatttaacaatagcccagatgaatcctcctattataggcaccatttcgccaggcaggacctgacccaatctctgatcatgattcaaccaatcctgtatagctacagctttcatgggccgcccgaaccggtgttgctcgacagttccagcatccttgcagaccggatcctactgatggatacattttttcagatagtgatttatctgggcgagacaattgctcagtggaggaaagctggatatcaagatatgccagagtacgagaatttcaagcatctgctccaggcaccattagatgatgcacaggaaatccttcaggctcggttcccgatgccacgctatataaacacagaacatggtggaagtcaggctaggttcttgttgtcgaaggtgaacccctctcagacacacaacaacctttacgcctggggacaggaaacaggggccccaatcttgacggatgatgttagtctccaggtatttatggatcacttaaaaaaattagccgttagcagtgcatgctag

SEQ ID NO: 204392 - DNA, 741 bp, Artificial Sequence
  Description of Artificial Sequence: Synthetic coding sequence
cagcggcggatccgggtgaccaccatcgcccggaactgggccgacgtgcagagtcagcttaggcatattgaggctgcctttgatcaagaggcggccgcagtcctcatggcccgcttgggtgtgtttagggcggagagcgaagaggggccggatgtgctgaggtggttagatagacaactcatccgtctttgccagaaatttggccaatacaataaagaagatcccaccagtttcaggttatcggactcattcagtctatacccacagttcatgtttcatctgagaagatcacctttcttacaggtgtttaataacagcccagatgagtcttcgtattataggcaccattttgcccggcaggacttaacgcagagcttaatcatgattcagcccatactgtacagttattccttccacggccctcccgagacaatcgcccaatggaggaaggccggctaccaggacatgcctgaatacgaaaattttaagcatctgctgcaggctcctcttgacgatgcgcaggaaattttgcaggcccgctttcccatgccccggtacatcaatacagagcacggcgggagccaagccaggttcctcttgtccaaggtgaatccttcgcagacccacaacaatctttatgcctggggccaggagacgggagctcccatcctgacagacgacgtgtctctacaggtgtttatggaccacctcaagaaactggcggtttccagtgcctgttag

SEQ ID NO: 204393 - DNA, 996 bp, Artificial Sequence
  Description of Artificial Sequence: Synthetic coding sequence
atggccacctacctggagttcatccagcagaacgaggagcgggacggtgtaaggttctcctggaatgtgtggcccagctctagactcgaggcaaccaggatggtagttcccctcgcatgcctgctgacccccctgaaggaacggcccgacctgccgcccgtgcagtatgaaccagtgctttgcagcaggccaacatgtaaggcagttctgaaccctctttgccaggtcgactaccgggccaagctgtgggcatgcaacttctgctttcagcgcaatcagttcccccccgcatatggaggaatctcagaggtgaatcagccagctgaacttatgccccagttcagcacgatcgagtatgtgatccagcgcggcgcacagagtccactcatctttctgtatgtagttgacacgtgcctggaggaggacgaccttcaggctctgaaagagagcttgcaaatgtctctgagtttgctgccgcccgacgccttggtagggctcattactttcggccgtatggtgcaggttcacgagcttagctgcgaagggatttcaaagtcttatgtctttaggggaactaaggaccttacagccaaacaaatccaggacatgctagggttgactaaacccgccatgccaatgcagcaggcacgtcccgcacagccacaggagcatccgtttgcctctagccggtttctgcaaccggttcacaagatcgatatgaacctcaccgatctgctaggtgagctccagcgagacccctggcctgtcacacaaggcaaacggcctcttcgcagtaccggcgtggccctgtctattgccgtcggtctacttgagggtacctttccaaacaccggagctcgaatcatgctgttcacgggggggccgcccacacagggtcccgggatggtcgtaggggatgaactaaaaatccctatcaggtcctggcatgacattgagaaggacaacgctagattcatgaaaaaggcaactaaatag

SEQ ID NO: 204394 - DNA, 1200 bp, Artificial Sequence
  Description of Artificial Sequence: Synthetic coding sequence
atggccgagcggcggcggcacaagaagcggatccaggaggtgggcgagccctctaaggaggagaaggccgtggcaaaatacctgcggttcaattgtccaactaagtccactaatatgatgggacatcgggtggactacttcatagcatcaaaagcggtggattgcctactggatagcaagtgggccaaggctaaaaaaggtgaggaagctctgttcaccactcgggagtctgtggtggattactgtaatagactgcttaaaaagcagttctttcatcgagctctcaaagtcatgaaaatgaaatacgataaggatatcaagaaggagaaggacaagggaaaggccgagtcgggtaaggaggaggacaagaaatctaaaaaggagaatatcaaggacgaaaagacaaaaaaagaaaaggaaaaaaaaaaggatggcgagaaggaagagtccaagaaagaagagaccccaggtactccgaagaagaaggagaccaagaaaaaattcaaacttgagccacatgatgaccaagtgtttctggatggtaatgaggtctacgtctggatttatgatcccgttcactttaagacattcgtgatgggactgatactggtgattgcagtgattgctgctactcttttccctctgtggcctgcagagatgcgggtgggggtgtattacctgtccgttggcgcaggatgtttcgtggcttctatcctgttgcttgctgtcgctcgctgtattctgttcttgattatatggctcatcactggcggccgacaccatttctggttcctaccaaatttaaccgccgatgtcggctttatagattccttcagaccattgtacactcatgagtacaagggtcccaaggctgatctgaaaaaagacgaaaagtccgagacgaaaaaacagcagaaatctgactccgaggagaaaagcgattcagagaaaaaggaagacgaagaaggcaaagtgggacccggaaatcacgggaccgagggtagcggaggggagaggcactccgacactgactctgacagacgggaagacgaccgatctcagcactccagcggaaatggtaatgacttcgagatgataaccaaggaagagctggaacagcaaacagatggggattgcgaggaagatgaagaggaagaaaacgacggcgagactccaaaatcaagccatgagaaaagctag

SEQ ID NO: 204395 - DNA, 1200 bp, Artificial Sequence
  Description of Artificial Sequence: Synthetic coding sequence
atggccgagcggcggcggcacaagaagcggatccaggaggtgggcgagccctccaaagaagaaaaagccgtggccaaatacctacgcttcaattgcccgaccaagtctactaatatgatgggccaccgggtggattactttattgcaagcaaagccgtggattgtctactcgatagtaaatgggccaaggccaaaaaaggagaggaggctctgttcaccacgcgggagagtgtggtcgactactgtaaccgcctgcttaagaagcaattttttcaccgcgctcttaaggtgatgaagatgaagtatgataaggacataaagaaggaaaaggacaaaggtaaggccgaaagcggtaaagaggaggataaaaaatccaagaaggagaatatcaaagatgaaaaaaccaaaaaagaaaaagaaaagaagaaagatggtgaaaaagaggagtcaaaaaaggaggagacccccgggaccccaaagaagaaagaaaccaagaagaagttcaagctcgagccccatgacgaccaggtgtttctcgacggcaacgaggtctatgtctggatctacgaccccgttcatttcaaaaccttcgttatgggcctgatcctcgtaattgcagtgatcgccgctaccctgttcccactgtggccggctgagatgcgcgtcggcgtgtactacttgtcggtgggggccggttgttttgttgccagtatactgctgttggccgtcgcccggtgcattttgttcttgataatctggctgattaccggaggtagacatcacttctggtttttgcctaacttgacggccgacgttggcttcattgattcattcaggccactgtatacacacgagtataagggtccgaaggctgaccttaagaaagacgaaaagtcggaaacaaagaagcagcagaaatctgacagtgaggagaaatccgactcagaaaagaaggaagatgaagagggtaaagtcgggccgggaaaccacgggactgagggctcaggcggcgagaggcatagcgacacggactcagacagaagggaagatgacaggagccaacatagtagtggcaatgggaatgacttcgaaatgataacaaaggaggagctcgaacagcagaccgatggagactgcgaagaggacgaggaggaggagaacgacggcgagacccctaaaagctctcatgagaagagttag

SEQ ID NO: 204396 - DNA, 372 bp, Artificial Sequence
  Description of Artificial Sequence: Synthetic coding sequence
atggccgagcggcggcggcacaagaagcggatccaggaggtgggcgaaccgtccaaggacgagaagtcggaaactaagaagcagcaaaaatccgatagtgaggaaaaaagcgactctgaaaaaaaggaagatgaggagggcaaagtgggccccggtaaccacggaaccgagggatccgggggagagcggcacagcgacactgatagtgaccgcagagaagatgacagatcccagcattcttccgggaacgggaatgacttcgagatgatcaccaaggaggaactggagcagcagaccgacggcgattgcgaggaggatgaggaagaagagaatgatggggaaacacctaagagctcccacgagaagtcttag

SEQ ID NO: 204397 - DNA, 2283 bp, Artificial Sequence
  Description of Artificial Sequence: Synthetic coding sequence
atggccggccagcagttccagtacgacgacagcggcaacaccttcttttattttctaactagctttgtgggtttgatcgtgattccagctacatattatttgtggccaagggatcagaatgcggagcagattcgactcaaaaatattcgcaaagtgtacggtcggtgcatgtggtacaggctacggcttctaaaaccccagcctaacataattcccaccgttaagaagattgtgctcctggccgggtgggccctctttttgttccttgcttataaggtgagcaaaactgacagagagtaccaagagtacaacccgtacgaagtgctaaatctcgatcccggagctacagttgccgagattaagaagcaatatcgcctcctctcactcaagtaccatcctgataagggaggggatgaagtgatgtttatgaggatcgcgaaggcctacgcagccctgacagacgaggaaagtcgaaagaattgggaggagttcgggaaccccgacgggccacaggccaccagttttggtattgccctaccagcctggatagtcgatcagaaaaacagcatattggtactgttggtgtacggtctcgctttcatggtcattctgccagtggtggtaggctcttggtggtacaggtccatccggtactccggtgaccagattctcattcgtactacccagatctacacctattttgtttacaagactcgcaatatggatatgaaacggctcattatggtactggccggggccagtgaatttgatccacagtacaacaaggatgcaacctctcgaccaacagacaatatcctcatcccacagctgatccgcgagatcggcagtattaatctaaagaaaaatgaaccccccctgacgtgtccttattccctgaaggcccgggtattactgctgagccacctggcccggatgaaaatccccgagacgcttgaggaagaccagcagttcatgctgaagaagtgccctgcgttactccaagagatggttaacgtaatttgccagttgatcgtcatggccagaaaccgtgaggagcgggagttcagggcccccacactcgctagtctggagaattgtatgaaactgtcccagatggctgtgcagggattacaacaattcaagtcccccctcctacaactgccccatattgaggaggataacctacgcagagtatccaatcataagaagtataagattaaaactattcaagatcttgtgagtctcaaggagtccgatagacacactctgttacacttcctggaggatgaaaagtatgaagaagtcatggcagtgctcgggagttttccctacgtgacgatggacataaagagtcaggtgcttgatgatgaagattccaacaatatcacggttggaagcctagtcaccgttctggtcaagctgacccggcagactatggccgaggtgttcgagaaggagcagtctatttgtgcagcagaagaacagcccgccgaggatgggcaaggtgagacaaacaaaaatagaactaagggcggatggcagcagaagagtaaagggcctaaaaaaactgcaaaatccaaaaagaagaaacccctgaagaagaaacccacccctgttctgctcccacaatccaagcagcaaaagcagaaacaggccaatggcgtcgtgggcaacgaggccgctgtgaaagaagacgaggaggaggtcagcgataaaggcagtgacagtgaggaagaagagacaaatagggatagtcaaagtgagaaagacgatggtagcgatcgcgactccgatcgcgagcaggacgaaaaacagaacaaagatgacgaagccgagtggcaggagttacagcagtccatacagagaaaggaaagagcacttttagagaccaaatcaaagatcacccatcccgtgtactccttgtattttccagaggaaaaacaggagtggtggtggctatacatagcagaccgcaaagagcagactttaatctcaatgccataccacgtgtgtacacttaaagacacggaggaggtggagctcaaattcccagctccaggaaaaccggggaattaccagtataccgtgttcctgcggtctgattcctacatggggctggaccagattaagcctttgaagctggaagtgcacgaagctaagccggtccccgaaaaccatccccaatgggatacagccatagagggggacgaagaccaggaggattctgagggctttgaagactccttcgaggaagaggaagaggaagaagaggatgatgactag

SEQ ID NO: 204398 - DNA, 1254 bp, Artificial Sequence
  Description of Artificial Sequence: Synthetic coding sequence
atgttcatgcggatcgccaaggcctacgccgccctgaccgacgaggagtcccggaagaattgggaggagttcgggaatccagacgggccacaggccaccagtttcgggattgcgctgcccgcctggattgtggaccagaagaatagcatcctggtgctactggtgtacggcctagcttttatggtcatcctccctgtggtggttggatcatggtggtacaggtctatcaggtactccggagaccaaattttgatcaggaccacccagatctacacatactttgtgtacaagacgcggaacatggacatgaagcggctcatcatggtgttagctggcgcctcggaattcgacccgcagtacaataaagacgccacatcaaggcctacagacaatattctaatcccgcagctgatcagagagatcggctctattaacctcaagaagaacgaaccaccacttacttgtccatattcgctcaaggctcgcgtgctgcttctgtcccacctggcacggatgaagatccccgaaaccctggaggaggatcagcagtttatgctgaagaaatgtcccgccttgctccaggaaatggtaaatgtaatttgccagttgatcgttatggcccgcaacagggaggagcgagagtttcgggctccaactttggccagcctcgagaattgtatgaagctgtcacagatggccgtgcaggggctgcagcaattcaaatccccactcctacaactcccccacattgaagaagacaacctgagacgggtatctaatcataaaaagtataaaatcaaaacaatccaggacctggtttcccttaaggaaagcgacaggcacacactgctacactttttggaagacgagaagtacgaggaggtgatggcggtcctgggatcctttccctacgtgacaatggatatcaagagccaagttttagacgacgaagattcgaacaatatcactgttggatcactagttacagttcttgtgaaactgacgcgccagacgatggcggaggtttttgagaaggagcagtcaatttgtgccgccgaagaacagccagccgaagatggtcagggagaaactaacaagaaccggacaaagggaggttggcaacagaagagcaaggggccaaagaaaacggccaagaaaaagaaggaaacgttcaaaaagaagacttacacttgcgccatcaccactgtgaaggccacagaaaccaaggcaggcaagtggtccaggtgggagtag

SEQ ID NO: 204399 - DNA, 1137 bp, Artificial Sequence
  Description of Artificial Sequence: Synthetic coding sequence
gagcacgagcgggagttccgggcccccaccctggccagcctggagaattgtatgaagctgtctcaaatggctgttcagggtctgcagcagttcaaatcgccgttgttgcagctgccacacatcgaagaggacaatctcagaagggttagtaaccacaagaagtataaaatcaagaccattcaggatctggtgagtctcaaggaatcggaccgacacaccttactccattttctggaggatgagaaatatgaagaggtgatggcagtcctgggctcttttccatacgtgactatggacattaagagccaggtactggacgacgaggattccaataacattacggtgggatcgctggttactgtgctcgttaaactcacaaggcagacaatggccgaagtcttcgagaaagagcaatcaatttgtgccgcggaggaacagccggcagaggacggtcaaggggaaaccaataaaaacaggaccaaaggcggttggcagcagaaatcaaaggggcctaaaaagaccgccaaatctaaaaagaagaaaccattgaaaaagaaacccactcctgtactgttgccccagtctaagcagcagaaacagaagcaagcaaacggcgtcgtcgggaacgaagcagccgtgaaggaggacgaagaggaagtgagtgataaagggtcagattcagaagaggagtggcaagagctgcagcagtctatacagcggaaagagagagcattgcttgagacaaaatccaagatcactcaccctgtgtattctctttatttccctgaagagaaacaggagtggtggtggctctatattgccgaccgaaaggagcagactcttatatccatgccatatcacgtctgcacgctgaaggataccgaggaggttgaacttaaattccctgcccccggcaaacctgggaattaccaatacaccgtgtttttgcgttccgactcttacatggggctggatcagatcaaacctcttaaactggaggtacatgaagcaaaacccgtcccagaaaatcaccctcagtgggacaccgcgatagaaggagatgaggatcaggaggattctgaggggtttgaggattcctttgaggaagaagaagaagaggaggaagacgatgattag

SEQ ID NO: 204400 - DNA, 2346 bp, Artificial Sequence
  Description of Artificial Sequence: Synthetic coding sequence
atggtgcgggtgctgcggagcatgtgcctgccccagctgtgcagccatatcctcagtgtttgtagtggtactacttccgacagaaatgtatacagcgtacctggcagccaatacctctataaccagccttcatgttatcgcggcttccagacagttaagcataggaatgagaatacatgtccgcttccccaggaaatgaaagccctgtttaagaagaagacctacgacgaaaaaaaaacttacgaccagcaaaaattcgattctgaacgagccgacggaacaattagttccgaaataaagagcgcaagaggcagccatcatctctctatctacgcagagaacagtttgaagtcagacggctatcacaagcgtaccgataggaagagccgaataatcgccaagaatgtctcaacctccaagcctgagtttgagttcacaactctggacttccctgagctgcagggggctgaaaacaatatgtctgaaatccagaagcagcctaagtgggggccagtccatagtgtgtccactgatatctcattattgcgggaagtcgtcaaacccgctgcagtactgtccaagggggaaattgtggttaagaacaaccccaatgaatccgtgacggcgaatgccgcaaccaatagccctagctgcactcgcgagctctcatggactcccatgggatatgtggtgagacagactctgagcactgaactgtccgccgcaccaaagaatgttaccagcatgataaatctcaaaacaatagcctcatctgccgaccccaagaacgttagcattccctcctccgaagcgctttcttcagatcctagttacaataaggaaaagcatatcatccaccccactcaaaagtcaaaagcatctcaaggtagcgatcttgaacagaatgaggcctcacgtaagaacaagaagaagaaggagaagagtactagcaagtacgaagtcttgacagtgcaggagcctcccaggatcgaggacgccgaggaatttcctaacctcgctgtggctagcgagaggcgagacaggattgaaacccccaagttccagtccaaacaacagccacaggataattttaagaataacgtgaaaaaatctcagcttcccgtccaactggacctcgggggcatgctaactgctttagaaaagaaacaacacagtcagcacgctaaacagagctctaagcccgtggtggtgtccgtgggcgctgttccagttctgagtaaagagtgtgcatctggagaacggggtcgtcgcatgtcacagatgaaaactccccataacccccttgatagtagcgcccccctcatgaagaaggggaagcagcgggagatccccaaggctaagaagcccacctcactgaaaaagatcatcctgaaggagaggcaagagcgcaagcagcgcctacaggagaatgcggttagccccgcctttacatccgatgacacccaagacggcgaatccgggggggacgatcagttccccgagcaggcagaactgtcagggcccgaggggatggatgagctcatctccactccatcggtcgaggataaaagtgaggagccgcctgggactgagctgcagcgcgacaccgaagcaagccacctcgctcctaaccatacgacttttccaaagatccacagccggcgatttcgcgattactgcagtcagatgctgtccaaggaggtcgacgcatgcgtcaccgacctgcttaaagaattggtgaggttccaggatagaatgtatcagaaggatcctgtaaaagctaagacaaaacgaaggttagtgctcggcctcagagaggtgttgaagcatctcaaactgaagaaactgaagtgcgtgatcatatcacccaactgtgaaaaaatccagagtaagggggggctagacgacactctgcataccataatcgattatgcttgtgagcagaacatcccattcgtcttcgctctgaacaggaaggccctggggcgcagcctgaacaaggctgtacctgtttctgtagtcggcatcttcagctatgacggcgcccaggatcaatttcataagatggttgaactcacagtggcggcgaggcaggcctacaagaccatgctcgagaacgttcaacaggagctggtgggagagccacgccctcaagcacctcccagcctgcccacgcagggccctagctgccccgccgaggacgggccccccgccttgaaggagaaggaggaacctcactatatcgaaatttggaaaaaacatctggaagcatactcagggtgcaccctggagctcgaggaaagcctcgaggcctcgacatcccagatgatgaacttaaacttgtag

SEQ ID NO: 204401 - DNA, 2565 bp, Artificial Sequence
  Description of Artificial Sequence: Synthetic coding sequence
atggccagcgagggcccccgggagcccgagagcgagggcatcaagctctctgcagacgttaagcccttcgttccccgcttcgccggacttaatgtagcctggttggagtccagtgaggcgtgcgtctttccatcttccgcggccacctactacccatttgtccaggaaccccctgtaactgagcagaagatttacaccgaagatatggcattcggcgcaagtacattccccccacagtacctgtcttctgagattacattacacccatatgcttacagcccttacacgctggattctactcagaacgtatatagcgtcccgggttcccagtacctttacaatcaaccctcatgttaccgtggctttcagactgtcaagcatcggaacgagaacacatgcccacttcctcaggaaatgaaggcattgtttaaaaagaagacttatgacgaaaagaagacgtacgatcagcagaagttcgatagcgagcgtgcagatggtaccatttctagcgaaattaagagcgctcgcggttctcaccatctgtccatttacgccgaaaacagtcttaagtccgacggctaccataaacggacagaccggaaaagtcgcatcatcgctaagaatgttagtacatcaaagcctgaatttgagtttactacgttagattttcctgagcttcagggggccgagaacaacatgagtgaaatacagaagcagccgaagtggggccccgtgcatagcgtgtcaactgatattagcttattgagagaagtagttaagcccgcagctgtactgtctaagggagagattgtggtcaagaataatcctaacgaatctgtgaccgccaacgccgcaaccaactctccctcctgtactcgtgaactgtcatggacacctatggggtatgtagtaagacaaacattgtccacagagcttagtgccgcccccaagaacgtgaccagcatgattaacctcaagacgatcgccagcagcgccgaccctaagaatgtgtctatccccagctccgaagcattatcttccgacccaagttataataaggaaaaacacatcatccatccaacacagaagagcaaagcgagtcaaggtagtgacctggagcagaacgaggccagcagaaaaaataaaaaaaagaaggaaaaaagcactagtaagtacgaagtattgacggtgcaggagccccccaggattgaggacgcagaggagttccctaacttggctgttgctagcgaacggcgggatagaattgagacgcccaagtttcagagtaaacagcaaccccaggacaacttcaagaacaatgtcaaaaagagccagttacctgtccagctggacctgggcgggatgctcaccgctttggagaaaaagcaacactcacagcacgctaaacagagctccaaaccagtggtcgttagtgtgggcgccgtccccgtgctgtccaaagaatgtgcttcgggagagcgggggagaaggatgagccagatgaagaccccacacaatccacttgactcctcggcccctcttatgaaaaaaggaaagcagagggagatcccgaaggccaagaagcccacgtcccttaagaagatcatactgaaggaacgccaggagagaaagcaacgattgcaagaaaacgctgtttccccagcctttacgtccgatgacactcaggatggagagagtggaggcgacgatcaatttcctgagcaggccgagctctccggcccagagggcatggatgagctgatctctaccccttccgtcgaggacaaatccgaagaaccaccaggcactgaactgcagagagacaccgaggcgtcgcatctcgcacccaaccataccacctttccgaagatccactcacgaagatttcgcgattactgttcacaaatgctgtctaaggaggtggacgcttgtgtcacagacctattaaaggagctggtgagatttcaggaccggatgtaccagaaagacccagtgaaagccaagaccaagaggaggctcgttctcggtctacgggaggtgctgaagcaccttaagctcaagaaactcaaatgtgttattatatctcccaattgcgagaagattcagagcaaaggcgggctcgatgatactctccataccataatagattatgcttgtgaacaaaacattccattcgtgttcgcgctcaatcgtaaggccctcggcagaagtctcaacaaagccgtgccagtgtcggtagtgggcatcttttcatatgatggcgctcaagaccagtttcataagatggtcgaactcaccgttgccgcaagacaggcatataagaccatgctcgaaaacgtgcagcaggaactggtcggagagcctaggccacaggcccccccatcactccccacccaagggcctagctgccccgcagaagatggtccgccagctctgaaggagaaggaagagcctcattacatcgaaatttggaagaaacacttggaggcttactccggatgtaccctggagctagaagagagcctggaagcttcgacttcccaaatgatgaatttgaacttgtag

SEQ ID NO: 204402 - DNA, 2583 bp, Artificial Sequence
  Description of Artificial Sequence: Synthetic coding sequence
cccgccagccggcggcccgccgccggcctgcgggacgccgccagctcggccccaaggggcatggcgtcagaaggtccacgggagcccgaatcagagggtataaaactctctgctgacgtgaagccattcgtgcctaggttcgctgggctgaatgttgcatggttggaatccagtgaggcctgtgtgtttccttcatcagccgcaacgtactaccccttcgtgcaggaaccgccagtgaccgaacagaaaatttacacagaggacatggccttcggcgcgtctacgttcccacctcaataccttagctctgaaataacgctgcatccctacgcctactctccttacacgttggactcaacccagaacgtgtactcagtcccagggtcacagtacttatacaaccagccatcctgctatcgagggtttcagacagtcaaacatcgaaatgagaacacttgtccgcttcctcaggaaatgaaggccttgttcaaaaaaaaaacttacgacgagaaaaagacatacgaccagcaaaaatttgattccgaaagggcagacggcactatcagctccgagattaagagtgcgcggggcagccatcacctctccatttatgctgaaaactcactcaaatctgacggctaccacaagcgtactgataggaagagccgaatcattgctaagaacgtttcaacctcaaagcccgagtttgagtttaccacactcgacttccccgaacttcaaggagctgaaaacaacatgtctgagattcagaaacaacctaagtggggtccagtgcactccgtgtcaactgatattagtctgctgcgggaggtcgttaaaccagctgctgtgctgtctaagggtgagatagtggtgaagaataacccaaacgaaagcgtgttgatgccccttcccattctgctccacgttcaggaaaccttgtccaccgagctcagcgcagctcctaaaaatgtgacatccatgattaacttgaaaacgatcgcgtctagcgcagacccgaaaaacgtcagtattccaagttccgaagctctgtcctcagatccgagctataacaaagagaagcacatcattcatcctactcagaagtccaaggcctcgcaggggtcggacttggaacagaacgaagcatcccgcaagaataaaaaaaaaaaggagaaatccacctccaagtacgaagtcctgactgtgcaggaaccccccagaatcgaagacgctgaggagttcccaaatcttgcagtggcaagtgaacgtagggaccgcatcgaaacccctaaatttcaaagtaagcagcaaccccaggataacttcaagaataacgtcaagaaaagccagcttccagttcaactggacctgggcggcatgcttacagcccttgaaaaaaaacagcattcacagcatgctaagcagtcatctaagcccgtcgtggtgtccgtgggtgccgtgcccgtcctgtccaaggagtgtgcatccggcgaacgagggagaaggatgagccaaatgaagacaccccacaatcccctggactccagcgctcccctgatgaagaaaggtaagcaacgcgagatacccaaagcaaaaaagcctaccagtttgaagaaaattattctcaaagagagacaagagcggaagcagcggctccaggagaacgccgtctctcccgcgttcactagtgatgacacgcaggacggcgagtccgggggcgatgatcagttcccagagcaggcggagctctctggccctgaaggaatggatgagctgattagcactccatcagttgaggataagtctgaggaaccacccgggaccgagctgcaacgtgatactgaagcatcacacctggcacccaaccacaccacatttcccaaaattcactcccgtagattcagagactattgcagccagatgctaagcaaggaggttgacgcctgtgtcactgatctgctcaaggagctcgtgaggttccaggacaggatgtaccaaaaggatcctgtgaaagctaagacgaagcgccggctcgtactaggtctccgcgaagtcctcaaacacctgaaacttaagaagctcaaatgcgttattatctctccaaactgcgaaaaaattcaaagcaagggcgggctggatgacacgctgcacaccatcattgattatgcttgcgaacagaacattccatttgtgttcgcgctgaaccgaaaggctctgggcaggagtttaaataaggctgtacccgtatctgtggtcgggattttcagctacgatggcgcccaggaccaatttcacaaaatggttgagctcaccgtagctgcccgccaagcctacaagacaatgctggagaatgtgcagcaggaactcgtaggggagcctcggccccaagcccccccatctctgcccacacaggggccgtcttgcccagccgaggatggacctccagctctaaaggaaaaggaggaaccccactacattgaaatatggaaaaagcaccttgaggcttattctggttgcaccctggagctggaagagtccttagaagctagcacttcacagatgatgaacttgaacctgtag

SEQ ID NO: 204403 - DNA, 828 bp, Artificial Sequence
  Description of Artificial Sequence: Synthetic coding sequence
ggcaccatcagcagcgagatcaagagcgcccggggcagccaccacttatccatctacgctgagaatagtctcaaaagcgatgggtatcacaaacgcaccgaccggaagtccagaatcatcgctaagaacgtgtccacatccaaacctgagttcgaatttacaacacttgattttccagaactgcagggtgccgaaaataatatgagcgagatccagaagcagccaaagtgggggccagtacacagtgtgtccacagacatttccttactgcgcgaggtagtgaaacccgctgcggtcctttcaaagggagagatcgtggttaagaataaccccaacgaatccgtcaccgcaaacgcggcgaccaactctccttcttgcaccagagcagatcctaagaacgtgagcatcccaagctccgaggcactctcttctgatccgtcttacaacaaagaaaaacacatcatccaccctacacagaaatcaaaggcctcccagggcagcgatctggaacagaacgaagcctcccggaagaacaaaaagaagaaagaaaagtccacatccaagtacgaagttctcactgtccaggaacccccacgaatcgaggacgcagaggagtttccgaacttggcggttgcatcagaaaggcgggacaggatagagacccccaaattccagagtaagcagcagccccaggacaactttaagaacaacgtaaaaaagtctcagctccctgtgcagctggacctggggggcatgctgaccgcgctcgagaaaaaacagcactctcagcacgcgaagcaatcaagtaaaccggtcgttgtcagttag

SEQ ID NO: 204404 - DNA, 183 bp, Artificial Sequence
  Description of Artificial Sequence: Synthetic coding sequence
atgcccctgcccatcctgctgcacgtgcaggagcagatcctgaagatgctcgtatatcacctccttaaactgtatctgcgcatcctgcctacgacaaaaaaaaacaccctctttattctcccaaagtccctcaaacaccataaagttgtgactctgaataagatgaaaccacaagagcgctag

SEQ ID NO: 204405 - DNA, 2361 bp, Artificial Sequence
  Description of Artificial Sequence: Synthetic coding sequence
atggccttcggcgccagcaccttccccccccagtacctgagcagcgaaatcaccctgcacccatacgcatattcaccttataccctggatagcacacagaacgtgtacagcgtgcccggcagtcagtacctgtacaaccagccaagttgctaccggggtttccagaccgtgaagcatcggaacgagaatacctgcccactgcctcaggagatgaaagcattatttaaaaagaaaacctacgatgagaaaaagacatacgaccaacagaagttcgacagtgaaagggcagacggtactataagttccgaaatcaaaagtgctcgggggtcacaccatctgagcatttatgcagagaattccctgaaaagtgatggctatcacaagagaactgaccggaaaagtcgcattattgcaaagaatgtgagtacatcaaagcccgaattcgaattcacaacgcttgactttcccgaacttcagggcgcagaaaacaacatgtcagagatccagaagcaaccgaaatgggggccagtgcacagcgtttctacagatattagtttgctgcgagaggttgtgaagccagcagccgtgctgtctaagggcgagatcgtggttaaaaataatcccaacgagagcgtgaccgctaacgcagcgactaattccccaagctgcacgagggagctgagttggactcccatgggctatgtggtgaggcagactttaagcacagagctctcggctgcccccaagaacgttacaagcatgataaacttaaaaactatcgcaagctccgccgatccgaagaatgtcagcatcccctcctccgaagccctcagtagtgaccccagttacaataaggaaaagcacattatccatcccacgcagaaatcaaaggctagccagggatctgacttggagcagaatgaggccagtcgtaagaacaaaaagaaaaaggagaaatctacgtctaagtatgaggtcctgaccgtacaggagcccccaaggatagaagatgcggaggaatttcctaatttggcagtcgcgtctgagagaagggatcggattgaaacacccaagttccaaagcaagcagcagccccaggacaatttcaagaacaacgtcaaaaagtcccagctgccggtgcagctggacttaggcggaatgctcaccgccctggagaagaaacagcattcgcagcatgcaaagcaaagctctaagcccgttgtggtttctgtcggtgccgtgcccgtcctgtccaaagaatgtgctagcggggagagagggagaaggatgtcacagatgaagacgcctcacaaccctctagactcttcagctcccctaatgaagaaggggaaacagagggaaattcctaaagctaagaaaccgacttcactgaaaaagattatactcaaggaacggcaggagcggaaacagagactgcaggaaaacgccgtgagcccggctttcaccagcgacgatactcaagatggggaatctggtggggatgatcagtttccggagcaggcagagcttagcggcccggaaggcatggacgaacttatctcaacgccttccgtcgaggataagagcgaggaaccacccggaaccgaacttcagcgcgatactgaggcgagtcatctcgcgcctaatcacaccactttccccaaaattcattcaaggcgctttagagattattgctcacagatgctgtcaaaagaagtggacgcatgtgtcactgaccttcttaaggagttagtccgcttccaagacaggatgtaccaaaaggaccctgtgaaggccaaaaccaagcgtaggctcgtcctcgggcttagggaggtcctgaagcacctcaagctgaaaaagctgaaatgcgttatcatcagcccaaactgcgaaaagatccaaagcaagggcgggctcgatgacaccttgcatacaataatcgattacgcttgtgaacaaaacatacccttcgtctttgccctcaaccgaaaggctttaggtcgtagtctaaacaaagccgtgcctgtcagtgtggtgggcatcttctcttacgacggggcccaggaccagttccataagatggtcgaactgacagtcgctgcaaggcaggcttacaaaactatgctggagaacgtgcaacaagaattagtgggggagcctcggccacaggcccctccctctctccctactcagggcccctcatgtcctgccgaagatggccctcccgctttgaaggagaaggaggagccccactacatcgaaatctggaaaaaacatctggaggcctacagcgggtgcacactggaattagaggagtccctggaggctagcacatcccagatgatgaatctcaacctgtag

SEQ ID NO: 204406 - DNA, 747 bp, Artificial Sequence
  Description of Artificial Sequence: Synthetic coding sequence
atgcagacctgccccctggccttccccggccacgtgagccaggcccttggcaccttactgtttctggctgcttctctgtcagcccagaacgagggctgggacagcccgatctgcaccgaaggagtcgtttccgtgtcctggggcgagaacacagtgatgtcatgcaacatctccaacgcattctcacatgtgaacatcaagctgcgtgcccatggacaagagtcagccatatttaacgaggtcgcgcccgggtatttctcgcgagacggctggcagttgcaggtgcagggaggtgtggcacagctggtgataaaaggagcgcgggatagtcacgccggattatatatgtggcacctcgtcggccatcagagaaacaaccgccaggtaacactggaggtgtccggagctgagcctcagagcgcacccgataccgggttttggcctgttcctgcggtcgttaccgctgtgttcattctgctggttgccttagtaatgttcgcttggtaccgctgtaggtgctcacagcagcggcgcgagaagaagttctttcttttagagcctcagatgaaagtcgccgcgctgagagctggtgcccagcagggattaagccgggccagcgctgagttatggactcccgatagcgagcctaccccacggcctcttgccttggttttcaaacccagccccctgggcgctctcgaactactgtctccacaacctctttttccctatgctgcagacccatag

SEQ ID NO: 204407 - DNA, 888 bp, Artificial Sequence
  Description of Artificial Sequence: Synthetic coding sequence
atgctgcagggccccggcagcctgctgctgctgttcctggccagccactgctgtctaggcagcgcccggggcctgtttctgttcggtcagccggactttagctacaagcggtccaactgcaagcctatcccagccaacctacaactgtgtcacggcatcgaatatcagaacatgcgcctccctaacttgttgggccacgaaactatgaaagaagtcctcgagcaggctggtgcttggatacctctggtgatgaagcaatgtcatcctgatactaaaaaattcctatgttctctattcgctcctgtttgccttgatgatttggatgagacgattcagccttgccacagcctctgcgtgcaggtgaaggaccggtgcgcccctgtcatgtctgcattcggcttcccctggccagacatgctggaatgcgatcgtttccctcaggacaatgatttgtgtatcccgctcgcctcatctgaccacctcctgcccgcgaccgaggaagccccaaaggtctgcgaggcatgcaagaataaaaacgacgatgacaatgatattatggaaacactttgcaaaaacgactttgctttgaaaatcaaagtaaaggaaatcacttatatcaatagggacacaaaaatcattcttgagaccaagtctaagaccatttataaactcaatggagtaagtgagagagacctaaaaaagtcagtattatggctcaaagattccctgcagtgtacttgcgaggagatgaatgacatcaatgctccatacctcgtgatggggcagaaacagggaggcgaattggttataacatccgtaaagagatggcagaaaggacagcgggagtttaaaaggatatcccggtccattaggaaattgcagtgctag

SEQ ID NO: 204408 - DNA, 312 bp, Artificial Sequence
  Description of Artificial Sequence: Synthetic coding sequence
atggccagccggtgggccgtgcagctgctgctggtggccgcctggtccatgggatgcggcgaagccctgaaatgttatacctgcaaagaaccaatgaccagtgcatcctgccgcacaatcacacgatgcaagcctgaagacacagcttgcatgacaactctcgtaacagtcgaagctgagtaccccttcaaccagtcaccagtggtcactagatcctgctcttcctcatgtgtagctaccgaccccgattccatcggggctgcccacctgatattttgttgctttcgggatctgtgtaattccgaactatag

SEQ ID NO: 204409 - DNA, 636 bp, Artificial Sequence
  Description of Artificial Sequence: Synthetic coding sequence
atgatcagccggatggagaagatgaccatgatgatgaagatcctgattatgttcgctctgggaatgaattactggtcctgttcaggatttccagtctacgactatgacccttcaagcctgagagacgcgctgtcggcgagtgttgtgaaggtcaattcccagagcctatctccttacttatttagggcatttcgctcctccctcaagcgagtggaagtgcttgatgagaataatctggtgatgaacctggaattctcaatcagagaaacaacttgccgtaaggattctggcgaggacccagctacctgtgccttccagcgagattactacgtgtctacagccgtctgtcgtagtactgtcaaagtctcagctcagcaggtccagggcgtgcacgcccgatgttcctggtccagtagcactagtgaatcttactcgtccgaagagatgattttcggggatatgctgggatcccacaagtggcgaaataactatctgttcgggctcatatcggacgagtctatatccgagcagttctatgatcgtagtctgggcattatgagacgcgtgctgcccccgggaaaccgccgctaccctaatcaccgccaccgcgccaggatcaataccgatttcgaatag

SEQ ID NO: 204410 - DNA, 636 bp, Artificial Sequence
  Description of Artificial Sequence: Synthetic coding sequence
atgatcagccggatggagaagatgaccatgatgatgaagatcctgattatgttcgcgctgggcatgaattactggtcatgcagcgggtttccagtgtatgactacgatccttcatccctgcgggatgccctcagcgcgtccgtggtgaaagtaaacagccagtcattgagcccgtatctgtttcgagcctttcggagctccttaaagagagtggaggtactggacgagaacaacctggtgatgaacttggagttttctattcgggagacgacatgccggaaggacagcggggaggaccccgcgacgtgcgccttccagcgggactattatgtgagtacagcggtttgccggagcacagtgaaggtatcagcacaacaggtgcagggcgtccacgcacgttgcagttggagttcgtctacaagcgagagttattctagtgaggagatgatatttggcgacatgttaggctcgcacaagtggcgaaataactatttattcggcctcatctctgacgagagtatatccgagcagttctatgatcggtcccttggcattatgcgccgagtactcccacctggcaaccgacgctaccctaatcatcggcatcgggcgcgtatcaatacagacttcgagtag

SEQ ID NO: 204411 - DNA, 366 bp, Artificial Sequence
  Description of Artificial Sequence: Synthetic coding sequence
atggccccccggcccctgctgctgctgctgctgctgctgggcggctccgcagctcgtcccgcgccccctcgagcccggcgccacagtgacggtacatttacctctgaattgagcagattgcgcgagggagcccgtctgcaaaggttactgcagggactggtggggaagcgctctgaacaggacgctgagaattccatggcctggactaggttgtcggccgggctcctctgtccaagtgggtccaacatgcccatcctgcaggcctggatgccactggacggaacctggtccccttggctgccaccgggccctatggtgtccgagcctgccggggccgctgccgagggcaccctgcgtccccgctag

SEQ ID NO: 204412 - DNA, 1323 bp, Artificial Sequence
  Description of Artificial Sequence: Synthetic coding sequence
atgcggccccacctgagcccccccctgcagcagctgctgctgcccgttttattggcttgcgcagctcattctaccggggccttgcctaggttatgtgacgttcttcaggtcctgtgggaagagcaagaccagtgcctgcaggagctgagtagagagcagacgggcgatctgggcaccgaacagcccgtcccagggtgcgaagggatgtgggataacatctcctgttggccatcaagcgtgccgggccgaatggttgaagtggagtgcccacgttttctccggatgctgacatctaggaatggatcacttttccgaaactgtacacaggacggatggtccgagacatttccaaggcctaatctagcctgtggagtcaacgtaaacgactctagtaacgaaaagcgacactcataccttctgaaactgaaggtgatgtacaccgtgggatactcttcatccctagtcatgctgctggtagcgctggggatcctgtgtgcctttagaagattacactgtacacgcaactacatacacatgcatctgttcgtctccttcatcctgcgggcactctccaacttcatcaaagatgctgtgttattctcgagcgacgatgttacttactgcgatgcccaccgggcgggatgtaagctggtgatggtcctttttcagtactgtatcatggccaactactcatggcttttggtggaaggactgtatctgcatacactgttagccatttccttcttctctgaacggaagtacctgcaaggctttgtggccttcggctggggcagccccgccatcttcgttgctctttgggcaatcgccagacactttctggaggacgtgggatgctgggatattaacgctaacgcctcaatttggtggatcatccgcgggccagtgattctcagcattctaattaacttcattctctttattaatattctccgcatcctcatgcggaaactgcgcacacaggagacccggggcaacgaggtgtcccactacaagcgcctggcacgatccacgctgctactgattccactgtttggcatacattacatagtgttcgcattttccccagaagacgcaatggagatccagctgtttttcgaactcgcccttggatcttttcagggtctggtggtggctgtgctttattgtttcctgaatggggaagtgcagctcgaagtgcagaaaaaatggcagcagtggcatctgcgggaatttcccctccaccccgtggcctctttctctaactctacaaaggcaagccatttagaacagtcacagggaacttgcagaacgtcaatcatttag

SEQ ID NO: 204413 - DNA, 288 bp, Artificial Sequence
  Description of Artificial Sequence: Synthetic coding sequence
atgaagctgctgatggtgctgatgctggccgccctgctgctgcactgttatgcagatagcgggtgcaagcttcttgaggatatggttgagaagacgatcaattccgatatttctatcccagaatataaggagctgctccaggagtttatcgactcagacgccgctgcagaagctatggggaaatttaagcagtgtttcctgaaccagtctcacaggaccctgaaaaacttcggcctgatgatgcatactgtttacgattccatatggtgcaatatgaagagcaactag

SEQ ID NO: 204414 - DNA, 1746 bp, Artificial Sequence
  Description of Artificial Sequence: Synthetic coding sequence
atgcccgccccccgggcccgggagcagccccgggtgcccggcgagaggcaacccctcctgccaaggggcgcgaggggtcccagaaggtggcgcagagccgctggagccgcggtcctccttgtcgaaatgctggagcgtgccgccttctttggcgtgactgccaacctcgtgttatatctcaacagtaccaactttaactggaccggagagcaggccacacgagcggccttggtattcctcggcgcttcttacctgctggctcccgtcggcgggtggctggccgacgtataccttggtcgataccgggcagtggccctctccctcttgctgtacctcgcggcctccggactgctgccggctactgctttcccagacggccgctcctctttttgtggggagatgcctgcgtccccactgggtcccgcctgcccttcagcaggctgcccaaggagcagcccaagcccctactgtgctcccgttctgtacgcggggctgctcctcctcggacttgccgcatcatccgtgcggtcaaaccttacgtcattcggtgccgatcaggtgatggacctcggcagggacgccactagacgctttttcaactggttctactggtctataaatttaggtgccgttttatcgttgctggtggtggctttcattcagcagaatatctcttttctcttggggtactcgattccagtagggtgtgtcgggttagccttcttcatctttctgttcgccaccccagtgttcatcactaaacctcccatgggcagccaggtaagttcgatgctaaagctggccttgcaaaattgttgccctcagctctggcaaagacactccgctcgggatagacaatgcgctagagtgctcgctgacgaaagaagccctcagcctggagcttcaccccaggaagacattgccaacttccaggtgctggttaagatcctgccagtgatggtgactctcgtgccctactggatggtatatttccagatgcaatcgacatacgtgctccaggggctgcatctgcatatacctaatatattcccggcaaatccagccaacatctcagtagctttgcgcgcccagggctcgagttacacgattccagaggcttggctgctgctggccaatgttgtggtcgtactcatcttggtcccccttaaggataggttgatcgacccactgctcctgaggtgtaagctcttgccttccgctctccagaagatggccctgggaatgttttttggatttacgtccgttatagttgcaggggtgctggagatggagcgactacactatatccaccacaatgagacagtgagtcagcaaattggtgaagtgttgtacaacgctgctcccctcagtatttggtggcagataccccagtatcttctgattggaatcagtgaaatttttgcgagcatccccggactagagtttgcttatagcgaagctccccggagcatgcagggggcaatcatgggcattttcttctgtttgtccggcgtgggaagcctcctgggaagcagccttgttgcactactgtcacttccaggcgggtggctgcattgtcccaaggactttggtaacattaacaactgccggatggatttatactttttcctcctggcagggatccaagccgtgactgctttgctgttcgtatggattgccggacgctatgagagggcgtctcaggggcccgcctcccactctcgtttttcacgggatcgtggctag

SEQ ID NO: 204415 - DNA, 363 bp, Artificial Sequence
  Description of Artificial Sequence: Synthetic coding sequence
atgaagctgctgatggtgctgatgctggccgccctgagccagcactgttacgcgggcagtggatgtcccttactcgaaaacgtgatttcaaagaccatcaacccacaagtctccaagacagaatataaggagctgttacaggaattcatcgatgacaatgccacaaccaatgctatcgacgaactcaaagaatgcttcctgaaccagaccgatgagacgctgagcaacgtcgaggtgtttatggtcatctccttcagtagctataagctctttaaaagtccagatcaagggcaagtgggatcatcctttctcacagacaacgcaaaggcaacctcggaacaagctttcagctacatcggatag

SEQ ID NO: 204416 - DNA, 315 bp, Artificial Sequence
  Description of Artificial Sequence: Synthetic coding sequence
atgaagctggccgccctgctgggcctgtgcgtggccctgagctgctccagtgccgccgccttcttggtgggctccgcaaagcccgtggcccagcccgtggctgccctggaatctgccgccgaagcaggcgcgggaaccttagctaatccgttgggtaccttaaatcccctgaagttactcctttcatcgcttggcattcctgttaatcatctcatcgaaggaagccagaagtgcgtcgccgaattaggcccccaagccgtgggtgcagtgaaggcgctgaaagcattgctgggtgcactgactgtatttggttag

SEQ ID NO: 204417 - DNA, 282 bp, Artificial Sequence
  Description of Artificial Sequence: Synthetic coding sequence
atgaagctggtgaccatcttcctgctggtgaccatcagcctgtgcagctacagtgccacagcttttttgatcaataaagtccccctacctgtggataagctggcacccctccctctggataacatcctcccattcatggaccccctcaaacttctcctgaagacccttggcattagtgttgagcatctggtggaaggcctgagaaaatgcgtgaatgaactcggacccgaggcgtctgaggccgtcaagaaattgctagaggctctcagccatctggtgtag

SEQ ID NO: 204418 - DNA, 1854 bp, Artificial Sequence
  Description of Artificial Sequence: Synthetic coding sequence
atggccgaggccaagacccactggctgggcgccgccctgagcctgatccccctgatttttctgatttccggggctgaagctgcgagctttcagcggaaccagcttctgcagaaggaacctgatctgagacttgagaacgtgcagaagtttcccagcccagagatgattcgtgctcttgaatatatcgagaaccttcggcagcaagcccataaagaggaatcctcacctgattacaacccataccaaggcgtgtctgttcccctgcagcagaaggaaaatggagacgaatcccatctgccagaacgcgatagtctttccgaagaggattggatgaggattatactggaggctctgaggcaggcagaaaacgagccccagtccgcccccaaggaaaacaagccttacgcgctcaacagcgaaaagaacttcccaatggatatgtccgacgattatgagactcagcaatggcctgagaggaaattgaagcacatgcaattcccacccatgtatgaagaaaacagccgggacaatccattcaaaaggaccaacgagattgttgaagagcaatacaccccacaatcactggccacattagaaagcgtcttccaggaactcggcaaactcacagggcctaataaccaaaagcgagaaagaatggacgaggagcaaaaactgtacaccgacgacgaggatgacatctacaaagctaacaatatcgcatacgaggacgttgtgggcggagaggactggaaccccgtggaggagaagattgagagtcagacccaggaagaggtccgggacagcaaggaaaacattgagaagaacgagcagattaacgatgaaatgaaacggtcaggacaactggggattcaagaggaagaccttcgtaaagaaagcaaagatcaacttagtgacgatgtgagcaaagtaattgcctatctgaagcggctggtgaatgctgcgggatcaggccgtctgcagaatggtcagaatggcgagcgggccacccgactcttcgagaagcctctggattcacagtcaatttatcagctgatagaaatttcacggaaccttcagattcctcctgaggatctgattgagatgctaaagacaggagagaagcctaacggctccgtggaaccagaaagggagctggatctgccagttgatctggacgacatcagcgaggctgatctcgaccatcctgacctgttccagaataggatgctctcgaaatcaggttacccaaaaaccccgggtcgagccggaaccgaggcgctgccagacggattaagtgtcgaggatatacttaacctgctaggaatggaaagcgcggcgaatcagaaaacttcatactttccaaatccatacaatcaggaaaaggtgctgcccagactcccatatggggcgggccgcagcaggagtaatcagctgcccaaggccgcctggatcccccacgtggagaataggcagatggcgtatgaaaacttgaatgataaagaccaggaactgggcgagtacctcgccagaatgctcgttaagtaccccgaaataatcaacagtaatcaagtcaagcgggtgcctggccaggggagctctgaggatgacctgcaagaagaagagcaaatagagcaagctataaaggagcaccttaatcagggctcctcccaagagacggataagctggcccctgtgtccaagcggttccctgtcggcccaccgaagaacgatgacacacctaataggcagtactgggatgaagatttgctgatgaaagttctggaatacctcaaccaggagaaagcggagaaaggacgcgaacacattgctaagagggcaatggagaatatgtag

SEQ ID NO: 204419 - DNA, 435 bp, Artificial Sequence
  Description of Artificial Sequence: Synthetic coding sequence
atggccgaggccaagacccactggctgggcgccgccctgagcctgatccctttaattttcctgatctctggtgccgaggccgccagttttcagaggaaccagctcctgcagaaggaaccggacctaaggctcgagaacgtgcagaagttcccgagccctgagatgatcagggcattagagtatattgaaaatctgagacaacaggcacacaaggaagagtcatccccggactataatccctatcagggcgttagcgtgcccctgcagcaaaaggagaatggagacgagtcccacctgcccgagcgcgactctctctccgaggaggactggatgaggattatcctggaggccctcaggcaagccgaaaacgagcctcagtcagccccaaaggaaaacaaaccctacgcccttaatagtgaaaagaatttcccatag

SEQ ID NO: 204420 - DNA, 378 bp, Artificial Sequence
  Description of Artificial Sequence: Synthetic coding sequence
atggccgaggccaagacccactggctgggcgccgccctgagcctgatacctctaattttcttgattagcggcgcagaagctgccagtttccagaggaatcagttgctgcagaaggagcctgacctgcgactggaaaatgttcagaagttccccagccctgaaatgattagagcactcgagtacatcgagaatctccgccagcaggcccacaaggaggagagtagtcccgattacaacccataccagggggtttcagtgcccctgcagcagaaggagaacggcgatgagagccatcttcccgagcgggattcactgagcgaagaagactggatgcgaattatcctggaagctctgaggcaggctgagaatgagccgtag

SEQ ID NO: 204421 - DNA, 1434 bp, Artificial Sequence
  Description of Artificial Sequence: Synthetic coding sequence
atggccgaggccaagacccactggctgggcgccgccctgagcctgatcccccttatattcctgatttcaggagccgaggccgccagcttccagcgtaaccagctgctccagaaggagcctgatctacgtctggagaacgtgcagaagttccctagcccagagatgattagggccctggaatatatcgagaatcttagacagcaggctcacaaagaggaatcttcccctgactacaacccgtaccagggggttagcgttccccttcagcagaaggaaaatggcgatgagagtcatttacctgaaagggactcactccgtggggaagattggaatccagttgaggaaaagatagagagtcagacccaggaggaggtacgggatagcaaggagaatatcgagaagaacgagcagatcaatgatgaaatgaaaagaagcgggcaactggggattcaggaagaagacctgcggaaagagtccaaggatcaactctccgacgacgtcagcaaagttatcgcatatttgaagagactggttaatgccgccgggtccggtagactgcaaaacggccagaacggggagagggccactaggctttttgagaagccactggattctcagagtatataccaactcatcgagattagtagaaatctgcagattccccccgaggacctgatcgaaatgctgaaaactggagagaagcccaatggcagtgttgagccggagcgcgagctggacctgccagtcgatctggatgacatatccgaagcagatcttgaccaccctgatttattccagaacagaatgctgtcgaagtcaggataccctaagacacccggccgagcaggtacggaagcactcccggacggcttgagtgttgaagatatactgaacctgctcgggatggaatcagccgctaatcaaaagacctcctatttccccaacccatacaatcaagaaaaggtcttaccacggctcccatatggcgccggaagatcaaggtctaatcagctgcccaaagctgcttggataccccacgtggaaaacaggcagatggcatatgaaaatcttaacgacaaagaccaggagctgggagaatacctagctcgaatgcttgtcaaataccccgagatcattaactccaaccaggtaaaaagggtacctgggcaggggagctctgaagacgacctgcaggaggaggaacagatcgagcaagctataaaggaacacctgaatcaaggatccagccaggagactgacaaacttgctcctgttagtaaaagattccctgtcggcccgcccaaaaacgatgacactccgaatcggcagtattgggatgaggatctgttgatgaaagttctggagtatctcaaccaggaaaaagctgagaaaggaagggaacatatcgcaaaaagggctatggagaatatgtag

SEQ ID NO: 204422 - DNA, 390 bp, Artificial Sequence
  Description of Artificial Sequence: Synthetic coding sequence
atggagcccagccagtgcgtggaggagctggaggacgacgtgttccagcctgaagacggcgaaccggttacacagcccgggagtctgttgtccgccgatcttttcgcacaatcccttctagattgccctctctctcggttacaactattccccttaacacattgttgtggccccggactgcggcctacatcacaggaggataaggccacccagactctgtctccggctagtccctcacagggagtgatgttgccctgcggagtgaccgaagagccacagagattattctacgcacccgccgaacccaagagctgcgttgttgccgatccacctctgccggcccagccatgctttgaatggagaagagaacaggagcgcggcaggccatag

SEQ ID NO: 204423 - DNA, 711 bp, Artificial Sequence
  Description of Artificial Sequence: Synthetic coding sequence
atggccgccatccaggacggcctggccaagggcgagaacgacgagactgtgtctaatacccttactctgactaacggtctcgagagaagaacgaaaacttactctgaggataattttgaagagttacagtacttccctaatttttacgctctgcttaagtcaatagactccgagaaggaggctaaagagaaggaaactttgataaccatcatgaagaccctgatagatttcgtaaaaatgatggtcaagtacgggacaatttcgccggaagaaggggtgtcatatcttgaaaatctagatgagatgattgccttgcagacgaaaaacaagctggaaaagaatgccacagacaacatttctaagctgttccccgcgccatccgaaaaatcacatgaagaaaccgatagtactaaggaggaagctgcaaagatggaaaaggaatatggctcattgaaggattctaccaaagacgataacagcaatcccggcggtaagacagacgagcctaagggaaaaactgaggcttatctggaagctatacgcaaaaacatagagtggctgaagaaacacgacaagaaaggaaacaaggaggactatgacttgtctaagatgcgagattttatcaacaaacaagccgacgcttatgtggagaagggaatactcgataaagaagaagctgaagccatcaagcggatctattcatccctttag

SEQ ID NO: 204424 - DNA, 174 bp, Artificial Sequence
  Description of Artificial Sequence: Synthetic coding sequence
atggccgccatccaggacggcctggccaagggcgagaacgacgagacggtgtccaacaccctgaccttaacaaacggcttagagcgccgaaccaagacatactctgaggataactttgaggaattgcagtattttccgaatttttacgcattactaaagtcaattgacagctag

SEQ ID NO: 204425 - DNA, 990 bp, Artificial Sequence
  Description of Artificial Sequence: Synthetic coding sequence
atgagcgccttcgacaccaaccccttcgccgaccccgtggacgtgaaccccttccaggatccttccgtcacccaactaacgaatgccccccagggcgggctcgctgagtttaatccctttagcgaaactaatgccgcaacaacagtacccgtcacccaactgcctggaagctcccagcctgccgtgttgcaaccctctgtggagccgacgcagccgactcctcaggccgtggtaagcgctgcccaggccgggcttcttcgccaacaagaggagttagaccgcaaggccgctgaactcgagcgaaaggagagagaactgcaaaatacagtggcgaatcttcatgtacggcaaaacaactggccccctctgccatcatggtgtccagtaaaaccctgtttttaccaggatttctcaaccgaaatcccagcggattaccagcgaatatgcaaaatgctgtactacctgtggatgttacatagtgtcacactttttctcaacctcttggcatgcctggcgtggtttagcggtaattcctccaagggggtggattttggcctgagcatcctctggtttttgatttttaccccatgtgcatttctttgttggtataggccgatctataaggcctttcgctctgataattctttctccttctttgtattcttcttcgtattcttctgccaaatcggcatttacattattcagctggtgggaattccagggctgggggactctggctggattgctgctttgtctaccctagacaatcacagcctggccatatccgtgattatgatggtggtggcaggcttttttacactttgtgctgtactgtctgtgtttctcctgcaaagagtgcactcactctaccgtagaaccggagcctccttccagcaggcacaagaggaattttcacagggtatttttagtagtcgcacattccacagagctgccagttctgctgcgcagggagccttccaaggcaattag

SEQ ID NO: 204426 - DNA, 864 bp, Artificial Sequence
  Description of Artificial Sequence: Synthetic coding sequence
atgagcgccttcgacaccaaccccttcgccgacaccaacgccgccaccacggtgcccgtaactcagttgccaggctcatcccaaccagcggttctgcagcccagcgtagagcccacacagccgaccccgcaggcggttgtctctgccgctcaggcgggtctgctccgacagcaggaggagctagatcggaaagctgctgaactggagcgcaaggaacgggagctgcagaatacagtggctaacttacatgtgcggcaaaacaattggccccctctcccatcttggtgtcctgttaaaccatgcttctatcaagatttttccacagagattcccgctgactaccagagaatctgcaagatgctgtactatctgtggatgttgcacagcgtcaccttgtttctcaatctgctggcatgtctggcctggtttagcggaaactccagcaagggggtggacttcggacttagtatcttgtggtttttaatatttacaccatgtgcttttttgtgttggtatagacctatttacaaggcctttaggtctgataactcctttagcttctttgtgttcttttttgtctttttttgccaaattggaatatatattatccagctcgtgggaattccgggattaggcgattctgggtggatagcagccctgtccacactggacaaccactccctggcgatcagcgtgatcatgatggtcgtagctgggttcttcaccttgtgtgccgtgctctccgtttttttactgcagcgtgtcagtggagtggggcgtgccgactccaaatgggaggaggccgggaataggttcctgcccttaccacgcgacgtgttccatcattgtagttgggcttcatag

SEQ ID NO: 204427 - DNA, 1044 bp, Artificial Sequence
  Description of Artificial Sequence: Synthetic coding sequence
atggcccagagccgggacggcggcaaccccttcgccgagcccagcgagctcgacaacccctttcaagatcccgctgtcatccagcacaggccttcccggcagtacgccaccctggacgtctacaaccccttcgaaactcgtgagccgccgcccgcctatgagcccccagcccccgcacctcttccacccccttctgccccttccctgcagcctagtcgtaagctttccccgacagagcccaaaaattacggatcatattccacccaagcttccgccgcagccgccacagctgaactgctaaaaaagcaagaagaactgaaccgaaaggcagaggaactggatcggcgcgaacgagaactgcagcacgcagctctaggcggcacagcgacccggcagaataactggccaccactgccctccttttgcccagtccagccttgcttcttccaggatattagcatggagatcccacaggaattccagaagactgtcagcaccatgtattatctttggatgtgcagcacccttgcactgctcctcaattttctggcttgccttgcgtccttttgcgtggaaactaacaatggagcaggatttggattgagtatattgtgggtgctgttgtttaccccgtgttccttcgtgtgttggtacaggcctatgtataaggcttttaggtctgacagctccttcaatttcttcgtgttcttttttatcttcttcgtgcaagacgttttgtttgtgctccaggctattggtataccagggtggggattctcaggttggatcagcgctctggtcgtcccgaagggcaacaccgccgtcagcgttcttatgttgcttgtcgcccttctcttcaccgggatcgcagtcttgggcattgttatgctcaagcggatccacagtttgtaccggaggactggggcttcattccaaaaggctcagcaggagtttgcagccggcgtcttcagtaacccagctgtgagaaccgctgctgcaaacgctgccgccggtgccgcagagaatgcttttcgagctccatag

SEQ ID NO: 204428 - DNA, 966 bp, Artificial Sequence
  Description of Artificial Sequence: Synthetic coding sequence
atggcccagagccgggacggcggcaaccccttcgccgagcccagcgaactggacaatccatttcagccgcctcccgcttatgagcctccggcaccggctcccctgccaccgccgagcgccccaagtctccaaccctcacggaaactctcccccacagaaccaaagaactatggcagttatagcacccaggcgtcagcagccgccgccaccgcagaactgttaaagaagcaggaggagctcaaccggaaagccgaggaactagaccgtagagaaagagaattgcaacatgccgcactaggagggacagccaccaggcagaacaattggccacccttgccttccttttgtcccgtccaaccttgcttctttcaggatataagcatggaaattcctcaggagttccaaaaaaccgtcagcacgatgtattacctgtggatgtgtagtaccctggcgttgctgctgaactttctggcttgtctggccagcttctgcgtggaaacgaacaatggcgcggggttcggcttaagtattctgtgggttctgctgttcaccccctgcagctttgtgtgttggtaccggccaatgtataaggcttttcgcagcgacagttcattcaatttttttgtgtttttctttatattctttgtgcaggatgtgctgttcgtacttcaagccataggcatacctggctggggcttttccggttggatttcggccctagttgtccccaaaggcaatactgcagtctctgttctgatgttgctcgtggccttattgttcacaggaatcgccgttctcggcatcgtgatgctgaaacgaattcattccctgtacaggaggaccggggcatcctttcagaaagcccagcaggagttcgcggctggggttttctcaaatccagcagtgcgaacagcggctgcgaacgcagccgcaggggccgcagaaaatgcctttagagcgccttag

SEQ ID NO: 204429 - DNA, 690 bp, Artificial Sequence
  Description of Artificial Sequence: Synthetic coding sequence
atgagcgagaaggagaacaacttcccccccctgcccaagttcatcccagttaagccctgcttctaccagaacttctctgatgagatcccagtagagcaccaggtcctcgttaagcgaatatatcggctgtggatgttctactgcgctacactaggggtgaatctcattgcatgtctcgcctggtggatcggtggcggttccggcacaaactttggcctggctttcgtgtggctccttctgtttactccatgcggctatgtttgctggttcagacctgtgtacaaggctttcagagccgactcttccttcaacttcatggccttctttttcattttcggcgctcagtttgtcttaacagtgatacaggctatcggattctctggatggggcgcttgtggctggctgtcagccataggtttctttcagtacagtcccggggccgcagtggtgatgctgctccctgcaataatgtttagcgtgagcgctgcaatgatggctattgccatcatgaaggtccatcgtatatacagaggcgccgggggctcctttcagaaggctcagacggaatggaacaccggcacatggcggaaccctccatcccgagaggcgcagtacaataacttctctgggaatagccttcctgaatatcctactgttcctagttatccagggagcggccagtggccttag

SEQ ID NO: 204430 - DNA, 588 bp, Artificial Sequence
  Description of Artificial Sequence: Synthetic coding sequence
atgagcgagaaggagaacaacttcccccccctgcccaagttcatcccagtcaagccttgcttctaccaaaatttcagtgatgaaatcccagtggagcaccaagtactggtgaaacggatttatcggctgtggatgttttactgtgcaactctgggcgtaaacctgattgcctgtttggcttggtggattggcggcggatcaggcaccaacttcggattggcctttgtgtggcttctgttattcacaccttgtggatacgtgtgttggttccgaccggtctacaaggcttttcgcggatggctttctgctatcggcttttttcaatactccccaggagcagcagttgtaatgcttttaccagccattatgttcagcgtttctgcagctatgatggccattgccattatgaaagtgcaccgtatctatcgcggtgcaggcgggagtttccagaaggcccagacggagtggaacacaggtacctggagaaatccaccttctagggaagctcagtacaataacttctccggcaattccctgccggaatacccaaccgtccccagctatccaggaagcggacaatggccttag

SEQ ID NO: 204431 - DNA, 588 bp, Artificial Sequence
  Description of Artificial Sequence: Synthetic coding sequence
atgatccagcggcacatccccgtgtgcggccggagccggccctaccagcgtgggtgcgttgtgcaggctgggagctcaggcagccccgggtggtcccactttaagatcatatgcggtcttgctccggctccatccgaggctgtactgtccgccaggaacaactgcgaacataccggcggatgcagactgcagcccgcattagttggggagacagagatgtccgagaaggaaaataattttccaccactgcccaaattcatccctgttaagccttgcttttaccaaaattttagtgatgaaatcccagttgaacatcaggtcttggtaaaaaggatctaccgtctgtggatgttttattgtgcaactttaggagttaatctgatcgcctgtttggcctggtggattggtgggggcagcggaaccaatttcggtctcgcatttgtgtggctccttctgttcaccccatgtgggtacgtatgctggttccgacctgtctataaagctttcagagccgattcctccttcaacttcatggcgttcttttttatcttcggggcccagttcgttctcaccgtaatccaggcctag

SEQ ID NO: 204432 - DNA, 708 bp, Artificial Sequence
  Description of Artificial Sequence: Synthetic coding sequence
atggccgagaaggtgaacaacttcccccccctgcccaagttcatccctctcaagccttgtttttatcaggacttcgaagcagatatcccccctcagcacgtgagcatgaccaaacgcctgtactacctgtggatgttgaacagtgtcactctcgccgtgaacttggtgggctgcttagcctggcttataggtgggggaggggcaactaatttcggcctggcatttctctggctgatcttgttcactccctgctcctatgtgtgttggttcaggcccatttataaagctttcaagacggatagcagttttagcttcatggccttcttctttaccttcatggcccagctggttatttctatcattcaggctgtgggcattccaggatggggagtttgtgggtggatcgcaaccatcagctttttcggcacaaacatcggttccgctgtggtgatgcttatccccaccgttatgtttactgtgatggcggtgttcagcttcatcgcactttccatggtgcataagttctataggggaagcggcgggtccttctccaaggctcaggaggaatggactacgggtgcttggaaaaaccctcacgttcagcaggccgctcagaatgccgcaatgggggccgcccagggcgccatgaaccaaccccaaacgcagtactccgctacacctaattacacttactccaatgagatgtag

SEQ ID NO: 204433 - DNA, 708 bp, Artificial Sequence
  Description of Artificial Sequence: Synthetic coding sequence
atggccgagaaggtgaacaacttcccccccctgcccaagttcatccctttgaagccatgcttctatcaggacttcgaggctgatatccccccgcagcatgtgagcatgacaaagcgtttgtattatctgtggatgttgaacagcgtgacactggctgttaacctagtcggatgcctggcttggctcatcgggggcgggggagctacaaactttggcctagcattcctatggctgatcctctttaccccctgctcttatgtttgctggttccggcccatttacaaggcgttcaagacagacagctccttcagcttcatggcgtttttcttcacatttatggctcagctagtgatctctatcatccaggccgtgggcatccccggttggggcgtctgcggctggattgcgactatctcgttttttgggacgaacatcgggtccgctgtggtgatgctgatacccacagtgatgttcacagttatggcagttttctctttcatcgccctctcaatggttcataagttctatagaggctctggcggctccttctcaaaagcgcaggaagagtggacaaccggcgcctggaagaacccgcatgtccaacaggcggcgcagaatgccgctatgggtgccgcccagggtgctatgaatcagccacagacacaatactcagcgactccaaattatacctattccaacgaaatgtag

SEQ ID NO: 204434 - DNA, 495 bp, Artificial Sequence
  Description of Artificial Sequence: Synthetic coding sequence
atgttcctgccccggctgcggggccggtacagcagccccgcctgccagcatgatcaggcacctctccttcctctggacgtcaccgatagcagcttctcctttatggcctttttctttacttttatggctcagctcgtgatatccataatccaagccgttggaattccaggctggggtgtgtgcgggtggatagcaaccattagcttcttcgggaccaatattggctccgccgttgtcatgctaatcccaacagtgatgttcaccgttatggccgtattcagtttcatcgccttgtcgatggtacacaaattttatcgaggcagtggaggttccttcagtaaggcccaggaggagtggacgacaggggcttggaagaacccgcatgtgcagcaggccgcccaaaacgccgccatgggagctgcccagggagcgatgaaccagcctcagactcaatattccgcaacacctaactacacgtacagtaatgagatgtag

SEQ ID NO: 204435 - DNA, 1083 bp, Artificial Sequence
  Description of Artificial Sequence: Synthetic coding sequence
atgttcgtggcccggagcatcgccgccgaccacaaggacctgatccacgatgttagctttgatttccatggccgtaggatggccacttgcagtagtgatcagagtgtaaaggtgtgggataaatccgagagcggcgactggcactgtaccgcctcctggaagacccatagtggatccgtgtggagagtgacatgggcccaccccgaattcgggcaggtgctcgctagctgctccttcgataggacagcagccgtttgggaggagatagtgggagagagtaatgataagctgagagggcagagtcactgggtgaaacgaactaccctagtggatagcaggaccagtgtgaccgatgtgaagttcgccccaaagcacatgggtctgatgttggcaacttgttcagccgatggcattgttaggatttatgaggctccagacgtgatgaacttgtcacaatggagtttgcagcatgaaatatcatgcaagcttagctgcagttgtattagctggaaccctagctcttctcgcgcacattctcctatgatagcagttgggagcgacgattcctcaccaaacgccatggctaaggtgcagattttcgagtacaacgaaaacactaggaaatatgctaaggctgagacactgatgacagttaccgaccctgtgcatgatattgcatttgcccccaatctcggcaggagcttccacattctggctatagccaccaaagatgtcagaatattcaccttgaagccggtgcggaaagagctgacctcatccggcgggccaaccaaattcgagattcatatagtagcccaatttgataaccataactcccaggtctggcgggtctcttggaatatcactggcactgtactcgccagctcaggcgacgatggctgtgtcagattgtggaaagccaactacatggataactggaaatgcacaggtattctgaaagggaatggctcccctgtaaacggttctagccaacaaggcacgagcaacccgtcactcggcagtacaatcccttcgctgcaaaattctcttaacggctcttcagcaggacggaaacattcctag

SEQ ID NO: 204436 - DNA, 1266 bp, Artificial Sequence
  Description of Artificial Sequence: Synthetic coding sequence
atgttcgtggcccggagcatcgccgccgaccacaaggacctgatccatgatgtcagtttcgattttcacggccggcgtatggctacatgctctagcgaccaatccgttaaggtctgggataagagtgaaagcggagactggcattgtacagcatcatggaaaacccactccggctctgtttggagggtcacatgggctcaccccgaattcggacaagtattggcctcctgtagctttgataggacagccgccgtatgggaagagatcgttggcgagtcaaacgacaagttaagaggacaaagccattgggtgaagcggaccactctcgttgactctcgtacttccgtgaccgacgtaaagtttgcccctaagcatatggggttgatgttggcaacctgctccgctgacggcattgtacgtatctacgaggcccctgacgttatgaacctgagccaatggtcattgcaacacgagatctcctgtaagttgtcatgctcttgtatttcatggaacccaagtagtagccgcgcccacagtcctatgattgctgtcgggtccgacgattcaagtccaaatgccatggcaaaggtccagatcttcgagtacaacgaaaatactcggaagtatgcaaaggccgagaccctcatgacggtcacagatcctgtacacgacattgcttttgctccgaacctcggcagatccttccatatcttagccatcgctactaaggatgtaagaatcttcaccctgaagccagtgcgcaaggaactgacatccagcggcggcccgacaaagttcgagatacatatcgtcgcccagtttgataaccataattcccaggtatggcgcgtctcatggaatatcacaggaactgtcctcgcttccagtggggacgacggctgcgtacgcctttggaaagctaactacatggataactggaagtgcactggaattctgaaggggaatggctctcccgtcaatggatccagccaacagggcaccagcaaccctagcttgggctccacgatacctagtctccagaactcgctgaacggtagtagtgccggaaggtacttctttacccctcttgactcccctcgggctggatctagatggtcgagttatgcgcagttgcttccccctccccccccccctctagtcgaacattcttgcgatgccgataccgctaacttgcaatatccccatccacggcggaggtacctttcaaggcccctgaacccactcccagaaaacgaagggatctag

SEQ ID NO: 204437 - DNA, 3075 bp, Artificial Sequence
  Description of Artificial Sequence: Synthetic coding sequence
atgcccgccgcccggccccccgccgccggcctgcggggcatcagcctgtttctcgcactcctgctgggctcacccgctgcagctttggagagagatgccctgcccgaaggcgatgccagcccattgggtccttaccttttaccttcgggtgctccagagaggggcagtccagggaaggaacaccccgaagagcgggtcgtgactgcaccgccatcctcgtcgcagtctgccgaggtgctcggcgagctggttctggatggcacagcacccagtgcacatcatgacatccctgccttgtctcccctgctgccggaggaggctaggcccaagcacgccttacctcccaagaagaaactaccatcattgaagcaggtgaactccgcccggaagcagctccgtcctaaagccacctccgccgccaccgtgcagagagccggttctcaaccagcttcccagggcctggatctgttatccagttctacagaaaagccaggccctcctggagacccagatcccatagttgccagtgaagaggctagtgaggtgcctctctggctggacagaaaggaaagcgcagtgcccaccactcctgctccgctgcagatcagccctttcacaagccagccatacgtcgctcacaccctccctcagcgtcctgaaccgggcgagccaggcccagacatggcgcaggaagctccacaggaagacaccagccccatggccctgatggataaaggagagaacgaacttaccggatctgccagtgaggaaagccaggagactacaacgtccactatcatcacaacaaccgtcattactacagagcaggctccagcactgtgtagtgtctcgtttagcaatcctgaaggctatattgatagtagcgactacccactgctcccgctcaacaacttcctcgagtgcacttacaatgtgactgtgtataccggatacggggtggagctgcaagtgaagtcagttaacctctccgatggtgaactgctttctatacgcggagtggacggtcccaccctgacagtcctcgctaaccagacactgttggttgagggccaggtgatcaggagcccgacgaatactatttccgtatactttcggacctttcaggatgatgggcttggcacgtttcagttgcactaccaggcgttcatgctaagttgcaacttccctcgccggccagattcgggagatgtgacggtgatggacctgcacagcggtggagttgcccactttcattgccatttgggatacgagcttcaaggcgccaagatgcttacatgcattaacgcttcgaaaccccattggtcctctcaggagcccatctgcagtgccccctgcggtggcgccgtccacaacgcaacaatcggccgcgtgctgtccccatcataccccgagaatactaacggatcccaattttgcatttggaccattgaagctccggaaggtcagaagctgcacctgcacttcgagcgactgttgctgcacgataaagaccgaatgacagtgcactcggggcaaaccaacaaatcagctctactgtacgacagtctgcagacggaatcggtgcctttcgagggattactgtccgaaggaaacaccatcagaatcgaatttaccagcgatcaggcgagagccgccagcacattcaatatccggtttgaagcattcgaaaagggtcactgctatgagccttatattcagaatggaaactttaccaccagcgacccaacatataacatcggaacaatcgtggaatttacctgtgacccaggacattctctcgagcagggtcctgctatcattgaatgtattaatgtccgcgatccatattggaacgacactgaaccattatgtagagccatgtgcggaggggagctgtctgcagttgctggcgtggtcttgtctcccaactggcctgaaccgtatgtggaaggcgaagactgtatatggaagattcatgtgggggaagagaagagaatattcctcgacatccaatttctcaacttgtccaacagcgacatcttgaccatttacgacggcgatgaagtcatgccgcacatcctgggccagtatctggggaactccggcccacaaaagttgtatagctccactccagacttaactatccagtttcattccgatcccgccggcctgatctttggaaagggacagggcttcataatgaattatatagaggtgagccgaaatgacagctgttccgacctccccgagatccagaacggctggaaaaccacgagtcacaccgaactagttagaggggcgaggataacgtaccaatgcgatccgggctatgacattgtcggctcagacacactgacttgtcagtgggacttgtcgtggtccagtgacccacctttctgtgagaagataatgtattgcacagatccaggtgaggttgatcatagtacccgacttatttctgaccctgtgctcctcgtgggcactaccatacagtacacatgcaacccgggatttgtcctggagggatcttccttgctgacctgttactcccgcgagactggtacacccatctggacgtcacggcttcctcactgtgttagcgaggaatctctggcctgcgataaccctggtctgcctgaaaacggataccagatcctctataagcgcctgtatctacctggcgaaagtttgacattcatgtgctatgagggctttgagcttatgggtgaagtgaccataagatgcatactgggtcagccgagccactggaacgggccactccctgtgtgtaaggtgaaccaggatagcttcgagcacgcccttgaggtggccgaggcagccgctgaaacctccctcgagggtggaaatatggcattagccatattcatccccgtgctcatcattagtctgctacttggaggcgcttacatttatatcacgcgatgcaggtattatagcaatcttagactcccactgatgtattctcatccctacagccagataactgttgaaaccgagtttgacaatcccatttatgaaaccggcgaaacccgcgaatatgaggtgtcgatatag

SEQ ID NO: 204438 - DNA, 2847 bp, Artificial Sequence
  Description of Artificial Sequence: Synthetic coding sequence
atgcccgccgcccggccccccgccgccggcctgcggggcatcagcctgtttcttgctctcctgctcggttctcccgctgcagccctggaacgggatgccctgcccgaaggcgacgcctcccccctgggaccctatttgctgccctccggcgcgccagagcggggaagcccgggtaaagaacaccctgaggagagagtggtgaccgcaccaccctcgagctcccagtctgcagaggtgttaggagaactggtgttggacggtactgctccatccgcccaccacgacattccggctctgagccctctcctcccagaggaggcaaggcctaagcacgctctcccacctaaaaagaagctgccatccctgaaacaggtcaattccgcccgcaagcagctcaggccaaaagctacttctgctgctaccgtgcagcgagcggggagccaaccagcctcccagggcctcgatctcctgagttcaagtaccgagaaaccaggacccccaggcgaccccgatccaatagtggcctccgaagaagcgtccgaagtcccactgtggcttgatcgtaaagagtcagcggtacccaccactccggccccacttcagatcagtccctttacaagtcaaccatatgtggcccacacacttccccaacggccagagccgggggagccaggaccagacatggcccaagaggcaccccaggaggacacctcacctatggctctaatggacaagggcgaaaacgaattgaccgggtctgcttctgaagaaagccaggagactaccaccagtacaatcatcactacaactgtgataacaactgagcaggctcccgctctgtgttccgtgtccttttccaatcctgaaggatacattgattcaagcgactacccgttgctgcctcttaataacttcttggagtgtacatacaacgttacagtctacactggttacggcgtagagcttcaggttaagagcgttaatctgagtgatggggagcttctgtccatccggggagtggacggacctaccctgaccgtgttagcaaaccagaccctgctcgtggaagggcaggtaatcagatctcccaccaacaccatctccgtttattttcgcacctttcaggatgacggactcggtaccttccagctgcactaccaggcctttatgttgtcttgcaactttccccggaggccagacagtggtgacgtgaccgtgatggatttgcactccggcggggttgcccactttcactgccaccttggctacgagctgcagggggccaaaatgcttacatgcattaacgcctctaaacctcattggtcctcccaggaaccgatctgctctgccccttgcgggggcgctgttcataatgctacgattggccgggtgctgtccccctcttatccagaaaacaccaatgggtctcagttctgtatttggactatcgaggcccctgaagggcaaaagctgcacctccattttgagcgtctgctgctgcacgacaaggatcgcatgaccgtccacagcgggcagactaacaagtctgctctgttgtacgactctctacagaccgagagtgtgccttttgaaggcctgctcagcgaggggaacactatccgaatcgagtttaccagtgaccaggcaagggccgcgagtacctttaatatcaggtttgaagcctttgagaaagggcactgttatgaaccgtacattcagaatggtaactttacgacatctgatcccacttataacattgggactattgtcgagtttacctgcgaccctgggcacagcttagagcaaggccccgccatcatcgagtgcatcaatgttcgggacccatactggaacgacactgagccattgtgcagagctatgtgcggaggggagctctcagccgtcgctggggtagtgctgagccccaactggccagagccatatgttgagggcgaagattgcatctggaagattcacgtaggggaggaaaaaagaatctttctggatatacagttcctgaatctatccaattctgatattttgaccatttatgatggagatgaagtgatgccgcatatccttggtcagtatcttggcaattctgggccacagaagctgtacagctctacacccgacctgaccatacagtttcacagcgatcccgccgggctcatcttcggtaagggccagggatttattatgaactatatcgaagtgagccgtaacgactcttgctctgatttgccagaaatccagaatggatggaaaacaacatcccacaccgaacttgtgcgtggagcacggattacctatcaatgtgacccaggatacgatatagtcggaagtgacactctaacttgccagtgggacctaagttggtcctcagatccaccattctgtgagaagatcatgtactgcaccgaccctggcgaggtagaccacagtactcgactcatcagtgaccctgttctactggtgggtacgaccattcagtacacttgtaatcctgggtttgtattggaaggatcaagcctcttgacttgttactcccgcgagaccggaactcccatctggacttcacgcctgccacactgtgtgttagctgaggccgcagcagaaacctccctggaggggggcaatatggccctcgccatttttattccagtgctgattattagcttactcttagggggcgcctatatctatataactaggtgtcgatattactcgaacctgcggctgccattaatgtacagccacccatattcccagatcaccgtcgagaccgaattcgacaaccccatctatgagacgggagagacaagagaatatgaggtatcaatatag

SEQ ID NO: 204439 - DNA, 2850 bp, Artificial Sequence
  Description of Artificial Sequence: Synthetic coding sequence
atgcccgccgcccggccccccgccgccggcctgcggggcatcagcctgtttcttgcgctacttttaggctctccagccgccgccttggagcgcgacgctctgcccgagggtgatgcgtcacctctggggccttatctgctgccttccggggcgcctgaacgcgggtctcctggaaaagagcacccagaagaaagagtcgtaaccgctcctccctcctcctctcagagtgccgaggtactgggtgagcttgttctggatggtactgcgcctagtgcccaccacgacattccggcattgagtccgctgctgcctgaagaggctcgacccaagcatgctctaccccccaagaagaagctgccttctcttaagcaggtcaatagcgctcgtaagcagcttcgccctaaggcgacatccgccgcaactgtacagcgggccggaagccagcctgcgtcacagggcttggatctcctaagctctagtactgaaaaaccaggcccccccggagatccagatcctattgttgcaagcgaggaagcaagcgaagtgccactgtggttggacaggaaagaaagcgccgtccccaccacacccgccccactgcaaatttcaccttttacctcacagccgtacgtggcccataccctgccacaaagacctgaacccggggaacccggaccagatatggctcaggaggcccctcaggaggatacatctccaatggctctgatggacaaaggggagaacgagcttaccggttcggcgagtgaggagtctcaagaaacaacgacctcaacaatcatcacaaccacagtcatcacaaccgaacaggcccctgccctgtgctcagtaagttttagcaatccagaaggctatattgactcttcagattatccactgctaccgctgaacaatttcctcgagtgtacgtacaacgtaacagtgtacacggggtacggcgtagagttgcaggtgaagtctgtgaacttatccgacggagagctcttaagcataaggggcgtggatggccccaccttgaccgtccttgcgaaccagaccctgctagtggaaggccaagttatacggagtcccacaaacactataagtgtgtatttcagaacattccaagacgatggattaggcaccttccaactgcattatcaagcctttatgctttcctgtaatttcccacggcggcccgattcgggcgatgtcaccgtcatggatctccacagtggcggagtcgcacattttcattgtcacctgggctacgaactccagggagccaaaatgcttacctgtattaacgcaagcaaaccccactggtccagtcaagagcctatttgttccgctccatgtggaggtgccgtccacaatgcaacaatcggcagggttctcagtccctcatacccagagaatacaaatggctcacagttctgtatctggacgatcgaggccccagaggggcagaaacttcacctacacttcgagcggcttctgctccatgataaggacaggatgaccgttcattccggacagactaacaagtccgccctgttgtacgacagcctccagacggagagcgtacccttcgagggcctgctgagtgaaggcaacaccataaggatcgaattcacaagtgatcaagctagggcagcttcaacgtttaatatacggttcgaagctttcgagaaggggcactgctatgaaccgtacattcagaacggaaatttcacaacgagtgaccccacctataatattggaacaattgtggagtttacttgtgaccctgggcattctttagagcaggggccagcgattatagaatgtatcaacgtgagggatccttactggaatgacacagagccactctgtagagctatgtgtggaggggagctgtccgcagtcgctggggtggtgctgagccctaactggcccgagccttatgtggagggcgaagattgtatatggaagattcatgttggcgaggagaagcgcatttttctggatatacagtttttgaatctgtccaattcggatatactgaccatctacgatggcgatgaggtaatgccccacattctcgggcagtacttaggcaactcagggccccagaaactctacagctcaactccggatctgacaattcagtttcactcagatcccgccggactgatttttgggaagggccaaggctttatcatgaactatattgaagtttctcggaatgactcctgttctgatctgcccgaaatccagaacggatggaaaaccacaagccacacagagctggtgagaggcgccaggatcacctaccagtgcgatccaggctatgatatcgtgggctctgacacattaacatgccagtgggatctgagttggtcaagtgaccctccattttgcgagaagaccgaggagtcgctggcatgcgacaaccccggcttgcccgaaaacggttaccaaatcttgtataaacgactttacctccccggagaaagcttgaccttcatgtgttacgagggatttgaactgatgggagaggtgactattcgttgcattctcggacagccttcgcattggaatggtcccctgcctgtctgcaaagtagctgaagcagccgcagagactagtttggagggggggaacatggcgttggcaattttcatcccagtgctgataatttccctactgctgggcggagcatacatctatatcacacgatgccgatattactctaacctcaggctcccactcatgtactcgcacccatacagtcagatcaccgtcgaaacggagtttgataatccaatatatgagacgggcgaaacacgggagtatgaggtgtccatctag

SEQ ID NO: 204440 - DNA, 420 bp, Artificial Sequence
  Description of Artificial Sequence: Synthetic coding sequence
atgtactgcaccgaccccggcgaggtggaccacagcacccggctgatctcagacccagtgctcctggtagggacaacgatccaatatacctgtaatcccggatttgtgcttgaaggttccagcctgcttacatgttacagccgggaaacgggcaccccgatttggacttcacgcctaccccactgtgtgtcagaggagtctctggcctgtgataaccctggcctcccagagaatggctatcagatcctttacaagcgactatacttacctggagaatccctcaccttcatgtgttatgaggggtttgaactgatgggcgaggtcacaatccgatgcatactcggccagccgtcccactggaacggaccattacctgtctgtaaagacgtcgccactatcccgacaagtgcctgcctctag

SEQ ID NO: 204441 - DNA, 3042 bp, Artificial Sequence
  Description of Artificial Sequence: Synthetic coding sequence
atgcccgccgcccggccccccgccgccggcctgcggggcatcagccttttcttggccttgctgctgggatcccctgctgcagctctcgaacgcgacgctctgcctgagggagatgcgagcccattaggcccttacctgttgcctagcggggctccagagagggggtcacccggcaaggagcacccagaggagcgtgtcgtgaccgcacctccatcaagcagtcagagcgcagaagtgctgggcgaactggtcttagatggtacagctccatctgcccatcatgacattcccgctctgagcccactgttaccagaggaggcccggcctaaacacgcacttccccccaagaagaagcttccatccttgaagcaggtcaacagcgcacgaaagcagctgcgacctaaggctacttccgccgccacagtacagcgcgccggctcacagccagcaagccaggggctggacctgctcagttctagcaccgagaagccaggacctcccggcgatcctgatcccatcgtggcgagcgaggaggcgtcagaggttccactgtggctggaccgcaaagaaagtgccgtccctacaacaccagccccactgcagataagcccattcaccagtcaaccatatgtggcgcacacactgcctcagaggccagaaccgggagagccaggacctgacatggcacaagaagccccccaggaggatacctcaccaatggcgctcatggataagggggaaaatgaactgacaggcagtgcatccgaggaatcccaggaaactaccaccagcacaatcataacaactacagtgataacgaccgagcaggcgccggcgctatgctccgtgtccttctctaaccccgagggttacattgattcttctgactacccccttctgcccctgaacaactttctggagtgtacctataacgttactgtatataccggttatggcgtggaactacaagtcaaaagcgttaacctctccgacggcgaactcctgagcattcggggagtggacggacctacacttaccgtcctcgcaaaccagacattattggtcgagggacaggtcattcgatctcctacaaacactatctccgtgtattttcgaacctttcaggacgatggtttaggcactttccagctgcactaccaggcatttatgctttcgtgcaatttcccaaggagacctgattcaggagatgttactgtaatggatctacactcaggcggcgtggcccattttcattgtcatctgggatacgaattacaaggagccaagatgctcacctgcattaacgcctctaagccccattggtctagccaagagccaatctgctcagccccttgtggcggcgctgttcacaatgctacaatcggtagagttctctccccctcttaccccgaaaacacaaacgggtcccagttttgtatctggaccattgaagcaccagagggacagaaactgcacctgcacttcgaacggttgttgctacacgacaaggatcgcatgaccgtgcactccggccagacaaataagagtgccctgttgtatgattcactgcagactgagtccgttccattcgaagggctgctgagcgagggtaacacaattagaatcgaattcacctcagatcaagcgagggccgcatctacttttaacattcgatttgaggccttcgagaagggtcactgttacgaaccgtacatccaaaacggcaactttaccaccagtgaccctacctacaatattggcactatcgtggagttcacatgtgatccgggccattccttggaacagggtcccgcaatcatcgaatgtatcaacgtgcgggatccttattggaacgacacggaacccctgtgtagagccatgtgcggaggggagctatcagccgtcgctggtgtggtactatcaccaaactggcccgaaccttacgtggaaggggaagactgcatctggaaaatacatgttggcgaggagaagcggattttcctggatatccagtttctgaatctctctaactccgatatattgacaatctacgatggagatgaggtgatgccacacatcctggggcagtacctgggcaactccggccctcagaaactgtacagtagtactccggatttgactatccagttccactcggatccggccggcctcatatttgggaagggccagggcttcataatgaattatatcgaagttagtaggaatgattcctgcagtgacttgcccgagattcagaacgggtggaagacgacctcccatacagaactggtcagaggggcccgaatcacctaccagtgcgaccctgggtacgatattgtcggctctgacactttgacgtgccaatgggatctgtcctggagttcggacccaccgttttgcgaaaaaataatgtattgtacagaccccggagaggtggaccattcgacccgattgatttctgatccagtgctcctggtcgggacgaccatccagtatacatgtaaccctggcttcgtgctggagggctcttcattgctcacatgttactcaagggaaactggaacccccatctggacatctagactgccccattgtgtgtctgaggagtcacttgcctgtgacaatcctgggctgccggagaatggctaccagatattgtataaacggttgtaccttcctggagagagcctgacattcatgtgttatgagggctttgagttgatgggcgaagtgaccatcagatgtattcttgggcagccatcccactggaacggcccattgcccgtgtgcaaagtcgcagaggctgccgccgaaactagcttagaaggcggcaacatggccttggccatttttatccccgttttgatcatctccctgctcttggggggggcctatatatatatcactaggtgccgctactacagcaatttaagacttcctctgatgtatagccacccttactcacagattaccgtggagaccgaatttgacaatccaatctacgagactggtgagacaagagagtatgaggtgagtatatag

SEQ ID NO: 204442 - DNA, 3072 bp, Artificial Sequence
  Description of Artificial Sequence: Synthetic coding sequence
atgcccgccgcccggccccccgccgccggcctgcggggcatcagcttgttccttgccctgctgctggggtctcctgccgcagcactcgaaagggatgcacttccggagggagacgcttctcctctgggaccttacttgctgccgtcgggtgccccggagaggggcagccccggaaaagaacatccggaagagagggtagttaccgctccaccgagtagtagtcaatctgcagaagtactgggtgagttggtactggacggtacagctccttctgcgcatcacgacataccggccctcagtcctttactgccggaggaggcccggccaaagcacgcactgccaccaaaaaagaagcttcccagcctgaaacaggtcaatagcgcgaggaagcagctacgtcctaaagctactagtgcagcaacagtccagagggccggaagccagcccgccagccaaggtctggaccttctctcaagtagcaccgaaaagcccggaccccctggcgatccagaccccattgttgcatctgaggaggcttccgaggttcctctgtggttagacagaaaggagagtgccgtgcccactactcctgccccccttcaaatctcccctttcaccagccagccctatgtggcccacactttacctcagcgacccgaaccgggcgagcctgggcctgatatggcccaagaggctccccaggaagacacctcccctatggcgctaatggacaaaggtgaaaacgaactgacgggctctgcatcggaagagagccaggaaacaacaacttccacaatcatcaccacgaccgtgattacaactgaacaggctcctgctctctgttctgtgtcattctcaaatcccgaaggctacattgactccagcgactatcccctgttgccacttaacaatttcctggaatgtacctacaacgtgactgtttatactggctacggcgtcgagctgcaggtgaaatccgtgaacctctcagacggggagctcttaagcatcagaggcgtcgatggccctacactgacagtgctcgccaatcagactcttctcgtcgaaggccaagtgattcggagtcccacaaataccatcagtgtctatttcaggacatttcaggacgacgggctcggaacatttcaattacactaccaggcgttcatgttgtcttgtaactttccaagaagacccgactccggcgacgtgaccgtgatggatcttcactcaggaggagtggcgcactttcattgtcacctgggatatgaactgcagggcgcaaagatgctcacgtgtatcaatgctagcaagccgcactggagctctcaggagccaatctgctctgccccttgtggaggagctgtccacaatgccactataggtcgagtgctctcaccatcttatcctgaaaataccaacggcagccaattctgtatctggacaatagaagccccagagggccagaaactccacttgcactttgagaggctattactccacgataaagacaggatgaccgtgcacagtggtcagacaaataaaagcgcgctgctgtacgattctcttcagacagagagcgtcccttttgaagggttgttgtcagaaggcaacactatcagaatagaattcacttctgaccaggcccgcgcagcaagcacttttaacataagatttgaggcgttcgagaagggacattgctacgagccatatattcaaaatgggaactttaccacatcggatcctacatataacattggtaccatcgttgaatttacctgtgaccccggccactccttagagcagggtccagctataatcgagtgtattaatgtgagggacccatattggaatgatactgaacctctgtgtcgggcgatgtgcgggggcgaactgagcgccgtcgccggagtcgtgctatctccgaactggcccgagccatatgtggaaggcgaagattgcatctggaaaattcatgttggcgaagagaaacgcatatttctggacatccagttcttgaatctgtccaactctgacattctgactatctacgacggagatgaagttatgcctcatatcttaggccagtaccttgggaactcaggtccacagaaactatattccagtactcccgatcttactattcaattccactccgatccagccggtctcatttttggcaagggacagggatttatcatgaattatatcgaggtctccagaaacgacagctgttccgatttacccgaaatacagaatggctggaaaacgacctcacacaccgagcttgtgcgtggggcacgaataacatatcagtgcgaccctgggtacgacatagtaggctccgatacattaacatgtcagtgggatctgtcctggagcagcgacccccccttctgtgaaaaaattatgtactgtacggatccgggtgaagttgaccactccactcgtttaatctccgatcccgtccttctggtaggaactaccattcagtatacatgcaatccaggttttgtgcttgaagggtccagcctcctaacttgctactcacgcgagactggcaccccaatctggacctcccgtctcccccactgtgtctccgaggagtctttggcctgcgacaaccctggcctaccagaaaatgggtatcagattctctacaagcgcctttacctccccggagagtccctcaccttcatgtgttatgagggtttcgaacttatgggcgaggttaccatccgctgtatcctaggtcagccctcccattggaacggcccgttaccagtttgtaaggttaaccaggatagcttcgagcacgcccttgaagcggaggcagcggccgaaacatcactggaaggaggaaacatggcattagctatttttattccggttcttatcatctccttgctgttggggggtgcgtacatctatatcaccaggtgtcggtactacagcaatctgaggttgcctctgatgtactctcatccatactctcagattactgtggaaaccgagtttgacaatcccatctatgaaactggcgagaccagagagtacgaggtctccatttag

SEQ ID NO: 204443 - DNA, 258 bp, Artificial Sequence
  Description of Artificial Sequence: Synthetic coding sequence
ggcttcggcaccgacgtggactacgagaccgccttcatccactaccggctggcatccgaacagcagcattccgcccaagctatgttcaacctgggttacatgcacgaaaagggactgggtatcaaacaagatattcacctggccaagcgcttttatgacatggccgcttcacaaccaagatgcacaagcagctccctcccttcccctcttcagataggcaggcgattgttcctcgccgtgcatactggaaataagtag

SEQ ID NO: 204444 - DNA, 2385 bp, Artificial Sequence
  Description of Artificial Sequence: Synthetic coding sequence
atgcgggtgcggatcggcctgaccctgctgctgtgcgccgtgctgcttagcctagcctccgcctcgtcagacgaggagggcagtcaggacgagtccctggatagcaaaaccaccctgaccagtgatgagtcagtcaaagatcatactacagccggcagagtggtggccggccagatcttcctcgattcggaggaatccgaacttgaatcctccattcaggaggaagaagatagtctgaagagtcaggaaggagagtccgtgacagaagatatttcattcctggagagccccaatccggaaaacaaagactacgaggaacccaagaaggtccggaaacccgcccttaccgctatcgaaggcacagcgcacggggagccgtgtcacttcccctttttattcctggataaagagtatgatgaatgcacatccgatggccgcgaggacgggaggctgtggtgtgcgacaacctacgactataaggccgacgagaagtggggcttttgtgagaccgaggaggaggcagccaaacgccggcagatgcaagaggctgaaatgatgtaccaaactggtatgaagatccttaacggcagcaacaagaaaagtcagaaaagggaagcttacaggtacttgcagaaggctgccagtatgaatcataccaaagcattagagcgcgtgtcttatgccctgcttttcggggactacttgcctcagaacatccaggccgcacgggaaatgtttgaaaagctcacagaggaggggtcaccaaaggggcagactgcactggggttcttatacgcttctgggctaggcgttaactcatctcaagccaaagccctggtgtactatacctttggcgcactggggggtaatctgatcgcccacatggtgctggggtaccgatattgggccgggatcggggttttgcaatcctgtgaatccgcattgacacactaccgtttggtggccaatcacgtggcctccgatatcagtttgacaggtgggagcgtcgtccagcgcatcagactgcctgatgaagtggagaatccaggaatgaactcaggcatgctggaggaggatctgattcagtactatcagtttctggcggaaaagggtgacgtccaggcacaagtaggcctcgggcagttgcaccttcatggaggccgcggagttgagcagaatcaccagcgggcgttcgactactttaatctggctgctaacgctggaaatagccatgcaatggcctttctcgggaaaatgtacagtgaaggctctgacatcgtgccccaatccaatgagaccgcgctgcattatttcaagaaggcggctgatatgggtaaccccgtcggacagtccggactcggaatggcttatctctacggccgcggagtgcaggttaattacgatctggccctgaagtactttcaaaaggctgccgaacagggttgggtggacggccaattacagcttggaagcatgtactataatggcattggcgtgaaacgcgactataagcaggcattgaagtactttaatttggcctcccaaggtgggcatatcctagcattctataacttggctcagatgcacgcctctggcaccggagtgatgcgtagttgtcacacagccgttgagctcttcaagaacgtgtgcgagaggggaagatggtctgaacggctgatgacagcttacaactcatataaagatggtgattacaatgccgcggtgattcagtatcttctgcttgccgagcaagggtatgaggttgctcagagcaacgcggcatttatacttgatcaacgagaagcaagtattgtgggcgagaacgaaacttatccaagagccttgctgcactggaacagggcggcatcccagggctatacggtggccaggattaaattgggggactatcatttttatggcttcggaacagatgtggactacgagaccgccttcatccactataggctggcctcggagcaacaacactctgcccaagccatgtttaacctggggtacatgcacgagaaagggttgggcataaagcaggacatacatctggccaagcggttctacgatatggctgccgaggcctctcccgatgcacaagtgccggtgtttctcgccctgtgtaagttaggcgtggtatacttccttcagtatatccgcgagaccaacatccgcgatatgtttacccagctagacatggaccagctgcttgggccggagtgggatctttatcttatgacaatcatcgcgctactgttaggtactgtgatcgcttatcgacagcgccaacaccaggatatgcccgccccaaggccccccggcccgcgaccagccccacctcaacaggaagggccacctgaacagcagccaccacagtag

SEQ ID NO: 204445 - DNA, 906 bp, Artificial Sequence
  Description of Artificial Sequence: Synthetic coding sequence
atgcgggtgcggatcggcctgaccctgctgctgtgcgccgtgctgctgtcactggcgtccgccagtagcgatgaggaaggaagtcaggacgaatcccttgacagcaagaccacactcactagcgacgaatctgttaaggatcacaccacagcgggaagggtggtggcaggacaaatttttctggattccgaagaaagtgaattggagagcagtatccaagaagaggaggacagtttgaaatctcaagaaggcgagtcagttactgaagatattagcttccttgaaagtccaaacccggagaacaaggattacgaggagcccaagaaggtccggaagcctgccctcactgctatcgagggcactgcccacggtgaaccgtgtcattttccatttctgtttctggacaaagagtatgacgagtgtaccagcgacggcagagaggatggccgtctgtggtgcgcaaccacctatgattataaagccgatgagaagtggggcttctgcgagactgaggaggaagccgcaaaacggcgacagatgcaggaagcagagatgatgtaccagacgggtatgaaaatcctcaacgggtccaataagaagagccagaaaagggaagcttacaggtatctccaaaaagctgcttcaatgaatcacaccaaagctctggagcgagtatcttacgctctgctcttcggggactatttgccacagaatattcaagccgctcgcgagatgtttgagaagctaaccgaggaggggtcacctaagggtcagacagcactcggtttcttgtacgcgtctgggttgggcgttaactcttcacaagccaaggctctggtctattacacattcggtgctctgggtggtaacctgattgcccacatggttctggtgtcccgcctttag

SEQ ID NO: 204446 - DNA, 2067 bp, Artificial Sequence
  Description of Artificial Sequence: Synthetic coding sequence
atgaagcccctgagcctgctgatcgagatcctgatcatcctgggcgtgactataaagaccataaaagccgaagagcacaataagcgccaaaaagaaagaaacgtgaccacgcaagtttctgtgaacgagataaagcagtacctgtcgcatatcctggaacagaggacctcatcaaacgtgattaataagcgggaaaacctgctggagaagaaaaaaaatcagcggaaaattcggataaagggcattcagaataaagacatcctgaagcgcaacaaaaaccatctgcaaaaacaggccgagaagaactttaccgacgaaggggaccagttatttaagatggggattaaagtgctgcaacagagtaagtctcagaagcagaaggaggaagcttacctcctcttcgccaaagcagcggacatgggaaacctgaaggccatggagaagatggctgacgccctgctctttggcaatttcggcgtgcagaacatcacggctgccatacagctgtatgagagcctcgccaaagagggctcttgcaaggcccagaatgctctcggattccttagctcgtacgggattggcatggagtacgatcaggctaaggccctaatatactacacatttggcagcgcggggggcaatatgatgagccagatgattctgggctaccggtacctttccggaataaatgtgctccaaaattgtgaggtggcactctcctactataaaaaggtggcggactatattgcagatacctttgagaagtccgagggagtcccagtcgagaaggttagactcactgagagacccgaaaatctgtcaagtaatagcgaaattctagactgggatatctatcagtattacaagtttcttgccgagcgaggagatgtgcaaatacaggtcagccttggccaattacatctgatagggcggaagggccttgaccaagactattataaagccttgcattatttcctgaaagccgcaaaggccgggagtgcaaacgccatggctttcatcgggaaaatgtacctcgagggcaatgccgctgttccacagaacaatgctaccgcattcaaatacttctctatggcagcatccaagggtaatgcgattggtctgcatggattgggattgttgtacttccacgggaagggtgttcctctgaattacgccgaagcactgaagtattttcaaaaagcggctgaaaaaggctggccagatgcccagttccagcttggatttatgtattattccggctcaggcatctggaaagactataagctcgccttcaagtacttctacctggccagccaatccggacagcccctggcaatctactatttggccaaaatgtacgccaccggaactggagtcgtcaggagttgccgcactgctgtggaattgtacaagggcgtttgcgaacttggccactgggcagagaagtttctgacagcttatttcgcatacaaggatggtgatatcgactcaagcttagtgcagtacgcactactggcggagatggggtacgaggtggcccagagcaatagcgcattcatcctggaaagcaaaaaggctaacatcctggagaaagaaaagatgtacccaatggccctactgctgtggaatcgtgccgccatacaaggcaacgcctttgctcgagtcaagatcggggactaccattactacgggtatggcaccaagaaggattatcagaccgctgccacgcactattccatagccgccaacaaataccacaacgcacaggccatgttcaatttagcgtacatgtacgagcacggccttggaatcacaaaagacatccacctggctaggcggctctatgacatggctgcccagacgtctcctgacgcgcatataccagtgctcttcgcagtaatgaagcttgagaccacccatctgctgagggatatactctttttcaactttactacacgctggaactggctgaagctggacaatactattgggccccactgggaccttttcgttattgggctgattgtccccggcctgattttactgctccggaaccaccacggctag

SEQ ID NO: 204447 - DNA, 1728 bp, Artificial Sequence
  Description of Artificial Sequence: Synthetic coding sequence
atgaagcccctgagcctgctgatcgagatcctgatcatcctgggcgtaacgattaagaccatcaaagctgaggagcataacaaacggcagaaagaaaggaacgtcacgacacaagtttctgtaaatgaaattaaacaatacctctctcacattctcgaacagagaacctcgtcgaacgtaatcaataaacgagaaaacctgctggaaaagaagaaaaaccaaagaaagattcggatcaagggaattcagaacaaagacatcttaaaacgaaacaagaaccacctgcagaaacaagcggagaagaatttcacagatgaaggggatcaactgtttaaaatgggcataaaggtccttcaacagagcaaaagccagaaacaaaaagaggaggcttacctgctgttcgcaaaagcagcggacatggggaaccttaaagccatggagaagatggctgacgcacttctgtttggcaacttcggagtccaaaatatcaccgcagccatccagctttacgaaagcttagcaaaagaaggaagctgcaaggcccagaatgctctggggtttctgagttcatacggcattggcatggaatacgaccaggctaaagccctgatctactacactttcggcagcgccggcggcaacatgatgtcccagatgattctggggtatcggtatttatcaggaatcaacgttcttcaaaactgtgaagtggccttgtcttactataaaaaggtagctgattatatcgccgataccttcgagaagtcagagggagtccctgtcgagaaagtgcgcctgacagagagacccgaaaatttaagcagcaactccgagattttagactgggacatctaccagtattacaaattcctggccgaacgcggtgacgtccagatccaggtctcgcttggtcagctgcacctcattggccggaaggggctcgatcaggattactacaaagccctacattattttctgaaggcagccaaagccggttcggccaatgccatggctttcatcggtaagatgtacctggagggtaacgccgctgtgccccaaaataacgccaccgccttcaagtattttagtatggcagctagcaaggggaacgcaattggcctccacgggcttggcctgctctacttccacggcaaaggcgtcccccttaactatgctgaggctctgaagtactttcagaaggctgccgagaaaggatggccagacgcacagttccagcttggtttcatgtattattccgggtctggtatctggaaggattataagctcgcctttaagtacttctatctggcaagccagtccggccagcccctcgcaatctattatttggctaagatgtatgcaacagggacaggagtcgtcaggagctgtcgcaccgctgtggaaaaaaggctgaccttcctgaagaaaagacgatgtattcagtggcgtttttcctacggcatcgaactgccattcaaggacatccacctggctagacgtctctacgacatggctgctcagacctctccagatgcacatataccagtcctgttcgccgtaatgaagctagaaacaacccacctccttcgagacattctcttttttaatttcaccacgagatggaactggttgaagctcgataacaccattggacctcactgggacctgttcgtgattgggttaatcgtacctggcctgatcctgctacttcgtaatcaccacggatag

SEQ ID NO: 204448 - DNA, 1833 bp, Artificial Sequence
  Description of Artificial Sequence: Synthetic coding sequence
atgatcgccagccagttcctgagcgccctgaccctggtgctgctgatcaaggaatcgggtgcatggagttacaatacctcgactgaagccatgacgtatgatgaggcatcagcatattgccaacagcgatacacacacctcgttgcaatccagaacaaggaagagattgagtatctgaattctattctgagttactcccccagctattactggatcggcattcggaaagtcaacaacgtgtgggtgtgggtaggcacccagaaacccctgactgaggaagcaaaaaattgggccccaggagaaccaaacaaccggcaaaaagacgaagattgcgttgaaatctacatcaaacgggagaaggacgtgggcatgtggaacgacgaaaggtgctccaagaaaaagctggctctgtgctacactgccgcgtgtaccaatactagttgttctggccatggggagtgcgtggagactataaacaattacacttgtaagtgtgatcccggcttttccgggcttaaatgtgagcagattgtgaattgcaccgccctggagtcgcccgagcatggctcccttgtttgctctcacccattaggcaatttctcttacaactctagttgcagcattagctgcgaccgtggctacttgccaagctccatggaaactatgcagtgtatgagctctggagagtggtcggcccctattccagcgtgtaacgtggtggagtgtgacgccgtgaccaaccctgcaaatgggtttgtcgagtgctttcagaatccaggtagcttcccttggaacactacctgcacatttgattgtgaggaaggtttcgaactcatgggggcccaaagtctccagtgcacaagctcagggaactgggacaatgagaaaccaacctgcaaggctgtcacttgcagggcagtgagacagccacaaaacggcagcgtgaggtgtagccatagtcctgcgggcgaatttactttcaaaagttcatgcaactttacctgtgaggaggggtttatgttacaggggcccgcccaggtcgagtgtaccactcaaggacagtggacccagcaaatccccgtttgtgaagcttttcaatgcactgcgttatcgaaccccgagcgggggtacatgaattgtctcccttctgctagcggcagcttcagatacgggtccagctgcgagttctcctgcgagcaggggttcgtcctcaaggggtccaagcgactccaatgtggacctacaggcgaatgggataacgaaaaaccaacttgtgaggcggtgaggtgcgacgccgtacaccagccccccaaggggctagtgaggtgcgcccattctcctattggggagtttacatacaagtccagttgtgctttctcttgtgaggaggggtttgaactgcacgggagtactcagctggagtgcaccagccagggccagtggactgaggaagtgccatcatgtcaagtcgtgaagtgctcctcattggcagttccaggaaagatcaacatgagctgcagtggagagccagtgtttggaacagtgtgtaaatttgcttgtcccgaaggttggacattgaatgggtccgccgctcgaacatgtggagctacagggcactggtcaggccttctgcccacttgcgaggcgcccacagagtctaatattccacttgtagccggcctgtcagcggccggactctctctgctgactctcgcaccttttcttctgtggctacggaaatgcctcagaaaagcgaagaaattcgtgccagccagctcctgccaatctttggagagcgacgggagctaccagaagccctcttacattctttag

SEQ ID NO: 204449 - DNA, 1455 bp, Artificial Sequence
  Description of Artificial Sequence: Synthetic coding sequence
atgatcgccagccagttcctgagcgccctgaccctggtgctgctgataaaagagtccggggcctggtcatataatacatcaaccgaggctatgacatatgacgaggcctcagcctattgccagcagaggtacactcacttagtcgccatccagaacaaggaggaaattgaatatctcaattctatcttgagctacagcccgtcttactattggattggcatcaggaaagtaaataatgtgtgggtgtgggtcggtacccagaagcccctgaccgaagaagctaaaaactgggccccaggggagcctaacaaccgccagaaagatgaggattgtgttgagatctacatcaaaagggaaaaggatgttggtatgtggaatgacgaaaggtgctcaaagaaaaagctggctctttgctacaccgctgcttgcactaatacaagctgttctggccacggagaatgcgtggagaccatcaataattacacttgtaagtgcgaccccgggtttagtggtctgaaatgcgaacaaatcgtcaactgtaccgccctcgaatccccagaacatggctcactcgtgtgcagccatcctcttggaaacttcagctacaattcttcctgctctatatcttgtgacaggggatacctgcccagcagtatggagactatgcagtgcatgtcatccggggagtggtcggcgcccatccccgcttgcaacgtggtggagtgcgatgctgttactaatccggccaatggctttgtggaatgcttccagaaccccggttcattcccatggaatactacatgtacctttgactgcgaggagggtttcgaactcatgggtgctcagagcttgcagtgcacatcgtccgggaactgggacaacgaaaaaccaacatgcaaggctgtaacctgccgggccgttaggcagccccagaatggatcagtgcggtgctcccacagccctgcaggcgaatttacgtttaaatccagctgcaattttacctgcgaagaggggttcatgttgcaagggcccgcacaggttgagtgtacaacgcaggggcagtggacccagcagataccagtttgcgaagtagtcaagtgttccagcttagcagttccgggcaaaattaacatgtcttgctcaggggaacccgtgttcggcacagtttgtaagtttgcttgcccagagggctggaccctcaatgggagtgcggcccgcacctgtggcgctacgggccactggtcgggcctgctgcccacctgtgaagcccctaccgaaagtaacatccccctggtggccgggctgtctgcagccggactgagtttgcttacgctggcaccctttctgctctggctccgcaagtgcctgaggaaagccaagaaatttgtacctgcctcatcctgccagagcttagagagtgatgggtcctaccagaaaccttcctatattctgtag

SEQ ID NO: 204450 - DNA, 1458 bp, Artificial Sequence
  Description of Artificial Sequence: Synthetic coding sequence
atgatcgccagccagttcctgagcgccctgaccctggtgctgctgataaaggaaagtggagcgtggagttacaacacttctactgaggccatgacctacgacgaagcttctgcgtattgccagcaacgctacacacacctcgtcgcgatccagaacaaggaggaaattgagtatctgaatagcattctctcgtacagtccatcttattactggattgggatcaggaaggtgaataacgtctgggtttgggtaggaacccagaagcccctgacagaggaggctaagaactgggcccccggtgaacctaataaccgccagaaggacgaagactgtgtggagatatatatcaaaagagaaaaagacgtggggatgtggaacgatgagcgctgttcgaaaaagaagctggctttatgttacactgctgcttgcaccaacacctcgtgttccggccacggggaatgtgtggagaccattaataactacacgtgtaaatgcgaccctggtttctccggcctcaaatgtgagcaaatggtggagtgcgacgccgtgactaacccagccaacggcttcgtggagtgttttcaaaaccccgggtctttcccttggaatacaacttgcacttttgattgcgaggaagggtttgagctgatgggcgcacaaagcctgcagtgcacctcatctggtaactgggacaacgaaaaacccacctgcaaggcagttacctgtcgggccgtgcgacaaccccaaaatggcagtgtacggtgttcacattctcccgccggcgagttcactttcaagtcctcgtgtaactttacttgcgaggagggctttatgctgcaaggacccgcccaagtggagtgtaccacgcagggacagtggacccaacagatacctgtatgcgaggccgtacgttgcgatgctgtacaccagccacctaaaggtctagtgcggtgcgcccattccccaatcggcgagttcacttacaaatcatcttgtgcctttagctgcgaggaagggttcgagcttcacggctccactcagttggagtgtacgtcacagggacagtggaccgaggaggtcccatcctgccaagttgtgaaatgttcttccctggccgtgcctggaaagatcaacatgtcctgctctggggagccagtgtttggcactgtctgcaaattcgcttgccccgaggggtggacattaaacggcagcgcggccagaacatgcggggccacgggccactggtctggattgttgcctacatgtgaggcccccaccgagtcaaacatccccctagtggctggactctccgcagccgggctgtctctgcttacactggccccttttctactctggcttcgaaagtgtctgcggaaggctaagaagtttgtgccagcctccagttgccaaagtctggagtccgatgggtcctatcagaagccttcttatatcctatag

SEQ ID NO: 204451 - DNA, 1644 bp, Artificial Sequence
  Description of Artificial Sequence: Synthetic coding sequence
atgatcgccagccagttcctgagcgccctgaccctggtgctgctgatcaaggaatccggtgcgtggtcctacaacaccagcactgaggccatgacgtacgacgaagccagcgcgtattgccagcagcgatacacccacctggtagccattcaaaacaaggaggaaatcgaatatttaaacagtatcctatcttattcaccaagttactattggattggtattcgcaaagttaataacgtgtgggtatgggtagggacacaaaagccactgaccgaagaggctaagaactgggcacctggggagccgaataaccggcagaaagacgaggattgtgtggagatctatattaagagagagaaagacgttggcatgtggaatgacgagaggtgttcgaaaaagaaactggcattgtgttacactgccgcatgcactaacacaagctgcagtggtcacggcgaatgcgtagaaacgattaataactacacctgtaaatgcgatcccggcttctcaggattgaaatgcgaacagatcgtaaattgcacagccttggaaagtcctgaacatggctctctagtttgctcccatccgctgggcaacttctcatacaactcaagctgttcaatcagttgtgacagaggctacttgcctagtagtatggaaactatgcagtgcatgagctcaggggagtggtctgcacccatcccggcgtgcaacgtggtcgagtgcgacgcggtgaccaaccccgctaacggattcgtcgagtgtttccagaatcccggtagctttccttggaacacgacttgcacctttgattgcgaggaaggctttgaattaatgggtgctcaatccttgcaatgtacaagctctggcaactgggataatgagaagcctacctgtaaagcggtaacatgccgggccgttaggcagccacagaatggctccgtgcggtgctctcacagcccagccggtgagtttaccttcaagtcgagttgcaacttcacttgtgaggagggcttcatgctccaaggacctgcacaggtagaatgcaccacccaaggacagtggacgcagcagattccagtgtgtgaggccgtcagatgcgacgcagtgcatcagccaccgaaggggctcgttcggtgtgctcatagcccaatcggtgagtttacttataagtcttcctgtgcgttctcctgtgaggaaggcttcgaactgcatgggtcgacccagctcgaatgtacgtcccagggccagtggactgaagaagtgccatcatgccaagttgtcaaatgttcctcactggcagttccaggaaaaatcaacatgtcatgctcaggagagcccgtgtttggtactgtttgcaagttcgcttgtccagagggctggacacttaatggtagcgctgccaggacctgtggagctacagggcactggtccgggttactgcctacttgcgaagcacccaccgagagcaacatacccctggtggcaggtctcagcgctgctgggctgagccttttaaccctcgcgcccttcctcctgtggctacggaaatgcctgcggaaggcaaagaagtttgttcccgcaagctcctgccaaagccttgagagcgatgggagttatcaaaagccttcttacattctgtag

SEQ ID NO: 204452 - DNA, 1644 bp, Artificial Sequence
  Description of Artificial Sequence: Synthetic coding sequence
atgatcgccagccagttcctgagcgccctgaccctggtgctgctgatcaaggaatccggagcctggtcctataatacaagtacagaagccatgacttatgacgaggcctccgcctattgccaacagcggtacacacatctggtggccatccaaaacaaggaggagatcgaatatttgaacagcatcctgagctactccccatcttattattggataggtatcagaaaggtgaataacgtgtgggtgtgggtcggcacccagaaaccattgacagaagaggccaaaaattgggctcctggagagccgaataatcgacagaaggatgaggattgcgtggaaatttacatcaaaagagagaaggacgtaggcatgtggaacgacgagcggtgttcgaagaaaaaactggctctctgctacaccgccgcctgcaccaacacgagttgctcaggacatggggaatgcgtggagacaattaacaactatacctgcaagtgtgacccaggcttctctggtctcaaatgtgagcaaatagtcaactgtacagcgcttgagagtcccgagcatggctcactggtctgttcccacccactgggtaacttcagttacaactcaagttgctccatctcctgtgaccgcggctacctgccgtcaagcatggagaccatgcaatgcatgagcagcggggaatggtctgctccaatccctgcctgtaacgtggtagagtgtgatgccgtgacgaatccggctaatggatttgttgagtgcttccagaaccctggtagcttcccttggaacactacctgtaccttcgactgtgaagaggggtttgaactcatgggcgcccaaagcttgcagtgcaccagtagcggcaactgggacaacgaaaagccgacctgtaaagccgtcacatgtcgagccgtaaggcagcctcaaaacggtagtgtcagatgtagccactcacccgccggagaattcacctttaagtccagctgcaattttacctgcgaagagggatttatgctgcaggggcctgcacaggtggaatgtactacccagggtcagtggacgcaacagatccccgtgtgcgaggcttttcaatgtacagcactctctaaccctgagcgggggtatatgaattgcctgccatctgcgtccgggagttttcggtacggcagcagttgcgaattttcttgcgaacaagggttcgtgttgaaggggtctaagagattacagtgtggacccacaggcgaatgggataatgagaaaccaacatgcgaagtcgttaagtgttcctctttggctgtaccaggcaagatcaacatgtcatgctcaggtgagccagtttttggaaccgtgtgtaaattcgcgtgtcctgaggggtggacccttaacggcagtgcagcccggacctgcggagcgaccggccactggagtgggctccttcctacctgtgaggcccccaccgaaagcaatatacctcttgttgcagggctcagcgcagccggcctgagcctacttaccctggcccctttcctgctgtggctacgcaagtgcctgagaaaggccaagaaattcgttcccgcgtcatcttgtcaatcactggagtcggatggttcatatcagaagccatcgtacatactctag

SEQ ID NO: 204453 - DNA, 1455 bp, Artificial Sequence
  Description of Artificial Sequence: Synthetic coding sequence
atgatcgccagccagttcctgagcgccctgaccctggtgctgctgattaaggagtccggcgcctggtcctacaacactagcacagaagctatgacctatgacgaagcctccgcttactgtcagcagagatatacacacctggttgccattcaaaacaaagaagagatagagtacctgaacagcattctcagctactctccaagctattactggattggtatccggaaggtgaacaacgtctgggtctgggtcgggacacagaagcccctgacggaggaggccaagaactgggcccccggagagcctaataacaggcagaaggatgaagattgcgtcgagatctacatcaaacgcgagaaagacgtgggaatgtggaacgatgagcggtgctcaaaaaagaagcttgcattgtgctacacagcggcatgtacaaatacatcatgcagtggacacggggagtgcgtcgagaccatcaataactacacatgtaagtgtgaccccggcttttccggactcaaatgcgaacagatagttaattgtactgcccttgaatcacctgagcatgggagcttagtgtgcagccatccactcggaaatttcagttataattcatcttgcagcatctcatgtgatcgtggttaccttccatcgagcatggagactatgcagtgcatgagcagcggcgaatggagcgccccgatccctgcatgtaatgtggttgagtgcgacgcagtgacaaaccccgcgaacgggttcgtcgagtgttttcagaacccaggttcatttccatggaacacaacctgtacttttgattgcgaggagggtttcgaacttatgggcgcgcagtcgctgcagtgtacttcctccggtaactgggacaatgaaaagccgacatgtaaagctgtgacctgccgcgctgtcagacagccccagaatggcagcgtgagatgtagccattcacccgccggggaatttaccttcaagagttcatgtaacttcacttgtgaagagggctttatgctgcaggggcccgcacaggtggaatgtactacccaagggcagtggactcagcagataccagtctgcgaagtagttaaatgctcgtccctggctgtcccaggcaagatcaacatgagttgttcgggagagccagtgttcgggaccgtatgtaaattcgcttgtcctgaaggctggactctgaatggctcagctgcccgcacgtgcggggctactggccattggagtggactgcttcccacttgcgaggctcccaccgagtctaatattcccctggtcgctggactaagtgccgctggtctcagtttgctgacgctggccccctttctgctgtggcttcgtaagtgtctccggaaggctaaaaaattcgttcccgcttcaagctgtcagtcccttgagtctgacggaagctaccaaaagccctcttacatcctgtag

SEQ ID NO: 204454 - DNA, 1458 bp, Artificial Sequence
  Description of Artificial Sequence: Synthetic coding sequence
atgatcgccagccagttcctgagcgccctgaccctggtgctgctgatcaaggaaagtggagcatggtcatataacacttccaccgaagccatgacttacgatgaggccagcgcatactgccagcagcgctatacccatctggttgctattcaaaataaggaggagatcgagtacctcaacagtatcctcagctacagcccctcttattactggatcgggattcgtaaggtgaataacgtttgggtgtgggtgggcacacagaagcccctgacagaagaggccaaaaattgggcccctggagaaccaaacaacagacagaaggacgaagattgtgtggagatctacatcaagagggagaaggatgtagggatgtggaacgacgagaggtgtagcaagaaaaagctggccttgtgctacacggccgcttgtactaacacctcttgcagcggtcatggggaatgtgtcgagaccattaacaattacacctgcaaatgtgacccagggttctccggtcttaaatgcgaacagatggtcgaatgcgacgccgtgacaaaccccgccaatggtttcgtggagtgtttccagaaccccggttcattcccatggaacactacgtgtacttttgattgcgaggaggggttcgaacttatgggggctcagtccctccagtgtacttcgagtggaaattgggacaacgaaaaacctacatgcaaagccgtgacctgtcgagcggtacgccagcctcaaaacggatccgtcagatgctcacattctcccgccggagaatttacatttaaatcctcctgcaatttcacctgtgaagagggcttcatgcttcaggggcctgcccaggtggaatgtactacccaaggacaatggactcaacagatcccagtttgcgaagccgttcgctgcgacgcagtgcaccaacctcccaagggtttagtgcgctgtgcgcacagcccaataggagaatttacctacaaaagcagctgcgcattttcttgtgaagaggggttcgaactgcacggatctacccagctggaatgcacttcccagggccagtggactgaagaagtgccatcctgccaggtagtcaagtgctcctccctggccgttcccggcaaaattaatatgtcctgttctggtgagcctgtgttcgggaccgtgtgtaagttcgcctgtcccgaaggctggactctgaatgggtcagctgccaggacttgcggggcgaccggtcattggtccgggctcctgcccacctgtgaggcgcccaccgaatccaatatccccttggtggccgggttaagtgccgcaggcctctccctcctgacgctcgctccgtttctcctatggctgagaaaatgtctgagaaaggcaaagaaatttgtgcctgcctcttcttgccagagtttagagtctgatggctcctaccagaagcccagttatatcttgtag

SEQ ID NO: 204455 - DNA, 1644 bp, Artificial Sequence
  Description of Artificial Sequence: Synthetic coding sequence
atgatcgccagccagttcctgagcgccctgaccctggtgctgctgattaaggagagtggcgcatggtcctacaacacttctactgaagccatgacatacgatgaggcatcggcctactgccaacagaggtacacacacctggttgctattcagaataaggaggagattgagtacctgaactctattttgtcttactccccctcctactattggataggcataagaaaggtgaataatgtctgggtgtgggtgggaacacagaagcccctgacggaagaagcgaaaaactgggcccccggggagccaaataacagacagaaagacgaggattgcgttgagatttatatcaagagggagaaagatgtggggatgtggaatgatgagcggtgcagcaagaagaagcttgctctctgctacactgcagcatgtactaacacaagctgttctggtcacggagaatgcgttgagacaattaacaattatacttgcaaatgcgatccaggattcagtgggctcaagtgcgaacaaatagtgaactgtactgccctcgaatcccccgaacacggaagtttagtttgcagtcaccccttgggtaacttcagctacaattcttcttgctctataagctgcgaccgaggttatctcccgagctctatggagaccatgcagtgtatgagctccggggagtggagcgccccaataccagcatgcaacgtcgtcgaatgcgacgcggtgacaaacccggcgaacggatttgtggagtgcttccaaaatcctggcagcttcccctggaatactacctgcacatttgattgcgaggaagggtttgaacttatgggcgcacaatcactgcagtgcacgtcttctgggaactgggacaatgagaagccaacatgtaaagccgttacctgtagggctgttcggcaacctcagaatggatcagttagatgctctcatagtcccgccggcgagttcacgtttaagtcaagctgtaacttcacatgcgaagaggggtttatgttgcagggccccgcccaggttgaatgcacaacccaaggtcagtggacgcagcaaatccctgtgtgtgaggccgttcgttgcgatgccgttcatcaacctccaaaagggctcgtaaggtgcgctcatagcccaatcggggagttcacatacaagagctcctgtgccttctcatgtgaggagggatttgagctgcatggctcaacgcagcttgaatgtacgtcccaaggccagtggacagaggaggttccatcttgccaggtggtgaaatgttcatccttggctgtccctggaaagatcaacatgagttgcagcggcgagccagtgttcggcaccgtctgcaagttcgcttgcccagagggatggacattaaacggaagcgctgctaggacatgcggagcaactggtcattggagtgggcttttacctacttgcgaggctcccacggaaagtaacatccccctggtggcaggtttgtcagccgcggggctgtccctgttaaccctagcgccctttctcttgtggctgagaaagtgtctgaggaaagctaaaaagttcgtacccgctagctcttgtcaatcactcgagtctgatgggagctaccagaaacccagctacatcctgtag

SEQ ID NO: 204456 - DNA, 1644 bp, Artificial Sequence
  Description of Artificial Sequence: Synthetic coding sequence
atgatcgccagccagttcctgagcgccctgaccctggtgctgctgattaaagagtctggcgcttggagctacaatacgtctacagaagcaatgacatacgacgaggcgtctgcctactgtcagcagcggtacacacaccttgtggccatccaaaataaggaagagattgagtatctcaactctatcctaagttactcccctagctactattggatcgggatccgcaaggtgaataatgtctgggtgtgggtggggacccagaagcccctcactgaagaggctaagaattgggcgccgggggagcccaataatcggcagaaagatgaggactgcgtggaaatctacatcaaacgagagaaggatgtgggcatgtggaatgacgaaaggtgttctaagaaaaaactggctttgtgctataccgcggcctgcaccaacacttcttgctcaggacatggcgagtgtgtggagactatcaataactacacatgcaaatgcgatccaggattctctggcctgaaatgtgagcaaatcgtcaactgcaccgccctggagagcccagagcacggctctctcgtgtgctctcatccactcgggaatttcagttacaactcaagttgttcaatttcttgcgatcgagggtatctcccatcttctatggagacaatgcagtgcatgtctagtggagagtggtcagctcctattccagcttgtaacgtggtggaatgcgatgccgtcacaaatccagcgaatggttttgttgagtgcttccagaatcccggttccttcccatggaacaccacttgtacattcgactgcgaagaaggttttgaactcatgggagcacagtcactgcagtgcacctccagtggaaactgggacaacgagaagccaacttgcaaagctgttacatgccgcgcagtgcgacagccccagaacggcagcgtccgttgttcacactccccagctggggaatttacctttaaatcgtcctgcaactttacttgtgaggaaggcttcatgcttcagggtcccgctcaagtggagtgcactacccaagggcagtggacccaacagatcccagtttgcgaggcatttcagtgtacagcactgagcaaccccgagaggggctacatgaactgtttaccatccgcttccggatctttcaggtacgggtcctcctgtgaattttcctgtgagcaagggtttgtcctgaaaggctccaagcgactgcaatgcgggccaaccggcgagtgggacaacgaaaagcctacttgtgaagttgttaagtgctcatccctcgccgttcccggaaaaatcaacatgtcatgttcgggggagcccgtgtttggcactgtttgtaagttcgcgtgtccagaaggatggaccttaaacggctcggccgccaggacgtgtggcgcgacaggacattggagtggacttctgcctacatgtgaagctccgaccgaaagcaatatccctctggtggcggggcttagcgcagcaggcctgtcgctcctaacgctggcgccatttttgttgtggttacgaaagtgccttagaaaggctaaaaaattcgtcccagcatcaagctgtcagtccctggaatccgatggctcctatcaaaaaccttcatacatcctgtag

SEQ ID NO: 204457 - DNA, 1158 bp, Artificial Sequence
  Description of Artificial Sequence: Synthetic coding sequence
atgggctgccggcggacccgggagggccccagcaaggccatgatctttccttggaagtgccagtccacacagcgggacctgtggaatattttcaaattgtgggggtggaccatgctctgctgtgactttctggcccaccacggcacagactgctggacgtatcactacagtgagaagcccatgaactggcagagggcgcgaaggttctgtagagataactatacagacctggtggcaatccaaaataaggccgaaatagagtacctcgaaaagactctgccattctcacgctcctattactggatcgggatacgcaaaatcgggggtatatggacctgggtaggcacgaataagtccttaacagaggaggctgaaaactggggagatggcgagccaaacaataaaaagaacaaggaagattgcgtcgagatctacatcaaaaggaataaggacgccggcaagtggaatgatgacgcctgtcataaactcaaggcagcactgtgttacaccgcgtcgtgtcagccatggtcttgttccggacacggggagtgcgtggaaatcattaacaactatacgtgtaattgtgatgtgggttactacgggccccagtgtcagtttgtgatacagtgcgagccactagaggcaccggagttggggacaatggattgcactcacccgctggggaacttttcgttttccagccagtgtgcctttagttgttccgaaggtacgaacttgaccggaattgaagaaactacctgtggcccctttgggaattggtccagtcccgagccaacatgtcaggtgattcagtgcgagcccctgtctgctccggatctaggaataatgaactgcagtcaccctctggcttccttcagtttcacctccgcctgtaccttcatctgcagtgaaggaactgaactgataggaaagaaaaaaacaatttgcgaatcttccggaatctggtccaatccaagcccaatctgccagaaacttgacaaatctttctcaatgattaaagagggagattataatcccctctttattccagtcgccgttatggtgactgcattctctggtctggcgttcatcatttggctggcccgacgactgaagaaaggaaagaagagtaaaaggagcatgaacgatccatattag

SEQ ID NO: 204458 - DNA, 2493 bp, Artificial Sequence
  Description of Artificial Sequence: Synthetic coding sequence
atggccaactgccagatcgccatcctgtaccagcggttccagcgggtcgtgttcggaatcagccagctgctgtgcttttccgcactgatttcagagctgaccaaccagaaggaggttgcggcatggacctatcattactccacgaaggcatactcatggaatattagcagaaaatactgtcagaaccgatatacagacctggttgcaatccagaacaaaaatgagattgattatctcaataaggtgcttccctactattctagctattactggatcggaatcaggaagaacaacaaaacatggacgtgggtcgggaccaaaaaagcgctaacaaacgaggcggaaaattgggccgacaacgaacccaataataagagaaataacgaggactgtgtcgaaatttatataaagtctcctagtgctccaggtaaatggaacgatgagcattgcttgaagaagaagcatgcgctgtgctacacagcctcgtgtcaggacatgtcttgctccaagcagggagaatgcctcgaaacgatcggaaactacacatgctcttgttatccgggtttttacggtccggaatgcgagtacgtacgggagtgcggtgagcttgagcttccgcagcatgtgctgatgaattgttcccatccactcggtaacttcagcttcaattctcagtgctctttccattgtacagacggttatcaagtcaacgggccgtctaaactagaatgccttgcatccggtatctggaccaacaaaccacctcagtgtctcgcagcacaatgtccgccactcaagattccagaaagaggcaatatgacctgtctgcattccgccaaagcttttcagcatcaatcctcttgtagtttctcctgcgaggaggggttcgcactcgtaggacccgaggtagtgcagtgtacagcctccggtgtttggactgcaccagcaccagtgtgtaaggccgttcagtgtcagcacttagaagccccatccgagggtacaatggattgcgttcacccattaacagccttcgcttacggcagtagctgtaaatttgaatgccagccaggatacagggttagaggactcgatatgctccgctgcattgattctggccattggagtgctcccttgccgacgtgtgaggctatctcctgtgaaccattggagtcgcccgtccatgggagcatggattgcagcccttctctgcgggcattccaatatgacacaaactgctccttccgctgtgccgaagggtttatgctccgtggagctgacatcgtgcgatgtgacaatcttgggcagtggactgctccagcacccgtgtgtcaagccctgcagtgccaggacctgccggtgccaaacgaggctcgggtgaactgttcccatccgttcggtgcgtttcgatatcagtcagtgtgcagtttcacatgtaacgagggactgctgctcgtgggtgcgagcgtgctgcagtgtctggccaccggaaactggaactcagtcccaccagagtgtcaggctatcccgtgcacgcccctgctctccccgcagaatgggactatgacttgcgtgcagcctctcggaagctctagttacaaatcaacctgtcagtttatttgtgacgaggggtatagcctgagcggccccgagcgcctggactgtacaaggtcgggccgttggaccgactccccgcctatgtgcgaggccatcaagtgtccagaactgtttgcccctgaacagggaagtttggattgttccgacaccagaggagagtttaacgtgggctctacttgtcacttcagttgcgacaatgggtttaagctggaaggccctaataatgtcgagtgcacaaccagcggaagatggtcagcaaccccgcccacgtgtaaaggcatcgcttccctgccaactcctggagtgcagtgcccggccctgaccacgcctggacagggtactatgtattgtcgccatcaccccggtactttcggatttaacactacctgctattttggatgcaatgctggcttcaccctgataggggactccacgctatcttgccgaccaagcggccagtggacagcggtcactccagcttgccgggctgtgaaatgtagtgagctgcacgttaacaagcctatagcaatgaactgctccaatctctggggtaatttctcatatgggtctatctgcagttttcactgcctggaagggcagctgctcaacggttctgcccagacggcatgccaggaaaatggccactggagcaccacagtacctacctgtcaggctggccctctgaccatccaagaagcgctgacttacttcggcggcgccgtggcgtctactattgggttaatcatgggaggcacactcctggccttactgcgtaagagatttcggcaaaaggatgacggaaaatgcccccttaatccacatagtcacctcggcacatatggggtcttcacaaacgctgcatttgatcctagcccatag

SEQ ID NO: 204459 - DNA, 2307 bp, Artificial Sequence
  Description of Artificial Sequence: Synthetic coding sequence
atggccaactgccagatcgccatcctgtaccagcggttccagcgggtggtgttcggaatcagtcagctgctgtgtttcagtgcactgatctctgagctgaccaaccagaaggaggtagccgcatggacctaccactacagcactaaggcgtattcctggaacatctcccggaagtactgtcaaaaccgttatacagacctcgtggctatccagaataagaatgagatcgactatttgaataaagttctgccatactatagctcttactattggattgggattaggaaaaacaataagacatggacatgggtcggcacaaaaaaagcgttgactaatgaggccgagaactgggctgacaacgaacctaataacaaacggaataacgaggactgtgtggagatctacatcaagtcccctagcgctcccggaaaatggaacgacgaacattgccttaagaagaagcacgccctgtgttacaccgctagctgccaagatatgtcatgctccaagcagggagaatgtctggaaaccatcggaaattatacctgctcttgttaccccggattttacggtccagagtgcgaatacgtcagggaatgtggagagctggagcttcctcagcatgtcctcatgaattgcagccaccctctcgggaatttctcgtttaatagccagtgctcatttcattgcactgatggctaccaggtcaatggaccctcaaagttggaatgtctggcatctgggatttggacaaataaacctccgcagtgcctggccgcccaatgcccgccactcaagattcctgagcgaggcaacatgacatgccttcattcagctaaggcattccagcaccagtcatcgtgcagtttctcatgtgaggaaggattcgccctggtgggccccgaggtcgtgcagtgcacagctagcggggtttggacggcacctgctccggtgtgcaaagccatctcttgtgagccactcgagagcccagtccatggttcaatggattgttccccgagcctgagagcgtttcaatacgatacaaattgtagctttcgctgcgccgaggggtttatgctaaggggggccgacatagtgaggtgcgataatctcggtcagtggaccgcccctgcgcctgtttgtcaggcattgcagtgtcaggacctgccagtgcctaacgaggccagggtgaattgctcccatccatttggagccttcagataccagtccgtgtgcagctttacttgtaatgaagggcttctgttggtcggcgcttcagtactacaatgcttagccaccggaaactggaactccgtgccccccgagtgccaggccatcccatgcacaccactgctaagcccgcagaacggaacaatgacatgcgtgcaaccgttgggaagtagctcatacaaatctacttgccagttcatttgtgatgaggggtacagcctcagtgggcctgagaggcttgactgcactaggtccggacgttggacagattctcctcctatgtgtgaggccatcaaatgtcctgagctgtttgcgcctgagcaagggtccctggactgttcagacactagaggggaattcaatgtgggctctacctgtcacttcagctgcgacaatggttttaaactggaaggccccaataatgtcgagtgcacgaccagcggccgctggagcgctactcctcccacttgcaagggtatcgcatctctgccaacaccaggtgttcagtgcccagccctcacaactcctggccagggaaccatgtattgcaggcatcatcccggcacattcggcttcaatactacttgttacttcggctgcaatgccggttttacacttatcggagatagtaccctgagctgtcgtccttccggccagtggacagcagtcactcctgcatgtcgagcagtaaaatgtagcgagctgcacgttaataagcccatagcgatgaattgtagcaacctgtggggaaacttttcctatggcagcatctgcagctttcactgtctcgaggggcagttgttgaatggcagcgcgcagactgcatgccaggagaacggacactggtctactacagtcccaacctgtcaggctggccctctcacgattcaggaggccctgacttacttcggcggtgccgtggcctccacaattggactgatcatggggggaactctgttggccttactccgcaagaggttcagacaaaaagacgacggaaagtgccctctgaacccccacagccacctggggacatatggtgtgttcaccaatgctgccttcgatcccagtccatag

SEQ ID NO: 204460 - DNA, 2307 bp, Artificial Sequence
  Description of Artificial Sequence: Synthetic coding sequence
atggccaactgccagatcgccatcctgtaccagcggttccagcgggtcgtcttcggtataagccaacttctctgcttcagtgccttgatttcagagcttactaaccagaaggaagtcgccgcttggacttatcactactcaaccaaggcatacagctggaatatcagccgaaaatattgccagaaccggtataccgatctcgtggcgattcaaaataagaacgaaatcgactatttgaacaaagtgcttccgtactatagttcgtattattggattggcatcaggaagaataataaaacttggacgtgggttggaactaaaaaagccttgacgaatgaggcagaaaactgggctgataatgagcccaataacaaacggaataacgaagattgcgtggagatttatatcaaatccccttcagcacccggaaagtggaacgatgagcattgcctcaaaaaaaagcatgccctttgctatactgcttcctgtcaggatatgtcctgtagcaaacagggcgagtgcttagagactatcggtaactacacttgcagctgttaccccggcttctacgggcctgaatgcgagtacgtgcgtgaatgcggggagctggaactgccccagcatgttctgatgaactgctcacaccctctgggaaacttctctttcaactcgcagtgtagctttcactgcactgacggttaccaggttaacggcccgagtaagctagaatgtctagcctctggaatctggacgaacaagcctccacagtgcctcgcagtacagtgccaacaccttgaagctccatccgagggcacaatggactgtgtgcacccattgaccgcgttcgcctatgggtccagctgcaaatttgaatgtcagcccgggtatagggtaaggggcctggacatgcttcggtgcattgattctgggcattggtcggccccactgcctacctgcgaggcaatatcttgcgagcccttggagagcccagtccatggttcaatggactgctctccttctctgagagctttccagtacgataccaactgtagttttaggtgtgccgaagggtttatgttgcggggagccgacatagtcaggtgcgataatctggggcaatggacagctccagccccagtgtgccaggccctgcagtgccaggacctcccggtccctaacgaagctcgggttaactgttctcatcctttcggcgcgtttcggtaccagtctgtttgttcatttacctgcaatgagggactactgttggtcggagcgtccgtacttcagtgcctggcaacggggaattggaacagtgtgccccctgaatgtcaagcaattccctgcactcctctgctatctcctcaaaatggaacaatgacttgcgtgcaacccctgggaagttcaagttacaagtccacctgtcagtttatctgtgacgaaggatactctctctctggccccgaaaggctggactgcactcgttccgggaggtggaccgatagcccaccaatgtgcgaagccattaaatgcccagagctctttgccccagagcaagggtctttagattgctccgatacacggggggaattcaatgtgggatccacctgccatttttcatgtgacaacggattcaagttagaaggccctaataacgtggagtgcaccacaagtggacgctggagtgctacacccccgacatgcaagggtattgcgtctttgccaacccctggcgtgcagtgccccgctttaactacacctggacagggcacaatgtattgtaggcatcaccccggaacattcgggtttaacaccacctgttactttggatgtaacgccggctttacccttatcggtgattccacattgagctgtcggccatccggacagtggaccgcagttacacccgcgtgcagagccgtcaagtgctctgagttacatgtgaataagcctatcgcaatgaattgcagtaatttatggggcaacttctcttatggcagcatttgttccttccactgccttgaaggccagcttctgaacggttcagcccagactgcttgccaggagaacggtcactggtccacaaccgtgccgacctgccaggccgggcccctgaccattcaagaagcactgacgtactttgggggcgcagtcgctagcacaataggactgataatggggggaaccttgctagccctgctcagaaagcgatttagacagaaagatgacggaaaatgccctctgaatccccacagccacctgggcacatacggcgtttttacaaacgcggcatttgacccatccccttag

SEQ ID NO: 204461 - DNA, 1941 bp, Artificial Sequence
  Description of Artificial Sequence: Synthetic coding sequence
atggccaactgccagatcgccatcctgtaccagcggttccagcgggttgtatttggcatttcccaactcctgtgcttctccgccctcatttctgagctgactaaccagaaagaagttgctgcatggacataccactattccaccaaggcctacagctggaacatctctcgtaaatattgtcagaacagatatacagatctggtcgccattcagaacaagaatgaaatcgactacctcaacaaggtcttaccgtattactctagctactactggattgggatcagaaagaacaataaaacttggacatgggtcgggactaaaaaagctctgactaatgaagcagaaaattgggcagataatgaacccaataacaaacgcaacaatgaagattgtgtggaaatctatatcaagagtccatccgctcccggcaagtggaacgacgagcattgcctgaagaaaaagcatgccctgtgttacacggcatcatgccaggatatgtcttgtagcaaacagggggagtgcttagaaaccattggcaactacacatgctcctgttaccctggcttttacgggcctgagtgtgaatacgtgcgtgaatgtggcgagctggagctgcctcagcacgttctgatgaattgcagccaccctttgggcaatttttcttttaacagccagtgcagttttcactgcacagatggctatcaggttaatggacccagcaagcttgagtgtttagcctcagggatttggacaaacaagcctccccagtgcctagcagcccagtgtccccctctgaaaatccctgaaagggggaacatgacatgtctgcactcagcgaaagccttccaacaccagtcaagttgctcattcagctgcgaagaaggattcgccctggtggggcccgaggtggttcagtgtacagcaagcggtgtgtggaccgcgcccgcccccgtatgcaaagcgatcagctgtgagccactggaatcccctgtccatggaagtatggattgttcaccaagcctacgcgccttccagtacgacactaattgctcttttagatgcgcagaagggttcatgttgcggggcgccgatatcgtccggtgtgataatctcggacagtggacagcgcctgcaccagtgtgtcaggccctgcagtgccaggacttgcctgttcccaacgaagctcgggtaaactgttcccatccattcggcgcgtttcggtaccaatcagtttgcagcttcacctgcaatgagggactcctgctcgtcggtgcttccgtcctgcaatgtctcgcaactggaaattggaactccgtgcctcctgaatgccagggtaagagcattgctagtctgccaacgcctggtgtgcagtgcccagccctcacaacccccggccaaggaactatgtattgtcggcaccacccgggtacattcggcttcaataccacctgctactttggctgcaacgccggtttcacccttatcggagacagcactctgtcctgccggcctagtgggcagtggaccgccgtgactccagcttgcagggccgtcaagtgctcagagctgcacgtaaataagcccattgccatgaattgctccaatctgtggggcaacttttcctatggtagcatttgctcatttcactgcctagagggccagctgcttaatggttctgctcagacagcttgtcaagaaaacggccactggtctacgacggtcccaacgtgtcaggccggacccttgactatccaggaagcattaacctatttcggaggggccgttgctagcactataggtctgattatggggggaactctactggcactcctcaggaagaggtttcggcagaaggatgacggaaagtgccccctcaacccgcacagtcacctcggcacatatggcgtgtttactaatgctgcatttgatcccagcccctag

SEQ ID NO: 204462 - DNA, 2493 bp, Artificial Sequence
  Description of Artificial Sequence: Synthetic coding sequence
atggccaactgccagatcgccatcctgtaccagcggttccagcgggtggtctttggaattagccagctgttatgcttttccgcattaatatcagagctcactaatcagaaagaagttgccgcgtggacgtatcactattctacgaaagcctattcttggaatatttcacgcaagtattgtcagaataggtatacagacttagtagctatccagaataagaacgagatcgactatctgaataaggttctgccctattactcatcatactattggatcgggattagaaaaaacaacaagacctggacatgggttggcactaagaaagccctgactaatgaggccgagaattgggctgataacgaaccaaacaacaagcggaacaacgaggattgtgtcgaaatttatatcaaatccccctctgcacccggcaagtggaacgatgagcattgtctgaaaaaaaagcacgcactctgctacaccgctagctgccaggatatgtcttgctctaagcagggtgaatgcctggaaacaattggtaattacacctgcagctgctacccggggttttatggcccagagtgcgagtatgtgagggagtgtggcgagcttgagctgccgcagcatgtgctgatgaactgcagtcatcctctggggaacttcagttttaactcacaatgtagctttcactgcaccgacgggtatcaggtgaacggacctagcaagctggagtgcctggcaagcggaatttggacaaacaagccacctcaatgcctggccgcgcagtgtcctcctctcaaaatccctgagcgtgggaatatgacttgcctgcatagtgccaaagcattccaacaccaatcttcctgctcttttagctgcgaggagggtttcgctctcgtcggcccagaggtggtgcaatgtactgcaagtggcgtttggacagcccccgcacccgtgtgcaaagcagtccagtgtcagcatctggaggccccatctgagggcaccatggactgcgttcatcctttaaccgcatttgcttatgggtccagctgcaaatttgagtgccagcccggctatcgagtgcgggggctggacatgcttcggtgcatcgattccggccactggagcgcccccctgccaacgtgcgaggctatctcatgcgaacctctggagtcacccgtccacggcagtatggactgttcccctagcctgcgggcgtttcagtacgacactaactgctccttcaggtgcgctgaagggttcatgctcagaggggccgacattgttaggtgtgataacctgggccagtggacagctccggcccctgtatgtcaagcacttcagtgccaggacttgccagttcctaatgaggcacgagtaaactgtagtcacccatttggggcctttaggtaccagtcagtttgctcctttacctgcaatgaaggccttctgcttgtgggagcgtccgtcctccagtgcctcgcaacagggaattggaatagcgtgccacccgaatgccaagctatcccttgtacccctctattgagccctcagaatggcactatgacctgcgtccagcccctgggaagctcatcgtataaatcaacatgtcaatttatttgtgatgagggatactccttgtcaggccctgagcgactggattgtacacggtccggaaggtggactgacagcccaccgatgtgcgaagcaattaaatgccctgagttgttcgcccccgagcaaggcagtctggactgtagcgacactcgcggcgagttcaacgtgggatcaacttgccacttttcttgtgacaacggtttcaagctcgaaggccccaacaacgtggagtgcactacatccggccgatggagtgctacacccccaacatgtaaaggtatcgcttctttgcctacccctggagttcagtgcccagccctgacgactcctggccaaggcactatgtactgcaggcaccaccccggtacatttgggtttaacacaacatgttattttggctgcaacgccggattcactctcattggtgactctactctgtcatgtcggccttccggacaatggaccgctgtgacgcctgcctgcagagctgtgaaatgttctgagctgcacgtgaataaacctatcgccatgaactgctcgaatctttggggcaatttcagttatggatccatctgcagcttccactgcctggagggtcagctgctcaacggatcggcccagactgcttgtcaagaaaatggccattggagcactaccgtgcccacatgtcaggcaggtcctttaactatccaagaagccctcacatattttggtggtgccgtggccagcacaatcggtcttataatgggaggtacccttctggcacttttgagaaaacgatttcgccagaaagatgacggtaaatgtccactgaacccacactcacatttaggcacatacggtgttttcaccaatgctgccttcgatccctccccttag

SEQ ID NO: 204463 - DNA, 1935 bp, Artificial Sequence
  Description of Artificial Sequence: Synthetic coding sequence
atggccaactgccagatcgccatcctgtaccagcggttccagcgggtggtgtttggcatttcacagttgctgtgcttttcagccctgatttcagaactaactaatcagaaggaggttgccgcatggacttatcactatagcaccaaagcttactcctggaatatctcgaggaagtattgtcaaaatcgatacacggacctggttgcgatacagaataaaaatgaaattgattatctaaacaaagtgctgccttactactcctcatattactggattggcatccgcaagaacaataaaacatggacgtgggtgggcacaaagaaagccctcacaaacgaggctgaaaactgggcggataatgagcccaacaataaaaggaacaacgaggactgtgtagaaatttatattaagagtccctcggccccaggaaaatggaacgatgagcattgcttaaaaaagaagcatgcactgtgctacactgcaagctgtcaagacatgagctgcagcaaacagggggagtgtcttgagaccatcggcaattatacttgttcatgctacccaggtttctacgggccagaatgtgagtacgtgcgggagtgcggagagttggagctgccccaacacgtactgatgaactgcagccacccgttgggcaacttctcctttaattcccagtgttcattccattgcaccgacgggtatcaggtgaacggaccctcaaagttggaatgtcttgcttcaggcatctggactaacaagccaccacagtgtcttgctgcccagtgcccccccttgaagattcctgaacgagggaacatgacatgtctgcacagcgccaaagcattccagcaccaaagcagttgcagcttctcatgcgaggagggattcgccctggtaggaccagaagtggtgcagtgtactgcttccggcgtttggacggctccggcccccgtctgtaaggcccttcaatgccaagacctccccgtgcctaacgaagcgcgtgtgaattgttctcaccccttcggggcctttaggtaccaaagcgtgtgtagctttacctgcaacgaagggctcctgctggtcggcgccagcgtcctgcaatgtctcgccacagggaactggaattccgtcccacccgagtgtcaggccatcccctgcactccactactgtctccccaaaatgggaccatgacatgtgtgcaaccgcttggctcctcgtcatataaaagcacttgccagtttatatgtgacgagggctactccctgtccgggcccgagcggctggactgcacaagatcaggccgatggacggactctcccccaatgtgcgagggtatcgctagccttcccacccctggtgtgcaatgtcctgcactgaccactcccggacaggggactatgtattgtcgccaccacccaggaacctttggttttaacactacttgctatttcgggtgtaatgctggttttaccctgattggtgactcaaccctttcttgtcgaccaagtggccagtggactgccgtcacaccagcctgccgcgccgtcaaatgtagcgaactacatgtcaataagcctattgctatgaactgctcaaacctttggggaaatttttcttatgggtccatttgcagtttccattgccttgaaggacagcttctgaacggatcggcccagacggcctgccaggaaaatgggcactggagtacgactgtgcctacttgtcaggcgggaccactcaccatccaagaggctctgacctattttggaggcgccgtggccagtactattggactcataatgggagggacactgctggccctgttacggaagcgattcagacagaaagacgatggcaaatgcccacttaatccccacagccacttggggacctatggggtcttcaccaatgctgcattcgatccctcgccgtag

SEQ ID NO: 204464 - DNA, 1941 bp, Artificial Sequence
  Description of Artificial Sequence: Synthetic coding sequence
atggccaactgccagatcgccatcctgtaccagcggttccagcgggtggtgttcggcatatctcaactcttatgcttttctgcactcatctctgaattgactaatcaaaaagaagtggctgcttggacataccattattccaccaaggcctacagctggaatatatctcggaaatactgccagaatcgctacactgacctggtggctattcagaacaaaaacgagatcgattaccttaataaggtattaccctactactcttcatactattggataggtatccggaaaaataacaagacatggacatgggttgggaccaagaaggccttaaccaatgaggccgagaactgggctgacaacgaaccgaacaacaaacgcaacaacgaagactgcgtggagatctatatcaagtctcctagtgctcccggaaagtggaacgacgaacattgtctcaagaagaaacacgccctatgctatacagcatcatgtcaggacatgtcctgcagtaagcagggcgaatgtcttgagacaattggcaattacacctgctcatgctaccccggattttacggccccgaatgtgaatacgtgagagaatgcggcgagctcgagctgcctcagcacgtgctgatgaactgcagccaccccctcggtaacttctccttcaattctcagtgcagcttccactgtaccgacgggtaccaggttaatggaccctctaaactggagtgtctagcttccggcatctggaccaataaacctccacagtgcctagcagcccagtgtcctcctttaaagatcccagaacggggtaacatgacatgcctgcacagtgccaaagctttccagcaccagtcgagttgctccttctcctgtgaggagggctttgctctggtcggccccgaggtcgtgcaatgcaccgccagcggggtgtggacggcgcccgccccagtttgcaaagccatatcctgtgagccgctggagtccccagttcacggctcgatggattgtagcccaagcctgagagctttccagtacgacacaaactgctctttccgatgtgcagaaggatttatgctcagaggggccgatattgtgagatgcgacaacctgggacagtggacagcgccagcacccgtttgtcaagccttgcagtgccaggacctgccagtgcctaatgaagcaagggttaactgctcacacccttttggcgccttccgctatcaatctgtgtgctcatttacctgcaatgaaggcttgctgcttgtcggggctagcgttctccagtgcctcgctaccggtaattggaacagcgtccctccagaatgccaagggaagtccattgcctctctgcccactcccggcgtgcagtgcccagccctaaccacaccaggacaaggcactatgtattgccgccatcatccgggtacattcggtttcaatactacctgctatttcgggtgtaacgctggattcacgctgataggcgattccactctgtcttgccgcccttctggtcaatggacggcagtgaccccagcttgtcgtgcggtcaaatgtagtgagctacatgtcaacaagcccattgcgatgaactgtagcaacttgtggggaaacttctcatacggttcaatctgttcctttcattgtttggaaggtcagctcttaaatgggtctgctcagaccgcctgtcaggagaatggtcactggtcaactactgttcccacctgccaggccgggccactgacgattcaggaagccttgacatacttcgggggtgcagttgcttccaccatcgggcttattatggggggtacactgctggcacttttgcgcaaaagattccgtcaaaaggacgatggaaagtgccccctgaacccacattcccacctgggcacttacggcgtgtttactaacgcagcatttgacccaagtccatag

SEQ ID NO: 204465 - DNA, 2307 bp, Artificial Sequence
  Description of Artificial Sequence: Synthetic coding sequence
atggccaactgccagatcgccatcctgtaccagcggttccagcgggttgtgttcggaatctctcaactgctttgcttcagcgccttaataagcgaattgaccaaccaaaaagaggtcgctgcctggacataccattattccaccaaagcctacagctggaacatttccaggaaatactgccagaataggtatacagacctcgtggctatccaaaataaaaacgaaattgactacctgaataaggtgctgccatactactcttcttactattggatcgggattaggaagaataataaaacttggacttgggtgggaaccaagaaagccctcactaacgaggcagagaattgggcggataacgagcccaacaataaacgcaacaacgaggattgcgtagaaatttatataaagtccccctccgcaccaggcaaatggaatgatgagcactgtctgaagaaaaaacacgctctctgttacacggcctcgtgtcaggacatgagctgttcgaagcagggcgagtgccttgagactataggtaactacacctgtagttgctatccaggattttacgggcccgagtgcgagtacgtgagggaatgcggcgaactggagctgccccagcacgttcttatgaattgtagtcatccccttggtaacttcagcttcaattcacagtgttctttccattgcacggacgggtatcaggtcaacgggcccagtaagctggagtgtctggctagcggcatttggaccaacaagcctccacaatgtttggccgttcagtgtcaacatctcgaggccccaagcgaggggacaatggattgtgtgcacccacttacagcttttgcatatggaagttcgtgtaaatttgaatgccagcccggctatcgcgtccggggcctggatatgctgcgttgcatagactctggccactggtctgcgccactgcccacatgcgaggcgataagttgtgagccgctggaaagccccgtgcacggaagtatggactgtagtccaagcctacgcgcttttcagtatgacacaaactgttcctttaggtgtgcggagggttttatgttgaggggcgctgacattgttagatgtgacaacctcgggcaatggacagcccccgcgccggtttgccaagcactccagtgtcaggatctcccagtcccgaatgaagcgagggtcaactgttcccatccatttggggcttttcgttaccaatccgtgtgcagtttcacatgtaacgaaggtttgctcctggtgggcgcctcagtgctccagtgcttggccacaggcaactggaacagcgttccacccgaatgccaggccatcccctgtacaccgcttctgagccctcagaatggcaccatgacatgtgtccagccactgggctcatcgagctacaagtccacgtgtcaattcatctgcgatgaagggtattctttgagcggacctgagaggctggactgtacaaggagcggtcgctggaccgattccccaccgatgtgcgaagcaatcaaatgtcccgaactatttgcacccgagcaggggagcctagattgtagcgataccagaggggaattcaacgtggggtcaacttgccacttcagttgcgataacggtttcaagcttgagggaccgaacaatgtagagtgcacaactagcggaaggtggtctgcgactcctcctacttgcaaaggaattgcttcactccctactcctggcgtacagtgcccggctctcacgacccccgggcagggcacgatgtattgtaggcatcacccagggacttttgggtttaatacgacatgctactttggctgcaacgcgggctttaccctaatcggcgatagtaccctgtcctgccgacccagcgggcagtggacagctgtgacaccagcctgtcgtgccgtaaaatgcagcgaactgcatgtaaataagccaatcgctatgaattgcagcaatctctggggcaatttcagttacggtagtatatgttccttccattgcctggaggggcagttgcttaacggctccgcccaaacagcttgccaggaaaatggtcactggagcaccactgtgcccacgtgccaggctggccccctgaccattcaggaggccttaacatacttcggtggggccgtggcctcaacaattggactcattatgggaggaacactgttagccctcctgaggaaacgctttaggcagaaggacgatggcaagtgccccctgaacccacactcacacctgggtacctacggggtcttcactaatgctgccttcgatccctccccttag

SEQ ID NO: 204466 - DNA, 2307 bp, Artificial Sequence
  Description of Artificial Sequence: Synthetic coding sequence
atggccaactgccagatcgccatcctgtaccagcggttccagcgggtggtgttcggaatttcccagctcctgtgcttttctgcactaatcagtgaattgacaaatcagaaagaggttgcagcttggacctaccactacagcaccaaagcatattcctggaacatcagtagaaaatattgccagaatcgctacaccgacctggttgccatacagaataagaatgaaattgactacctgaacaaagttctgccttactattctagctactactggatcgggatacgcaaaaacaacaagacctggacatgggtgggcacaaaaaaggcactaaccaatgaagccgagaattgggccgacaacgagcctaacaataaaagaaacaacgaagattgtgtagaaatctatataaagtcccctagtgcacccggcaagtggaatgacgaacattgtctgaagaaaaaacatgctctttgttacactgcgtcgtgtcaggatatgagctgttccaaacagggagaatgtctagagactatcgggaactacacctgttcatgttacccaggcttctatggaccagagtgcgaatatgtaagagaatgtggagagttggaactgccacagcatgttttgatgaattgctcacatccacttggtaatttctcatttaatagtcagtgcagctttcactgcactgacggataccaagtaaatgggccatcaaagctggagtgcctcgcatccgggatatggactaacaagcctccccaatgtctggctgcgcagtgcccaccgctgaagatacccgaaagggggaatatgacctgtctccacagcgccaaggcctttcaacaccagtcaagctgttccttcagttgtgaagaaggattcgcgctagtgggacccgaggtggttcagtgtacagcctctggagtttggaccgcacccgcgccagtgtgcaaagcgatctcttgtgaaccactggaaagcccggtgcacggaagcatggactgcagcccaagcttgcgcgcctttcaatacgacacgaactgtagctttcgatgcgcggagggctttatgttgcgtggagccgatatcgtacggtgcgataacctcggccagtggaccgctcctgcccccgtttgccaagccctccagtgtcaggacctcccagtccccaatgaggcgcgggtgaattgctctcacccctttggcgcattccggtaccaatcagtgtgcagtttcacgtgtaacgagggcttactgctagtcggcgctagtgttctgcagtgtctcgctaccggtaactggaacagcgtccctcctgagtgccaggccataccgtgcactccgcttttaagcccccagaatgggactatgacctgcgtacaacctttaggctccagttcatataagtcaacctgtcagtttatctgcgatgagggatactccctttcaggaccagaaaggctggattgcacaaggtctggaaggtggactgactcgcctccaatgtgtgaggctataaaatgccctgaactgttcgctccagagcagggctctttggactgcagcgatacacgaggagaattcaacgttgggagcacttgtcatttcagttgcgacaacgggtttaaattagaaggaccaaataatgtggagtgtaccacgtccggacggtggagtgccacacctcctacttgcaaaggcatcgccagcttacctactccaggggtccagtgtccagctctcaccacaccggggcagggcactatgtactgccgtcatcacccaggcacattcggtttcaatacaacttgttacttcggttgcaacgcggggtttaccctcatcggcgactccacgctgtcttgccggccttcaggccagtggaccgcagtgaccccagcatgccgcgctgtaaagtgttccgaacttcacgtcaacaagccaatcgccatgaactgcagtaatctgtgggggaacttttcttatggctccatctgctctttccattgcctcgaggggcagcttctgaatggatccgcccaaacggcctgccaggagaacggacattggagcacaaccgtgcccacatgccaagcgggccctctgactattcaggaggctctgacctatttcggcggcgctgtagcttcgaccatcggcttgattatgggaggaaccttactggcactgctcaggaaaagatttaggcagaaggacgatggtaagtgccctctgaatccccattctcacttgggcacatacggcgtgtttaccaatgctgccttcgatccctctccgtag

SEQ ID NO: 204467 - DNA, 1935 bp, Artificial Sequence
  Description of Artificial Sequence: Synthetic coding sequence
atggccaactgccagatcgccatcctgtaccagcggttccagcgggtcgtgtttggcatctcacagctgctttgcttttcagctctaatctctgaactgacgaaccagaaagaggttgcagcttggacttaccactatagcactaaggcctactcttggaatatatctaggaaatactgccagaaccgctatactgatttagtcgcaatacaaaacaagaacgaaatcgactacttaaataaggtactgccatattatagcagctactactggatcggaatacgaaagaataataaaacctggacttgggtgggtactaaaaaggctcttaccaacgaagctgagaattgggccgataacgagcctaataacaagaggaacaacgaggactgcgtggagatttatattaagtctccaagcgcacccgggaagtggaacgatgaacactgtcttaaaaaaaagcatgcactttgctacacagcctcctgtcaggatatgtcatgtagcaaacagggggaatgtttggaaactattggcaattatacatgtagttgctatccaggcttctatggcccagagtgtgaatacgttagagaatgcggggaactagaactaccccaacacgtgctgatgaattgcagtcatcccctcggaaatttttccttcaacagtcagtgctcatttcactgtaccgatggttatcaggtgaacggacccagcaagctggagtgcttagcttcaggaatttggacgaacaaaccaccccagtgcttagccgctcagtgcccccccttgaagatccccgaaaggggcaacatgacttgcctgcactccgccaaagcttttcagcaccaaagctcatgttctttttcatgtgaggaaggcttcgctctggtggggcctgaagtcgttcaatgcaccgctagcggtgtttggactgcccccgctccggtgtgtaaggccctccagtgtcaggatctgcccgtcccaaacgaagctagagtgaattgttcacatccctttggagcgtttcgatatcagtctgtctgcagcttcacctgcaacgaaggccttctgttggtcggagctagcgtgctccagtgccttgcaacagggaactggaacagcgttcctccagaatgtcaagctattccatgcacaccacttttatcccctcagaacggcacaatgacatgtgtccagcctctgggttcaagctcatacaaatcgacctgccagttcatctgtgacgaagggtattcattgtccgggcctgaacgcctggactgcactaggtccgggcggtggacagactctcctccgatgtgcgaagggatcgccagcttgccaaccccaggagttcaatgcccagcgctgactacccccggacaaggcactatgtactgcagacaccaccctggcacgttcgggttcaatactacgtgctactttggttgtaatgcaggcttcactcttatcggcgatagcaccttgagctgccgaccttcagggcaatggacagctgtgacaccagcctgtagagccgtcaagtgcagcgaactccatgtgaacaagcccatcgccatgaactgttccaacctgtgggggaatttctcttatgggtccatttgctccttccactgtcttgaaggtcagttgttaaacgggtccgcccagactgcctgccaggaaaacggacattggtccaccaccgtgccaacctgccaggccggacctcttactattcaggaagcactgacctatttcggcggagccgtggcatccaccatcgggctcattatgggggggaccttactcgctctgctcagaaaaagatttagacagaaagacgatgggaagtgccccttaaacccgcattcccaccttggcacatatggtgtgttcaccaacgccgctttcgatccgtccccttag

SEQ ID NO: 204468 - DNA, 2490 bp, Artificial Sequence
  Description of Artificial Sequence: Synthetic coding sequence
gccaactgccagatcgccatcctgtaccagcggttccagcgggtggtgttcgggataagccagcttctgtgtttcagcgcactgattagtgagctcaccaatcagaaggaggtggccgcctggacctatcattattctaccaaagcctattcatggaatatctcccgaaaatactgccaaaacaggtacaccgatttggtggccatccagaacaagaatgagatcgattatcttaacaaggtcttgccatactacagtagttactattggatagggattagaaaaaacaacaagacttggacgtgggttgggacgaaaaaagccttaacaaacgaagctgaaaattgggcagacaatgaaccaaataacaaaaggaacaatgaggactgcgtggagatctatattaagagcccatcagccccgggcaagtggaatgatgagcattgcctaaagaagaaacacgcactctgttatactgcgtcttgtcaggatatgagttgcagcaagcaaggggagtgtttggagacaatcggaaactacacctgctcctgttacccaggattctacggtcccgagtgcgaatatgtgagagagtgtggcgagcttgagcttccacagcacgtcctgatgaactgctctcaccccttaggcaatttctctttcaatagtcaatgtagctttcattgcactgatggctatcaggtgaacggaccttctaagctggaatgcctggcgtccggtatctggacaaacaaaccaccacagtgtctggcagcccagtgcccccccttaaagatcccagagaggggcaatatgacctgccttcactcagctaaagctttccagcatcagagtagctgtagtttctcctgtgaagaagggttcgccctcgtggggccagaggtggtacagtgcacagcgagcggggtgtggacggccccagcgccagtgtgtaaagcagtgcagtgccaacacctcgaggctccaagtgaaggcacaatggactgcgtccaccccctgacagcgtttgcttacgggagctcctgcaagtttgagtgtcagccaggataccgtgtccgcggcctcgatatgctccgatgcatagactccggccactggtcagcacctctcccaacatgcgaagccatcagctgtgaaccattggagtccccggtgcatggctcaatggattgcagtcctagtctgcgagcgttccaatatgacacgaactgttccttcagatgtgcagagggattcatgctcaggggagccgatatagtccgttgcgacaatctcggacaatggacggcaccggctcctgtttgccaggccttgcagtgccaagatttaccggttcctaatgaagccagagtgaactgttcacaccccttcggggcctttcgctaccagtccgtctgttctttcacttgtaacgagggtctgctcttggtaggcgcttctgtgctgcaatgcttggctactggtaactggaacagtgtgccccccgagtgccaggctataccatgtacacctctgctgtctccccagaatggaacgatgacttgtgtccagccattgggttcctcctcatacaagtctacttgtcaatttatctgtgatgagggctatagcctgagtggcccagagcgccttgattgtaccagatcgggtcgctggaccgacagtcctcctatgtgcgaggccataaagtgccccgagctgttcgcaccggagcaaggatcactcgattgcagtgacactcgcggtgaatttaatgtggggtccacctgccacttctcctgtgataatggctttaaacttgaagggccaaacaatgtggagtgtacgacttctggtcgctggagtgcaacccccccgacatgcaagggtattgcctctctgcccaccccaggcgtgcagtgccctgctctaaccacgcctgggcagggcactatgtactgcagacaccaccctgggactttcgggtttaatacaacatgctacttcggatgcaacgccggcttcacactcattggagatagcacactttcctgtaggccatcgggccaatggactgcagtgactccagcctgccgcgccgtgaaatgttcagagttacatgtgaacaagccaatcgcgatgaattgctcaaacctctggggaaatttttcctatggtagcatttgcagtttccactgcctggagggccaactgctaaatggtagcgctcagacagcatgtcaggaaaatggccactggagcactaccgtgcctacttgtcaagcaggaccattgaccatccaggaggccctcacttactttgggggtgctgtggcaagtaccatcggactcatcatgggtgggactctcctggcactcttgcgcaagcggtttagacagaaggatgacgggaagtgccctctgaatcctcatagtcatcttggcacttacggcgtctttaccaatgcagcgttcgacccgtccccttag

SEQ ID NO: 204469 - DNA, 1941 bp, Artificial Sequence
  Description of Artificial Sequence: Synthetic coding sequence
tgagccaactgccagatcgccatcctgtaccagcggttccagcgggttgtatttggcatttctcaacttctctgcttcagtgcactcatctctgagctgacaaatcaaaaagaggtggcagcctggacctatcactacagcacaaaggcttattcgtggaacattagccgcaagtactgtcagaatagatacaccgacctggtggctatccaaaacaagaatgagatagactacctcaacaaagttctgccttattactcttcatactactggatcggtattcgtaagaacaacaagacatggacctgggtggggacaaagaaagctcttactaatgaagccgaaaattgggccgataacgaacccaataacaaaaggaataacgaggactgcgtggagatatacatcaagtccccatccgcacccggaaaatggaatgacgagcattgcttgaaaaagaagcatgcactctgttatacagcctcttgccaggatatgtcatgctctaagcagggagaatgtctggaaaccattggcaattacacgtgctcttgctacccagggttttatggtcccgaatgtgagtacgttcgagagtgcggcgagctggaattgccacagcacgtgctgatgaattgtagtcacccgctcgggaatttctccttcaacagccagtgttcgttccactgcactgatggatatcaggttaatggtccttccaaactggagtgccttgcctccggcatttggaccaacaagccacctcagtgcctggcagctcagtgcccaccacttaagatacctgagcggggaaatatgacgtgtctgcattctgctaaggcgtttcagcaccagagttcctgttcgtttagttgcgaagaggggttcgctttggtggggccggaagttgtacagtgcaccgcgagcggcgtctggaccgcacccgctcccgtttgtaaagccatctcctgcgaacctctggagagcccagtccatggatccatggactgttcaccatcactgagagcctttcagtacgacactaactgcagctttagatgtgctgagggatttatgctgagaggggctgacattgtgcgatgtgacaacctggggcaatggactgcccccgcgcccgtgtgtcaggccctccagtgtcaggacttgccagttccaaatgaggctcgtgtgaactgcagccacccatttggagcgtttcgctatcagtcagtctgttctttcacgtgcaatgaaggccttcttctggtgggggcttctgtgttacagtgcttagcaacaggcaattggaactctgtgcctcccgagtgccagggtaagagcatcgcctcactgccaacccccggggtgcagtgtcctgccctgaccacccccggccagggaaccatgtattgccggcatcatcctggaacctttggtttcaacaccacgtgttacttcggatgcaacgccggattcacacttataggagactccacattgagctgtcgaccctccggccaatggactgccgtgacccccgcatgtagggccgtcaagtgctccgaactccatgtcaataagccaattgcgatgaactgcagcaacttatgggggaacttttcttatgggtccatctgtagtttccattgcctcgagggccagttgctgaacggctctgctcagaccgcgtgtcaggaaaatggccactggtccactaccgtccccacttgtcaggccggccccctgaccattcaagaggctctgacatactttggcggcgccgtggcatcaacaatcggattgatcatgggcggtaccctcctggcgcttctgcgaaagcgctttcgccagaaagatgacggaaaatgtcctcttaacccccattcccaccttggaacgtatggcgtgttcacaaacgcggcctttgatccttccccttag

SEQ ID NO: 204470 - DNA, 2262 bp, Artificial Sequence
  Description of Artificial Sequence: Synthetic coding sequence
gtggtgttcggcatcagccagctgctgtgcttcagcgccctgatctctgagctgaccaatcaaaaagaagtggcagcgtggacctaccactacagtaccaaagcctacagttggaatatctcacggaagtactgtcagaataggtatacggatctggtggctatacagaataaaaatgagatagattaccttaataaagtactgccatattactcctcttactattggattgggattagaaagaacaacaagacttggacttgggtgggcaccaaaaaagccctcacaaacgaagccgagaactgggccgacaatgaacccaataataagagaaataatgaagattgtgttgagatctatattaaaagcccctctgccccaggaaagtggaacgatgagcactgcttgaaaaaaaaacacgccttgtgttacaccgcgagttgtcaggatatgtcctgctctaagcagggcgaatgtctggagacgattggaaattacacgtgcagttgctatccaggcttctatggtcctgaatgcgaatacgtgcgagaatgtggcgaactggagcttcctcaacatgtcctgatgaactgttcgcaccctctcggcaacttttcctttaatagtcaatgctcctttcattgtactgatggatatcaagtcaatgggcccagcaagttggagtgcctggcttctggaatctggaccaacaaacccccccagtgtcttgccgcacagtgtccccctttaaaaatccctgaacggggcaacatgacatgtcttcatagtgctaaagcttttcagcaccagagcagctgttctttttcctgcgaagaagggttcgcccttgtcggtcctgaagttgtacagtgtactgctagcggagtctggacagctccagctccagtgtgtaaggccatctcatgtgagcctctggaaagccccgtgcatgggtccatggattgttcccctagcctccgagcattccaatatgacaccaactgctctttccggtgcgcagagggtttcatgctgcgtggggcagatatcgtacgatgtgataatctggggcagtggacggcccccgctccagtctgtcaggcacttcagtgtcaggatctccccgtcccaaatgaggcacgcgtcaattgcagtcatccatttggagcatttcggtatcagtccgtgtgttctttcacatgtaacgaaggcctcttacttgtcggtgcatccgtgctccagtgcctggcaacagggaattggaattctgtgcctccagagtgccaggccattccctgtaccccacttctaagcccccagaacggcacaatgacatgcgtgcagcccctgggctcaagtagttacaaatctacctgtcagtttatttgcgatgaaggatactctctctcaggcccggagagactggattgcacgcggtcaggtcgatggacggatagcccgcctatgtgcgaggctataaagtgcccagaactgtttgcacccgaacaagggagcttagactgctccgatacaaggggcgaatttaacgtcggctcgacttgccatttctcatgcgataacggctttaaactggagggcccgaataatgtggaatgcacaacctctggaagatggagcgctacaccccccacctgtaagggcattgctagtttgcccactccaggcgtgcagtgccccgcactgactactcctggacaggggactatgtattgccgccaccaccccgggaccttcggttttaatactacatgctacttcggatgcaacgctgggttcacactcatcggagacagcacgcttagctgccgcccttcaggacagtggaccgcagtgacaccagcttgccgtgctgtcaagtgcagcgaattgcacgtgaacaagcccatcgcaatgaattgctccaatctttggggcaatttctcttacggttcgatctgctctttccattgtctcgagggccaactcctcaacggcagcgcacaaaccgcttgtcaggaaaacggccactggagtactaccgtgcccacttgccaggcgggacccctcactatccaggaggcgctaacttattttggaggggccgttgcctccaccattgggctgattatggggggcacacttctcgccttactgcgcaaacgttttcgccagaaggacgatggcaagtgccccctgaaccctcacagccatttggggacttatggggtcttcacaaacgcagcgttcgacccaagcccctag

SEQ ID NO: 204471 - DNA, 2373 bp, Artificial Sequence
  Description of Artificial Sequence: Synthetic coding sequence
atggccaactgccagatcgccatcctgtaccagcggttccagcgggtggtcttcgggatcagccagttgctctgtttttcagctctgattagcgaactgaccaaccaaaaagaggtagccgcctggacctaccattacagcacaaaagcatactcttggaatataagccgtaagtattgtcagaatcggtacactgacctcgtcgcgattcagaacaagaacgaaatcgactacttgaacaaggtgctcccctactactcgtcatactactggatcggcattaggaagaataacaagacttggacttgggtcggcaccaagaaggccctcacgaacgaagcagagaactgggccgataacgagcccaacaacaagaggaataacgaggactgtgtggagatatacattaagtcccctagcgcccccggcaagtggaatgatgagcactgtcttaaaaagaagcatgccctgtgttataccgctagctgtcaagacatgagctgctctaaacagggagagtgcctcgagaccattggtaattatacatgctcctgctatcctgggttctatgggccagaatgtgaatacgtgagggaatgtggcgaactcgaactgcctcagcacgttctgatgaactgctcgcatcctctggggaacttttcctttaatagccaatgttcatttcactgcacagatgggtatcaggtaaatgggcctagtaaattggaatgcctggcgtcaggtatttggacgaacaaaccacctcagtgtctggccgctcagtgtccacctcttaaaatccccgagaggggaaatatgacctgcctgcattctgccaaggcctttcagcaccagtcctcctgttccttctcttgcgaggaagggtttgcccttgttgggcccgaagtggtccagtgcaccgcgagtggggtgtggacagccccggccccagtctgtaaagctgtgcagtgtcagcatctggaagccccttcagaaggaacaatggactgtgtccatcctctgaccgctttcgcctacggctcctcctgcaagttcgagtgccagcccggataccgcgttcgggggctcgacatgctgcgatgcatcgattccggtcattggtccgcacccctgcccacttgtgaagccatctcatgcgagccacttgagtctcccgtccacggttcgatggattgctcaccctccctgcgggctttccagtatgacactaattgcagctttagatgcgcagaaggatttatgctacgcggagccgatattgtacggtgtgataatttaggacagtggactgcccctgcccccgtgtgccaagccctgcagtgtcaggatctaccagtgccaaatgaggcacgcgtaaattgttcccacccttttggggcctttcgttaccagtcagtgtgcagttttacttgtaacgaaggcctgcttctcgttggagcatccgtgctgcaatgcctggccaccggaaactggaattctgttcccccggagtgccaggccatcccatgcacccccctcctatccccgcagaacggaaccatgacttgcgtgcagcctctgggatctagttcgtataaaagtacatgtcagtttatttgtgatgagggatactctctcagtggccctgaacgactcgattgtaccagaagcgggagatggaccgactctccacccatgtgtgaggccatcaaatgtccagaactttttgcccccgaacaaggaagcctggattgtagtgacacacgcggcgagttcaatgtgggatccacgtgccacttctcctgtgacaacggtttcaaacttgagggtcccaacaacgtggagtgcactacttccgggcgctggtctgctaccccgcctacctgcaaagggatagctagtcttcctacaccgggggttcagtgcccagctttaactactccaggacaggggactatgtactgtcgtcatcaccccgggacattcgggttcaacactacctgttatttcggatgcaacgcaggctttacactcattggagacagcacactcagttgccggccgagcggccagtggaccgccgtgacgcccgcgtgcagagctgtcaagtgttctgagcttcacgtgaacaaaccaattgcaatgaactgctccaacctgtggggaaatttcagttatggatccatctgtagttttcattgcctggagggacaactgctgaacggaagtgcacagacagcctgtcaggagaacggccactggtcgactaccgtgcccacctgtcaagatgatggcaaatgcccactgaacccccactcacatttggggacttacggggttttcacaaacgccgcctttgaccctagcccctag

SEQ ID NO: 204472 - DNA, 450 bp, Artificial Sequence
  Description of Artificial Sequence: Synthetic coding sequence
atgatgaccaagcacaagaagtgcttcatcatcgtgggcgtgctgatcactaccaatataataacgctaatcgtcaagctgacaagagattcccaatctctgtgcccctatgactggattggattccagaacaagtgttactacttttcgaaggaagaaggcgattggaactctagcaagtataattgctcaactcagcacgccgatctgacgatcattgacaatatcgaggagatgaacttcctccgtcgctacaagtgttcctcagaccattggattggactgaagatggcgaagaaccggactgggcagtgggtggacggtgctacattcaccaagagtttcgggatgcgcgggtctgaaggctgtgcctacctatccgacgacggggccgctactgccaggtgctacaccgagaggaagtggatctgccgtaaacggatacattag

SEQ ID NO: 204473 - DNA, 1209 bp, Artificial Sequence
  Description of Artificial Sequence: Synthetic coding sequence
atgcccctgcagctgctgctgctgctgatcctgctgggccccggcaacagtttgcaattgtgggatacatgggctgacgaggctgaaaaggccctcgggcctctgctcgccagagatcgtcggcaggccacggagtacgaatatctggattatgactttctcccggaaactgagccaccggagatgctaaggaatagcaccgatacgacgcccttgaccggaccggggacccccgaatcgacgactgtggagcctgcagcccgccgctctacaggactggatgctggcggggcagtgaccgaactgacaactgaactcgcaaatatggggaaccttagtacagattctgctgccatggagatccagaccacacagcctgccgctaccgaggcgcagacgaccccgcttgcggccaccgaagcccaaaccacgagactgaccgccacggaagcccagactacaccactggctgccacagaggcgcagaccacacctcccgctgctactgaagcccagaccacacagccaacagggctcgaggcccagactacagctcctgccgctatggaagcccaaacgactgctcccgctgccatggaagcccaaacaacacctcctgccgctatggaagcacagaccacccaaacaacagcgatggaggcacaaaccaccgctcccgaggctaccgaagcccagacaacccagccaacagctactgaggctcagaccactccactggccgccatggaagcactgtccacagagccttccgcaaccgaggccctctccatggaacccaccacaaaaagggggctgtttattcctttttcagtgtcctccgtcacacataagggaatacccatggccgcgtccaacttgagcgtcaactaccccgtgggggccccggatcacatatccgttaagcagtgtctgctcgcaatcctcattttggctttagtcgcaacaatcttctttgtctgcacggtggtcctcgccgtgcgtctgagtcgcaagggacatatgtaccccgtgagaaattactctcccacagaaatggtgtgcatcagtagcctgttaccggatgggggggaaggtcccagcgccactgctaacggcggtctatcaaaggctaaatcccccggattgacacccgagccaagggaagatcgggaaggcgacgacctaacgctgcattcgtttttaccctag

SEQ ID NO: 204474 - DNA, 1239 bp, Artificial Sequence
  Description of Artificial Sequence: Synthetic coding sequence
atgcccctgcagctgctgctgctgctgatcctgctgggccccggcaatagcctccagctctgggacacatgggcggatgaggccgaaaaagctcttggccccctcctagccagggatcggagacaggcaacagagtatgagtacttggattacgactttctgccagaaactgaacctccagaaatgctgaggaactccacagataccactcctctgacaggaccaggaactccggaatcaaccacagtagaacccgccgcacgaagatctaccgggcttgatgcagggggcgctgtgaccgagttgaccacagagctggcaaacatggggaatctctctacagacagtgcagccatggaaatccagactacccagccggctgccacagaggctcagactacgcagcctgtgccgacagaggcacagacaaccccgctggctgctactgaggcgcagaccacaagactgactgcgaccgaggcccagacaaccccactggcagcaaccgaagctcagaccaccccacctgctgccacagaagcacagactacacagcctaccggactcgaggcacagacaacggccccagccgcaatggaagcccagaccacagctccagcagcaatggaagcacagacaactccccctgctgcaatggaggcccagaccacacaaaccaccgccatggaagcgcagactacagcccccgaggccacggaagctcagacaacacagcccactgctaccgaagcacaaacaacccctcttgccgccatggaggccctgagcactgaaccctctgcaacagaagctctatccatggagcccaccaccaaaaggggcctctttatcccattcagcgtttcttcagtaacacataagggaataccaatggccgcctctaatctgtctgtgaactaccctgttggagcccctgaccacatttccgtcaagcaatgtctgttagcaatcctcatccttgctctcgttgccactatcttcttcgtgtgtacagtggtcctcgctgtgcggctgagtcggaaggggcacatgtaccctgtccggaactacagtcccactgagatggtgtgcatcagcagtctacttccagacggaggggaagggcccagtgccacagccaatggaggcctgtctaaggcaaaatcacccgggctgacacccgaaccaagggaggatcgggagggcgacgatttgactctgcattcatttttgccttag

SEQ ID NO: 204475 - DNA, 1419 bp, Artificial Sequence
  Description of Artificial Sequence: Synthetic coding sequence
atggccaccaagtgcggcaactgcggccccggctacagcacccccctggaggccatgaaaggcccacgggaggaaattgtatatctgccctgcatctacagaaataccgggactgaagcccctgattacttggctactgtggacgtcgacccgaaatcccctcagtattgtcaggtcatacaccgcttgccaatgcctaatctgaaagatgagctgcaccacagcggttggaacacttgctcaagttgctttggcgatagcaccaagtcaaggaccaagctagtgctgccatctcttatctcctcccgtatatatgtcgtcgacgtggggtctgagcctcgggcccctaaattgcacaaggttattgagccaaaagacatccacgccaagtgtgagctggcatttctgcatacttcacattgcctggccagcggagaggtgatgatctcaagcctgggcgacgtaaagggaaacggtaagggtggatttgtgttgctagatggcgaaacttttgaagtgaaggggacttgggagaggccaggtggggcagctcctctggggtatgatttctggtaccagcctagacacaacgttatgatctccacagaatgggcagcgcccaacgtactgcgcgacgggttcaatcctgccgatgtcgaggccggactgtacggatcccacctgtatgtctgggactggcagcgccatgaaatcgtccaaacactaagcctgaaggacggccttatacctctggagatccgctttctccacaaccctgatgcagcacagggcttcgtaggttgtgcgttatcatctaccatccaacgcttttacaagaacgagggtggcacatggtcagtcgagaaagtgatccaagtgccaccgaaaaaggtgaaggggtggctcctccctgagatgcccggactcattactgatatcctactgtctctagacgacagattcctgtacttttcaaactggttacacggggaccttcgccagtacgacatctcagatccccaacgacctaggcttactggccagctgttcctgggcggtagcatcgtgaaggggggcccggtccaagttttagaggacgaagagttgaaaagtcagccggagcccttagtggttaaagggaaacgcgttgccggaggtcctcagatgatccaactgtcactggacggaaagagattgtatataaccactagtctttacagcgcctgggataagcagttttacccagatctaattcgcgaaggatcggtcatgctgcaggttgacgtggataccgtgaaggggggcctcaaactgaacccaaacttcctggtagatttcggcaaggagcccctgggaccagccctcgcccacgagctcagatacccaggcggagactgttcctctgacatctggatctag

SEQ ID NO: 204476 - DNA, 1227 bp, Artificial Sequence
  Description of Artificial Sequence: Synthetic coding sequence
atgcccaacctgaaggacgagctgcaccacagcggctggaacacctgttcttcctgcttcggggatagcactaagtcaagaacgaaactcgtgcttccaagcctgatctccagtagaatttacgtggtagatgtgggatcagagccaagggctccgaaactccacaaggtcatcgaaccaaaagatatccatgccaagtgcgagctggcgtttctgcacacgtctcactgtctggctagtggggaagtcatgattagcagcttgggagatgtaaaaggcaatggcaaaggcggattcgttctcttggacggggagacctttgaagtgaagggaacttgggaaaggcctggcggagccgcacctctggggtacgacttctggtatcagccacgccacaacgtcatgatcagcactgagtgggcggcaccaaatgtacttcgcgacgggtttaatcccgcagatgtggaagccggactctacggatcacacttgtatgtgtgggactggcagagacacgaaattgttcagacgttatcattaaaggatggactgattcccctggagatccggttcctccataatcccgatgctgctcagggctttgttgggtgtgccctgtcctccacgatccagcgtttttacaagaatgaggggggtacttggtccgttgagaaggtcatccaagttcccccaaaaaaagtgaaaggctggctcctccccgaaatgcccggcctgatcactgatattctgctgtcactggatgaccggttcttatatttctcaaactggctccacggcgacctcagacagtatgacatcagcgatccccaaagacccagactcactggtcagctctttctgggcggtagcatcgtcaaaggaggaccagtgcaggtgctggaggatgaagagttgaaatctcagccagaaccacttgtagttaaaggtaagagggtggctggaggaccccagatgatacagctctccctcgatggcaagaggctctacatcaccacatccctttactctgcttgggataaacagttctatccagacctgattcgggaggggtcagttatgctccaggtcgacgttgataccgtaaaaggcggtcttaagcttaatccgaactttctggtcgattttggcaaagagccgttgggaccagcattggctcatgagctgagataccccggtggagattgctcttctgatatttggatctag

SEQ ID NO: 204477 - DNA, 1233 bp, Artificial Sequence
  Description of Artificial Sequence: Synthetic coding sequence
atggccaccaagtgcggcaactgcggccccggctacagcacccccctggaagccatgaaagggcccagagaggaaatcgtctatctcccgtgcatttacaggaacactggcacggaggcaccggattatctcgctaccgttgatgtggaccccaagagcccgcagtattgtcaggtgatcgagcccaaagacatccacgccaaatgcgaactggccttccttcacacatcccattgcttggccagcggggaggtcatgatcagtagtctgggcgacgtcaaaggaaacgggaagggggggttcgtgctgttggatggagaaaccttcgaagttaagggcacatgggagagaccaggcggcgctgccccactcggatatgacttttggtaccaacctcgacataacgttatgatatcaacagagtgggcggctcccaatgtgctgcgagacggcttcaatcctgccgacgtggaagccggactgtacgggtcgcacctctacgtgtgggactggcaaaggcacgaaatcgttcagacattgagcctgaaagacgggcttatcccgctagagatcaggttcctgcacaaccctgacgctgctcagggctttgtgggttgcgctctatcaagcactatccaaagattctacaagaacgaggggggtacatggtccgttgaaaaggttatccaggttccacctaagaaagttaaggggtggctgttaccagaaatgccaggcttgatcactgacatactgctgtcactggatgatcgtttcctgtacttctctaattggttacacggcgatctgaggcaatacgatattagtgatcctcagcgcccgcggttaaccggccaactgttcctgggaggttctattgtgaaaggggggcccgtgcaggtactggaagacgaagaactgaaatcacagccagagcccctcgttgtcaagggcaagcgggtggccggaggcccgcagatgattcagttatcactggacggtaaacgtctttatattaccacaagcttgtactccgcttgggacaagcaattttaccctgacctgatcagagagggatctgttatgctgcaggtcgacgtggatactgttaagggagggttgaaactcaacccaaatttcctggtggactttgggaaagagccattggggcccgctctggcccatgaactgaggtaccctggaggcgattgctcgagcgacatttggatctag

SEQ ID NO: 204478 - DNA, 1362 bp, Artificial Sequence
  Description of Artificial Sequence: Synthetic coding sequence
atgcccggcagcagcggcgccggcatggaggccgccgtggcccccgggagagatgcaccagcccctgcggcctctcaaccttcaggatgcgggaagcacaatagcccagagcgtaaggtgtacatggactacaatgccacgacccctttggaaccagaggtgatccaagccatgacaaaggctatgtgggaggcctgggggaatccttcttccccttattcagcaggaaggaaggcaaaagatattatcaacgcagccagggagagcttagctaagatgatcggcggaaaaccccaagatattatctttactagtggtggaaccgagtctaataacctggtgatccactcagtggttaaacactttcatgccaatcagacatcaaaagggcacactggagggcaccattctccagtgaagggggcaaaaccacactttatcaccagctccgttgaacacgactcgattagattgccgctggagcacctggtcgaggagcaagtagctgctgttacattcgtgccagtgtctaaggtgagcgggcaagcagaggttgatgatattctagctgctgtgaggcccactacaaggttggtcaccattatgctcgctaataatgagactgggattgtgatgcctgtgccggagattagtcagagaattaaggcccttaatcaggagagggtggctgctgggcttccacccatcctggttcacactgacgccgcccaggctctgggcaagcagcgggtggacgtagaggacctgggggtggactttctcactatcgttggccataaattctacggcccccgcattggcgcgctgtacatccgcggattgggagaattcacacccctttaccctatgttatttggaggcggccaagagaggaattttcgtcctggtaccgaaaacacgccaatgatcgctggcctcggaaaagccgctgaactggtcactcagaactgtgaagcttacgaagcacacatgcgagacgtgcgcgactaccttgaggaaaggctggaggctgagtttggacaaaaacgcatccatctcaacagtcagttccccggtacgcagaggctgccgaatacatgtaatttcagcataagaggcccaaggctgcagggacatgtggtccttgcccaatgtcgggttctgatggcttcggtgggggcagcttgtcatagcgatcacggagaccagccctccccagttttgctctcctatggagtgccatttgacgtcgcacgaaatgcccttagactgtcggtggggagatcaaccacgagggccgaagttgacctcgtggtacaggacctaaagcaggcagttgcccagttggaggatcaagcatag

SEQ ID NO: 204479 - DNA, 708 bp, Artificial Sequence
  Description of Artificial Sequence: Synthetic coding sequence
ttcagcaaccccttctgcggcgagaccttcccccggaagcccgacctgaagggaacacatagatgggcacctcaaccttccgaaggagggcaggccccctttcattattttttgggaggaacacggctgcaccccgccgctccaggagcaccaggagggcgaacttccggctccctcctaaacgtgaaaatgatgaagatgaaaacctttatgatgatttgcttccatctgatcaacactgtcactttcgtgccggtgtccaaagtgtccggacaagccgaggtggacgatatccttgcggctgtcagacctaccacacgtctggtcacgatcatgctggcaaataacgagactgggattgttatgccagttcccgaaatctcacagcgtatcaaggccttaaaccaggagcgtgttgctgctggcctgcccccaatcctggttcatactgacgccgctcaagctctgggcaagcagcgggtggatgtggaagacctgggcgtcgactttttgacgatcgtggggcataaattttacggcccaaggatcggcgcactttatatcagggggttaggagaattcacccccctgtaccccatgctgtttggaggggggcaggagcgcaattttcggcctggaacggagaacacacctatgatcgccggacttggaaaggtcagtccaggtgaattggaggagatgtcatag

SEQ ID NO: 204480 - DNA, 954 bp, Artificial Sequence
  Description of Artificial Sequence: Synthetic coding sequence
atggaggccgccgtggcccccggccgggacgcccccgcccccgccgcatcacagccgtcaggttgcggtaaacacaactcgcctgaacggaaggtatatatggactataatgccaccacaccactcgagccagaagtgatccaagccatgacgaaggcaatgtgggaagcgtggggaaatccaagtagcccatactctgctgggcgcaaggctaaggatatcattaatgcggctcgggagtcgctggcaaagatgattggcggcaaaccacaggacattatctttaccagtgggggcaccgagtcgaataacctggtcattcacagcgtggtgaagcactttcatgccaaccaaaccagcaaggggcatacaggaggccatcactctcctgtgaagggcgccaaacctcactttatcacatcttctgttgagcacgattcaatcagattgcccctcgagcacctggtagaagaacaggtcgccgctgtcacattcgtgcccgtgtccaaggtaagcggacaagccgaagttgatgatatcctggcagcagtacgaccgacgactcggctcgttaccataatgcttgcgaataacgaaaccggcattgtgatgcctgtgcctgaaatcagtcaaagaatcaaagctctcaaccaggagcgcgtcgctgccggcctccctcccattctggtgcataccgacgccgcacaggctcttggtaagcagcgcgttgatgtcgaggacttgggcgttgactttctgacgattgtgggccataaattttacgggccccgtattggcgccctttacattcgcggcttgggagagttcactcctttgtatccaatgttgttcggcggtggccaggagcgcaacttccgtcccggaacagaaaacacgcccatgatagcaggcctgggcaaggtgtcccccggggagttggaggaaatgagctag

SEQ ID NO: 204481 - DNA, 1056 bp, Artificial Sequence
  Description of Artificial Sequence: Synthetic coding sequence
atggaggccgccgtggcccccggccgggacgcccccgcccccgccgcttcacaaccgtccgggtgcggcaagcacaatagcccagagcgaaaggtttacatggactacaatgctacgacccctctggaaccagaggtgatacaggccatgactaaggcgatgtgggaagcctggggcaatccgtcttcaccctattccgcggcagtaacatttgtcccagtgtccaaggtctcaggccaagccgaggtggatgatatccttgccgcagttaggcccaccaccaggctggtcacaattatgctggcaaataatgagaccggtatagtgatgccagtacccgaaatctcacagaggattaaggccctgaatcaagagcgagtggccgccgggctgccacctatactggttcatacagatgccgcacaggcccttgggaaacagcgcgtcgacgtggaggatctgggggtggactttctgactatcgtgggccataagttttatggccctagaatcggcgccttgtacattagggggctgggcgagtttacacccctatatcctatgctgtttggtggcgggcaggagcggaatttcagaccgggcactgagaacacgcccatgatagctggactcggaaaggcggctgagcttgttacccagaactgtgaagcttatgaagctcatatgagagacgtgcgagactacttggaagaaagactggaggccgagttcggccagaagcgcattcacttgaatagccaattccctggcacccagaggttgcctaatacgtgcaatttcagcattcggggcccccgtcttcagggacacgttgtgctagcacagtgccgcgtgctgatggcatctgtcggggcagcatgccattccgaccatggggaccagccttctcctgtgctgctgagctatggcgtgcccttcgacgtcgcacgcaatgctcttagactctctgtaggtcgctcgaccacgcgggctgaggtcgatctggttgtccaggacctgaaacaggccgtggcacagctcgaggaccaggcctag

SEQ ID NO: 204482 - DNA, 720 bp, Artificial Sequence
  Description of Artificial Sequence: Synthetic coding sequence
atggaggccgccgtggcccccggccgggacgcccccgcccccgccgctagtcagcccagcgggtgcggaaagcataattctccagagagaaaggtgtatatggattataatgcaacaacccccctggagccagaagtcatacaagccatgaccaaagcaatgtgggaagcttggggaaatccttcctcaccctacagcgccggcaggaaggcaaaagacatcattaacgctgcacgggagtcactggccaagatgatcgggggcaaacctcaggacattatcttcacctccgggggaacggaagctgctgagctggttacacaaaactgcgaggcctacgaggcccatatgagggatgtccgagattatctggaggagcgcttggaagccgaattcgggcagaagcgcattcacttaaacagtcagttcccagggacccagagactcccaaacacatgtaacttttctataagaggacctaggttgcaggggcatgtggtactagcccagtgtcgcgtgcttatggcctcagttggcgcagcgtgtcacagtgaccatggagaccaaccctcgccagtgttgctatcctatggcgtccccttcgatgtggcccgaaatgcgctgcgactgtccgtcgggcggtctaccacccgtgccgaggtggacctggtcgtccaggacctcaagcaggcggtggcccagctagaagatcaggcctag

SEQ ID NO: 204483 - DNA, 1338 bp, Artificial Sequence
  Description of Artificial Sequence: Synthetic coding sequence
atggaggccgccgtggcccccggccgggacgcccccgcccccgccgccagtcagcctagtggctgcgggaaacacaacagtcccgaaaggaaggtgtacatggactacaacgctaccacgccactggagccagaagtgattcaggccatgaccaaggccatgtgggaagcatggggaaacccctcctctccatacagtgcggggcgtaaggctaaagacatcatcaatgctgcccgcgagtcccttgcaaagatgattggcggcaagccacaggacataattttcacgtcaggaggcaccgagtcaaataatctcgtcatccattctgtcgttaagcactttcacgctaatcagactagtaaaggacacacaggtggccaccactcaccagtgaaaggagccaaaccacactttatcacgtcttcagtggaacatgatagtataagactgcccctcgagcacttagtggaggagcaggtggctgccgtgacttttgtccctgtttctaaggtgagtgggcaggccgaggttgacgacatccttgccgcagtgcgtccaaccacccgactggtgacaatcatgttagcaaacaacgagactggtatagtaatgcctgtgcccgaaatctcccagcgcatcaaggccctgaaccaagaaagagtcgcggctggacttccacccattctagtgcacacagatgccgcccaggcgttaggaaagcagagagtggacgttgaggacctgggagtggatttcttaactattgtgggtcacaagttctatggcccacgcatcggcgcactttacattcggggcctgggagagtttacccctttgtaccctatgttgttcggcggcgggcaggaacgcaattttcgacccggtaccgaaaatactccaatgatagccggcctgggcaaggctgccgaactcgttacacagaactgtgaagcctatgaggctcacatgcgggatgtaagggactaccttgaggagcgtctggaggctgaatttgggcagaaaaggattcatctaaattcacagttccccggaactcagcgactgcccaacacatgcaatttttctatacgaggccccagactgcaaggccacgtcgtcttggcacagtgccgcgtcctgatggcaagcgtgggagccgcatgtcatagtgatcacggcgaccaacccagccccgtcttactgtcatatggagtgcctttcgacgtagcgcggaatgccttaaggctcagcgttggacgtagcaccacccgtgccgaagtggatttagtggtgcaggacctaaaacaggccgtcgcgcagctggaggaccaggcttag

SEQ ID NO: 204484 - DNA, 966 bp, Artificial Sequence
  Description of Artificial Sequence: Synthetic coding sequence
atgagcacccgggagagcttcaaccccgagagctacgagctggacaaaagcttccgcctcacaaggttcacggagctgaaaggaaccgggtgcaaggttccccaggacgtgctccagaaactgctggagagtttacaggagaatcacttccaggaagacgaacagttcctgggggcagttatgcctaggttggggattggaatggacacatgtgttatccccctgagacacggcgggctgtcattggtgcaaacgacagattacatttacccaatcgtggatgatccctacatgatgggacgtatcgcttgcgccaacgtcctttcagatctgtacgctatgggcgtgactgaatgcgataacatgctaatgctgctgggggtgtccaacaagatgacagaccgcgagcgggataaagtaatgccgttgattatccagggcttcaaggacgccgctgaagaagccgggacaagcgtgaccggcggccaaactgtgttaaatccatggattgtattgggcggcgtcgctacaactgtgtgtcaacccaacgagttcatcatgcctgacaacgccgtcccgggtgacgtccttgttctgacaaaaccattgggcacacaggtggcagtggccgtacatcagtggctagatatcccagagaagtggaataaaatcaagctcgtggtcacacaggaggatgtcgagttggcctatcaagaggctatgatgaacatggcacgcctgaaccgaaccggaggtctgcttatttgcttacctcgggaacaggctgcacgcttttgtgcggagatcaaaagtccaaagtacggagagggccatcaggcatggataattgggatagtagaaaagggaaataggacggcacgcatcatagacaagccaaggatcattgaggtggcgccacaggttgctacgcagaatgtgaatcctacacccggagctactagctag

SEQ ID NO: 204485 - DNA, 1179 bp, Artificial Sequence
  Description of Artificial Sequence: Synthetic coding sequence
atgagcacccgggagagcttcaaccccgagagctacgagctggacaagtctttcagactgaccagattcactgaactgaagggaaccggatgcaaggtgccccaagacgtgttgcagaaacttctggaatcactccaggagaaccatttccaggaggacgaacaattccttggcgccgttatgcctagacttgggatcggaatggacacatgtgtgatacctctgcggcatggagggcttagcttggtccagactactgactacatctatccaatagtggatgatccctacatgatggggaggattgcgtgtgcaaacgtcttgagtgatctgtatgccatgggggtgactgagtgtgacaatatgctgatgctgcttggcgtctctaacaagatgacggatagagaacgggataaggtcatgcccctgatcatacagggctttaaagacgccgccgaagaggctggaacctccgttaccgggggacagactgtcttgaacccctggatcgtcttgggcggagtggctactaccgtgtgccagccaaacgaatttatcatgcctgacaacgctgtgccaggcgacgtgctggtgctcaccaaacctttgggtacccaggtggccgtagccgttcaccaatggcttgacattcccgaaaagtggaacaaaattaagctggttgtaacccaagaggacgttgaactggcctatcaagaggccatgatgaacatggcccgactgaaccgaacagctgcggggcttatgcacacattcaatgcacacgctgccactgacatcaccggcttcggtatactgggccacgcacagaacctggccaaacagcagcgaaatgaggtaagctttgtaattcacaatctcccagtgctcgctaagatggctgcagtaagtaaggcatgcggtaacatgttcggcttaatgcatgggacttgccctgaaaccagtggaggtctgcttatctgtcttcctagagaacaagctgctaggttctgcgctgagatcaagagccctaaatatggcgaaggccatcaggcctggatcatcggcatcgtcgagaaaggtaatcgaacggccaggatcatagataaacctcgtattatagaggtagcgccccaggtcgctacccagaatgttaatcccacaccgggtgccaccagctag

SEQ ID NO: 204486 - DNA, 966 bp, Artificial Sequence
  Description of Artificial Sequence: Synthetic coding sequence
atgagcacccgggagagcttcaaccccgagagctacgagctggacaagtccttcagactgacgaggttcaccgagctcaagggcaccgggtgcaaagtgccacaggacgtgctgcaaaagctgctcgagtctctgcaggagaaccactttcaggaggacgagcagtttcttggcgcagtgatgcccagactagggataggcatggacacttgcgtaatccccctgcggcacggggggctatcactagtacaaacaacagattacatctacccaattgtggatgacccctatatgatggggaggatagcctgcgcaaatgtgttgtcagacttatatgcaatgggtgtgaccgagtgtgacaacatgctcatgctccttggggtttccaataagatgacagatcgggagcgagacaaagtgatgcccctaattattcaggggtttaaagacgcagctgaagaagctggcacaagcgtgaccgggggacagacggttttaaacccctggattgtgctcggcggcgtagccaccactgtgtgtcaacctaatgaattcatcatgccggacaatgccgtgcctggcgacgtactggtgctcactaaacccctagggacgcaggtggccgtggcagtgcatcagtggctggatatcccagaaaaatggaataagatcaagctagtggtgacccaggaagatgtagaattagcatatcaagaggcaatgatgaatatggcaagacttaatagaaccggaggtctcctaatatgtctgccacgagaacaggccgccagattttgtgcggagattaaaagtcccaagtacggcgaaggacaccaagcttggatcattggaattgtggaaaaaggaaacaggacggctcggattatcgacaagccaagaatcatcgaggtggctccacaagtggccacccagaacgtgaacccaacacctggcgcgacatcttag

SEQ ID NO: 204487 - DNA, 501 bp, Artificial Sequence
  Description of Artificial Sequence: Synthetic coding sequence
atgagcacccgggagagcttcaaccccgagagctacgagctggacaagtctttccggttgactcgattcacggagctgaaggggaccggctgtaaggtcccccaagacgtgctgcagaaactgctcgaaagcttacaggaaaaccattttcaggaggacgaacagttcctgggggctgtcatgcctcggctgggcataggcatggacacttgcgtaatcccattgagacacggtggcctgtcactagtgcaaacaaccgactatatttaccctattgtggatgacccttacatgatggggagaattgcgtgcgctaatgtactgtccgatctttatgctatgggggttacggaatgcgataatatgctgatgcttctgggcgtatccaacaagatgactgacagagagagagacaaggtgatgccactgattatccagggatttaaagacgcagccgaggaggccggtacaagcgtcactggcggccagaccgtactatag

SEQ ID NO: 204488 - DNA, 279 bp, Artificial Sequence
  Description of Artificial Sequence: Synthetic coding sequence
atggacacctgcgtgatccccctgcggcacggcggcctgagcctggttcagaccacagattatatttaccccatagtcgacgacccatacatgatgggacgaattgcttgcgccaatgtcctgagcgatctgtatgccatgggagtgactgagtgtgacaacatgctgatgctcttgggcgtgtctaacaaaatgactgacagggaaagagataaggtaatgccccttatcatccagggattcaaagatgcagctgaggaggccggtactagcgtgtag

SEQ ID NO: 204489 - DNA, 978 bp, Artificial Sequence
  Description of Artificial Sequence: Synthetic coding sequence
atggacacctgcgtgatccccctgcggcacggcggcctgagcctggttcaaaccacagattacatatacccaatcgtggacgatccatatatgatgggaagaattgcttgtgctaacgtcttgtcagatctgtatgccatgggggtcacggagtgtgataacatgctgatgctcctcggtgtgtctaacaaaatgacggacagggagcgagacaaggtcatgcccttgattatccagggcttcaaagacgccgcagaagaagccgggacttccgtgaccggaggccagactgtcctgaacccctggatcgtattaggcggggtggccaccacggtgtgtcagccaaatgaattcatcatgccggataacgccgtccccggagatgttcttgtgcttaccaaaccgcttggcacacaggtggctgtagccgtccaccaatggctggacatccctgaaaagtggaacaagattaagttggttgtcacccaggaggatgtggagttagcataccaggaggccatgatgaatatggcacgtttgaacagaaccgctgccggtctgatgcacacttttaacgctcacgcagccactgatatcactggatttggcatccttgggcatgcacagaacctcgccaagcaacagagaaacgaggttagttttgtcatccataacttacccgttctggctaagatggccgctgtttctaaagcttgcggcaatatgttcggactgatgcatggcacctgcccggagacctccggtggcctgctaatctgcttgccgcgggaacaggctgcgcgtttctgcgccgagattaaatcccccaagtatggagagggacaccaagcttggatcattggcatagtggagaagggtaataggacagccaggatcattgataaaccacggattatcgaggtagcaccccaagtcgcaacacagaatgtgaaccccactcctggagcaacatcctag

SEQ ID NO: 204490 - DNA, 975 bp, Artificial Sequence
  Description of Artificial Sequence: Synthetic coding sequence
atgagcacccgggagagcttcaaccccgagagctacgagctggacaagagttttcggctgacacgcttcacggagctgaaaggcactggttgcaaagtgccacaggacgtactccagaagctcctggagtcactacaagaaaaccacttccaggaggatgaacagttcctgggcgcggtgatgcccagattagggatcgggatggatacgtgcgtcataccactgagacatggcggactcagccttgtgcaaacaacagactatatctaccctattgtggatgacccctacatgatggggcgaatcgcttgcgccaatgtgctgtcggacctgtatgccatgggggttaccgagtgtgataatatgctgatgctgctgggcgtgtcaaacaagatgaccgatcgcgaacgcgataaggtaatgcctttaattatacagggcttcaaggacgcagccgaggaggctgggacgagtgttactggagggcagacggtgcttaatccttggatcgtcctgggaggagtggccacaaccgtgtgtcagcctaatgaattcatcatgcctgacaacgcagtgcctggggatgtactggtgctgacaaagcctctcgggacacaggtggctgtggcggttcatcagtggttagacatacccgaaaaatggaataaaatcaagctggttgttacgcaagaagatgttgagctcgcatatcaggaagcaatgatgaacatggcccgcctgaatagaactgctgctgggctaatgcacaccttcaacgcccatgcagccacagatatcaccggattcggaatactgggacacgcccagaatctagccaagcagcaaagaaacgaagtttcattcgtgattcataatctccccgtccttgcgaaaatggccgcagtttcaaaggcttgcggtaacatgttcggattgatgcacggaacctgcccggagacgtccgacgtccaatag

SEQ ID NO: 204491 - DNA, 1200 bp, Artificial Sequence
  Description of Artificial Sequence: Synthetic coding sequence
atggccgaggccagcgccaccggcgcctgcggcgaggccatggccgccgctgagggaagtagtggcccagccggccttacgctgggaaggctgaccggattctctggtatgaaaggactggtgggtgggcaggaggaggcaagtcaagaggcaggattaccagcaggcgcaggtccttcccccaccttcccagctttggggatcggcatggactcctgcgtgattccacttagacatgggggattgtcactcgtgcagacgacggactttttctacccactcgtggaagacccttacatgatggggagaatcgcatgcgcaaatgtgctctctgatctgtacgctatggggatcaccgagtgtgacaacatgcttatgctactgtctgtaagtcagagcatgtcagaggaagagcgagagaaggtgacaccattgatggtgaaggggtttagggacgctgcagaggaaggtggtacggcagtcaccggagggcagactgtggtcaatccctggattatcatcggaggagtagccactgtcgtctgtcagcctaatgaatttatcatgccagactccgctgtggtcggggatgttctggtgctgaccaaacctctcgggacccaggtcgctgtaaacgcacaccagtggctggacaatccagagcgatggaataaggtgaagatggtagtgagcagggaggaggtggaactcgcttaccaggaggctatgtttaacatggcaaccctgaacaggaccgcagccggactcatgcacacctttaatgcccacgctgcaactgacatcaccggtttcggcatccttggccattctcaaaatcttgcaaaacagcaaaggaacgaggtgtcgtttgtgattcacaacctgccaatcatcgccaaaatggcggccgtgagcaaagcttctggtcggttcgggcttctacagggcacaagtgccgagacctccggagggctgctcatttgtctgccgcgagagcaagcggccagattctgtagcgagatcaagtcatccaagtacggtgaaggccaccaggcgtggatagtcggcatcgtggaaaaggggaaccggacagctcgcataatcgataaacccagagttatcgaagtgttacctcggggggccacagcagccgtcctcgctccggactcgtcgaatgcatctagtgagccttctagttag

SEQ ID NO: 204492 - DNA, 1452 bp, Artificial Sequence
  Description of Artificial Sequence: Synthetic coding sequence
  Description of Combined DNA/RNA Molecule: Synthetic coding sequence
atggccgaggccagcgccaccggcgcctgcggcgaggccatggccgccgcggaaggcagtagtgggcccgcagggctgactctcggcaggagtttctccaattaccggccatttgaaccacaggcattgggcctttcacccagttggcgtctgaccgggtttagcggcatgaaaggtugagggtgcaaggtgcctcaggaagccctgctcaagttactagccgggctgacaaggcccgacgtcaggccgccgctgggcaggggattagtcggcggtcaggaggaagcctctcaagaagcaggactgcccgccggggccgggcctagccctacattccctgcgttaggcatcgggatggattcatgtgtgatccctttgcggcatggcgggctctccttagttcagacaaccgatttcttttatcccctggtagaggacccatacatgatggggcgcattgcctgcgctaatgtactgtccgacctgtacgccatgggcattaccgagtgtgacaatatgctcatgctgttgtcagtgtcgcaaagcatgagcgaagaggaacgtgagaaagtgaccccactaatggtaaaaggctttagagatgcagctgaggaggggggaaccgccgtcacaggggggcagaccgtagtgaacccatggataatcatcggtggggtggccacagtggtatgccagcctaatgagttcattatgccagatagcgcagtggtcggagacgtcctggtcctcacaaagcctttaggaacccaagtggcggtaaacgcccaccaatggctggacaacccagagcgatggaacaaagtgaaaatggtggtctcacgggaggaggtggagttggcctaccaagaagccatgttcaacatggccacactcaaccgaactgctgccggactgatgcacacctttaacgcgcacgccgccaccgacattacagggttcggaatcctagggcattcacaaaacttggctaagcagcagagaaacgaggtgtctttcgtgatccacaacctgccaatcatagcgaaaatggcagccgttagtaaggctagcgggagattcggcctgctccaaggcactagcgcggagacttcaggcggcttgcttatctgtctcccccgcgaacaggccgccaggttctgctcggagatcaaatcatcaaagtatggagagggtcatcaggcatggatcgtggggatcgtggagaaaggaaaccggaccgctaggattatcgataaaccccgcgtgattgaagtacttcctcgaggagccacagcagccgttctggccccagactcgtccaatgcctcatcagaaccttcctcaugagatgagcgtaccgaggtggtctggacacttgaacctctgtcgacaatcactgatggctcccaagagcttattgtaaggaatttccagagaagactacccgcttag

SEQ ID NO: 204493 - DNA, 1347 bp, Artificial Sequence
  Description of Artificial Sequence: Synthetic coding sequence
  Description of Combined DNA/RNA Molecule: Synthetic coding sequence
atggccgaggccagcgccaccggcgcctgcggcgaggccatggccgccgctgaagggagttctggtcctgccggtctgacactgggcaggagcttttcaaactacaggccttttgaaccacaggcattaggactgagcccttcatggcgtctcactggttttagcggcatgaaaggtugagggtgcaaggtgcctcaggaggctctcctgaagctgcttgccggtttgactagaccagacgtacgcccgcccctaggacgcggtctggtgggaggtcaggaggaggctagtcaggaggctggcctccccgccggcgcgggtccttcacctaccttccctgctctcgggatcggcatggattcttgtgtgattccactgcggcacggtggcttatccctagtccagacaacagatttcttctacccgcttgtggaagatccctatatgatggggaggatcgcttgcgccaacgtgctaagcgacttatacgctatgggtatcaccgagtgcgataatatgctgatgcttttgtccgtctctcagagtatgtccgaagaagaacgcgaaaaggtgactcccttgatggtgaagggttttagggatgctgccgaagagggtggcaccgctgtgacaggcggccagacagttgtgaatccatggatcatcattggtggggttgcaacagtggtgtgccagcctaatgaattcattatgccagatagcgcggtcgtgggcgatgtgctggtgctcactaaacctctcggcacacaggtggccgtgaatgcacaccagtggttggacaaccctgagcgctggaacaaagtcaagatggttgtgagtcgggaagaggtggaactggcttatcaggaagccatgttcaacatggccacgctgaacagaactgctgctggcctcatgcacactttcaatgctcacgctgccacagatatcaccggattcgggatccttggtcattcacaaaaccttgcaaagcagcagcggaacgaagtgagctttgtgatccataatctacccatcattgcaaaaatggcagccgtcagcaaagcctccggccgcttcgggttattgcagggcacgtccgcagaaacctcggggggactcctgatttgtctgccacgcgagcaggcagccaggttctgtagtgaaattaagagtagtaaatatggcgagggccaccaggcttggatcgtgggaattgtggagaaggggaaccgcactgcccgcattattgacaaaccacgggtgatcgaagtattgcctagaggagcaactgccgccgtgctcgctcctgactcatccaacgccagttccgagccgtccagttag

SEQ ID NO: 204494 - DNA, 1176 bp, Artificial Sequence
  Description of Artificial Sequence: Synthetic coding sequence
atggccgaggccagcgccaccggcgcctgcggcgaggccatggccgctgcggaaggcagttctggacctgccgggctgacacttgggcggtccttcagcaactacaggccgttcgagcctcaagaagccggcttaccagcaggggcggggccctcccctacttttcctgccctcggtatcggaatggacagctgtgttattcccctgcggcatggtggcctaagcctggttcaaaccacagactttttctatcccttggtagaggatccctatatgatgggtagaatcgcctgcgccaacgtgctatcagacctgtacgccatggggatcaccgagtgtgataatatgcttatgctgctgtcggtttcccagtcaatgagcgaggaagagcgtgagaaggtgacgccgctgatggtgaaaggctttagagatgccgcagaggagggtggcaccgcagtgacaggaggccagactgtggtgaacccttggatcattatcggcggcgttgcaacagtggtatgccagcccaatgagtttattatgcccgattcagccgtagttggggacgtgctggtgctgaccaaacccctgggcactcaggtggcagttaatgcacaccagtggttagacaatccggaaagatggaacaaggttaagatggtcgtgagtcgggaggaagtcgagctggcctaccaggaagcaatgtttaatatggccacactgaaccggactgctgctgggctgatgcacaccttcaatgctcacgctgcaaccgatattacagggtttggtatcctcgggcatagccaaaaccttgcaaaacagcagaggaacgaggttagttttgtgatccacaatctccctataatcgctaaaatggctgccgtgagcaaagcatccggtagattcggcttgctgcagggcacttctgctgaaactagcggcggcttgctcatctgtcttccacgcgagcaggctgcacggttctgttccgagatcaagagtagtaagtacggagagggccatcaggcctggatcgttggcatcgttgagaaagggaataggaccgcccgcattattgacaaacctcgcgtaattgaggtgttgccaagaggtgctaccgctgccgtccttgcgcccgattccagcaatgcctcttcggagccctcgagctag

SEQ ID NO: 204495 - DNA, 1671 bp, Artificial Sequence
  Description of Artificial Sequence: Synthetic coding sequence
atgggccgggcccggcccggccagcggggcccccccagccccggccccgccgcccagccacccgcacccccccgcagaagagcgcgcagtctcgctttgctaggcgcacttctcgccgccgcagccgccgccgccgtgagggtctgtgcgaggcacgcggaagcccaggccgcagcccggcaggaactggccctcaaaacactcggtaccgatggactctttcttttcagctccctggacacggatggcgatatgtacatttcacctgaagaatttaaaccaatagccgagaagctgaccgggtctacgccagctgcatcctgtgaagaggaagagctgccccccgatccgtccgaggagactttaaccatcgaagcaaggtttcagccgctcctccccgagactatgactaaatctaaagatggttttctgggtgttagtaggttggcccttagcggcctcagaaactggactgcagccgcgtcgcctagcgccgtttttgctacgcgacacttccagccatttttacccccgcctggacaagaattgggggaaccgtggtggatcatccctagcgaacttagtatgttcacgggctaccttagcaataaccgtttttaccccccacctccaaaaggtaaagaggtgattatccaccggcttcttagcatgtttcaccctaggcccttcgtcaaaacgcgatttgcccctcagggcgctgtggcctgcctgaccgccataagtgacttctattacactgtgatgtttaggattcacgctgaatttcaactctcagaacctccagacttccctttttggttttcacccgctcagttcaccggacatatcattctgagcaaagatgccacccatgtgcgggatttccgacttttcgtgccaaaccaccgatctctgaacgttgacatggagtggctgtacggcgcctctgagtcttctaatatggaagtggatattggatatattccacagatggaattagaggcaacggggccctccgtcccaagtgtcatcctcgatgaagacggttctatgatcgactcccatctgccatctggagagccgcttcagtttgtgttcgaggagatcaagtggcagcaagagctcagttgggaggaggccgccagaaggttggaagtggcaatgtacccgtttaaaaaagttagttacttgccattcactgaggctttcgatcgcgctaaggcagaaaataaacttgtacactccatcctgctatggggtgccctagatgatcagagttgccattgtagcggtcgaaccttaagggagactgtcttggagtcgtccccgatccttacgctgctgaacgagagctttatcagcacctggtctctcgtcaaagagcttgaggagctgcagaacaatcaggaaaattcctctcaccaaaaactcgctgggcttcacctcgagaagtacagcttcccagtggaaatgatgatatgtctccctaatggtaccgtggtgcaccacataaacgccaattatttcctggatattacctctgtgaaaccagaggagatcgaatccaatctgttcagcttttccagcacctttgaagatcctagcacagcaacatacatgcaatttctaaaggaaggtctaagaaggggccttcctctcctgcagccctag

SEQ ID NO: 204496 - DNA, 1773 bp, Artificial Sequence
  Description of Artificial Sequence: Synthetic coding sequence
  Description of Combined DNA/RNA Molecule: Synthetic coding sequence
atgggccgggcccggcccggccagcggggcccccccagccccggccctgccgcacagcctcccgcacctcctaggcgcagagcgcggtcactagccttgcttggggccctgctcgccgctgctgctgccgcagccgttcgcgtctgcgctcggcacgccgaagcgcaggcggccgctcgacaggaactggctctgaagacactggggacagatggactctttctcttctcttctctggataccgacggagacatgtatattagccctgaggagttcaagcctatcgccgagaaattgacggggagttgtagtgtcacacagacgggagttcagtggtgctcccatagctcactccagccacaattgccgtggctgaacugatcctcctgcctctccttgttaagatctactcctgcagcctcctgtgaagaagaggagcttccacccgatccctccgaagagactctgacgatcgaagcacgttttcaacctttgctcccagagaccatgactaagagcaaggatgggttcctgggggtttctaggctagctctgagtggcctacgcaattggacggctgccgcctccccctcggcggtattcgctacacgccattttcaaccgttccttcctccacccggacaagaactcggggagccttggtggatcattcccagcgaactcagtatgtttaccggctacttgtcaaacaataggttttatcccccaccacccaagggcaaggaggtcatcatccatagactgttaagcatgttccacccacggccattcgtaaaaacacgtttcgcccctcaaggggccgtggcttgcttgaccgctatttccgacttctattacacggttatgttcaggattcacgcagagttccagctttcggaacccccagacttccctttctggttttccccggcgcagtttactggacacattatcctgtccaaggatgctacacatgtgcgagacttccgcctgtttgtgccgaatcacaggtccttgaatgtggatatggaatggctgtacggcgcttctgagagctccaacatggaggtagatatcggctatatcccacagatggagcttgaggcaactgggccctctgttccttccgtgattcttgacgaggacgggagcatgattgactcacatctaccttctggcgagcccttgcagttcgtgttcgaggaaataaaatggcagcaggaactatcgtgggaagaggccgcacgtaggcttgaggttgctatgtatccgttcaagaaagttagctacctgccattcactgaagcattcgatagggccaaggccgaaaataaactggtgcactctatacttctgtggggggcccttgatgatcaaagctgtugagggtccggtcgcacactgagagagacagtattggagagcagcccaattctgacgcttttgaacgaaagctttattagcacatggtcgctcgtcaaagaattggaggaactccagaataaccaagagaacagtagccaccagaagctggctggcctgcacttggaaaaatactcatttcccgtggaaatgatgatctgcctccccaacggaactgtagtgcaccacatcaacgcaaattactttctggacattacctctgtgaaacccgaggaaattgaatccaacctgtttagtttctcaagcaccttcgaagatccatcgaccgctacatatatgcagtttttgaaggagggtttgaggcggggcctgcctttgcttcagccatag

SEQ ID NO: 204497 - DNA, 1671 bp, Artificial Sequence
  Description of Artificial Sequence: Synthetic coding sequence
  Description of Combined DNA/RNA Molecule: Synthetic coding sequence
atgggccgggcccggcccggccagcggggcccccccagccccggcccagcagctcagccccccgccccacctaggcgaagggcgcgctccctggctctcctcggtgccttgctggctgccgccgctgccgccgctgtgagggtgtgtgcccgacatgctgaagcccaggccgctgcaagacaggaactggcattaaaaactctcggcaccgacggtctgttccttttctcatccctggacacagatggtgacatgtatatctcaccagaggagtttaagcctatcgctgaaaaattaactggcagcacaccagccgcttcatgcgaagaagaagaactgccccccgacccttctgaagaaacgcttaccattgaggctagatttcagcctcttcttcccgaaactatgactaagtcaaaagatggctttctcggcgtctctcggctcgcgctctctggattgaggaattggaccgccgctgcctcaccttcagccgtcttcgccactcgccacttccagccgtttcttcctcccccgggccaggaactgggcgagccttggtggattatcccaagtgagctttccatgtttaccggttacttgtctaataatcgcttttaccctccacccccaaaaggcaaggaggtcatcattcatcggttgctgtcaatgttccaccctaggcccttcgtcaaaacaagattcgcacctcagggagctgtggcctgtctcactgccatctcggacttctactatactgttatgttcaggattcacgccgagtttcaattatccgagcctccggacttccctttctggtttagcccggctcagttcactggacatattatactaagcaaagacgcaactcacgtgagagacttcaggctcttcgtacccaatcacagaagcttgaacgtggacatggagtggctctacggcgcatccgaaagttctaatatggaggtcgacatcggctacattccccagatggaactcgaggcaaccggcccctccgtcccatctgtgatcctcgacgaggacggcagcatgatcgactcccatttgccttccggcgagcctctccaatttgtgttcgaggagattaagtggcaacaagaactatcgtgggaagaagccgcaaggagattagaggtggctatgtatcctttcaagaaagtgtcatatttgcccttcaccgaagcctttgaccgcgccaaggccgaaaacaagctcgttcactcaatactgctgtggggtgccctagacgatcagtcctgtugagggtccggccgcacattgagagagactgtgcttgaatcatcacctatcctgactctcctcaatgaatcctttatcagcacatggtccctggtgaaagaactggaggagctccagaacaatcaggaaaattccagccatcagaagctggccggcctgcacctcgagaagtactccttccccgtagagatgatgatctgtctccccaacggtactgtcgtgcaccacatcaatgcaaactacttcctcgatattaccagcgttaaacctgaagagatcgaatcaaacttatttagcttttcttccaccttcgaagaccctagcaccgcaacttacatgcagttccttaaggaggggctgagacggggcttacctcttctacaaccatag

SEQ ID NO: 204498 - DNA, 1146 bp, Artificial Sequence
  Description of Artificial Sequence: Synthetic coding sequence
  Description of Combined DNA/RNA Molecule: Synthetic coding sequence
atgtggcggagcctgggcctggccctggccctgtgcctgctgccctctgggggcaccgagtcccaggaccagtctagcttatgcaagcagcctcccgcctggagcatacgggatcaggaccccatgttaaattccaatgggtccgtcacagtggtcgccctgctccaggcttcaugatatttgtgtattctccaggcctctaagttagaggatctgagagtcaaactcaagaaggagggctactccaatatctcatatatagtcgttaaccaccaaggcatcagcagccgcctgaagtatacccacctgaaaaacaaggtgagcgaacacatacccgtgtaccagcaggaggaaaatcagactgacgtctggacattgttaaacggatctaaagatgactttcttatctacgaccgatgtggccgtctggtgtaccacctggggctaccattctccttcctgactttcccatatgtggaagaggccatcaagatcgcgtactgcgagaagaagtgcgggaactgcagccttacaaccctgaaggatgaagacttttgcaagcgcgtgtctttggccactgtcgataagacagtagaaacaccatccccccactatcatcacgaacaccatcacaatcacgggcatcagcatctaggatcaagtgagctgtcagaaaaccaacagcccggggcccccaacgctcccactcatcccgcaccccccgggctacatcaccaccataagcacaaaggtcagcatagacagggacatcctgaaaatagggatatgccagccagcgaagatctccaggacttgcaaaagaagctttgtagaaaaaggtgcattaaccaactgttgtgcaagctgcctaccgatagtgagttagctcccaggagtugatgctgtcattgtcgtcacctcatctttgagaagacgggttcagcaatcacaugacaatgcaaagagaaccttccttcactgtgttctugacagggcctgagagccgaggaaaacatcaccgagagttgccaaugaaggttgcctcctgccgcaugacagatctcacagcagttaattcctaccgaggcttctgcgtcaugacgaugaaagaaccaagcaaagaagugagagugaccttcaaattag

SEQ ID NO: 204499 - DNA, 630 bp, Artificial Sequence
  Description of Artificial Sequence: Synthetic coding sequence
  Description of Combined DNA/RNA Molecule: Synthetic coding sequence
atgtggcggagcctgggcctggccctggccctgtgcctgctgccctccggcggaaccgaatcgcaggatcagagctccttatgtaagcagccgcctgcctggtccattagagaccaggacccaatgcttaacagtaatgggagcgtgaccgttgtcgccctcttgcaagcatcaugatatttatgcattctccaggccagcaaactcgaggaccttcgcgtcaaattgaaaaaggagggatattctaacatttcctacatagtcgtcaatcaccaggggatttcatctcgcttgaagtacactcatcttaaaaacaaggtaagcgaacacattcctgtgtatcagcaggaagagaaccaaaccgatgtctggacccttttgaacggatccaaggatgatttcctcatctacgaccgatgcggcaggctggtgtatcacttaggcttacccttctccttcttgacctttccttatgtggaagaggccattaagattgcctattgtgagaaaaaatgcggaaactgttctctgaccactctcaaagacgaagacttctgtaaacgagtgtccctcgccactgtggacaaaacggtcgaaaccccttccccacactaccaccacgagcattag

SEQ ID NO: 204500 - DNA, 1146 bp, Artificial Sequence
  Description of Artificial Sequence: Synthetic coding sequence
  Description of Combined DNA/RNA Molecule: Synthetic coding sequence
atgtggcggagcctgggcctggccctggccctgtgcctgctgccctcaggtggaacggaatcacaagatcagagtagcctatgtaaacagcctcccgcatggagcataagggatcaagatccaatgctgaacagtaatggttccgtaacggtcgtcgcactgctgcaagcgtcgugatatctgtgtattctccaggcctctaagctggaagacctgagagtgaaactgaagaaggagggctattctaatataagctatatcgtagtcaaccatcagggaatcagtagtagactcaagtacactcatctcaaaaacaaggtctcggagcacattcctgtatatcaacaggaggaaaaccagactgacgtgtggacactgttgaatggaagcaaagatgactttcttatttacgatcgctgtggaagattagtgtaccatctggggttgccgttttccttcctgacctttccctacgtagaggaagcaattaagattgcttattgcgaaaagaaatgcggcaactgttctctgaccacactgaaggacgaagacttctgcaagcgggtgagtctggccaccgtcgacaaaacagtggaaaccccaagcccccattaccatcatgaacaccatcataatcacggccaccagcacctgggaagctctgagctcagtgagaatcaacaacctggagcaccaaacgcgccgacgcaccccgctcccccgggccttcaccaccatcataaacacaagggccaacatcgccaaggtcatcctgagaatcgcgacatgcccgcatccgaggacctgcaggacctgcaaaaaaaactctgtagaaaacgctgcattaaccagctgttatgcaaactcccaacggatagcgagcttgcacccaggagcugatgctgtcattgccgacatctaatttttgagaaaaccggctccgcgattacaugacagtgtaaggaaaaccttccctccctctgtagtugacagggtttacgggctgaggagaatataacagagagctgtcagugaagattgccgccagcggccugacagattagccagcaacttatacccacggaagcatctgcttcgugaagaugaaagaaccaggccaagaagugagagugaccctccaattag

SEQ ID NO: 204501 - DNA, 933 bp, Artificial Sequence
  Description of Artificial Sequence: Synthetic coding sequence
  Description of Combined DNA/RNA Molecule: Synthetic coding sequence
atgtggcggagcctgggcctggccctggccctgtgcctgctgcccagcggagggacagagtctcaggaccagtcgtctctttgtaagcaacctcctgcatggtccatcagggatcaggatccaatgcttaacagtaacgggtcagttaccgttgtggcattgttgcaggccagcugatacctttgcattctgcaagcctcgaagctcgaggatctcagggtgaagctcaagaaggaaggatatagcaacatttcctatatcgtggtcaaccaccaaggcatctcctctaggctgaaatatactcacctgaagaacaaggtctcggagcatattcccgtgtatcagcaggaggagaaccaaacagatgtgtggacgctcctcaatggatcaaaggatgactttctcatttacgatcgatgcggaaggctggtataccatctaggcttaccattcagctttctgacttttccctatgtggaggaggcaatcaagattgcttactgtgaaaagaaatgcggaaattgtagtcttacaacactgaaagatgaggatttctgcaagcgggttagcctcgctaccgttgataagaccgtagagactcccagcccccactatcaccatgagcaccaccacaaccatggacatcagcatctggggtcgagcgagctgagcgagaaccaacagcccggggcccccaatgccccgacgcatccagcccctccagggttacaccaccatcataaacacaaaggacagcaccggcagggccatccggagaacagggacatgccagcctccgaggatctccaggatctgcagaagaagttgtgcaggaagcgctgtataaatcagctcctgtgtaagcttccaaccgattccgagctggctcctagatccugatgttgccattgcaggcacttaatctttgagtag

SEQ ID NO: 204502 - DNA, 1146 bp, Artificial Sequence
  Description of Artificial Sequence: Synthetic coding sequence
  Description of Combined DNA/RNA Molecule: Synthetic coding sequence
atgtggcggagcctgggcctggccctggccctgtgcctgctgcccagcggcggaacagaatcccaggaccagtcatccctttgcaaacaacccccagcctggagtatacgggatcaggatcctatgctgaactcaaatggcagcgtcactgtcgtcgctcttcttcaggccagtugatacttgtgcatcctgcaggcgagtaagttggaggatctccgcgtcaagctcaagaaggaggggtatagcaacatctcctatatagtcgtgaatcaccaaggcatttcatctcggttaaagtatacacacctcaagaataaggtgagtgagcacataccagtctaccagcaggaggagaaccagacagacgtttggacattgttaaatggatcgaaagacgatttcttgatttacgatcggtgcggaagacttgtgtaccacctcggcttgccattcagtttcctgactttcccctatgtggaggaggctattaaaatagcctattgtgagaaaaagtgcggtaactgcagtctgactacgttgaaagatgaagacttctgcaagcgagtgtcactagctactgtggacaagaccgtagaaacaccctccccacactatcaccacgagcaccaccacaatcatggccaccagcatctgggctctagtgagctttcagaaaaccaacagcccggggcccctaacgctcctactcatcccgctccccccggactgcatcaccaccacaaacataagggccagcaccgacagggtcatcccgagaatcgtgacatgcccgcatcagaagacctgcaggacctgcagaagaaactatgtcgaaaacgatgcatcaaccaactcctgtgcaaactccccaccgatagtgaactggcacctcgctcaugatgttgccactgtcgacatctgatctttgagaagaccggaagcgctattactugacagtgtaaagaaaatctgccttcattatgcagcugacaaggcctgcgggcagaggagaatatcacagaatcatgccaaugaaggctgcccccggccgccugacagatcagccagcaactgatacccaccgaggcatcggccagtugacgcugaaagaatcaagctaagaaaugagagugacctagtaactag

SEQ ID NO: 204503 - DNA, 264 bp, Artificial Sequence
  Description of Artificial Sequence: Synthetic coding sequence
  Description of Combined DNA/RNA Molecule: Synthetic coding sequence
atggccctggccgtgcgggtggtgtactgcggcgccugaggctacaaatctaagtatttacagctgaaaaaaaagctggaggacgagtttcccgggaggcttgacatttgcggagagggcacgcctcaagctactggcttttttgaggtgatggttgctggaaaactgatacacagcaagaagaagggggacgggtacgtggatactgagtctaaattcctcaagctcgtcgcggctatcaaggctgctttggcccagggctag

SEQ ID NO: 204504 - DNA, 267 bp, Artificial Sequence
  Description of Artificial Sequence: Synthetic coding sequence
atggccctggccgtgcgggtggtgtactgctgcggcgccggcggctataaatcgaaatacttgcagctcaaaaagaagctcgaagatgaattccccggaaggctcgacatctgtggcgaaggcacaccccaggccacaggcttcttcgaggtcatggtcgccggtaagcttattcatagcaaaaagaagggcgatggctacgtcgataccgagtcaaagttcctcaagttagtggctgccattaaagctgctttggcacagggatag

SEQ ID NO: 204505 - DNA, 351 bp, Artificial Sequence
  Description of Artificial Sequence: Synthetic coding sequence
  Description of Combined DNA/RNA Molecule: Synthetic coding sequence
atgagcttctgcagcttcttcggcggcgaggtgttccagaaccacttcgagcctggtgtgtatgtgtgcgctaaatgcggctacgagctcttctcctccaggtctaaatacgcacattcctcaccctggcctgcttttactgagaccatccacgctgatagcgtcgctaagagacccgagcataacagatcagaagctctcaaggtttcatgcggcaaatgcggtaatgggctgggtcacgagtttctaaacgacggacccaagcctggtcagtcgcgcttcugaatcttcagtagtagcctgaaattcgtgcccaaaggaaaagaaactagcgccagccagggccactag

SEQ ID NO: 204506 - DNA, 681 bp, Artificial Sequence
  Description of Artificial Sequence: Synthetic coding sequence
atgagcttctgcagcttcttcggcggcgaggtgttccagaaccactttgagcccggcgtttacgtgtgcgctaaatgtggctacgagctcttttcctcccgctcaaagtatgctcacagttccccgtggcctgcattcaccgaaactatccacgccgatagtgtggccaagagaccagaacataataggtcagaggctctgaaggtgcggggtcatcggggaggagggggcaccggggcagctcgggagtcaagggagccggtgccccccagctcactgtgtttaccccactcttcccggggactggaggcctcaatcccaggcctactcccactccctggctcctgtcatccacgtttaagcggggagcccgggctgctcgttcagatgtgggagacaggccaggtgagttgcactgggagtcgaaccaaggtcaacctgctttgcagaagaagcgcgtgggagattggcgtttgggaggagactcccagcgcttctccatcaaaaggactgcattgtggctgcattatggcaaggagctcaccgagttgtctggtaatctttccaggtgtgctgtggcaggtttggcagtgggtggggccccgagtgcctgaacggcgcccacaggccggagcggtgcccatcttaaatatccagcagctggctgaggtgtgtccttag

SEQ ID NO: 204507 - DNA, 2328 bp, Artificial Sequence
  Description of Artificial Sequence: Synthetic coding sequence
atggccagcgccggccacatcatcaccctgctgctgtggggctaccttctagagttgtggaccggagggcacaccgctgatacgacccatcccagactccgactcagccataaggagctcctgaacctgaataggactagcatatttcatagcccctttggcttcctggacctccacaccatgctcctggatgagtaccaggagcgcttgttcgtcggcggtcgggacctggtctactccctgagcttagaacgcatctctgacggctacaaagagattcactggccctctaccgcgctcaagatggaggagtgcattatgaagggcaaagatgctggtgagtgtgccaactatgtcagggtgctgcaccactacaatcgcacacacctcctcacttgcggtacaggggctttcgatcctgtgtgcgcttttattcgtgtgggatatcatttagaggatcctctgttccacctggaaagtccacgctccgagcgtggtaggggccggtgtcctttcgatccaagctcctcattcatctctacattaattggatccgagctgttcgccggtctttattcagactattggtctcgcgatgctgcgatttttagaagtatgggacgcctggctcatatcagaaccgaacacgatgacgagcgcctgctgaaagaacctaagttcgtgggttcatacatgatccctgacaatgaagatcgggatgataacaaagtttatttctttttcacagagaaggcccttgaggcagaaaataatgctcacgccatttacacaagagtaggtaggctctgtgtgaatgatgtggggggccaacggatactggtgaataagtggtccactttcttaaaagcccgcctggtatgttcagtacctggcatgaacggcattgacacatattttgacgaattagaggatgttttcctgctacctacacgggaccataagaaccccgtaatattcggcctgttcaataccacgagtaatatctttagagggcatgccatctgcgtttaccacatgagcagcatacgcgctgcttttaatgggccatacgctcataaagaaggacccgaataccattggtccgtctacgaaggtaaggtaccctatcctcgtcccggatcatgcgctagcaaggttaacggcgggagatacggaaccaccaaggattacccagacgacgccattcggttcgctaggtcccacccacttatgtaccaagcaataaagcccgcgcataaaaagccaatccttgtcaagactgacggaaaatacaacctgaagcagattgccgttgaccgcgtcgaagcggaagatggccagtatgacgtgctcttcatcggcacggacaacggtatagtcctaaaggtgattacaatctacaaccaggagatggaatctatggaagaggtcattctggaggagttgcagatattcaaggatccagtgccaatcataagcatggaaatttcaagcaaacgacaacaactgtacattggcagcgccagtgccgtagctcaagttcgctttcaccattgtgacatgtacggatccgcctgcgccgattgctgcctggctcgggatccttactgcgcttgggatggcatttcttgcagccgatactaccctaccggtacccatgcaaagagacgattccgcaggcaagatgtgcgacacgggaacgcggcccaacagtgttttggtcagcagttcgtgggtgacgccctggacaaaacggaggagcaccttgcttatggaatcgagaacaacagcacattgctcgagtgtaccccgcgctcactccaggctaaggtgatatggtttgtccagaaaggtcgagaaacacggaaagaggaggttaagacagatgaccgggtcgttaagatggatctcgggctgctgttcctgagattgcataagtcagatgcaggtacgtacttctgccaaaccgtggagcactccttcgtgcacactgtgcgcaagatcactctggaggtcgtggaagaggagaaggtcgaagatatgttcaacaaagatgacgaagaagataggcatcaccgcatgccttgtcctgctcaatcttctattagtcagggggccaagccttggtacaaagaattccttcagctgattggatatagcaattttcagcgggtggaagaatattgtgaaaaggtgtggtgtaccgaccgcaaaagaaaaaaattaaaaatgtccccaagtaaatggaagtacgcaaatcctcaggagaaaaaacttcgcagcaaaccggaacattaccgcctaccgcggcatacattggatagttag

SEQ ID NO: 204508 - DNA, 2148 bp, Artificial Sequence
  Description of Artificial Sequence: Synthetic coding sequence
atgctgctggacgagtaccaggagcggctgttcgtgggcggccgggacttagtatattccctgagtttagagaggatatctgatggctataaagagatccactggccaagcaccgcgcttaaaatggaggagtgcattatgaagggtaaagatgcgggcgaatgtgctaattacgtgcgcgttctgcatcattataataggacccacctgttaacatgtggaaccggtgcattcgaccctgtgtgcgcattcatccgggtgggataccacctggaggatcccttatttcatcttgagtcaccgcggagtgagaggggccggggaagatgcccattcgacccaagctctagcttcatctcaactctgattggcagcgagctcttcgccggtttatactcggactactggtcgcgggatgccgctattttccggtctatgggaagattggctcacatccgaacagaacacgatgacgaaagacttcttaaggagcccaagtttgttggatcctacatgataccagataacgaagatagggacgacaataaggtgtatttctttttcacagagaaggctctggaggccgaaaacaatgcgcatgccatatataccagagtgggaagattgtgcgtaaacgacgtgggcggacaaagaattttggtaaacaaatggtctacgttcctgaaagcgagactcgtttgctcagtgcctgggatgaatggtatcgatacttactttgatgagttggaggatgtgttcttactccctacccgtgaccacaagaatcccgtgatcttcggcctcttcaataccacatctaacatttttcggggccacgcgatttgtgtctaccacatgtccagcatcagagctgctttcaacggcccatacgcccacaaggaagggcctgaataccattggagcgtatacgaggggaaagtgccataccctcgtccaggttcttgcgcttctaaggtgaacggcggcagatatggcaccactaaagactaccctgacgacgcaatcaggttcgctcgtagccatcccttaatgtaccaggcgatcaagccggcccataagaagccaatcctggtgaaaaccgacggaaaatataacctgaaacaaatcgcggtggatcgggttgaggctgaagatggccagtatgatgtgttattcatcgggacagacaacggtattgtgctgaaggtgataacaatctataatcaggagatggaaagtatggaggaagtgatcctggaggaactgcagatctttaaggatcccgtgcccataatctcaatggagataagctcaaagcgtcaacagctttacattggctccgcctcagctgtagcccaggtgcgctttcaccattgcgatatgtacggatccgcttgcgccgattgctgcttagcccgggatccctattgcgcatgggacggaataagctgtagcaggtactatccaacaggcacccatgctaagaggcgctttaggcgacaggacgtgcgacacgggaacgccgctcagcagtgcttcggacaacagttcgtgggcgacgctctggacaagacagaagaacatttggcctacggaatagagaataacagtacattgcttgagtgtactccaaggagcctgcaggctaaggttatctggttcgtgcagaaaggaagagaaactcggaaggaagaggtcaaaactgacgacagggtcgttaagatggacctgggacttctgttcctaaggctgcataaatctgacgccggtacctacttttgccagaccgtcgagcatagttttgtacacaccgtcaggaaaataacattagaggtggtcgaggaggagaaagttgaggacatgtttaacaaagatgacgaagaagacagacatcaccggatgccctgtcctgcacagagttcgatttcacagggagctaaaccttggtataaagaatttctgcaactgattggttactcaaacttccagcgagttgaggagtactgtgaaaaagtgtggtgtaccgatcgaaagcggaaaaagctcaagatgagtccaagcaagtggaagtacgccaatccccaggagaagaagttacggtctaagcctgagcattaccgcctgcccaggcacacactcgatagttag

SEQ ID NO: 204509 - DNA, 2301 bp, Artificial Sequence
  Description of Artificial Sequence: Synthetic coding sequence
atggccagcgccggccacatcatcaccctgctgctgtggggctacttactggagctgtggacaggtggacacactgcagacacaacccacccacggctcagactttctcacaaagaactgcttaatctgaatcggacctcaatcttccacagcccctttggttttttggatcttcacactatgctcctggacgagtatcaggagaggctgttcgttgggggacgtgatttggtttacagcctgtccctagagaggattagcgacgggtataaagaaatacactggcccagcacggccttgaaaatggaagaatgtattatgaaaggcaaggatgctggagaatgcgccaactatgtacgcgtcctccaccattacaaccgaacccatctgctcacctgtggcacgggcgcctttgacccggtgtgcgcgttcattagagtgggttaccatcttgaagaccctctgtttcacctggagagcccacgtagcgaacggggacgagggaggtgtccctttgacccatcttcgagcttcataagtaccctgattggctctgaactcttcgcaggcctgtacagtgactactggagcagagatgcagcaatctttagatccatgggaagactcgcacacatccggacggaacacgacgatgagaggttgctcaaagaacctaaattcgttgggtcttacatgatccctgataacgaggaccgagacgacaacaaggtctacttcttctttactgagaaagctctggaggcagaaaataacgctcatgccatttataccagagtggggaggctgtgcgtgaatgacgtgggcggtcaacgtatactggtcaataagtggagcacatttttgaaagcccgactggtctgcagtgtgcccggtatgaatggcatagacacttacttcgatgaactagaagatgtgttcctgctgccaaccagagatcataagaaccctgtgattttcggactgttcaacactacttccaatatttttcggggccatgcaatctgtgtgtatcacatgagctccattcgagccgcatttaacggaccctacgcccacaaagaagggccagagtatcattggtccgtctacgagggtaaagtgccatatcctcgcccgggttcttgcgcttctaaagtcaacggaggcaggtacgggactaccaaggattaccctgacgacgccattaggttcgctagaagccacccattgatgtatcaagccataaaaccagcacataagaagccaatcctggttaaaaccgacggcaagtacaacctaaagcaaattgccgtggacagagtagaagcagaagatggacagtatgatgtgctgtttattggaaccgacaatggaatcgttttgaaagtgatcacgatctataaccaggaaatggagagcatggaggaagtgatactggaggagctgcaaatatttaaagatcctgttcctataatctcgatggaaatttcttcaaagaggcaacaactctacatcggatcagcatcggcagtggcacaggtgcggttccatcattgtgacatgtacggaagcgcgtgcgcggactgctgcctagcccgagacccatactgcgcttgggatggcatcagctgctcgaggtattaccccactgggacccatgccaaacgacgattcaggagacaggacgtgaggcatggcaacgcagcccagcagtgctttggccagcaatttgtgggagacgcactggacaaaacagaagaacatctggcttatgggatagaaaacaatagcaccctcctggagtgcacgccgcggtccctgcaagctaaagtaatatggttcgtacaaaagggccgcgaaactcggaaagaagaagttaaaaccgacgatagggtggtaaaaatggacctcggtttactgtttcttcgcttacacaagagtgatgccggaacttatttttgccagaccgttgagcattctttcgtgcacacggtgagaaaaattacccttgaagtcgttgaagaggagaaggtggaggacatgttcaataaagacgacgaagaggaccggcaccaccgcatgccctgtcccgctcagagctcaatcagtcaaggtgcaaagccttggtacaaagagttcttgcagcttatcgggtactctaatttccaacgcgttgaggagtactgtgaaaaggtgtggtgtaccgatcgcaaacggaagaaactgaaaatgtccccctctaagtggaaatatgccaatccccagcactacaggctcccacgccacacccttgactcatag

SEQ ID NO: 204510 - DNA, 2286 bp, Artificial Sequence
  Description of Artificial Sequence: Synthetic coding sequence
atggccctgcccgccctgggcctggacccctggagcctgctgggcctcttcctcttccagcttttgcaactcctgctacccacaaccacggcagggggaggcgggcagggtccgatgcccagagtccgctattacgcaggtgatgaaaggagagctctgtcattctttcatcagaagggactgcaggattttgatacgctgttgttgtctggggatggtaatacactgtacgtgggcgcccgagaggccatccttgccctggatattcaggatcctggggtgcctcgactcaagaacatgataccctggcccgcctcggacagaaaaaagagcgagtgcgcattcaagaagaagtctaatgaaacacagtgcttcaattttatccgagtcctggtgtcttacaatgtgactcacctgtacacctgtgggacgttcgcatttagccccgcctgtacctttatcgagctgcaagactcatatcttttacctatctctgaggacaaagtgatggaggggaagggccagtccccatttgatcccgcccacaaacacactgccgtactggtcgatggcatgctgtactcaggcaccatgaataactttctggggagcgagcccatcctcatgagaacgctggggtcccaaccggttctgaaaactgataattttttgaggtggctgcaccacgacgccagtttcgtcgccgctatcccaagcactcaggttgtctattttttcttcgaggaaacagcctccgagtttgactttttcgaacgcctgcacacgagccgcgtagctcgggtgtgtaagaacgacgttgggggggagaagttactgcagaagaagtggactacctttctgaaggctcaacttctttgcacacagcctggacagttgccgttcaacgtgatccggcacgccgtgctcctgccagccgatagcccgactgccccccacatctacgcggtgtttacctcacagtggcaggtgggaggtactcgcagctcagcagtctgcgcgttctcccttttggatatagagagagtgtttaagggcaaatataaggagctcaacaaggagactagtcgctggacaacatacagaggcccagagactaatccaagaccaggaagctgttcagtcggcccatcttctgataaggcgttaacatttatgaaagatcactttttaatggatgaacaggtggtcggcacaccgctcttggtgaaaagcggcgtagaatacaccagactggcagttgagaccgcacagggcctggacgggcactcccacctggtgatgtatctgggaactacaacggggtctctccataaagccgtggtaagcggagactcatccgcccaccttgttgaggagatacagctgtttcccgatcccgagccggtgcgcaacctgcagctggccccaactcagggggccgtgttcgtgggcttttcaggaggagtttggcgcgtgcctagagcaaattgctccgtgtatgagtcgtgcgttgattgcgtgcttgctcgagaccctcactgcgcctgggaccccgaatctcgcacatgttgccttttatcagcccctaacctcaacagttggaagcaagatatggagcggggaaacccagagtgggcatgcgcaagcggcccaatgtctaggagcctaaggccccagagtaggcctcagattattaaggaggtgctggctgtgccaaattcgattttagaactcccatgcccccatctgtctgccctggcttcctattactggtctcacgggcccgcggccgtgcctgaggcttccagcacagtgtataacggatcgttgttgctgatagtccaggacggagtaggaggattataccaatgctgggccactgagaacggcttttcatatcctgtaatttcttattgggttgattctcaggatcagactttggctctagacccagaactcgccggaatacctagagagcatgtgaaagtccctctcacgcgcgtttcaggcggagccgctttagctgcccagcagagctattggcctcatttcgtgaccgtgacggtgttgttcgcactggtactctccggcgctttgataatcctggtggcctcccctttgcgcgcgctccgggcccggggtaaggttcaagggtgtgaaaccctccggccaggcgaaaaggccccccttagtcgcgagcaacacttgcagtcgcctaaggagtgccgaacttccgcaagcgacgtggacgctgataataactgcctggggaccgaagttgcttag

SEQ ID NO: 204511 - DNA, 2286 bp, Artificial Sequence
  Description of Artificial Sequence: Synthetic coding sequence
atggccctgcccgccctgggcctggacccctggagcctgctgggcctcttcctctttcagctgctgcagctgctgctccctacaaccaccgccggaggagggggacaggggcctatgcctcgggtcaggtattacgccggggacgagcggcgcgcgctctccttcttccatcagaagggattacaggattttgatacactgcttctgagtggcgacggcaacacattgtatgttggcgcacgcgaggcaatcttggctctcgatattcaggacccaggggtcccgcggctgaaaaatatgatcccatggccggctagcgaccggaaaaagtctgagtgtgcatttaaaaagaagagcaatgagacacagtgtttcaactttattagggtgctggtgagctacaacgttactcatctctatacatgtggaactttcgccttcagccctgcctgtacatttatcgaactgcaggattcttatctcctgccaatttctgaggacaaagttatggaaggaaaaggacaaagccctttcgaccccgcacacaaacatactgcggtcctggtggacgggatgctgtactctggaaccatgaacaacttcctggggagcgagcctatcctgatgagaaccttgggcagccagccagtgcttaaaaccgacaattttctgcggtggctgcaccatgatgcctcttttgtggcagccatccccagtactcaggttgtgtacttcttctttgaagaaacggccagcgagtttgatttcttcgagcgcttacatacttcgcgggtagcacgggtatgcaagaacgacgttggtggcgagaagttgttgcagaaaaagtggacaacatttctcaaggcccagttgctctgcactcagcccgggcagctgcccttcaatgtaattcggcacgccgtattgctgcccgccgatagtccgaccgctcctcatatttatgccgtgttcactagccagtggcaagtgggagggaccagatcttccgctgtgtgcgccttttcattgctggatatagagcgagtctttaagggcaaatataaggaattgaacaaagagacctcgaggtggactacatatagagggccagaaactaacccacgtcctggctcttgcagtgtaggcccctcatccgacaaggcgctgacattcatgaaagatcactttttgatggatgagcaggtggtgggaactccactgctcgtgaaatccggggtcgagtacacacgtctggcagttgaaacggcacagggcctggacggacatagtcacctagttatgtatcttggcaccacaacgggttcactgcataaggccgtggtctccggcgacagttccgcccacctggtggaggagatccagctgttcccggaccctgaaccagttaggaatttgcagttggctcccacacaaggggccgtattcgtaggattcagtggcggagtttggcgcgtgcccagggcaaattgtagcgtctacgaatcctgtgtggactgcgtccttgcacgagaccctcactgtgcctgggaccccgagagccgcacgtgttgcctgctaagcgcacccaacttaaacagctggaagcaggatatggagcggggcaacccagaatgggcatgcgcttccggacccatgtccagaagccttaggccgcagtcgaggcctcagattattaaagaggtgttagccgtgcctaattccattctcgagctcccctgcccccacttatctgcactggcaagctactactggtcacatggtccagcagccgtccctgaagcatcttcaactgtgtacaatgggagccttctcctcatcgttcaagatggcgtgggaggcctgtaccagtgttgggcgacagagaatggcttcagctatcccgtgatctcgtattgggtcgactcccaggaccaaacacttgctttagatcctgagctggccgggatccccagggaacacgttaaggtgcctttgacacgcgtgtcaggaggtgctgcccttgctgcccagcagagctactggccccacttcgtgaccgtaacggtcctgttcgcactcgttctaagcggggccctgatcatacttgtggctagtccgctgcgtgcactcagagcaaggggcaaagtccaggggtgcgagacgttgcgacccggagagaaggcccccctgtctagagagcagcacctacagtctccaaaggagtgcagaacctccgcttccgatgtggacgcggataataactgcttaggcacagaggtggcctag

SEQ ID NO: 204512 - DNA, 2172 bp, Artificial Sequence
  Description of Artificial Sequence: Synthetic coding sequence
atgccccgggtgcggtactacgccggcgacgagcggcgggccctgtctttttttcatcagaaaggcctgcaggacttcgataccttgctactatccggagatggtaacacgttgtatgtgggggcccgggaggcaattctggcactagatattcaagacccaggcgtacctcgcctgaagaatatgattccctggcctgcctctgataggaagaaaagtgagtgcgccttcaaaaaaaaatccaacgaaacacagtgcttcaatttcatacgggtcctggtttcttacaacgttactcatctgtacacatgtggcacctttgcctttagtcccgcctgtacttttattgaattacaggatagttacctgcttccaatcagcgaggataaggtcatggaaggaaagggtcaaagtccttttgatcctgctcacaagcacacggccgtcctcgtggatggtatgctgtacagtggtacgatgaataactttcttggtagcgagccaattcttatgaggaccctgggcagtcaacccgttcttaaaaccgacaactttctgaggtggctgcaccacgacgcttcattcgtcgccgcgatccctagcacccaagtcgtctatttttttttcgaggagacggcttcggagtttgatttctttgaaaggctccatacgagcagagtggctcgagtgtgcaagaacgatgtgggaggtgagaaactactgcagaaaaaatggactacttttctcaaggcccagctgctctgcacccagccaggccagcttccattcaatgtgattcggcacgccgtgctcctcccggctgattcgcccacagcacctcatatctatgccgtgtttactagtcagtggcaagtgggtggcaccagatccagcgccgtgtgcgccttctccctgctggacatcgagagagtctttaaaggcaaatataaagagctgaacaaggagacgagccggtggacaacatatcgtgggcccgaaactaatcctaggcctggctcatgctcggtgggaccgtcgtcagataaggcgttgaccttcatgaaagatcactttcttatggatgagcaggttgtgggaacacctttactcgtgaagagcggagtggagtatacgagacttgctgttgaaaccgcccaaggtctcgatgggcatagccacctggtcatgtacctggggaccacaactggttctctgcataaggccgtggtcagcggcgatagctctgctcacctggttgaagagatccagctcttccctgacccggaacccgtgcgaaatttgcagctggctcccacccaaggcgctgtttttgtgggcttttccggcggcgtgtggcgtgtcccccgggcaaactgttcggtttacgagtcctgcgtcgactgtgttttggccagggatccacattgtgcctgggatcctgaatctagaacctgctgcctcctgtccgcccctaatctgaatagctggaagcaagatatggaaagaggtaatccagaatgggcctgcgcctcaggccctatgagccgatcgctgcggcctcagtcgcgcccgcaaattattaaagaagtgctcgccgttccaaactccattctcgagctcccgtgcccccacctctccgccttggctagttattattggagtcatgggccggccgccgtgcccgaggcttcatccactgtatacaacgggagcctcctgttaatcgttcaagacggtgtggggggcctctatcagtgctgggctacagaaaatggcttttcctacccagtgatttcctattgggttgatagtcaggatcagaccctggctttagatccagaattggccggaattccccgagagcatgtcaaggttcctcttacacgcgtatcgggcggcgctgctctggcagcccagcagagctactggccccactttgtgacagtgactgtgttatttgcactggtactctccggagcattaattatcttggtggcatctccactcagagcactccgggctcggggcaaggtgcaggggtgtgagacacttagacccggtgagaaagcacctttatctagggaacagcacctgcagtctcccaaggagtgtcgcacatcagcctcagacgtcgatgcggataataattgcctgggcacagaagtcgcctag

SEQ ID NO: 204513 - DNA, 1890 bp, Artificial Sequence
  Description of Artificial Sequence: Synthetic coding sequence
atgatcccctggcccgccagcgaccggaagaagagcgagtgcgccttcaagaagaagtctaatgaggaactccaggactcatacctcctacccatctcagaggacaaagtcatggaaggcaagggtcagtctccttttgaccctgcacataaacacacagcagtgctggtggatggcatgctctactcaggtacaatgaataacttccttggctccgaaccgatattgatgaggacgcttggctcccaaccggtcttaaagaccgacaatttcctcagatggctacatcatgatgcttcctttgtcgccgccatacccagtacccaagtcgtgtattttttcttcgaggaaaccgccagcgagttcgacttcttcgagcggcttcatactagcagagtggcccgggtctgtaaaaacgacgttgggggtgaaaagttgttgcagaaaaagtggacgacctttttgaaggcccagttgctatgtacccagcccggccagctgcccttcaacgtgatccggcacgccgttctgttgccagctgatagtcccactgcacctcatatctacgcagtttttacctcacagtggcaggtgggggggacccgatctagtgctgtgtgtgctttctcgctgctggacatagaaagagtcttcaaaggtaagtataaggagctcaataaggaaactagcagatggaccacgtatcgcggcccagagaccaaccctcgccccggaagctgtagcgtgggcccaagctccgacaaagcactgacgttcatgaaggatcacttcctgatggacgagcaggtcgtcggcacccctctcctggtgaagagtggggtagagtatactagattagccgtggagaccgcacagggtctggatggccactcccatctcgtcatgtatctcggaactacaaccggcagcctgcataaagctgttgtgagcggcgatagcagcgcccacctggtggaggaaatccagctgtttccagacccagagcccgtccgaaacttgcagctcgccccaacccagggcgccgtcttcgttggcttttcagggggggtgtggagggtgccgcgggccaactgctcagtctatgagagctgcgtggactgcgtcctggccagagatccccattgtgcgtgggatcccgagtcccgcacgtgctgtctgctgtccgcaccaaacctgaatagttggaagcaagatatggaacggggaaaccccgagtgggcttgtgctagcggacccatgagtcgcagtctgcggcctcaatcaaggcctcagattatcaaagaggtcctggcagtccctaattcgatcttggaattgccatgccctcatctaagtgccctagcctcttattactggtcacatgggcccgcagccgttcctgaggcttcctctactgtctataacggctcgctactgctaattgtccaggatggcgtcggcgggctgtaccagtgttgggcgacagaaaacggtttctcttatcctgttattagctattgggtagactcccaagaccagactttagctttggacccagaactcgccggaattcccagagaacacgtgaaagtgcccctgacccgagtcagcgggggagcagccttggccgcccagcagtcatactggccgcacttcgtgaccgtgacagtcctgttcgcattggttctctccggggctctgatcatcctagtggcctctcccctcagagcccttcgcgctcggggaaaagttcaggggtgcgagacgctgagaccgggtgaaaaagcccctctctcacgcgagcaacatttgcagtctcctaaagaatgcagaacatctgcttccgatgtggacgccgataataattgtctggggaccgaggttgcttag

SEQ ID NO: 204514 - DNA, 2286 bp, Artificial Sequence
  Description of Artificial Sequence: Synthetic coding sequence
atggccctgcccgccctgggcctggacccctggagcctgctgggcctgtttttgttccagttgctgcaactgctgctgcccaccactaccgctggaggaggcggacaaggtccaatgcctcgagtgcggtattacgccggtgatgaaaggagggctctgagcttctttcaccaaaaaggcttgcaagattttgacacgctactgttgtccggcgacggaaataccttgtatgttggtgctagagaagccatcttagccttagacatccaggaccccggagttccgagactaaagaatatgataccatggccggccagtgaccgcaaaaaaagcgagtgcgcgtttaagaagaaatccaacgagacccagtgtttcaatttcataagagtgctagtgagttataatgtgacacatctgtatacctgtggcacttttgccttttcccccgcatgtacttttattgaattgcaggactcttatctcctcccaatatcagaggataaggtaatggagggaaaagggcagtccccttttgacccggctcataagcatactgctgtccttgtggacgggatgctgtacagcggcaccatgaataacttcctcggttcagaaccaattctgatgcgtaccctgggctcccaacccgtcctgaaaaccgacaatttcctccgctggctgcatcacgacgcgagcttcgtagcagctataccgagcacacaagtggtatactttttcttcgaggagaccgcttccgaatttgacttcttcgagcgtttgcacacttcacgagttgccagggtctgtaaaaacgatgtggggggggagaagttgctgcagaagaaatggactactttcctcaaagcccagttgctgtgcacacagcccgggcagcttccattcaatgttatacgccatgcggttctgctgcctgccgacagccctacagcgcctcacatctacgccgtgtttactagtcagtggcaagtggggggcacaaggagcagcgcagtgtgcgccttttccctccttgacatcgagcgagtgtttaaaggcaaatacaaagagctgaacaaggagacatcaaggtggacaacctacaggggtcccgagactaacccaagaccaggctcgtgcagcgtggggcctagctcagacaaggcactcacgtttatgaaggaccattttttgatggatgagcaggtggtcgggacccccctgctggtgaagagcggtgtggaatacacgaggctggcagtggaaacagcgcaggggttggacggacacagccacctggttatgtacctcggcaccacaacaggatcactgcacaaggccgtcgtatccggagattctagcgctcacctggtggaggagattcagctatttcccgaccctgagcccgtgagaaacttacagctagcccccacccagggagctgttttcgtgggctttagtgggggcgtgtggagagtgccacgggctaattgtagtgtgtatgagtcgtgtgtggattgcgtgttagcacgcgatccacattgtgcctgggaccctgagagcagaacctgctgtctcctgagcgctcccaatctcaatagttggaaacaggacatggaaaggggtaatccggaatgggcctgtgcgtccggtcctatgagtcgatctctgagaccacagtctcggcctcaaattataaaagaggttctagccgtgcctaatagtattctggaactgccctgccctcatctaagcgccctggcttcctactactggagccatggtcctgctgctgtcccggaggctagctccacagtgtacaacgggtccttgttgctaatcgtgcaggatggagtgggcggactatatcagtgctgggccactgaaaatgggttctcttaccccgtgatctcttattgggtggattctcaagatcaaaccctggctctggatccggaactagccggcattcctcgggaacacgtgaaagttcctctcacccgcgtgtctggaggcgccgcgctggcagcccagcaaagttactggccacactttgtgacggtcactgtgctatttgccttggtcctgtcaggtgccctgatcattcttgtggcctcccccctccgagcactcagagctcgcggaaaagtacaggggtgcgaaactcttagacccggagaaaaggcacctctgagccgggagcagcacctccagagccccaaggagtgtaggacttcagcttctgatgtggacgccgacaacaactgtctgggcaccgaggttgcttag

SEQ ID NO: 204515 - DNA, 1890 bp, Artificial Sequence
  Description of Artificial Sequence: Synthetic coding sequence
atgatcccctggcccgccagcgaccggaagaagagcgagtgcgcctttaagaaaaagagcaacgaagagctgcaagattcctacttactgccaattagcgaggacaaagtgatggagggtaaagggcagtcaccgttcgatccagctcataaacataccgccgtcctcgttgacggtatgctctactcaggcactatgaacaatttcttgggcagtgaacccattctgatgcgtacactgggcagtcagccagtactaaagacggataatttcctccgatggttgcaccacgacgcgtccttcgttgctgccatcccatctacgcaagtcgtttactttttcttcgaagaaaccgccagtgaatttgacttctttgaaagactccatacatccagggttgcgcgcgtgtgcaaaaacgacgtcgggggagagaagttattgcagaagaagtggactacgtttttgaaagcccagcttctgtgcacacagcctgggcagctgccctttaacgtcatccgccacgccgtgctactcccagcggactcacccaccgcgcctcatatttatgcggtgtttacctctcaatggcaggttggcgggactagatccagcgccgtctgcgcgtttagtttactcgacatagaaagggtttttaagggaaagtacaaagagctgaataaggagacctctcggtggaccacatatcgtggccccgaaactaatcccagacccggaagctgctccgtaggcccttcaagtgataaggccctaacattcatgaaggaccattttctaatggatgaacaggtcgtagggactcctttgttggtgaagagtggagtcgagtatactcgcctggcggtcgaaacggcacaagggctggatggccacagtcatttagtcatgtatctaggaaccacaacgggttcgctgcacaaagctgtggtgtctggcgattcatccgcccatctggtggaggagatccagctgtttccagatccagaaccagtgcgcaacctgcagcttgctcctacccaaggggccgtctttgtgggtttctctgggggcgtgtggagggtcccacgggctaattgcagcgtttatgagagctgcgttgattgcgtgcttgcgcgggaccctcactgtgcctgggacccagagtcacggacttgttgtctcttgagcgcacccaatctcaattcttggaagcaggatatggaacgcgggaatcctgagtgggcatgtgcatcaggcccaatgtcacggtcgctgcgcccccagtctcgccctcagattatcaaggaagttctcgccgtacccaattccattttagaactcccttgcccacatttatccgctctcgcctcatactattggtcccatgggccagctgccgtgccagaggcttctagtacggtctacaacggttctctgcttctgatcgtgcaggacggtgtggggggactttatcagtgctgggcgactgagaatggcttttcttatcccgtaatctcctactgggtggactcccaagatcaaaccctggcactagatcctgagctcgctggaatcccaagggagcacgtcaaggtacccttgacaagagttagcggcggggccgcacttgccgcccagcaatcctattggccgcacttcgtgaccgtcactgtgttatttgctctagttttgtctggagctctgataattcttgtcgcatcgccgttgcgagcgctgcgtgctaggggcaaagtacagggatgtgagacgcttcgccctggcgagaaagcgcctctttcccgggaacagcatctgcagtccccgaaggagtgccggactagtgcttctgatgtggatgcggataataactgccttggtactgaggtggcctag

SEQ ID NO: 204516 - DNA, 663 bp, Artificial Sequence
  Description of Artificial Sequence: Synthetic coding sequence
atgatcccctggcccgccagcgaccggaagaagagcgagtgcgccttcaagaagaagagtaatgaaacccagtgctttaacttcatcagagtgttggtatcttacaatgtgacccacctgtatacctgcgggacctttgccttttctcctgcctgcaccttcattgaacttcaggactcatacctgctgcccattagcgaggataaagtgatggagggaaaggggcagtcaccttttgaccctgcccacaagcacaccgctgtcctggttgatggcatgctgtattccgggactatgaataacttcttgggaagcgaacccatcctgatgcgcaccctgggctcccaacctgtccttaagacagataactttctcaggtggctccaccacgatgcctcttttgtggcagccataccatcaacgcaggtggtatatttcttctttgaggaaactgcctcagaatttgacttctttgagcgtctgcacacgagccgcgtcgctcgagtgtgcaagaatgatgtggggggcgagaaattattgcagaagaaatggacaactttcctcaaagcccagttgctgtgcacgcagcccggccagctccccttcaatgtgattagacacgccgtgttgttaccagccgactctcctactgctccccattag

SEQ ID NO: 204517 - DNA, 966 bp, Artificial Sequence
  Description of Artificial Sequence: Synthetic coding sequence
atggccctgcccgccctgggcctggacccctggagcctgctgggccttttcctcttccagttgctgcaacttctgcttccgactactacagccggcggcggcggccaaggtcccatgccgagagtgcgatattatgcaggcgacgagagacgagcactgtcattcttccaccaaaaaggactgcaggacttcgacacactgctactgagtggagatggcaataccctgtacgtgggcgctcgagaagctatcctggccctggacattcaggacccgggcgtaccacgcctgaaaaatatgatcccctggccagctagcgacaggaagaagtcggagtgcgcgttcaaaaagaaatcaaatgaaactcaatgtttcaactttattagggtccttgtcagctacaacgtcactcatctgtacacatgtggaacctttgccttttcgcctgcttgtacatttatcgaactgcaggattcttaccttcttcctatcagcgaggacaaagtgatggaggggaaggggcagagtcccttcgaccccgctcacaaacacaccgccgtcctagtagatggtatgctatatagcgggactatgaacaacttccttggaagcgaaccaatccttatgcgaaccctggggagccagcccgtactgaagactgataacttcctccggtggctgcaccatgatgcaagcttcgtggccgccattccatccactcaagtggtgtatttttttttcgaagagaccgcatccgagttcgacttttttgaaaggttacacacctccagagtagccagagtgtgcaagaacgacgtgggtggggagaagctgctgcaaaagaagtggaccacctttctgaaggcgcagctcttatgtacccagccgggacaattaccatttaacgttattagacatgctgtccttctgcccgctgatagtcccaccgcccctcatatctattag

SEQ ID NO: 204518 - DNA, 711 bp, Artificial Sequence
  Description of Artificial Sequence: Synthetic coding sequence
atggccctgcccgccctgggcctggacccctggagcctgctgggcttgtttctgttccaattactgcagctcctgcttccaacaacgacagcagggggcggaggccagggcccaatgccccgggtcaggtattatgctggagacgaacgacgcgctctgtcattctttcaccagaaaggcctccaagattttgatacactgctgctgtcaggagatggcaacaccctgtacgtgggcgcgcgagaagcaattcttgctctggacattcaggatcccggcgtgccaagacttaagaatatgatcccgtggccggcttctgaccggaaaaagtccgagtgcgcgttcaagaaaaaatctaacgaagaactgcaggacagctacctgctcccaatctcagaggacaaggtgatggagggcaaaggccaatctccattcgaccctgctcataagcacactgcagttctggtagatggtatgctctactctgggacaatgaacaactttttaggtagtgagcctatccttatgagaacactcggctcgcagcctgtgctgaagaccgataacttcctgagatggctgcaccacgacgcatccttcgtcgcagccataccttccacacaagtagtgtactttttttttgaggaaactgctagtgagtttgactttttcgagcgactgcatacctctcgggtcgccagagtttgttag

SEQ ID NO: 204519 - DNA, 2172 bp, Artificial Sequence
  Description of Artificial Sequence: Synthetic coding sequence
atgccccgggtgcggtactacgccggcgacgagcggcgggccctgtcatttttccaccagaagggtctgcaggattttgacaccctactgttgagtggagacggcaacacattgtatgtgggcgccagagaggcgatcttggccctcgacatccaggatccgggcgtccccagactgaagaatatgattccatggcccgcgagtgacaggaaaaagtctgagtgtgctttcaaaaagaagagcaacgagactcagtgctttaactttattcgcgtgcttgttagctataatgtgactcacctatacacgtgtgggacctttgcgtttagtcccgcttgtacctttattgagttacaggatagctatctcctgcctatcagcgaagataaggtgatggagggcaaaggccagtccccttttgacccggcccacaagcatacagccgtcctggtcgacggaatgctatattctggtacgatgaataacttcttgggtagcgagcctatcctgatgagaacactgggctcccagcccgtgttgaaaacggacaactttctgagatggctgcaccatgacgcaagcttcgtcgcagctataccctcaacccaagtggtgtactttttcttcgaggagacagcttctgaattcgacttctttgaacggctgcacacttcccgggtcgctcgcgtgtgcaaaaatgacgtagggggtgaaaaactgctgcaaaagaaatggacaacgttcctgaaagcccagttactgtgcacacagccaggacagctgccattcaatgtgattcggcacgccgtgttgctgcccgctgatagccccactgccccccatatctatgccgtgttcacctcacagtggcaggtcggcggaacgagatcctctgcggtgtgcgccttttccttgctggatatcgagagagtattcaaaggtaagtataaggagttgaacaaagagaccagccgatggaccacataccgcgggcctgaaactaaccccagaccaggctcttgctctgtcgggcccagcagcgacaaagctttgactttcatgaaggaccacttcttgatggatgagcaggttgttggcacgcccttactcgtcaaatccggggtagagtatacgcgtcttgccgtagaaactgcccagggtttggatggccatagccacctggtgatgtatctggggaccaccaccggttctctgcataaggcagtggtgtctggtgactcctctgcccatctggtagaggagatacagttatttcctgacccagaaccggtcaggaacctccagctcgctcccactcaaggagccgtgttcgtgggtttctccggcggggtgtggagggtgccccgggctaattgttccgtgtacgaatcctgtgtggactgcgtgctggctcgagacccccactgcgcgtgggacccggagtctcgcacttgctgtctcctgtccgctccaaacttgaacagctggaaacaggacatggagagaggcaaccccgagtgggcctgcgctagcggaccgatgagtaggtcccttagaccgcaaagccggccgcagatcataaaggaggtgctggccgtgcccaattctatcctggagttaccttgtccgcatctttctgcccttgcgagctactattggtctcacggaccagccgctgtgcccgaagcctcctcaacagtctacaacgggtccttgctgcttatagtccaggatggagttggcgggttgtaccaatgttgggcaacggagaacggtttcagctacccagttatctcttactgggtggactcacaggatcagacgttggcgctcgatcccgagcttgccggcatcccacgcgagcacgtgaaagtcccattgacgcgcgtctcgggcggagcggcacttgcagcccagcagagctattggccacatttcgtcacagtcaccgttttatttgcactggtgctgagtggggccctgatcattctcgtggccagccctctacgtgctttacgtgcaaggggtaaggtccaggggtgtgagaccctgcggcccggagagaaagccccgcttagtcgagagcaacatctgcagtcgccgaaagagtgccgtacatcggccagtgatgtggatgcagacaacaactgtctaggcaccgaagtggcctag

SEQ ID NO: 204520 - DNA, 3225 bp, Artificial Sequence
  Description of Artificial Sequence: Synthetic coding sequence
atgaagggcacctgcgtgatcgcctggctgttcagcagcctgggcctttggcggctggcacaccctgaagcgcagggcaccacccaatgccagcggactgaacacccagtgataagctataaggaaattggcccatggttacgcgagttccgggctaagaatgcagttgatttctcgcagcttacgtttgacccagggcaaaaggagctggtggtgggggctagaaactatctgttcaggctccagctcgaagacctctctttgattcaagccgtagagtgggagtgcgatgaagctacgaaaaaggcatgttactcaaaaggtaaaagcaaagaggagtgtcagaattacatccgggtgcttctggtgggaggggataggctatttacgtgcggaacaaatgccttcacgcctgtttgcaccaataggtccctctccaacctgacagaaatccacgatcagattagcgggatggctcggtgtccctatagcccacagcacaacagtacagcccttctgactgcaggaggtgaactctatgctgccactgctatggattttccgggcagggacccagccatatacagatctctcgggattctccctccactaaggaccgcccaatataactccaagtggctcaacgagcccaacttcgtgtcgagttatgacatcgggaatttcacttactttttcttcagagaaaacgcagtggagcatgactgtgggaaaacagtcttctctcgagcagcgagagtatgtaaaaacgatatcgggggacgtttcttgctggaagatacatggaccacatttatgaaggcccggcttaattgctcccggccaggcgaagtccctttctattataacgaactgcaatcgacctttttccttcctgagcttgatttaatctatgggatttttacgaccaacgtcaactctatagccgcctctgcagtgtgtgtgttcaacttgtctgctatcgctcaggcgttctccggaccgttcaaataccaggaaaatagccgctcggcctggttaccttatcccaacccaaatccccactttcagtgtggcaccgttgaccagggcctctacgtgaatctcaccgagcggaacctccaggacgcacagaagttcatcctaatgcatgaggtcgtccagccggttaccacagtgccgtcctttatggaagataattctcgttttagccacgtggccgtagatgtagtgcaggggcgagaggccctggtgcatataatctatttagccaccgattatggcactataaagaaagttcgggtccccctgaatcaaacaagcagcagctgcctgcttgaggagatagaactcttccctgaacgcaggagggagcccattcggagccttcaaattctgcactctcaaagtgtgctgttcgtcggactgagagagcatgtggttaagattccgctcaagcgctgccagttctaccgtactcgctcaacctgcattggtgcccaggacccctactgtggatgggacgtggtgatgaagaagtgtacatctctggaggaatctctttcaatgacccaatgggagcaatctatctccgcatgtccaacacgcaatctcacggtggatgggcacttcggcgtgtggtctccctggaccccttgtactcacacggacgggagtgctgtgggcagttgtttgtgcaggacaaggagctgtgactctccagcgcctcagtgcggcggttggcagtgtgagggaccagggatggaaattgcaaattgtagtagaaatggagggtggaccccttggacttcatggagcccatgttcgacaacttgtgggattgggttccaggttagacagcgctcatgctcaaaccccactccgaggcacggaggccgggtgtgtgttggtcagaatcgcgaagagaggtactgcaacgagcacttactctgcccaccccatatgttctggaccggttggggcccttgggaacggtgcaccgctcagtgcgggggtgggatacaggctcgccgccggatatgtgagaacggacctgactgcgcggggtgcaacgtcgagtatcagtcgtgcaacacaaatccttgtcccgagctgaagaaaacaacgccctggacaccctggacaccagttaacatctccgacaatggcgggcactatgagcagcgcttcaggtacacatgcaaggcccgacttgccgatcccaacctgttggaagtgggccgacaacgaatcgaaatgcgttattgcagctccgatggcactagcggctgctccaccgatggccttagcggcgactttctccgagctggccggtacagtgcccacacagttaatggagcctggagcgcctggacctcttggtcccagtgctctcgggattgtagccggggcatccgcaaccgcaagcgcgtgtgtaacaatccggaaccaaaatatggtggaatgccgtgtctcggcccttccctagaataccaggaatgtaacattcttccctgccccgtggacggagtatggtcttgctggagcccatggactaaatgttctgccacctgcggtggcggccattacatgcgcacgaggtcgtgctctaatccagcaccagcctacggtggcgacatttgtctgggccttcacacagaggaggccctctgcaacacgcaaccatgtccagagtcctggagtgagtggagtgattggtctgaatgcgaggcatctggtgtgcaagttcgcgctagacagtgcatccttttatttcctatgggttcacagtgctctggcaataccacagaaagccgaccctgcgtgttcgatagcaacttcattcccgaagtctcagtcgctcgctccagttccgtcgaagaaaagaggtgtggggaattcaacatgttccacatgatcgctgtgggtctgtcaagtagcattcttggctgtctgcttacactgcttgtttacacttactgtcagcgatatcagcagcaatcccacgacgccacagtgatccatcccgtaagccccgccccactgaacaccagtatcacaaatcacatcaataaactggacaagtacgattccgttgaggccataaaagcattcaacaagaataatttgattttggaggagaggaataagtactttaatccacacttaaccggaaagacatattcaaatgcatattttactgatcttaacaactatgatgagtactag

SEQ ID NO: 204521 - DNA, 765 bp, Artificial Sequence
  Description of Artificial Sequence: Synthetic coding sequence
atgaagggcacctgcgtgatcgcctggctgttcagcagcctgggcttgtggaggcttgctcacccggaagcccaggggacgacacagtgccagagaaccgaacatccagttatatcctacaaagagatcggcccttggctcagagagtttcgcgcaaagaacgctgtagatttttcacagctgactttcgaccccgggcagaaggagctggtggtaggggctagaaattacctcttccggttgcagttggaggatctcagcctgatccaggccgtggagtgggagtgtgacgaggccacaaagaaggcttgctactctaaagggaaaagcaaggaagagtgccagaattacattcgcgtgctgctggtcgggggtgaccgcctcttcacctgtgggactaacgctttcacgcccgtctgcactaatcggtcgttgagcaatctgacagagatacacgaccaaattagtgggatggcgcgctgcccatatagcccacaacacaattctacggctttgttgactgcaggtggagagctctacgctgctactgccatggactttccagggagagaccctgctatctacaggtctctaggtatcctgccaccactgcgtaccgcccagtacaattctaagtggctgaatgagccaaacttcgtgtcttcttacgatattggcaatttcacatatttcttctttcgcgagaacgcggtggaacacgactgcggcaagacagtcttttctagggcggcgcgcgtttgttag

SEQ ID NO: 204522 - DNA, 2001 bp, Artificial Sequence
  Description of Artificial Sequence: Synthetic coding sequence
atgaccccccccccccccggccgggccgcccccagcgccccccgggctagagtacccggcccccctgcccgtttaggtctgccgttgaggttaagactgcttctgttactctgggccgctgctgcttcagcccaagggcacctgcgatcagggccccgaatttttgccgtttggaaaggccatgtgggtcaggacagggtggactttggacagacagaacctcatacggtcctgtttcacgagcccggctccagctctgtgtgggtggggggaagagggaaagtgtatctgtttgatttccctgagggcaaaaacgcctcggtccggaccgtgaacattggttccaccaagggatcatgcctggataagagagactgcgagaattatatcacccttttagaaagacgctctgaaggacttctggcctgcggcaccaacgcccgccacccaagttgttggaatctggtgaacggaacagtggtcccgttaggcgaaatgcgcggttacgcccctttttcccccgacgagaactctctcgtgttatttgagggagatgaggtgtattccacaattcgtaagcaagagtataatggcaaaattcctaggttccgcaggatccgcggggagtccgaactgtacacttctgacaccgtcatgcaaaacccccagtttatcaaagccacgattgtgcaccaggatcaggcatatgatgacaagatttattactttttccgagaagataacccagacaaaaaccctgaggctcctctgaacgtatccagggtggcacagctgtgtagaggggaccaggggggtgagtctagtctgagcgtcagcaagtggaacacatttttaaaggccatgctggtctgtagtgacgccgctaccaacaagaactttaaccggctacaggatgttttcttgctccccgatccctcgggccagtggagagatactagggtatatggcgtcttctccaatccttggaactactccgctgtgtgcgtgtacagccttggcgacatagacaaggtcttcagaacttcctctttaaaaggataccacagcagcctccccaatccgaggcccggaaagtgcctccctgaccagcagcccatccctacggagaccttccaagtggcagaccggcatcctgaggtcgcacagagagtggagcccatgggacctctgaaaacccctttgttccacagcaaatatcattaccagaaagtcgccgtgcacagaatgcaggcaagccatggggaaacctttcatgtactctacctcactactgatagaggcactatccataaggtcgttgaacccggggagcaagagcacagttttgcattcaacattatggagatccagcctttccggcgagccgctgctatccagacaatgagcctggacgctgaaaggcggaagctttacgtgagttcccagtgggaggtttcacaggtgcccttagacctctgcgaggtctacggcggcggctgccacggctgcttgatgtctcgcgacccctactgtggatgggaccagggtaggtgtattagcatctactcatcggagaggagtgtgctgcagtcaatcaatcccgccgagccacacaaagagtgcccaaatccgaaaccagacaaagcgccattgcagaaggtctcattggcacccaactcacgctactatctttcatgcccaatggagagcagacacgcaacatactcttggaggcacaaggagaatgttgaacagtcctgtgaacccgggcaccagtcacccaattgcattcttttcatcgaaaacttaacggctcagcagtacggtcactatttctgcgaggcccaagaaggatcctacttccgggaagcacagcactggcagctcctgccagaggatggcatcatggcggagcacctgctcggccacgcctgcgccttggcagcctctttgtggctcggagtgctgcctacactgactttgggtctgctagtacactag

SEQ ID NO: 204523 - DNA, 1506 bp, Artificial Sequence
  Description of Artificial Sequence: Synthetic coding sequence
atgcggggctacgcccccttcagccccgacgagaacagcctggtgctttttgaaggcgatgaagtgtactccactattcgtaaacaagagtataacggcaagataccccggtttcgacggatcaggggcgaaagtgaactgtatacatctgataccgtgatgcagaacccacagtttattaaagccaccatcgtgcaccaagaccaggcctacgatgataaaatttactacttcttccgcgaggataaccccgataaaaatcccgaggccccactgaacgtctcccgggttgcccaattgtgccgcggtgaccaaggaggtgagtcgtcactgagtgtctctaaatggaacactttcttgaaggctatgctagtgtgtagcgatgccgccactaacaagaactttaaccgcctccaggacgtgttcttgctgccggacccctcgggccagtggcgggacacccgcgtgtacggcgtgttttctaatccatggaattactccgctgtttgtgtgtattccctcggcgacatagacaaagttttcagaacatcgtctcttaagggctatcattcctccctgccgaaccctaggcctggcaaatgtcttcccgatcaacagccaattcctaccgaaactttccaggtcgctgacagacaccctgaggtggcccagcgcgtggaaccaatgggccctctgaaaaccccgctgttccatagcaaataccactaccagaaggttgccgtgcaccgcatgcaggcctctcacggggagacttttcacgtactctatctaacaacggacaggggcacaattcacaaagttgtggaacctggggaacaagaacacagttttgcattcaacataatggaaatccagccttttaggcgggccgcagctattcaaacgatgagcctggacgcagaacgacgcaaactgtacgtaagcagccaatgggaagtttcccaggtccccctggacctttgcgaggtgtatggaggaggctgccatggatgcttaatgtcgagggacccttattgcgggtgggaccaaggaaggtgcatttccatctattcttcagagcggtcagtgttacagtctatcaaccctgccgagcctcataaagagtgtcctaaccccaaaccggataaagctcccctgcagaaagtgagcctcgctccaaacagccgttactacttaagctgcccaatggaatcacggcatgcaacatattcctggcgacataaggagaacgttgagcagagctgcgaaccaggccatcagagtcccaattgcatcctgtttatagaaaacctgacagcacagcagtacggacattacttctgtgaggctcaggagggtagctattttcgcgaggctcagcactggcagctgctccccgaggacggcattatggccgaacacctattaggacatgcctgcgcattggcagctagtctgtggctaggcgtcttgcccacactcacactggggcttctcgtgcattag

SEQ ID NO: 204524 - DNA, 1959 bp, Artificial Sequence
  Description of Artificial Sequence: Synthetic coding sequence
atgaccccccccccccccggccgggccgcccccagcgccccccgggctcgcgtacccggaccacccgcccggctgggtttgccactccgcctgcgcctattgctcctgctgtgggcagctgccgcctcagctcagggccacttgcggtccggccctcgcatctttgccgtgtggaagggacacgtggggcaggatagagtcgacttcggccagaccgagccccacacagtcttgtttcatgaacctggttcatccagtgtatgggtaggaggccggggcaaagtttatctctttgatttcccagaaggcaaaaacgcctcagtcaggacggactgcgagaattacataacacttcttgaaaggcgctcagagggactcttagcttgcgggaccaacgcccgccatccctcctgttggaatctggtcaacggtaccgtcgtgcccctaggtgagatgcgaggctatgctcccttcagtcctgacgagaattctctagttctgttcgaaggcgacgaagtctattctacaatacggaagcaggaatataacggaaaaatccccaggttccgccgcattcgcggtgaaagcgaactgtacacaagcgacaccgtaatgcagaatccacagtttataaaggccaccatcgtccatcaggaccaagcatatgatgataagatctactacttttttagggaagacaacccagataaaaacccagaagccccactgaacgtgtcgcgtgtggctcagctttgcaggggtgaccagggaggcgaatccagcctctctgtgtctaaatggaatacattcctaaaggcaatgttggtctgttccgacgcagccacgaacaaaaactttaatcgacttcaggatgtgtttctcctgcctgatccttctgggcagtggagggatactagggtctacggagtgttcagcaacccttggaattattccgccgtgtgcgtttacagtttaggagatattgacaaagtgtttcgcactagcagtctcaaggggtatcactcgtccttaccaaacccacgacctggcaaatgtctgcccgatcaacagccgatccctaccgaaacttttcaagtggccgataggcaccccgaggtcgctcaacgagtagaaccaatgggaccactaaaaactcccctttttcactcaaagtatcactatcagaaggtggcagttcatagaatgcaggcatcccacggcgagacatttcacgtgctgtacctgactacagatagagggaccattcacaaagtggtcgagccgggcgaacaggagcattctttcgcgttcaatattatggaaattcaaccattcaggcgtgccgccgccatccagacgatgtccttagacgccgagagacggaagctctacgtaagtagccagtgggaagtgtctcaggtacccttagacttgtgtgaagtgtacggtggagggtgccacggctgtctaatgagccgagacccctactgcggctgggaccaggggagatgtatctccatatattccagtgagaggtctgttctgcaatcgataaaccccgcagagccacacaaggaatgccccaaccctaagcctgacaaggccccactgcagaaagtgtcattggcacccaattcccggtactacttaagctgcccgatggagtctaggcacgccacatatagttggcgccataaagaaaacgtcgagcagagctgcgaaccgggacaccagagccccaattgtatcttgttcattgaaaacctcacggcccaacagtatggacattacttctgtgaagcgcaggagggatcatacttccgggaggcccaacactggcagttactgcccgaagatggcatcatggcggagcatttgctaggtcatgcgtgtgccctggccgcctccctctggctgggagtcctgccaacactgaccctcggcttactggtgcattag

SEQ ID NO: 204525 - DNA, 1209 bp, Artificial Sequence
  Description of Artificial Sequence: Synthetic coding sequence
atgaagcccaacatcatcttcgtgctgagcctgctgctgatcctggagaagcaagccgctgtgatgggccagaaaggcgggtccaaaggtcggcttccgtccgagttttcacagtttccacacggccagaaaggacagcactactccgggcagaaaggcaaacagcagacggagagcaagggttctttcagcattcagtatacctaccacgtggacgccaacgaccacgaccagagccgcaagtcccagcaatatgatctgaatgccttgcacaaaacgacgaagtcacagcggcacctcggcgggtcccagcagctgcttcacaacaagcaggaaggcagagatcacgacaaaagtaagggccacttccaccgggtcgttatccatcacaagggcggtaaagcacatagaggaactcaaaatccatcacaagatcagggcaactcaccaagcggcaaggggatttcgagccagtattccaatacggaggagcgcctgtgggtccacggcctcagcaaagaacagacttcagtgtctggagctcagaagggcagaaaacagggcgggtcgcagagtagttatgtgctacagactgaggaactggtggccaacaagcagcagcgcgaaaccaagaactcacatcagaacaaaggtcattaccagaacgtagtcgaagtccgtgaagagcacagttcaaaggtccagacttccttatgtccagcgcatcaggacaagctgcagcacggcagcaaggatatcttcagcactcaggacgaactcctcgtgtataataagaaccagcaccagaccaagaatctcaatcaggatcaacagcacggacggaaggcaaacaaaatctcctatcagtcttcttccaccgaagaacgccgcctccactacggtgaaaacggtgtccaaaaagatgttagtcagagatcaatctattcacagaccgagaaactagttgccggtaagagccaaatccaggctcccaacccaaaacaggaaccctggcacggtgagaatgcaaaaggagaaagtggtcagagtacaaatagagagcaagacctcctctcccatgagcagaaagggaggcaccagcacggtagccatggcggattggacatagtgatcatagagcaggaggatgacagtgataggcatcttgcacagcacctgaataacgatcgcaatccgctgtttacctag

SEQ ID NO: 204526 - DNA, 1389 bp, Artificial Sequence
  Description of Artificial Sequence: Synthetic coding sequence
atgaagcccaacatcatcttcgtgctgagcctgctgctgatcctggaaaagcaggcggctgttatgggacagaagggggggtccaaggggcgactgccatcagaattctctcagttcccacacggacagaagggccagcactactccggccagaagggtaagcaacagaccgagagtaagggctcattctcaattcagtatacctatcacgtcgacgccaatgaccatgaccaatcgagaaagtcccagcagtatgacctgaatgccctccacaagacgacgaagagtcaaaggcacctcggcggaagtcaacagctgcttcacaataaacaggagggaagggaccatgacaagagcaaggggcactttcacagggtcgtgatccatcacaagggcggaaaagcccaccggggcacccagaatccatctcaggatcaagggaatagcccgagcggcaaaggcatcagttcccagtactctaacactgaagagaggctgtgggtgcatggcctatcaaaagagcagacttccgtgagcggggctcaaaaaggccggaagcagggtgggagccaatcgtcatacgtgttgcagacagaggagttggtggccaataagcagcagcgcgagaccaagaacagtcaccagaataaagggcactaccagaatgtcgtggaggtgcgcgaggaacactcaagcaaggtccagaccagcctatgccccgcacatcaggacaaactacagcatggcagcaaagatattttttcaacgcaggacgaacttttggtctataacaagaatcagcatcagaccaagaatctgaatcaagaccaacagcacggacggaaagccaataaaatcagctaccaaagttcatccacagaggagaggcgtctgcactatggggaaaacggagtgcagaaggatgtttcccagtcttcaatttacagccagactgaggagaaggcccaagggaagagtcagaagcagataactattccctcacaggaacaggagcatagccaaaaagccaataagatatcctatcaaagtagcagcacggaagaaagaaggctgcactatggtgagaatggtgtgcaaaaagatgtctctcagcgttctatttattcacagactgaaaagctcgtcgcaggaaagtcacagatccaagctcccaatccaaaacaagaaccctggcatggcgagaacgccaagggtgagtctggacagtcaaccaacagggaacaagatctgctaagccatgaacagaagggccggcaccaacacggctcccacgggggactggacattgtcattattgaacaggaagacgactctgatcgccatctggctcagcatctgaataatgacagaaatccactgttcacgtag

SEQ ID NO: 204527 - DNA, 1749 bp, Artificial Sequence
  Description of Artificial Sequence: Synthetic coding sequence
atgaagagcatcatcctgttcgtgctgagcctgctgctgatcctggaaaagcaggctgcggtgatggggcaaaagggaggttctaaaggccaactgccctctgggagttcccagttcccccatggacagaagggccaacattacttcggtcagaaggatcagcaacacaccaaatccaagggcagtttcagtattcagcacacgtatcacgtggatattaacgaccatgattggactaggaagtcccagcagtacgacctcaacgcactgcacaaggcaaccaaaagtaagcagcatctggggggctcccagcagctcttaaattacaaacaggagggcagagatcacgacaagtctaagggccattttcatatgattgtcattcatcacaagggagggcaagcacatcacggtacacaaaatccatcacaggaccagggaaatagtcccagcggcaagggcctctccagccagtgttctaacactgagaaaaggctgtgggtacatggtctgagtaaagagcaggcgtccgcttccggggcccagaagggtcgaacgcaaggcggaagccaaagctcgtatgtattgcagaccgaagagttggtggttaacaagcagcaacgcgaaaccaaaaatagccaccagaataaaggccactaccagaatgtggtcgatgtgagggaagaacactcctcaaagcttcagacctccctgcatcccgcgcatcaggaccgactgcagcatggccctaaagatatctttacgactcaggatgaactccttgtgtataataagaaccagcatcagaccaagaacctgtcccaggaccaggaacacggaaggaaagcccacaagatcagctatccgagctccagaaccgaggaacgccagctgcaccatggagagaagagtgttcagaaagatgtgtcgaaaggctcaattagtattcagaccgaggagaagatccacgggaagtcccaaaaccaggtgacaattcatagccaagatcaggagcatggacacaaagagaacaagatctcctatcagtctagctcaaccgaagaaagacacttaaattgtggggagaaaggcatccaaaagggagtatcgaagggctccatcagcatccagacagaggaacaaatccacggaaagtctcagaaccaggtgcgcatcccaagtcaagcccaggaatacggccataaagaaaataagatctcttaccagtccagctccactgaggagcgaagactgaattccggtgaaaaggatgtgcagaaaggagtcagcaagggatctattagcatccagacggaggagaagattcatggcaagagtcaaaatcaggtgactataccctcacaggatcaggagcatggacacaaggagaataagatgtcctaccagtcctccagcaccgaagagcggaggttgaattacgggggcaaatcaacccagaaagacgtgagccagtccagcatctcctttcaaattgagaagctggtggagggcaaaagccagatccagacacctaaccccaatcaggaccagtggtcaggccagaatgccaaaggtaaaagtggtcagtctgccgacagcaagcaggacctcctctcccatgagcagaagggtagatacaagcaggaatcaagcgagtcccataatatcgttatcaccgagcacgaagtggcccaagacgaccatttgacccagcaatacaacgaagatcgcaatcccattagcacatag

SEQ ID NO: 204528 - DNA, 447 bp, Artificial Sequence
  Description of Artificial Sequence: Synthetic coding sequence
atggccgagagcgactgggacaccgtgaccgtgctgcggaagaagggcccgacagcggcccaagctaagtcgaagcaggcaattctggccgcccagagacgcggagaggacgtcgagacgagcaagaaatgggccgcaggacagaacaagcaacactctataacaaaaaatacagcaaaactggatcgagagactgaggagttacatcacgacagagtgactcttgaggtgggaaaggtgatccagcagggcagacagtccaaagggctgactcagaaagatctggcgaccaagatcaacgagaagccgcaggtcattgccgactacgaaagcggccgggccatccccaataatcaggtcctcggcaaaatagagagggcaataggcctgaagctgagagggaaggacattggaaagcccattgaaaagggcccgagggcgaagtag

SEQ ID NO: 204529 - DNA, 8121 bp, Artificial Sequence
  Description of Artificial Sequence: Synthetic coding sequence
atgagcacctgctgctggtgcacccccggcggcgccagcaccatcgattttctgaaaagatatgcttctaacaccccctccggtgaatttcagactgctgatgaagacctgtgttactgcctggagtgcgtcgccgaatatcacaaagcgcgggatgagcttccttttctgcatgaagtgttatgggagctcgagactctgcgactgattaatcacttcgagaaatcaatgaaagccgagataggcgatgacgacgaactgtatatagtcgacaataatggcgaaatgccactcttcgatatcaccgggcaggatttcgagaacaagctgagggtcccccttctggagatcctgaagtacccatatctcttgctgcatgagcgcgtgaacgagctttgcgttgaagccctgtgcagaatggaacaagccaattgcagttttcaggtgttcgataaacaccctgggatctacctgtttttagtccatccgaacgaaatggttcggaggtgggctattcttactgcgcggaatctgggtaaagtggatagggatgactattatgacctccaggaggtactgctttgtctcttcaaggtcatcgagctcggattgctggaaagtccagatatctatacgtctagcgtgctggagaaggggaaactaatactactgccctcccacatgtacgacacgaccaattacaaaagctactggctaggcatttgcatgctgctgactatcctggaagaacaggccatggactctctgctcctcgggtcagacaagcagaatgacttcatgcagtccattctccatactatggagagagaagctgatgatgattctgtagaccctttctggccagcgctgcactgctttatggtgatacttgaccgccttgggagtaaggtctggggccagctcatggacccaatagtagccttccaaaccattatcaacaatgcatcatacaaccgggaaattcgacacatccgaaattcctctgtccgtaccaagctggagccagagtcctacctggatgatatggtgacttgttcccagatcgtgtacaattataacccagagaagacaaagaaggattctggttggaggaccgcgatctgcccagactactgcccaaatatgtatgaggagatggagacactcgcttccgtactccagagtgacatcggccaagatatgagggtgcacaacagtacatttttatggtttatcccatttgtgcagtcgctgatggatctgaaagatttgggggtggcctacatcgctcaggtagttaatcacctgtactcggaagttaaggaggttctgaatcagacagacgcagtgtgcgataaagtgaccgaattttttctgctcatacttgtaagtgtcatcgagttgcaccggaacaagaagtgcttgcacctcctgtgggtgagcagtcagcagtgggtggaagcagtggtgaagtgtgcaaagctgccgaccaccgcctttacacgctcatccgaaaagtcatcagggaactgctctaagggaaccgccatgatcagctctctgtcgttgcactcaatgccctcaaactctgttcaattagcatacgtgcagctgattcgctccttgcttaaagagggataccagcttggacaacagtcactctgcaagcgcttctgggacaagcttaacctgttcttgagaggcaacctgagcctcggatggcaattaaccagccaagaaactcacgagctgcagtcctgtctaaagcagatcatccgcaacatcaaattcaaggccccaccctgtaataccttcgtggacctcacctcagcctgcaaaattagccccgcgagttataataaggaagagagcgagcagatgggcaaaacaagccgaaaagatatgcactgtcttgaggccagcagtcctactttttctaaagagccgatgaaggtccaagactcagtactgattaaggctgataacacaattgaaggggacaacaacgagcaaaattacatcaaagacgtaaaactggaggaccacctgctggctgggagttgcctgaagcaatcttctaaaaatatttttaccgagagagcagaggaccagattaaaatcagcacaagaaaacagaaatccgtcaaggaaatcagttcgtacactcccaaagattgtacatctaggaatggtcccgagcgcggctgtgaccggggcatcatcgtcagtacacgcctcttaactgactccagtaccgacgccttggagaaagtgagcacatcaaacgaggacttttccctaaaggacgatgcgctcgctaagacatctaagcgcaaaacaaaggtacagaaggatgaaatttgtgctaaactgtcacacgtgattaagaaacaacacagaaaatctaccctggtggataatacaataaacctggacgagaacctgacggtgagtaacatagaatccttctactcacgcaaagacactggagtacagaagggggatggattcattcacaacctttctctggacccttcaggggtgctcgatgataaaaatggagagcagaaatctcagaacaacgtgctccccaaggaaaagcagctgaagaatgaggagctggttattttttcttttcatgagaataattgcaagattcaggagtttcacgtggacggaaaagaactgatcccgtttaccgaaatgacaaacgcatccgagaaaaagtccagtccatttaaagacctcatgacagtccccgagagcagggatgaggagatgagcaattccacttcagtgatatattcaaatctaacgcgtgagcaggcccccgatatctcacccaagtccgataccttgactgactcccagatagatcgcgatctgcacaaactgagcctgcttgctcaagcatcagtgataacattcccttctgatagcccccagaacagtagtcagctccaacgcaaagtgaaggaagacaaaaggtgcttcacggcgaaccagaacaatgtgggcgatacatcccgagggcaggttatcattatatccgactccgacgatgatgacgatgagaggatcctgagcctagaaaagcttacaaaacaggataaaatctgcctcgagagagagcatcctgaacaacacgtgtccactgtcaactctaaagaggaaaaaaatccggtgaaggaagagaaaaccgagacacttttccagtttgaggagagcgattcccaatgtttcgagtttgaaagctcatcagaagtgttctctgtttggcaggatcaccccgacgacaacaattccgtgcaggacggcgagaagaaatgcctagctcctatcgcaaatacaaccaatggacagggttgcactgattacgtttctgaggtcgttaagaagggagccgagggcattgaagagcacacacggcccagatctatatccgtggaggagttctgtgaaattgaagttaagaaaccaaagcgcaagcgctccgaaaaacccatggccgaagacccggtgaggcccagcagctcggtgcgaaacgaaggacagagcgatactaacaaacgcgatctggtaggcaatgactttaaaagcatcgacagaaggacctcgacaccaaacagccgcatccaaagagccactaccgtttcccagaagaaaagctccaagctttgtacatgtacagagcctataaggaaggtcccagtgagtaaaacaccaaagaagacccattcagacgccaagaaaggccagaaccgcagttctaactacctgtcttgtcgaaccacacctgccatcgtgccacctaaaaagtttcgccagtgtcccgaacctacaagcactgctgagaaactggggctgaagaaaggccctcgaaaggcctatgagctgagccagaggagtctcgactatgtggcgcaactcagggaccacgggaagaccgtgggcgttgtggacacacgtaaaaagactaagctcatctctccccagaatctgtctgttcggaacaacaagaagttgctcacttcccaggagctgcagatgcagcggcaaatacgacccaaatcccagaaaaataggagaagactgtccgactgtgagtcgacagatgtcaaaagagctggttcacacactgcacagaacagtgacatctttgtcccagagagcgaccgaagcgattacaactgtaccggcgggaccgaggtgctagctaactctaacagaaagcagctgatcaaatgcatgccttcggagccagagactataaaggccaaacatggatcacctgcaaccgatgacgcttgcccactgaaccaatgcgattcagtagtactcaatggtacagtcccaaccaacgaggttatagtgagtacaagcgaggatcccctgggcggaggcgacccgacagcccgtcatatcgagatggcggccttaaaggagggcgagcccgacagttcatctgatgccgaagaggataatttgttcttgacccagaacgatcctgaagacatggacctgtgctcacagatggagaacgacaattacaaactgattgaactaatccatggcaaggatactgtggaagtggaggaggatagcgtaagtcgcccacagctggagtctttaagcggtactaaatgtaaatacaaggattgtctggaaactaccaaaaaccaaggagaatactgtccaaaacattccgaggtcaaagctgctgacgaggacgtctttaggaaacccggcctgccccctcccgccagtaagccacttagaccgaccaccaaaatcttttccagcaaatcaacttctaggattgctggcctttctaagtccctagaaacctcttccgccctgagcccatcccttaagaacaaaagtaaaggtattcagtcaatcttgaaggtgccacaacctgttcctctcattgcccagaagcctgttggagagatgaaaaattcctgcaatgtgctgcatcctcaaagccctaataactctaaccgacagggctgtaaggtgcctttcggggagagcaaatactttcccagcagctcacccgtcaacatcctcctgagttcacagtcagtgtccgatacgttcgtcaaagaggtcctcaagtggaaatacgaaatgttcctgaatttcggccagtgtggaccaccagccagcctctgtcagagtatctctcgcccagtgccagtacggtttcataattacggggattattttaacgtcttcttcccattgatggtgctgaacaccttcgagaccgtcgcacaggagtggttgaactcacccaaccgagagaacttttaccaactccaagtgcgtaagttcccagccgattacatcaagtattgggaattcgccgtctatctcgaagaatgcgagctggccaaacagttataccctaaggaaaacgatctggtctttctggcacccgagcgaataaacgaagaaaaaaaagacacagaacggaacgacatccaggatctgcatgaatatcacagcggctatgtgcataagttccggagaacttccgtgatgcgcaacggcaagactgagtgctatctctccatccaaacacaggagaattttcccgctaaccttaatgaactggtgaattgcatagtgatatcatccttggtcacaacacagcgaaagctgaaggcaatgagcctgctgggaagtaggaatcagttagcaagggcagtcttaaacccgaatcctatggatttctgcacaaaagacctgctgactacaacatctgagcgaattatcgcttacctccgcgattttaacgaggatcagaagaaggccatcgaaacggcttacgctatggtcaagcactcgccaagcgttgccaaaatttgtcttatccacggcccgcctgggaccggaaagtcgaagaccatcgttgggttgctgtacagactgcttaccgaaaatcagcggaaaggacattctgatgagaatagtaatgctaagatcaaacagaacagggtgcttgtgtgtgccccctctaacgctgccgtggacgaactgatgaagaagatcattctggagttcaaggaaaaatgcaaggacaagaaaaatcctctagggaactgcggagacattaatttagtgcgcttaggcccagaaaaaagtatcaactccgaggtgttaaaattttcactcgattcccaggttaatcaccgcatgaagaaggaattaccctcccacgtccaggcaatgcataaacgcaaggagtttctggattaccagctcgacgagctctcaagacaacgggctctgtgtagaggcggaagagaaatccagcgtcaggaacttgacgagaatatctccaaggtgagcaaagaacggcaggagctggctagcaagatcaaggaggtgcaggggcgaccccagaaaactcagagcattatcatactggagtcacacatcatctgctgcactctgagcaccagcgggggactactactggaaagcgctttccgcggccaggggggggtgccattctcctgtgtgatagtcgatgaggctggacagagttgcgagatagagacactgaccccactcatccaccgctgcaataagctaatactggtgggtgatcctaagcagctccctccaactgtgatcagcatgaaagcccaggaatatggttatgaccagagcatgatggctcgattttgcagattgctagaggagaatgtggaacataacatgatctcccggcttccgatactacagctgacagtgcagtaccggatgcatcctgatatttgcctgttcccgtccaactatgtgtataaccggaaccttaagaccaaccggcagactgaagctatcagatgctcatctgactggccctttcagccgtacttggtgttcgacgtgggcgacgggtcagaaagacgagataatgattcctacatcaacgtacaggagatcaagttggtcatggaaataataaaactgattaaggacaagaggaaggacgtatcattccgcaacatcgggatcatcactcactataaggctcagaaaaccatgatccagaaggatttggacaaggagttcgacaggaaagggcccgcggaagtcgacaccgttgacgctttccaaggtcggcagaaggattgtgtcattgtgacttgcgtgcgtgcaaacagtattcaggggtcgatcgggttcttggcgagcctacagaggctgaacgtcacaatcactagggcaaaatatagtctgttcatcttgggccacctcaggaccctgatgcagctgctgcctcgcagtttctgcgtgcacgtgaaccactccccttttttttcccctgaaccgaagtacctgcattgggcactcaaggaaaatcaacattggaaccagttaattcaggacgctcaaaaacggggcgccattatcaagacctgcgataagaattatagacatgatgccgtgaaaattttgaagctcaaacccgtcttgcagagaagtctgacgcaccccccaactattgccccagaaggatctcgccctcagggggggctcccatcaagtaagctagattcaggattcgctaaaacctccgtggccgctagtctgtatcataccccgagtgactccaaagagataactctcacggtgacgtctaaggatcccgaacgcccgccagtccacgatcagctccaagatcccaggttgctcaaacgcatgggcatagaagtcaaaggtgggatcttcctctgggatcctcagccttctagcccccaacatcctggggctacacccccaacaggcgaacccggtttccctgttgtgcaccaggacctgagccacatccagcagccagctgcagtagtggctgctctgtcttctcacaagccaccagtgcgtggggagcccccggcagccagtcccgaggcaagtacctgccagagcaagtgcgacgatcccgaagaggagctctgtcaccgccgtgaagccagagccttcagtgaaggggagcaggagaagtgtggatctgaaacccaccatacacggcgcaacagtagatgggataaacggaccttagagcaagaggactcatcttccaagaaaaggaagttgctgtag

SEQ ID NO: 204530 - DNA, 7935 bp, Artificial Sequence
  Description of Artificial Sequence: Synthetic coding sequence
atgagcacctgctgctggtgcacccccggcggcgccagcaccatcgattttctcaaacgatatgcttctaacacacccagcggcgagttccagaccgccgacgaggacctgtgctactgcttagagtgcgtggcagagtaccacaaggcgcgagacgagctgccctttctgcatgaggtgctgtgggaattagagactctgagactgattaatcacttcgagaaaagtatgaaggctgaaatcggggacgatgacgaactctatatagtggataataacggagagatgcccctgtttgacattacgggccaagacttcgagaacaagctccgcgttccactgctggagattctcaagtatccgtacctccttctccacgaaagagtcaatgagctatgtgtcgaggctctgtgtcgcatggaacaggccaactgctcgttccaggtgtttgataagcatccaggaatctacctatttcttgtccacccaaatgaaatggtcagacgatgggccattctgaccgcccgaaatctaggcaaggttgatagagacgattactacgaccttcaagaagtccttttgtgcctctttaaggtgatcgagttgggactgctcgaatctcccgacatttacacaagtagtgtgctggaaaagggaaagctaattctcctcccgtcacacatgtacgacaccacaaactataaatcatattggctagggatctgcatgttactgaccatactcgaggagcaagctatggatagcctgctcttgggaagtgataaacaaaatgattttatgcagtctattctgcacaccatggagagagaggctgacgacgatagtgtggaccccttttggccagcacttcactgttttatggtaatcctcgatagattagggtcaaaagtgtggggacagctcatggatccaatcgtcgcgttccagactatcatcaataacgcatcttataaccgcgagattcgtcacataagaaatagtagcgttaggaccaagctggaacccgagtcttatttggacgacatggtgacctgcagccagattgtatacaactataatcctgaaaaaacaaagaaagattccggctggagaactgcaatttgcccggattactgcccaaacatgtacgaagaaatggaaacccttgccagcgtcctccagtctgacatcggccaggacatgcgggtgcacaactccacattcctttggtttatacccttcgtccagtcactgatggaccttaaagacctgggtgtagcctacattgcgcaggtagtcaaccatctctacagcgaagtgaaggaggttctgaatcagactgatgcggtgtgtgacaaggtgacagagttcttcctattaattctggtttccgtgatcgagctgcatcgcaacaagaagtgcctccacctcctgtgggtctcttcacagcagtgggtcgaggccgtggttaagtgtgcaaagttgccgacgacggccttcaccagatcttctgagaaaagctcagggaattgcagtaagggcaccgcgatgatcagcagtctgagtcttcacagcatgccctcaaattctgtccagcttgcatatgttcagctcatccggtctctgctcaaagagggctaccagctcgggcagcaatctctgtgtaagcgattctgggacaagcttaatctctttttacgcgggaacctttcactgggttggcagctgaccagccaggaaactcacgagttgcagagttgtctcaaacaaatcatcagaaacattaagttcaaggcaccaccttgtaatactttcgtggacttgacctccgcttgtaaaatttctccagctagttataacaaagaggagtctgagcagatgggaaaaaccagccgcaaagacatgcattgtctcgaagcaagcagtccgactttttcaaaagagcctatgaaggtgcaggactctgtgcttattaaggccgataacactattgaaggcgataataacgagcagaactatatcaaagacgtcaaactagaggaccatctactggccggcagctgtctcaagcagagctccaaaaatattttcacggaacgcgcggaagaccagatcaagatctccacacgaaaacagaaatctgtcaaagagatttcatcatacacacctaaagactgtacgtctaggaatggacccgaacgtggctgcgacagaggcattattgtttccacacgccttttaactgacagttccacggatgcactcgagaaagtgagcacaagcaacgaagatttcagcctgaaagatgacgctctggcaaaaaccagtaaaagaaagaccaaggtccaaaaggatgaaatctgtgcaaaactcagccacgtgatcaaaaaacagcatcggaaaagtacactggtggacaacaccattaacctcgacgagaatcttacagtgtccaacatcgaatctttctacagtagaaaagatacgggggtgcagaaaggtgacgggttcatccataacttgtcactggatcccagcggcgtgctcgatgacaaaaacggcgaacagaagtcacagaataatgtgctccctaaggagaaacagctgaaaaatgaggagttggtgattttttcctttcacgagaataattgcaaaattcaagaatttcacgtggatggcaaggaactgattccattcaccgaaatgactaatgcttctgaaaaaaagtccagtccctttaaagaccttatgaccgtaccagagtctagggacgaagagatgagtaacagcaccagcgttatatactctaaccttacgcgcgagcaggcgccagacatctcccccaaatcagataccctgaccgacagtcagatcgacagggacctacacaagctgtctttactggctcaagcctcggtaatcacattccccagtgacagcccgcagaactcatctcagctgcagcgcaaagtcaaggaggacaaacgatgttttactgccaaccaaaataacgtaggtgatacctcacgaggccaagtgattatcatatctgactctgatgatgacgacgacgagagaattctgtctttggagaaactgacaaaacaagataaaatatgcttagagagagaacaccctgagcagcacgtctccacagtcaactctaaggaagagaaaaacccagtgaaggaggagaagacagaaacactgttccagtttgaggagtctgactcccagtgctttgagttcgagtcctctagcgaagtattctcagtgtggcaggatcatcccgatgacaacaacagtgttcaggacggagagaagaagtgtcttgctcccatcgccaacacaactaacggtcaagggtgcactgactacgtatctgaggttgtcaaaaaaggagcagaagggatcgaagagcacacccggccacgttcaatctcagttgaagagttttgcgagattgaggtgaaaaaaccaaagcgcaagcgtagcgagaaaccgatggctgaagatcctgtcagaccgtcatccagcgtgagaaacgaaggtcagagtgataccaacaagcgagatctggtcggtaacgacttcaagagtatcgatcggcgtacatcaacacccaacagcaggattcaaagagcaacaaccgtctcccagaaaaaaagctccaagctctgcacttgtaccgaacctatccggaaagtgccggtgtcaaaaacaccgaagaagacgcattccgatgcaaagaaagggcagaataggtcttctaattatctgagctgcaggactactccagccatcgtgccccctaaaaaattcagacagtgccccgagcctacctctacagcagagaagcttggcttgaagaagggacctagaaaggcttacgaattgagccagcgctctctggattacgtcgcacagctgagagaccacggtaagactgtcggcgttgtggatacacggaagaaaacaaagctgatcagtcctcagaatctcagcgtgcgcaacaataagaagctgctgacctctcaggaacttcaaatgcagcggcagatccggcccaagtctcagaaaaacagacgtcgattgagcgactgtgaatcaactgatgtgaaacgagcaggtagccatactgctcaaaatagcgacattttcgttcctgagtctgatcggtctgactacaattgcacgggaggaacagaagtgttagctaatagcaaccgcaagcagcttataaagtgtatgccgtctgaacctgagacgataaaggcgaagcacggcagccccgctacagacgatgcatgtcctctcaatcagtgtgactctgtggtccttaatgggaccgtgcctaccaatgaggtcatcgtgtcaaccagtgaggatccgctgggaggcggcgacccaactgcgaggcacattgaaatggctgctttgaaagagggagagcccgattctagctctgatgcagaggaggacaaccttttcctaacccagaatgaccctgaggatatggatttatgcagccagatggagaatgacaactataaacttatcgagctgattcacggaaaagacactgtagaagtggaggaggactcagtgagcaggccacagcttgaatccctctccgggactaagtgtaaatataaggattgccttgaaactacgaagaaccagggtgaatattgtccaaaacatagtgaagtgaaggcagctgatgaggatgttttcaggaagcctggtctccccccccctgcaagcaaacctttaagaccaaccacgaagatcttctcctcaaaatccactagcaggatcgcaggactctccaagtcacttgaaactagttcagccctgtcaccgtcactgaaaaataagagcaaaggcattcaatccattctcaaggtgccacagcccgttccactcattgcccagaaacctgtgggcgagatgaaaaactcttgcaatgtgttgcatccacaatcacccaataactccaatcgccagggttgtaaagtccctttcggagagtccaaatactttcctagctccagtcctgttaatattctgctgtcctcccaatccgtcagtgacacgttcgtgaaggaagtgctcaagtggaaatacgagatgtttcttaatttcgggcaatgcggccctcctgcttctctttgtcagtcaatctctcgcccagtgcctgtgcggttccacaattacggtgactatttcaatgtgttcttccccctgatggtgctcaatacctttgagacagtggcacaggaatggcttaatagccctaatagagagaatttctatcagctccaggtcaggaaatttcccgcggattatatcaagtactgggagttcgcagtttacctggaagaatgtgagttggcaaagcagttgtaccccaaggaaaacgatctggtgtttctggctcccgaaaggattaacgaagaaaagaaggacaccgaaaggaatgatatccaggacttgcatgagtatcactccggatatgtgcataaatttaggcgaacgagcgtgatgcgcaatggaaaaaccgaatgttatctgagcattcagacccaagaaaacttccccgcgaacctcaatgagctcgtcaattgcatcgttatttcttctctggtgactacacagcggaaattgaaagcaatgtcccttttagggtcacgaaatcaactggctcgcgctgtcctcaaccccaaccccatggatttctgcaccaaggacctgcttactactacatccgaacgcatcatcgcatatcttagggacttcaacgaggatcagaaaaaagccatcgaaactgcctacgccatggtgaaacacagtccatctgtggcgaaaatatgtttaatacacggccccccgggtacaggtaaatccaagaccattgtgggcctactgtatagactactgactgagaaccagaggaagggtcactctgacgagaacagtaacgccaaaattaaacaaaaccgggtcctggtctgcgctccatccaacgctgcagtggatgaactgatgaagaaaatcatcctcgagtttaaggaaaagtgcaaggacaagaaaaaccccttgggcaactgtggagacattaaccttgtgcggctgggccccgaaaagtcaataaacagcgaggttctcaagttttcattggattcgcaggtgaatcatcgaatgaaaaaagaacttccatcacacgtccaggcaatgcacaagcgcaaagaattcttggactatcagctcgatgagctttctagacagcgggctctctgtaggggaggccgagagatacaaagacaggaactggatgaaaacataagcaaggtgtccaaggagagacaagagctggccagcaaaatcaaggaggtccagggaaggcctcaaaaaactcaatcaatcattatactggagtcccatataatctgctgtacattgtctacaagcggggggctcctgctggaaagcgcattccgggggcaggggggagtgcccttcagctgtgtgatagtggatgaggctgggcagagttgcgagattgaaacacttactccgttgattcacagatgcaataaactgatccttgtaggggatcctaagcagctgccacctacagtgatctccatgaaggcacaggaatatgggtatgatcaaagtatgatggctaggttttgtagactgcttgaggagaacgttgagcacaacatgatatcgcgattacccattcttcagctgacggtacaatatcggatgcatcccgacatatgcctgttccctagcaattatgtatataaccggaacctaaaaaccaaccgccagaccgaggccattagatgcagctccgattggcccttccagccctacctggtctttgacgtaggagatgggtccgagcggagggataacgatagctacattaacgtgcaggaaattaaactcgttatggaaatcatcaagctcataaaagacaaacgaaaggatgtgagttttcgtaacattgggattataacacattataaagcacagaagacaatgatccagaaagacctcgacaaagaatttgatcgaaagggctttttggcctccctccagcggcttaatgtgaccattacaagagcgaagtatagcctgttcattcttggacatctgcggacactgatggaaaatcagcattggaatcagttgatacaggatgctcaaaaacgcggtgcaatcataaaaacgtgcgacaagaattatcgtcacgatgccgtgaagatactcaagctgaaacccgtccttcagaggagtctgacgcaccctccgaccattgccccagaagggtcccggccccagggaggcttgccaagctcaaaactcgactctggctttgccaagacgagtgtggccgcaagtctctaccataccccctcagactcaaaagaaattaccctgaccgttacatcgaaagacccagagcgcccccctgttcatgatcagctccaggacccccggctgctcaagaggatgggcatagaagtcaaaggaggcatattcctatgggacccccagccaagcagcccgcagcatcccggcgctacaccccctaccggggagccaggcttcccggtcgtccatcaggacttgtcccacatacagcagcctgccgccgtcgtggctgcactctcttcccacaagcccccagttaggggcgaacctcctgcagcttccccggaggcgagcacctgccaaagcaaatgtgatgatcctgaagaggagttgtgccatcgccgagaggccagagctttctcggagggtgaacaggagaagtgtgggagtgaaacccatcatacgaggcgcaacagccgatgggacaaacgaacactggagcaggaggatagctcctccaagaaacggaaattgttatag

SEQ ID NO: 204531 - DNA, 2847 bp, Artificial Sequence
  Description of Artificial Sequence: Synthetic coding sequence
gtggcccaggagtggctgaacagccccaaccgggagaacttctaccagctgcaggtacggaaattccctgcggattatattaagtactgggagtttgcagtgtatctggaagaatgtgagcttgccaagcaactgtatcccaaggaaaatgatcttgtgttcctggcccccgagagaattaatgaggaaaagaaagacaccgaaagaaacgacatccaggacctccacgaatatcattctggttacgtgcataagtttaggcggacaagtgtcatgagaaacggcaagactgagtgctatctgagtattcagacacaggaaaacttccccgcaaaccttaatgagctggtgaattgcatcgtcattagtagcctggtaacgacccagagaaaattgaaggctatgtcccttctgggctcccgaaaccaattggcgagagcagttctgaaccctaaccccatggatttctgcactaaagacctactcactaccacttctgaaaggataatcgcctacttgagggacttcaatgaagaccaaaagaaagccattgagacagcatacgctatggtgaagcactcaccctccgttgcaaagatctgccttatacacggacccccgggaacaggcaaatccaagaccattgtggggcttctttacaggctgcttacagagaatcagcggaagggacattctgacgagaacagcaacgcaaagattaaacaaaacagggttctcgtctgcgccccgtccaatgcagccgtcgacgaattgatgaagaaaattatcctggagtttaaggaaaagtgcaaagacaaaaaaaacccgctgggcaactgtggcgacatcaatctagttaggctcggtcccgagaagagcattaatagcgaagtcttaaagttttctctggattcgcaggtgaatcataggatgaaaaaggaactcccctctcacgtgcaggcaatgcacaagagaaaagaatttctggattatcagctggatgagttgagtaggcagcgcgcactctgtcgaggtggccgcgagattcagcgccaggaactggatgaaaatatcagtaaggtatccaaggaacgacaggagctggcaagcaagataaaggaggtgcagggcaggccccagaagacgcaaagcattatcattctggagagccacatcatttgttgcaccttgtcgacgagcggtggactgttactggaatccgccttcagggggcagggaggcgtgccattttcatgtgtgattgtagatgaagccggccagtcatgtgagattgaaacgttgacccccttaatccacaggtgtaataaactcatcttagtcggcgatccgaagcagttgcctccaactgtgatttcaatgaaagcacaggaatacggatatgatcagagcatgatggccaggttctgccgcctgctcgaggaaaatgtcgagcacaacatgatttccaggctgccaatcctgcagctgacggtgcagtacaggatgcacccagacatctgcttgttccccagcaactacgtgtataaccggaatctaaagacgaaccgacagactgaggctattagatgctcgtccgactggcctttccagccctatctggtgtttgacgtgggtgatggcagcgaaaggcgagacaacgacagctatattaatgtacaggaaataaagttggtgatggagatcataaaactcattaaggacaaaaggaaagatgtctcctttcgcaacatcggcatcatcacgcactacaaggcgcagaagacgatgatccaaaaggacttagacaaggaattcgaccgaaaaggtccagctgaggttgataccgtcgacgctttccaggggcggcaaaaagattgcgtgatagtcacgtgtgtgagggcaaatagcatacagggctctatcggatttctcgcctcgctgcagcgcttgaacgtcaccatcaccagagctaagtattccctttttattcttgggcatctgcgcacgctgatgcagcttctcccaagatcattctgcgtgcatgtcaatcacagtccctttttctcgcctgaacccaagtatctgcactgggctttgaaggaaaatcagcattggaaccagctcatccaagacgctcagaagcggggagccatcatcaaaacctgtgacaaaaactatcggcacgacgccgtgaagattctcaagttaaaacctgtgttgcagcggagcctgacgcacccccctacgatcgcccccgagggaagcaggccacaggggggtctgcccagtagcaagctggatagtggttttgccaagacatctgtcgcggcgagtctgtaccatactccttccgactccaaagaaatcactcttaccgtgacatccaaggatcccgagcgccctccagtgcacgaccagcttcaggatcctagattactgaagcggatgggaatcgaggtcaagggcggaatctttttgtgggacccgcaacccagtagcccccaacatcccggagcgacacccccaaccggcgagccaggctttccggtggtccatcaggatctaagccatatccagcagcccgcggcagttgtggctgcactttcctctcataaaccaccagttaggggtgagcctcctgccgctagcccagaggcgtctacctgtcaaagtaaatgcgacgacccggaggaggagttgtgccatagaagagaagcccgggccttctccgaaggagagcaagaaaaatgtggctctgagacgcatcataccaggcgcaattccagatgggacaagaggactctggaacaggaggacagcagcagtaagaagaggaagctcctctag

SEQ ID NO: 204532 - DNA, 1269 bp, Artificial Sequence
  Description of Artificial Sequence: Synthetic coding sequence
atgagcaccagctacggctgcttctggcggcggttcatccacggcatcggacgaagcggggacatctccgcggtccaaccgaaagcagctggttcatctcttcttaacaagatcaccaatagtcttgttcttgacattattaaactcgcgggtgtacatactgtcgctaactgtttcgtggtgcccatggcgactgggatgagtctgaccctttgtttcttgactctgcgacataaacgtcccaaagctaagtacattatctggccccgaattgatcagaagtcttgtttcaaatcgatgattaccgctgggtttgaacctgtggtgatcgagaacgtgctggaaggggacgagcttcggacagatctcaaggctgtcgaagcgaaagtacaagaactgggtcctgattgcatactttgtatccattccaccacatcatgtttcgcgcccagagtgcctgataggctagaggaactggccgtcatctgcgcaaactacgacatcccccacatcgtgaacaatgcatacggcgttcaatcttctaagtgcatgcaccttatccagcagggggctagagtgggccggatcgatgctttcgttcagagtctcgataaaaatttcatggtgcctgtgggcggtgctatcattgccggttttaatgattcgttcatacaggagatttctaagatgtacccagggagggcgtcagcttcaccctcccttgacgtactaatcacactgctctctctcggttctaacgggtacaagaagcttctcaaagaacggaaggaaatgttcagctatttgtctaatcagatcaagaaattatccgaagcttacaatgaacgtctccttcacactcctcataaccctatcagcctggcaatgactctcaagacactggatgagcaccgcgacaaggccgtgacacaacttgggtcaatgttgttcacccgacaggtctcgggagcccgagtggtgcctcttggttccatgcagaccgtgagtggttatacgttccgcggcttcatgtcccatacaaacaactatccctgcgcctaccttaacgcggcaagcgccataggaatgaagatgcaggacgtggacttgtttatcaagcggttggacagatgcctgaaagcagtccgcaaagaaagaagtaaagagagcgacgataattacgataagactgaggacgtcgatatcgaggaaatggctcttaagctggataatgtcctgctggatacataccaagacgccagttcatag

SEQ ID NO: 204533 - DNA, 1506 bp, Artificial Sequence
  Description of Artificial Sequence: Synthetic coding sequence
atgaaccgggagagcttcgccgccggcgagcggctggtgagccccgcatacgtgagacaggggtgcgaagcgcgtcggtctcatgaacatctgatcagactgttactggaaaagggaaagtgtccagagaacgggtgggatgagtcgacactggagctctttcttcacgaacttgccatcatggatagtaacaactttctgggcaattgcggcgtaggagagagagagggacgtgttgctagtgctctcgtggctcgcaggcactatcggtttattcatggcataggaaggtcaggtgatattagcgcagttcagcctaaggccgctggcagctcactgctcaataaaataacaaatagcttagtcctggacatcataaaactcgccggtgttcacacagtcgctaattgctttgtggtcccgatggcaacagggatgtccctaactctctgtttcctaacattgcgacacaagcggcccaaggccaagtatatcatatggccgcgaatcgaccagaagagctgctttaagagcatgattactgccggattcgagcccgttgtcattgagaatgttctggagggcgacgagctgaggaccgatctgaaagcagtggaggctaaggttcaagagcttggtcccgattgcatcctgtgcatccactcgacaacatcctgctttgcacccagggtcccagaccgtttggaggaactggccgtgatttgcgctaattacgacatcccacacatagttaataatgcttacggggtgcagtccagcaagtgtatgcatctgatacagcagggcgccagggtgggccggatagacgcctttgttcaatcgctagataaaaattttatggtcccagtgggcggcgccataatcgcggggttcaacgattcttttattcaagagatatctaagatgtatcccggacgggcttctgcatccccttccctcgatgtacttatcacacttctttccctgggcagcaatgggtacaagaaactcctgaaggaacgaaaagagatgttttcctatctgagcaatcagatcaaaaaactgtctgaggcctacaatgagagactgcttcacactcctcacaaccctatctccctcgctatgactttgaagactttggacgagcacagagataaagctgtgacccagttaggatctatgctgtttacccgccaggttagcggcgcacgcgttgtcccgctgggctcaatgcagactgtgtccggctatacatttagggggttcatgagccacacaaacaattatccctgcgcctacctgaatgctgcatctgccatcggaatgaagatgcaggacgttgacctcttcataaagcgcctcgatcgatgtttaaaggcagtgcggaaggaacggagcaaagaaagcgacgataattatgacaagactgaggatgtggacatagaggagatggccctaaaactggacaacgtcctcctggatacctaccaggacgcatcaagttag

SEQ ID NO: 204534 - DNA, 903 bp, Artificial Sequence
  Description of Artificial Sequence: Synthetic coding sequence
atggagggcgtgctgtacaagtggaccaactacctgaccggctggcagccacgatggttcgtgctggataatgggatcctgtcgtattatgatagccaggacgacgtatgtaagggatcaaaaggctccatcaagatggccgtctgtgaaattaaggttcacagcgcagacaataccaggatggagctgattatccctggggaacagcatttttatatgaaagctgtgaacgcagcagagagacaaaggtggctcgtggcccttggttcctcaaaggcctgcttaacagatacccgtacaaaaaaagagaaggaaatcagtgaaacatccgaatcgctcaaaacaaaaatgtccgagttaagactttactgcgaccttctgatgcagcaggtgcacacaatccaggaattcgtccatcatgatgagaaccattctagtccatccgcagagaacatgaacgaggcctcttcattgttatccgcaacctgcaatacttttataacgacccttgaagagtgcgtgaagatagccaacgcaaagtttaaaccagaaatgtttcaactacatcaccccgatccacttgtttccccagtgtcaccttctccggttcagatgatgaagagatcagtgtcccaccccgggagctgcagcagtgagagatcgagtcactctataaaagagcctgtatcgactctccaccgcctctcccagcgacggagaagaacatatagcgatacagactcatgtagtgacatccccctcgaggatcctgaccgccccgtgcattgcagcaagaacaccctgaacggggacttggcatcggctaccattcctgaagagtctcggctgatggccaaaaagcagtccgagagtgaagataccctcccctctttcagctcctag

SEQ ID NO: 204535 - DNA, 1104 bp, Artificial Sequence
  Description of Artificial Sequence: Synthetic coding sequence
atggacaaggagtacgtgggcttcgccgccctgcccaaccagctgcaccgcaaatcagtaaaaaaaggatttgattttactctcatggtggcgggcgaatccggcctggggaagagtaccctgatcaatagtttgtttttaactaacttatatgaggatcgacaggtacctgaagcctctgcaaggcttacccagaccctcgccattgagaggcggggtgtcgagatcgaagagggcggtgtaaaggtgaaactaaccctggtggacacgccaggctttggcgactcggtcgattgttccgattgctggctgcctgtggtcaaatttatagaggagcagtttgagcagtatctcagggatgaaagcgggctgaatcgtaagaatatccaagactctcgcgttcactgctgtctttactttatttctcctttcggcagaggtttaagacccctggacgttgctttcctgcgcgccgttcacgaaaaagttaacatcattccagtgatcgggaaagccgacgccctgatgccccaggagacacaggccctgaagcaaaaaataagagatcagctgaaagaggaagaaatccacatctaccagttccccgagtgtgatagtgacgaagacgaggatttcaaacgtcaagacgctgagatgaaggagagtatccccttcgcagtcgtgggttcttgcgaggtggttcgcgacggcggaaaccgtcccgtgcgaggccggaggtacagttggggcacagtggaggtggaaaatcctcaccattgcgacttccttaatctgagaaggatgctcgtacagactcacctgcaggacttgaaggaggtaacacacgacctgttgtatgaagggtaccgggcaaggtgcctgcaatcattggccagacccggggcccgtgatcgagccagccggagcaagttatctagacagtccgctacggagataccactgccaatgctacctcttgctgacacagagaagctgattcgagaaaaagatgaggaactgagacgaatgcaggagatgttagaaaaaatgcaggcacaaatgcagcagtctcaggcccagggagagcaatcggacgctctgtag

SEQ ID NO: 204536 - DNA, 1104 bp, Artificial Sequence
  Description of Artificial Sequence: Synthetic coding sequence
atggacaaggagtacgtgggcttcgccgccctgcccaaccagctgcatcgcaagagcgtgaagaagggctttgattttactctcatggttgctggagaatctgggttgggaaagagtacactgatcaattccttgtttctgacaaacctgtatgaggatcggcaggttccagaggcaagcgccaggctcacgcagactctggccatcgagcggagaggtgtggaaattgaggaaggtggagtcaaggtgaaactgaccttggtggatacaccaggctttggtgattctgtggactgctcagactgctggctgcctgttgttaagttcatcgaagagcagtttgagcagtatcttagagatgagtcaggcctcaacaggaagaacattcaggatagccgggtgcactgctgcttgtacttcattagcccattcggccgtggcctgagacctctggacgttgccttcttgcgcgccgtgcacgagaaggtgaatataataccggtcattgggaaagccgatgcactgatgccacaggaaacacaggccttaaaacaaaaaatccgcgatcagcttaaagaagaggaaattcatatttatcagttccctgagtgtgactccgacgaggatgaagactttaaaagacaggatgcggaaatgaaagaaagtatcccctttgcagtggtcggctcctgcgaagtagtaagagatggaggcaatcgaccagtgcgtggaagacgctacagctggggaaccgtagaagtcgagaatccccaccactgcgacttcctgaacctgcgaaggatgttagtgcagacccatctccaggacctgaaagaagtgactcatgacctgctttacgaaggttaccgggccaggtgtctgcaaagcctcgctcggcctggtgccagggatagggcctctcgctccaagctttctcgccagtccgctactgaaatcccactcccgatgctcccgctcgcggatactgagaagcttattagagagaaagatgaagagctccgaaggatgcaggaaatgctggaaaagatgcaggcccagatgcaacagtcccaggctcagggcgagcagtcagatgctctctag

SEQ ID NO: 204537 - DNA, 966 bp, Artificial Sequence
  Description of Artificial Sequence: Synthetic coding sequence
atgatgaaccggtactaccagcccatcgtggactacatcgacgcccagttcgaagcttacctgcaagaagagcttaaaattaaaagatctctgttcacttatcacgattcaagaatccatgtatgcctttattttatatctcccacaggtcactccctgaagacactggacctcctgactatgaagaatctggactctaaagtcaacatcatccctgtgattgccaaggccgataccgtgtctaagacagagctgcagaagttcaagattaagctgatgagtgaactggtcagcaacggggtccagatctatcaatttcccacagacgacgacacgatcgcgaaggtcaatgccgcgatgaatggacaactgcccttcgccgtggtcggcagcatggacgaggtgaaggtggggaacaaaatggttaaagcacggcagtatccctggggcgtggtccaagtcgagaacgagaatcattgtgattttgtgaagctgcgggaaatgctgatttgcactaatatggaggacttgcgtgaacaaacccacactcgacactatgagctgtatcgcaggtgtaaacttgaagaaatgggttttacagacgtgggaccagagaataagcctgtgagcgtgcaggagacatacgaggctaagagacatgaattccacggcgagcggcagcggaaagaggaggaaatgaaacaaatgtttgtgcagagagtgaaagaaaaagaggccatactgaaggaagcggagcgagaacttcaggcaaagttcgagcatctgaaacggcttcaccaagaggaacggatgaagctggaagagaagaggaggctgctggaggaggaaatcatcgcatttagtaaaaaaaaggcgacatcagagatctttcacagccagagcttcttagccacaggcagtaatctgagaaaggacaaggacagaaagaactccaattttctctag

SEQ ID NO: 204538 - DNA, 954 bp, Artificial Sequence
  Description of Artificial Sequence: Synthetic coding sequence
atgagcggccacgtgggcttcgagagcctgcccgaccagctggtgaacagatcaatccaacaaggtttttgcttcaacattctatgtgtcggcgaaacaggtatcggcaaaagcactttaattgacacactctttaacactaacttcgaagactacgaaagctctcacttctgcccgaatgtcaagctgaaggctcaaacgtacgaactgcaagagagtaatgtccagctcaagcttactattgtgaatacagtaggttttggcgaccagattaacaaagaggagtcttaccagccgatcgtcgactatatcgatgcccagttcgaggcttacctgcaggaggagctgaagatcaagcgcagcctgttcacgtaccacgattcaagaattcacgtgtgcctgtattttatctcacccacaggccactccctgaagacgctggatcttcttacaatgaagaatttggacagtaaggtaaatataatcccagtgatcgctaaggctgacactgtgtccaaaacagagctgcaaaaattcaaaatcaagctaatgagcgagctagtatcgaatggagtgcagatctatcaattccccacagatgacgacaccattgctaaggttaacgcagccatgaatgggcagctaccattcgcagtggtgggtagcatggatgaggtcaaagtcggtaacaagatggtgaaagctcggcagtacccctggggagtggttcaagttgaaaacgagaatcactgcgatttcgtgaaactgcgagagatgttaatctgcacaaacatggaagacctcagagagcagacccatacacgccactatgagctgtatcgcaggtgtaaactggaggagatgggatttacagatgtggggcccgagaacaaacccgttagttaccgacccaacctgagcacactgcgggacttcactaaaaagagggagtag

SEQ ID NO: 204539 - DNA, 1635 bp, Artificial Sequence
  Description of Artificial Sequence: Synthetic coding sequence
atggccagcagcgaggtggcccggcacctgctgttccagagccacatggccacaaaaaccacctgcatgagctctcagggtagtgatgacgagcagataaaacgcgagaatatcagatctctcactatgtctggccacgtgggctttgaatccttacccgatcagcttgtcaatcgtagtatacagcagggcttctgttttaatatcttgtgcgtgggagagactggaataggcaaaagcacactgatcgacacactttttaacaccaatttcgaggattatgaaagcagtcacttttgtcccaatgtgaaactcaaggcacaaacctacgaacttcaagaatcgaatgtgcaactgaagctgactatcgtcaataccgttggatttggagatcagataaacaaggaggagagttatcagcctattgtggattacattgatgcacaatttgaagcatacttgcaggaggagctgaaaatcaagcggtccttgttcacataccacgacagcaggatacatgtatgtttgtatttcatttccccaactggccacagcctgaagacgctggaccttctaaccatgaagaaccttgactcaaaagtcaacatcattcccgtgattgccaaagcagacacggtcagtaagaccgaactgcagaagttcaagatcaaacttatgtcagagcttgtctccaacggcgtgcagatctatcagttccccaccgatgatgacaccatagcgaaggtgaacgctgccatgaatgggcagctgcccttcgccgttgtcggcagtatggatgaagtgaaggtggggaataagatggttaaggcacgccagtacccgtggggcgtggttcaggtggaaaatgaaaaccattgtgattttgtgaaactgcgggagatgctcatctgtaccaatatggaagaccttcgcgagcagacccatacaagacattacgagctctataggaggtgtaagctggaagagatgggctttacagacgtcggtccagagaataagccagtgagtgttcaggaaacctacgaggcaaagaggcatgaattccacggtgaacgccaaaggaaggaggaagaaatgaagcagatgtttgttcaaagggtaaaagaaaaagaagccatcctcaaggaggccgagcgcgaattacaagcaaagttcgaacacctcaaaagactgcatcaggaggaaaggatgaaactggaagagaagcgtcggctcctggaggaggagatcattgccttctcaaagaagaaggccacatcggagattttccacagccagagtttcctggcaactggatcaaacctaaggaaggacaaagatcggaagaaggagcctggctgtaggttcgaactgctttgcatcgatgtaagagcgtgcgagacaaatgggggtcgtaaagacgctgagaaggcaccaatcttctgtaaaacagaggtgccagagcaccggcgctcctcgtctcaggctaatttcattaaaaagaagctggaggtgtgttttgatttcgcagtgatttgcttcattacctctatctttggtgaacagccccagctgctgatcttcatggaaaaatacttccaggtgcagggccagtatatttcacagtccgagtag

SEQ ID NO: 204540 - DNA, 1365 bp, Artificial Sequence
  Description of Artificial Sequence: Synthetic coding sequence
atggccagcagcgaggtggcccggcacctgctgttccagagccacatggccaccaaaaccacctgcatgtcgtctcagggttctgacgacgagcagatcaagagggaaaacatacggagcttaacaatgtccggtcatgtgggattcgagagtctgccagatcaacttgtcaaccggagtatccagcaggggttttgttttaatatactttgtgtgggggaaacagggatcggaaagtcaacactgattgacaccctgttcaatacaaatttcgaagactatgagtcctctcacttctgtcctaatgttaagctcaaagcccagacctacgaactccaagaatccaatgtgcagctcaagctgaccatcgttaacacagttggattcggagaccagatcaataaagaggagtcctatcagcccatcgtggattacattgatgcacagttcgaggcgtacttacaggaggagttgaaaataaaaagatcactgttcacttaccacgactcgcggattcacgtgtgtctgtacttcatctcaccaaccggccatagtctgaaaacgctggatctgctgacaatgaagaacctggattcaaaggtgaatattattcccgtgatcgccaaagccgataccgtttcaaaaactgaactgcagaagtttaaaattaagctgatgagcgaacttgtttccaacggagtccagatctatcagtttcccactgacgacgatactattgctaaagtaaacgcggccatgaatggtcagctgcccttcgccgtcgttgggtcaatggacgaagtgaaggtcgggaacaaaatggttaaagccaggcagtacccctggggagttgtgcaggtggagaatgagaaccactgtgatttcgtgaagctccgagagatgctgatttgcacaaatatggaggatctgcgtgagcagacacacacgcgccactacgaactttatcggaggtgtaagttggaggagatgggctttactgacgtgggcccagagaacaaacccgtcagtgtccaggagacctatgaagctaaaaggcatgagttccacggagagcgccagcgcaaggaggaagagatgaagcagatgtttgtccaacgggttaaagaaaaggaagccattttgaaagaagctgagagagagctgcaagcgaagttcgagcacctcaagaggttacaccaggaggagaggatgaaattggaagaaaagagaagactattggaagaagaaattatcgccttttcaaagaagaaagccaccagcgagattttccacagtcagagttttctcgccacagggagcaacctgaggaaagacaaggacagaaaaaattccaacttcctgtag

SEQ ID NO: 204541 - DNA, 1296 bp, Artificial Sequence
  Description of Artificial Sequence: Synthetic coding sequence
atggccagcagcgaggtggcccggcacctgaagcgggagaacatcaggagcctcaccatgtccggtcacgtcggattcgaatcactgccagaccagctggtaaaccgctccattcaacaaggcttttgttttaacatcttatgcgtcggtgaaacgggcattggcaagagcaccctcattgacaccttgttcaataccaatttcgaagattatgagtcgtcgcacttttgcccaaatgttaagctcaaggcgcagacgtatgaattgcaggagtcaaatgtgcagttaaaattaactatagtgaatacggtaggcttcggggatcagatcaacaaggaagagtcctatcagccaattgtcgactacatagacgctcagtttgaggcctacctgcaggaagagcttaaaattaagcggtctctgttcacctatcatgacagccgtattcacgtctgtctgtactttatttcacccactggacattccctcaagacactggatcttctaacaatgaaaaatttggacagtaaggtaaatatcatccctgtgatcgccaaggcagatacagtctccaagaccgaactccagaagtttaaaatcaagctgatgtccgagctggtgtcgaacggtgtacagatttaccaatttcccacagacgatgatactattgctaaggtgaacgccgcaatgaatgggcagctccctttcgccgttgtcggcagcatggatgaggtcaaggttggcaacaagatggtgaaagcccggcaatacccatggggggttgtacaagttgaaaatgagaatcactgtgactttgtgaaacttagagagatgctcatttgcacaaacatggaggatctgcgggaacagacacacaccaggcattacgagctatacagacgatgtaaactggaagagatgggattcacagacgttgggccagagaataaaccagtctctgtgcaagagacatacgaggcaaagcggcacgaatttcacggagagcggcagaggaaggaggaggagatgaagcagatgttcgttcagagggtcaaggagaaggaggcaatcctgaaggaggccgaacgcgagctgcaggccaaatttgagcacttaaaacggttacaccaggaggagcgcatgaagctcgaggagaagcgccgactgcttgaagaggagataattgctttctctaaaaaaaaggccaccagcgaaattttccacagtcagagctttttggctaccggtagtaatcttcgcaaggacaaagaccgcaaaaactccaattttctttag

SEQ ID NO: 204542 - DNA, 1353 bp, Artificial Sequence
  Description of Artificial Sequence: Synthetic coding sequence
atggccagcagcgaggtggcccggcacctgctgttccagagccacatggcaaccaagaccacctgcatgtcttcccaagggagtgacgacgaacagatcaagcgcgagaacatcaggtccctcaccatgtccggtcatgtgggcttcgaaagtttgcctgatcagttggtgaatagatctatccagcagggattctgtttcaacatcttgtgtgttggtgaaaccgggataggaaaatccaccctgattgataccctgttcaatactaactttgaggactacgaatccagtcatttttgccctaacgtgaagctcaaagcccaaacgtacgaactacaagagagcaatgtccagctgaagcttacaattgttaacactgtcggctttggtgaccagatcaacaaagaggagtcataccaaccaatcgtagactacatcgatgctcaatttgaggcctatctacaagaagagctgaaaataaagagatcactgtttacataccacgacagccggattcacgtgtgtctctatttcatctccccaacaggccactctttaaagactctagacctgctgactatgaagaatctggacagcaaggtgaatataatccccgttatcgccaaggccgataccgtgagtaagaccgaacttcagaaattcaaaattaaactgatgtccgaattagtttccaatggtgtgcagatctatcagtttcccacggatgatgatacaatcgcaaaggtaaatgccgcaatgaatggccagctccctttcgcagttgtaggttctatggatgaggtgaaagttgggaacaagatggtcaaggccaggcagtacccttggggcgtggtgcaggtggaaaatgaaaaccactgcgatttcgtaaaactgagagagatgctgatctgtaccaacatggaggatctgcgcgaacagacccatacccggcattacgagctctaccggcggtgcaagctggaggagatgggattcacagacgtgggtcccgaaaataaacctgtgagtgtgcaggagacatacgaggccaagcgccatgaattccatggagaaaggcaaagaaaggaggaagagatgaaacagatgttcgttcagagagtgaaagagaaggaggctattctcaaggaagccgaaagagagctgcaagccaagttcgaacacttaaaacgcctacatcaggaagagcgtatgaagctggaggagaaacgcagacttctcgaagaggagatcattgccttcagtaaaaagaaagccacctctgagatcttccattcccagtcatttttggctactggaagtaatctgaggaaggacaaggaccgcaagaagtag

SEQ ID NO: 204543 - DNA, 1422 bp, Artificial Sequence
  Description of Artificial Sequence: Synthetic coding sequence
atggccaccaagaccacctgcatgagcagccagggcagcgacgacgagcaaattaaaagagaaaacatcaggagcctgaccatgtccggccacgttggattcgagtccctacctgaccaattggtgaacagatccatccagcagggcttctgttttaacattttatgtgtgggcgagaccgggataggcaaatcaaccttgattgacaccctgttcaacacgaatttcgaggattacgaatcctcccacttctgtccgaacgtgaaactgaaagctcagacctacgaactgcaggagtctaacgtgcagttgaaacttacaatcgtgaacacggtgggctttggcgaccaaatcaacaaagaggagtcataccagcccatcgtggattacatcgatgcccagttcgaggcttatctgcaagaggagctcaagattaagcgtagtctgttcacctaccacgactcaaggattcatgtctgtctgtacttcatttcgccaactgggcattccctcaagacgttggatttgctgacgatgaaaaatctcgatagtaaggtcaacatcattcctgtaatcgctaaggcagacacggtgtccaagacagagttgcagaaatttaaaatcaaactgatgagcgaactggtgtccaatggagttcagatttaccagtttcctaccgacgatgacacgatcgccaaagtgaatgccgctatgaacggacagctgcccttcgccgtggtaggttcgatggacgaggtgaaggtgggtaataaaatggttaaggccagacaatacccttggggcgtggtgcaggtcgagaatgaaaatcattgcgattttgtgaagctgagggaaatgctgatttgcacaaatatggaggatttgcgggagcagactcacaccaggcattatgaattgtataggcgctgtaaactggaagagatggggtttacagatgtggggcccgagaacaagcccgtgtctgttcaggagacctatgaagccaaaaggcacgaattccacggcgagcggcagaggaaagaagaagagatgaagcagatgtttgtgcagagagtgaaagaaaaggaggccattctgaaagaggccgaacgggagctgcaagctaagtttgagcacctgaagcgcctccaccaggaagagaggatgaaactggaggaaaaaaggcgacttttagaagaggagatcatagcattctccaagaagaaagcaacctcagagatattccacagccagagcttcctggcgaccggcagtaatctgagaaaagataaggatagaaaaaaggagcccggctgtcggtttgagctcttgtgcattgatgtgagggcctgcgaaacaaacggcgggcggaaagacgctgagaagggccgggagggtcactccgcacggggacaaccgtag

SEQ ID NO: 204544 - DNA, 852 bp, Artificial Sequence
  Description of Artificial Sequence: Synthetic coding sequence
atggccagcagcgaggtggcccggcacctgctgttccagagccacatggcaacaaagaccacctgcatgagttcccaggggagcgacgatgagcagatagtcaatatcatccccgtcatcgcaaaagcggacacagtgagtaagaccgaactgcaaaaatttaagatcaagctgatgtccgaactggtcagcaacggcgtgcagatctaccagttccccacggacgacgatacaatcgccaaggttaacgcagccatgaatggacagcttccatttgccgtagtcggcagcatggatgaggttaaagtcggcaataaaatggtcaaagcccggcagtacccctggggagtggtgcaggttgagaacgagaatcattgtgatttcgtgaagctgagagaaatgttgatttgcactaatatggaagatctgcgcgaacagacacataccagacattatgaattgtaccgccgctgtaaattggaggaaatgggctttactgacgttggcccggaaaacaaacccgtttcggttcaagaaacttacgaggcaaagaggcacgaatttcatggtgagcgccagcgtaaggaggaagaaatgaaacagatgtttgtgcaaagggtgaaggagaaggaggctattctaaaagaagctgaaagggagctacaggccaagttcgaacacctcaagcgacttcatcaagaagaaaggatgaaattagaggagaagaggcgcctcttagaggaggagattattgcctttagcaagaagaaggctacgtctgaaattttccacagccagagctttctggccaccggaagcaacctgcgcaaagacaaggacagaaagaagtag

SEQ ID NO: 204545 - DNA, 1290 bp, Artificial Sequence
  Description of Artificial Sequence: Synthetic coding sequence
atggccgtggccgtgggccggcccagcaacgaggagctgcggaacctgagcctgtccggccatgttggattcgactccttgccagatcagttggtgaataaatcgacaagccagggcttttgttttaacattctgtgtgtcggagagaccgggataggtaagagcacactgatggatactctcttcaatacaaaattcgagtccgatcctgctacacacaacgagccaggcgtccgactgaaggcaagatcgtatgagctgcaggagagtaatgtgcgcctgaagttaactatagtggacacagttgggttcggcgaccagattaacaaagatgactcatacaaacctattgtggaatacattgatgctcagttcgaagcctacctgcaagaggagttaaagattaaaagaagcctgtttaattatcatgacacacgcatccacgcttgcctgtattttatcgctcccacaggtcactctttgaaatcacttgatcttgtgactatgaaaaagctggattccaaagtcaatattatccctataatcgccaaggccgacacaattgccaaaaacgaactacacaaattcaagagcaaaatcatgtctgagctggtatccaatggggtgcagatctatcaatttcctaccgacgaggagacagtcgccgagatcaacgcaaccatgtccgtgcacctgccttttgcagtggtgggatcgaccgaagaagttaagataggaaataaaatggccaaggccaggcagtatccatggggcgtcgttcaggttgaaaatgagaatcattgtgattttgtgaagctccgagaaatgctgattagggtcaacatggaggatctgcgggagcagacacacactaggcattacgaactgtacaggcgctgcaagcttgaagagatgggctttaaagacactgacccagacagcaaaccattttcactccaggaaacatacgaggcgaaacgaaatgaattcctgggagaactgcagaagaaagaagaagagatgcgtcagatgttcgtgatgcgggtcaaggagaaggaggctgagctgaaagaagccgaaaaggagctgcacgaaaagtttgatctacttaagagaacccatcaggaagaaaagaaaaaggttgaagataaaaagaaagaactggaggaggaagtcaataactttcagaagaagaaagcagccgcacagctgctacagtcacaggcgcagcagtccggggcccagcagaccaaaaaggacaaagacaagaagaatgcttcttttacctag

SEQ ID NO: 204546 - DNA, 1278 bp, Artificial Sequence
  Description of Artificial Sequence: Synthetic coding sequence
atggccgtggccgtgggccggcccagcaacgaggagctgcggaacctcagcctctccggacacgtcggctttgacagcctgcccgaccaactggtgaataaatccacgtctcagggcttctgttttaacatactttgcgtaggagagactggtattgggaaatctacactgatggacacactattcaacactaagttcgagagcgatcctgccacccacaacgagcctggagtccgattgaaagctaggtcgtatgagctccaggaatccaacgtgcgcctcaaacttacaattgtggatacggtcggattcggagatcagatcaataaagatgacagttataagcccattgtggagtatatcgacgcacagttcgaggcttatcttcaggaggaattgaagattaagcgcagtctgttcaattaccatgacacgcgcatccatgcctgtttatatttcatcgccccgacgggtcattcactgaagagtctggacctagtcactatgaagaaactcgacagtaaagtcaacatcattccaattatcgccaaagctgatacaatcgccaagaacgagctgcacaagtttaagtcaaagatcatgagcgaattggtgagcaatggggtgcagatatatcagttcccgaccgatgaggaaacagtagccgagatcaacgcgacaatgtcagtccacctcccttttgctgttgtcggcagtactgaggaagtcaagattggcaataagatggctaaagcccgacaatatccctggggcgtggtccaggtggaaaacgagaaccattgtgattttgtaaaattgcgggaaatgctgattcgcgtgaacatggaggatctcagggagcaaacacatacccgacactatgagctttaccgaagatgtaagctagaggaaatgggatttaaggacacagaccctgattctaagcccttctcacttcaagagacctatgaagccaaaaggaatgaattcctcggcgagttgcagaaaaaagaggaggaaatgcgccaaatgtttgtgatgagagtcaaagagaaggaggcagaacttaaggaggcagagaaagagctgcacgagaagttcgatctgctgaagagaacccaccaagaggaaaaaaaaaaggtggaggataagaagaaggaattggaagaagaggtcaacaacttccagaaaaaaaaggcagcagcacagctgctccaatcacaggcacagcagtcaggcgcacaacagaccaagaaagacaaggacaagaagaagtag

SEQ ID NO: 204547 - DNA, 1320 bp, Artificial Sequence
  Description of Artificial Sequence: Synthetic coding sequence
atggaggagcggaagcccgcccacgtgctgcggagcttcaagtacgctgcctttatgaacgaggagcttcgcaatctctccttgtccggtcatgtggggtttgactcgttgcctgaccaactggtaaacaagtcaacgtcccaaggcttttgcttcaacatcctctgtgtcggcgaaactggtattggaaaaagcacgctcatggatactctgtttaataccaagttcgagtccgatcctgctacgcataatgaacctggggtccggctgaaagccagatcgtatgaactgcaggaatctaatgtacggctgaaactgactatagttgacacggtgggctttggggaccagataaataaggatgactcctacaagccaatagtcgagtacatcgacgcacagttcgaagcgtacctgcaggaggagctgaagatcaagcgcagtctattcaattaccatgacacacggatccacgcttgtttatattttatcgctcccaccggccactccctaaaatctctagatttagtgaccatgaaaaaactggacagtaaagtgaatatcatcccaatcattgctaaagcagatacgatcgcaaaaaatgaactgcacaagttcaaatcgaagattatgtccgaactggtgtccaacggtgtgcaaatctaccagtttcccaccgatgaagaaaccgtagccgagatcaacgcgaccatgtctgtgcacttaccgtttgccgttgtggggtccaccgaagaggttaaaattggaaacaagatggccaaagctcgccagtacccatggggcgtggtacaagtagagaacgaaaatcattgcgatttcgtgaagctgcgagagatgctgatcagggtgaacatggaagatctaagagaacagacccatacccgccattatgaattgtaccgccgttgtaagctcgaggaaatgggctttaaggatactgacccagactcaaagcctttttctctgcaagagacatatgaggctaaacggaacgagttcctgggagagctgcaaaagaaggaggaggagatgaggcagatgtttgttatgcgggtgaaggaaaaggaagccgagctcaaggaagctgagaaggaactgcacgagaagtttgatctcctgaagagaacccaccaggaggaaaaaaagaaagtcgaagacaaaaaaaaagagttggaggaggaagtgaataacttccagaagaagaaggcagccgctcagttgctccaaagtcaggcacagcagagcggggcccagcagactaagaaagacaaggacaagaaaaatgcctcgttcacatag

SEQ ID NO: 204548 - DNA, 1077 bp, Artificial Sequence
  Description of Artificial Sequence: Synthetic coding sequence
atggaccccctgcggcggagccccagcccctgcctgagcagccagccctcctcaccaagtacgccaccctgtgagatgcttgggccagtaggtatcgaagctgtgttggaccagctgaaaataaaagccatgaagatgggttttgagttcaatatcatggttgtcggacaatctggtctcggcaaatccacaatggtgaacacacttttcaagtcaaaggtgtggaaatccaatccacccggactaggagttcctacgccacaaactctgcagctccacagcctgacccacgtgattgaggagaagggcgtaaagctgaagttaactgtcacagacacacccggtttcggggatcagataaataatgacaactgttgggacccgatcctcggttacataaatgagcagtacgagcaatatttgcaggaagaaatcctgatcaccaggcagcgccatataccagacactagggttcactgctgtgtttatttcgttccaccgacaggccattgtctccgtcctttggacatcgagtttcttcaaagactatgccgaaccgttaacgtcgtaccggtcattgcacgggcggatagtctgacaatggaggagagggaagctttcagaaggagaatccagcagaatttacgaacccattgcatcgatgtgtatccgcagatgtgtttcgatgaggacataaacgataaaatccttaattcaaaacttagggacaggatcccttttgccgtggttggtgctgatcaggagcatctggtgaatggtcggtgcgtgcttggccgcaagacaaagtggggcatcatcgaggtggagaatatggcccattgtgagtttccactattgagagacctcctgattcgatcacaccttcaggatctcaaggatatcacacacaacattcactacgagaactatcgtgtcatccgactcaacgagtcccatctgctacctaggggaccaggttgggtaaatctggcaccagcgagtccgggccagcttactactccacgcaccttcaaggtgtgccgaggtgcacatgatgacagcgacgatgaattctag

SEQ ID NO: 204549 - DNA, 939 bp, Artificial Sequence
  Description of Artificial Sequence: Synthetic coding sequence
atggaccccctgcggcggagccccagcccctgcctgagcagccagccaagctctccttcgacacctccctgtgagatgctaggcccagtgggaattgaggccgtgctcgaccagcttaaaatcaaggcaatgaaaatgggtttcgagttcaatattatggtggtgggacagagcggcttaggcaagagtacaatggtaaatacgctatttaaatccaaagtttggaagtcaaatcctcctggactgggggtgccaacaccacagactctccaactgcattccctcacgcacgtaatcgaggaaaaaggagtgaaactcaaattgaccgtgaccgacactcctggattcggtgaccaaatcaataacgacaattgtttgagacctctcgacattgaattcctgcaacgcttatgccggactgtcaacgtcgttcccgtgattgcaagagcagactccctcactatggaagaaagagaggcctttaggcggcgcatacagcagaatctccggactcattgtattgacgtctatccacaaatgtgctttgacgaagacatcaatgacaagatcttaaattccaagttgagggataggattccgttcgccgtcgtcggcgccgatcaggagcaccttgtcaacggccggtgtgtgctgggacgcaagaccaagtggggaataatcgaggttgagaacatggctcattgtgagttccccctgcttcgggatctgctgatccgctcccatttgcaggatctgaaggacatcacccacaatattcactacgaaaattatagggtaataaggctgaatgagtcacaccttttaccgaggggcccaggatgggtcaacctagcaccggcctctcccggacagcttaccactccccgcacatttaaggtgtgcaggggtgctcacgacgattccgacgatgagttttag

SEQ ID NO: 204550 - DNA, 1299 bp, Artificial Sequence
  Description of Artificial Sequence: Synthetic coding sequence
atggccgagcggaccatggccatgcccacccagatccccgccgacggcgatacacagaaggaaaataatatccgttgcctgacgacaatcgggcactttggctttgagtgcttgcctaatcaattggtgtcccgctctattcgtcagggtttcaccttcaatattctgtgcgtcggggagaccggcattggaaaatcaaccctgattgacacactctttaataccaacctcaaggacaacaagtcaagtcacttttactccaatgtcggcctgcaaattcaaacttacgaactacaggagtcaaatgtgcagttgaagctcactgtggttgaaacggtcggctatggggaccagattgacaaagaagcctcgtaccagcccatagttgattacatcgacgcacagtttgaagcatacctccaagaggaattgaaaattaagcggtctctgttcgagtaccatgattctagagtgcatgtgtgcctgtatttcatttctccgaccgggcacagtttaaagagccttgatctcctgactatgaagaacttagatagtaaagttaatatcatccctttgatcgcaaaggccgacactatttccaagaatgacctccagaccttcaagaacaagatcatgagcgaactgattagcaacggaatccaaatctaccagttgcccacagatgaagagactgccgcgcaggcaaacagctcagtgagcgggctactgccatttgccgtcgttggaagtacagacgaggtgaaggtcggcaagaggatggttagggggagacattacccgtggggagtgctgcaggttgaaaacgagaatcactgcgattttgtgaagctaagggatatgctgttgtgtacaaatatggaaaacctcaaggagaagacacatacccagcactacgagtgctaccgttatcagaaactacagaaaatgggctttacggatgtgggaccaaacaatcagcctgtgagttttcaagagatatttgaggctaagaggcaagaattttacgaccagtgtcagagagaggaggaggagctgaagcagaggttcatgcagcgggttaaagaaaaggaagccacgtttaaggaagccgaaaaagagctccaagacaaattcgaacacctgaaaatgattcagcaggaagagatcaggaagctagaagaggaaaaaaaacagttggagggtgaaataatcgatttttacaagatgaaggccgcctctgaagcactgcagacacagctcagcaccgatacaaaaaaggacaagcatagaaaaaaatag

SEQ ID NO: 204551 - DNA, 1086 bp, Artificial Sequence
  Description of Artificial Sequence: Synthetic coding sequence
atgagcaagcagcagcccacccagttcatcaaccccgagacccccggctacgtcgggtttgccaatcttcccaatcaggtgcatcggaaatccgtgaaaaaggggttcgagtttactctcatggttgtgggagagtccggcttgggtaagtcgacactcatcaatagcctgttcttgacagacttgtatcccgagcgggtgatccctggcgcagccgaaaagatagaaagaacagtgcagatcgaggccagcacagtggagatagaggagcgcggagtgaagctgagactcactgtggtagacactccgggctacggcgatgctattaattgtcgggactgttttaagacgattatcagctacatagatgaacaattcgagaggtatctccatgacgaatctggtttgaatcggagacatattattgacaaccgcgtacattgctgcttttattttatctcacccttcgggcacggtctgaaacctctggacgtagccttcatgaaggcaatccataacaaagtgaatattgtccccgtcatcgctaaggccgacacgctgaccctgaaagaaagggagcggctgaagaaaagaattctggacgagatcgaagaacacaatattaagatttaccacttgcctgacgcggaaagtgacgaagatgaagacttcaaagaacagacccgtcttctcaaggcatctatacccttctcggtcgtggggagcaatcagctcatcgaggcaaaagggaagaaagtgcgaggccgcctatatccctggggagtcgttgaggtcgagaaccctgagcataatgactttctgaaacttcgtaccatgttaatcacgcatatgcaggatttacaggaagttacacaagatctacattatgaaaactttcggagcgagcgtctgaaacgaggaggaaggaaggtggaaaatgaggacatgaacaaagaccaaatcttgcttgagaaagaagccgaactgagacgaatgcaggagatgatagccagaatgcaggcacagatgcaaatgcagatgcagggaggagacggcgatggtggtgctctaggtcatcacgtgtag

SEQ ID NO: 204552 - DNA, 1086 bp, Artificial Sequence
  Description of Artificial Sequence: Synthetic coding sequence
atgagcaagcagcagcccacccagttcatcaaccccgagacccccggctacgttggctttgcgaatttacccaatcaggtccataggaagtctgtaaaaaaaggctttgaattcaccctaatggtggtgggtgaaagtggacttggcaaatccacgctgataaattctctcttcctcacagacttgtaccctgagagagttattccgggagcagccgagaaaattgagaggacagtacaaatagaagcgtctactgtcgagatcgaagaaaggggagtgaagctccgtctgacagtcgtggacaccccgggatacggagatgccattaattgcagggattgctttaaaaccattatctcctatatcgacgagcagtttgaaagatacctgcacgacgaatctggtctaaataggagacacattatagataacagggtgcattgttgcttttacttcatcagtccttttggccatggactgaagccgttggatgtggcttttatgaaggccatccacaataaggtgaatattgttcctgttatcgccaaggctgacactctgactctcaaagagagggagcgactcaagaaaaggattctggacgaaatcgaggaacacaatataaaaatctaccatctgccagacgccgaatctgatgaggacgaggactttaaagagcagacccgattgcttaaggcgtccattcccttctcagtggtggggagcaaccagttgattgaggccaagggcaagaaggtgagggggcgtctgtacccgtggggcgtggtcgaggttgaaaaccccgagcataatgactttttgaagttgagaactatgcttataacgcatatgcaagacctgcaagaggttacccaggacctgcactacgaaaatttcaggtctgagaggctcaagcggggcgggcgcaaggtggagaatgaggacatgaataaggaccagatcttactcgaaaaagaggcagaattgagaagaatgcaggagatgatcgccagaatgcaggctcaaatgcagatgcagatgcagggcggggacggagatggtggggccctaggccatcatgtctag

SEQ ID NO: 204553 - DNA, 1191 bp, Artificial Sequence
  Description of Artificial Sequence: Synthetic coding sequence
atgccctggatcagcgagggccgggccacccggccctgcctgcgggttccctccgcccgccgaggtgatgaggggttgcaccagcgggacgaggccagccagaagatgagcaaacagcaacctacacagtttataaaccccgagactcccgggtatgtcggcttcgccaatttgccaaaccaggtgcaccgaaagtcggtgaaaaaaggattcgagttcaccctcatggtggttggtgagagtgggctggggaagtccactctgatcaactctctgtttttgaccgacctttatcctgagagggtcattccaggtgccgccgagaagattgagcgtactgtgcaaattgaggctagcactgtagagatcgaagagcgtggcgtgaaactccggttaacagtggtggatacgcccggctatggagatgccatcaattgtagggactgtttcaaaaccatcataagctacatcgacgaacagttcgagcgctatctgcacgatgaatctggactcaataggagacacattatcgataaccgagttcattgttgtttttacttcatctcccctttcggccatggcttaaagcctttggatgtggcattcatgaaggccattcataataaggtaaatattgttccagtcatcgcaaaggccgacacactgacactgaaagaaagggaacggcttaagaagcggattctggacgagatcgaagagcataatataaaaatttatcatctgcctgacgccgagagcgatgaggatgaggacttcaaggaacagacaaggctcctcaaggcatccatcccattctcggtggtcggttctaatcagctaatcgaagcgaagggaaaaaaggtccggggccgtctttatccctggggagtggtggaggtggaaaatcctgagcataacgattttctgaagctccggacgatgttgataactcatatgcaggatctgcaagaggtgacccaggatcttcactacgaaaacttcaggtcagaacgcctcaaacggggcggcaggaaggtggagaacgaagacatgaataaagatcagatcctcttggaaaaggaagccgaactacggaggatgcaggagatgatcgcccgcatgcaggcccagatgcagatgcaaatgcagggaggggacggggatgggggagccctggggcatcatgtgtag

SEQ ID NO: 204554 - DNA, 1086 bp, Artificial Sequence
  Description of Artificial Sequence: Synthetic coding sequence
atgagcaagcagcagcccacccagttcatcaaccccgagacccccgggtacgtggggtttgcaaacctcccaaatcaggtccaccggaagagcgtgaaaaagggctttgagttcacactgatggttgtgggcgaaagtggcctcggaaagtccaccctgatcaattcccttttcctaacagatctgtatcctgaaagggtaataccaggagcagccgagaaaattgaaaggacagtgcagatcgaagcctcaacggttgaaatcgaagaacgaggcgtaaagctgcggctgaccgtagttgacacccccggctatggcgacgcaattaattgccgggattgtttcaaaacgattatatcctacatcgacgagcaatttgaaagatacctccacgatgagtccggtctcaaccgcagacatataatagacaatcgcgttcattgttgcttttactttattagccctttcggccacggactgaaaccgctggacgtggcatttatgaaggcgatccataataaggttaacatagtcccggtcattgccaaggctgacactctgaccttaaaagaaagagagcgcctaaagaaacggatactggacgagatagaggagcacaacataaagatctatcatctgccggatgccgagagtgacgaagatgaagacttcaaggaacaaacgcgattgctgaaagcctctattcccttcagtgtggtcggctcgaatcagctgatcgaggccaaggggaagaaagttcgcggccggctttacccgtggggagtcgtcgaggtggagaatcctgagcacaacgacttcctcaagctgaggacaatgctcatcacccatatgcaagaccttcaagaagtgacccaggaccttcactatgaaaactttcgatccgaacgtcttaaacggggtggacgaaaagtcgagaacgaggatatgaataaagaccagatcctcttggagaaggaggcagaactgagaagaatgcaggaaatgatcgccagaatgcaagcgcagatgcagatgcagatgcagggaggggatggggatggtggcgccctaggtcaccacgtctag

SEQ ID NO: 204555 - DNA, 1086 bp, Artificial Sequence
  Description of Artificial Sequence: Synthetic coding sequence
atgagcaagcagcagcccacccagttcatcaaccccgagacccccggctatgtcggcttcgcaaatctgccaaatcaggttcatagaaaatccgtgaaaaagggattcgagttcaccctgatggttgtgggcgagagtgggctgggcaaaagcacactcattaactcactctttctcactgacctgtaccctgagcgggttattccgggagccgccgaaaagatagaacggactgtgcagatagaggcttctactgtcgagatcgaagagcgtggggtgaagttgagactcactgttgtggacacaccggggtatggggacgccatcaactgccgggattgctttaagactatcattagttatatcgacgagcagtttgagcgctacctgcacgatgagtctggacttaataggagacatattatagacaatcgcgtgcactgctgcttttacttcatctcaccttttggccacggtttaaagccactggatgtagccttcatgaaggcaatccacaacaaagtgaatatcgttcccgtgattgctaaagccgataccctcactctcaaagaacgcgagaggctgaagaagaggatcttggatgaaatcgaggagcacaatataaagatctatcacctgcccgacgccgaaagcgacgaggacgaagatttcaaagaacaaactaggctgctgaaagcttctatccctttctcggtggtgggatcaaaccaactcattgaggccaaaggcaaaaaggttaggggacggctgtacccatggggcgtagtcgaggtggagaatcctgaacataatgatttcctgaaactgcggacaatgctgatcacccacatgcaggatttgcaagaggtgacccaggacctccactatgagaactttcggtccgagcggctgaagcgggggggccgtaaagttgagaacgaagatatgaacaaagaccagattcttctggaaaaagaggcagaactcaggcgaatgcaagagatgatcgcgcgtatgcaggcacagatgcaaatgcagatgcagggtggagatggagatggcggcgcactgggacatcatgtgtag

SEQ ID NO: 204556 - DNA, 159 bp, Artificial Sequence
  Description of Artificial Sequence: Synthetic coding sequence
atgagcaagcagcagcccacccagttcatcaaccccgagacccccggctatgtgggctttgctaaccttcccaaccaggttcatcgtaaaagcgtgaagaagggctttgaatttacattgatggtcgtgggagaaagcgggttgggaaagtctacttag

SEQ ID NO: 204557 - DNA, 153 bp, Artificial Sequence
  Description of Artificial Sequence: Synthetic coding sequence
atgagcaagcagcagcccacccagttcatcaaccccgagacccccggctatgttggctttgctaacctaccaaaccaggtccaccggaagagcgtcaagaaagggttcgaatttaccctcatggtcgtcggggagtcagggcttggcaaatag

SEQ ID NO: 204558 - DNA, 72 bp, Artificial Sequence
  Description of Artificial Sequence: Synthetic coding sequence
atgagcaagcagcagcccacccagttcatcaaccccgagacccccggatatgtcggcttcgctaatctgtag

SEQ ID NO: 204559 - DNA, 447 bp, Artificial Sequence
  Description of Artificial Sequence: Synthetic coding sequence
atgagcaagcagcagcccacccagttcatcaaccccgagacccccggctatgtcggattcgccaatctccccaaccaggtgcatcggaagtctgtcaaaaagggatttgaatttacactaatggttgtaggagagagcgggttaggcaaaagtacgctcattaattccctgttcctgactgacctctaccccgagagagtgataccaggcgcagcagaaaagatagaaagaacagtccaaatcgaagctagcactgtagagatcgaagaacgaggcgtaaagttacgtctgactgtagtggatacacctggatatggggatgccataaactgtagagactgctttaaaacaatcatctcgtatattgacgaacaatttgagaggtaccttcacgatgagagtgggctaaacagacgacatatcatcgacaatagggtgcactgttag

SEQ ID NO: 204560 - DNA, 396 bp, Artificial Sequence
  Description of Artificial Sequence: Synthetic coding sequence
atgagcaagcagcagcccacccagttcatcaaccccgagacccccggttatgtaggcttcgctaacctgcccaaccaagtgcaccgaaagtcagtcaagaaggggttcgagttcaccctgatggtcgtgggcgagagcggcctcggtaagagtaccttgatcaatagtctgtttttaaccgacctgtatcctgaacgtgtgatcccgggggcagctgagaaaattgagagaacagtgcagattgaagcctctactgttgagatagaggaaaggggggtgaagctgcgcttgactgtcgtggacacccctggatatggtgacgccataaactgccgtgactgttttaaaaccattatctcttatatcgacgagcagttcgaaaggtatttgcactag

SEQ ID NO: 204561 - DNA, 219 bp, Artificial Sequence
  Description of Artificial Sequence: Synthetic coding sequence
atgagcaagcagcagcccacccagttcatcaaccccgagacccccggctatgtgggattcgcgaatctccctaatcaggtgcatcggaagtccgtgaaaaagggttttgagttcacattgatggtggtaggagaatcaggcctgggcaaaagcacactgataaattcgttatttctgacagatttgtatcccgagcgagtgattcctggagccgcctag

SEQ ID NO: 204562 - DNA, 219 bp, Artificial Sequence
  Description of Artificial Sequence: Synthetic coding sequence
atgagcaagcagcagcccacccagttcatcaaccccgagacccccggctacgtaggctttgccaatctcccaaatcaagtccatagaaagagcgtgaagaagggttttgaattcacactaatggtggtgggagaaagtggcctggggaaatctacactgattaatagtctgtttctcactgatctgtatcccgagagagttatacctggcgctgcgtag

SEQ ID NO: 204563 - DNA, 522 bp, Artificial Sequence
  Description of Artificial Sequence: Synthetic coding sequence
atgagcaagcagcagcccacccagttcatcaaccccgagacccccgggtatgtcggattcgcaaatttgcccaaccaagtgcataggaagagtgtcaaaaagggctttgagttcacacttatggtcgtgggagagtctggtctcggaaaatcaacactgatcaattctctgtttcttactgacctgtaccccgagagagttatccctggggccgcggagaaaatcgagcggactgtacagatcgaggcgtctacagtggagatagaagaacgcggagttaaacttagactgacagttgtagacactcctgggtacggcgatgctattaattgtagggattgtttcaagacgatcatcagttatatagatgaacaatttgagaggtacttgcacgacgagtccgggctgaacagacgccatatcatcgacaaccgcgtgcactgctgtttttactttatttcaccattcgggcacggactgaagcctctggacgttgctttcatgaaagctatccataattag

SEQ ID NO: 204564 - DNA, 90 bp, Artificial Sequence
  Description of Artificial Sequence: Synthetic coding sequence
tgagagatgatcgcccggatgcaggcccagatgcagatgcagatgcaggggggtgacggcgacgggggtgctttagggcaccatgtgtag

SEQ ID NO: 204565 - DNA, 861 bp, Artificial Sequence
  Description of Artificial Sequence: Synthetic coding sequence
atgagcaagggccagagcggcctgggcaagagcaccctggtgaacacgctctttaagagccaagtgtctcgtaaagcctcttcctggaacagggaggagaagatcccaaaaacagtggaaatcaaagccatcgggcacgttattgaagaaggaggagttaagatgaagttaactgtaattgacactccagggtttggagaccagatcaacaacgagaactgctgggagcctattgagaagtatataaatgaacagtatgaaaagttccttaaggaggaggtgaatatagctcgaaagaaacggatacccgatacacgcgtgcattgttgcctttactttatcagcccgaccgggcactctctgcgtcctttggacctcgagttcatgaaacacctgagcaaggtggttaacataattcccgtcattgccaaagccgacaccatgaccctggaagaaaagtcggagttcaagcagagagtgcgcaaggaactggaggtgaatggaatcgagttttacccacagaaggagtttgatgaggatctcgaggacaagactgagaacgacaagatacgccaagagagcatgcccttcgctgtcgtgggctccgacaaagaataccaggtcaacggtaagcgggttttaggcagaaagactccctggggcattattgaagtcgaaaacttaaatcactgtgagttcgccctcctacgggattttgtcatcaggacccacctgcaggaccttaaggaagtgactcacaatattcactacgagacctaccgtgcaaaacgactgaatgacaacggcgggctgccaccagtcagcgttgatactgaggagtcccacgattcgaatccatag

SEQ ID NO: 204566 - DNA, 252 bp, Artificial Sequence
  Description of Artificial Sequence: Synthetic coding sequence
atgagcaagggcctgcccgagacccggaccgacgccgccatgagcgagcttgtgccagaaccaagaccgaagcccgctgttcctatgaaacctatgagcattaattccaacctgctcggatatatcggtattgatacgatcatcgaacaaatgagaaagaaaaccatgaagacgggctttgattttaacattatggttgttgcggggagccctttaaggtctacaagtatgtcaagcactaggagttcctag

SEQ ID NO: 204567 - DNA, 1053 bp, Artificial Sequence
  Description of Artificial Sequence: Synthetic coding sequence
atgagcaagggcctgcccgagacccggaccgacgccgccatgagcgagctggtcccagaacctcgtccaaagcctgccgtgccaatgaagcccatgagcatcaactcaaatctattaggctacattggaatagatacaattattgaacaaatgaggaagaaaactatgaagacaggcttcgactttaacatcatggtagtgggccagtcaggcttaggtaaatctactttagttaacactctgttcaaatcccaggtgtctcggaaggcctctagctggaaccgcgaagagaagatccccaaaacagtcgaaattaaggcaataggtcacgtcatcgaggagggtggtgttaagatgaagctgaccgtgatagacacacccggctttggtgatcaaattaacaacgagaattgctgggaacctattgagaagtatatcaacgaacaatacgagaaattcctgaaggaggaggtgaatattgctaggaagaagcgaatcccagacacccgagtgcactgttgcctgtattttatttctccaactggccacagtctgaggcccctggacctagagtttatgaaacacttatcaaaggtagtcaatataataccggtaattgccaaggccgatactatgaccctcgaggaaaagtctgaattcaagcagcgtgttcgcaaagaattagaagtaaatggcattgagttttacccacaaaaggaatttgatgaagatctggaggataagacagaaaatgacaagatccggcaagaaagcatgccttttgctgtggtcggatctgacaaagagtaccaagtgaacggcaaaagggttctggggaggaagaccccatggggaattattgaggttgagaacctgaaccattgtgagtttgccctcctcagggatttcgtcattcgcacgcacctgcaggacttaaaagaggttactcacaatatacactacgaaacttaccgcgctaaaagactgaacgataatggcggactccctcctgtcagtgtggatacggaagaatcccacgatagtaacccttag

SEQ ID NO: 204568 - DNA, 1077 bp, Artificial Sequence
  Description of Artificial Sequence: Synthetic coding sequence
atgagcaagggcctgcccgagacccggaccgacgccgccatgagcgaattagtgcctgaacctcggcctaaacctgccgttcctatgaagccgatgtccataaacagcaacctgctggggtacatcggaattgacactatcatcgagcagatgagaaagaaaaccatgaagaccggttttgatttcaatatcatggtggtaggacaaagcggcctcggcaagagcactctggtgaacactttgtttaagtcacaagtgagtaggaaagctagcagctggaaccgggaggagaaaattcccaaaaccgttgaaattaaggctatagggcacgtcattgaagagggcggtgtgaagatgaagctgacagtgatcgacactcccggtttcggcgaccaaattaataatgaaaattgttgggagcctattgagaagtatatcaatgagcaatacgagaagtttttgaaggaagaagtgaatatagcacggaaaaaaagaattcccgatacgagagtgcactgctgtctgtacttcattagccctactggtcattctctgcgaccactcgatttggagttcatgaaacacttaagcaaagtggtgaatatcataccagtgatcgctaaagccgacactatgaccctcgaggagaagagtgaatttaagcagagagtgcggaaagagctggaagtgaatggaattgagttttaccctcagaaagagttcgacgaagatcttgaagataagaccgagaatgacaaaatccgccaagagtctatgccttttgcggttgtcggaagcgataaggagtaccaggtgaatgggaagagagtgctcggacggaagaccccatggggcattattgaagtagaaaacttgaatcattgtgagttcgctttgctcagggattttgtcatccgcactcatctgcaggaccttaaagaagtcacccacaacatacattacgagacctaccgcgcgaaacgtctgaatgacaacggtggtctacctcctggcgaaggtttactcgggacagtgctccctcccgtaccagccaccccttgccctactgccgaatag

SEQ ID NO: 204569 - DNA, 885 bp, Artificial Sequence
  Description of Artificial Sequence: Synthetic coding sequence
atgagcaagggccagagcggcctgggcaagagcaccctggtgaacaccttgttcaagagccaggtgtctcggaaggccagctcctggaacagggaggaaaaaatacctaagaccgtggagattaaggcgatcggccacgtaattgaggaaggtggagtcaagatgaagctgaccgtcatagataccccaggattcggagaccaaatcaacaacgagaactgctgggagccgattgaaaagtacattaatgagcagtatgaaaaatttctgaaagaggaggttaacatagcccggaaaaagaggatcccagacacccgggtgcactgttgcctctatttcattagcccaacaggacactctctgcgacccctggatctagaattcatgaagcatctgtccaaagttgtgaacatcatacctgtgattgccaaggccgacacaatgaccctcgaggaaaagtccgagttcaaacagcgcgtgcgcaaagagctcgaagtgaacggcatcgaattttaccctcaaaaagaattcgacgaggacctcgaggataagaccgagaatgacaagattcgtcaggagtccatgccatttgcagtggtcggatcagacaaggagtatcaagtcaacggcaagcgcgtgctgggcagaaagacaccatggggcataatcgaagtggagaaccttaatcactgcgagttcgcactgttgagggactttgtcattcggacccaccttcaagacttgaaggaggtgactcacaatatacactatgaaacatatcgcgccaaaaggctgaacgataatggcggccttcctccaggggagggcttgctcggaactgtattgcctccggtgcccgccactccctgtcccacggcagaatag

SEQ ID NO: 204570 - DNA, 537 bp, Artificial Sequence
  Description of Artificial Sequence: Synthetic coding sequence
atgagcgagctggtgcccgagccccggcccaagcccgccgtgcccatgaaacctatgagcatcaacagtaacctgcttggatatattggcatcgacacaataatcgaacagatgaggaaaaaaacgatgaagactggcttcgactttaatattatggttgtcggacagtccggcctgggaaaatcgacccttgttaacaccctgttcaagtcacaagtgagtcggaaagctagcagttggaaccgggaggagaagattccaaagaccgtggagattaaggctatcggacacgtgatagaagaggggggagtcaaaatgaaactaaccgtcatcgacacacctggcttcggagaccaaatcaataatgagaactgttgggaacccattgagaagtacatcaatgaacagtatgagaagttcctgaaagaggaggttaacattgcacgcaagaagagaatccccgacactagggtccactgctgtctctatttcatcagccctaccggccactcattaagacccctagacctagaatag

SEQ ID NO: 204571 - DNA, 1137 bp, Artificial Sequence
  Description of Artificial Sequence: Synthetic coding sequence
atggacagcctggccgccccccaggaccggctggtggagcagctgctgagcccaagaactcaagctcagaggagactgaaagacatcgacaagcagtatgtaggatttgccaccctgcccaatcaggtgcaccggaagagcgttaaaaaaggctttgacttcacactcatggtagcgggagaatctggattgggcaagtctaccttggtccactctctcttcttaaccgatctctataaggacagaaagctattgtcggccgaggagcgtatctcgcaaacagtagagatactcaagcatacggtagacattgaggaaaaaggagttaagctgaaactgacgatcgtcgataccccagggttcggggatgccgtcaataacaccgagtgctggaagccaattaccgattatgtggatcagcagttcgaacagtactttagagatgagagcggcctgaataggaagaatatccaggacaaccgcgtgcactgctgtttgtatttcatcagtccgttcggacacggactcagacctgtggacgttggcttcatgaaggctctgcatgaaaaggttaatatagtcccactgattgcaaaggctgattgccttgtcccatctgagatcagaaagctcaaagagcggattcgcgaggaaattgacaaatttggaatccacgtgtaccaatttcccgagtgtgactctgacgaggacgaggactttaaacagcaggatagagagcttaaggaatccgcaccattcgccgtcataggttctaacactgtggtggaagcaaagggccaacgagtgagaggaaggctctacccctgggggatcgtcgaggtggagaatcaggcacactgcgactttgttaagttgagaaacatgctcatccgcacacatatgcacgacctcaaggatgtgacttgcgatgttcactatgaaaattacagagcccattgtattcagcaaatgacttcaaaactgacacaggattctagaatggaatctcctataccaatcctgcctcttcccacccccgatgccgaaactgagaagctgattcgcatgaaggacgaagagctgagacggatgcaggagatgctgcagcgaatgaaacagcagatgcaggatcagtag

SEQ ID NO: 204572 - DNA, 969 bp, Artificial Sequence
  Description of Artificial Sequence: Synthetic coding sequence
atggtggccggcgagagcggcctgggcaagagcaccctggtgcactcactcttcctgaccgacctgtataaggacagaaaactcctcagtgcagaggagaggattagtcaaaccgtggaaatcctgaagcacacagtggatatcgaggagaaaggggtcaaattgaagcttactatagtggatacacctgggtttggtgacgcggtgaacaataccgaatgttggaagcctatcacggactatgtagaccagcagttcgaacagtacttcagggacgaatctgggctgaatcgcaaaaatattcaggataatcgggtacactgttgcctgtattttataagcccatttgggcacggcctcaggcccgttgatgttggctttatgaaggcgctccatgagaaagtcaacatcgtgcccttgatagctaaggcagattgtctcgtgccctctgagatcagaaagctgaaggagcgaataagggaagagattgataagtttggcatccatgtgtatcaattcccagaatgcgatagtgacgaggatgaggactttaagcagcaggacagagagctgaaggaaagcgcaccgttcgccgtgataggatcgaacaccgtggtggaggccaagggacagagggtgcgcggcaggttgtacccgtggggcatcgtggaggtagaaaatcaggcccattgtgatttcgtcaagctccgcaatatgctaatcaggacccacatgcatgacctgaaggatgttacttgtgatgtccactacgagaactaccgcgcccattgtatacaacagatgacttcgaagctgactcaggattctcggatggaaagtccaatcccaatcctccccctcccaacccccgacgccgaaaccgaaaaactgattcgcatgaaagacgaggagttgcgacgtatgcaggagatgctgcagcgaatgaagcagcagatgcaggatcagtag

SEQ ID NO: 204573 - DNA, 1041 bp, Artificial Sequence
  Description of Artificial Sequence: Synthetic coding sequence
atggacagcctggccgccccccaggaccggctggtggagcagctgcttagccctcgcacccaggctcaacgccgactcaaagatattgacaaacagtatgttggattcgcaaccctgccaaatcaggtccatcgcaaaagcgtgaaaaaaggatttgattttaccctaatggtggctggcgagtccggattgggaaaatccactttagtccacagcctcttcttaaccgacctttacaaagatagaaagctgctctccgcagaagagcggataagtcagacggtcgaaatactgaagcatacagtagacattgaagagaagggcgtgaagttgaagctgaccattgtcgatacgcccgggtttggagacgccgtaaacaacaccgagtgctggaagcccattacagactacgtggaccaacagttcgaacagtactttagagatgaaagtggccttaatcgaaagaatatccaggacaacagagtgcattgttgtttatattttattagtccctttgggcatggcctgaggccagtggatgttgggttcatgaaggccctccatgagaaagtgaatatagtaccacttatcgccaaagccgattgccttgttccatccgagatcaggaagctcaaggagcgaattcgtgaggaaatcgataagtttggcatacatgtataccaatttcctgaatgtgattctgatgaggacgaggattttaaacaacaagacagagagctaaaagagtcggctcctttcgctgttattggctctaatacagtcgtggaggcaaagggccagagagtgcgcgggcgcctctacccctgggggattgtagaaggggcgcttcgcctgcgtgaagccgcccagcacgctcatccacacgcatatgcccgtccccaggggcgcgacgttcgcagagctcttcgggaattacctagggccctccaccccgccgatgaccagcagacagatccgggccaaccccatggggagccccatccagatccagcagccgcccaccctggacgcagagactag

SEQ ID NO: 204574 - DNA, 450 bp, Artificial Sequence
  Description of Artificial Sequence: Synthetic coding sequence
ctgcccaaccaggtgcaccggaagagcgtgaagaagggcttcgacttcaccctgatggtagctggcgagtccggactggggaaatccaccttagtacatagcctctttttaaccgatctgtataaggaccgcaagttactgagcgctgaggaaagaatcagtcagacggtcgagatcttaaagcacaccgtcgacatcgaggagaagggcgtgaagttgaagctgactatagtggacacccccggattcggcgacgccgtgaacaacactgagtgctggaagcccatcactgactacgtggaccagcaatttgagcagtacttccgtgatgaatctggccttaatagaaaaaacatccaagataaccgagtccattgttgcctttatttcatcagcccatttgggcatggactgagaccagtggatgggtttcacgagggaatagcttag

SEQ ID NO: 204575 - DNA, 1110 bp, Artificial Sequence
  Description of Artificial Sequence: Synthetic coding sequence
atgagcaccggcctgcggtacaagagcaagctggccacccccgaggataaacaagacatcgacaaacagtacgtcggattcgcgacactccccaatcaggtccatcggaaaagcgttaagaagggcttcgacttcacactcatggttgcaggtgaatccggactgggtaagtctacactggtgcactccctgtttctcacagacctgtataaagatcgtaaactgctctcagccgaggaacggatttctcaaaccgttgagatccttaagcacaccgtagatatcgaagagaagggcgtgaaacttaaactcacaattgtggatacccctgggttcggcgacgctgtgaacaatacagagtgctggaaaccaatcacagactatgtcgaccagcagttcgaacagtactttcgcgatgaaagcggactgaacagaaaaaatatacaggacaaccgtgtccactgttgcctgtattttataagcccatttggacatggactgcgaccagtggacgtcgggttcatgaaagctctccacgagaaggtgaatattgttcctctgatcgccaaggcggattgtctcgtacccagcgaaatacgcaagctgaaggagaggatccgagaggagatcgataagttcggtatccacgtgtaccagtttccagaatgtgattctgacgaagacgaggatttcaaacagcaggacagggaactcaaagagagcgccccatttgcggtgattggttccaatactgtggtagaggccaagggccagagggtccggggtaggctctacccctggggaatcgtggaagtcgaaaaccaggcacactgcgatttcgtgaaactccgtaatatgctgatacgtacccatatgcatgatctgaaggacgttacctgcgacgtccactatgaaaactaccgcgcccattgtattcagcagatgaccagcaaattgacccaggacagccgtatggaatctcctatccccatcctgcccctgccaacccccgatgctgagacagagaagctgatccgaatgaaggatgaagagctgcgccgcatgcaggaaatgctacagagaatgaagcagcagatgcaggatcaatag

SEQ ID NO: 204576 - DNA, 1137 bp, Artificial Sequence
  Description of Artificial Sequence: Synthetic coding sequence
atggacagcctggccgccccccaggaccggctggtggagcagctgctaagcccacggactcaggcacagcgcaggctcaaggacatcgacaagcagtacgtggggttcgctaccttgcctaaccaggtgcatcggaagtctgtgaagaaaggtttcgattttacgctgatggttgcaggcgaatctggcctgggcaagagcacattggtgcattctctattccttactgacttgtacaaagacagaaagctgctgtccgcagaagaacggatttctcagacagtggagattctgaaacatactgtggacatcgaggagaaaggcgtgaagttaaagctgaccatcgttgatacccctggcttcggcgacgccgtgaacaatacagagtgttggaagccaatcaccgattatgtggaccagcaattcgaacagtattttcgcgacgagagtggtctcaatcggaagaatatccaggacaacagagtccattgttgtctgtacttcatttcccccttcggtcacgggctgagacccgtggacgtcggtttcatgaaggcattgcacgagaaagtcaatatcgtgccactgattgcgaaagctgactgtctggttccctccgaaatccgaaagctgaaagaacgcatcagggaggaaattgataaatttgggatacacgtataccagtttcccgagtgtgattcggatgaggatgaggactttaaacagcaggaccgggaactcaaggagtcagcacctttcgccgtgatcgggagtaacaccgttgtggaggctaagggtcaacgagtgcgcgggaggctgtacccttgggggatagtggaagtggagaaccaagcacattgcgacttcgtgaaactcaggaacatgttaatccgcacccacatgcacgatttaaaggacgtgacttgtgatgtccactacgagaactatagagcccactgcattcagcagatgacatctaagctaacccaagatagcaggatggaatcccctatcccaattctgccgctccctacccctgatgctgagacggaaaaactgataaggatgaaggacgaagaactccggaggatgcaggagatgctccaaaggatgaaacagcagatgcaagaccagtag

SEQ ID NO: 204577 - DNA, 1305 bp, Artificial Sequence
  Description of Artificial Sequence: Synthetic coding sequence
atggccgccaccgacatcgcccggcaggtgggcgagggctgccggaccgtgccactcgctggacacgtcggttttgactctctaccagaccaactggtgaataagagcgtgtcacagggattctgtttcaatatattatgcgtgggcgaaacaggcctgggaaaatccacattgatggataccttgttcaacactaagttcgagggcgaacctgctactcacactcagccaggtgtgcaactgcagagcaacacatatgatcttcaagaatctaacgttagactcaaactgaccatcgtcagcacagtcggattcggagatcaaatcaataaagaggattcatataaacccattgttgaattcattgacgcccagtttgaagcctatctacaggaagagctgaaaattcggcgggtgttgcatacttatcatgactctagaattcatgtgtgcctttacttcattgcaccgacgggccattctctcaagtcattggatcttgttaccatgaaaaagctggattcaaaagtgaatattattcctattattgcaaaagccgatgccatttctaagtctgagctgacgaagttcaaaatcaagatcacatccgagttagtgtctaatggcgtccaaatctatcagtttccaaccgatgacgaaagcgtggctgagataaacggcaccatgaatgctcatctgcctttcgccgtgatcggctccacagaagaacttaagattgggaacaagatgatgagggcaaggcagtacccttggggcacagtccaggtagagaacgaagcccactgtgactttgttaaattgcgggaaatgcttataagagtgaacatggaagacctgagggagcagacccatacgcggcactacgagctgtatcggcgctgcaagctggaggagatgggatttaaggacaccgacccggacagtaagccgttctccttgcaggagacctacgaagccaaacggaatgagttcttaggcgaactgcagaagaaagaggaggaaatgagacagatgtttgttcaaagggttaaggagaaagaagctgaacttaaggaggctgagaaagagttgcatgagaaatttgaccgcctcaagaaacttcaccaggatgagaagaagaagctggaggacaaaaagaaatccctggacgacgaggtcaatgccttcaaacaaaggaagacggcagcggaactgctgcagagtcagggcagtcaggctggtggctcccagaccctgaaacgcgacaaggagaagaagaataatccatggctgtgtactgagtag

SEQ ID NO: 204578 - DNA, 1290 bp, Artificial Sequence
  Description of Artificial Sequence: Synthetic coding sequence
atggccgccaccgacatcgcccggcaggtgggcgagggctgccggacggtccctcttgcagggcatgtgggttttgatagccttcctgaccagttggttaacaagtccgtttcccaagggttctgtttcaacatcttgtgcgtgggtgaaaccgggctcggaaagtccaccttgatggataccctgtttaataccaagtttgaaggggaaccggcaacacacacacagcccggagttcaactccagtccaacacctacgacctgcaggagtcaaatgtgagactgaagctgactatagttagcacagtcggttttggcgaccagattaataaggaggattcttacaaacccatcgtggagtttattgatgcacaattcgaagcctatctgcaagaggaactgaagattcgtagagtcctgcacacgtatcatgattcacgcattcacgtctgcttatacttcattgcccccacaggtcattcccttaaaagcctcgacttagtgactatgaagaaattagatagtaaagtaaacatcattcccattatcgccaaagccgacgccatctctaagtcagagctgacgaagttcaagatcaagataaccagtgagctggtcagcaacggtgtgcaaatttaccagtttccgacagatgatgagtccgtcgccgagattaatggaacaatgaatgcacacctccccttcgccgtaataggctcaacagaggaactgaaaattggaaataagatgatgagagcgcgtcagtacccctgggggacagttcaggtggagaatgaggcgcattgtgattttgtcaaattaagggagatgctgattagagtcaacatggaagatctgcgtgaacagactcatacccgacactatgaactgtatcggaggtgtaagctggaggagatgggattcaaagacactgaccctgattcaaaaccattcagtctgcaggaaacatatgaggcaaaacgaaacgagtttctaggagagctccaaaaaaaagaagaggagatgagacagatgtttgttcagagggtcaaagagaaggaagcggagctgaaagaagcagagaaggagcttcacgagaagttcgatcgcctgaagaagctgcaccaggacgaaaagaagaagctcgaggacaagaagaaaagtctggacgatgaggttaatgcatttaaacagaggaaaacagccgccgaacttctacaaagccaaggcagtcaggctgggggtagccagacattgaaacgtgataaagagaaaaagaatttcttttag

SEQ ID NO: 204579 - DNA, 1296 bp, Artificial Sequence
  Description of Artificial Sequence: Synthetic coding sequence
atggccgccaccgacatcgcccggcaggtgggcgagggctgccggacagtaccactggccggtcatgtgggctttgatagcttgcccgaccaattggtgaacaagtccgtgtctcaagggttttgcttcaatatactgtgtgtcggagagacgggcctggggaaaagtacactgatggatacactattcaatacgaaattcgagggtgagcctgcaactcacacacagcccggggtgcaactgcagtcaaacacttacgatttacaagaaagtaatgtgcggctgaagcttaccattgtaagcaccgtgggcttcggagatcagatcaataaggaagactcttataaaccaattgtggaatttatagacgctcaatttgaggcatatctgcaagaagaactaaagattcggagagtgctgcacacttaccacgatagccggatccacgtgtgcctctacttcatcgcccccacaggacactctttgaagagtctcgacctcgtgactatgaagaagctggattccaaggtgaacatcattcctattatcgcgaaggcggacgccatttccaagagcgagctaactaaattcaagattaagattacctccgagcttgtctcaaatggcgttcaaatttaccagttccccaccgacgatgaaagcgtggcagagataaatggcaccatgaatgcgcacctgccatttgcagtaataggctcaactgaggaactcaagattggaaataagatgatgcgagcccgacaatatccatggggtacggtgcaagtggagaacgaggcccactgcgatttcgtgaaactcagagagatgctgattagggtgaatatggaggacctgcgagagcagacacatactagacactatgaactttaccggaggtgtaagctggaggaaatgggatttaaagataccgatcccgactcgaagccttttagtttgcaggagacatatgaggccaaacgtaatgagtttctgggcgagctccaaaagaaggaagaggagatgcgccagatgtttgtccaacgggtgaaggagaaggaggctgaactgaaagaggcggagaaggagctgcatgaaaaatttgatagacttaagaaacttcatcaggacgagaagaagaagctggaagacaaaaagaagtcccttgatgacgaagtcaacgcgttcaagcagaggaagacagcagctgaactgctgcagtctcaggggtctcaggctgggggcagccagaccctgaaacgtgataaggaaaagaagaacctcggctttctttag

SEQ ID NO: 204580 - DNA, 1284 bp, Artificial Sequence
  Description of Artificial Sequence: Synthetic coding sequence
atggccgccaccgacatcgcccggcaggtgggcgagggctgccggacagttcctctcgcaggtcacgtcgggtttgacagcctccccgaccagttggttaataagtcagtgtcccaaggattctgtttcaacatactctgcgtgggcgaaaccgggctcggtaagtcaaccttgatggacaccctattcaataccaagttcgaaggagagccagctacccacacacagccaggcgtgcagctgcagtccaacacatacgatctgcaagaaagcaatgtgcgtcttaagttgacaatcgtctcaacagtcggtttcggtgatcaaatcaacaaagaggactcttacaaacctatcgtggagtttatcgatgcacaatttgaggcatatttacaggaagaactaaaaatccgaagggtgttacatacatatcatgattctaggatccacgtgtgcttatactttatcgcacctaccggccactccctaaagtcactggacctggtaacaatgaaaaagcttgattctaaggtgaatatcatccctatcatagcaaaagccgacgctatctctaagtctgagctgacgaagttcaaaatcaaaataactagtgaattggtgtcgaacggagtgcagatataccaattccccacggacgacgaatccgtggcggagatcaatggtaccatgaacgcccacttgccatttgcagtgatcggtagcaccgaggagttgaaaattgggaacaaaatgatgcgagcccgccaatatccttggggaacagtacaggtcgaaaatgaagcacactgtgatttcgtaaagctcagagaaatgctgatcagggtcaatatggaggacttacgcgagcagacccacacacgccattatgagctctatcgaaggtgcaagttagaagagatgggctttaaagatactgaccctgatagtaagcctttcagccttcaagagacctatgaggcaaagcggaacgaatttcttggcgaattgcagaagaaagaagaggagatgcgacagatgtttgtgcaacgcgtgaaagagaaggaagccgagctcaaagaagccgagaaggagcttcacgaaaagttcgatagattgaaaaagttacatcaggatgagaaaaagaagctcgaagataagaaaaagtctctagacgatgaggttaacgcgtttaagcagagaaagacagcggcagaactacttcagtctcagggctcccaggccggcggttctcaaacccttaagcgggataaagagaaaaaaaattag

SEQ ID NO: 204581 - DNA, 1284 bp, Artificial Sequence
  Description of Artificial Sequence: Synthetic coding sequence
atggccgccaccgacatcgcccggcaggtgggcgagggctgccggactgtcccgctggccggccacgtcggcttcgattcgctacctgatcaattagtaaacaagtccgtgtcgcagggtttttgtttcaacatcctgtgtgtgggtgaaacaggcctcgggaagagcacactcatggacactttgttcaacacaaagttcgaaggggagcccgcaacccacactcaacctggggtgcagctgcaatcaaacacctacgacctgcaggagtccaatgtgagactcaaactgacaattgtgagcacggtcggattcggggatcagattaataaggaggattcgtataagcctatcgtcgaattcatcgatgctcaatttgaggcctacctgcaggaagagctgaagattagacgagtgctccatacctaccacgacagcaggatccacgtatgcctgtattttattgcacccacgggacactccctcaagtctttagacctcgtcaccatgaaaaaactggacagcaaggtcaacataattcctatcattgccaaagcggatgccattagcaagagtgaactcaccaaattcaaaattaaaatcacatcagaactggtctctaatggagtccagatctaccagttccccacagatgatgagagcgtcgcagagattaatggaacgatgaacgcccatctgccattcgccgttattggttccaccgaggagcttaaaatcggcaataaaatgatgcgggctagacaatacccctgggggaccgtgcaagtcgagaatgaggctcattgcgactttgtgaagttgcgagagatgcttattcgggtgaacatggaggatttgagggagcagacccacacccgccactatgaactctatcgccggtgtaagcttgaagagatgggctttaaggacacagaccctgattcaaagccattttccctgcaggagacatatgaggcaaaacggaatgagttcctcggcgagttacagaaaaaagaggaagagatgcggcaaatgttcgtgcagcgcgtgaaagagaaagaggcagaactgaaagaagcagagaaggaactacacgaaaaatttgatcgtctcaagaaactgcatcaagatgagaagaaaaaattggaggacaagaagaaatctctagatgatgaggtgaatgctttcaagcagaggaagaccgccgctgaactcctacagagccaaggatcacaggcggggggctctcaaaccctgaaacgggataaagaaaagaaaaactag

SEQ ID NO: 204582 - DNA, 1110 bp, Artificial Sequence
  Description of Artificial Sequence: Synthetic coding sequence
atggacaccctgttcaacaccaagttcgagggcgagcccgccacccacactcagcctggggtgcagcttcagtccaacacctatgacctgcaggagtccaacgtgcgattgaagctgactatcgtatcaaccgttggatttggagaccagattaataaggaagattcctataaacctatagtggagttcatcgacgcccagttcgaggcttatctgcaagaagagttgaaaatcaggcgcgtgctgcacacctaccatgacagcaggatacatgtctgtctctatttcatcgcccccaccggacatagcttgaaatcactggatctggtcaccatgaaaaaattagactccaaagtgaatatcattcccattatcgccaaagcggacgcaatttctaagtcagaacttaccaaattcaagatcaaaatcactagcgagctagtctccaacggcgtgcagatataccaattccctacggatgatgagtccgtcgctgagatcaacggaaccatgaatgcacatctccccttcgctgtcatcggatcaacagaggaactgaaaatcgggaataagatgatgagggctagacagtacccttggggaaccgtacaggtggagaacgaagctcattgcgatttcgtcaaactgcgtgaaatgttgataagagtaaacatggaagatctgcgggaacagacacatacgagacattatgagctgtatagacggtgcaaacttgaagagatgggctttaaagatacagatcccgatagcaaaccattctctctgcaggagacctacgaggcaaaaagaaacgagtttttgggtgagctgcaaaaaaaggaagaagagatgaggcagatgttcgttcaacgcgtcaaagagaaggaagctgaattgaaagaggccgagaaggagctgcacgaaaagttcgaccgcctgaagaagttgcaccaggatgaaaagaaaaagctggaggataagaaaaaaagcctggacgatgaggtaaatgcctttaagcagaggaaaactgcagctgaactcctgcaaagtcaagggagccaggccggcgggtcccaaaccctgaaaagagacaaggagaagaagaaatag

SEQ ID NO: 204583 - DNA, 1374 bp, Artificial Sequence
  Description of Artificial Sequence: Synthetic coding sequence
atggccgccaccgacatcgcccggcaggtgttcggccggcggcggctgcttcttctcggattcgagactgtggggttctctgcagcctgtactgaagagggcggtcatatgttaaggaggggagaaggttgtcggacagtcccactcgcgggacacgttggtttcgactcactgcccgaccagctggttaacaaatctgtgagtcagggcttctgtttcaacattctgtgcgtcggcgagacgggactaggtaagtcaacgcttatggacactctttttaacacaaagttcgaaggtgagcctgctacccatactcaaccaggggtacaactccagtcgaatacttatgacctgcaagaaagcaatgtccggctgaagttaaccatcgtctctaccgttgggttcggggaccagattaataaggaggactcctacaagccaatcgtagagttcatcgatgctcagtttgaggcttacttacaggaggaactgaagatcaggcgtgtactccatacttaccatgactcccgaattcacgtgtgtttgtacttcatcgctcccacaggccactcccttaagagtttggacttggtgacaatgaaaaaactcgacagcaaggtcaatatcattcccatcatagctaaggccgatgctatttctaagtctgagctcacgaaattcaagattaaaattaccagcgagctggtttctaacggagtccaaatttaccaattccctactgatgacgagtccgtggcggaaattaacgggaccatgaatgctcatctgccttttgctgtaataggctcaacagaggaactgaagattgggaacaaaatgatgcgagcacgacaatatccctggggcactgtgcaggtagaaaatgaggcccattgcgactttgtgaagctacgagaaatgcttatcagagtgaacatggaagatttgagggagcagactcacactaggcactacgagctctacagacggtgcaaattggaggagatgggattcaaggacactgacccagactctaagcccttctcattgcaagaaacctacgaggcgaagcgcaacgaatttttaggtgaacttcagaagaaggaggaggagatgcggcagatgtttgtacagcgagttaaggagaaagaagccgagctgaaagaggccgaaaaggagttgcatgagaagttcgaccgcctcaaaaaactgcatcaggacgagaaaaaaaaacttgaagacaaaaaaaagagtcttgatgacgaggtgaacgccttcaagcagaggaagacggccgccgagttgctccagtcacaaggcagccaggccggggggtcccagactcttaaacgggacaaggagaaaaagaaatag

SEQ ID NO: 204584 - DNA, 1284 bp, Artificial Sequence
  Description of Artificial Sequence: Synthetic coding sequence
atggccgccaccgacatcgcccggcaggtgggcgagggctgccggacagtcccgcttgccggccacgtcggcttcgactcactccctgaccagttagtgaacaaaagtgtgagtcagggattctgtttcaatattctgtgcgttggcgagaccggactcggcaagtccacactcatggacaccctgttcaatacaaagttcgagggcgaaccagccacccacacacagcctggagtccagcttcagtccaatacctatgacttgcaagagagcaacgtgcgcctcaagctgaccattgtgtcaacagttgggttcggcgaccaaattaataaggaagattcctacaaacctattgtagaattcatagatgcccagttcgaagcctacttgcaggaggagctgaaaatacgccgggtgttgcacacctaccatgactcccggatccatgtgtgtctatacttcatcgcccctactggtcactcgcttaaaagtctcgatctagtgacaatgaaaaagctggacagcaaggtgaacatcatccccattatcgcaaaagcagatgcaatctctaaatccgagctgactaaatttaaaatcaaaataacatctgaacttgtatctaatggagttcaaatatatcagttccccacagacgacgagagcgtagcggagatcaacggcactatgaatgcacatctcccttttgccgttattggaagtaccgaagaattgaaaattgggaataagatgatgcgcgcccggcaatatccttggggcaccgtgcaggtggagaacgaagcgcattgcgattttgtcaagctgcgggagatgctgatcagggtcaatatggaggatctgcgggaacagactcacacacgccactatgagttatatagacgctgcaagttggaagagatggggtttaaagatacagaccccgactctaagccattttcactccaggaaacatacgaagccaaacggaacgagttcctcggtgagttgcaaaaaaaagaggaggagatgcggcagatgttcgttcagcgggtcaaggaaaaggaagctgagctgaaagaagccgagaaggagctccatgaaaagttcgatagactgaagaagctgcaccaggacgagaaaaagaaattggaggataaaaaaaagagcctggatgatgaagtgaacgcctttaaacagcggaagacagccgcagagctgctgcagtcgcaaggatcccaggccggcgggtctcaaaccctgaaacgggacaaagagaagaaaaattag

SEQ ID NO: 204585 - DNA, 804 bp, Artificial Sequence
  Description of Artificial Sequence: Synthetic coding sequence
atggccgccaccgacatcgcccggcaggtgggcgagggctgccggacggttcctctggcaggacacgtgggatttgatagtctgccggatcaactggttaacaaaagcgtgtcacagggcttttgttttaatatcctgtgtgttggcgaaacaggcttgggcaagagtacactgatggatacgcttttcaacactaagtttgaaggggagcccgctacacacacccaacccggtgtgcaattacaaagcaacacttacgaccttcaggaaagtaacgtgcgactaaaattgaccatagtgtccactgtgggcttcggggaccagatcaacaaagaggatagctacaagcccatcgtggagttcattgacgctcagttcgaggcctatctccaagaggagctcaagatcagacgtgtgcttcatacctaccatgactcccgcattcatgtgtgtctttattttatagcccctacaggccactccctcaaatccctcgacctcgttacgatgaagaagttagacagtaaagtcaacatcatccccatcatcgctaaagctgatgctatatctaagtccgagctgaccaagttcaagatcaaaatcacatcagaattggtgtctaacggcgtgcagatctatcagtttcctacagacgacgagagcgtggccgaaatcaacgggacaatgaatgctcatttaccctttgccgtgattggctcaacagaggagttgaagatcggtaataagatgatgcgggcccgccagtacccctggggcactgttcagggaagcagccaagtgtag

SEQ ID NO: 204586 - DNA, 1452 bp, Artificial Sequence
  Description of Artificial Sequence: Synthetic coding sequence
atggccgccaccgacctggagcggttcagcaacgccgagcccgagccacggagtcttagcctcggagggcacgtcggcttcgatagcctcccagaccagctcgtcagcaagtcagttacgcaagggttttcctttaatatcttgtgcgtgggggagacagggatcggtaaaagcacactcatgaacactctgttcaacaccacatttgaaaccgaagaagcctctcaccatgaagcatgtgtgcggctccgcccacagacgtatgacctgcaggagagcaacgtgcagctgaaacttacaatcgtagatgcggtcggcttcggggatcagattaacaaggacgagtcctatagacccattgtcgactacatagacgctcagttcgaaaactatctgcaggaggaactgaagataaggcgctccttgtttgactaccatgacacccggattcatgtgtgtctctactttattactcctaccggtcactcactgaaaagcctggacctcgttacaatgaagaagctggactccaaggtaaatatcattcccatcattgctaaagctgacactatcagcaagtccgagttgcacaaattcaaaatcaaaataatgggcgagttggtgagtaacggtgtgcagatctaccaatttcccacagacgacgaagctgtggcagagattaatgctgttatgaacgcacatctcccattcgctgtcgtaggaagtacggaagaggtgaaagttgggaacaaactggtgcgtgccagacaatacccatggggcgtggtgcaggtggaaaatgaaaaccactgtgacttcgtgaagttaagagagatgctgatccgggtcaatatggaagatctgagagaacagactcactcccggcactacgagctttaccgcaggtgcaagctcgaggagatgggctttcaggatagcgacggtgactcacagcctttttccctccaggaaacctacgaagccaagaggaaggaattcttgtcagagttgcagaggaaagaagaggaaatgagacagatgtttgtaaataaggtcaaagaaacagaactggagctgaaagaaaaggaaagagaactccacgagaagttcgagcacttaaaaagagtccaccaggaggagaagcgcaaggtggaggagaagcgacgggaactcgaagaggaaacaaacgcatttaacaggcgaaaggccgcggtggaagccctgcaatcccaggcactgcacgctacttcccaacagccactgcgcaaggataaggataaaaagaatcgttctgatattggtgctcaccaacctggaatgtctctcagctcctccaaggtaatgatgactaaagcaagcgttgagcccctcaattgtagctcatggtggccagcaatccagtgctgctcatgtttggtccgggacgccacctggagagaggggtttctgtag

SEQ ID NO: 204587 - DNA, 1110 bp, Artificial Sequence
  Description of Artificial Sequence: Synthetic coding sequence
atgaacaccctgttcaacaccaccttcgagaccgaggaggccagccaccacgaggcttgcgtccggttgagaccacagacatatgacctgcaggagagcaatgtccagttaaagctcactatcgtagacgccgttgggttcggcgaccagattaacaaagatgagtcctaccggccaattgttgattacatagatgctcagtttgagaattatcttcaggaggagctgaagatcaggcgatcactctttgactatcatgatacccgaatacacgtgtgcttgtattttattacacctacaggtcattccttgaaatctcttgaccttgtcactatgaaaaagcttgattcaaaagttaatattatccctattattgcaaaggctgatactatcagcaaatccgaactccacaaatttaaaatcaagattatgggggaattagtgagcaatggcgtccagatataccaatttcccactgacgacgaggcggtagccgaaataaatgctgtgatgaacgcccacctgcccttcgctgtggttggatccaccgaagaggttaaggtcgggaataaattagtaagggcaagacagtacccttggggggtggtgcaggtcgagaacgaaaatcattgcgactttgtgaaactgagggaaatgctgattagggtcaacatggaagaccttcgcgagcagacacactccaggcactatgagctctatcgtcgctgcaaactggaggagatgggattccaggactctgatggggacagtcagccttttagcttacaggagacctatgaagcgaaacgaaaggagttccttagtgagctgcagagaaaagaggaggaaatgcgccaaatgttcgtgaacaaggtcaaggagacagagctggagttgaaggaaaaggagagagagcttcacgaaaaatttgagcacctgaagcgggtgcatcaggaagagaagagaaaggtggaggaaaagagacgagagctcgaggaagagaccaatgcgttcaataggcgcaaggctgctgtggaagcactacagtcgcaggcccttcatgcgaccagccaacagcccctccgtaaagataaagacaagaagaactag

SEQ ID NO: 204588 - DNA, 1290 bp, Artificial Sequence
  Description of Artificial Sequence: Synthetic coding sequence
atggccgccaccgacctggagcggttcagcaacgccgagcccgagccccggagcctaagtttgggaggacatgtcggcttcgatagcctgccagatcaactcgtaagcaaaagcgtaacacaagggttttcatttaacatcctgtgcgttggagagacaggaatcggcaagagcacgctgatgaacacactgtttaacaccaccttcgagacagaggaagctagccaccacgaggcatgcgttagactcaggccccaaacttacgatctgcaggagtccaatgtccaacttaagttgacaatagtggacgccgttggtttcggtgatcagataaacaaggacgaaagctacagacccattgtcgattatatcgacgcccagttcgagaactacttgcaagaggagctcaagatccggcgctccctgttcgactaccacgacacgagaattcatgtatgcctgtatttcatcacccctacgggtcacagcctgaagtccctcgatttggtgacaatgaagaaactggattcaaaggtaaatatcatccctattattgccaaggccgatacgatttctaagtccgaattacataagttcaaaataaagatcatgggcgaactcgtctccaatggcgtacagatttaccagttcccaaccgacgacgaggccgtggccgaaattaacgccgtaatgaatgcccatctgccctttgccgtcgtaggctctaccgaagaggttaaggttggaaataaactcgtgagggccaggcagtacccgtggggagtggttcaggtggaaaatgagaaccactgcgactttgtcaaactgcgcgagatgttgatcagggtgaacatggaagaccttcgtgagcagactcactcccgccactacgagctataccgaaggtgcaaacttgaagaaatggggtttcaggacagcgatggcgatagccagccgtttagcttacaagaaacctacgaggctaaacggaaggaatttcttagtgaactccagcgaaaagaagaggagatgcggcagatgtttgtcaataaggtcaaggaaactgagctcgaactgaaagagaaggaacgcgagctgcacgagaagtttgaacatctcaagcgggtgcatcaggaagagaaaagaaaggtggaagagaaaagacgggaacttgaagaggagaccaatgcattcaaccgtcggaaagccgcagtcgaggcacttcaatctcaggccctgcatgccacctctcaacagccgcttcgcaaagacaaggacaagaagaactag

SEQ ID NO: 204589 - DNA, 1329 bp, Artificial Sequence
  Description of Artificial Sequence: Synthetic coding sequence
atggccgccaccgacctggagcggttcagcaacgccgagcccgagcccagaagcttatcgcttggcggacacgtgggattcgactcccttcccgatcagctggtgtccaagtccgtcacacagggattctccttcaatatcctctgcgttggggagacagggattggcaagagcacacttatgaatacgcttttcaacaccaccttcgagactgaagaggcgagccaccacgaggcctgtgtgaggctgaggccccagacttatgacctgcaggaaagtaatgtacagctgaagttaactattgtggacgcggtcgggttcggagatcagattaataaggatgaatcctatagacccatagtggactacattgacgctcagtttgagaattacctccaggaagagctgaaaattaggcgcagcctctttgactatcacgacaccagaatccacgtgtgcctatattttatcacacccacgggtcattcattgaaatccctcgatcttgtcaccatgaaaaaactggattccaaggttaacattatccctatcattgcaaaagccgacacaatttccaagtctgaactccacaagttcaagatcaagattatgggtgaacttgtaagtaatggagtccagatttatcaatttcctaccgacgatgaagctgttgcggagatcaatgccgtcatgaatgctcacctgccctttgcagtggtggggagcacagaagaggtgaaggttgggaataagctagtgcgggctcggcagtatccttggggggtcgttcaggtggaaaatgaaaaccattgcgatttcgtcaaactgcgcgagatgttaattagagtgaatatggaggaccttagggagcaaactcatagccgacattatgaattgtatcgcaggtgtaaactagaagagatgggcttccaggattcagacggcgattcacagccattctctctgcaggaaacttacgaggccaagagaaaggagtttttgtctgagcttcagagaaaggaggaggaaatgcgacagatgttcgtgaataaggtgaaagagaccgagctcgaactcaaggagaaggagagagaactgcacgagaaattcgagcacctgaagagggttcatcaggaggaaaagcgcaaggttgaggaaaaaaggcgagagctcgaggaagaaacaaatgctttcaacaggcgcaaagccgcggtagaggctctccagtcgcaagccctccatgcaacctcccaacaacccctacgaaaagataaggataagaagaaggcatctgggtggtcctcaatttattcagtcacaattccctag

SEQ ID NO: 204590 - DNA, 1707 bp, Artificial Sequence
  Description of Artificial Sequence: Synthetic coding sequence
atggagcgggaccggatcagcgccctgaagcggagcttcgaggtggaagaagtggagactcccaattctacccctccgcgaagagtgcagaccccgctgcttcgggcgacagtcgcctcctccactcagaaatttcaagatctgggagtgaagaattctgaaccctcagccagacacgtcgatagcctgtcccaacgcagcccaaaggcctcgctgaggcgtgtcgagctgtcgggacctaaagctgccgaacccgtgtctcggagaactgagctgtccattgacatttcctccaagcaggtcgaaaatgcgggcgccatcgggcctagtcgattcggacttaaacgagcagaagttctgggacacaagacccctgaacccgcccctcgcaggaccgagatcacaatagtaaagccccaggagtccgcccacagaaggatggaaccacccgcttccaaagtccccgaagtgcccacggcacctgcaacagacgccgctcctaagcgggtggaaatccaaatgccgaaaccagccgaagccccgactgctccttctccagcccagacccttgagaactccgaacccgctcccgtgtcccagcttcaatccaggctggaaccgaaaccacagccacccgttgctgaggctacaccaagaagtcaggaggctaccgaagctgctccctcttgcgtgggcgacatggctgataccccccgggatgcaggtctgaagcaggcgccagcttctagaaatgaaaaggcacccgtggatttcggttacgttggaatcgatagcatccttgaacaaatgcggcgcaaggccatgaagcagggcttcgaatttaacattatggtagtcgggcaatccggcctgggaaaaagtaccctcataaacacactgtttaaatctaagatttcgagaaagagcgtgcagcccaccagcgaggaaaggattccgaagacaattgaaatcaaatctattacccatgatattgaagagaagggggtgaggatgaaacttactgtcatagatacacctggattcggagaccacattaataatgagaactgttggcagccaataatgaaattcatcaacgatcagtacgagaagtatcttcaggaggaggtgaacattaacagaaagaaaaggattccagacacgagggtccattgttgtttatatttcattccggccactggccattccctgaggccgctggatattgaattcatgaaacgcctgtctaaggttgtgaacatcgtgcctgtgatagccaaggcagatacactcactctggaggagagggtgcacttcaaacaacgcattaccgccgacctattgtctaacgggattgatgtgtatccacagaaggaattcgatgaggactctgaggatcggctcgtcaacgaaaagtttagggagatgataccctttgctgtggtcggctccgatcacgaataccaggtgaatgggaaacgtatcctcgggcgcaaaaccaagtgggggacgatcgaagttgagaacacaactcactgcgagtttgcgtatcttcgcgacctactcattcgaacacacatgcaaaacattaaggatatcacttcaagcattcactttgaggcctatcgggtgaagcgcttgaacgaaggttcctctgccatggccaacgggatggaggagaaagagcctgaggctcctgagatgtag

SEQ ID NO: 204591 - DNA, 591 bp, Artificial Sequence
  Description of Artificial Sequence: Synthetic coding sequence
atggccgacaccccccgggacgccggcctgaagcaggcccccgcctctcgtaacgagaaagctcccgttgatttcgggtacgtgggtatagacagcattctagagcagatgaggcgcaaagctatgaaacaggggttcgagttcaatatcatggtcgtcggccagagtggtcttggaaaaagtactctcataaacacactgtttaagagtaagataagccggaaatccgttcagcctacttcggaagaacgcatacctaaaacaatcgagatcaagagtatcactcatgacatcgaggagaaaggtgttaggatgaagctgactgttattgatacacctggttttggggatcacattaacaatgagaactgttggcagcccatcatgaagtttatcaatgaccagtatgagaagtaccttcaggaggaagtgaatataaacaggaagaagcgaatccccgatacccgcgtccactgctgcctgtattttattcctgcaacggggcattcactgcccctgttagaacagaaggttccattatcccagccgtcagcggattgcctggctcgatgcggggacaggttggagtag

SEQ ID NO: 204592 - DNA, 1740 bp, Artificial Sequence
  Description of Artificial Sequence: Synthetic coding sequence
atgagcgaccccgccgtgaacgcccagctggacggcatcatcagcgactttgaggccctgaagcggtcctttgaggtggaggaagtggagaccccaaacagcacccctcctagaagggtgcagacaccacttctccgagctactgtcgcttcctcaacgcagaagttccaggacctgggcgtgaagaattcagagcctagtgctcgtcatgtcgattcgttatctcagcgatcaccaaaagccagcctgcggagggtcgagctgtcaggcccaaaggccgccgagccagtatcacggcgtaccgagctgtcaattgatatctcaagtaagcaggttgaaaatgccggagccatcggcccttccagattcggtttaaaacgtgccgaggtactgggtcataagactccagaaccagctccccgaagaacagagatcacaatcgtcaagcctcaggagtctgcacaccggcgcatggagccacccgccagtaaagttcctgaggtgcctacagcccccgctacggatgccgctcctaaacgggtagaaatccagatgcccaagccagccgaagcccctaccgctcccagcccagcgcagacactagaaaactccgagccggcacccgtgtctcaactccaaagcaggctggaacccaagccccagcccccagttgctgaagcaacacccagaagccaggaggccacagaagccgctccatcctgcgtgggagatatggccgacactccgcgggatgccgggctcaaacaggcccccgcctcacggaatgaaaaggcgcctgtggattttggctacgtcgggattgatagtattttggagcagatgaggcgtaaggcaatgaagcaaggttttgagttcaatattatggttgttggccagtccggactcggaaaatctacgctcataaacactctctttaagagcaagatttcccggaagtccgtgcagcccactagcgaagaacgtattccaaagaccattgagataaaatctattacgcatgacatcgaagagaaaggcgtgcgtatgaaactgactgtgatcgacacgcccggcttcggcgaccacattaacaatgaaaattgctggcaacctataatgaagtttattaacgatcagtatgagaaatacctgcaggaggaggtgaacatcaaccggaaaaagcggatacccgataccagagtccattgttgcttgtacttcatccccgctactgggcactccctcagaccgttagatatcgaattcatgaagcggctgagtaaggtggtcaatatcgtaccagtcatcgcgaaagcggatacactaaccctggaggagagggtgcactttaagcaacgcatcactgcagacttgctcagcaatgggatcgacgtttatccgcagaaggaattcgatgaggacagcgaggaccgccttgtgaatgagaaatttagagagatgatcccctttgccgtggttggaagcgatcatgagtatcaggtgaacggcaaacgaattctggggcggaaaaccaagtggggcacgatagaggtggaaaacacgacgcactgcgaatttgcttacctgcgcgacctgcttatacggacccacatgcagaatatcaaagatatcacctctagcatccacttcgaggcctatcgggtaaagcggctcaatgagggcagcagcgccatggctaacggaatggaagagaaagaacctgaggcccccgagatgtag

SEQ ID NO: 204593 - DNA, 1761 bp, Artificial Sequence
  Description of Artificial Sequence: Synthetic coding sequence
atgaagaagagctacagcggcggcacccggaccagcagcggccggctgcgtcggctcggcgattccagcgggcccgctttaaaacgtagtttcgaggtcgaggaggtagagacgcccaattccacgcccccaaggcgagttcagaccccccttctgcgagctaccgtagccagctctacgcagaagttccaggacctgggggtaaagaatagtgaacctagcgctcgccacgtggattctttatctcaacggtcccctaaagcctcgctccggcgggttgagttgagcgggccgaaggccgctgaacccgtttctagacgcaccgagctatccatcgatatttccagcaagcaggtcgaaaacgcaggcgctatcggcccctcaagatttgggctgaagagggccgaggttttaggtcataagactcccgaaccggccccacgccgcaccgaaatcactattgttaagccgcaggagagcgcacatagacgcatggagccgccagcctccaaggtgcctgaagtcccaaccgcccccgccaccgacgctgcaccaaaaagagtggaaatccagatgccaaaaccggctgaagcccccaccgctccctcacccgctcagactctggagaattcggagccagcgccagtgtcccaactgcagtcgaggctggagccaaaaccccagccccccgtggccgaagcgacccctcgtagccaggaagccaccgaggcggcgccatcctgtgtaggggacatggcagataccccaagagacgcgggcctgaagcaggcgccagccagccgaaacgagaaggcccccgtggattttggatatgtaggaatagattctatcttggagcaaatgaggagaaaggcaatgaagcaggggttcgagtttaatattatggtggtcgggcaatctggccttgggaagtccactcttatcaatacattgtttaaatctaagatatctcggaagagcgtgcagcctactagtgaggaacgcatccctaaaaccattgagataaagtcaataacacatgatatcgaggaaaaaggcgtgcgaatgaaacttacggtgatcgatacaccaggatttggcgaccacatcaataatgaaaattgctggcagcctatcatgaagtttatcaatgatcagtacgaaaaatatctgcaagaggaggtgaacattaatcgcaaaaagaggatccctgacacacgcgttcattgttgcctctattttatccctgcaaccgggcacagtttgagaccactggatattgaattcatgaagcgtctgagtaaggtggtgaacatcgtccccgtaatcgccaaggctgacaccttgaccctggaggagcgagtgcacttcaagcagcggattacagccgatctcttgtccaatggcatagacgtttatccacagaaagagtttgacgaggattcagaggatagattggtcaatgagaagttccgagagatgatccccttcgcagtggttggcagcgaccatgagtatcaggttaatgggaaacggatactggggagaaagactaaatggggaaccatagaggtggagaacaccactcattgcgagttcgcctacttgcgcgatttgctgatcaggacccacatgcagaacatcaaggatataacatcgagcatacactttgaggcttacagggtgaaaaggctaaacgaggggagttctgctatggccaacgggatggaagaaaaggagcctgaagctcccgaaatgtag

SEQ ID NO: 204594 - DNA, 1425 bp, Artificial Sequence
  Description of Artificial Sequence: Synthetic coding sequence
atgggcagcagcttctgggagggcctgcaggtggccgtgggcctgcctcagggttgttggcctcagggcctggattctggggagccagccgaaggcggccaactggaggcagcaccggtctgcattgtgactcgccaaagcaaagagactgccggtcctactctgggccgagggggatggagacagggctcccttcgaagaggcaaaggcacgtcgtgtaggtgtagacagctaagccccggccatggcccgggccgactgaccggatgcggcgagtgtcacaggctcccatgccgcggcctggtgtcagggtttacaggactcaggggacaggaggaggatgatctcgccttctgtctggccaccatcggaagcgacagacaggccaccgaagcggcgccttcatgtgtgggagacatggcagacactcccagggatgccggcctcaaacaggctccagcctcacggaacgaaaaggctccagttgatttcggatacgtcgggatcgattccatcctggagcaaatgcggcgtaaggctatgaaacaggggttcgaatttaacatcatggtggtgggacagtctggtctggggaaatctacattgataaacactttattcaagtctaagatctcacgcaagtctgtacaacccactagtgaagagagaattccaaaaacaatagagattaaatcaatcacccacgatatcgaagaaaaaggcgttcggatgaagctgacagtaattgatactcctgggtttggtgaccatatcaataacgaaaactgttggcagcctataatgaaattcattaatgaccaatatgagaaatacttacaagaggaggtcaacatcaaccgtaagaagcgtatccctgataccagagtccactgctgcctgtattttattccagccactggtcactcccttcgaccacttgacattgaatttatgaagagattgtcaaaagtggttaatatcgtgccagtgatcgccaaggcagatacacttactctcgaagagagagtgcatttcaaacagcgcataaccgcggatctgctaagcaatggcattgatgtatatccccaaaaagagttcgatgaggactcagaagatagactagtaaacgagaagttccgggaaatgattcctttcgccgttgtcggctccgaccatgaatatcaggtcaacggcaagagaatactcgggcggaaaacaaagtggggaactattgaagtggagaataccacccattgcgaatttgcttatctccgtgacctgctcattaggacacacatgcaaaatattaaggatattacctcttctattcacttcgaggcgtatagagtgaaacgacttaacgaagggtcatcagccatggccaacggcatggaggagaaggagccagaagccccggaaatgtag

SEQ ID NO: 204595 - DNA, 1269 bp, Artificial Sequence
  Description of Artificial Sequence: Synthetic coding sequence
atggagccccccgccagcaaggtgcccgaggtgcccaccgcccccgccactgacgccgccccaaagagagttgaaatccagatgccgaaaccagcagaggcacccaccgccccgtcacctgcccagacacttgaaaactctgagccggctcccgtttcccagctccagtctcgtttagagccaaagccccaaccccccgtggcggaggctacccctcgcagccaagaagccaccgaagcagccccgtcttgtgtgggggacatggcagacacaccgagagatgccgggcttaagcaggcaccagcttcacggaacgagaaggctcctgtggactttggctacgtgggaattgatagcattctggagcagatgaggcggaaggctatgaaacagggcttcgagttcaatattatggtggtgggacagtctgggttgggtaagtccacgctcattaataccctattcaagtcaaagatctctcggaagtcagttcagcccactagcgaggagaggatccccaagaccattgaaatcaagtccattacacacgatatcgaggaaaagggagttaggatgaagctaaccgtaatagatacccctgggtttggcgatcatattaacaatgagaattgctggcaaccaattatgaagtttattaacgatcagtacgaaaaatacctgcaggaagaagtcaacatcaaccggaagaagcgcatccctgatactagggttcattgctgtttgtattttatcccagccactgggcatagcttacgaccacttgacatcgagtttatgaaaaggctgtccaaagtagtcaatattgtaccagttattgcaaaagcagatacgctgaccttagaagaaagagtgcatttcaaacagcggatcacagccgatctgctatcaaacggcatagatgtctatcctcagaaggagttcgatgaagattcagaggaccgactagttaatgagaagttccgggaaatgattccattcgcagtggtcggcagcgatcacgagtaccaggttaacggcaaacggattctggggaggaaaactaaatggggcaccattgaagtggaaaataccactcattgtgagttcgcctacttgagggacctcctcatcaggacgcacatgcagaacatcaaagatattaccagctcaatccactttgaagcctaccgtgtcaagcgcctcaatgagggcagtagtgcgatggctaatggaatggaggagaaagagccagaagcccccgagatgtag

SEQ ID NO: 204596 - DNA, 1008 bp, Artificial Sequence
  Description of Artificial Sequence: Synthetic coding sequence
atggccgacaccccccgggacgccggcctgaagcaggcccccgccagccgaaacgagaaagctcctgtggacttcggttacgtcggaatcgactcaatcctggaacagatgaggagaaaggccatgaagcaaggcttcgagttcaatatcatggtggtgggacaaagtgggttgggcaagtctaccctgattaacacactgttcaaatctaaaatttccagaaaatctgtccagccaacctctgaggagagaatccctaagacaatcgagatcaagagcataacccacgatattgaagagaaaggagttcggatgaaattgactgtcattgatacccccggctttggagatcacattaacaatgaaaactgctggcagcctataatgaagtttataaacgaccagtacgaaaagtatttgcaagaagaggtgaatattaacaggaagaagagaatccccgacactcgtgtgcactgctgcctctactttatccccgccaccgggcacagcctgcggcctctggacattgagttcatgaagagattgtcgaaggtggtcaatattgtacctgtaatagcgaaggcggacactctgaccctcgaggaacgggtgcacttcaaacaacggatcaccgctgacctcttatctaacggcattgatgtttatccccagaaggagtttgacgaagatagcgaagatcgcttagttaatgagaagtttcgcgagatgatcccattcgccgtcgtgggctctgatcatgagtaccaggtgaacggaaaaagaatactaggacggaaaaccaagtggggcacaattgaggtcgagaacactactcattgtgagtttgcctacctgcgagacctgctgattaggactcacatgcaaaacattaaagacatcacttcttccatccatttcgaagcgtaccgggtgaaaagactcaacgaagggagtagcgctatggccaacgggatggaagagaaagaacccgaagcccctgaaatgtag

SEQ ID NO: 204597 - DNA, 1269 bp, Artificial Sequence
  Description of Artificial Sequence: Synthetic coding sequence
atggagccccccgccagcaaggtgcccgaggtgcccaccgcccccgctaccgacgctgcacccaaacgcgtcgagatccaaatgcctaaacctgctgaggctcctaccgctccttcccccgcccagaccttggagaacagtgagccagctcccgtgtcccagctgcagagtcgattggagcccaagcctcagcctcctgtagcagaagccacacctcgatcccaagaagcaaccgaagctgccccgagttgtgttggtgacatggccgacactccaagagatgccggccttaaacaggctccagcgagccggaatgagaaagcaccggtggatttcggttacgttggaatcgattccatcctggagcagatgcgccgcaaggctatgaagcaggggttcgaatttaatatcatggttgtaggccagtctggactggggaagtctactctgattaatacactgttcaagtccaagatatccaggaaaagcgtgcagcccacgagcgaagagcggatcccaaagacgattgagattaagagtataacacatgacatcgaagaaaagggggtaagaatgaagttgaccgtgattgatacgccagggttcggagatcatataaataatgaaaattgttggcagcctatcatgaaatttatcaatgatcagtacgagaagtatttgcaggaagaggttaatataaacaggaagaaaagaattcctgacactagggtgcactgttgtctttattttattcccgcgaccggacattccctgcggccactcgatatcgaatttatgaaacggctcagcaaagtggtgaacatcgtgccagttatcgccaaagccgacactcttactctcgaggaacgcgtgcactttaaacagcgtataacggctgatttactgagtaacggcattgatgtctacccgcaaaaagagttcgatgaagattcagaggaccgtctggtaaacgagaaatttagggagatgattcccttcgcagttgtgggctctgatcacgagtaccaggtcaatgggaaacgcattttggggaggaagacaaagtggggcactatagaggtggagaataccacccattgtgaatttgcctatttgcgcgaccttttaatcagaactcatatgcagaacatcaaggatatcaccagcagcatccacttcgaagcataccgggtgaaacgattgaatgagggttcctccgcgatggccaacggaatggaggagaaggagcccgaagccccggagatgtag

SEQ ID NO: 204598 - DNA, 1089 bp, Artificial Sequence
  Description of Artificial Sequence: Synthetic coding sequence
atggccggcgccggctgcaccggcacctggagctggctgtggggcaccgccactgaagctgctccctcttgcgtcggggacatggccgatacacctagagacgccggccttaaacaggctccagcctctcgaaatgagaaggcaccagtggactttggctatgtgggtattgactcaatacttgagcaaatgagaagaaaagcaatgaaacagggcttcgaattcaatattatggtagtcgggcaaagcggattgggtaagagtacgctcattaacactcttttcaagtcaaaaatctctcgtaagtcggtacaaccaacctctgaagagagaatcccaaagaccatcgaaatcaaatccatcacacatgatatcgaggaaaagggcgtgaggatgaaactgacagtgatagatacacccggtttcggggaccacatcaataacgaaaattgctggcagcccattatgaaattcatcaatgatcagtacgaaaagtacctgcaggaggaggtgaacattaatcggaagaaaagaatccccgacacaagagtccactgctgtctctacttcatccccgcgaccggacacagtcttaggcctcttgacattgagttcatgaagcggctctctaaggtcgtgaacattgtgccagtgatagccaaagcggataccctgactttggaggaacgcgtacacttcaagcagcggattactgccgacttactgtccaatggcattgacgtctatccacagaaggagttcgatgaagacagcgaagacaggttggtaaatgagaagtttagggagatgatacccttcgctgtggtaggctctgatcatgagtaccaggtgaacggtaaaagaattttgggtagaaaaacaaagtggggcacgatagaagtggagaacaccacccactgcgaattcgcgtatctgagagacctattaatccggacccacatgcagaatatcaaggacatcactagcagcatccacttcgaagcctatagagtcaagcgcctaaacgagggtagttctgcaatggctaatggtatggaggagaaagaaccagaggctcccgaaatgtag

SEQ ID NO: 204599 - DNA, 582 bp, Artificial Sequence
  Description of Artificial Sequence: Synthetic coding sequence
atgaccctgtgcccccaggcctggctgcccgagggcagcgaggagcagctacgctgtgcagaccatccttcgtgtggcgtgctgtctgctgggccctgggggggcggccaggcaagccacttgcaacggtcccccgtgggatgtactcttccttctatcccaattgggccggtgccgtggtctgttagcgagccccgaggggagtgttcacctcctggagcccccggcccccccgccagacacatggtctggccttccctttccccctacccttgtcccgctccaaagggcagaaaattacagggcccactgcccccaactgcacagccactgcaggccccttggcagctcccactccttgaacagaaagttcccctgtcccaaccaagcgccgattgttggccggatgccggaactggctggaatgaaggcggggtgtttatatcccttcccagcccaagtcacgcaaccccagctcctaccggcctccaggtcctccttatgagatgggacctaatcgaggacaaaaaggagggggaaatgacacccaccccgagctcacccagcttcgaaaaagtgtag

SEQ ID NO: 204600 - DNA, 1071 bp, Artificial Sequence
  Description of Artificial Sequence: Synthetic coding sequence
atggccatgagctacgtgaaggacgacatcttccggatctacatcaaggagaaaaaggaatgcagaagggatcatcgcccaccctgtgcccaggaggcacccagaaatatggtccaccctaacgtcatctgtgatggctgtaacggtcccgtggtagggaccagatataaatgtagcgtgtgtcctgactatgacctttgctctgtgtgcgaaggcaaaggactacatagagggcacacgaagctggcttttccaagtccatttggccacctgagtgagggattctcacacagcagatggctcaggaaagtgaagcacggccacttcggatggccagggtgggaaatggggccacccgggaactggtcacccagaccacctagagccggcgaggctaggcccggcccgaccgctgagagcgcttccggcccgagcgaagatcccagcgttaatttcctcaagaatgtgggagaatccgtggcggccgcactttctccgctgggcatcgaagttgacattgatgtggagcatggcgggaaacgctccagactgacaccagtgtcacccgagagttcgagcaccgaagaaaagtcctcttcccagccctcctcctgctgctctgacccctccaagccaggggggaatgttgaaggagccacacaatctctggctgagcagatgcgtaaaatcgcccttgaaagtgaggggcggcctgaagagcagatggagagtgacaattgctcggggggcgacgacgactggacccacctttcaagtaaggaagtggaccccagtaccggtgagctgcagtccttgcaaatgcccgagagcgaggggcccagcagccttgaccctagtcaggaaggccctactgggctgaaggaagccgcattgtacccccacctcccccccgaagctgaccctcgcctcattgaaagcttgtctcagatgttgtccatgggtttctctgatgagggtggctggttgacccgcctgctgcaaacaaaaaactatgatatcggagcggccctggatactattcagtactctaagcacccgccaccgctgtag

SEQ ID NO: 204601 - DNA, 1071 bp, Artificial Sequence
  Description of Artificial Sequence: Synthetic coding sequence
atggccatgagctacgtgaaggacgacatcttccggatctacatcaaagaaaagaaagaatgtagacgtgaccaccgccccccgtgcgcacaagaagccccacggaacatggtgcatcccaacgtgatctgtgacggatgcaacggtcctgttgttggcacgcgctataagtgtagtgtgtgcccagattacgatctctgttccgtgtgtgaagggaagggtttgcaccgtgggcacacgaaactggcgttcccttctccatttggacatctctccgaggggttttcccacagccgatggctgcggaaagtgaaacatggtcatttcggttggcctggttgggagatgggaccacctgggaactggagtcctagacccccgagagccggcgaggctcgcccagggccaaccgccgagagcgcctctgggccaagtgaggacccttctgtgaacttccttaagaatgtaggggagagcgtcgcagctgccctgtcacctctcgggatcgaggtggacattgacgttgaacatggggggaaacgatctcggctgacaccagtgagcccagaatcgtcctctaccgaggaaaaaagctccagccagccatcttcttgttgttcagacccaagcaagcccggtgggaacgtggagggggccacccaaagtctcgccgagcagatgagaaagatcgccctggaaagcgaaggaagaccagaagagcagatggagtccgataactgttcgggcggcgacgatgattggacacacctgtcaagtaaggaagtggacccctccacaggcgaactccaatccctgcagatgccggaaagtgagggcccaagctcattggacccaagtcaggagggaccaactgggctgaaagaggcggccctatatccacatctcccccctgaagcagaccctaggctgatcgagtccctctctcagatgctgagcatgggtttcagtgacgagggtggctggctgacgcggctccttcaaaccaagaattacgatataggtgccgctctggacactattcagtactccaagcaccccccccccctatag

SEQ ID NO: 204602 - DNA, 1323 bp, Artificial Sequence
  Description of Artificial Sequence: Synthetic coding sequence
atggccagcctgaccgtgaaggcctacctgctgggcaaggaggacgccgcaagggagataaggcggttctcattctgctgtagcccggagcccgaggccgaggctgaggctgctgccggaccagggccttgcgagcggctgctatccagagtggccgccctctttcccgcattgaggcctggcggatttcaggcccattatcgagatgaagatggcgacttagtcgctttctcctccgacgaagaactcactatggccatgagttacgttaaggacgatatttttcggatctatattaaagagaaaaaggaatgtcgcagggatcatcgacctccctgcgctcaggaagccccccggaacatggtgcaccccaatgttatatgcgacgggtgcaatggccctgtcgtcggcacaagatataaatgctcggtgtgccctgattacgatctctgtagcgtctgtgagggcaaaggtctgcaccgcggacatactaagctggcgttcccttctccgttcggacatctgagcgaagggttctcccactctcgatggcttagaaaggtaaagcacggccattttggctggccgggttgggaaatgggccctccaggcaattggagcccccgtcccccacgagccggagaagcacgccctggcccaactgcagaatcggcaagcggcccctccgaggacccctcagtgaacttcctcaagaatgtgggagaaagcgtggcagctgctctgtcccctctggggatcgaagtggatatcgacgttgagcatggaggcaaacgctcacgcctaacacctgtctcgcctgagagcagctctactgaagaaaaatcctccagccaaccatcttcctgttgcagcgacccgtcgaaacctggcgggaatgtagaaggtgcaacgcagagcctggccgagcaaatgaggaagattgcattagaaagtgagggacggcctgaggagcagatggagtccgataattgtagcgggggtgatgacgattggacacacctatcctctaaggaagtcgacccctccacaggggagctgcagtctttgcagatgccagagagcgaggggccgagttcactcgacccctcccaagaagggcccacagggttgaaagaggctgccctgtatccacacttaccccctgaggccgatcctagactgattgaaagtctcagtcagatgctgagtatgggttttagcgacgaagggggatggttgacccgcctgctgcagactaaaaactacgatataggggctgccttggacacaatccaatactccaaacaccccccacccctgtag

SEQ ID NO: 204603 - DNA, 1071 bp, Artificial Sequence
  Description of Artificial Sequence: Synthetic coding sequence
atggccatgagctacgtgaaggacgacatcttccggatctacatcaaagaaaaaaaagaatgcaggcgagaccatcgcccaccctgcgcgcaggaagctccgcgcaacatggtacatcccaatgtcatctgtgatggatgtaacggcccagtggtaggcactcgctataagtgtagcgtgtgtcccgattacgatctgtgcagcgtgtgcgaaggtaagggtctgcaccgggggcataccaaactggctttcccatctccatttgggcatctcagcgaggggttttcacattctcgctggctgcggaaggtgaagcacggccacttcggctggcccggttgggaaatgggcccccccggaaactggagtcctcgccctcctagggcaggggaagctagaccgggcccgactgctgaatccgcaagcgggccaagcgaagacccatccgtcaatttccttaagaatgttggcgagagcgtggccgccgcactgagcccattgggaattgaagtggacatcgatgtggagcacggaggtaagagatcacggttgacccccgtgtcccccgagtcctcttcaacggaagaaaaaagcagttctcagccatcctcctgctgctcagacccttccaagcccggcggaaacgtcgaaggcgcaacacagagtctggctgagcagatgcgaaagatcgctttggagtcagaaggcagacccgaagagcagatggagtccgataattgcagtggcggagacgacgactggacccacctgtcaagcaaagaagttgatccgtccacaggcgagctgcagtctctccaaatgcccgagtccgagggcccaagctcattagacccctcccaggaaggtcctactggtctgaaggaggccgccttgtacccacatttgccacccgaagcagaccctagactaatcgagagcctaagtcaaatgttgagtatgggattttctgatgaagggggttggctcactaggctactgcaaacaaaaaactacgatattggtgcagctctcgacacaatccagtactctaaacacccaccccccctgtag

SEQ ID NO: 204604 - DNA, 423 bp, Artificial Sequence
  Description of Artificial Sequence: Synthetic coding sequence
atggccatgagctacgtgaaggacgacatcttccggatctacatcaaagaaaagaaagaatgtcggcgggaccaccgccccccctgtgcacaggaagctccccgtaacatggtgcatcccaatgtgatctgcgatggatgcaacgggcctgtggtggggacaagatacaaatgtagcgtatgtcccgactacgacctgtgcagcgtatgtgaaggtaagggcctgcatcgcggccacacaaagctcgcatttccatcgccattcggccacttgtccgaagggttttctcacagcaggtggctcagaaaggtcaaacatggccacttcgggtggcccggttgggagatgggcccccccggcaattggagccctaggccacctagggctggagaggcacggcctggacctacagctgagagttag

SEQ ID NO: 204605 - DNA, 891 bp, Artificial Sequence
  Description of Artificial Sequence: Synthetic coding sequence
atgaccagcagcgagagcaccctgaagcggaagaagagcgccggcggaaccactgctcaccgagtgctgcgacgaagaccgttcggacaccttagcgagggtttttctcactctcgctggctgaggaaggtgaaacacggccatttcggatggccagggtgggagatgggtccacccggaaactggtcccccaggccaccacgcgctggagaggcccggcccggtcccacagcagagtcggcctctggaccgtcggaggacccttccgtaaatttcctcaaaaatgttggcgaaagcgtcgctgccgcactctcccctctggggatcgaagtggatatcgatgttgaacacgggggaaagcggtcccggcttacacccgtgtccccggaatcttcaagtactgaggaaaagagcagcagccagcctagtagctgctgcagcgatccgtccaaacccggaggcaatgttgagggcgccacacaatccctagccgaacaaatgcggaaaatagccctcgaaagcgaaggccgccctgaagaacagatggagtccgataactgctctggaggagacgacgactggacacacctttctagcaaggaggttgatccctcaacaggagagctgcagtctcttcagatgccggagtccgaaggacctagctctctggatccaagccaggagggacctaccgggctcaaggaagccgcactatatccccacctgcctccagaggcagatcctcgcttgatagaaagtctgagccagatgctgtccatgggcttcagcgacgaaggcgggtggctcacacgcctgctgcaaacaaagaattatgacatcggagctgccctggacaccattcaatactctaagcatcctccccccctttag

SEQ ID NO: 204606 - DNA, 504 bp, Artificial Sequence
  Description of Artificial Sequence: Synthetic coding sequence
atggccatgagctacgtgaaggacgacatcttccggatctacatcaaagagaagaaggagtgtcgacgagaccaccgccctccctgcgctcaggaggcaccacggaatatggtgcatcctaatgtcatatgtgacggttgtaacggacccgtcgtagggactaggtacaagtgctctgtgtgccctgattacgatttgtgctccgtgtgcgaagggaaggggcttcatcgaggacataccaaactggcttttccaagtcctttcgggcatctatctgaggggttttcgcacagtagatggctcaggaaggtgaagcatggtcatttcggctggccagggtgggagatggggccacctggcaattggtcccccagaccccctagagccggcgaggccaggcccggccccaccgctgaatccgcgtcaggtccttcagaggatccttccgttaacttcttgaagaacgtgggagagtccgtcgctgccgccctatcaccactgtag

SEQ ID NO: 204607 - DNA, 477 bp, Artificial Sequence
  Description of Artificial Sequence: Synthetic coding sequence
atgatgcagaagctgctgaagtgcagccggctggtgctggccctggccctgatcctggtgttggagagttcggtgcagggttacccgacccggcgcgcacgctatcaatgggtgagatgtaatccggacagcaattctgccaactgcctggaggagaagggccctatgttcgagctactccctggcgagagcaataagatccctagactgcggaccgaccttttcccaaagacccgaattcaggacctcaatcggatctttcccctctccgaggactactcaggtagtggcttcggatccggatccggttctggctctggctccggatctggctttctcactgagatggagcaggattaccagctggtcgacgaatctgacgcgtttcatgacaacctgcgctccttggataggaacctacccagtgacagtcaagatctcgggcagcacggcttagaggaagacttcatgctgtag

SEQ ID NO: 204608 - DNA, 987 bp, Artificial Sequence
  Description of Artificial Sequence: Synthetic coding sequence
atgatgagcggcgagcccctgcacgtgaagacccccatccgggactcaatggctctgtctaagatggcaggcaccagcgtgtaccttaaaatggatagcgcccagccatcaggctcatttaagattaggggcatcggtcatttttgcaagcggtgggccaaacagggatgtgcgcacttcgtgtgctcgtccgcagggaacgccggaatggcggctgcatacgctgcccggcagctgggcgtacctgcaactattgtggtgccatcgaccactcccgcactaaccatcgagaggctgaagaatgagggcgctacggtgaaggtggtcggcgagctgctggatgaagcttttgagctggccaaggcccttgccaaaaacaatcctggctgggtgtatattcctccctttgacgacccactgatatgggaaggacatgcctctatcgtgaaggaacttaaggagacgttgtgggagaagcccggcgcaatcgcactgtccgtgggaggtggcggactgctgtgcggcgtggtgcaaggtctgcaggaagtgggatggggtgacgttccagttatcgccatggaaacctttggcgctcactcattccatgctgcaaccaccgctggaaagctggtgagcctgcccaaaataacatcggtggcaaaggccttgggagtcaaaacggtgggggctcaggctctcaaactatttcaggagcacccaatattcagtgaggtgatttcggatcaggaagcagtcgccgccatcgaaaaattcgtggatgacgaaaagattcttgttgagcccgcgtgtggagcggcactggctgccgtgtatagtcacgttatccagaagctgcagctagaaggtaaccttaggacccccttaccctcattggtggttatagtctgtggtggcagcaatatctcccttgctcaactgcgggcgttgaaagaacaattaggcatgaccaataggttgcctaagtag

SEQ ID NO: 204609 - DNA, 657 bp, Artificial Sequence
  Description of Artificial Sequence: Synthetic coding sequence
atgatgagcggcgagcccctgcacgtgaagacccccatccgggactcgatggctttaagcaagatggccggtacctcagtgtatctgaaaatggactctgcgcagccgagtggcagcttcaagatcagagggataggacacttctgcaaacgatgggcaaagcagggttgtgcacactttgtttgttccagtgccgggaacgcgggtatggccgctgcatatgcagccagacagctgggcgtccccgctacaatagtggttccctcgacgaccccagccttaacaatcgagcgtctcaaaaacgaaggggcaaccgtcaaggtggtgggggagcttctggacgaagcttttgagctggccaaggctttggcgaaaaacaatcccggctgggtctatataccaccgtttgatgacccactgatctgggagggccatgccagcatagtcaaagagcttaaggagacactttgggaaaagcctggagctattgctctgagtgtgggcggcggcgggctcctttgtggcgtcgtgcagggactgcaggaggtcggatggggggacgtccctgttattgccatggaaacctttggcgctcacagtttccatgcagccactacggccggcaagctggtgtccctcccaaaaatcacaaggtag

SEQ ID NO: 204610 - DNA, 1452 bp, Artificial Sequence
  Description of Artificial Sequence: Synthetic coding sequence
atgaccatgcccgtgaacggcgcccacaaggacgccgacctgtggtccagccacgacaagatgcttgctcaacccctgaaggactctgacgttgaagtttataacataataaaaaaggagtctaaccggcagcgggtgggattagaactcatagcttcggagaactttgcctcccgggctgtgctcgaagcccttggcagctgcctgaataataaatattctgagggctatcccggacagagatactatggaggcacagaattcatagacgagctggagaccctttgccagaagcgggcacttcaggcctacaaattagacccccagtgctggggagtgaatgtccagccatattccggcagcccagccaatttcgccgtctacactgcccttgtggagccccatggccgaatcatgggcctggatctacctgatggaggacacttgacccacggtttcatgacggacaaaaagaagataagtgcaaccagcatattcttcgagagcatgccctataaagtgaaccctgacactgggtatattaattatgaccagctcgaagagaacgcacggctgttccacccaaagttaataatcgctgggaccagctgttactcacgcaaccttgaatacgcgcggctgcggaagattgccgacgaaaacggcgcctatcttatggcagacatggctcacatttccgggctcgtggccgccggggtcgtgccgagccctttcgagcattgtcatgtggttacaaccacgactcacaaaaccctccgcggctgcagagctggaatgatcttttatagaaaaggggtgaaaagtgtagacccgaagactgggaaagaaattctttacaatctagaaagcctcattaacagtgcagtgtttcctggcctgcagggtggacctcataatcacgccatagccggagtggctgtggctctaaagcaggctatgaccctggagtttaaggtataccagcatcaggttgtggcaaattgccgggcattgagcgaggccctaacagaactcggatataagatcgtgaccggggggagcgataatcacttgatcttggttgacctcagaagtaagggcacggatggcgggcgcgccgaaaaagtgctggaagcgtgttcaattgcctgtaacaaaaacacttgcccaggagatagatccgctcttcgacctagcgggttacgccttggcacgcccgccctgacgagccgagggctgttagagaaggattttcagaaagttgcccattttatccaccggggtatagagttgactcttcaaatccagtctgacacaggagttagggccaccctcaaagaatttaaggagaggctggccggagacaagtaccaagcagccgttcaggcacttagagaagaagtggagtcgttcgcttccctcttcccactccccggtctgcccgacttttag

SEQ ID NO: 204611 - DNA, 378 bp, Artificial Sequence
  Description of Artificial Sequence: Synthetic coding sequence
atgcggtacctgctgcaggtggcccagctggtgtggctgaccgtggatagccggggaattggagggaccctggatcacgctgggtttagtatctgtattttcaccgtgcctcctttgtccttcttcgggctgtgtgaagctcagacattcggactttccgggtccaaatctccagcccttcatcgctattatggaggcacagagttcattgacgagcttgagaccctgtgccaaaagcgtgccctgcaagcttacaaactggacccacagtgctggggagtcaatgtgccaacacaggtgttagtatcatctatatggcccggcgctgcgtcatcctgcgcatcacctagagctgatatgcatcaggaagagtcctag

SEQ ID NO: 204612 - DNA, 1212 bp, Artificial Sequence
  Description of Artificial Sequence: Synthetic coding sequence
atgaccatgcccgtgaacggcgcccacaaggacgccgacctgtggtcaagccacgataaaatgctggcacagccactgaaggacagtgatgtggaagtctacaacataatcaaaaaggaaagcaaccggcagcgagtggggttagagctaattgcaagtgagaatttcgccagcagggccgtgctggaagcattgggaagctgtttgaataataagtactctgagggctatcccgggcagcggtattacggaggaacagaattcatcgatgaactggaaaccttatgccagaagcgcgccctccaggcgtataagctggatccccagtgctggggcgtcaatgtgcaaccatattcaggtagtcccgccaatttcgcagtctatacggctctggtggagcctcatgggcgcatcatggggctcgacctgccggacggtggccatctgacacatgggtttatgaccgataagaagaagatctccgccacgagcatcttttttgaatccatgccgtataaagtgaatcctgacaccggttacatcaactacgaccagctagaggagaatgctaggctttttcatccaaagcttattattgcaggcacctcatgctactctcggaatcttgaatatgctcgactaagaaagatcgctgatgagaacggcgcctatctgatggcggatatggcccatatctccggtctggtggccgctggcgttgtcccaagcccctttgagcactgccacgtcgttacaaccacaacgcacaagacgttgagaggctgcagagctggcatgattttttatcgtaagggaggatcagataatcatctcattctggtggacctgagatctaagggaactgacggtgggcgtgccgaaaaagtcttagaagcatgcagtatcgcatgtaataagaatacgtgcccaggcgacagaagcgctttaagaccttccggacttaggctgggcacacctgctttaacttctagagggctgttggagaaagactttcaaaaagtggcccacttcatccaccgcggtatcgagttaactctgcagatccagtccgacactggggtacgggctactctcaaggagttcaaggaaaggctggccggggacaaataccaagctgccgtacaagctctacgcgaagaagtcgaaagtttcgcatcccttttcccgctcccgggcctgcccgatttttag

SEQ ID NO: 204613 - DNA, 1335 bp, Artificial Sequence
  Description of Artificial Sequence: Synthetic coding sequence
atgaccatgcccgtgaacggcgcccacaaggacgccgacctgtggtcctcacatgataaaatgctggcccaacccctcaaagactctgatgttgaggtgtataacatcatcaagaaggagtctaaccggcagcgagtgggtttggagctgatcgccagtgaaaacttcgcgtcccgcgctgtacttgaggcacttggttcatgcctcaacaacaaatacagcgagggctaccccgggcagcgctactatggcggtacagaattcattgacgagctggaaactctatgccaaaagcgagccctgcaggcctacaagctggacccacaatgttggggcgtcaacgtgcagccctactcaggtagtcccgctaattttgctgtgtatacagcactcgtggagccccatggaagaattatgggtctagacctgccggacggtgggcatttgactcacggcttcatgactgacaaaaagaagatctctgcaaccagcatttttttcgagtcaatgccttataaagtcaacccggacaccggctatatcaattatgatcagctcgaagaaaacgctagattattccatcccaaactgataatagcaggaacaagttgctacagcaggaacttagagtacgcaagactacggaaaattgccgatgagaatggagcttatctgatggctgacatggcccatatctccggtctcgtcgccgctggtgtggttccttcgccatttgagcactgccacgttgtgaccactaccacccataagacccttcgcgggtgccgggctgggatgatcttttaccgcaaaggagtggccgtcgcactaaagcaggctatgactcttgaatttaaggtataccagcatcaggtggtcgcaaactgtagggcattgagcgaggcacttactgaactagggtataagattgtaacagggggctccgacaatcaccttattcttgtagacttgagaagcaaaggaacagatggaggacgagcagagaaggtccttgaggcctgttcaatcgcatgtaacaaaaatacctgccccggagacaggtccgcactgcgcccttcaggcttgaggctaggcacccctgctctcacctcccgtggcctcttggaaaaggacttccagaaggttgcccactttattcaccgtggtattgagctcactctgcagatccaatccgacaccggcgtgcgggccactctcaaggagttcaaagaacgcctggctggcgataaatatcaagccgccgtgcaagctctgagagaggaagtggagagcttcgcgagcctcttccccttacccggcttgccagacttctag

SEQ ID NO: 204614 - DNA, 285 bp, Artificial Sequence
  Description of Artificial Sequence: Synthetic coding sequence
atgaccatgcccgtgaacggcgcccacaaggacgccgacctgtggtcatcccatgacaagatgttggcgcagcctctgaaggactcggatgtggaagtatacaatatcatcaagaaagaatctaaccggcagcgcgtcggactggaactcatcgccagcgaaaacttcgcgtcaagggctgtcctcgaagcgctcggctcttgcctgaacaataaatacagcgagggttacccggggcagagatatgtcaacatcttcaaaggtttagttctaacacagtcatag

SEQ ID NO: 204615 - DNA, 777 bp, Artificial Sequence
  Description of Artificial Sequence: Synthetic coding sequence
atggccgacatggcccacatcagcggcctggtggccgccggcgtggtacctagccctttcgaacactgtcacgttgtgacaaccacaacacataagactctccgggggtgccgggccggcatgattttctatcgaaaaggagtgaaatccgtagaccctaaaacaggaaaggaaattctttataatctcgagtcccttattaatagcgcagtgtttcccggtctgcaagggggtccgcacaatcatgcgatcgctggggttgccgttgctctgaaacaggccatgacactggagttcaaagtgtatcaacatcaggtggtcgccaactgccgggcacttagcgaggccctgaccgaattgggatataaaatagtgacaggtgggagcgacaaccacctcatcctggtggacctgaggtccaagggtacggatggtgggagggccgaaaaagtcctggaggcttgtagtattgcatgcaataagaatacctgccccggggaccgctctgccctgcggccaagcggcctgcggctgggaacccctgctttgacttccagggggctgcttgagaaggatttccaaaaagtggcccacttcatccaccgagggatcgaattgaccctacaaatccagagtgatactggggtgagagcaactcttaaggagtttaaggagcgattggcgggagataagtaccaggccgccgttcaagccctaagagaagaagtggaatcctttgcttcactgttccctttacctggcttgcccgatttctag

SEQ ID NO: 204616 - DNA, 1341 bp, Artificial Sequence
  Description of Artificial Sequence: Synthetic coding sequence
atgaccatgcccgtgaacggcgcccacaaggacgccgacctgtggtcatctcacgacaagatgctggcccagccactaaaggattcagacgtagaggtttataacatcatcaagaaggaaagcaataggcagagagtaggcttggaactgattgcctctgaaaatttcgcttctcgtgctgtgctggaagcgcttggatcatgtctgaataataagtattccgaagggtaccccggacagcgctactacgggggcactgagttcattgacgaactggagactctctgtcagaagagagcactccaggcatacaaactggaccctcaatgttggggcgtcaatgtgcaaccctattccggctcccctgcaaattttgccgtatataccgccctcgtggagcctcatgggcgcataatgggactggatctccctgacggcggccacctgactcacggatttatgacagataaaaaaaaaattagcgccactagtattttcttcgagtctatgccttacaaggttaacccagataccgggtacatcaattatgaccagttagaggaaaatgcccggctgtttcaccctaaactgattatcgcaggcaccagttgttattccagaaatctcgagtacgcccgtctgaggaaaattgctgacgagaacggggcttacctgatggccgatatggcccatatatccggtttggttgctgctggggttgttccatctccttttgagcattgtcatgtagtcaccacaactactcacaagacactgaggggatgccgtgcaggcatgattttctaccgaaagggcgtcaagagtgtggaccctaagaccggcaaggaaatcctctataacctggagagtcttattaacagcgctgtttttccgggtttgcagggaggtcctcacaaccatgccatcgccggggtagctgtggccctgaaacaggctatgaccctggaattcaaggtgtatcagcaccaagttgtagctaactgtcgggccttgagtgaggctcttacagaactgggatacaagattgtgaccggaggttccgataaccatctaattctcgtggatctccggagtaaaggcaccgacggtggacgggccgagaaggtactggaagcatgttccattgcctgcaacaagaacacttgtcctgggatagagctgacactccagattcagtccgacacaggtgtcagagcaactcttaaggaattcaaagaaagactggccggggataaatatcaggcagccgtgcaggcacttagagaagaagtcgagtctttcgctagcttgttcccgctgcctggactacctgatttctag

SEQ ID NO: 204617 - DNA, 1038 bp, Artificial Sequence
  Description of Artificial Sequence: Synthetic coding sequence
atgggcctggacctgcccgacggcggccacctgacccacggcttcatgaccgacaaaaaaaaaatctctgccaccagcatcttcttcgaaagcatgccttataaggttaatcccgatactgggtatatcaattacgaccagctggaggagaacgccagactgttccatcccaaactgatcattgctggtacaagttgttactcgagaaacttagaatacgcaaggctgcgaaagatagcggacgagaacggagcatatctgatggcagatatggctcacattagtgggctggttgccgccggagtagtcccatcacctttcgaacactgccacgtcgtgacaactactacccacaagactcttagaggctgccgcgccgggatgatcttctatcgcaagggagttaagtccgtggacccgaagaccggtaaggagattctctacaacctggaaagcctgattaactcagccgtatttcctggcctccaaggcggcccacacaatcacgctattgccggcgtcgccgttgctctgaaacaggctatgaccctggagtttaaggtgtatcaacaccaggtggtggcaaattgtagagcgttatccgaggcgttgacggagctgggctataagatcgtgacggggggaagcgacaaccaccttatcctggtggatctaaggtcaaaaggaacagatggggggagggccgagaaagttcttgaggcatgttctattgcgtgcaacaaaaatacctgtccaggggaccgatccgctctccgtccctctggcctgcgcctgggcactcctgccctgaccagcagaggattgcttgagaaggattttcagaaagtcgctcactttatccacagaggaattgagctcactctacaaatccaaagcgatactggcgtccgcgctacacttaaggagttcaaagagagactggctggcgataagtaccaagccgcagtccaggctctgagagaggaagttgaatcttttgctagcctgtttccactgccagggctgcccgacttctag

SEQ ID NO: 204618 - DNA, 1515 bp, Artificial Sequence
  Description of Artificial Sequence: Synthetic coding sequence
atgctgtacttcagcctgttctgggccgcccggcccctgcagcggtgcgggcaactggtcagaatggcaattagagcacaacactcgaacgcagcacagacccagaccggagaggcaaacaggggctggacaggccaggagtcactttcagatagtgatccagaaatgtgggagctgctgcagagggaaaaagatcggcaatgccggggactcgagctgatcgctagcgagaacttttgctcaagagccgcactagaggcgctgggctcatgtctgaataacaagtacagtgaaggctaccccggcaagagatattacggaggagccgaggtcgttgacgaaattgagctcctatgtcagagacgtgcgctggaggccttcgatctcgaccctgcccagtggggggttaacgtacaaccctattccggatccccagcaaatctcgctgtgtacaccgcgctgctgcagccgcacgaccggatcatgggactggatctgccagatgggggccacctgacccatgggtacatgtctgacgtgaaacgaatcagcgccaccagtattttcttcgagtccatgccttacaagttgaatccaaagactggactcatagattataaccagctggcgttaacagctcgcctcttcaggccacgccttatcatagcggggactagtgcgtacgccaggctcatcgactatgcacgcatgcgcgaggtgtgtgacgaagttaaagcacatctgctggcggacatggctcacataagcggtttggttgcagctaaggtcattcctagtcccttcaaacacgctgatatcgtgactacaaccactcacaaaaccttaaggggcgccagatcaggcctcattttctaccgcaagggagtgaaggccgtggatcctaagaccggcagggaaattccatacacattcgaggacagaatcaacttcgccgtttttccttccctgcagggtggaccccataaccacgcaatagccgcagtcgctgttgcattgaaacaggcttgcactcccatgttccgagaatattccctgcaagtgctgaaaaacgccagagccatggctgatgccctactggaacgaggttactctctggtcagtggaggtaccgataatcacctggtgctagtggatcttagaccaaaggggctggacggcgcccgtgcagaaagggtacttgaactggtatccatcaccgcaaataagaacacgtgcccaggcgacagaagcgccatcacacctggaggtttgaggctgggggccccagccctgacctcgcgtcagttcagagaggatgattttcgccgggtggtcgattttattgacgaaggtgtgaacatcgggctcgaggtgaagtccaagactgctaagctgcaggacttcaagagtttcttactgaaggatagcgagactagccaacgactcgccaatttacgacagcgggttgaacagttcgcacgtgctttcccgatgcccggctttgatgaacactag

SEQ ID NO: 204619 - DNA, 1227 bp, Artificial Sequence
  Description of Artificial Sequence: Synthetic coding sequence
atgggcgagcagcggtggtggatgaagctgagctgctgcgccagcgccggcccttggaaaccattgacatggattctccattctggtgaatctatgtcaagcccaactcctggaccccagccgacttggccatctacccagccattttgcaaccttaccaccggatcatgggggtggacatgccctatgggagccatctcaccaaccgctacctgcctgacttcaagcggctaccagccgcgcccctcttcatccagcctgtgcccaatatcttctacagcgctggctgtgtgtgtgtcagtgcagcctaaaacgggcttgattgactacaaccagctggcgctgacagccaggttatttcggcctagactgattatcgcagggacatctgcgtatgcccggctgattgactacgctagaatgagagaagtctgcgacgaggtcaaagcccacctgttggccgatatggcgcacatatccggtctggtcgctgcaaaagtcattcctagccccttcaagcatgcagacattgtgacaaccactacacataagaccctgcggggtgcccgatctggattgatcttctatcgaaaaggcgttaaagcggtcgaccctaaaaccggcagggagattccttatacatttgaggacaggatcaatttcgccgtattcccatccttacagggcggccctcacaaccacgccatcgccgcagttgcggtcgccctgaaacaggcttgcacacccatgtttcgtgaatattccctacaggtactgaaaaacgctcgagcaatggctgatgccctccttgagaggggatatagtctggtatcaggaggtactgataaccacctggtgctcgttgatctgagaccgaaaggcctggacggcgccagggcagagagagttctggagttggtgagcataacagctaataagaatacatgccctggggacaggtctgccatcacacctggtggcttaagacttggtgcaccggccctgacgagcagacagtttagggaggacgacttcaggcgagtggtggacttcatcgacgagggggtaaacatcggactggaggtgaaatctaaaaccgcaaaactgcaagacttcaagtcttttcttttaaaggattctgaaacatcccagcggctcgcaaatcttaggcagagagttgagcaattcgcacgcgcgtttccaatgcctggttttgacgagcactag

SEQ ID NO: 204620 - DNA, 1452 bp, Artificial Sequence
  Description of Artificial Sequence: Synthetic coding sequence
atggccatccgggcccagcacagcaacgccgcccagacccagaccggagaggccaatcgcggttggacgggacaagaatccctgtctgactccgatccagaaatgtgggaattacttcaaagggaaaaggaccggcagtgccggggattggagctcattgcatctgagaatttttgctcaagggctgctctagaggctttaggttcttgcttaaacaataaatattctgagggctatcccggtaagcgctattatggcggggcagaagtcgtcgacgagattgagctcctgtgtcaacgtagagccttagaggctttcgatctggacccagctcaatggggagtcaatgttcaaccctattctgggtcacccgccaatctggctgtgtacaccgccttgttacagccacatgatcggatcatgggactcgatctgccggatggcggacacctgacgcatggctatatgtccgatgtgaaacgcatatccgctacgagcattttttttgagagtatgccatacaagctcaatccaaagactgggctcatagactataatcagctggcgctgactgcacgactttttaggccccggctgattattgctgggacttccgcatacgcacggctgattgattacgcacgcatgcgcgaggtctgcgatgaggtcaaggcgcatctgcttgctgacatggctcacatctcgggcctggtggctgctaaagtgatcccctcccccttcaagcatgccgacatagtgaccacaaccactcataaaacgcttaggggggcacgtagcggactgatcttctatagaaagggcgtgaaagccgtggacccaaaaactggcagagagattccatacacattcgaggatagaataaactttgcggtgtttccttctcttcagggggggcctcataatcacgccatcgccgccgttgctgttgcgctcaaacaagcctgcacaccaatgtttagagagtactcactgcaggtactcaagaacgccagagccatggcagatgccctgttggaaaggggatactcactggtgagtggaggtacagacaatcacctggtgttggttgacctcaggcccaaaggactcgatggcgcgagggctgaacgagtactagaattggtctccatcaccgccaataagaatacttgccccggtgaccgctcagccattacgccaggcggtctccggctcggcgcgccagcactgaccagtcgtcagtttagggaggatgacttcaggcgcgtcgtcgatttcattgacgagggggtgaatatagggttagaggttaagagcaaaactgctaagcttcaggatttcaaaagtttcctgctcaaggatagcgagacgtcacagcgtctcgccaaccttcggcagagagtcgaacaattcgcgcgcgcgtttcccatgcctggtttcgacgaacattag

SEQ ID NO: 204621 - DNA, 1452 bp, Artificial Sequence
  Description of Artificial Sequence: Synthetic coding sequence
atggccatccgggcccagcacagcaacgccgcccagacccagaccggggaggccaatcgtgggtggaccggacaggagagcctcagcgattctgatcccgagatgtgggaactgttgcagagagaaaaggatcggcagtgtagagggttggagctgattgccagcgaaaacttttgttcgcgggccgccctggaagcgctgggatcatgtctcaacaataagtacagcgagggctacccaggcaaaagatattacggcggtgcggaggtagtggatgagatcgagctcctgtgtcaacgccgagctctcgaagcatttgatctggatccagcgcaatggggagtgaacgtgcaaccatacagtggatctccagctaatcttgcggtgtacacagctcttctccagccacatgatcgcataatggggcttgatctgcccgacgggggacacctgacacatgggtatatgagcgacgtaaagcgaatcagcgcgacaagcatctttttcgagtcaatgccatataagcttaaccccaaaacgggactgatcgactataatcagctggctctaacagcgaggctcttccgaccccgacttattatagcgggtacatcagcctacgcacgtctgatcgactacgcgcggatgagggaggtgtgcgacgaagtcaaggcgcacctgctggcagacatggcacatatatccgggctagtggctgctaaagtgatccccagtccctttaaacacgctgatatcgtgaccactacaacgcacaagaccctgcgcggagccagatcagggcttatattctacagaaagggggtgaaagcagttgatcctaaaaccggacgcgaaataccttatacattcgaggatagaatcaactttgctgtatttcccagtctgcaaggaggcccccataaccatgctattgccgcagtggcagttgctctcaagcaggcctgcactcctatgttcagagagtacagtttgcaggtcctgaagaacgcgagagctatggcggacgccctgctggagcgcggctacagcctggtttctgggggcacggacaatcatctcgtcctggtggacctgagaccgaagggcctggatggggcccgggcagaacgagtcctggaacttgtctccataacagccaacaaaaacacctgcccgggtgatagaagtgccattactcccggcggcctccgactgggtgcgcctgccctgactagcaggcagtttcgagaggatgattttagaagagtcgttgacttcattgatgagggtgtcaatatagggctggaggtcaaaagtaaaaccgctaaactccaggattttaaaagcttccttctgaaagactccgaaacgtcacaaagattagctaacctccgccagcgggtggaacagtttgcacgggctttcccgatgcctggctttgatgagcactag

SEQ ID NO: 204622 - DNA, 1452 bp, Artificial Sequence
  Description of Artificial Sequence: Synthetic coding sequence
atggccatccgggcccagcacagcaacgccgcccagacccagaccggcgaggccaatcggggatggactgggcaggagtctttaagcgatagcgatcccgagatgtgggaattactgcaaagagaaaaagatcgtcagtgccgcggccttgagctgatcgcctctgagaatttttgtagccgggccgctctggaggccctgggtagttgcctgaacaataaatatagcgaggggtaccccgggaaacggtactacggcggggcggaggtagtcgacgagatcgaactactgtgtcagcgccgcgccctggaagcttttgatttggatcccgctcaatggggcgtgaacgtgcagccttacagcgggtcccctgcaaacttggccgtctacacggctctgctccagcctcacgacagaatcatggggctcgatctcccagatgggggccacctcacacacggttatatgagcgatgtgaaaaggattagtgctacctccatcttcttcgagtcaatgccatacaaactcaacccaaagacaggacttattgattataaccagctggccctgaccgcacgcctatttagacctagactaattatagccggtacatctgcatacgccaggttgattgactatgccaggatgcgagaagtctgcgacgaagtaaaagcacacctgctcgctgacatggctcacatatctggtcttgtagcggcgaaggtgatcccaagccccttcaagcacgccgacatcgtgaccacgacaacccacaaaacgctgcggggcgcccgaagtggattgatattctaccggaagggcgttaaagcagttgatcccaagaccggtcgggagataccctacacttttgaagaccggattaatttcgccgtgttccccagcctgcaggggggaccccacaatcacgccattgctgcggtcgctgtagcgcttaagcaagcctgtactcctatgtttagagaatacagcttgcaggtcctgaagaacgcgagagccatggctgatgctttgctggaacgaggttacagcctcgtctcaggcggaactgataatcatctagtgttggttgatttgcgcccaaaaggcctggacggtgccagagccgaacgggtactcgaacttgtctctatcacggccaataaaaacacgtgtcctggcgaccgcagcgctattactccaggcggacttcgactgggcgctcccgcccttacgtctcgccagtttcgcgaagacgacttccgcagggtggtggatttcatagacgagggggtcaacattggcctcgaggtgaagtccaagactgcaaagcttcaggattttaaatccttcctcctcaaggacagtgaaacgagccagcggctggcaaacctgaggcagcgggtggagcagtttgcaagagcttttcccatgcccggctttgatgagcactag

SEQ ID NO: 204623 - DNA, 1485 bp, Artificial Sequence
  Description of Artificial Sequence: Synthetic coding sequence
atgctgtacttcagcctgttctgggccgcccggcccctgcagcggtgcggccagctcgtgcgcatggccatccgtgcccagcattctaacgccgcacagactcagaccggtgaggcaaaccgaggctggaccgggcaggagagcctgtccgattctgatccggaaatgtgggagcttcttcaaagggagaaagacagacagtgccgagggctggagctcattgcatcagagaacttctgctcgcgggcggccctggaagctctcggatcatgcttgaataacaagtactccgaggggtacccagggaaaagatactatggaggcgctgaggtggtcgacgagatcgagctcctgtgccagcggagagctctggaagcattcgatttagacccggcacagtggggcgttaacgtgcagccttactccggaagtcctgccaacctggccgtgtatacggccctgctgcagcctcacgacagaattatgggtctggatctccccgacggcggccatctgacacacggctatatgtctgatgtaaagcggatctctgcaaccagtatattttttgaatcaatgccctataagttgaaccttgcattgactgcccgcctgtttaggcctcggttgattattgccggaacctccgcctacgctagacttattgattatgcccgcatgcgagaggtgtgcgacgaggtaaaagcacatctgctggctgacatggcgcatattagtggcctggtggctgcaaaggtgattccgtcccctttcaagcatgcagacattgtgacgaccactacccacaaaacactgcgaggcgctcggtccggactgattttctatcgtaagggcgtcaaggccgtggaccccaagaccggacgcgagattccctatactttcgaggacaggatcaatttcgccgtgttcccctcgctgcaagggggaccccacaaccatgccattgccgcagtggccgtggctttgaaacaagcatgtaccccaatgttccgtgaatactccctgcaggtgcttaagaatgcgagagcaatggctgacgccctgctcgaacggggctattcactggtttcaggggggacagacaaccatttggttctagtggatctccggccaaaggggctggacggtgcccgtgccgagcgggttctcgaattagtgtctatcactgcgaataaaaatacttgtccaggggaccgctccgctatcacacctggcgggctcaggttaggagctcctgccctgacgtcaagacagttcagggaagatgacttccgcagggtggtggacttcatcgatgagggtgtcaatatcggactggaagtgaagtcaaagacagctaagttgcaggacttcaagtcttttcttctgaaagatagcgagacttcacagagattagctaatctcaggcagagagtggagcaatttgcaagagcattccctatgccagggtttgacgaacactag

SEQ ID NO: 204624 - DNA, 1422 bp, Artificial Sequence
  Description of Artificial Sequence: Synthetic coding sequence
atgggcgccgtgctgggcgtgttcagcctggccagctgggtgccctgcctgtgctcaggagcctcgtgtcttctctgctcttgttgtccaaactcaaaaaattccacagtcacaaggttgatttacgctttcatccttcttctgagtacagtggtgtcctacatcatgcaacggaaggagatggaaacataccttaagaagattcccggattctgtgagggcggatttaagatccatgaggccgatatcaacgccgacaaggattgtgacgtgctcgtcggctacaaagcggtctatagaatcagcttcgccatggccatttttttttttgtcttcagcctgctcatgttcaaagtcaaaacaagcaaggatctgcgcgccgccgtgcataatgggttctggtttttcaaaattgcagccctcatcggaatcatggtcggttccttttatatcccaggaggctattttagttctgtctggtttgtcgttggtatgatcggggcagctctgtttattctgatccagctagtgctgttagtggactttgctcatagctggaatgaatcatgggttaaccgtatggaagaaggaaacccccgcttatggtacgcagcactgctcagtttcacatctgccttctacattctgagtatcatttgtgtggggctactatacacctattacacaaagcctgacggttgtacggaaaataaattctttatttcaattaacctcatcttatgcgtggtcgcatctataattagtatccacccgaaaatccaggagcatcagccccgctccggcttattacagtcttctctaatcaccctgtacacaatgtatctaacatggtcggccatgagcaacgaacccgaccgcagttgcaatccaaatctaatgtcttttataacccgcataaccgccccaacccttgccccagggaatagcactgcagtagtgcctacccccacacccccctcaaaatctggctcactcctcgacagtgataattttatcggtctgttcgtgtttgtcttgtgcctgctgtacagttccattaggacctccacaaactctcaggtggacaagctcactctgagcggatccgattctgtgatattgggtgacaccaccacctcgggcgcatccgatgaagaagatggacaaccaaggagggcagtggataatgagaaggagggggttcagtactcctacagcctctttcatcttatgctctgcctagcctcactctacatcatgatgacgttgacctcctggtacagtcccgacgccaaattccagtcaatgacctctaaatggccagctgtctgggtgaagatatccagctcctgggtgtgccttcttctgtacgtatggaccttggtggcgcctttggtgctgacctctcgagacttttcatag

SEQ ID NO: 204625 - DNA, 1422 bp, Artificial Sequence
  Description of Artificial Sequence: Synthetic coding sequence
atgggcgccgtgctgggcgtgttcagcctggccagctgggtgccctgcctctgctccggagcatcctgtctcctctgttcctgttgcccgaacagtaaaaatagcacagtgacgcgactcatctatgcgttcattttgctcttgagtacagtggtgagctatattatgcagcggaaggaaatggaaacctacctgaagaaaatcccagggttttgtgagggcgggttcaaaatccacgaagcagatatcaatgccgataaggactgtgacgtcctcgtaggttacaaagcagtgtaccgaatatctttcgctatggccatttttttttttgtgtttagcttgctcatgtttaaggtgaaaacatccaaggacctccgcgctgctgtgcacaacggtttttggtttttcaagatcgctgctcttatcggaatcatggttggatcattctacatccccggtggatattttagttctgtttggtttgtcgttgggatgataggggcagctctgttcatcctcattcagcttgtgcttctcgtcgattttgcacatagctggaacgaaagctgggtgaatcgcatggaagagggcaacccccggctatggtacgccgcactgctgtcattcactagcgccttttatattctgtccataatatgcgtggggctgctttatacatactataccaagcctgatggctgcactgagaacaagttcttcatttcaatcaacctcatcctgtgtgtggtcgcttccataatctccatccaccccaaaatccaggaacatcaaccgagatccgggttgctgcagtcaagtctgatcactctctacacaatgtatctgacatggagcgccatgtcgaacgaacccgaccgctcttgcaaccccaacttaatgtcatttatcacccgcatcacagctcctaccctagcgcccggcaattcaactgccgttgttcccactcccacacccccaagcaaatccggatcgctgctggatagcgataatttcattgggctttttgtgttcgtcctctgtctgctgtattcctctattcgaacctcaacaaatagccaggtagataagctcacgctgtcggggagcgactccgtaatactgggggacacaactacatccggcgctagcgacgaggaggatggacagccacgccgagccgtcgacaacgagaaggaaggggtccagtattcatactcattatttcacctgatgttgtgtttggcctccctatatataatgatgacattgacaagctggtacagccccgatgctaagttccagagcatgactagcaagtggccagccgtgtgggtcaagatttcttcctcatgggtatgcctgctcctgtatgtgtggaccctcgtggcgcccttggtgttgaccagcagagacttttcttag

SEQ ID NO: 204626 - DNA, 639 bp, Artificial Sequence
  Description of Artificial Sequence: Synthetic coding sequence
gagcaccagccccggagcggcctgctgcagagcagcctgatcaccctctataccatgtatcttacatggagtgctatgtcgaacgaacctgaccggtcttgtaacccgaacctgatgagctttataacacggatcaccgctcctactttagcaccaggcaacagtactgcagtagtgcctacccctacccccccaagtaaatcaggcagcctcctggatagtgataatttcatcgggctgtttgtatttgtcctatgtctgttgtatagtagcatccggacctccaccaattcccaggtagacaagctcacccttagcggatccgactccgtgatcctgggtgatacgacgacctccggagccagcgacgaggaggatggccagccacggcgtgcagtggataacgaaaaggaaggggtccaatatagctattccctcttccacctgatgttgtgtctggcttccctttacataatgatgaccctgacctcatggtattcacccgacgcaaagttccagtctatgacctccaaatggcccgcagtatgggtgaagatcagctcttcttgggtctgcctgctgctgtatgtgtggacactagtcgctcctctggtattgacttcgcgtgactttagctag

SEQ ID NO: 204627 - DNA, 1323 bp, Artificial Sequence
  Description of Artificial Sequence: Synthetic coding sequence
atgcccctgcagcggtgcctgatctacgccttcatcctgctgctgtctaccgtcgtgtcctatataatgcagcgaaaggaaatggagacataccttaagaaaatacctggtttctgtgagggcggatttaaaattcacgaagctgacatcaacgcagacaaggactgcgatgtgctggttggttacaaagccgtgtaccgtatctctttcgcaatggccatcttcttttttgtctttagcctgcttatgtttaaagtgaagacttccaaagacctccgggctgcggtccataacggtttttggttttttaagatagccgcactgattggaataatggtgggctccttctatatccccggcgggtatttcagtagtgtgtggtttgtcgtgggtatgattggcgccgcattattcattttaattcagctggttctgcttgtggattttgcccatagctggaatgagtcatgggtgaatcggatggaagagggaaaccctcgcctctggtacgcggcgcttttatcatttacttccgccttctacatcctgtctataatctgcgtgggcttgctatacacctactataccaaacccgacggatgtactgagaataagtttttcatcagcatcaaccttattctgtgtgtcgttgcttccataatctccattcaccctaagatccaggagcaccagcctcggagcgggctcctgcagagtagcctcattaccctctataccatgtatttgacttggtccgctatgtctaacgaaccagatcgaagttgcaacccaaatctcatgagtttcataactcgcatcactgctcccactctcgcccccggcaactcaaccgctgtagtcccaactccaacccctccatcaaagtcagggagtttgcttgactccgacaatttcatcggcctgtttgtgttcgtgctctgtctgttgtactcctccatcaggacgtccaccaactcccaagtggataaactaactttatcgggtagcgactcagtaattttgggagacactactacatccggcgcgtcagacgaggaagacgggcagccacgcagagctgtcgacaacgagaaggagggagtgcagtattcttacagcttgttccacctaatgctatgtctggcttcactgtacattatgatgactctgacctcgtggtacagccccgatgccaagttccagagtatgacctcaaagtggccagcggtgtgggtcaagatttcatcctcctgggtctgtctgttattgtacgtttggaccctggtggcccctctggtgctcaccagccgcgacttctcctag

SEQ ID NO: 204628 - DNA, 1257 bp, Artificial Sequence
  Description of Artificial Sequence: Synthetic coding sequence
atgcagcggaaggagatggagacctacctgaagaagatccccggcttctgtgagggcggctttaaaatccacgaagcagatatcaacgccgacaaggactgcgacgtcctggttgggtacaaagccgtctacagaatatccttcgcaatggctatattctttttcgtgttctcattgctcatgttcaaggtgaagacctcaaaggatcttagagccgcggtgcataacggattctggttctttaaaatcgctgcccttattggcatcatggtgggtagcttttacataccgggcggatattttagcagcgtgtggttcgtcgttggaatgattggcgctgctttatttattctcattcagctggtgttactggtcgacttcgcccactcatggaacgagagttgggttaaccgtatggaggagggtaatcccaggctgtggtacgccgccctcctgtcatttacttcggcattttatatcctatcaataatttgtgtgggcctgctctatacttattatactaaacccgatggctgtaccgaaaacaagttttttatctcgataaatctcatcctgtgtgtcgtggccagcattatatcaattcatcccaaaatacaggagcatcagccccggtctgggctgctccagtcatcactaatcacactgtatacaatgtacctgacgtggtccgccatgtccaacgagccggatcgatcatgcaatcccaacttaatgtcattcattactcgtatcacagcaccaacactggctccgggcaattctactgccgtagttcccaccccaacccctccctctaagagtggttccctcctggactccgataacttcattggactgttcgtgttcgtactctgtcttctgtactcttcaattcggacgtctacaaattcccaggttgacaaactgacactgtcagggtccgattcagtgattctgggtgacactacaaccagcggagcaagcgacgaagaggatgggcagcctcggcgagccgtggataatgaaaaagaaggagttcaatatagttactctttatttcacctgatgctgtgcctcgccagcctgtatattatgatgacattaaccagctggtattccccagatgcgaaattccagtccatgactagtaagtggcccgcggtttgggtgaagattagtagttcctgggtgtgcctactgctctatgtctggaccctggtcgcaccactggtcctgacaagtcgagacttctcatag

SEQ ID NO: 204629 - DNA, 1422 bp, Artificial Sequence
  Description of Artificial Sequence: Synthetic coding sequence
atggccaccgccaccgagcagtgggtgctggtggagatggtgcaggcactgtacgaggcccctgcataccacctgattctggaaggaattctcattttgtggattatccggctcctttttagtaagacctacaaactgcaggaaaggtctgacctgaccgtcaaggaaaaagaggagctgatcgaggagtggcagcccgagcctctggtaccccctgtgcccaaagatcacccggcacttaattacaatattgtctctggccctccctcgcataaaaccgtggttaacgggaaggagtgcattaacttcgcatccttcaactttctaggccttctggataatcccagagtgaaagcagcggctctcgcgtccctcaaaaagtacggcgtgggaacctgcggccctagaggattttatgggacatttgatgttcacctggatctggaagaccggctggccaagtttatgaaaacggaagaggccattatctattcctacggattcgccaccatcgccagcgctatcccagcctattcaaagaggggagacattgtgttcgtggaccgggcagcatgcttcgcaattcagaagggactccaagccagcagatccgacatcaagctgtttaagcataacgatatggccgacctggaaagactcctaaaagaacaggaaatagaggaccagaagaatccgcgtaaggcgcgggtcactcgtcggttcattgtcgtggaaggattgtacatgaatactgggacgatctgtccgctcccagagctagtgaagctcaagtataagtacaaggcccggatcttcctggaggagtccctttcgtttggcgttcttggcgaacacggtagaggggtgacagaacattacggcataaatatcgacgatattgatctcatcagcgctaatatggagaacgctttggcttccatcggagggttctgttgtgggcgaagttttgtcatcgaccatcagagactgtctggccagggttactgcttctctgcaagtctgcctcctctacttgcagctgcagctatagaggccctgaatattatggaagaaaatcccgggattttcgcagtgcttaaagagaagtgtgggcagatccataaggcacttcagggcattagtggacttaaggtggtgggggagagcctgagcccagcctttcaccttcagctggaggagtctaccggcagtcgggagcaagatgttagacttttgcaagagatagttgaccagtgcatgaatcgttctattgctcttacccaggccaggtacttagagaaggaagaaaaatgcctgccgcccccatcaataagagtggtggtgacggtcgagcaaactgaggaagaactcgaaagggcggccagcacaatcaaagaggtggcccaggcagtgctcttgtag

SEQ ID NO: 204630 - DNA, 432 bp, Artificial Sequence
  Description of Artificial Sequence: Synthetic coding sequence
atggccaccgccaccgagcagtgggtgctggtggagatggtgcaggcgctgtatgaggcaccggcctaccatcttatcttagaagggattctgatcctctggattatccggctgctcttcagtaaaacgtacaagctgcaagaacgatcagaccttactgtcaaggagaaagaggaacttatagaggagtggcagccagagcctttagtccctccagtccctaaggaccaccccgcacttaattataatatcgtgagtggccctccatcccataaaaccgtagtcaatggaaaggagtgcatcaatttcgcctcattcaacttcctgggattgctggataatcctcgggtcaaagcagccgctctggcgagtttgaaaaaatacggagtggggacatgcggacctcggggcttttacggaacctttgagtag

SEQ ID NO: 204631 - DNA, 1017 bp, Artificial Sequence
  Description of Artificial Sequence: Synthetic coding sequence
atggccaagtggggcgagggcgacccccggtggatcgtggaggagagagctgatgcaactaacgtgaacaactggcactggacagaacgcgacgcatcaaattggtctaccgacaaactgaaaacactcttcctggccgtgcaggtgcagaacgaggagggaaagtgtgaggtgacagaagtctccaagctagacggcgaggcttctattaacaatcggaaagggaagctgatttttttctatgagtggtccgtgaagcttaactggaccgggacatcaaagtccggcgtacaatacaagggccatgtggagatacctaacctgagtgacgaaaattcagtcgacgaggtggagatctcagtcagtcttgcaaaggacgagcccgatacgaatctcgttgctcttatgaaagaagagggtgttaaattactccgggaggcaatgggcatttacatctccaccctcaagacagagtttactcagggcatgattttaccaacgatgaatggagagagtgtcgacccagttgggcagccagcactgaagactgaagaaagaaaggctaagccagccccgtcaaagacacaagccaggcccgttggcgtaaaaatacctacatgcaaaataactctgaaagagacgttcctgacctcaccagaggagctgtacagggtgttcacaacgcaggagcttgtgcaagcgtttacgcatgctccagcaacactggaggccgaccggggaggtaagttccacatggtcgacggtaatgtgtccggagagttcacagaccttgtgcctgagaagcatatcgtgatgaaatggcggtttaagtcatggccagaagggcacttcgccacgattacattgactttcatcgataagaacggggaaaccgagctatgcatggagggtcgcgggattccagccccagaagaggagcgaaccagacagggatggcagcggtactatttcgagggaatcaagcagacctttgggtacggagcaagactcttttag

SEQ ID NO: 204632 - DNA, 990 bp, Artificial Sequence
  Description of Artificial Sequence: Synthetic coding sequence
atggccaaccccggcggcggcgccgtgtgcaacggcaagctgcacaaccacaagaaacagagtaacgggtcccagtcacgaaactgcactaagaatggcatcgtgaaggaggcacagcagaacggtaagccccatttttatgacaaacttatcgtagagagtttcgaagaagcacctctgcatgttatggtgttcacgtatatggggtacggaattgggacgttgtttgggtaccttcgcgattttctgcggaattggggcattgagaaatgtaatgctgctgtggaaaggaaggaacagaaggacttcgtgcccctttatcaggacttcgaaaacttctacacgaggaatttatacatgaggatccgagacaattggaacaggccgatttgttccgccccggggcccctgtttgacctgatggagcgggtctccgatgattacaattggacatttagattcactgggagggttataaaggatgtaattaatatggggtcgtacaactttttgggactggctgccaaatacgacgagagcatgagaactattaaagatgtgttagaggtctacggaacaggggtggccagcactaggcacgagatgggtacactggacaagcacaaagagctggaggatttagtggctaagttccttaacgttgaagccgctatggtcttcggtatgggatttgcgacaaactcaatgaacatcccagcgctggttggcaagggatgtctcattttatccgatgagctgaatcacacctccctcgtgctgggcgccagactgagcggggccaccatacggatattcaaacacaataacacccagtccctcgagaagctccttcgggacgctgtcatctacgggcagccgcgcacacgtcgcgcttggaagaaaatcctgatcctggtggagggcgtgtaccgaacctcttggataatttatggcttcacacgcatcgtgctctttatgcttcacccctag

SEQ ID NO: 204633 - DNA, 1659 bp, Artificial Sequence
  Description of Artificial Sequence: Synthetic coding sequence
atggccaaccccggcggcggcgccgtgtgcaacggcaagctgcacaatcataaaaagcagtctaatggcagccagagccgcaattgcaccaagaacggtattgtcaaagaggcccagcagaatgggaaaccccacttctatgacaagctgatagtggagagcttcgaagaagcccccttgcatgtgatggtgttcacctacatgggttatggcataggtacactgtttggttatctgagagactttttaagaaattggggtattgagaagtgcaatgccgcggtggaacgcaaggagcaaaaagacttcgttcccctgtaccaggattttgagaatttctacacaaggaacctctatatgcggatccgcgacaactggaatagaccgatatgtagcgccccagggccactctttgatttgatggagagagtgagtgacgattataattggacttttcgcttcaccgggagagttataaaggatgtgatcaacatgggatcctacaattttttgggtctggcagcaaagtatgacgaatctatgcgaacgatcaaagacgttcttgaagtgtatggaacaggggtggcctctacccgccacgagatgggcaccctggataagcacaaagagttggaggacctagttgctaagtttctcaacgtagaagctgccatggtattcggaatgggctttgccaccaattccatgaatatcccagcccttgtgggtaagggatgcttaatactgtcagacgagctaaaccatacatccctggtgctaggcgccaggttatccggggcgacgatccgcatttttaagcacaataacacccagagtctagagaagctgctccgtgacgccgttatctatggccagcctaggacccgcagggcttggaagaagatcctcatactggtggaaggggtttacagtatggagggttccattgtgcaccttccgcagatcattgcattgaaaaaaaaatacaaagcatacctgtatatcgacgaagcgcacagtattggcgctgtgggtcccaccggcaggggagtaactgagtttttcggactcgatccacacgaagtggacgttcttatgggcactttcaccaagagtttcggagcttctggtgggtacatagccggtcgaaaagacttagtggattacctccgggtccattcacactcagccgtgtatgcctcctctatgagccctcctatcgcagagcaaatcattcgctccctcaaattgattatgggcctcgacggcactactcagggcttgcagcgggtccagcagctcgcaaagaatactagatattttcgacagagactgcaggagatgggattcataatctacggtaatgagaatgcatcagtcgtgccactcctgttgtacatgccaggcaaggtagcagcgttcgcccggcacatgctggaaaagaaaatcggggtcgtggtggtgggctttcccgccactcctctggccgaagcacgcgcccgcttctgcgtgtcggcagcccacactcgtgagatgctggacaccgttctggaagcactggacgagatgggtgacctgctgcagttaaaatacagtcggcacaagaaaagcgcacgcccggagttatacgacgagacctccttcgaacttgaagattag

SEQ ID NO: 204634 - DNA, 366 bp, Artificial Sequence
  Description of Artificial Sequence: Synthetic coding sequence
tgaagcccccccatcgccgagcagatcatccggagcctgaagctgatcatgggactggatggaactacccagggtttgcagcgggtgcagcagttggcaaaaaatacgcggtatttccgccagcggctgcaagaaatgggattcatcatctatggaaatgaaaacgcatccgttgtgccattgctgctctatatgcctgggaaagtcgctgcctttgcccgccacatgctggagaaaaaaattggggtcgtagtggtgggttttcctgccacccctctggctgaagccagggctcggttttgtgtgtccgccgcccatacacgtgagatgttggatacagttatatgctgtgtcatgaagatctag

SEQ ID NO: 204635 - DNA, 420 bp, Artificial Sequence
  Description of Artificial Sequence: Synthetic coding sequence
atggccaaccccggcggcggcgccgtgtgcaacggcaagctgcacaaccataagaaacagtcaaatggctcgcagtctaggaactgcaccaagaacggaatcgtcaaagaggcccagcaaaacggtaagccgcacttttacgataaactgatcgtggaaagctttgaagaggcacccctgcatgttatggtgtttacgtacatgggctacgggatagggacgctgtttggatacctgagagactttctgcgtaactggggtatcgagaagtgtaatgccgctgtagaacggaaagagcagaaagatttcgtgccactttaccaggattttgaaaacttctacaccaggaacctatacatgcggatacgcgacaactggaaccgtcccatctgttccgcccctggacccttgttcgattag

SEQ ID NO: 204636 - DNA, 648 bp, Artificial Sequence
  Description of Artificial Sequence: Synthetic coding sequence
aactgcaccaagaacggcatcgtgaaggaggcccagcagaacggcaaacctcatttttacgataaattaatagtagaatccttcgaagaagctccacttcacgtaatggtgttcacatacatgggatacggaattgggaccctgttcggatacctgagggattttctgaggaactggggaatagaaaaatgtaacgccgcggtggaaaggaaagagcagaaagatttcgtgccgttgtatcaggatttcgagaacttttacacccgtaatttgtacatgagaatccgggacaattggaatcgacccatctgctcagcccccggccccctttttgatctgatggagagagtttccgatgactataattggacttttagatttacaggaagagtcatcaaagacgtgattaatatgggatcctacaacttcctgggactagccgccaagtacgatgaatcaatgagaaccataaaagatgtgctcgaggtctatggcacaggtgttgcgtcaacacggcatgagatgggggagttcaccagttcgtggcagaacgcactgtgtgttggaggcgtattgcaagctgactctgtcccccaggggcctccctggtcctggaagatgggccgtcatagttcactcctggagtag

SEQ ID NO: 204637 - DNA, 360 bp, Artificial Sequence
  Description of Artificial Sequence: Synthetic coding sequence
atggccctgagcgtgctgcggctggccctgctgctgctggccgtgaccttcgccggatccgcccggagcggtccaggggaacggggaccacctgagaaatcaggcttcggcagccaaactggtggggggccctgcccggccccaggcggcttgggtgacgccagcttaattccccagttcggcctgttttccaaatacaggactcctaattgcagccagtatcgattgcctggctgtccaaggcacttcaacccggtatgcgggtctgacatgagtacgtacgcaaatgaatgtacactctgcatgaagatccgggagggcggccacaatataaaaattatccgcaatggtccgtgctag

SEQ ID NO: 204638 - DNA, 405 bp, Artificial Sequence
  Description of Artificial Sequence: Synthetic coding sequence
atggccctgagcgtgctgcggctggccctgctgctgctggccgtgacttttgctggctcggcacgctctggccctggtgagcgcgggcccccagagaaatccggttttggcagtcagacgggcggtgggccctgccctgcgcctggaggcctgggagacggaacacgagctcctgtgacaggagggagccccgaagatttgccagcttcactgatcccccagtttggtctgttctccaaatacagaacacccaattgttcacaataccgcctgcccgggtgcccaagacatttcaatccagtgtgtggttctgacatgagcacctacgccaatgagtgcaccttatgcatgaaaattagagagggaggtcataacatcaagatcattagaaatggtccctgttag

SEQ ID NO: 204639 - DNA, 240 bp, Artificial Sequence
  Description of Artificial Sequence: Synthetic coding sequence
atgaaggtgaccggcatcttcctgctgagcgccctggccctgctgtctctcagtggtaataccggggctgattctctgggcagagaggccaaatgttacaacgagctcaacgggtgcacgaaaatctatgatcccgtttgcgggaccgatgggaatacttaccctaacgagtgcgtgttatgtttcgagaaccgaaagcggcaaacaagtattctgatccaaaaatccggcccgtgttag

SEQ ID NO: 204640 - DNA, 255 bp, Artificial Sequence
  Description of Artificial Sequence: Synthetic coding sequence
atggccctgagcgtgctgcggctggccctgctgctgctggccgtgacttttgctgcgagtctgatcccacagttcggtctattctcaaagtacaggacacctaattgcagtcagtataggctgcccgggtgcccccgtcactttaatcctgtctgtgggtccgatatgagcacatatgccaacgaatgcaccctgtgcatgaaaatccgagaagggggtcacaacattaaaattatcaggaacgggccatgctag

SEQ ID NO: 204641 - DNA, 261 bp, Artificial Sequence
  Description of Artificial Sequence: Synthetic coding sequence
atggccgtgcggcagtgggtgatcgccctggccctggccgccctgcttgtcgttgatcgggaggtgcctgtcgcagccggtaaactaccctttagtaggatgccgatctgtgagcacatggttgagagcccaacctgctcccagatgtcgaacctggtatgtggcacagatggcctgacctacaccaatgagtgccagctctgcctggctcggattaaaaccaaacaagacatccagatcatgaaggacggcaagtgctag

SEQ ID NO: 204642 - DNA, 330 bp, Artificial Sequence
  Description of Artificial Sequence: Synthetic coding sequence
atgatcctgggcatcggcagcagcccccacctgctgtggaccctggagggcacccatatttggagtctgctgggcgatgcatctcacaccgacaggctacctgaggcgggcgctggaaaattactgagcgaggtgcctgtcgctgccggcaagttgcctttctctcggatgcctatctgcgagcacatggtcgaaagccccacctgcagccagatgagtaatctggtgtgcggtaccgatggtctgacctacaccaacgagtgccagctgtgtctagccagaataaaaaccaagcaagatattcagattatgaaggatggcaagtgttag

SEQ ID NO: 204643 - DNA, 330 bp, Artificial Sequence
  Description of Artificial Sequence: Synthetic coding sequence
atgatcctgggcatcggcagcagcccccacctgctgtggaccctggaagggacccacatctggagccttcttggtgacgcctctcacactgacagattaccagaagctggtgctggcaaactcctgtccgaggtcccagtggctgccggcaagttgccattttcaagaatgcctatttgtgagcacatggttgagtctcctacatgttcacagatgtcaaacttggtgtgcggtaccgacggcctgacctataccaatgaatgtcagctatgcctagcccgcatcaagaccaagcaggacatccagatcatgaaggatgggaagtgttag

SEQ ID NO: 204644 - DNA, 3195 bp, Artificial Sequence
  Description of Artificial Sequence: Synthetic coding sequence
atgaagatcgccaccgtgagcgtgctgctgcccctggccctgtgccttatacaagacgccgcctctaagaatgaagatcaggagatgtgtcatgaattccaggccttcatgaaaaacggaaagctgttctgcccccaagacaagaaatttttccaatcactggatggcattatgttcattaataagtgtgccacctgcaagatgatcctcgagaaggaagctaaaagtcaaaaacgtgcccggcaccttgcacgcgcaccaaaggcaaccgctcctacagagctgaattgtgacgatttcaaaaagggcgagagagatggggactttatctgtccagactattatgaggcagtctgtggtactgatggaaagacttacgacaatcgttgcgctctatgcgccgaaaacgctaagacaggaagtcagattggcgtgaaatcagagggggagtgtaaatcgtccaacccagagcaagatgtgtgtagcgccttccgccctttcgtccgcgacgggagattgggttgcaccagggagaacgacccggttctcggacccgatggtaagacacatggcaataagtgcgccatgtgtgccgaactatttcttaaggaagccgaaaatgctaagcgagagggggaaactcggattaggcgcaatgctgaaaaggatttttgtaaggagtacgagaagcaggtgcgaaacggcaggttattttgcacgagagagtcagacccagtcaggggtcctgatgggagaatgcacgggaacaaatgcgccctttgcgccgaaatttttaagcagcggttttcagaagagaactctaaaacggaccagaatttggggaaagctgaagagaaaaccaaagtgaaaagagagattgtgaaattgtgttctcagtaccagaaccaggccaagaacggcatcctgttctgcactcgggagaacgaccccatcagaggccccgacgggaagatgcatggaaatctctgcagtatgtgccaggcttacttccaggcggaaaatgaagagaaaaagaaggccgaagccagagctagaaataagcgggaaagcggaaaagccacgtcttatgccgagctttgtagtgagtatcggaagttggtgcggaacggcaaattggcctgcactagggaaaacgatccaatccagggtccggatggaaaggtccacggtaacacctgcagcatgtgcgaagtcttctttcaggcagaagaagaagagaagaagaagaaggagggcaagagcagaaataagcgccaaagcaaaagcaccgcctcttttgaggaactttgttcagagtataggaagtctcgcaaaaacggccgtctgttctgtaccagggagaatgaccctattcagggccctgatggcaaaatgcatggaaacacctgctctatgtgcgaagctttctttcagcaggaagagcgggccagggcaaaagcaaaaagggaagccgcaaaggagatctgcagtgaatttagagatcaagttcggaacggaaccttgatttgcacccgggagcacaatcccgtgaggggaccagatggcaaaatgcacgggaataagtgtgcaatgtgcgccagtgtgtttaaactagaggaagaggagaagaagaacgataaagaggagaagggaaaggtggaggctgagaaggttaagcgggaagcagtgcaggagctgtgctccgaataccggcactacgtccgaaatggtcgcttaccatgtacccgggagaacgaccccatcgagggtctggacgggaagatccatggaaacacttgttccatgtgtgaggcctttttccaacaggaggcaaaggaaaaagagagagccgaaccaagagccaaagtaaagcgggaagccgagaaggaaacatgtgatgagtttaggaggcttcttcagaacggcaagctcttttgcacccgggaaaatgatcctgtgcgaggccccgacggcaagacccatggcaacaagtgcgctatgtgcaaagccgtttttcaaaaggaaaacgaagaaagaaaacggaaggaggaggaagaccaaagaaatgccgcgggacacgggtcatctggtgggggtggaggtaatacccaggacgagtgcgccgagtaccgggagcagatgaaaaatgggaggttgtcctgcacaagggaatccgacccggtacgagacgcagacggaaagagctacaacaaccagtgtactatgtgtaaagcaaaactggagcgcgaggcagagcgcaagaatgagtattccagaagcaggtccaatggcacaggctccgaaagtggcaaagatacatgcgacgagtttcggtctcaaatgaagaacggcaagctgatatgtacacgggagtccgaccccgtccgagggccagacggcaagacacatggaaacaagtgtacgatgtgcaaagaaaaactcgaaagggaggcggctgagaaaaagaagaaagaagacgaggatagaagcaacacaggggagcggtccaacaccggggaacggtccaacgataaggaagacctctgtagggagtttaggagcatgcaaagaaatggcaagttgatctgtactcgggagaataatccagtaagagggccatacgggaagatgcatattaataagtgtgcaatgtgtcagtctatcttcgaccgtgaggcaaatgaacggaaaaaaaaagacgaggaaaagtcgtcctccaaacccagtaacaatgctaaagacgagtgttctgagtttcgcaattatattcgtaataacgaactcatctgcccgagggagaacgacccggtgcacggagccgacggcaagttttacactaataaatgttatatgtgcagagccgttttcctgactgaggcacttgagcgggctaagttacaggagaaaccgagtcacgtccgagcctcacaggaggaggattcgcctgactctttcagttccctggacagtgagatgtgcaaagattatcgcgtgcttccaagaattgggtacctctgccctaaagacctaaagccggtgtgtggggatgacggccagacctacaataacccatgtatgttgtgccatgagaatttgattaggcaaaccaacacccacatcaggagcactggcaagtgcgaagagtcttccacaccaggtacaacagccgcttccatgccaccttcggacgaatag

SEQ ID NO: 204645 - DNA, 3285 bp, Artificial Sequence
  Description of Artificial Sequence: Synthetic coding sequence
atgaagatcgccaccgtgagcgtgctgctgcccctggccctgtgcctaattcaggacgccgcttcaaagaacgaagaccaggaaatgtgtcacgagtttcaagcattcatgaaaaatggaaagctgttctgtccccaggacaaaaaattctttcaatccctggacgggattatgttcatcaacaagtgtgcaacatgcaaaatgatactggagaaagaagctaagtcgcaaaagcgagccagacacttagcacgagccccgaaagcaacagcaccaacggaactgaattgtgatgatttcaaaaagggggagcgcgatggggatttcatttgtcctgactactatgaggcagtgtgcggaaccgacggcaagacttacgataatagatgcgcgctctgcgccgagaacgcaaagactgggagccagattggcgtaaagtcagaaggggagtgcaaaagttccaatccagaacaagacgtttgcagtgccttccgaccattcgtgcgcgatggtcgactgggttgcaccagggagaatgacccagtcctgggcccggacgggaaaacgcatgggaataagtgtgccatgtgtgccgagttgttcctgaaggaagcggagaatgccaagcgcgagggtgaaacacgtatccggcgcaatgccgaaaaggatttttgcaaagaatacgagaaacaggtccgtaatggccgactgttttgtacaagagagtctgatcccgttagggggcctgacggccgcatgcacgggaacaagtgcgcactgtgcgctgaaatctttaaacaaagattttcagaggagaattcgaagacagatcagaacctgggtaaagctgaggaaaagacgaaggtgaagcgcgaaatcgtcaaactttgtagccaataccagaaccaggccaagaatgggatcttattttgtacgagagaaaacgacccaataaggggccccgatggtaagatgcacgggaatctctgctccatgtgtcaggcttatttccaggcggaaaatgaggaaaaaaagaaggcagaggcccgcgcacgtaacaagcgcgaatcagggaaagccacgagttatgccgagctgtgctcagagtatcggaaactggtgagaaacggcaagttggcctgcacaagggagaacgaccccatccagggacctgatggcaaggtccatggaaatacatgtagtatgtgcgaggtgttcttccaggccgaagaggaagagaagaaaaagaaagaaggaaagagcaggaataaaagacaaagtaagagtacagctagcttcgaggaactttgctctgaatatcgtaaatcacgcaagaacggacgactgttttgcacccgggagaatgaccccattcagggccccgacgggaaaatgcatggcaacacctgttctatgtgcgaggcctttttccagcaagaggaacgggcccgcgctaaggcaaaacgggaagccgcaaaagaaatatgtagcgaattccgggaccaggttcggaacggtaccctgatctgcactagagagcataatcctgtcagggggcccgatggcaagatgcatggaaataaatgcgccatgtgcgcctctgtgtttaaactggaggaggaggagaaaaaaaatgacaaagaagaaaaggggaaggttgaagccgaaaaggttaaaagagaggccgtccaggagctgtgcagcgagtacagacattatgtgagaaacgggcggctcccttgcacgcgagagaacgatccaatcgaaggcctcgatggaaagatccatggcaatacctgttcgatgtgcgaggccttcttccaacaggaggccaaggagaaggaaagagccgagccgagagctaaggttaaaagggaggcagaaaaagagacttgcgacgaattcagacgccttctacagaacggtaagctgttttgcacacgagagaacgacccagtgcgaggaccagatggtaagacccacggaaataagtgcgctatgtgtaaagcggtgttccaaaaggaaaacgaagagcggaagaggaaggaagaagaggatcagcgaaacgcagcgggccacggtagtagcgggggaggggggggaaacacacaagatgaatgtgcggagtaccgcgaacagatgaagaacgggcggctctcatgtacgcgagaatctgacccagttcgagacgccgacgggaagagctacaacaatcaatgtactatgtgtaaggccaaacttgagagagaagccgaacgcaagaacgagtactctaggtccaggagcaatgggactgggtctgaaagcggtaaggacacttgtgacgagtttagatctcagatgaagaacggcaaactgatttgtactcgagagtccgacccagtacgcggccctgatggtaagacacacggtaataaatgcaccatgtgtaaagagaaattggaacgagaagccgcagaaaaaaagaagaaagaagacgaagacagaagtaacactggtgagcggtccaacaccggcgagaggagcaatgacaaggaagacctgtgtcgcgagtttcgcagtatgcaaaggaacggcaagctcatctgtacacgcgagaacaatcctgtgagggggccatacggtaaaatgcatattaacaaatgcgctatgtgccaatcaatttttgaccgagaggccaacgagcgtaaaaaaaaggatgaagagaagtcgagctctaagcccagtaacaatgccaaggatcagtgccgacaggtgcagaatgaggcggaagacgcaaagttcaggcaacctggaaggtctcttgcctctgttgctaggatgagcacagatgaatgttccgaatttcggaactacatccgcaataatgagctgatctgtccccgagaaaatgaccctgtacacggtgcagatgggaagttctacactaataagtgttatatgtgccgggcagtctttcttacagaagccttagaacgggctaaactacaggaaaagccatcccatgtgcgggcttcacaggaagaagatagtcccgattcattctctagcctggactcagagatgtgcaaagactacagagtgttgccaaggatcggctacttgtgcccgaaggaccttaaacccgtgtgcggagacgacggccaaacatataataacccgtgcatgctctgccacgagaacctcattcgtcagactaatactcatattcgatcaacggggaagtgtgaggagtcgtccacccctggcactacagctgcatccatgccaccttccgacgagtag

SEQ ID NO: 204646 - DNA, 2751 bp, Artificial Sequence
  Description of Artificial Sequence: Synthetic coding sequence
atgaagatcgccaccgtgagcgtgctgctgcccctggccctgtgcctgatccaggatgcggctagcaaaaacgaagaccaggagatgtgccacgaattccaagcctttatgaagaacgggaaattgttttgtccacaggataaaaaattctttcaatccctcgacggcattatgtttatcaataagtgtgccacttgcaagatgattctggaaaaagaggcgaaaagccagaagagagctcgccatctggccagagcaccaaaagccaccgcccctactgaactgaactgtgatgattttaaaaagggagagcgcgatggtgatttcatctgtccggactactacgaggccgtctgtggcaccgatggcaaaacttatgacaaccggtgcgccctctgtgctgagaacgccaagactggaagccagattggggtcaagtcagagggagaatgcaagtccagtaatccggaacaggatgtgtgtagtgcattccggccctttgtccgcgacggccgactgggatgtacccgggagaacgacccagtgttggggcccgacggtaagacccacggcaacaagtgcgctatgtgtgctgagctatttcttaaagaggcagagaatgcaaagagagaaggcgagacccggatcaggagaaatgccgagaaggatttctgcaaagagtacgaaaaacaggttcgcaatggacggcttttctgtaccagagagtctgaccccgtgcgggggccggatggtcgcatgcatggcaataaatgcgctctgtgtgccgaaattttcaaacagcgcttcagtgaagagaacagcaaaaccgatcagaacctgggcaaagcagaagaaaagacgaaagtaaagcgggagattgttaagctgtgctctcaatatcaaaatcaggccaaaaatggaatcctcttctgcacaagggagaacgaccctatacgaggccctgatggaaagatgcacggcaacctctgctcgatgtgtcaagcatacttccaggccgagaacgaggagaaaaagaaagccgaggccagggccaggaataagcgggaaagtgggaaggcgacatcctatgctgaactttgctcagagtataggaaattggtgaggaacggcaaactggcctgcacacgcgaaaacgatccaatacagggcccagatggcaaagtccacggtaacacttgcagcatgtgcgaagtgttctttcaggccgaagaggaggagaagaagaagaaggagggaaagagccgcaataagcggcagagcaagagcaccgcctctttcgaggaactttgttccgagtatagaaagagccggaagaatggcagactcttctgtacccgagagaacgacccaatccaaggcccagatggcaagatgcatggtaacacctgtagcatgtgcgaggccttcttccagcaggaggagcgcgctcgcgctaaagccaagagggaggccgcgaaggagatatgcagtgagttcagagaccaggtcaggaatggcactttaatttgcacaagagagcacaaccccgtaagagggcctgacggtaagatgcatggcaacaaatgcgccatgtgcgcatcggtgttcaagctggaggaagaagaaaagaagaatgataaagaggagaaagggaaagttgaggccgagaaggtgaaacgagaggccgtccaggaattgtgctccgagtaccgacattatgtgagaaacggaaggttgccctgtacccgcgagaacgacccaatcgagggcttggatggcaagattcatgggaatacgtgttcaatgtgcgaggcgttcttccagcaggaggctaaagaaaaggagagagccgagccacgtgcgaaagtcaagcgcgaagctgagaaggagacatgtgacgagttccgccgtctattgcagaatgggaagctgttttgtacacgggaaaatgatcccgtcagggggcctgatggaaagacgcacgggaacaaatgtgcaatgtgtaaagcagtcttccagaaggagaatgaggagagaaagcgaaaagaggaagaagatcaacgaaacgctgcaggtcacggctcttccggagggggaggcggaaacacgcaggacgaatgcgctgaataccgcgagcagatgaagaacgggcgcctgtcttgcactcgggaatcagatcccgtgcgcgatgccgatggcaagagctataacaatcaatgcactatgtgcaaggctaaactggagcgggaagctgaaaggaagaacgagtacagcaggagccgctctaacggcacaggatcagagtcaggaaaggatacatgcgacgaatttcgttctcagatgaaaaatggaaaacttatctgcacccgggagtcagatccagtaagaggcccggatgggaaaacccacggaaataaatgtacgatgtgcaaagagaagctggaaagggaggctgccgagaagaaaaagaaagaagacgaggaccggtctaatacaggagagcggtcaaatactggagagcgatctaacgataaagaggatttgtgtagagaatttcgctcaatgcagaggaacggcaaactgatctgcactagagaaaacaatccagtgcgcggaccctacggcaagatgcatatcaacaagtgcgccatgtgtcagagcattttcgatagggaagctaatgagcggaagaagaaggatgaggaaaaatcaagctcaaagcctagcaataacgctaaagtaatttactag

SEQ ID NO: 204647 - DNA, 261 bp, Artificial Sequence
  Description of Artificial Sequence: Synthetic coding sequence
atgcgggccaccgccatcgtgctgctgctggccctgaccctggccacaatgtttagcattgaatgcgccaaacaaacaaaacaaatggtcgattgttctcattacaaaaaacttccgccaggtcagcagagattctgtcatcacatgtatgacccaatttgcggttccgacggtaagacttataagaatgactgtttcttttgtagcaaagtaaagaaaacagacggaacactgaaatttgtgcacttcggaaaatgttag

SEQ ID NO: 204648 - DNA, 759 bp, Artificial Sequence
  Description of Artificial Sequence: Synthetic coding sequence
atggcccagctgtgcggcctgcggcggagccgggccttcctggccctgttgggtagcctcttactgtctggggtgctcgccgctgatagagagaggtctattcacgacttttgcctagtatccaaggtcgtgggaagatgtcgtgctagcatgcctcggtggtggtacaacgtgactgatggctcatgccagctgttcgtgtatggaggctgcgacggaaactctaacaattacctaaccaaagaggagtgtctgaaaaaatgtgcaacggtcacagaaaatgccactggtgatcttgccacctcaagaaatgcggcagactcttccgtgcccagtgcaccacggagacaggactctgaggaccactcttctgacatgtttaattatgaagaatactgcaccgccaacgcagtcacaggcccatgtagagcatcatttcccaggtggtattttgacgttgaaaggaattcttgtaataacttcatctacggtggctgccggggcaacaaaaacagctacaggagtgaagaggcctgtatgctgcgctgctttcggcagcaagagaaccctccactgccactgggatctaaggtagtagtgctcgccggactgttcgtcatggtacttattctgtttcttggagcgagtatggtgtacttaattcgggtcgcccgtcgtaatcaggagcgcgcattgagaactgtctggtcttccggagatgataaggaacagcttgtgaagaacacttacgttctgtag

SEQ ID NO: 204649 - DNA, 588 bp, Artificial Sequence
  Description of Artificial Sequence: Synthetic coding sequence
atggcccagctgtgcggcctgcggcggagccgggccttcctggccctcctcggcagtctgctcttgtccggggttcttgcagccgacagagaacgcagcatccatgaaaacgctacaggagatctggctacgagcagaaatgctgctgattcgtctgtgccatccgctccccggcgtcaggacagcgaggatcacagctccgatatgtttaattacgaggagtactgcactgctaatgcggtaaccggaccatgccgagcgagctttccaaggtggtatttcgacgtggaaaggaactcctgtaataacttcatttacggcggctgcagaggtaataaaaactcatacaggtccgaggaggcgtgtatgctgcgatgctttcgtcaacaggaaaatccacctctccccctcggcagtaaagtggtggtgctcgccggtttgtttgttatggttcttatcctctttctgggcgcctccatggtttatctcattcgcgtcgcgcggcgtaatcaggagcgggccctgcgcacagtgtggagttccggtgacgataaggagcagctggttaagaacacttacgtgctttag

SEQ ID NO: 204650 - DNA, 1299 bp, Artificial Sequence
  Description of Artificial Sequence: Synthetic coding sequence
atgagcgacaagctgccctacaaggtggccgacatcggcctggccgcatggggccgcaaagcacttgacatagccgagaacgagatgccgggacttatgcggatgagagaacggtactcagctagcaaacctctgaaaggcgcccggatcgccggctgcctgcacatgactgtggagactgcagttttaattgagactttggtgacactgggagctgaggtgcagtggtccagctgtaatatcttctccacacaagaccacgccgcagctgcaatcgctaaagccgggattccagtttacgcctggaaaggggagaccgatgaggaatatctgtggtgtattgagcagacgttgtatttcaaggatggccccctgaatatgatcttagacgatggtggagacctcacgaacttgatccacacaaagtatccccaactgctccccggcattcgtgggatctctgaggagacaaccacgggcgtgcataatctgtacaagatgatggcaaacggtattctgaaagtccccgccattaatgtcaatgacagtgtgacgaagtctaagttcgacaatttgtacggttgtagagagtcactgattgatggtatcaagcgtgcaaccgacgtgatgatcgcaggaaaagtggccgtggtcgctgggtacggcgatgtggggaaaggctgcgctcaggcacttcggggcttcggggccagagtcattataaccgaaatagaccccatcaacgctctgcaggccgcaatggagggctatgaagtaactaccatggacgaggcttgccaggaaggtaatatatttgttacaactaccggttgtattgatatcattctgggtcgccactttgagcagatgaaggatgatgcgatagtgtgcaatataggacacttcgatgtcgaaatcgatgtgaaatggttgaacgaaaacgccgtggaaaaagtgaatattaaaccacaagtcgatcggtacagactgaagaacggcaggcgaattattcttctggccgaaggaagattggtaaacctgggctgtgcaatgggccacccaagcttcgtcatgtccaattctttcacaaatcaggttatggctcagattgagctgtggacacatcccgacaagtatcccgtcggtgtacactttctacctaaaaagctcgacgaggcggttgctgaagcacacctcggcaaattaaatgtcaagttgactaaattaaccgagaagcaggctcagtacctggggatgagctgcgacgggccatttaaaccagaccactaccggtattag

SEQ ID NO: 204651 - DNA, 1023 bp, Artificial Sequence
  Description of Artificial Sequence: Synthetic coding sequence
atgtgcgcccagtactgcatcagcttcgccgacgtggagaaggcccatatcaatatccgcgattccattcacctcaccccagttctgacctccagtatcctcaatcagcttaccggcagaaaccttttttttaaatgtgaattattccagaaaacgggcagcttcaaaataagaggtgctcttaatgccgtccgcagtttggtgccagatgctttagagcgcaagcccaaagccgtcgtaacccacagttccggcaatcacggacaagcactgacctacgccgcaaaattggagggcattccggcttatattgtggtgcctcagactgcgcctgattgcaagaaactagctattcaagcctacggtgcaagtatagtttattgcgaaccctctgacgaatcacgcgagaacgttgccaaacgagttactgaagagaccgagggcatcatggtccacccaaaccaggagcctgctgtgattgccggccaagggacgatcgcgttggaggtgctgaatcaggtcccattggtggatgccctggttgtgcccgtcggagggggggggatgctggctggcattgcaatcacagtgaaggccctcaaaccttcagtgaaggtgtacgccgctgagcccagcaacgccgatgattgctaccagagtaagttgaagggcaagctaatgcccaacctgtaccctcccgagacaatcgcagacggtgtaaagtcgagcatcggcctgaacacttggcctatcatccgcgacctggtggacgacatatttacagtgacagaagatgaaattaaatgtgccacccagttggtctgggagcgtatgaaactgctgatcgagcccacagcaggagtgggtgttgctgccgtgctcagccaacattttcagacagtatctcccgaggtgaaaaacatttgtattgttttgtctggtggcaacgtggatctgacatctagtataacctgggtgaaacaggccgagagacccgccagttaccagagcgtgtcggtctag

SEQ ID NO: 204652 - DNA, 1638 bp, Artificial Sequence
  Description of Artificial Sequence: Synthetic coding sequence
atggccgagcccagcggcagccccgtgcacgtgcagctgccccagcaggccgctcccgttacagccgccgcggcagcagctcctgctgccgcaaccgccgcgcctgcgcccgccgctcctgcggcgcctgctccagctccggcccccgctgcccaagcagtagggtggcccatttgccgagacgcctacgagcttcaggaagtgattggttccggtgctaccgccgtggtccaagccgctctgtgcaagcccaggcaagaacgcgtcgccatcaagcgcatcaatctggagaaatgtcagacttctatggatgagctgctgaaagagatccaagcaatgagtcagtgttctcatcctaacgtagtgacttactacacatcatttgtcgtaaaggacgagttgtggttggtgatgaaacttttgtcaggagggagcatgctcgatattattaaatacattgttaaccgaggcgaacataaaaacggtgtgctggaggaggctatcatcgcaacaattctaaaggaagtgctggaagggctcgactacctccaccgtaacggccagatacacagagatcttaaggcagggaacatcctgctgggggaggacggcagcgttcagattgccgattttggtgtaagcgcttttttggccacaggaggggacgtgacccgtaataaagtgcgcaaaacatttgtgggcaccccctgctggatggcgcccgaagtgatggaacaggtgagaggatacgatttcaaggccgatatgtggtcatttgggattaccgctatcgaattggcaaccggtgctgctccttatcacaagtatcccccaatgaaagttctgatgcttacactccagaatgatcccccaacattggagactggagtagaagacaaggaaatgatgaagaagtacgggaagagctttaggaaattgctgtcactgtgcctccaaaaagacccctcaaaacgcccgactgccgccgagctcttaaaatgtaaattcttccaaaaagccaagaaccgcgaatacctcatcgagaagttgctcacacgaacccccgacatcgctcagcgagcaaagaaggtaaggcgcgttcccggaagcagcggacacctgcacaaaacagaggacggcgactgggagtggagcgatgacgagatggacgaaaaaagtgaggaagggaaggccgccttttctcaagaaaaatctcgccgggtgaaggaagaaaacccagaaatcgccgtgagcgcctccactatacctgagcagattcagtcactgtctgtgcatgattcccagggcccccctaacgcgaacgaggactacagggaagcctcatcgtgtgctgtgaacctggtgctgcggctgaggaactcgcgaaaagaactgaatgatatccggtttgaattcacaccagggagagataccgccgacggtgtatctcaagaactctttagtgctggacttgtggatgggcacgatgtggtgatagttgctgctaacctccagaagattgtagacgatcctaaggctctgaaaactctcacctttaagctggccagtgggtgcgacggaagcgagattcctgatgaagttaaattgatcggtttcgcccagctgagcgtgtcatag

SEQ ID NO: 204653 - DNA, 2715 bp, Artificial Sequence
  Description of Artificial Sequence: Synthetic coding sequence
atggacgccggcttcttccggggcaccagcgccgagcaggacaacaggttctcgaacaagcagaaaaagttactcaaacagttaaagttcgctgagtgcttggagaaaaaggtagatatgagtaaggtgaatcttgaagtcatcaagccatggattacaaaaagggtgacagaaatcctgggattcgaggacgatgtagtcatagagttcatattcaaccaactggaggtgaagaatccagactcaaagatgatgcagataaacctcactggctttctcaacggaaaaaacgcacgggagtttatgggcgagctgtggcccttattactgagcgctcaggagaacattgcaggcatcccatccgcatttcttgaactaaaaaaggaggaaattaagcaaaggcagatagagcaggagaaactcgccagcatgaaaaagcaggatgaggacaaagacaaaagggataaagaggaaaaggaatcaagccgggagaaaagagagagaagccgctctccgcgaaggcgaaagagtcggagcccatccccccgacgacgcagctcacctgtcagacgcgaaagaaaacgctctcattcccgctcaccgaggcatcggaccaaaagtcgctccccgtcccctgcacctgaaaagaaagagaagacccctgagctgccagaaccatccgtgaaagtcaaggagcccagtgtccaggaggccacgtccacatctgatatcctgaaagtaccaaagcctgagcctatccccgaacctaaggaaccctcgccagaaaagaattctaaaaaagaaaaagagaaagaaaaaacccgacctcgttcccgatctcgctccaagagtcgttcacgcaccagaagccggtcccctagtcatacccggccgagaagacgacacagatccaggtcaagatcatattcaccccggaggcgaccctctcctcgccggaggccttcccccaggagaagaacacctccacggaggatgccccctccccctcgacatcgtagatctcgttcacccgtgcggagacgcagacgctcctccgcatctctgtctggaagttcgtcatcatcctcttcctccaggagccggagccccccgaagaaaccccccaagagaacatccagccctccccggaagacgaggaggcttagtccttctgcttcacccccccgccggcgacaccggcccagccctccagctacccctcccccaaagacacgacactctcccacacctcagcaaagtaatcgaacccgcaaatcacgcgtgagcgtgagccccggaagaacctctggaaaggttacaaaacacaaggggactgagaagcgagaatccccttctcctgcccccaaaccacgcaaggtcgagctgagtgagagcgaggaagacaaaggtgggaagatggctgccgccgattccgtgcaacagcggaggcagtatcgccgccagaaccagcaatcctcctccgactccggtagcagcagctcttctgaggacgaaaggcccaagagaagccatgtcaaaaatggagaagtggggagaaggagacggcatagccctagtaggtcggccagtccaagtccgcgtaaacgccagaaggagaccagtcccaggggtagaagacgacgctcccccagtccccccccgactcgacgaagaagatctcccagcccagctcctcctccaaggaggcggaggaccccaacaccgccccccaggaggaggacgccctctcctcccccccgaagacgttcaccaagcccacggcggtactccccgccaatccagcgacgatattcccccagtccaccccccaagaggcgaactgccagtccgccacctcctccaaaacgaagagctagcccctccccacccccaaagcgcagggtgagtcactcaccgccacctaaacagcggtcatcaccagtgacaaagcgtcgctcaccttcccttagttcgaagcatcgtaaggggtctagcccatccaggtccacgcgcgaagcccgttccccacagcccaataaaagacacagccccagtcctcgccctagagcgcctcagacaagttcatcaccaccacccgtgagacgcggcgcaagctcctcaccccagcggagacaaagtcccagcccgtcaaccaggcccatccggagggtttcacggacccccgaacccaagaaaatcaaaaaagccgcttctccatctcctcagagcgtccgccgggtcagctcctcccgctctgtctcgggcagtcccgaacctgcggcaaagaagcctcccgcacctccatcccccgtgcagagtcaatccccgtctaccaactggtctccggctgtacctgtgaaaaaagcaaaaagccctacgccaagccctagccctccaaggaactccgatcaggaagggggaggcaagaagaagaagaaaaagaaggataagaagcacaaaaaggacaagaagcataagaagcacaagaaacataaaaaagaaaaggctgtcgccgcggccgcagctgctgccgttacccccgccgccattgcggcagctaccaccactttggcgcaggaagagccagtcgccgcgccagaacctaagaaagagactgaaagtgaggccgaggataacctggacgatctggagaaacaccttagagaaaaggccttgcgtagcatgcgcaaggcccaggtctcaccacaatcctag

SEQ ID NO: 204654 - DNA, 2742 bp, Artificial Sequence
  Description of Artificial Sequence: Synthetic coding sequence
atggacgccggcttcttccggggcaccagcgccgagcaggacaacaggttttccaataagcaaaagaagttgctgaagcagttaaagtttgcagaatgtctggagaaaaaggtcgacatgtctaaggtcaaccttgaagtgatcaagccatggataacaaagcgcgtcacagaaatcctagggtttgaggatgacgtggtaatagagttcattttcaaccagctggaggtgaagaaccctgacagtaagatgatgcagatcaaccttaccggcttcttgaatggcaagaacgcaagagagttcatgggtgagctttggccactgctcttgagtgctcaggaaaacatcgcagggatcccaagcgcattcttggagctgaagaaggaggagataaaacagcgacaaatcgagcaagaaaaactagcctccatgaagaagcaggacgaggataaggacaaacgggataaggaggaaaaggaatcttcgcgcgagaagcgggaacgatcacgcagtccaaggagaaggaaatcacggagcccctctcctaggcggcgtagttcgcccgtcaggagagaacgaaagcggtctcattcacgatccccacggcaccgaaccaagtccagatctccctccccagcacccgaaaaaaaagagaaaactcccgagttgcccgaaccttccgttaaggtgaaagagccgtctgtccaggaagctactagcacatctgacattctgaaagtgcctaagccagaacccatacctgaacccaaggagcccagccctgagaagaatagcaagaaggagaaagagaaggaaaagactagaccgagatctcggtcacgctctaagtcccgctctaggactcgtagccggtccccttctcacacgcgtccccgtcggagacaccgttccaggtcccggcggaggccttcccccaggaggcgtccctctcccagacggcgaactccaccacgccggatgcctccaccccctagacaccgccgcagccgatcacctgtgcgccggcgacggaggagctcggcttcattgtcggggagtagctcgtctagttcctcatctcgttcacggtctccacctaaaaagccgcccaagcgcacaagctccccaccccggaagacacggcgcttgtcgccaagcgcctccccccctcggaggcgacatcgaccatccccaccagcaacccccccgcctaaaacgcgccacagcccaacacctcagcagagcaaccggaccaggaagtcgcgggtgagcgtctcccccgggaggaccagtggtaaagtgactaagcacaagggcaccgagaaacgagaatccccctctcccgccccaaagcctcgaaaagtggagctatccgagagtgaggaagacaaaggcgggaaaatggctgccgccgattcagtgcagcagagacggcagtatagaagacagaatcaacagagctcaagtgactctggttctagttcttcgtccgaggatgagcgacctaagcggagccacgtgaaaaatggagaagtcggacggagaagacggcactccccatctagatctgcgtctccgtcaccgcggaagcggcagaaagaaacatcaccaagaatgcaaatggggaagcgctggcagtcaccagtcactaagagtgggcgccggcggcgctccccaagccctccgccaacacggcggaggcgctccccctcccctgccccaccgcctcgacggcgcaggactcccactcctccgccccgaagaaggacaccctcccctccgccccggagacgaagccccagcccaaggaggtattctccacccatccagagaagatactctccttctccacctcctaagcgacggacagcgagtccaccaccgccacccaagaggagagctagcccatcccccccaccaaagaggagagtttcccatagccccccccccaaacagagatccagccctgtaacgaagagaaggtccccctcattgtcctcgaagcataggaaggggtcttccccatctcggtcgacaagggaagcacgcagtcctcagccaaataagaggcactctcccagtccacgacctcgggcccctcagactagctctagtcccccccctgtgcgaaggggggcctcgtcatctccgcagcgccgccagtctccaagtccctctactcgccctattcgccgagtgtctcgtacccctgagcctaaaaagatcaagaaagcagcttctcctagtccgcagtcagtccggagagttagcagctctcgaagcgtatctggatcgcctgagcccgctgctaaaaagcctcccgcccctccctctccagtgcaaagtcagtccccaagtacaaattggtctccagccgtgcctgtgaagaaggccaaatcaccaacaccctctccttcaccgcccagaaactcagaccaggagggcggcgggaagaagaaaaaaaaaaaaaaagacaaaaagcacaagaaagacaagaagcataagaagcataagaaacataagaaggaaaaagccgtcgccgccgcagcagccgctgcagtcaccccagccgccattgccgcagcgaccacaacactggcacaggaggaaccagtggctgccccggagcctaaaaaggagaccgagtctgaagccgaggacaatcttgatgacctggagaaacatctgagagaaaaggccctcagaagtatgaggaaagcgcaggtttccccccagtcatag

SEQ ID NO: 204655 - DNA, 2751 bp, Artificial Sequence
  Description of Artificial Sequence: Synthetic coding sequence
atggacgccggcttcttccggggcaccagcgccgagcaggacaaccggtttagcaacaaacagaagaagctgctgaagcagctgaaattcgccgaatgtctggagaagaaggtcgacatgagtaaagtgaacctggaggtgatcaagccctggatcaccaaaagggtgactgagatactaggctttgaagacgatgtggttattgagtttattttcaatcagctagaggtcaagaaccccgatagcaaaatgatgcaaataaacctgaccggcttcttgaatggaaagaatgcccgagaatttatgggggaactgtggcctcttctcctctctgcccaggaaaacatagcaggcattccatctgcgtttctggaactgaaaaaagaggaaattaagcagcgccagatcgagcaggagaaactcgcatcaatgaagaaacaggacgaggataaggacaaaagggacaaagaagagaaggaaagtagtagggagaagcgcgaaagatctaggtccccccgtaggaggaagagcaggagcccttccccgagacgtaggagcagccctgttcggcgggagcggaaacgaagtcactcaagatccccccggcacagaacaaaatctagatccccctcccccgcccccgagaagaaagagaagactcccgaactccctgagccttccgtgaaggttaaagaaccaagcgtccaagaagccaccagtacatccgacatcttgaaagttcccaagccagagcctatacccgagccaaaagaaccttccccagagaagaattcaaagaaggaaaaagagaaagagaaaacccggccaagaagccgctcacgtagtaaaagtcgaagtcgcaccaggtcccgaagcccatcacatacccggcctaggagacgtcatcgatcacgatcacgctcttattctccacggagacgcccctcaccccggcgccgccctagtccccggagaaggactccaccgcggcgcatgccaccccctcctcggcatcgccgatcgcggtctccagtgcggcgaagacgccgtagtagtgcatctctgtccggtagcagtagctccagttctagttccaggagcagatcccccccgaagaagccaccaaaacgcacatctagccctccccgcaagacacggcgtctatcacccagcgcatcgccgccacgcagacggcacagaccttcccccccggcgacgccaccacctaagacccggcatagccccacgccgcaacagagcaatcgaacgagaaagtcaagagtgagcgtttcccctggtaggactagcgtgaccaagcataaggggaccgagaagagagaaagtccttcaccagcgcctaagccccgcaaggtcgaacttagcgagtctgaggaggacaagggggggaagatggccgctgccgatagtgtgcagcagagacgacagtatagacggcaaaatcagcagagtagcagcgatagcggatccagctcatctagcgaggacgaacgccccaaacgctcccatgtgaagaatggtgaggttggcaggaggaggagacacagccctagtaggagtgcctccccatctccccgcaaaaggcagaaggaaacatccccccgaatgcagatgggcaagaggtggcagtcacctgtaactaagagcggccgacggagaagaagtcctagtcccccccccactaggcgccgccgctcaccctcgcccgcaccacctccgaggcgacgccgaacacctacacctcctcccagaaggcggacaccttcccctcccccacggaggcgatctccttctcctaggcggtacagcccacctattcagaggcggtactcaccttcgccccctcctaagcgacggacagctagtcccccgccccctcctaaaagaagggcgagtcccagccccccccctaaaaggcgggttagccatagcccaccgcctaagcagagatcatcccccgtcaccaaacgcagatctccatccctgtcgtctaagcaccgcaagggatcctccccatcacgcagcactcgtgaagccagatctccccagccgaacaaacgccactcaccatccccgcggccccgcgccccacagacctcttcctcacccccgccagtccggaggggagcttcttccagcccacagagacgccaaagtcccagtccgtcaacccggcctataagaagggtcagtagaactcccgaaccgaagaagatcaagaaagctgcctccccctcccctcaatcagtgagacgagtgtcatcatccagatccgtgtccggaagcccagaaccagcggcaaaaaagcctcccgcccctcccagcccggtacaaagtcaaagcccctcaaccaactggtcccctgcggtccctgtgaagaaagccaaaagtcccaccccaagccctagtccccccagaaattccgatcaagaaggcgggggtaagaaaaagaagaagaagaaggacaaaaaacacaagaaggacaagaagcacaaaaagcacaagaaacataagaaagagaaggcagtcgcggcagccgcggccgccgcagtgacccccgccgctattgccgctgctacgactactctggctcaggaagagccggtggcagccccggagcctaagaaagaaaccgaatctgaggcagaggataacctggatgatttggagaagcatctgagagaaaaggcactccggagcatgaggaaagcgcaggtttccccccagtcttag

SEQ ID NO: 204656 - DNA, 957 bp, Artificial Sequence
  Description of Artificial Sequence: Synthetic coding sequence
atgggcgagctgtggcccctgctgctgagcgcccaggagaacatcgcaggcatcccttctgcctttctggaacttaagaaagaagaaatcaagcagaggcagatcgaacaagaaaagttggcatctatgaaaaagcaggacgaggacaaggataaacgggacaaggaagaaaaggagtcttctcgtgagaagagagaacgcagccgctctccccgaaggaccaaaagtaggagcccctccccagctccagaaaagaaagagaagaccccagaattgcccgaaccctctgtcaaggtcaaagagccctcagtccaagaggcaacttccacgagtgatattttgaaagtccccaagcctgagcccatccctgagcccaaggagcccagcccagagaaaaactccaagaaggagaaagagaaagagaagaccagacccaggtcacgctcccgctcgaagtccaggtcccgaactcggagccgatctccttcacacactcgccctcggcgccgtcacaggagtagatctcgatcatattcacccagacgcaggcccagcccccgccgccgaccctcaccccgacggaggaccccccctaggaggatgcctcccccaccaaggcatcgaaggtctcgctcacctgtgcgtcggttttccggaatactgccccctaaggtcaactctgctgaggaggacgttcggcaacacccatgtcttggcgttgcgcatcaccctcttcaccttgtgcacggacatcatcagcgtagtttacctcgaggacatcccgctcctcttgggaaacttgtcggatatttacttcagcaggtcttgcaaggggagggaaccggccaccacttattgcagctccatcacccaaagctgggaattcctctgcatccaagtagccaaaccgtgcaggaaaaggtggtttttttatgcctacagggcgaactacagtag

SEQ ID NO: 204657 - DNA, 8259 bp, Artificial Sequence
  Description of Artificial Sequence: Synthetic coding sequence
atgtacaacggcatcggcctgcccaccccccggggcagcggcaccaacggatatgtccaaaggaacctgagccttgtgcgagggcgaaggggcgagcggcctgattacaaaggggaggaagagcttcgtcggctggaagcagccctggtcaagagacctaacccagatattttagaccacgagcgaaaacggcgggtcgaactccggtgtttggaattggaggagatgatggaagaacaggggtacgaggagcagcagatacaggagaaagttgctacattccgattaatgttactggaaaaagatgtcaaccccggaggcaaggaagaaacacccggtcaacgcccagccgtcaccgagacacatcaattggctgaattgaacgagaaaaagaacgaacgcctaagagcagccttcgggattagcgactcttatgtcgatggcagctcttttgacccacaaagacgcgcgcgggaagctaagcagcctgctcccgagccaccaaagccttattccttggtccgggaaagctcgtcctcgcggtcacccaccccaaagcagaaaaagaaaaagaagaagaaggacaggggtagaagatctgagtcatcctctcctaggagggagcgtaagaagagtagcaagaagaaaaagcaccgctccgaaagcgagtcaaagaaacgcaagcaccgttcaccaaccccaaagtccaaaaggaaatctaaggataaaaagcggaagcgctcacggtccacaactccagccccaaagagccgccgcgcacatagaagcacatcggcggattccgcgtcaagcagcgacacctctcgctccaggtctcgctccgctgccgcaaagacccatacgacagccctggcgggccgcagcccatctcctgcgagcggaagacgcggcgagggggacgcccccttttccgagcctggcaccactagcacgcagagaccgtcctcgccggagaccgcaaccaaacagccatcttctccttatgaagataaagacaaggataaaaaggagaagtctgccacgcgtccctcgccatctcccgagaggtcaagcacaggccccgagccccccgctccgaccccactgctggctgagaggcatggaggaagcccgcagcccctcgccaccactccattgtcacaagaaccggtgaaccccccctctgaggcaagccccacacgggataggagcccacccaagtcacccgagaagctcccccaaagcagctcctctgagtccagccccccttcaccccaacccactaaggtttctaggcatgctagcagcagtccggagagccccaagcctgcccctgcccccggatcacatagagagataagctctagtccaactagcaagaaccgctctcacggccgggccaagcgcgataagtctcacagtcacacaccttctcgcagaatggggcggtccaggtctcccgccaccgctaaaagaggcaggagcaggagtaggacccctactaagagggggcatagcaggagtcggagcccacagtggaggcgcagccgctcagctcagcgctggggaagaagccgctcgccacagcggcgcggacggtcacgttcaccccagcggccaggatggtctagatcccgcaatacacaaagacgcggcaggtcacgaagtgcacggagggggcggtctcactcccgctctccggccacccgggggcggtccaggtcgcgcaccccggctcggcggggccggagtcggagccgtactccggctcgaaggaggagccggtcccggacaccaaccagaagaaggtctcggtctaggactcccgcccggagggggcgaagccgttctaggacaccagcgcggaggcgttctcgaaccagatccccggtccgccgtaggtcgcgatccaggtcacccgccagacgctcaggccggagccggtcgcgcacaccggcaaggaggggcaggtctcgtagccgcacgcctgcccgccgaggaaggtcgcgcagccggaccccagcgcgccgtagtggacgaagtcgaagcaggactcctgccagaaggggccgcagccggtcacgcactccccgccgtggccgctcacgaagccgtagtcttgtgagacgggggagatcgcactcacgaacaccccagaggcgcggacggagcggcagcagcagcgagcgcaagaacaagagtaggaccagtcagcgaaggtcccgtagtaacagctctcctgaaatgaaaaagagcagaatttctagtaggcggtcccgtagtttgtcttcaccccggagcaaggccaaatctcggctgtcgctgcgcaggagcctgtcagggagttcaccttgtcccaagcaaaagagccagacaccacctcggcgttcccgctctggcagcagtcagccgaaggctaagagtaggacaccgcctcgcaggtccaggtctagctcctctcccccaccgaagcagaagtccaagacaccgtccagacagagtcactcatcgagctcaccacacccaaaggtgaaatcgggtacaccccctagacagggctctattacatccccacaggcaaacgagcagagcgtgacgccgcagcgtcgctcatgctttgagtcatccccagatccagagctgaaaagccgaaccccaagccggcacagctgttccgggtctagtccccctagagtgaaaagctccacacctccgagacagtcaccatcgcgatcttcgtcgccacaacccaaagtgaaggcgatcatctctccaagacagcgcagtcactctgggtctagctcgcccagcccttctagagttacctctcgcaccacacccaggcgatcccgctctgttagcccatgctctaacgtggaatcccggttattgcctaggtactcccacagcgggtcaagctccccggacactaaggtcaagcccgaaacaccgccacgacaatctcattctggatcaatctctccttacccaaaagtcaaggctcagactccccccggacctagcttgtcgggcagtaaaagcccatgtccacaggagaagagcaaggacagccttgttcagtcatgtccagggtctctgagcctgtgtgctggcgttaagtctagtactcccccaggggagagttacttcggagttagcagtctacagcttaaaggccagtcacagacctcgcccgaccatcgttccgatacgtcctcacccgaagtcagacagtcccattcagagagtcctagtctgcaatccaagagtcagacctcccccaagggagggcgatcccggtccagctcgcccgtgactgagctggccagcagatctcccattcgccaagacagaggcgaatttagtgcatcaccgatgttgaaatccgggatgtcgcctgagcagagccgtttccagtctgactcctcgtcctaccctacggtggactcaaatagtttgttgggtcagtcaaggcttgagaccgccgagagtaaggagaagatggcgctccctccccaggaggacgcgacagcatccccaccaaggcaaaaggacaaattcagtcccttcccagtacaggaccggcccgaatcctcccttgtctttaaggatactctgcgaacgcctccccgggagaggagtggcgctgggagctcccctgaaacgaaagagcaaaattccgctctcccaacctccagtcaagacgaagaactgatggaggtggtcgagaagtccgaggaaccagctggccaaatcctgagtcacctgagttccgagttaaaggagatgagtacatctaattttgaatccagtcctgaagtcgaggagaggcctgctgtatctctcacactggatcagagccagagtcaggcctctctggaagctgtggaggtgccatctatggcttcatcttgggggggcccacatttcagtccagagcacaaggagctatctaatagcccattacgcgagaatagttttgggagccctctcgaattcagaaattccggtcccttaggcacagaaatgaatactgggtttagcagtgaggtgaaagaggatctgaacgggccgtttctgaaccagctggaaaccgacccttctttggatatgaaggaacaaagcacacggagctctggacatagctcgtccgaactttctccggacgcagtggagaaagccggtatgtcaagtaatcagtccatctcgagccctgtgctggacgctgtccccagaaccccgtcgagagaacgctcttcttccgcatctagtccagaaatgaaggacggtctcccccgtacgcccagccgaaggagcagatccgggtcatcaccaggtctacgggacggaagcggaacaccctcccgacacagtctatccggctcaagccccgggatgaaagatattccaaggactcccagccgggggagaagtgagtgcgactcatctcctgaacccaaagctctgccccagaccccgaggcctagatcgcggtctccaagctcaccagaactaaacaacaagtgtctgacaccccagcgtgaacgctctggatcggagtcctccgtagatcagaagactgttgcccgaactcccttggggcagcgaagcaggagcgggtctagtcaagaactggatgttaagccatcggctagtcctcaggagcgctccgagtcagattcttctcccgactccaaagcaaaaacaaggacaccgctgcggcagagatctaggtcgggctccagtccggaagtagacagtaagagtcggctctccccgaggaggagcaggagtgggagttctcccgaggtgaaggacaagcccagggccgcgccgcgggcccaatcgggcagtgatagttctcccgagcctaaagcacctgccccacgtgctctaccaagacgcagtagaagtggctcttcctcaaaaggacgcggccctagcccagagggcagtagtagcacggagtccagtccagagcatcctcccaagagtcgtactgcacgacggggatccagatcttccccagagccaaagaccaagagcagaaccccccctaggcgcaggtcctcacggagttcccctgaattaactcgcaaagcccgtctgtctaggcgctccaggtctgccagctcttcacccgaaacaaggagtcgtactcctccgcggcacaggagaagcccctccgtctcgtcacccgagccagccgagaaatcccgctctagcagacggcgtagaagcgcctcctccccgaggacaaaaacaacttcccgccgagggcggagcccttctccaaaacctcgaggattacagcgcagtaggagtcgatcccggagagagaaaacccggaccactcgccgtcgagataggagcggaagttcccagtctacttctcgccgaaggcagcggtctcggtccaggtctcgagtgacacggcgtcgccgtgggggttcaggttaccactccaggtcccctgcccgccaagagtcctccagaacctcgtctagaagacgccgggggagaagtaggactcctccaactagccgcaagcgaagcagatcgcgcacctcccctgctccctggaagcgatctcggagccgggcctcccccgccacccatcggcgtagtcggtcgcggacacccctgatctccaggaggcggtctcggtcccgcactagtccagtctcccggagacgcagccgttctagaactagcgtgacccggcggcgaagtcggtcacgtgcaagcccagtgagcagaaggaggtcccgaagtcggaccccccctgttacgcgcagacggtcccgtagtcgcaccccaactacccggcggaggagtcggtcccgcacccctcctgtgacgcggcgcaggagccgatcacggactccacctgtgacgaggcgtagatcacgcagcagaacgtcccctatcacccgcaggagatcaagaagccgaacaagccctgtgacccgtaggaggtcccgttcccgaaccagcccggtcacacggcggcgctcgcgatcccgtacttctcccgtcacaagaagaagaagcaggtcacggacgccgcccgctattaggagacgctcaaggtcgcgaactccactgctcccacgtaagcgaagccgctccaggtcacccctggccatccggcgccgtagcagatccagaacccctcgtaccgccaggggcaagaggagtctaactagatcaccccctgcgatccgccgccgctcagctagtggaagtagctcggatcggagcaggtccgctacccctcctgctacccgcaaccactccggttccaggacccccccagtggccctcaatagttctcggatgagctgcttctctcgacctagcatgtcccctaccccgttagatagatgccggtcacctgggatgctagagccattgggatcatccagaacccctatgtcagtgctgcagcaggctggaggctctatgatggatggccctggcccgagaatccccgaccaccagaggacatcagtgccagaaaaccacgctcagtccagaatcgccctggccttgaccgctatcagcctaggaaccgccagacctccgccaagtatgtcagccgcgggcctggccgccaggatgtcccaggttcccgcccctgtgccgctcatgagcctccggactgcacccgccgctaatctggccagccggattcccgccgccagcgccgctgctatgaacctggcttccgcccggactcccgccattccaaccgcagtcaacctcgccgactccaggacgcctgcagcggcagccgccatgaacctagccagccccaggaccgccgtagcacctagcgcggtgaacttggccgaccctcggaccccaactgcgccggcggtcaatctggcgggggccaggacgcccgccgccttagccgctctgtcactcaccgggtctggaaccccccccaccgctgccaactacccttccagctctcgcactcctcaggctcccgccagtgccaaccttgtaggcccccggtccgcacacgccacagcaccagttaatattgctggatcgagaaccgccgcagccctggcaccagcctccctgacgagcgccaggatggctcccgccctgagcggagctaaccttactagcccacgggtcccactttctgcatatgagagagtctccggccggaccagcccccccctgctggaccgggcgaggtctcgtacaccaccctcagcccctagtcaaagcaggatgacaagtgagcgcgcaccaagccctagctcacgcatgggccaggcaccttcccagtcactacttccaccggctcaagatcaacctcggagccccgtccccagcgcattctccgaccagagtcggtgtcttattgcacagaccacacctgtggccgggtcccagtccctaagtagcggcgccgtggctaccactacaagttccgccggtgatcacaacgggatgctgagcgtacctgctcccggcgtcccgcactccgatgtgggcgagccgcctgcatccacaggggcccagcaacccagcgccctggcagccttgcagcccgccaaagaaaggcggtcttccagttcttcttcctcttctagcagtagcagctccagtagttcttctagcagctcttcctcctctagctctggttcgtcttcctccgattccgaagggagcagcctcccggtccaaccggaagtggcccttaaaagagtacccagcccgacacctgcaccaaaggaggcagtgagggagggtcgcccccccgagcccactcctgccaagcggaaaaggcgctcctcgagctccagctcaagtagttccagtagctcaagctcgtcatcaagttctagctcatccagtagctcgtcgtcttcttccagctccagcagttcttcgagctcctcctcctcctcctccagtccaagccccgcaaagccaggcccgcaagctctgcctaagccggccagcccaaaaaaacctccacctggagagcgtcgctctcgctccccccggaaacccatcgacagcctcagagactcaagatccctgtcctatagccccgtggaacgccgaagacccagtccgcagccaagtccacgggatcaacagtcatcaagtagcgaaagaggaagcagaagggggcagagaggcgactctcggtccccatcgcacaaaaggagacgcgagaccccttcaccgaggcctatgcgtcacaggtccagccggagcccctag

SEQ ID NO: 204658 - DNA, 702 bp, Artificial Sequence
  Description of Artificial Sequence: Synthetic coding sequence
atgatcagcttccccagcctgcagcggaccgagctggaggagatggaccttatactgcagcaggagggttggcagctggatctgaaacgaaatagccttggatggaaagatctccagcgctcttcccacccctcaccgtgccttcaggccgggcggcctctgccacagcccacttgcacacacaggggcttaccgaaattgcggctttccgaggagggagattaccccgcttcggcctcgacccccgaaccgaggggtcttataccgcctagtgggacgtttttacgctttaacctcgatccgttgtgctgtggccctcagcccgtcgccagcgtgagtagaggctgggttagctcacaccattgctccccagaaaattgttggttgacttggttaggcgaacttcccgcgcctttctcaggcacccccccaccaaccgcagtgcctcctggccaggggagccggagtcgttccccccgtaagccaatcgatagtttacgtgattccagatctctgagctactcccccgtcgagagaagacgccccagtccacagccatccccccgcgaccagcagagcagcagctcagagcgaggctcccgacgcggtcagcgaggagacagcagaagtccttctcacaaacgaaggcgcgaaaccccaagtcctaggcctatgcgtcaccggtcaagccgttccccgtag

SEQ ID NO: 204659 - DNA, 7005 bp, Artificial Sequence
  Description of Artificial Sequence: Synthetic coding sequence
atgtacaacggcatcggcctgcccaccccccggggcagcggcaccaatggatacgttcagcggaacttgagcctggtgaggggacgccgaggggagcgaccggactataaaggcgaagaagagctgcgaaggttggaggctgcattagttaagcgccccaaccccgacatcctggaccatgagcgcaagcgccgggtcgagctccgatgtctggagctggaagagatgatggaagagcaaggttatgaggaacaacagattcaagagaaggtggcgaccttccggctgatgctactcgagaaggacgtgaaccctggcggaaaggaggagacccctggtcaacgcccggctgtgaccgagactcaccagctagctgagttgaacgaaaagaagaatgaacgtctgagagcagcctttggaatctccgattcctatgtcgatggctcttcttttgacccccagcgacgagccagagaagctaagcagccggcccctgagcctcccaaaccttacagcttggtgcgggaaagctcttcgtctcgatcaccgactcctaagcaaaagaagaagaagaagaaaaaagatagaggtcgcagaagcgagagctccagcccgcggcgggaaaggaaaaaatccagcaaaaaaaagaaacataggagcgagtcagagtccaaaaagcgcaagcataggagccctacacctaagagtaagcggaaaagcaaagacaagaaaaggaagagatcacgcagcaccacccccgcacccaaatctagaagggcccatcgctccacctccgcagatagcgcatccagcagcgacacgagccgttcgcgtagtcgctcagccgcagctaaaactcacacaactgcgctggccggccgttcacctagcccagcaagcggccggcgcggggagggggacgcacctttctccgaacctggtacaacctcaacacagaggccatcctctcccgaaacggctacgaagcaaccatcatcgccttacgaagataaggataaggacaagaaagagaagagtgcgaccaggcccagtccttcacctgagcgaagctctacagggccggagccccccgcccccacccccctcttagcagaacgccatgggggtagtcctcagccgcttgctacaacgcctctctctcaggagccagtcaaccctccttctgaagcatctcctacgcgcgaccgttctccccctaagtctcccgagaagctgccccagtcaagttcgtcggaatcatcgccccctagtccccagcccacaaaggtcagcagacacgcctctagttctcctgaatcaccaaagcccgcccccgctccaggatcccatcgagaaatttcaagcagtcccaccagtaagaaccgctctcacggaagggccaagagggacaaaagtcattcacacacaccatcgcggcgcatgggtcggtcccgtagccctgccacagccaagcggggtagaagtagatcccggacgcccaccaagcgagggcattcacgcagtaggtccccacagtggagacggtcaaggtcagcccaacgctggggcaggtctaggagtcctcagagaagaggaagatcaaggagcccacagcggcctgggtggtcaagaagtaggaatacacaaagaagaggacgatcaaggtctgctcgtcgtgggcggagtcattccagatctcccgctaccagaggacggagccggtctagaactcccgcgcgaagaggtcgatccagatctaggacgcccgcacgacgccgttcacgaagccgtacgccgacaagacggcgcagtaggtcccggacgcccgctcgaaggggacgctcccgatcacgaacccccgcaaggaggcgctccaggaccagatcccctgtacgcagaaggtcccgcagtcgcagtccggctcgcaggtctgggcgaagccggagtcgaacccccgccagacgcggccggtcgcgctcccggacccccgctcgtaggggcaggtctaggtcccgtacccctgccaggaggagcggccgcagccgaagcaggactccagcacgcagagggcgctctcgttcacgaacacccagacggggacgtagcaggagtaggtcacttgttcgtcggggaagaagtcacagtcggacaccccagagacgtgggagatccgggtcgagtagcgagaggaagaacaaaagcaggacttctcagagacgctcacgtagcaacagctctccagaaatgaaaaaatcacggatttcctcaaggcgttcgagatccctgtccagcccgcggtcaaaggctaaatctaggctgagtctgagaaggtctctttcaggctcctccccttgccccaaacagaagagccaaaccccaccaaggaggagtcgttccggcagtagccagcccaaggcaaagagcagaacacctccccggaggtccagatcttcatctagtcccccacccaagcagaagtccaagacaccttctaggcagagtcactcctcgtcgagtcctcatcccaaagttaagtccggaacgccaccaaggcagggctctatcactagtccccaggcaaatgagcaaagtgtgactccacagaggcgtagttgttttgagtcctcccctgatcctgagcttaagtcacgcacacccagcagacattcctgctccggcagcagccctccccgtgttaagtcaagtaccccgccacggcagagcccaagtcggtcttctagccctcagcctaaggtgaaggccattatctcacctagacagaggtcacacagtgggtctagctcccctagcccatcacgtgtgacctctagaactaccccacgcagatctagatctgtgtcaccgtgtagtaatgtggaatctcgactgctgccccggtattctcactcagggtccagctcacctgatacaaaagtcaagccagaaacacctccccgccagtcccactccggatccatcagcccttacccaaaggtgaaggcacagacaccaccaggaccatcactgtctgggagcaagagtccatgtccccaggaaaagagcaaagacagtctagtgcaatcttgccccggtagcctcagcttatgcgctggagtcaagtcatctactccacccggggaatcttactttggtgtctcttccctccagttgaaaggacagagccagacctcaccagatcatcgctcagatacatcttccccagaagtgaggcagtcccactctgaaagtcctagcctgcaaagcaaaagtcaaacatccccgaaaggcggacgctcccggtctagttccccagtgacagagttagcctcgaggtcacctataaggcaagataggggagagttcagcgcttcccccatgctgaaaagcggtatgagcccggagcagagtcgcttccaaagtgactctagtagctatccgaccgtagatagcaacagcctcttggggcaatctcgtttggagacagccgagagcaaggagaagatggccctgccacctcaggaggacgctacggcctctccgccccgccagaaggacaaattctcaccattccccgtacaggaccggccagagtcttctttggtgtttaaggataccctgcgcacgccacccagggagagatccggggcaggctcatcccctgagaccaaagagcagaatagcgccctgcccactagttcacaagacgaagagctgatggaagttgtggaaaagtctgaggaacctgccggccaaatccttagccatctgagcagtgagctgaaggagatgtccactagcaattttgagagctctcccgaggtggaggagcgtccggccgtttctttgacactggaccagtcccagtcccaggccagcctggaggctgtggaggtaccctctatggcttcctcatggggcgggccccacttcagcccggagcataaggagttgagtaactcccctctccgtgagaatagcttcggtagtcctcttgagtttaggaattccggacccttgggaaccgagatgaacacaggcttctcgtctgaggtaaaagaggaccttaatggcccattcctgaaccagctcgagaccgacccatctctggacatgaaagaacagtcgacgaggagctcaggacacagctcttccgaattatcgccggatgctgtcgagaaggccgggatgagttcaaatcagagcatctcctcccctgtgcttgacgctgtgccgcgcactccttcacgggaacgttcctccagcgcctcctcccctgagatgaaagatggccttccaagaaccccaagcaggaggtcacggagcggctccagtcccggcttgagagacgggagcggaactccatcccggcattccctgtctggcagcagtcccgggatgaaggatatccctaggacaccaagcagaggaagaagtgagtgtgatagcagtccagaacccaaagcactgccacaaacacccagaccaagatctaggtcgccttcttcccctgaattgaacaataaatgcctgacaccacaacgggaacgatcaggaagcgaaagctctgtcgaccagaaaaccgtggctcgcactcccttgggtcagcgctccagatcggggagcagccaggagctagacgtgaaacccagtgcctctccccaagagcggagcgagagtgactccagccctgacagtaaggcgaaaacccgaactcccctccggcaacggagcaggtctgggagttcccctgaagtggactcaaagagtcgcttaagtcctcgtcgaagcaggagcggctccagtcccgaggttaaggacaagccgcgggcggcgccacgtgctcaatcaggatccgacagttcgcccgagccaaaagcacctgcccctagagccttgccccgtagatctcgtagcggatctagcagcaaggggaggggcccctccccggagggaagctcgagcaccgagtcgagtcccgaacaccctccaaaatctagaactgcccgccgggggtcccgcagctctccggaaccaaagactaaatctaggaccccccctaggcggaggagcagcaggagcagccccgagctgactcggaaggcaaggctgtctaggcggagccgttctgcctcttcctctcccgagacccgaagtaggacgccccctcggcataggcggagtcccagtgtgtcctctcctgaaccggccgagaaatcacgctcttcccgcagaagacgtagcgccagttccccccgtacgaaaaccacttcgcgaagggggcggtctcccagtcccaaacctcgaggactgcagaggtcacgatctaggtcccggcgggagaagactagaaccactcggagacgtgatagaagtggcagtagtcaaagcacatcgcgccggcgccagcgcagcaggtcccggtccagagttactcgtcgtcgcaggggtggctccggatatcacagtcggtcccctgcacgccaagagtcctccagaacctcctcccggcggagaagaggccgatcccggacccctccaaccagcagaaagagaagcaggagccggacctcacccgccccatggaagaggtctagaagcagagcctcccccgcaactcaccgcagatcccggtccagaactcctctaatttcccggaggcggtcccgttctaggaccagtcctgttagccggcggcgctctcgcagcagaaccagtgtaacccgccgtcggagcagatcaagggcatcaccagtctcccggcgaagatctcgatctcgcacccccccggtaacccgccgtcgttcaagatccaggacgcccaccacaaggcgccgctctagaagtagaactccaccggttacccgacgccgcagcagaagtcggacaccacccgtgactaggcgcagatcacgctctcgaacctcccctattacacgacgccggtcgcggagcagaacatctcccgtaacacgccggcgtagtcgatctcgaacttcacccgttacacgcaggagatcacgatcacgcacttcccccgtgaccagacgcaggagtcgttcacgtacccctcctgcccaggatcaaccacggtctcctgttcctagtgccttttctgaccaatctcggtgtctgatcgcccagaccacaccggtcgcggggtcccaatctttgtcgagcggtgccgttgccacaaccaccagctccgctggagatcacaatggcatgctgagtgtccccgccccaggggtaccgcactctgacgtgggcgaaccacccgcatccacaggagctcagcagccatctgcactggccgccctccaacctgcgaaggaaaggcgctctagttcgtcatcttcatccagctcctcttcatccagtagttcctcgtcttcctccagctcatcatctagttcaggctctagcagcagcgactcggaggggtccagtctgcccgtgcagcctgaagttgcactgaagcgtgtgccctccccgactcccgcccccaaggaagctgtgcgagagggacgaccccctgagcccacacctgccaagcgaaaacggaggagttcgtccagcagcagctcttcaagttcatcctcatcctcttcttcttcgtcatcttcttcatcaagcagctcctcatcctcttcctccagttcctcatcatcatcatcttcttcctctagcagccctagtccagcaaagcctggacctcaagccttacctaaacctgccagccccaagaagcccccccctggggagaggagatcccgcagtcctaggaaaccaatcgactctctgcgcgacagtcgctccctgagctacagccctgtcgagagaagaagacctagcccccagccctctcctcgggaccagcagtctagcagctccgagcgtggatcccgacgcggtcaaagaggtgactcaaggtctccgtctcataagagacggcgtgagacaccttctccgagacccatgcgacatcgctctagcagatcaccatag

SEQ ID NO: 204660 - DNA, 936 bp, Artificial Sequence
  Description of Artificial Sequence: Synthetic coding sequence
atgctgctggagaaggacgtgaaccccggcggcaaggaggagaccccagggcagcgacccgccgttacagaaacccaccagttagccgaactgaatgagaagaagaatgagcggctcagggcggcattcgggatttctgactcttacgttgacgggagctcctttgatccccaaagacgcgcaagagaagccaaacagccagccccagaaccacccaagccctattccttagtccgagaaagctccagcagccggtcccctacgccgaagcaaaagaagaagaaaaaaaaaaaggatcggggtcggaggtctgaaagttcatcaccccgtcgagagaggaagaagtcgtccaaaaagaaaaagcaccggtcagagtcggagagcaagaagcgcaaacatcgctcaccaacccccaagagcaaacgtaagtcgaaagacaaaaaaagaaagcgctcgcgaagtacaaccccagcccccaaaagccggcgtgctcacagaagcacctctgccgattctgcatcttcatccgatacctcccgtagccgatcccggtctgccgccgcaaagacccatacaactgccctcgcaggccgtagtccttctccagcctccggccgacggggtgaaggcgacgccccattttccgagcctggcacaacatccacccagcgccccagtagtcccgagaccgcaaccaagcagccatcctctccatacgaggataaagacaaggacaagaaggagaagtctgcgaccaggccttcccccagccccgaaaggagctcaactggccctgagccccccgcccctaccccgttgctcgctgagcgtcacggaggctcaccccagcccctggccacaacgccactgtcgcaggagccagtgaacccctcaccacagcttttcatgtttcttaaaggaatcttggtgttctag

SEQ ID NO: 204661 - DNA, 2871 bp, Artificial Sequence
  Description of Artificial Sequence: Synthetic coding sequence
cggcggcggcggctgcggcgggccgaccggcggggcgaggccgccgcaccaggcccaagagatagcggcgcgagggctgccgccgcagcaagacccctgccactcgggggcggcggccgacggcggagggtcaggggctatgaggaacagcagatccaggagaaagtggcgacctttcggctgatgttgctcgaaaaggatgttaaccccggcggaaaggaggagacacccggtcagcgaccagctgtcaccgagacccatcagctcgccgagctcaatgagaagaagaacgagcgactccgggccgcattcggcataagcgattcttacgtggatggatcttccttcgacccccagagacgcgcccgggaggctaagcagccggctcctgagccccccaagccctactcactcgtgcgggaatcatcctcttcccggagtcccacaccaaagcaaaaaaaaaaaaagaaaaagaaggaccgcgggcgtcgttctgagtcatcctcacctaggcgcgagagaaagaaaagctcgaagaagaaaaagcaccgatccgagtccgaatctaaaaaaaggaagcatcgctcacccacccctaaaagcaagaggaagtccaaggacaaaaagagaaagaggagccgaagtactactcctgctcccaagagccgtcgggcccatcggagcaccagtgccgatagtgcatcttcaagcgatacttcccgatcaaggtcccgttctgcagccgctaagacccacacgaccgctctcgctggcaggtctccgtcacccgccagtggcaggcgcggcgaaggagatgccccatttagtgaacctggaacaacatcgactcagcgaccctcaagccctgaaaccgccacgaagcaaccttcatccccttatgaggataaagacaaagataagaaggagaagagcgccacacgcccctctcctagccccgagcgaagtagtaccggcccagaacctcctgcacctacacccctcctggcagaacgtcatggcggcagtccccaacctctagctactacccctctgtctcaggaacctgtgaaccctccttctgaggcgagccctactcgcgatcggtcaccacctaaaagccccgagaaactgccccaaagctcatcctctgaatcttccccccccagcccacagcctacaaaggtcagccgccatgcatcctcctctccggaatctccgaagcccgcccccgcacccggttcccatcgggaaatcagttccagccccacgtcgaaaaatcgtagtcatggtagagccaagagagataaaagtcatagtcacacccccagccggcgcatggggcgtagtcgatccccagccacagccaagcggggccggtcacggtcacggaccccaaccaaaaggggtcattccaggtcacgcagcccccagtggaggcggtccaggtctgcgcagagatggggccgctccaggagccctcagcgcagaggccggtccaggtccccccaaagacctgggtggtctcggagcaggaatacacaacggcggggccgatcccgctctgctaggaggggtagaagccactctcggtcacctgccacgaggggccggtcaaggtctagaaccccagcccggagaggccgctccagatcccgcacacccgcacgacgccggagtagatcaagaacccctaccagaagaagatctagatccagaacacctgcccggagaggcagatcccgttctagaactcctgctagaaggaggagtcggaccagatccccagtaaggcggagaagccggtcacgctccccggctcggaggagcggcagatctaggtcacgtacccctgctaggagaggaaggtccagaagcaggactcccgcacgccgaggccgatcccggtctcggacacccgctagaagaagcgggcgaagcaggtctcgaactcctgcgcgcagaggacggagcaggtcacggaccccccgtcgcggcagatcaaggtccaggtccctcgtcaggcgtggacgcagccacagccgaacaccccagcgtagaggacgcagtggatcttctagcgaacgcaagaataaatcccgcacatctcagcgccggtccagaagtaactcttcaccagagatgaagaaatctcgtatctccagccgacgctctaggtctctgagttctccgcggtccaaggcgaagagccgtctcagtctacgcaggtcgttgtcaggctcctccccctgccctaaacaaaagagccaaacccccccccgccgctccaggtcaggctccagccagcccaaagctaagtcccggacacctccccgcaggtcacgatcttcttcctcccctccccccaaacagaagagtaagactccatcccgtcagagccactccagctcgagtccccatccgaaggtcaaatcgggcactccaccgagacaaggaagtattacttccccacaggcaaacgaacaaagcgtgaccccccagcggcgctcttgtttcgaaagtagtccggaccctgagctgaagtctcgcactccatccaggcatagttgctctggttcttcccctcctcgggttaaatcctcaactcccccccggcagtcaccaagcaggagcagtagcccacagccaaaggtgaaggccattattagccccagacagcgctctcatagtggcagttcatcaccctccccttcgagggtcactagtcgcaccaccccgcgacgaagtagatccgtctcaccttgttctaacgtggagtccagactccttccaaggtactcccacagtggctcttccagtccagataccaaggttaaacccgaaacccccccgcgacagagccacagcgggtag

SEQ ID NO: 204662 - DNA, 6036 bp, Artificial Sequence
  Description of Artificial Sequence: Synthetic coding sequence
atgaagaagagccggatcagcagccggcggagccggagcctgagcagcccacgctctaaggcaaagtctagactgagtttgcggcgttccctctcagggtccagcccatgccccaaacaaaagtcccaaactcctcctaggagaagtcgcagcgggtcctctcaaccaaaggcaaagtcgaggaccccgccacgcagaagccgcagctcttcaagccccccgccaaagcaaaaatccaaaactccatcccgacagagccactcatcttcaagtccacatcccaaagtcaagtctggtacaccgcctaggcagggctcaattacctctccacaggccaatgagcagtccgttacgccacagcgccggtcctgctttgaaagctcccccgatcccgagctgaagagcagaaccccctctcgtcacagttgttcaggctcttcgcccccaagagtgaaatcttctacaccgccgcgacagagtcctagccggtcctcttctccccaacctaaagtcaaagcgatcatctccccacgacagcggtctcacagcgggtcgagcagcccgtcccctagtcgggtcactagtcgcaccacacctaggcggagcaggagcgtgagcccgtgttcaaatgtcgagagcaggctgctccccagatactctcactccgggtcttcaagccctgacacgaaagtgaaaccagaaacaccccctcggcagtcacacagcggaagtatatcaccctatcccaaggttaaggcgcagaccccaccaggcccctccctctccggctccaagtcaccatgcccgcaagagaagtcaaaggactcactcgtgcagtcttgtccgggctctctgagtctgtgtgcaggggtcaaatcttctaccccaccaggagagagctattttggtgtgagctcactgcaactgaaaggccagagccagacgtcaccagatcatcggagcgacaccagttcacccgaagttcggcagtcccactccgagagccctagcctgcagagcaagtcacagacctcacctaagggtggccggagtcgatcatcctctcctgtcaccgaattggcctcgaggagccccataaggcaggatcggggcgagttctccgcttccccaatgctgaaatcggggatgtctcccgagcagagcaggttccaaagtgacagctcatcgtatcctacggtggattcaaacagcctactggggcaatcccggttagaaaccgccgagtccaaggagaagatggctttgcccccacaagaggatgccacagcaagcccgcccaggcagaaggataagttctctccatttcccgtgcaagacagaccggagtcatcccttgtgtttaaagacacactgcgcaccccaccgcgagaaagatccggtgccggtagctcacccgaaactaaggaacagaattccgcgttacccactagctcccaggacgaggaactcatggaagtggtcgaaaaatcagaggaaccagccggacaaatcctttctcatctgtcctcagagctgaaggaaatgtcaacaagtaacttcgaaagctcgcccgaagtggaggaacggccagccgtatctttaacactcgaccagtcccaaagtcaggcctcccttgaagctgtggaagttccttccatggcatcatcgtggggcgggccacacttctctccagagcacaaagaattatcgaactctccgctaagggaaaattcctttgggtcccctctcgagtttcgtaattcagggcccctgggaacagaaatgaacacgggcttctcctctgaggtcaaggaggacctaaacggcccatttctgaaccagctggagacagacccctctctagatatgaaggagcagtctacaagatcgtctggacacagcagcagtgagctcagccccgatgccgttgaaaaagctggcatgtctagtaatcaaagcatctcgagcccagtccttgacgcggtcccccgcacaccaagtagggaacgctcaagtagcgcctcatcccctgaaatgaaagatggccttcccaggacgccctctcgccggagccgctcaggcagctcccccgggctcagggatggcagtggaaccccctctcgccattctctgagtggatcttcccctggcatgaaggacatcccccgcacaccatccagaggcagatcagaatgcgatagctcccccgaacccaaggctctacctcagactcccaggccccggtccaggtccccctcatcgcctgaactcaacaataagtgtcttaccccccaaagggaacggtccggctctgagagttctgttgaccaaaagaccgtggcacgcactcccctcggacagagatctcgctccggcagtagccaggagttagacgttaaaccatccgctagcccccaggagcgatcggaaagtgactcatcacccgactccaaggcaaagactagaactcccttaaggcaacgcagcaggtctggtagtagccccgaggtggattctaaaagcagactgtcgcctagacggagccgctcggggagttcccccgaggttaaggataaacctcgagcagctccccgcgcccaatctggcagcgactcaagtccagagccaaaagctcctgctcctagagcactcccacggcgatcaaggtctgggtccagctcaaaggggcgtggtccgagtcccgaaggctcatcgtcaaccgaatccagtcccgagcatcctcccaaaagccggacggctagacgggggtcccggagtagtcctgagccaaaaaccaagtcaagaactccgccgcgtcggcgctctagccggtcctccccagaactgactcgcaaggcacggctgtcaaggcgctcacgttctgcctcctcctcgcccgaaaccaggtccagaacgccccctcgccataggcgaagtccttcagtgtcctcccctgagcccgctgaaaaatcaaggtccagccgtagacgtcgatccgcctcatctcctaggacaaaaacaacaagcagacgaggccggagcccatctccaaaacctcgcgggctgcagcgatcaagatccaggagccgccgcgaaaagacaaggactaccaggagaagagatcgttctgggagctctcagtcaacttcacgcaggcgacagagatcccgttctagatctagagtcacaagaagaaggaggggaggatccggataccactcccgcagtcctgctaggcaggagagcagtaggacttcatccagacgccggcgtggcaggtctcgaaccccccctacctctaggaagcgaagtaggagtcgaacttcgcctgccccttggaaacgaagtcgaagccgcgctagcccagcaacgcaccgccgctccaggagtcggacccctctcatctccagacgccgttcacgtagtaggactagtcccgtttccaggcgccgttcaagatctcgtaccagtgtaactcggcgcaggagccgttcaagagccagccccgtgtcccgcagacgcagcagatcacggacccctcccgttactcggcgacgcagccgtagccgaacacctacaacccgccggcggagtagatctcgcacgccaccggtgacacgcagaagaagccggtcccgtacccctccagttacacgtagacgcagcaggtcgcggacaagccctataaccagacggcggtcccgtagtcgaacttccccagtgacgagacggcggtcacgtagccgaaccagccccgtgaccaggagacgatcccgctctagaacctcgcccgtcacacggagacgcagcaggtctaggacaccacccgctatacgaaggaggtcacggtcgcggacacccctgctgccgcgtaagcggtcccgatcaagatctcctcttgctatccggcgtagaagtcgctccaggacaccccgaaccgccaggggaaagcggtcacttactaggtctcccccggctatacggcggcggagtgcctccgggtcttcctctgatcgaagtcgttctgcgactccgcccgcgaccagaaatcacagtgggagcagaacccctcccgtagctctgaattcaagcaggatgtcttgctttagtaggcctagtatgtccccaacgccactggataggtgcaggagtcccggaatgttggagcctctgggctccagtagaactcctatgagtgtgcttcagcaggcaggggggagcatgatggacggtcctggcccgagaatccccgaccaccagcggacctctgtgccagagaaccacgcacagtctagaatcgctctggccctcactgcaatctctctgggcacagcacgtccacctccaagcatgtctgccgctggtctcgccgcacggatgagtcaggtcccggcgcccgtgccgctgatgagtctgcgcactgcccctgcagccaatctggcatctcggatccccgctgctagcgctgccgccatgaacctagcctcagcccgaactcctgccattccaacggccgtgaatctggccgacagcaggaccccagcggcagcggccgctatgaacctggctagtccaagaaccgctgttgccccttcagccgtcaatctcgctgatccgcgcaccccaacagccccagctgtaaatctggccggagctcggacccctgccgccctggcagccctgtccttaacgggaagtgggacgccaccaaccgccgccaactatccaagctcaagtcgaaccccgcaagcccccgctagtgccaacctggtgggcccaaggtccgctcacgccactgccccagtgaatatcgccgggagtcgaactgcagctgctctggccccagcgtctctgacttccgccagaatggcacccgcgttatcgggagcaaacctgacaagtccaagggtgcctctcagcgcatatgagcgggtgagtggccgtacgagccccccactactcgaccgagccagaagccggacaccgccctccgcccccagccaatcaaggatgacgtccgagcgggctccgagccccagctccaggatgggccaagctccctctcagagtcttctgcctccggcgcaggatcagccccgatcccccgtgccaagcgccttttccgaccagtctagatgtctgatcgctcaaaccactcctgtcgctgggtcacagagcttgagctcaggagctgttgccacaaccacctcgtctgccggtgaccacaatgggatgcttagcgtacccgccccaggcgtgccgcacagtgacgtcggtgagcccccggctagcacaggcgcccaacaacctagcgcactcgccgcattgcagccagccaaagagcggcggtcctccagcagcagcagctcaagcagttcctcttcatcctcatccagcagcagtagttcatcatcatcatcctccggctcttcttcaagcgattccgagggcagttcgctgcccgtgcagcctgaggtggccctgaaaagggttccgagccctactccagctccgaaggaggctgtccgggaggggcggccacccgaacccacccctgccaaaaggaaacgtaggtcaagttcgtcgtcctcgtccagctcaagcagctcaagttcaagttcatcttcctctagcagttcttctagcagctctagcagctcatctagcagctcatcatccagcagctcgagttcttcaagcccgtccccagctaagcctggaccacaggctctgccaaagccggcttcacctaagaaaccccccccaggagagcgcagtttgctgcccgtctctccttcaccgcgacattctttaccccatgtggctagagggacatttctgaaaaggacctcagggtatttccctccccttcataagtctttcggtactccttgcgggctacaggataaggcccctccactccgcgaatggagggtgcgtctctttaccaacggaccatgtcctccctgtgtactgctgttaccagcccctacacacgcactttgcagctctcatactcaaagattagctgtgtag

SEQ ID NO: 204663 - DNA, 1836 bp, Artificial Sequence
  Description of Artificial Sequence: Synthetic coding sequence
atggccagcgtgcagcagggcgagaagcagctgttcgagaagttctggaggggaactttcaaggcagtggcgaccccaagaccggagtctatcatcgttgcctcaatcacagcccgaaagcctctgcctcgcaccgagccccaaaataatcctgtcgttccagctcaggacggcccgtccgaaaaactcggacagcacctggccacggagccactgggaacaaattcctgggaacgcgataaaacttgccgcgagctgggagcaacacgtggccacagtgcctctcacgataaagacctgaccccaccccctagttcacgagggaagaagaagaaaaagaagagcacccgcaagaaacgcagacggtcaagttcttattctccatctcccgttaaaaaaaagaagaagaagagtagcaagaagcataaacggagacgatccttctctaaaaaacgtaggcatagctccagcagccccaaatctaaacggagagatgagaagcgtcacaagaagcagagtcggtccaggccacggaagagccatcgccatcgtcaccatcgctgtccttctcgtagccagtcaagcgagagtaggccctctagctgtgagtcccgccacagagggcgttcacctgaagaggggcagaagagcaggcgccgccattcacgacgttgcagcaaaacattatgcaaggattcacccgaggcgcagagctcaaggcccccatcacagccccttcaaatgctggggtacctctccgccaggggcgttattaccgggtctggctccgcagcagacctgttcactaagaccgccagccctctgactacctctaggggccggtcccaggagtacgatagtggaaacgatacaagcagccctcccagtactcagacatcttctgcccgctcgcgaggccaggaaaagggctctcccagtggtgggctgagcaagagtcgagaactgaatagtggcaacaccagcgactcaggcaattcgtttacaacgtcatccccacagaacaagggagccatgcttgaaaacttgtcacctacttcccgaggcagagaatctagagggttccagagcccgtgtctggaatgtgcagaagtgaagaagtcatcactcgtgccgtcaactgccagatcctccccgatgaaagggtgcagcagatcttcttcctatgcctctacgcgctctagtagtcatagctcccgatcccctaatccccgagcatccccccggtacacccagtccagaagcactagctccgaaaagaggagctacagccgcagtccatcctactcaagtaaaagcggtaagcgcagccccccgtcaagatcaagtcgcagtagacgcagcccatcctacagccggtactccccctctcgggagagggaccctaagtacagcgagaaggactctcagcagcgtgaaagagagcgtgcacggaggcggagaagatcttactcgccaatgcggaagaggcggcgtgactctccatctcacctggaagcacggcgaattacatcagcccgaaagcgccccatcccatattaccgacctagtcctagttctagcggctccctctcttcaacatccagttggtattccagttcttccagtagaagcgcctctcgcagctactctagaagccgatccaggtctaggagtaggcggaggtcccggactagaacttcatccagcagcagcagccgatctcctagcccagggtcaagatcaaggtcgaggtcccgctctcggagccgcagccgtagccgcagtcaaagtcgatcctattcgagcgcagatagctattcgtcaacccgcagatag

SEQ ID NO: 204664 - DNA, 747 bp, Artificial Sequence
  Description of Artificial Sequence: Synthetic coding sequence
atgagcggcggcggcgtgatccggggccccgccggcaacaacgactgtaggatttacgtgggaaatcttccaccggacatccgcactaaggacatagaagatgtattctataaatacggggccattagagacatagacttgaagaacaggcgcggcggtcctcctttcgcctttgtggaattcgaagacccccgcgacgctgaagacgctgtgtacgggcgagatggatacgattacgacggatacagactgcgcgtggagttccctcgctccgggcgcggtaccggcagaggtggcgggggtggcggagggggaggggcgcctcgcggcagatatggacccccctcacgacggagtgagaatcgggtcgttgtcagcgggctaccaccttccggcagttggcaggacctaaaggaccacatgagagaggcgggggacgtctgttacgccgacgtgtatagagacggtaccggcgtggtcgagttcgtgaggaaggaggatatgacctacgctgtcaggaagctcgacaacacaaaattccgctcacacgaaggcgaaaccgcttacataagggtcaaggtcgacggtcctagatcaccttcttacggtagatccagaagcaggagtaggtcacggtccaggtcaagaagtagatccaattctagatcgagatcctactcaccaagacgatctcgaggctctccgaggtattctccaaggcacagcagatcaagaagccgcacatag

SEQ ID NO: 204665 - DNA, 606 bp, Artificial Sequence
  Description of Artificial Sequence: Synthetic coding sequence
atgagcggcggcggcgtgatccggggccccgccggcaacaacgactgccgcatttacgtcggcaatctccctccagacatccgcaccaaggacatcgaagacgttttctataaatatggagcgattagggatatagacttaaaaaatagacggggtggtcccccttttgcgtttgtggagtttgaggaccctcgggatgctgaggacgcggtgtacgggagagacggctatgactacgacgggtatcggctgagggtggaattcccaaggtcgggccgagggactgggaggggcggcggcggcggcgggggaggcggcgcgcctcgcggacgctatggccccccttctcgccggtctgagaatcgtgtcgtcgtcagtggactgccccccagcggaagctggcaagacctgaaggaccacatgcgcgaggcgggagacgtgtgctacgcagacgtttacagggatgggaccggcgtggtcgagtttgtccgaaaagaagacatgacttacgcagtaaggaagctggataataccaaatttcgctcgcacgaggtgggttacacccggattctattcttcgaccagaattggatccagtggagctag

SEQ ID NO: 204666 - DNA, 786 bp, Artificial Sequence
  Description of Artificial Sequence: Synthetic coding sequence
atgagccggtacctgcggccccccaacaccagcctgttcgtgcggaacgtggcggacgacactcgttcagaagatctccgccgagaatttggcaggtatgggcctatcgtagacgtttacgttccactcgacttctacacacgacgccctcgggggttcgcatatgtccaatttgaggatgttcgtgacgccgaagacgctcttcacaacctagatagaaaatggatctgtggcaggcagattgagatccagtttgcccagggtgatcggaaaaccccaaatcagatgaaggctaaagagggccggaacgtgtactcaagtagcaggtacgacgattatgacaggtaccgccggtctcgcagccggagctatgagagacgtagatctcgcagccggtctttcgactacaattaccgaagatcctattcacctagaaatcggcctaccggccgtccccgcagatcccgcagtcattctgacaatgaccgctttaagcacaggaaccgtagtttcagtcgttccaagagcaacagcaggtctagaagtaagagccaacccaaaaaggagatgaaggccaaatccagaagccggtctgctagtcataccaaaaccagaggcactagcaagaccgactccaaaacacattataaatctggatcccgctatgagaaggagtcccgtaagaaggaaccaccgcgatctaagtctcagagtaggtcccagtctcgctcaagatccaagtcccggtcacgctcttggacgtctccgaaaagtagcggacattag

SEQ ID NO: 204667 - DNA, 552 bp, Artificial Sequence
  Description of Artificial Sequence: Synthetic coding sequence
atgagccggtacctgcggccccccaacaccagcctgttcgtgcggaatgtggctgatgatacgcgcagtgaggatctgaggagagaatttggcagatacgggccaatagtagacgtgtacgttccactagatttttacactcgtcggcctcgggggtttgcatatgtgcaatttgaggatgtgcgtgacgcagaggatgcactacataatctcgaccggaagtggatctgcggccgacaaatagagatccaatttgctcagggcgatcggaagacaccaaatcagatgaaagccaaggagggaaggaatgtctatagttcctccaggtacgacgactacgaccgatatcggcgtagccgtagccgctcctacgaacgtcgccgatctcgctcccgctcatttgactataattatcgacgaagctacagcccacgaaattcgcgccctaccggtcggccacgcagatctagatcacattctgataacgatcgtccaaattgctcatggaacacacagtattcctctgcctactacacctctagaaagatctag

SEQ ID NO: 204668 - DNA, 522 bp, Artificial Sequence
  Description of Artificial Sequence: Synthetic coding sequence
atgagccggtacctgcggccccccaacaccagcctgttcgtgcggaacgtcgccgatgacacccgttcagaggatctcagaagagaatttggacggtatggtccaatcgttgacgtatacgttccactggacttttatactagacgacctaggggattcgcctatgtgcagttcgaagacgtaagagacgctgaggacgccttgcataatcttgacaggaagtggatatgcggacgccagatagagatccaattcgcacagggtgacagaaagaccccaaaccagatgaaagctaaggagggtagaaacgtttacagcagcagtcgatacgatgactacgaccgatatcgcaggagccgttcccgctcctacgagagaaggcgctcaagatcccgctccttcgactacaattacagacgcagctattctcccaggaactcccgcccaacgggacggccccgcaggagcaggtctcattccgataacgattcacaggtaagcaagaagaagaacgaacggtag

SEQ ID NO: 204669 - DNA, 519 bp, Artificial Sequence
  Description of Artificial Sequence: Synthetic coding sequence
atgagccggtacctgcggccccccaacaccagcctgttcgtgcggaatgtggcggatgacaccaggagcgaagacctgaggagggaatttggacgctatgggccaatcgtggatgtgtacgtgccactcgatttctacacaagacgccccagaggctttgcctatgtgcaattcgaggacgtgcgggatgcagaggatgctctgcacaacttggacagaaagtggatctgtgggagacaaatagagatccagtttgcccagggggatcgaaaaacacctaaccagatgaaggctaaggaagggcgtaacgtttactcgagtagccgctatgacgattatgatcgctaccgtcgctcgaggtccagaagctatgagcgcagacgaagccgctccagatctttcgattataattatagacgcagctatagcccgcgaaacagaccaacgggacgacctaggcggtctcggtcacacagtgataatgattctcaggtgtctaaaaaaaagaacgagagatag

SEQ ID NO: 204670 - DNA, 498 bp, Artificial Sequence
  Description of Artificial Sequence: Synthetic coding sequence
atgagccggtacctgcggccccccaacaccagcctgttcgtgcggaatgtggccgacgacacaaggagtgaggacttgcggagagagtttggccggtacgggcctatcgtagacgtttatgtacctcttgacttttacactaggaggccacgagggttcgcctatgttcaatttgaggacgtcagggatgcagaagacgcattgcacaatttggacaggaaatggatatgcggccgccaaatcgaaattcagtttgcccagggcgaccgcaaaacgcctaaccagatgaaagccaaagagggccgtaacgtttactcatcctctcgctatgatgattatgacagataccgtaggtcccggtcaagaagctatgaaagaagacgctcccggtcccgcagctttgattataattatcggaggtcatacagccctagaaaacctaattgcagctggaatacacagtacagcagtgcctattacactagtagaaagatttag

SEQ ID NO: 204671 - DNA, 549 bp, Artificial Sequence
  Description of Artificial Sequence: Synthetic coding sequence
atgagccggtacctgcggccccccaacaccagcctgttcgtgcggaacgtcgcggatgacaccaggagcgaggatctaagacgggagtttggacggtacgggcctattgtcgatgtctatgttccactcgacttctacacccgcaggccccgcgggttcgcctacgtgcagttcgaggacgtgcgagatgcagaggacgccttgcataatctggatcgaaaatggatctgtggacggcaaatcgaaatacagttcgcccaaggcgacagaaagaccccaaatcaaatgaaagcaaaagagggacgcaacgtgtacagctcttcacgttatgatgattacgaccgatataggaggtcgagatcaaggtcatatgagaggaggcgcagcaggtccagatctttcgactataactatcggcgctcatattcaccaagaaatcgccccactggacgtccaaggagaagccgatcccatagcgacaacgatagaccgaactgttcttggaacactcagtactcttcggcctattatacgagccggaagatatag

SEQ ID NO: 204672 - DNA, 789 bp, Artificial Sequence
  Description of Artificial Sequence: Synthetic coding sequence
atgagccggtacctgcggccccccaacaccagcctgttcgtgcggaacgtggcggacgacacaaggtccgaggacctgagacgtgaattcgggcgttacggacccatagtggatgtctacgtgcctttggatttctacaccaggcgcccaagagggtttgcctacgttcagtttgaagatgtacgggatgctgaggacgccctacacaatctagataggaagtggatttgcggaagacagatagagatccaattcgctcagggagatcgcaagactcctaaccagatgaaagccaaggagggaaggaatgtgtactccagctcccgctatgacgactacgatagatacaggcgcagcaggagtagaagctatgagcgtcgcaggagtaggtcacgcagttttgattacaactacaggagatcatactcacctaggaacagccgaccgacaggccggcctagacgctcaagatcccatagtgataacgaccgattcaagcacaggaacagatccttctccaggtcgaaatctaactcaagatcgagatctaaatctcagcccaagaaggaaatgaaagcaaagagtcgatctcgaagcgcctcccacacgaaaacccgcggaacgagtaagaccgacagtaagacgcactacaagtcgggcagtagatatgagaaggagagccgaaaaaaagagccgcctcggtccaagtcccagagcaggtcacaatcccgatcaagatccaaaagtcggagcagatcttggacatcgccaaaaagtagcgggcattag

SEQ ID NO: 204673 - DNA, 1275 bp, Artificial Sequence
  Description of Artificial Sequence: Synthetic coding sequence
atgatcaacaaccaccggaaccaggccctgtacttcagcgagcacaagtattttcagcagactcaggtggtttatcagggcgacatcttctgggtattcctttgcgtcttttgcctccggaaggagtgcgtcctcatgcaagggtgcttctcagccggcgttatccccgacgaggctaaagctttgagtctgttggcccctgcaaacgcggtggcagggctgctgccaggcggaggtctcctgccgacccccaacccactcactcagataggtgccgttcccctggcagctctaggagcccctactctggatcctgctctggccgccctggggctgcccggagcaaatcttaatagccagtctcttgccgctgaccagttgctcaaattgatgtctaccgtggacccgaagcttaaccatgttgcagccggcctcgtgtcccccagcttgaaatcagatacctcctctaaggaaatcgaggaggctatgaaaagggtaagggaggcccagagcctgatcagcgccgcaattgagccggataaaaaagaggaaaagagacgccactcaaggtctagaagccgcagcaggcgccggaggaccccaagcagctccagacacagaaggtccagaagccggagccggcgacggagccacagcaagagccggtccagacggcggtctaaatccccgcggcggagaagatcacacagccgcgagaggggtagaagaagccgctcaaccagcaagacccgagacaaaaaaaaggaagataaagaaaaaaagaggtcaaagaccccacctaagtcatattcgaccgcgcgcagatctcgtagcgccagtagagaacgacggcggagacggagtcgctctggcacccgctcccctaagaagccccgctcgccgaagcgcaagctaagccggagcccatccccccgccggcataagaaggagaaaaaaaaagacaaagacaaggaacggtctcgcgacgaaagggaacggagcacctctaagaagaagaaatcaaaagacaaagagaaggaccgcgagcggaagtctgaatcagacaaagatgtgaagcaggttaccagggactatgacgaggaggagcaaggatacgatagtgagaaagagaagaaggaagaaaagaagccaatcgagaccggatcccccaagacaaaggaatgcagcgtcgagaaaggcaccggcgactcccttcgggaaagtaaggtgaatggggacgaccatcatgaagaagacatggatatgtctgactag

SEQ ID NO: 204674 - DNA, 1455 bp, Artificial Sequence
  Description of Artificial Sequence: Synthetic coding sequence
atgagcaacaccaccgtggtgcccagcaccgccggccccggcccctcaggcggccccggcgggggcggtggcggaggtggtggtgggggcggcaccgaggttatccaagttaccaacgtcagtccgtccgcctcctcagagcagatgcgcaccttattcggatttcttggtaaaattgatgaactgagactgttcccaccagatgatagtccactgcccgtctcctccagggtgtgtttcgttaagtttcatgacccagattctgccgtggtggctcagcaccttaccaacaccgtcttcgtggaccgggccctcatcgtggtgccttacgccgagggggttatcccagatgaggccaaggccctctcactgctggccccagctaatgcagttgctggactgctgccaggcggaggtctgctcccgaccccaaatcctctgactcagattggggccgtacccctggctgctcttggagcgcctacgcttgacccagcattagccgcactcggattacccggcgctaacctcaattcccagtctttggctgcagaccagcttctgaaattgatgtcaaccgttgatcctaaactcaaccacgtggccgccgggctggtgtcacccagccttaaatccgatacaagctccaaggaaatcgaagaggccatgaagagggtgagagaggcccagagcttgatctctgctgccatcgaacctgacaagaaggaagaaaagcgccggcacagccggtctagatctagatctcgcagacgaagaacgcctagttctagtaggcaccgacggtcccgttctcggtctcgtagacgttctcacagcaagtctagaagccgaaggcgtagtaagtcccccaggagaagacgttctcacagtcgggagagaggacggcgtagcaggagcacatccaagactcgggacaagaagaaagaagacaaggagaagaagaggtccaagacaccccccaaatcctacagcacagcacgccgctcaagaagcgcttcacgcgagaggaggaggcgccggagtcgatctggtacaaggtcacctaagaaacctagaagccccaaacgcaaactgagccggagtccatctccgagacggcacaagaaggagaagaagaaggataaggataaagagcgcagccgcgacgagcgggaacgaagtacctcgaaaaaaaagaagagcaaagataaagaaaaggatcgggagcgaaaatccgagagcgacaaggacgtcaagcaggtgacccgggattatgatgaggaggagcagggctacgattccgaaaaagaaaagaaggaggaaaaaaagcccattgagacaggatcccctaagactaaggaatgttccgtcgagaaggggacgggcgattcattgagggaaagcaaagtcaacggcgatgatcaccatgaggaagatatggatatgagcgactag

SEQ ID NO: 204675 - DNA, 1452 bp, Artificial Sequence
  Description of Artificial Sequence: Synthetic coding sequence
atgagcaacaccaccgtggtgcccagcaccgccggccccggccccagcggaggacctggtggaggaggaggaggcggcgggggcgggggggggaccgaagttatccaggtcaccaatgtgagtccctccgcatcctcggaacagatgaggacgctctttgggttccttggtaaaattgacgagctcaggctgtttcctcctgacgactccccactgcctgtttccagccgcgtttgtttcgtaaagttccacgatcccgacagtgctgttgtagcccagcatctgacgaacacagtgttcgttgaccgtgctcttatcgtggtgccttatgcggagggtgtcatacccgacgaggcaaaagccctgagtttgttggccccggcaaacgcagtggccggactgttgcccgggggaggactactcccgacgcctaatcccctgacgcaaattggcgctgtccctttggctgccctcggggcccccacccttgatccggcattggccgcactgggcttgcccggagcaaacttgaatagccaaagcctggcagcagaccagctgctcaaactcatgtctaccgtcgaccccaagctcaaccacgtggctgcaggcctcgttagtcccagtctcaaatcagacacaagtagcaaagagattgaggaggccatgaaacgtgttcgagaagcccaaagcctcatcagcgccgcgatagaaccggacaaaaaggaggagaaaaggcgtcattccagatctcgcagccggagtagacgtagaaggaccccatcatcatccaggcatcgccgatcgcggtcgagaagccggcggcgaagccattcgaaatctagaagtaggcgcaggtccaagtctccccgtaggcgccgtagtcattcacgcgagaggggacgacggtcccgtagcacttccaagactcgtgacaaaaagaaggaagataaggagaagaaaaggtctaaaacccctcccaagtcatactctacagccaggcgtagccgctcggcgagtagagagcgcaggcgccgacgctccaggtctgggaccaggtccccaaaaaagcctcgttctcccaagcgtaagctcagcagatccccgtctccccggcgacataaaaaagagaaaaagaaggacaaggacaaagagagatccagagacgagcgcgagagatctacaagtaagaagaagaaatctaaagacaaagagaaggacagagaaagaaagtctgagtctgacaaggatgttaaagtgacacgggattatgacgaggaagagcaggggtatgactcagagaaggaaaaaaaggaggaaaagaagccgattgagacagggagcccaaagaccaaggagtgtagcgtagagaaaggaactggagactcactcagggagagtaaggtaaacggcgacgaccatcacgaggaggacatggatatgtcagattag

SEQ ID NO: 204676 - DNA, 1170 bp, Artificial Sequence
  Description of Artificial Sequence: Synthetic coding sequence
atgagcaacaccaccgtggtgcccagcaccgccggccccggcccctcaggcggccctggaggaggtggaggcggcggaggcggcggcggcggcactgaagtgatacaggtgactaatgtctccccaagtgcatcctccgagcagatgcgcaccctgttcggattcctcgggaaaattgatgagcttcgtctgtttcctcccgacgactcccccttgccagtgagctcaagggtttgcttcgtcaagtttcacgaccctgactccgctgtggtcgcacaacacctgacaaacactgtcttcgtagaccgcgctttaatcgtcgtcccttatgccgagggcgtgattcctgatgaggcaaaagcactgagcctgctcgctccagccaatgccgttgctggactacttcctggtggagggttactcccaacccctaacccgctcacgcagattggggctgttccccttgctgcccttggagcccccacactggatccagcactcgcagccttaggacttcccggagctaatcttaactctcaatctctcgcagcagatcaactactaaaactgatgtcaacggtggaccctaagcttaaccatgtagcagcagggctggtgtccccctcgctcaaatctgacacctctagtaaggagattgaagaagcaatgaaacgagtccgggaagcccaatcactcatctctgccgcaatcgaacccgataaaaaagaagagaaaagacggcatagcaggagccggtcacgcagcagacggcgaaggactccttcttcgagtaggcacagacgctcccgctccaggtctcgccgtcggtcccacagcaagtcgcgatcacgacgccgttccaagagtccaaggcggcgcagatcacatagtagggaacggggccgtcggtcacgttcaacaagcaagacacgagataaaaagaaggaagacaaggagaagaaacgcagcaaaacgccacctaagtcctactcaaccgctaggcgctcacgcagcgcaagcagcttacatatttgtgatagcagggagcgcaggaggcgaaggtcccggtctgggactcggtcaccaaagaagccacgcagcccaaaaaggaagctgtcccgaagtccttctccaaggagacacaaaaaagaaaaaaagaaggataaatag

SEQ ID NO: 204677 - DNA, 1455 bp, Artificial Sequence
  Description of Artificial Sequence: Synthetic coding sequence
atgagcaacaccaccgtggtgcccagcaccgccggccccggcccctcaggtggtcccggagggggcggaggcggcggtggaggaggaggcggaacggaagttattcaggtgaccaatgtgtctccctctgcatcatccgagcagatgcgcacgctcttcggctttctgggaaagatcgacgagctccgactgtttcccccagatgatagtccgctgcccgtgagttcgcgggtgtgttttgtcaagttccatgaccccgattcagccgtcgtagcccagcaccttactaacactgtctttgtcgatcgggctctgatcgtggttccttacgccgagggtgttattcccgatgaagcgaaagccttgagtctgctcgcgcctgccaacgctgtagctggcctgttgcctgggggtgggctgctgcccactccaaacccattgacgcagattggagctgtgccactggccgccctgggcgcccctacgttggatcctgctctggcggctctgggactgcccggagcaaatttgaattctcagagtttggcagccgaccaattgctgaagcttatgagtaccgtggaccctaagctgaatcatgtcgctgctggactagtctcgccatcccttaagagcgacacatccagcaaagagatcgaggaggccatgaagcgcgtgcgagaggcacagtccctcatttctgcggcaattgagcccgacaaaaaggaggagaaaaggagacacagccgctcacgctctcggtcccgtcggcgccgaactccgtccagcagcagacaccggcgcagtcgatcccgctccagacgcagaagccatagtaaaagtagatcgcgcaggagaagcaaaagtcccagacggcggcgttcccatagtcgagagcggggcaggcggagccgatcaacatctaaaactcgggacaaaaaaaaggaggataaggagaaaaaaaggtccaagacgccccccaaatcatacagcacagccaggcggtcccgctccgcctcgagagagagacgtcgccgtcgctcaagaagtggcacaagaagccccaagaaaccacgcagtcccaaaagaaaactttctcgatcaccctccccacgccgacacaaaaaggaaaaaaaaaaggataaggacaaagagcggagcagagatgagcgggaaagatccacgtccaagaagaagaagtcaaaggacaaggaaaaagacagagaacgcaagtctgagtcagacaaggatgtgaagcaggtcactcgggattatgacgaggaagagcagggatatgactcagagaaggagaagaaggaggaaaagaaaccaattgaaaccggttccccgaaaactaaggagtgctctgtagaaaaagggactggagacagcctccgtgagtcaaaagtgaatggcgacgaccaccacgaagaggacatggatatgtccgactag

SEQ ID NO: 204678 - DNA, 387 bp, Artificial Sequence
  Description of Artificial Sequence: Synthetic coding sequence
atgagcaacaccaccgtggtgcccagcaccgccggccccggcccctccggcggcccaggcgggggcggaggaggtggcggaggcgggggcggcacagaggtgattcaagttaccaacgtgtcaccttctgcctccagcgagcaaatgcggacgctctttggatttctgggaaaaatcgatgagctcagactatttccgccagacgactcccccctcccagtcagctctagagtttgcttcgtcaaatttcacgaccccgactccgctgtggttgctcagcatttaactaatacggtattcgtcgaccgggcactgattgtcgtgccctatgccgaggtaaagcagccaacacgcgtcgtagtgcacaagaccgcctttgagtcctag

SEQ ID NO: 204679 - DNA, 396 bp, Artificial Sequence
  Description of Artificial Sequence: Synthetic coding sequence
atgagcaacaccaccgtggtgcccagcaccgccggccccggcccctctggcggaccaggagggggcggcggaggggggggcggcggcggcggcaccgaggtgatccaagtgacgaatgtctcccctagcgctagctcagagcaaatgcggaccttgttcggtttcctcggaaaaattgacgaattacgactttttccgcccgatgattctcctctgcccgtcagctccagagtctgctttgtaaaatttcacgatccggacagcgcagtggtcgcccaacacctgacaaacaccgtgttcgtggatagggcccttatcgtggtgccctacgctgaggtctttcacggaagtattaaggctgcagttaagaaaatactgcttacgcacgagaactag

SEQ ID NO: 204680 - DNA, 630 bp, Artificial Sequence
  Description of Artificial Sequence: Synthetic coding sequence
atgaccagcctgaaggtggacaacctgacctaccggaccagccccgacaccttgcgcagggtgtttgaaaaatacgggcgagttggcgatgtgtacatcccgcgcgaccggtacactaaagaatctcgggggtttgccttcgtgaggttccacgacaagcgcgatgctgaggacgccatggacgccatggatggggctgtgctagatggaagggaacttcgtgtgcagatggctcggtacgggcgcccgcccgatagccaccactcccgaagaggcccaccaccacgccgatacggaggaggcggctatgggcggcggagcagaagcccgcgccggcggcggcgatcaaggagccggagccgtagccgtagtaggagcaggtcaagaagtaggtactccaggtcgaaaagccggtcaaggacaaggtcacgttctagatcaacaagcaagagcaggtccgctagaaggagcaagtccaaatcctcgtccgtgagtcgctcccgcagccgttctagatctcgatctaggtctaggagcccacctccggtgtcaaaaagagagtccaagtcccgctctagaagcaaaagccctccgaagtctcccgaagaagaaggggccgtgtcatcctag

SEQ ID NO: 204681 - DNA, 606 bp, Artificial Sequence
  Description of Artificial Sequence: Synthetic coding sequence
atgagctacggccggcccccccccgacgtggagggcatgaccagcctgaaagtcgataacctgacctacaggacttcacctgacacattaaggcgggtcttcgagaagtacggcagagtcggcgacgtttatattcctagagatcgatacaccaaagagagcagaggatttgcttttgtgaggtttcatgataagcgggacgccgaggatgctatggatgcaatggatggtgccgtgctcgacggcagagagctaagggttcagatggcccgctgcgggggctacggccgccgcagccgaagcccgcgacggcgcaggcgttccagaagcagatcgcgaagtcggagccggagtcgttcccggagccggtattcccgttctaaatcccgttctcgcacgaggtccagaagcaggtcaacatcaaaatcgaggagcgccaggcggagcaagtccaagagcagctctgtttcgcgctcccgctcacggtcccgtagtagaagccgcagccgttctcccccccccgtttctaaacgcgagagcaagagtaggtcaaggtcgaaaagcccaccaaagtccccagaggaggagggggccgtatcttcctag

SEQ ID NO: 204682 - DNA, 666 bp, Artificial Sequence
  Description of Artificial Sequence: Synthetic coding sequence
atgagctacggccggcccccccccgacgtggagggcatgaccagcctgaaggtggacaacttaacttaccggacgagtcctgatacccttcgaagagtttttgagaagtacggccgcgtaggagatgtgtacatccctcgcgacaggtacaccaaagaatccaggggctttgccttcgttcgatttcacgacaagcgcgacgccgaggatgccatggacgctatggatggcgctgtgctggatgggcgcgaactgagggtgcagatggcgaggtatgggcgccctcctgacagccaccacagtcgtagggggccccccccccggagatacgggggcggaggctacgggaggcggtccagaagcccaaggaggaggcggagatcaagaagcagaagccgatctaggtcgagatctagatcacggagccgctattctcggagtaagtcgagatcacgaacgcgatctcggtcacggtccacatcaaaaagccgcagcgcgcgccggagcaagtcgaagagctcctcagtatctagaagtcggtctcgttctcgttctcgaagcaggagcaggagccccccgcccgtctctaagagagagagcaagtcccggagcagatccaagtctcctccgaagagccctgaagaggaaggtgcggtgagctcctag

SEQ ID NO: 204683 - DNA, 540 bp, Artificial Sequence
  Description of Artificial Sequence: Synthetic coding sequence
atgagctacggccggcccccccccgacgtggagggcatgaccagcctcaaagtggataacctcacctacaggaccagcccagacaccctgaggagagtgtttgagaagtacggcagggtcggcgatgtctatatacctcgcgaccggtacactaaggaatctagggggttcgccttcgtgcggttccatgataagagggatgcagaagatgcaatggacgcaatggacggggccgacccaggggttggggtggttcctggactggcagccgatctggccaccgccgccagatcccttggtcctgctctggtgttagatctggggcgacccccctcacccgacccacatgagggaccaagtccctcaccccggcggtcaccagatctggtccgcggtcccgggcccgggctgggcccaggggtgctccctcagtgcccgcgcgggaatcccaatcctggccgagatagacgggtcccaccttccctcctgaaaagaaaagaacggtgccccctcaagaaaatgcttaggagcccagtgtag

SEQ ID NO: 204684 - DNA, 669 bp, Artificial Sequence
  Description of Artificial Sequence: Synthetic coding sequence
cccgagcggcggggcgtggcccccccccgggccgaggaggccggcgcgtctagcaggggcagcggcccccccctccgagccatgagctacgggcggcctccacctgacgtcgagggaatgacatcactcaaggtcgataatctcacctatcggacatcacctgataccctgaggcgtgtcttcgaaaaatacggcagggtgggcgacgtatacatacctagagatagatacaccaaggaatcacgcggattcgcctttgtgcgattccatgataaaagagacgcagaagacgcaatggacgccatggatggtgcggtgctcgacggcagggaactgcgagtccagatggctaggtatggtcgccccccagactcccaccactccagaaggggcccaccccctcggcgctacggaggtggcggatatggaaggcgcagccggtctccacgtcgtcgccgccggagtaggagtcgatcaagaagcaggtcgcgttcccgctccagaagtagatacagccgcagtaaatctcgcagtaggacacggagtcgcagcaggtccacctcaaagagtaggagcgctcgtaggagcaaatctaagtcctcaagtgtcagcagatctagaagtaggagccgcagccgctccagaagtcggtctcccccgccagtatag

SEQ ID NO: 204685 - DNA, 375 bp, Artificial Sequence
  Description of Artificial Sequence: Synthetic coding sequence
atgcaccgggacagctgccccctggactgcaaggtgtacgtgggcaacctggggaataatggcaacaagactgagttggagagagcctttggatactatggccccctgcggtctgtttgggtagccagaaatccccctggattcgcctttgtagagtttgaggaccccagagacgcagccgacgcagtcagggaactggatggccgcacactgtgcggatgccgggtgagagttgagctctcaaacggagaaaagcgaagtcgcaaccgcggcccccctccatcttgggggaggaggccaagagacgattatagaagacgctccccacccccaaggaggagggttacgatcatgagtctactgacgacactctag

SEQ ID NO: 204686 - DNA, 495 bp, Artificial Sequence
  Description of Artificial Sequence: Synthetic coding sequence
atgcaccgggacagctgccccctggactgcaaggtgtacgtgggcaatctgggaaacaacggaaataagactgagcttgagcgggctttcggttattacggtccccttagatccgtttgggtcgcgcgtaacccacccggattcgccttcgtggagttcgaagatcctcgggatgccgccgatgccgtgcgggagctggacggacggacactgtgtgggtgccgcgtccgcgtggaactgtctaacggagagaaacggagtcgaaatagggggcccccaccatcctgggggaggcgccctcgggatgactaccgtcgtcgttctccgccccccaggagacggagcccccgccgcaggtcattttccagaagtagatcacggtccttgtctcgagaccggcgccgtgagaggagcctctctagggaacgcaaccacaagccaagtaggtctttctcacgcagccggtccaggtccaggtccaatgaacgcaagtag

SEQ ID NO: 204687 - DNA, 1485 bp, Artificial Sequence
  Description of Artificial Sequence: Synthetic coding sequence
atgccccgggtgtacatcggccggctgagctaccaggcccgggagcgggatgttgagcggttcttcaagggttacggcaaaatcctcgaagtggatctgaagaatggatatggattcgtggagtttgatgatctccgagatgcagatgatgcggtgtacgaactgaacggcaaggatctctgcggcgagcgcgtgattgtcgaacatgcacgtgggcccaggcgggatggatcttatggatcagggagatcgggctacggctatagaaggagcggtcgtgacaagtacggaccaccgactcggacagaatatagactgattgtcgagaacctgtccagtcgctgttcgtggcaggatctaaaagactatatgaggcaggctggcgaggttacatacgctgatgcacataaaggccggaaaaatgagggagtgatagaattcgtgagttactccgacatgaaaagagcactggaaaagctagatggcactgaggtcaatggaaggaagatccgactagtagaggataaaccgggctctaggcgtaggcgatcatacagtaggagccggtctcactctcgcagtagaagcagaagcaggcacagccgtaaaagccgttcgcgctcaggctccagcaaatccagccacagtaagtccaggtctcgttcacgaagcgggtctaggagcaggtcaaagtcaaggtcacggtctcaaagtaggagtagaagcaagaaagaaaagagtaggtctccatcaaaagagaagtcaaggagtcggagccactcagcggggaagagccgctccaaaagcaaggaccaggccgaagagaaaattcaaaataacgacaacgtgggaaaaccgaaaagtaggtctcccagccgccacaaatctaagtctaagtctcggtcccggtcccaggagagacgcgtggaggaagagaagcgggggtcagttagccggggcagatctcaggagaagtccttgaggcagagcaggagtaggtccagaagcaaaggtggctctcggagcaggtcccgttcccgcagcaagtccaaggacaaaaggaagggaaggaaaagatcccgcgaagaatccaggtcccgatctcgctcccgctccaagagcgagaggtctaggaagagggggagtaagcgcgattctaaagccgggagcagcaagaagaagaaaaaggaagacaccgaccgatcccaaagcagaagtccatctaggagcgtgagtaaggagagagagcatgcaaagtccgagtctagtcagcgcgaggggaggggcgaatctgagaacgcagggacaaaccaggagactagatcacgctcgcgtagtaacagcaagtcgaagcctaacttgccttccgagtccagaagccggagtaaatcagcgtctaaaacacggagtcgctccaagtcccgaagccgctcagcctctagaagccctagtcggagtcgctcacggagccactcaagatcctag

SEQ ID NO: 204688 - DNA, 1221 bp, Artificial Sequence
  Description of Artificial Sequence: Synthetic coding sequence
atgccccgggtgtacatcggccggctgagctaccaggcccgggagcgtgacgtagaaagattttttaaaggctacggcaaaatcttagaagtggatctgaaaaacggatacggcttcgtggagttcgacgacctaagggacgcagacgacgctgtctacgaactgaatggcaaggatttgtgtggggaaagggtgatcgtagagcatgctcgtggccctcgcagggatggcagctacggctctggacgctccgggtatgggtaccgcagatcagggcgggataagtatggaccacccacccggaccgaatatcgccttatagtagaaaatttatcctctcgctgctcttggcaggacctgaaggactacatgcgacaagcaggtgaggtgacttacgccgacgcccataaggggagaaagaatgaaggtgtgattgagttcgtttcatattcagatatgaaaagagccctggagaagctggatgggaccgaggttaacggacgtaaaataaggttggtcgaagacaagccaggatccagaagaaggcgcagttattcccgttcaagatctcatagtcgaagccgatcccggtcccgccattctcgtaagtccaggtctcggtcaggctcttccaagtccagccactcaaaatcacgcagtaggtccagatctggctctcgtagtcgcagcaaatctcggagcagaagccagtcacggtccagatccaaaaaagagaaaagcagatcgccaagcaaggaaaaaagtcgtagcagatcacactctgcggggaaatcccgatctaaatccaaggatcaggccgaggagaagatccagaacaatgacaacgtcggaaaacctaagtcacgctcgccttctcgacataaaagcaaaagtaaatcaaggagccggagccaggagagaagagtagaagaggagaaacgtggttccgttagtcgggggcgctctcaggagaagtctcttcggcagtccagaagccggagcaggagtaagggcggatcaagatcaaggagccgatcccgctcaaaatcgaaggacaagcgaaaagggcgcaagaggtccagagaggaaagccgatctcgctccaggtcacgaagtaagtccgaaaggtcacgtaagcgtgggagtctggcttttcggcccggtctgagttatcgcgagctctctaaccttgatggctctaaggccggcatgactacctag

SEQ ID NO: 204689 - DNA, 477 bp, Artificial Sequence
  Description of Artificial Sequence: Synthetic coding sequence
atgccccgggtgtacatcggccggctgagctaccaggcccgggagagagatgtggaacggttctttaagggctatggaaagatcctcgaagtcgacttgaaaaatggatacggcttcgtggagttcgacgacctcagagacgcagacgacgctgtctatgaacttaacggaaaagacttatgtggggagcgggtcatcgtggagcatgcaagagggcctaggagggacggctcctacggttctgggcgctcaggatacggatacagacgctctggtagagacaaatacggcccccccacaaggaccgagtaccgccttatcgtggagaacctctcatcccgatgttcttggcaagatctgaaggtgggactgcctctgccggagcaggagcctgagccggaaccagagagcgagcctgaacaggaaagagaaaaacaagagcctcagcagggtaaagaacctcagccccagccctag

SEQ ID NO: 204690 - DNA, 819 bp, Artificial Sequence
  Description of Artificial Sequence: Synthetic coding sequence
atgagcggctgccgggtgttcatcggccggctgaaccccgccgccagggagaaggacgttgaacggtttttcaagggatacgggaggattagagatatagacttgaaaagaggctttggctttgtagagttcgaggatccacgcgacgccgacgatgccgtatacgagttggatggcaaggagctgtgttctgagagagtgacaatcgaacacgccagggccaggagcaggggtggccgcggccgtgggaggtactctgacagattttcctcccggcggcctcggaacgataggcggaacgccccgccagtgaggactgaaaacagactgattgtggagaacctttcctcgcgggtgagctggcaggacctgaaagacttcatgaggcaggcaggagaagtgacctttgctgatgcccaccgccccaaactgaatgagggcgtggtcgaattcgcctcctacggtgacctgaagaacgccattgagaaactttccggcaaggagataaatggtagaaaaattaaactgatcgagggttcgaaacgacatagtagaagtcgttcccgatcccggtctcgtaccaggtcctcttctcgcagccgatctcgtagtagatcacgtagccggaaaagctactcgcggagccgttccagatcaagaagtcgctcaagaagcaagagcaggtccgtgtcccggtcacctgtccccgaaaagtcccagaaaagggggtcatcttctcgcagcaaatcccctgccagtgtggaccgacaaaggtctcgatctagaagtcgctctcggagcgttgactcagggaattag

SEQ ID NO: 204691 - DNA, 417 bp, Artificial Sequence
  Description of Artificial Sequence: Synthetic coding sequence
atgagcggctgccgggtgttcatcggccggctgaaccccgccgccagggaaaaagatgtggaaagattttttaaaggctacgggcgaatccgtgacatagacctgaaacgagggttcggctttgtggagttcgaggacccacgcgacgctgatgatgctgtctatgagctagacgggaaggaactgtgcagtgaaagagttaccatcgagcacgcccgggcacggtcacgggggggaagaggcaggggccggtactccgaccgcttcagcagccggcggcctagaaatgataggcgcaatgcgcctcccgtgagaaccgagaaccgacttatcgtagagaacctgagctctcgcgtgtcttggcagcccgtttgcgtggtggggctgatgacccggagcgcttgcgggctgagctag

SEQ ID NO: 204692 - DNA, 819 bp, Artificial Sequence
  Description of Artificial Sequence: Synthetic coding sequence
atgagcggctgccgggtgttcatcggccggctgaaccccgccgcccgcgagaaggacgtggagcggttttttaaaggctacggccgaattagagacatcgacctaaaacgcggctttggcttcgttgaattcgaagacccacgtgatgccgacgacgcggtatatgagctggacggaaaagagctctgctcagagcgtgtgaccatcgagcatgcgcgggctagatctcgtgggggtcgggggcgaggtcggtatagtgaccgattctcctcccgtcgccctcgaaatgatcggcggaatgcgccccctgtgcggactgagaatcgactaatagtggagaatctgtcgtcacgcgtcagctggcaggacctcaaagacttcatgcggcaggcgggggaggtgacatttgctgatgctcatcgccctaagctcaatgaaggcgtggtcgaatttgcttcgtatggagatctgaaaaacgctatcgagaagttatcagggaaggaaatcaacggtagaaaaatcaagctcattgagggatccaagcgccacagcaggagccgctcacgtagcagatcacggactagatctagctctcggagcaggagccgctcacggagtcggtcaagaaaaagctactcccgttccagaagcaggtctcgcagtcgcagtagatctaaatcaagaagcgtgtcacggtcacccgtgccagaaaaatctcaaaagagaggctctagttcacgctctaagagccccgcttccgtggacagacagcggagtcgcagtcgttcacggtcaagatctgtcgactcgggcaattag

SEQ ID NO: 204693 - DNA, 819 bp, Artificial Sequence
  Description of Artificial Sequence: Synthetic coding sequence
atgagcggctgccgggtgttcatcggccggctgaaccccgccgcccgtgagaaagacgttgagcgattcttcaaggggtacgggaggattagagacatcgatctaaaaagaggattcggctttgtcgagtttgaggacccgagggatgcggatgatgcagtttacgagctggacgggaaggagctgtgcagcgagcgagtcaccattgagcatgccagggcccgcagcagaggaggtcgaggaagggggcgctatagcgacagattctcctcccgtagaccgcggaacgaccgtcggaacgctcctccagttcgaaccgagaacaggcttatcgtggagaacctgtctagtagagtaagctggcaagatttgaaagacttcatgaggcaggcaggagaggtgacttttgcagacgcacaccgacccaagttgaacgaaggtgtagtggaatttgctagttatggcgacctcaagaacgccattgaaaagttaagtggtaaggagatcaacggaaggaagatcaagttaatcgaagggtccaaaagacattccaggagccgcagccggtctaggagtaggacacgtagcagctcgcgatcacgaagcaggagcaggagtaggagtaggaagtcctatagtcgctcaagatcccggagtcgttctcgcagcagatcgaaatcccgttcggtgtcgagatcacccgttcccgaaaagtctcagaagcgcggatcttcatcccgctctaagtcaccagcatcggttgacaggcagagatctagatccagatcccgatctagatcggtggactcaggcaattag

SEQ ID NO: 204694 - DNA, 1035 bp, Artificial Sequence
  Description of Artificial Sequence: Synthetic coding sequence
atgccccgggtgtacatcggccggctgagctacaacgtgcgggagaaagatattcaaaggttcttttctggttacggacggttgctcgaagtggatctgaagaatggatacggcttcgtcgaattcgaggactccagggatgccgacgacgcagtttatgaattgaacgggaaggagctctgcggagagcgggtcatcgtcgagcatgctagaggtcccaggcgcgaccgggatggatacagctatggcagcaggagcggagggggaggctacagcagccgtcggacttcaggcagagataaatacggcccgcctgttaggaccgaatatagactgatcgtcgagaacctttcctctcgctgttcatggcaagacctaaaggacttcatgaggcaggccggagaggtgacctatgctgacgctcacaaggaacgaaccaacgagggtgtgatcgagttcaggagctactctgacatgaagagggctttagacaagctcgacggaacagaaataaacggtcgcaatataagattaatagaggacaaaccgcggacgagccaccgccgctcctactctggcagtaggtctcggtccagaagcagacgaagatctcgctccaggtctcgcaggagcagcaggtcccgtagccggtcaataagcaagtcccgttctcgcagcaggtcaaggtccaagggtaggtcccggtcccgttcaaagggtcgcaaatctcgctctaaatccaaatccaagcctaagagcgatcgtggcagccacagccattcgcgaagtcgaagcaaggacgagtacgaaaaatcccgaagtagaagtcgatcgagatcccctaaagagaatgggaagggagatattaaaagtaaatcaaggtcaagatcccagagtcggtctaactcccctcttcctgttccccccagcaaagccagatcagtctcccccccgcctaaacgagccacatcccgctcccgtagcagaagcaggtcaaagagccgcagcagaagccgctctagttcccgcgactag

SEQ ID NO: 204695 - DNA, 717 bp, Artificial Sequence
  Description of Artificial Sequence: Synthetic coding sequence
atgagccggtacggccggtacggcggcgagaccaaggtgtacgtgggcaacctgggcacaggcgccggcaagggcgaattggagcgagctttctcatactacggtcccctacggaccgtgtggattgccagaaatccaccgggcttcgcgtttgtggagttcgaggatccaagggacgctgaagacgccgtgaggggactggacggcaaggttatctgtggcagtagagtccgggtcgaactgtcaacaggtatgccacggagaagccggttcgataggccaccggcgaggaggccgttcgatcctaatgaccgttgctacgagtgcggtgagaaggggcactatgcgtacgactgtcatcggtacagccgccgccgccgctcgcggagcagatctcggagtcatagtagatcccgggggagaagatattcccgttcacgttcccgaagtcgcgggcggcggagcaggagcgccagtccaagacggagtcggtccatttctttaagacgtagtagatctgcctcactccgaagatccagatcaggatccatcaagggcagccgatattttcaatctccctctcggtctagatctcgaagtcgctccatcagtcggccccggtccagccgttcgaaatccagaagtccctcccctaagcggtcgcggagcccatctggctcacctcggcgctccgcctcaccagaacggatggactag

SEQ ID NO: 204696 - DNA, 681 bp, Artificial Sequence
  Description of Artificial Sequence: Synthetic coding sequence
atgagccggtacggccggtacggcggcgagaccaaggtgtacgtgggcaatctgggcaccggtgcggggaagggggaattggagagggccttctcttactacggaccattgcgcacagtgtggatagcgcgcaaccctcccggcttcgctttcgtcgaattcgaggatcctcgcgatgccgaggacgcagtgagaggcctggacgggaaagttatttgcggcagccgcgtgcgggtcgagctgtcaacagggatgcctcggcggtctcggttcgaccgccctccagccaggcggccgtttgaccctaatgaccgatgctacgagtgcggcgagaaaggccactatgcctatgactgtcacaggtacagtcggcgccgtcgtagtagatcacggtcacgctctcacagccgctcacggggaaggaggtattcaaggtctaggtctcggtcccgaggacggcggtcacgcagtgcctcccctagacggagccggtccataagtttgcgcagaagtagaagcgcatccttgagaaggagccggtctggctccatcaaaggcagccgatattttcagagcccgagccgaagccggagtcgctcaagatccatctcacgacccagaagtagcagaagcccatctggatctcccagaaggagcgcatctccagagcggatggattag

SEQ ID NO: 204697 - DNA, 1926 bp, Artificial Sequence
  Description of Artificial Sequence: Synthetic coding sequence
atgaactgggccgccttcggcggcagcgagttcttcatccccgagggcatccagatagacagccgctgtcccctgagtcgaaatataacagagtggtatcactactatggaattgcagtaaaagagagcagtcaatattacgacgtcatgtactccaaaaagggggcagcctgggttagtgaaacgggaaaaaaagaggtctcaaaacagactgtggcctattcaccacggtctaaactgggcaccctcctgccagaattcccaaatgttaaggacctgaacctgccggccagcttaccagaggaaaaggtctcgactttcataatgatgtaccgcactcattgccaacgcatcctggatacggttatcagggccaactttgacgaggtccagtctttccttctgcatttttggcaaggcatgccaccgcacatgttacctgtactgggcagcagcactgtggtgaatatcgtgggcgtgtgcgattcgatactctacaaagctatctcaggggtgcttatgccaacagttctacaggcactgcctgacagcctgacacaggtgattagaaaattcgccaagcagcttgacgaatggcttaaagtggcgcttcatgacctccctgagaatttgcgaaacattaagttcgagttatcaagacgctttagccagattctgcgaaggcagactagccttaatcacctctgtcaggccagcaggacagtgatccattcagcagatattaccttccagatgctggaagattggcggaacgttgacctgaatagtatcacaaagcaaacactgtacacgatggaggacagccgcgacgaacataggaagttaataactcagttgtaccaggagtttgaccatttgctcgaggagcagagcccgattgagagttacatcgaatggctggacacaatggtggatcggtgtgtcgtcaaagtcgccgcgaagcgccaaggctcactcaaaaaggttgcccagcagtttctgctgatgtggagctgctttggtacgagagtgatcagagatatgactctccactccgctcccagctttgggagtttccacttgattcatctcatgttcgacgactatgtgctctatctgctggagtcacttcattgtcaggagcgggctaatgagttgatgcgagcaatgaagggagagggctcgacggccgaggtgagggaggaaattatcttaaccgaagcagcggcaccaaccccgagccctgtgcccagcttttctcccgcaaagtcagccaccagtgtggaagttccccccccaagtagccccgtttctaacccaagccctgaatacacaggcctgagcaccacaggcgccatgcagagttacacctggtcactgacgtacactgttaccactgccgccggaagtcctgcagagaattcgcagcagctaccctgcatgcggaatactcatgtgccctcctccagtgttactcatcgaatccctgtctacccacatagagaggaacatggttacactggctcctataattacggatcatacggaaaccaacacccacaccctatgcaatcccagtaccccgctttgccacacgatactgccatttctggaccgttgcactatgccccataccatcgcagctcagcacaatatccattcaactctcccaccagtcgcatggagccatgcttgatgtcttccactccccgcctgcaccctacacccgtgacacctaggtggccggaagtcccctccgccaatacttgctatacttctccatcagtgcacagcgcaaggtatggcaatagctcagacatgtacacaccgctgaccacaagacgtaactctgaatacgagcatatgcagcattttccaggattcgcctacattaatggcgaggcctcaacaggatgggccaaatag

SEQ ID NO: 204698 - DNA, 2907 bp, Artificial Sequence
  Description of Artificial Sequence: Synthetic coding sequence
atggccttcgccaacttccggcggatcctgcggctgagcaccttcgaaaagagaaagtcccgggaatatgagcacgtgcgcagggatctggaccccaatgaggtctgggagattgtcggcgaactcggcgatggggcttttggaaaagtttataaagcaaagaacaaggaaacaggtgccctggctgccgccaaggtgattgagaccaagtccgaagaggagctggaggattatatagttgagatagagatcctggctacctgcgatcacccatatatcgtaaaacttctcggcgcctattatcacgacggaaagctttggataatgatcgagttttgtccggggggcgcagtggatgccattatgcttgagctagaccgcgggctgacagagccgcagattcaggtggtgtgtaggcagatgttagaagctttaaactttctgcacagcaaacgcattatccatcgcgacctgaaggcgggcaatgtgcttatgaccctggaaggcgacattagactggctgactttggcgtcagcgctaaaaatctgaagaccctgcaaaagcgggatagttttattggtaccccatactggatggcacctgaagtggtcatgtgcgagaccatgaaagataccccttacgattacaaggccgatatttggagtctgggtatcaccttaattgaaatggcacagatcgagccaccacatcacgagctcaatccaatgagggtactcttgaaaatagccaagagcgatcctcctacgctcctgaccccctcaaaatggagcgtggagtttagagactttctgaagatcgcactcgataaaaacccagagactagaccaagcgcagctcagctcttggaacaccccttcgtgtctagcatcacgtccaacaaggcccttagggaactggtggcagaggccaaagctgaggtgatggaggaaatcgaggatgggcgggacgagggtgaggaggaagatgccgtggacgcggcctctactctggagaaccatacccagaactcttcggaggtcagccccccttcgttgaacgcagataaacccctggaggaatccccctctacccccctcgctccttcacaaagccaggactccgtgaacgaaccgtgctctcagccatcaggtgatcgctcactccagactacctccccccccgtcgttgccccgggaaacgaaaatgggttggcggtgccagtccctctgcggaagagccggccagtgtcaatggacgctcggatccaggttgctcaggaaaagcaggtcgcagagcagggaggcgatctgagcccggcagccaatcggtcccagaaggcctcccaaagccgtcccaatagcagtgccctggagacactgggcggggaaaagctggcaaatggatctctagagcccccagcccaggcagcaccgggtccatcgaagagagactcggattgctcgtcactgtgtacctccgaaagtatggattacggcaccaacttgtctactgatctctcacttaataaggagatgggatctctgagcataaaggatccaaagctttataagaaaactctgaagaggacacgtaaattcgtggttgacggtgtggaggtcagcattactaccagtaagatcatcagcgaggatgagaaaaaggacgaggagatgagattcctcaggaggcaagaactgagggaactgcggctcctgcagaaggaggaacacagaaaccagacccaactgtctaataaacatgaactccagctggagcaaatgcacaaacgattcgagcaggaaattaacgccaagaagaagttcttcgacaccgagttagaaaacttggaacgccaacagaaacagcaggtagaaaagatggaacaagatcacgctgtgagaaggagggaggaagctagacggatacgccttgaacaagatcgtgactacactaggtttcaagagcagctgaagctcatgaaaaaggaggtgaagaatgaggtagagaaactgccacgtcagcagcggaaggagtcgatgaagcagaaaatggaagagcacacgcagaaaaagcagctcctggacagagactttgtggctaagcagaaagaggacctggaactggcaatgaagcggcttactactgataaccggcgtgagatatgtgataaagagagggaatgtctcatgaaaaagcaggaactgcttcgcgacagagaggccgcactatgggagatggaggagcaccaattgcaagagaggcaccagctggtaaagcagcagttaaaggaccaatatttcttacagcgccatgagctgttgcgaaagcacgagaaggaacgggagcagatgcagagatataaccagcggatgatcgaacagttgaaagtgcggcagcagcaggaaaaggcacgacttcccaagatacagagatcagaaggtaagacccgcatggccatgtacaaaaagagtctacatatcaacggtggggggtccgctgcagaacagcgggagaaaatcaaacaattcagccagcaggaggagaagcgtcagaagagcgagcgcctccagcagcaacagaaacatgaaaaccagatgcgagacatgctcgcccagtgtgagagcaatatgagcgagcttcaacaactgcagaatgaaaaatgccacctactggtggagcacgagacccaaaagttaaaggccctagacgagagtcacaaccagaatttaaaggagtggagggataagttacgcccccgaaaaaaagctctagaagaggatttaaatcaaaaaaaacgggaacaggaaatgttcttcaagttatccgaggaagcagaatgccctaacccatcaactccttccaaggctgccaaattctttccctattctagtgccgatgcttcatag

SEQ ID NO: 204699 - DNA, 2907 bp, Artificial Sequence
  Description of Artificial Sequence: Synthetic coding sequence
atggccttcgccaacttccggcggatcctgcggctgagcaccttcgaaaaaaggaagagtcgggagtatgaacatgtgagacgcgacctcgatcctaatgaggtctgggagattgtaggcgaattaggagatggggccttcggaaaggtgtataaagcaaaaaacaaggaaactggggctctggcggctgccaaagtgatcgagacaaagagcgaagaggagctggaggattacatcgtcgaaattgagatacttgcaacgtgtgaccatccatacatcgtaaagctactgggagcatactaccatgacgggaaactttggatcatgatcgaattctgtccagggggtgcggtcgatgcaataatgctcgaactggaccgaggcctgaccgaaccgcaaattcaagtcgtgtgtcggcaaatgcttgaggctttgaacttcctgcacagcaagaggatcattcatcgggatctaaaggctggtaacgtgcttatgacgctggagggtgacatccgactggccgactttggagtgagcgcaaagaatctgaagaccttgcagaaacgggactccttcatcggtacaccctactggatggcacctgaggtggtcatgtgtgagactatgaaggacacgccatatgattacaaagcagatatttggtccctgggtatcactctcatcgaaatggcacagattgagccgcctcaccacgagcttaacccgatgagagtgctgttgaagattgcaaagtccgacccacctaccttactcacacccagcaaatggtctgtggaattccgagactttctgaaaatcgccctggataaaaaccctgaaacacgcccttctgctgctcaactgctggagcatccattcgtatccagcatcacgtccaacaaagctcttagagagctcgtcgctgaggcgaaagccgaggtaatggaggagattgaagacggcagggacgagggcgaggaggaagacgccgttgatgccgcctctactctcgagaatcacacgcaaaattcatctgaagtgtctcccccttccctgaacgcagacaaaccactggaagagtcgcccagcacaccgctcgcgccctcacaatcacaggacagtgtaaacgaaccgtgctctcagccatccggtgatcgatctctccagactacctcccctccagtggtggcccccggcaatgaaaacggccttgctgttccagtgcccctcagaaagtcccgacccgtgagcatggacgcgagaatccaagttgcccaagaaaagcaggtggcagagcagggcggggatctgagcccagctgcaaatcggtcccaaaaggcatcacagagccgtcccaacagctccgctctcgagacactggggggagaaaagctcgccaacggtagcttggagccccctgcacaggccgctccagggcccagtaagagagattctgactgcagctctctgtgcacctccgagtcaatggactatggtaccaatttgtcaaccgacctttccctgaataaagagatgggctcgctttctattaaagatcccaaattatacaaaaagacgctcaagagaactcgaaaattcgtggtagacggtgttgaggtgagcattacaacgtccaaaataatcagcgaggacgagaagaaggatgaggagatgagatttctccggagacaggaattgcgcgaattgcgcttactgcagaaggaggaacataggaatcagacacagctatccaataagcatgaacttcagttggaacagatgcataagcgctttgagcaggagatcaacgcaaagaaaaagttttttgataccgagctcgagaatctggaaagacagcagaaacaacaggtcgagaagatggaacaagaccatgccgtacggcgcagggaggaggctagaaggatccgtctggaacaggatagggattatactagattccaagaacaactcaagctgatgaagaaggaagtaaagaacgaagtcgagaagctgccccggcagcagcgtaaggaatccatgaaacaaaagatggaagaacatacacagaaaaaacagcttctcgaccgggacttcgtcgctaaacagaaggaggacctcgagttggccatgaagcgtctgaccactgacaatcggagggagatttgtgacaaggagcgagagtgcctgatgaaaaagcaggagttgctgagagatagggaggcagccctatgggaaatggaagagcaccagcttcaggaaaggcatcagctcgtcaaacagcaactgaaagaccagtattttctccagcgtcatgaactcctgcgcaaacacgagaaggagcgggagcagatgcaacggtacaaccagcggatgattgagcagctgaaagtcagacaacaacaggagaaggctcgtctcccaaaaatccagcggtctgagggtaagactaggatggcaatgtacaagaagtcacttcacattaacgggggaggatctgcggccgaacaaagggagaagattaagcagttcagtcagcaagaggagaaaagacagaagagcgagcgtctgcagcaacagcaaaagcacgagaaccagatgagagatatgctcgcacaatgcgagtctaatatgagtgaactccagcaattgcagaatgagaagtgtcacctgctcgtggaacatgagacacagaaacttaaggctctggacgaaagtcataaccagaaccttaaagaatggagagacaagcttaggcctcgtaagaaggctctcgaggaggatttaaatcaaaagaagcgcgagcaggagatgtttttcaaacttagtgaagaagccgagtgtcctaacccatccacacccagcaaggcggcaaaattcttcccttacagtagtgccgatgcctcttag

SEQ ID NO: 204700 - DNA, 3300 bp, Artificial Sequence
  Description of Artificial Sequence: Synthetic coding sequence
cggttcggcagcgccccccagcggcccgtggccatgaccaccgcccagcgcgactccctcttatggaaacttgccggcctgctgcgcgagtcgggagacgtggtattgtctggttgttcaactttgtcccttttgactcccaccctccaacaactgaaccatgtgtttgagctgcacctgggcccttggggaccagggcagacaggcttcgtggccttacctagccatccggcggacagtcctgtaattcttcagctgcagtttttatttgacgtactgcagaaaacactgtccctaaaactagtgcacgtggcaggacccggcccaacaggtccaattaagatcttcccattcaaaagcctgcggcacttggaattgaggggggtgccactacattgcttgcacgggttacgcggcatctacagccagttggaaacactgatttgttccaggagcttgcaggcccttgaagaactgctgtcagcctgcggcggtgacttctgcagtgcactgccttggctcgcccttctgagcgccaacttctcgtacaacgctctgaccgcccttgactcctcactgcgccttctctccgcgctcagatttctgaacctgagccacaaccaagttcaagattgtcagggtttcctaatggatttatgtgagctgcaccatttggacatcagttacaaccgcttgcatctagtgcccagaatgggtccaagcggggctgcgctgggtgtactgatactccgcggcaatgagctccggtctttacatggtctcgagcaacttcgcaacctgcggcacctcgatctggcatacaacttactagaaggccaccgtgaattaagcccgctgtggctcctcgcagagctcagaaagctatacttggagggaaaccctctgtggttccaccctgagcaccgcgccgccacagcccaatacctcagtcccagggctagggatgctgctacgggctttctgctggatggcaaagtcctaagcctgaccgatttccagactcatacatcactagggctttctccaatgggacctccacttccttggcccgtaggtagcacaccagaaaccagtgggggtccggatctcagcgactccttatctagtggaggtgtggtcacccaaccgctcctccacaaggtcaagtcacgcgtccgcgtgcgccgggcgtcgatctcagaaccctcggataccgacccagagcctcggacacttaacccatctcccgctggctggttcgtccagcagcaccctgagctggagctgatgtcttcttttagggagcgtttcggacggaactggctgcaatacaggtctcacctggagcccagcggtaatcccctacctgccacgcccacaactagtgctccaagcgccccgccagcttcctcgcaggggcctgatacagcccctcgcccctctcccccacaagaggaagcgcgcgggcctcaagagtctccgcagaagatgtccgaggaagttagagccgagccacaggaagaggaggaagagaaggaagggaaggaggaaaaggaggaaggagagatggtcgagcagggagaggaagaagccggcgaggaggaagaggaggagcaagatcagaaggaggttgaggctgagctgtgccggcccttactggtatgcccactcgagggaccagaaggggtccgcggtagagagtgctttttgcgggtgacatcagcgcatttgtttgaggttgagcttcaggctgccagaactctggagcgcctggagctgcagtccctggaagccgccgaaattgagcccgaggcgcaagcccagcgctcaccccgtcctactggttctgatctgttgccaggagctccaatactcagtctcagattcagttacatctgtccagataggcaactcagacggtaccttgttctggagcccgatgcccacgccgccgtgcaggaactcttggccgtgctgactccagtcactaacgtagctagggagcaactaggagaagctcgcgatctgttgctcggcaggttccaatgcctgaggtgtgggcatgaatttaagccagaagaaccgagaatggggctcgacagtgaggaaggctggcggcctttattccagaaaacagaatccccggcggtatgcccaaactgcgggagcgaccatgtggtcctgttggcagtgtcccgaggtacccctaatcgggaacgaaaacagggagagcaaagcctagctcccagcccatcagcctcacctgtatgccatcctccagggcacggggaccacctagacagggcaaagaattcacctcctcaagcaccgagcaccagagaccacggaagttggtccctgtcgcctcccccagagaggtgtgggctacgcagcgtcgatcatcgattaaggctattcctggatgtcgaggtgttttcagacgctcaggaggaatttcagtgctgcctgaaggtgcctgttgcactcgcaggccataccggggagtttatgtgtctggtggttgtgtccgatagacggttatatcttctgaaggtcactggagagatgagggaaccacctgctagctggctccaacttaccctggccgtgcctctgcaggacttatccggtatcgagctggggctggctggacaaagtctgcgtctggaatgggccgctggggccgggcggtgtgtcctgttaccaagagacgctagacactgtcgcgctttcctcgaagaattgctagacgtgctgcagtcactcccacctgcctggcggaattgtgtctctgctacggaggaggaggttaccccacagcatcggttatggccactgctcgaaaaagattcaagtctagaggctcgacagtttttctacctgagggcttttctggttgagggcccaagcacatgtctggtgtctctactgttgaccccctcgactttgtttctcctcgacgaagatgcagcaggtagtcctgccgaaccaagccctccagccgccagtggcgaggcatcagagaaggtgccaccttcgggcccaggacccgcggtccgcgtccgcgagcagcagccactgagcagtctcagctccgtgttactctaccggtcagcacccgaagatcttcggctgctgttttacgatgaagtgtcccgtttagagtctttctgggccctacgagtggtgtgccaggagcagctgacagccttacttgcgtggatccgggaaccctgggaagagttgttctctattgggctgcggaccgtgatacaggaagccctcgccttggatagatag

SEQ ID NO: 204701 - DNA, 1938 bp, Artificial Sequence
  Description of Artificial Sequence: Synthetic coding sequence
cggttcggcagcgccccccagcggcccgtggccatgaccaccgcccagagggattcgctcctgtggaagctggcaggcctgctccgtgaatctggcgacgtggtactcagcggctgctccaccctcagtttattaactcctacccttcagcagctcaaccatgttttcgagctccacctgggaccatgggggcctggtcaaacgggatttgtggcccttccttcccatccagcagacagcccagtgattctacagctgcaattcctgttcgacgttctgcagaaaaccctgtccttgaaactggttcacgtggctgggcccggacccaccggccctatcaagatcttcccttttaagtcccttcggcacttggagttacgcggcgtgcccctgcactgtcttcacggactccgaggaatctacagccaactggaaacccttatttgtagccggagcctgcaggctctcgaggaattgctgtcagcgtgtggcggggacttctgctcagcgttgccctggctcgcgttgctgtctgccaacttttcttataacgccctgacagcattggatagctctctcaggctgttatccgccctgcgattcctgaacttaagccacaatcaagtccaagattgccaaggctttcttatggatctgtgcgagctgcatcacttagatatctcttataatcggctgcatctagtccccagaatggggcctagtggagccgccctcggcgtgctgatcctgcggggcaacgaactgcggtccctgcatggcctcgaacagttgcgcaaccttcggcacttagacctggcctataatcttctggagggtcatagagagttgagtcctctgtggcttctggcagagctgaggaaattcctgcttgatggaaaagtgctgtccctaacagatttccagactcatacgtcactgggcctgagccctatggggcctcctttgccatggccagtgggctctaccccagagacatccggtggcccagatctctcagattccttatctagcggaggggtcgtgacacagcccctattgcacaaagtgaagagccgcgtccgagtgaggagagcttccatctccgaaccatcggacaccgaccccgagccacgtaccctgaacccaagtcccgcaggttggtttgttcagcaacatcccgaactggagctgatgtcctcttttcgcgagcggtttggccgaaactggctgcaatacagatctcaccttgaaccctctggcaacccactgccagcgacaccaaccacatcggctccatcagcgccacccgcgagtagtcagggtccggatacagctccccgcccatctcctccacaagaggaagcgcggggaccccaggaatcaccccaaaagatgtctgaggaggttcgggcagaaccgcaggaagaggaggaagaaaaggaggggaaagaggagaaagaggagggtgagatggtggaacagggagaggaggaagctggcgaggaggaggaggaggaacaggaccagaaggaagtggaagctgagctttgtagacccctgcttgtctgtcccctcgagggacccgagggagtcaggggccgtgaatgtttcttgcgcgtgacctccgctcacctctttgaggtggagctacaggccgcccggactctggagcggctggagttgcagagcctggaagcggcagaaatcgaacctgaggctcaggcccagcggtcacctagacccaccgggtcggacctgttgccaggggcccctatcctatccctgcggttctcctatatctgtccagatcgccagctgcgaagatacctcgttctggaaccagacgcacacgccgccgtgcaggtgatggcccctagagtgggcgcccaagaagcagtcggcataaagcgagccagaggaaagtggcagcaagcatag

SEQ ID NO: 204702 - DNA, 1095 bp, Artificial Sequence
  Description of Artificial Sequence: Synthetic coding sequence
atgcagaagtggttcagcgccttcgacgacgccatcatccagcggcagtggcgggcaaaccccagccgggggggcggcggcgtttctttcactaaagaggtggatacaaacgttgccactggcgccccaccccgtcgccagcgtgtaccaggacgggcctgtccctggagggaaccaattcggggtcgccgcggcgctaggccaggcggaggggacgctggcggcactccgggcgaaaccgttcgacattgctccgcacctgaggatccaatctttcggttttcctctctccacagttatccatttcctggtacgatcaagtcccgtgacatgtcgtggaagagacatcatctgatccccgaaacattcggtgtgaaaagacgtcgcaaaaggggtccagtggaatctgatcctctgcggggagagccaggctccgcaagagcagcagtatcggagttaatgcagctctttcccaggggcctcttcgaggatgctttgccgcctatcgttctgcgctcacaagtgtatagcctggtaccggacaggacggttgctgaccgacagctaaaggaactccaagagcagggtgagatccgaatcgttcagctcggattcgacctggacgctcatgggatcatttttacagaggactacagaactcgcgtgcttaaagcatgtgacggcagaccttatgctggagcagtacagaaatttttagcctccgtgttacccgcatgcggcgatttgtcgtttcaacaggaccaaatgacgcagacctttgggtttagagactccgaaattacacacttggtcaatgccggagtcctcaccgttagagatgccggcagctggtggctcgctgtgcccggcgccgggcgatttataaagtattttgtgaaggggagacaggccgtcctgagcatggtgagaaaagccaagtaccgtgagctgcttttatctgagctgttaggacgccgtgcacctgtggtggtgcggctggggcttacctatcatgtgcacgacctgatcggcgcacagctggtggattgtatctccacgacatcaggaaccctactgcggcttcccgagacatag

SEQ ID NO: 204703 - DNA, 1107 bp, Artificial Sequence
  Description of Artificial Sequence: Synthetic coding sequence
atgcagaagtggttcagcgccttcgacgacgccatcatccagcggcagtggcgcgctaacccatctcgcggggggggaggggtgtctttcaccaaagaggtcgacaccaatgtcgcaactggcgcccctccccggagacagagggtcccaggccgggcctgtccatggcgagagccaatccgtggccgccgaggtgcccgccctggcggcggggatgcgggcgggaccccaggcgaaacagtgagacattgctccgctcccgaggacccaatctttagattttcaagccttcactcctatcctttccctggcacaattaagagccgagatatgtcctggaagcgccatcacctgattcctgagacgttcggggtcaagcggagaaggaagagaggccccgttgagagcgaccccctccggggtgagcccggctcagcccgcgcggcggtgagtgagttgatgcagctcttcccaaggggtctcttcgaggacgcccttcctcccattgtgctacggagtcaggtgtattcacttgttccggaccggactgttgctgatcgtcagctcaaagagttacaggagcaaggagagatccgaatcgttcagctgggctttgacctggacgcccatggtatcatattcactgaagactaccgcacaagagtttgcgactgtgtgctgaaagcttgcgatggtcggccatatgcaggggctgtccagaaattcctggcatccgtgctaccagcttgcggtgacttgtcgtttcagcaagaccaaatgactcaaacctttggcttcagggattctgagattacccatctggtgaatgcaggcgtcctgacagtgcgtgatgccggctcatggtggctcgctgtgccaggggcaggaaggtttatcaaatatttcgtgaaggggaggcaagcagtgctgagcatggtcaggaaggccaaataccgtgagctacttttgagcgagttgcttggcagaagagcgccggtcgttgtgagacttgggctgacataccatgtgcatgatctgataggcgcccagctggtggattgtatttcaacaacgtcaggcaccttactcagattgccagagacctag

SEQ ID NO: 204704 - DNA, 1107 bp, Artificial Sequence
  Description of Artificial Sequence: Synthetic coding sequence
atgcagaagtggttcagcgccttcgacgacgccatcatccagcggcagtggcgcgccaaccctagtcgcggcggaggcggagttagtttcacaaaggaggttgacaccaacgtcgcaactggggccccacccagacgacagagggtccctgggcgcgcttgtccctggagggagccaataagaggcaggcggggcgctcgaccaggcgggggcgatgccgggggaacccccggagagaccgtgaggcactgcagcgctcccgaggaccctatcttccgattcagctctctgcacagttacccatttcccgggaccattaagtcacgcgatatgtcttggaaacggcaccatttaatacctgagactttcggcgttaagcggcgacgcaagaggggccccgtcgaatccgatcccctgaggggtgagccagggtccgcccgcgccgccgtgtccgaattgatgcagctgtttcctaggggcttgttcgaggatgcactcccccccatcgtgctgcggtctcaggtgtacagtttggtgcctgatcggaccgtggcagaccgacaacttaaagagctccaagaacagggcgagatcagaatagttcagctgggattcgaccttgatgcccatggcatcatttttacagaggattacaggacccgggtctgcgactgtgtgcttaaggcctgtgacgggagaccgtatgctggcgcggtccagaagttcttagcatcagtactccctgcttgcggagacctttcattccagcaggatcagatgactcaaacgtttgggtttcgggactctgagataacccacctggttaacgcgggagtacttacggtgagggacgccggctcgtggtggctcgccgtacctggcgccgggcggttcataaaatacttcgttaaagggcgacaagcggtgctaggcatggttcggaaagcaaagtacagggagcttcttctgagcgagttgcttggcagacgtgccccggtcgttgtaaggctgggactcacgtaccacgtgcatgatttgatcggtgcccagctggtagattgcatctccactacgagtgggacactgctgcgcctgcctgagacctag

SEQ ID NO: 204705 - DNA, 1095 bp, Artificial Sequence
  Description of Artificial Sequence: Synthetic coding sequence
atgcagaagtggttcagcgccttcgacgacgccatcatccagcggcagtggcgcgccaatccctcacgcggaggtggcggtgtatcatttacgaaggaagtggacacaaatgtggcaacaggtgcacctccccgccgccagagagttcccggccgcgcctgtccttggcgagagccaatccgcggtaggcgcggtgcccgccctggggggggcgacgcaggagggaccccgggtgaaactgtgcggcactgctccgcccctgaggaccccatcttcagatttagcagcttgcactcttacccttttcccgggacaattaaatcaagagacatgagttggaaacgccatcatctaattccagagacattcggagtcaagaggagacgcaagagaggccccgtcgagagcgatcctcttagaggagagcccgggagcgcgcgggccgcggtatcagaactcatgcaattatttccaaggggtctcttcgaagatgcacttcccccaattgtgctcagaagccaggtctattccttggtgcctgaccgtactgtggccgataggcagctgaaggaactgcaagagcagggcgaaatcaggatcgttcagctaggatttgatctagacgctcacgggataatctttaccgaagactatagaacgcgtgtgctgaaagcttgtgatgggcggccctatgccggggccgtccaaaaattcttagcaagcgttcttccagcttgcggcgacctatcattccaacaggaccagatgacacagacgtttgggttccgagattcagagattactcatttggtaaacgcaggagttctgacagttagggacgcaggctcgtggtggctcgccgtcccaggcgcgggtcgcttcatcaaatatttcgtaaaagggagacaggcagtattggggatggtgcggaaagctaaataccgcgagcttttgctttccgagctgctgggtcgccgcgcacccgtcgtcgtacgactgggcctgacgtaccatgtgcacgatctgataggagcccagcttgtggattgcatcagcaccacctcgggtaccttgctcagactaccagagacttag

SEQ ID NO: 204706 - DNA, 1095 bp, Artificial Sequence
  Description of Artificial Sequence: Synthetic coding sequence
atgcagaagtggttcagcgccttcgacgacgccatcatccagcggcaatggagggccaacccttctcgcggcgggggcggggtgagcttcactaaggaggtagacaccaacgtcgccactggtgctcccccaaggcgccaacgggtgccaggacgcgcttgcccttggcgagaacctatccggggaaggcgtggagctcgccctgggggcggcgacgcaggcggtaccccaggcgagaccgtacgacattgcagtgctcccgaagatccaatctttaggttcagctctctacactcttatccattccccgggactatcaaaagtagggatatgagctggaagcggcaccatcttattccagagacatttggcgtcaaacgaaggcgcaaaagggggcctgtcgaatccgatcccctcaggggagagcccggatccgccagagctgctgtcagtgagctgatgcagcttttcccacgcgggctgttcgaagacgctctgccccccatcgtcctgaggagccaagtgtacagcctcgtgcccgaccggacagtggctgatagacagctgaaggaactgcaggaacagggggagattcgcatcgtccagctgggctttgacctcgacgctcatgggatcattttcaccgaggactacagaacacgtgttctcaaggcctgtgacgggcgcccttatgccggggctgtccagaaattcttagcctcggtattgccagcttgcggcgacctttcattccaacaggatcagatgacacaaacttttggtttccgggattctgaaataactcacctggtgaatgctggcgttcttacggttagagacgcagggtcctggtggctcgctgtgccgggagctggaagattcatcaagtattttgtgaaggggcggcaggccgtcctgtcgatggtgaggaaagccaaataccgcgagcttctcttaagtgaactcctcggcaggcgcgccccagtggtggttcggctcgggctcacgtaccacgtgcatgacctgatcggcgcacaattagtggactgcatttccactacttccggcacccttttgagacttccggagacctag

SEQ ID NO: 204707 - DNA, 1095 bp, Artificial Sequence
  Description of Artificial Sequence: Synthetic coding sequence
atgcagaagtggttcagcgccttcgacgacgccatcatccagcggcagtggagggctaaccctagccgcggcggaggcggcgtctcctttacaaaggaggtagacacaaacgtggctactggggccccccccagacgccagagagtgcctggaagggcatgtccatggcgagagccaatccggggaaggcggggcgcacgccctggtgggggagatgccggcggcactccaggagagaccgtgagacattgtagcgcccctgaggaccccattttccgtttcagttcccttcactcctaccccttcccaggtacaattaagtcgcgggacatgtcttggaaacgacaccacctcatccccgagacgtttggcgtcaagcggaggcgtaagcgtgggcccgtagaaagtgaccctctcaggggcgagccaggctccgctcgcgcggccgtgagcgaattaatgcagctctttccaaggggcctgttcgaagatgccttgccccctattgtcctccggagtcaggtctacagcttggtacccgaccggactgtggcggacaggcagctgaaggaactccaggagcagggcgagatcagaatagttcagctgggtttcgacctggacgctcatggaattatttttacagaggattaccgcacgcgagtccttaaggcatgcgacggacggccctacgccggcgccgtccagaagtttttggcctccgtcctgcccgcctgcggtgatctttcttttcagcaagatcaaatgacacaaacgtttggattcagagacagtgaaattacacatctcgtcaacgctggtgttctcaccgttagagacgcggggagctggtggctggccgtgcctggggccgggaggtttataaaatacttcgttaaggggagacaggcagtgctatccatggtccgcaaagccaagtacagggagctgttactgtccgagttgctgggacgtcgagctcctgtggtcgtaagattgggactaacctatcacgtgcatgacctcataggagctcagcttgttgactgcatcagtactacatctggaactctcctgagactgcccgaaacgtag

SEQ ID NO: 204708 - DNA, 1095 bp, Artificial Sequence
  Description of Artificial Sequence: Synthetic coding sequence
atgcagaagtggttcagcgccttcgacgacgccatcatccagcggcagtggagagctaaccctagtaggggcgggggtggcgtatccttcaccaaagaggtcgacactaacgtggccacaggcgctcctccccgcaggcagagggtgccagggagagcttgcccttggagggaaccaattcgcggccgtcggggcgccagacctggcggtggagatgccggcggtacacctggcgagaccgtcagacactgctccgcccctgaagatcctatcttccgcttcagcagcctccacagttatccattccccggcacgatcaagagtagggacatgagctggaaacgacaccacctcattccagagacctttggtgtcaaacgccggcgcaaaagaggcccagtcgaatcggaccccctacgcggggagcctggttccgcccgagcggcggtgagcgagttgatgcagctgttcccaagaggattattcgaggacgccctcccgcctatagtcctgagatcacaagtgtactccctcgtgcccgacagaacagtcgccgaccgtcagctgaaggagcttcaagagcaaggggaaattcgtatcgtccaactgggcttcgatctcgacgcgcatggtatcatattcacagaagattataggaccagagttttgaaggcgtgtgacggtaggccctacgctggcgctgtgcagaagtttttagcctcagtgttgccggcttgcggggatttatcttttcagcaagaccaaatgacacaaaccttcggcttccgggacagtgagattacccacttagtgaacgccggagtgctgacggtccgcgacgctgggagctggtggttagccgtccctggcgcaggaaggttcatcaagtatttcgtgaagggccgccaagcggtcctatctatggtgaggaaggccaagtatagagagctattgctttccgagttactgggcaggagggcgccagtggtagtccggctagggctgacctaccatgttcatgatctcatcggcgcgcagcttgttgactgtatctctaccacatctggaactctgctgcgcctgcctgagacctag

SEQ ID NO: 204709 - DNA, 1107 bp, Artificial Sequence
  Description of Artificial Sequence: Synthetic coding sequence
atgcagaagtggttcagcgccttcgacgacgccatcatccagcggcagtggcgcgccaaccctagccggggcggcggcggggtgtcctttactaaagaggttgacaccaatgttgccactggggccccacctcgtaggcagcgggtgcctgggagagcttgcccgtggagggaacccatcagagggcggagaggcgctcgtcccggaggcggcgatgcaggtggaacccccggcgaaacagtgaggcattgttcagcacctgaggaccccatttttcggttcagcagtctgcattcatacccttttcccggcaccatcaaaagccgagatatgtcctggaaaaggcaccacttgatccccgagacgttcggcgttaaacgccgtcggaagcgcggtccggtggaaagcgatcctttgcgaggcgaaccaggcagtgctagagccgctgtctccgaactcatgcagttattcccgagggggctgttcgaagatgccctgcctcctattgtgttacgtagtcaggtgtatagtctcgtccccgaccgcactgtggctgaccgccaactcaaagagttgcaggagcagggagagatccggattgtccaactggggtttgatttggatgcgcatggcattatctttacggaggattacagaaccagggtctgcgattgcgtactaaaagcctgcgacggaaggccctatgctggcgcggtgcagaagttcctggcttctgtgttacccgcctgtggcgacctgtcatttcaacaggaccagatgactcaaacctttggatttcgagattccgagattacacatttggttaacgcgggagtgttaacagtgagagatgcaggttcttggtggctggcagtccccggcgctggacggtttattaagtattttgtaaaggggagacaagctgtcctctcaatggtgcgaaaagccaaatatagggaattgctcctttctgagctgctgggacgaagggcccctgtagtggtacgactgggactcacctaccacgttcacgatttaattggcgctcagttagtggactgcatctctacaacaagcgggaccttgctcagactgcccgaaacttag

SEQ ID NO: 204710 - DNA, 1107 bp, Artificial Sequence
  Description of Artificial Sequence: Synthetic coding sequence
atgcagaagtggttcagcgccttcgacgacgccatcatccagcggcagtggcgcgcgaatccatctcgtggcgggggcggtgtgtcttttacaaaagaagtggacactaatgtggccacaggtgcccccccccgacgacaacgagtgcctggcagagcctgcccctggagggagcctataagggggcgccggggcgcacggcccgggggcggagatgcgggcggtacaccgggcgagacggtgaggcactgcagtgccccagaagatccgatctttagattcagttccttgcactcttatccttttcccggcacgattaagagccgcgatatgagctggaagcggcatcatttgatcccagaaaccttcggcgtcaagcggcgccggaaacgcggtcctgtagaatctgatcctctgaggggcgagccaggttcagctcgggcagcagtttcagagctgatgcagttgttcccaagaggcctgttcgaggatgccctgccccctatcgtgttgcgttcacaggtgtatagcctggtgccagaccgcacagttgcagataggcagttaaaagaattgcaggagcaaggggaaattcgcattgttcagctgggatttgatctcgatgcgcatggcatcatattcaccgaggattaccgaacacgagtatgcgactgtgtgctgaaggcgtgtgatggtcgcccctatgccggagccgtccaaaagttccttgcatcagtcctgcccgcatgcggtgatctgtctttccagcaggatcagatgacccagactttcgggtttcgtgacagtgaaattacccacctggtcaatgcaggggtgctgaccgtaagagacgcggggtcctggtggttagctgtgccaggggcgggccggttcattaaatattttgtgaagggtagacaggctgtgttgagtatggtgcgcaaggcaaaataccgggagctcttactttctgagctgctggggagacgggcgcctgtcgtggtgcggctcggtttgacctaccacgtgcacgatctgattggtgcgcagctggttgactgtattagcaccacttctggaacccttctccgccttcctgaaacttag

SEQ ID NO: 204711 - DNA, 1107 bp, Artificial Sequence
  Description of Artificial Sequence: Synthetic coding sequence
atgcagaagtggttcagcgccttcgacgacgccatcatccagcggcagtggcgcgcgaacccatctcgtgggggcggaggcgtgtcctttacaaaagaagtggataccaacgtggccactggggctccgccacgccgccagcgggtgcccgggagagcctgtccatggagggagccaattcgaggccgccggggggcgcgacctggcggaggggatgccggcggcactcctggtgagacagttaggcattgctctgcgcctgaagacccaatttttcgcttttcctcattgcatagctatcctttcccagggaccattaaaagccgggatatgtcatggaagcggcaccaccttatccccgaaaccttcggggtcaaacgtcgccggaagcgggggcccgttgaaagtgatcccttgagaggcgagccgggatcagccagggctgccgttagcgagcttatgcagctgtttccacgcgggcttttcgaagatgccctcccacccatcgtgctgcgctcgcaagtctactctttggtacccgatcggacagtggcggatcgccagttaaaggagctgcaggaacagggcgaaatccgtatcgtgcaactcggctttgacctcgatgcccatggaataatttttactgaagactacaggacccgagtctgcgactgcgtgcttaaggcttgcgacggtcgaccctacgccggcgccgttcagaaattccttgcatcggtgttgccagcctgcggtgatctgagcttccagcaggatcagatgactcagacgtttgggttcagggattctgaaattacccatctggtgaacgctggcgtccttacagtccgcgacgccggaagctggtggctcgccgtgccaggagccgggcgatttatcaagtacttcgtaaaggggagacaggctgtcctgtccatggtcaggaaagcaaaataccgcgaacttcttctgagtgagctgcttggccgtcgggcacctgtggtggtgagactgggccttacatatcacgtgcatgacctgatcggagcccagctggtagactgtatcagcactacgagcggaaccttgctgaggttacccgaaacctag

SEQ ID NO: 204712 - DNA, 1095 bp, Artificial Sequence
  Description of Artificial Sequence: Synthetic coding sequence
atgcagaagtggttcagcgccttcgacgacgccatcatccagcggcagtggcgggccaacccctcaagagggggagggggcgtctccttcacaaaagaggtggataccaacgtggcgaccggtgccccccctaggagacagagggtgcccggcagggcctgcccctggcgcgaacccataaggggccgcaggggagcacgacccgggggcggcgatgccggtgggaccccaggagaaactgtccgtcattgcagcgcgccggaggatcccattttccgcttcagctctctgcatagctacccctttcccggcactataaagagccgagacatgtcctggaaaaggcaccacttaattccagagaccttcggagtgaagcggagaaggaaacgtggacccgtcgaaagcgacccattgcgaggtgaacctgggtctgctagggccgccgtctcagaactgatgcaactgtttcctcggggtttgttcgaggacgcgctgcctccaatcgtgcttcggtcgcaggtctactccttggtgcctgacagaacggtcgctgaccgacagctcaaagaactgcaagaacagggagagatcagaatcgtacagttgggatttgatttggacgcccacgggatcatatttaccgaagattacagaacacgcgtgctcaaagcttgtgatggccgtccatatgccggcgccgtccagaaattcctagcctccgtgttgcctgcttgcggggacttgtccttccagcaagaccagatgacccagacttttgggtttcgggattccgaaattacacacttggtcaacgctggcgtgctgaccgtccgggatgctggcagttggtggctcgccgtgccaggcgcagggagattcatcaagtattttgtgaagggccgtcaagctgtccttagtatggtaaggaaagccaagtaccgcgaacttcttctctccgagctgctcggccgacgcgcgccagtggtcgttcggctgggcctgacttatcatgtacacgatctaataggcgctcagcttgtggactgcatatccacaacatcaggaacacttttacgattgcctgagacatag

SEQ ID NO: 204713 - DNA, 1107 bp, Artificial Sequence
  Description of Artificial Sequence: Synthetic coding sequence
atgcagaagtggttcagcgccttcgacgacgccatcatccagcggcagtggcgcgccaacccctctcggggcggtggcggggttagtttcacaaaggaggtcgatacaaatgtagcaaccggcgcaccaccacggagacagcgagtgcctgggcgtgcatgtccttggcgcgagccaatacggggtagacggggcgcccggcccggtggcggcgacgctggagggacgccaggtgagacagtgcgccactgttcagcacccgaggaccctatctttaggttcagctctctacactcctatccattcccaggcacaattaagtctcgcgacatgtcgtggaagaggcatcatctcatccctgaaacttttggcgtgaagaggagaaggaaaagaggacctgtggagtccgatccactgaggggagagcccgggtccgctagagctgccgtctccgaactgatgcagctgtttccacgggggctgttcgaggacgcgttgcctcccatcgtcctgagaagccaggtatattcgctggtccctgatcggactgttgctgatcggcagttgaaggaacttcaagaacagggagagatccgaatcgtccagctcggctttgacctagatgctcatggcatcatattcacagaggactaccgcacccgcgtgtgtgattgcgtcctgaaggcctgcgacggccgcccctatgcaggcgcagtccaaaaatttctggccagcgtgcttcccgcatgcggagatctcagcttccagcaggatcagatgactcaaacgttcggcttccgagactctgaaataacacacctggtgaatgcaggtgtcctgaccgtgagggacgcaggatcatggtggctggctgttcccggggcaggccgcttcattaagtatttcgtgaaaggacgccaggccgtcttgtcaatggtgagaaaagcaaaatatcgagagctgttactgagcgaactactgggccgacgcgcaccggtagtcgtgcggttgggtctgacctaccatgtgcatgaccttatcggtgctcaacttgtggattgtatatctaccaccagcggcacgctcctgaggctgccggagacctag

SEQ ID NO: 204714 - DNA, 339 bp, Artificial Sequence
  Description of Artificial Sequence: Synthetic coding sequence
atgcagaagtggttcagcgccttcgacgacgccatcatccagcggcagtggagagccaacccttccaggggcggcggaggtgtgtcattcaccaaagaagttgataccaatgtggccacgggggctcctcctcgacgccagagagtcccgggcagagcttgcccttggcgggagcccattcgaggacgtagaggagcccggcccggaggcggcgatgcagggggaacgcccggagagacagtacgccattgttccgcgcctgaggatcctatcttccgtttttcttctctgcactcctatccttttccaggtaccatcaaatccagagacatgagctag

SEQ ID NO: 204715 - DNA, 966 bp, Artificial Sequence
  Description of Artificial Sequence: Synthetic coding sequence
atgctggtgtgcgccagccccccccccctgcccgccctgaccggcttgcgggacgataagctaacccttttgagttcttcaccaggactcggcggcactcctggggagactgtgcgccactgcagcgctccagaggatccaatcttccgatttagcagcctgcatagctatcctttccctggcacaattaagtctcgagatatgtcttggaagagacaccatcttattcctgagactttcggtgtaaaaagacggcgcaaacgcgggccggtggaaagtgatccactcagaggagaaccagggtccgctagggcggccgtcagcgagttaatgcagctctttccgcgtgggttgtttgaggatgcactgccacccattgtgctgaggagccaggtctactctctagtgcctgatcggaccgtcgccgacagacagctgaaggagctccaggaacagggcgagatcaggatcgtgcagctgggctttgacttagacgcccacgggattatttttactgaagactaccgcaccagagtcctcaaggcctgtgatgggagaccatacgcaggcgccgtccagaagttcctagcctccgtgctgcccgcctgcggcgatttgtcgtttcagcaggatcagatgactcagacatttgggttccgagattctgaaattactcacctcgtgaatgcgggagtactgactgtcagggacgccggctcctggtggttggctgtgcctggcgcgggacgatttataaaatacttcgtgaagggcaggcaagcggtgctcggtatggtgcggaaggcaaaatacagagagctcttgctctcagaacttttgggcagacgagctcctgtggtagtacgactgggcctgacctaccatgtacacgatctgattggagcccagttggtcgactgcatttctaccaccagtggcaccctcctccgactccccgagacgtag

SEQ ID NO: 204716 - DNA, 966 bp, Artificial Sequence
  Description of Artificial Sequence: Synthetic coding sequence
atgctggtgtgcgccagccccccccccctgcccgccctgaccggcctgcgcgatgataaattaactctgctaagttcctcaccaggcctcggcgggacacctggcgagacagtgcgccactgcagcgcaccggaggatcccatctttaggttcagcagcttgcattcttatccctttccagggaccattaagagtagggatatgtcttggaagaggcatcatctgatcccagagactttcggcgtgaaaaggaggcgaaagcgaggacctgttgagagtgaccctctgaggggagagccgggctcggcccgtgcggcagtgtcagaactgatgcagctgttccccagaggccttttcgaagacgctctgccaccgattgtcctgcggagtcaggtatatagcctggttccagaccgtaccgtggcagaccgacaactgaaagagctgcaagaacaaggcgaaattaggattgtccaactaggttttgacctggacgcccacgggatcatttttacagaggactatagaactcgcgtactgaaagcctgtgacggacgcccatatgcaggcgccgtgcaaaagttccttgccagtgtgctgcccgcatgtggtgatctcagtttccagcaggaccagatgacacagacttttggttttagggactccgaaatcacacatctggtcaatgctggcgtcctcactgtccgcgacgccggctcctggtggctggccgtgcctggagctggccgtttcatcaagtattttgtcaaaggcaggcaagccgtgctctctatggtgcgtaaggcaaaatatagagagctcctgctgtccgaattgttaggcagaagagcccccgttgtggtgcgcttaggcctaacataccacgtgcatgaccttattggggctcaacttgtagattgcattagtacaacaagcgggaccctgctgaggctcccggagacttag

SEQ ID NO: 204717 - DNA, 966 bp, Artificial Sequence
  Description of Artificial Sequence: Synthetic coding sequence
atgctggtgtgcgccagccccccccccctgcccgccctgaccggcctgcgggacgataagctgaccctgttaagctcaagccctggactggggggtacccctggggagactgtcaggcattgctcagccccagaggacccaatttttagattttccagccttcatagttacccatttccgggtaccattaagagtagagatatgtcatggaagcgccaccatctgatccctgagacctttggcgttaagagaaggcgcaagcgcgggcctgtggagagtgaccccctgagaggtgagcctgggagcgctagagctgccgtgagcgagctcatgcagctctttccaagggggttattcgaagacgccctgccacccatcgttttacgaagccaggtctacagtttggtgcctgatcgaaccgtagcagacaggcaactaaaagagctccaggagcagggagagatccgaatcgttcagctcggtttcgaccttgacgcccacggaatcatctttacggaagactatcgcactcgggtcctgaaagcctgcgatggtcgtccgtacgccggagcagtgcagaagttcctcgcatcggttctgcctgcctgcggagatctcagtttccagcaagatcagatgacgcagacttttggattccgggactccgaaataacccatctggtgaacgcaggagtcctcacagtacgcgatgccgggagttggtggctcgcagtgcccggagctgggaggttcatcaagtatttcgtcaagggccgacaggccgtgctgagcatggtgcgaaaagccaaataccgcgagctgttgttatctgaactactcggtagaagggccccagtggtggtccgactgggtctgacatatcatgtgcatgatcttatcggagcccagctagtcgactgcatctccacgactagcggcaccttattacgcctcccagaaacttag

SEQ ID NO: 204718 - DNA, 966 bp, Artificial Sequence
  Description of Artificial Sequence: Synthetic coding sequence
atgctggtgtgcgccagccccccccccctgcccgccctgaccggcctgagagatgataagctgacactcctgtctagttctcccgggctgggcggcacaccaggcgaaacagttcggcactgtagtgcgccagaggaccctatcttccgattcagctctcttcattcctatccctttcctggaactattaagagtcgagacatgtcgtggaaacgccaccatcttattcccgagacgttcggcgtgaaacggcgcagaaagcgcgggcccgtggagagtgaccccctgcggggcgaacccggtagcgcccgtgcggccgtgagtgagctcatgcagctttttccccggggactgtttgaggacgctttaccccccatcgtgctgcgctctcaggtttactcattagttcccgatagaacagttgcggaccggcagctgaaggagctccaagagcagggggaaattcggatagttcaacttggtttcgacctggacgcccatgggatcatctttaccgaggattaccgcaccagggtgctgaaggcttgcgatgggcggccatatgccggagccgtgcagaagttcctcgcttcagtgctccccgcatgcggagacctgagctttcagcaggaccagatgacccagacttttgggttcagggactcggaaataacacatctcgtcaacgctggagtgctgactgttcgagatgcaggaagttggtggctggctgtgccaggagccggtcggtttataaagtattttgtgaaaggtcgccaagccgtgttgagtatggtaaggaaagctaagtacagggaactgctgctgtctgaattgttagggcggagagcccccgtagtggttcgactgggcctcacctaccatgtgcacgatcttattggagcgcaattagttgactgcattagcactacctctgggactctactccgactgcctgagacttag

SEQ ID NO: 204719 - DNA, 966 bp, Artificial Sequence
  Description of Artificial Sequence: Synthetic coding sequence
atgctggtgtgcgccagccccccccccctgcccgccctgaccggcctcagagacgataagttgaccttactgagctcatctcctggcttgggtggaacacctggggagacagtccgacattgtagtgcacccgaggatcccatctttcgcttttcatccctgcattcttaccctttccctgggacgatcaagtcaagagatatgagctggaaaaggcaccatctgattccagagacattcggcgtgaagaggcggagaaagcgggggccagtcgaatcagaccctctccgaggcgaacccgggagtgcgcgggctgcagtttctgaattgatgcaactgttccctcgcggcttattcgaggacgcactaccaccaatcgtgctgaggtcccaagtgtactctttggtgcctgaccggaccgttgcagaccgccaactgaaggaactgcaggaacagggggagatcagaatcgtacagctgggattcgatctggatgcccacggcatcatattcacagaagattaccggactagggtgttgaaggcctgcgacggcaggccctacgccggggctgtgcagaaattccttgcgagcgtgttaccagcatgcggtgatctatcctttcaacaggatcagatgactcagacatttggctttagagatagcgaaataacacacctggtcaatgctggcgtattaacagtcagagatgcgggatcttggtggttggcggtgccaggtgctggccgctttattaagtacttcgtcaagggccgtcaggccgttctcagcatggtgcgaaaggccaagtaccgtgaactgctcctcagcgaactcctggggcgtcgggccccagttgtggttcgcctgggactgacctatcacgtccacgacctgatcggcgcccagttggttgactgtattagtacaacctctggaacactgttgcgccttccagaaacttag

SEQ ID NO: 204720 - DNA, 1320 bp, Artificial Sequence
  Description of Artificial Sequence: Synthetic coding sequence
atgcagaacctgaaggccgaccccgaggagctgttcaccaagctggagaagataggcaaaggcagcttcggcgaggtttttaagggtatagacaacaggacacagaaagtggtcgccatcaagattatcgatctcgaagaagctgaagacgaaatcgaggacatacagcaggagatcacggtgctttctcagtgcgattccccatacgttactaagtactacggctcttatttgaaggacacaaagctgtggattatcatggaatacctaggcggcggctccgccctcgacctgttggagccgggaccccttgacgagacccagatagctacaattttgcgggagatcttgaagggtctcgattaccttcacagtgagaaaaaaattcacagagacataaaggctgccaatgttctgctgagtgaacatggagaggtcaaactcgccgatttcggcgtggctggccagctgaccgacacccagatcaaaaggaatacattcgtgggcacaccattctggatggccccggaagtgattaaacagagcgcctacgactcaaaggccgatatctggtctctgggcattacagctatcgagcttgcacgaggtgaaccacctcacagcgaactccaccctatgaaagtcctctttctgattcccaaaaacaaccctccaacactggaggggaattattctaaaccactgaaagagtttgtcgaagcatgcctcaacaaggagccatctttcaggccgaccgccaaggagctgctaaaacacaagttcattttacgcaatgctaaaaaaaccagctacctaaccgaactgatcgatcgctataagagatggaaggccgaacaaagccacgacgacagctcctctgaggactctgacgccgaaactgatggccaggcctcaggcggcagcgactcgggcgactggatctttacaatccgagagaaggaccctaagaacctcgaaaatggagccttgcagccttccgaccttgatcggaacaaaatgaaagacatcccaaagaggccttttagccagtgcctgtctaccatcatctcacctctgtttgcggagcttaaggaaaagtcccaggcttgcggagggaacctgggaagtatagaggaactcaggggggctatttatttggctgaggaagcttgtccaggcataagcgataccatggtggcccagctcgtccagcgccttcaaaggtccattcacggcaatcaggcacccccggactgccaccttgcacaagtgcaagctttcggaggaagcgggtgtgttctggggagccggagcgtgtag

SEQ ID NO: 204721 - DNA, 672 bp, Artificial Sequence
  Description of Artificial Sequence: Synthetic coding sequence
atggcccccgaggtgatcaagcagagcgcctacgacagcaaggccgacatctggtctctcggtatcactgccattgaactcgcgcgaggggaaccaccacactccgagctacatcccatgaaagttcttttcttgattccaaaaaataatccgcccacacttgagggaaattacagtaagcccctgaaagaattcgtggaagcttgccttaacaaagagccatcttttcgccctaccgctaaagagctgctgaagcataagttcatcctccgtaacgccaaaaagacctcgtatctgactgagcttattgaccgctacaaaaggtggaaagctgagcaatcccacgacgactcctctagtgaggactccgatgccgagaccgatggccaggcgtctggaggcagtgacagcggcgactggatctttacaatcagggagaaagaccctaaaaacttagaaaacggcgcccttcagccctctgacctggatcgcaacaaactgaaggagaagtcgcaggcatgtgggggcaatcttggctcaatcgaagagctaaggggcgcaatctacttggctgaagaagcttgccccggcatttccgataccatggtcgcccagttggtacagaggctgcagcggtattccctgtccgggggaggaacatcgagtcattag

SEQ ID NO: 204722 - DNA, 1332 bp, Artificial Sequence
  Description of Artificial Sequence: Synthetic coding sequence
atggacagccgggcccagctgtggggcctggccctgaacaagcggcgcgccacgctcccccaccctggcggaagcacaaacctgaaagcagaccctgaagagttgtttaccaagctggaaaagatcggaaagggttctttcggggaagtttttaagggaatagataaccggacacaaaaggtggtcgcgattaagattattgacctggaggaggccgaagacgagatcgaagatatacaacaggaaattactgtcctgagccagtgcgattctccctacgtaacaaaatattacggaagctacctgaaagatactaagctttggatcataatggaatacctgggcgggggctctgcacttgatctgctggagcctgggcctctggatgaaacacagattgccaccatccttagagagatcctcaaaggactcgactatctgcacagtgaaaagaagatccatcgggatattaaagctgctaacgtgctgttgagcgaacatggggaagtgaagctggctgattttggagtggcgggccaactcactgacacccagatcaaaaggaacaccttcgtgggcacaccgttttggatggcaccagaggtgataaaacagagtgcttacgatagcaaagcagatatatggtcactaggaataactgccatcgagctggcccgtggagagcctccccactccgaactgcatcctatgaaggtgctgtttctgattccaaaaaacaatccgccgactcttgagggcaactactcaaaacccctgaaggagtttgtggaggcttgcctgaataaagagccgtcttttcggccaacagcaaaagagctgttgaagcacaagtttatcctgcgcaatgccaaaaagacctcttatctcacggagctgatcgacaggtataaaagatggaaagcagaacaatcacatgacgatagttccagtgaggacagtgatgcagagaccgatggccaggcctctggtggaagcgactcaggcgattggatatttacaatccgcgagaaggatcctaaaaatctggaaaacggagcacttcagccatctgatttagacagaaataagatgaaagatattccaaagcggcctttttctcaatgcctcagcactattatctcaccactctttgccgagcttaaggaaaagagtcaagcttgcggtggcaatttagggtcaattgaagagctcaggggcgctatctacctggcagaagaagcttgtcctggaatcagcgacaccatggtggcgcagcttgtgcagaggctgcagcggtactcactgtcggggggaggcacctcttcccactag

SEQ ID NO: 204723 - DNA, 1296 bp, Artificial Sequence
  Description of Artificial Sequence: Synthetic coding sequence
atggcccacagccccgtgcagagcggcctgcccggcatgcagaacctgaaggccgatccagaggagctctttacaaagttggaaaagatcggcaaaggtagtttcggagaggtttttaagggtatcgacaaccgcacacagaaggtggtggcaataaagatcattgatctggaagaagccgaggacgaaatagaggacattcagcaggagatcaccgtgctgtcccagtgcgactccccgtatgttaccaaatattatggatcttacctcaaagacacgaaactctggataataatggagtatctcggcggaggaagtgccctcgacctgctggaacctggccctctggatgagacccagatcgcgactattctacgcgagatcctgaaaggcctggactatctccactcagagaaaaaaatccaccgggacattaaggctgccaatgtgctgctgtccgagcacggagaggttaaacttgccgactttggggtggcaggccagctgaccgatactcagatcaagagaaacactttcgtcggcactcctttctggatggccccagaagtgatcaaacaaagcgcctatgactcaaaagctgatatctggtcattggggattacagccatcgagttagcaaggggcgaacccccacatagcgagcttcaccccatgaaggttctgtttttaattcccaaaaataaccccccgacattggagggcaattactcaaagccactgaaagaattcgtggaggcctgcctgaacaaggagccctcgtttcgtccaacggccaaagagttactgaagcacaagtttatcctcagaaatgctaaaaaaacctcatacttgactgagctgatcgatcggtacaaacgctggaaggccgagcagagccacgacgactctagttctgaagattccgacgccgaaactgatggtcaagcctctgggggatcggactcaggagattggatttttaccatccgggagaaagaccccaagaacctggagaacggcgctctccagccatcagatttagataggaacaaaatgaaggatattcccaagagaccatttagccagtgcctgagcaccatcataagcccactcttcgcagagctgaaggaaaaatctcaggcttgcggcgggaatctcgggagcatcgaggaactcaggggggcgatttacttggcagaagaagcatgtcctggcatcagcgacacgatggtggcccaactggtacagcgacttcagagatatagcctaagtggaggtggtacgtctagccactag

SEQ ID NO: 204724 - DNA, 1239 bp, Artificial Sequence
  Description of Artificial Sequence: Synthetic coding sequence
atggcccacagccccgtgcagagcggcctgcccggcatgcagaacttgaaggccgatccagaagaattgtttaccaagttggagaagatcgggaagggcagcttcggggaggtgtttaaaggcatcgataaccgcacccagaaagtggtggctattaagatcattgacttggaagaggcggaagatgaaattgaggatatccaacaggagattactgtgctgagccaatgtgatagcccttacgtcacgaagtactatggctcttacctcaaacttgaacctgggccacttgacgagactcaaatcgccaccattttgcgcgagatcctgaaagggttagactaccttcatagtgaaaagaagatacaccgagatattaaggccgccaacgtcctcctgagtgaacatggagaggtgaagctagctgatttcggcgtggcgggccagctgacagatacgcagatcaaacgcaacaccttcgtaggtactccattttggatggcgccagaggtaattaagcaatccgcctatgatagtaaggcggatatctggtccctggggattacggcaattgaactagcgaggggtgagcctccacattcagaacttcaccctatgaaagtcctgttcctgattccaaagaataacccaccgaccctggaagggaattactctaagcccttaaaagaattcgtggaggcctgtctaaataaagaaccctcattccggcccaccgccaaagagctcctcaagcataaattcatcctgcgtaacgctaaaaagacctcgtatctgaccgagctaatcgacaggtacaaaaggtggaaagcagagcagtctcatgacgactcctccagtgaggatagcgatgctgaaaccgatggtcaggcatccggagggtccgactccggtgactggatctttaccattagagaaaaagatccaaagaaccttgaaaacggcgctttacaaccatctgaccttgataggaataagatgaaagacatccccaaacgacctttctctcagtgcttaagtactatcattagtccgctcttcgctgagttgaaagagaaatcccaggcttgcggcggcaacctgggctctatcgaggagttgcgaggcgccatctacctggctgaggaggcttgcccgggcatttcggacacaatggtggcccaactcgtgcagagacttcagcgatacagtctgtctgggggggggacgtccagccactag

SEQ ID NO: 204725 - DNA, 1029 bp, Artificial Sequence
  Description of Artificial Sequence: Synthetic coding sequence
atggcccacagccccgtgcagagcggcctgcccggcatgcagaacctgaaggcggacccagaggaactctttaccaaactggagaaaatcggaaagggatcgtttggcgaagtgttcaaaggcatcgacaataggacccagaaagtcgtcgccattaagattatagatttggaggaagctgaagatgaaatcgaagatatccaacaggaaattacagtcttgtcccagtgcgactccccctatgtaaccaaatactatggcagctatctgaaggataccaagctctggataatcatggaatatctgggcgggggatctgcgctggacttacttgaacccgggcccctcgatgagacgcagattgcgacgatcctccgcgagatcctgaagggactggactatttacactccgaaaagaaaatccacagggatatcaaagctgccaatgtgctcctgagcgaacatggggaagttaaattagctgatttcggggtggctggtcagttaactgatacacagattaaaaggaatacgttcgtgggaactcctttttggatggctcctgaggtcatcaagcagtccgcttacgattccaaagcagacatttggtctctcggaatcaccgctattgagctcgcccgcggtgaacctccacacagtgaattgcatccgatgaaggtccttttccttatccctaaaaacaaccctcccacattggagggaaattactcgaagcctctgaaagaatttgttgaagcctgtctgaacaaggaaccttccttccggcccaccgctaaggagctgcttaagcacaagttcatcctcaggaatgctaagaagacctcttacctaacagagctgatcgataggtataagcgctggaaagccgagcaatcacacgacgattcatcttccgaggacagcgatgccgaaaccgatggacaggcttctggaggatcagactcaggggattggatctttacaataagggaatggagtagttcagccataggcttgggacagaagtag

SEQ ID NO: 204726 - DNA, 2991 bp, Artificial Sequence
  Description of Artificial Sequence: Synthetic coding sequence
atggacgaggacacccactacgacaaggtggaggacgtggtgggcagtcacatcgaagacgccgtaaccttttgggcccaatctatcaatagaaacaaagacatcatgaagatcggatgtagcttgtctgaagtctgtccacaggcatctagtgttttgggaaacttggatcccaacaaaatttatggggggctgttttctgaggatcagtgttggtaccgttgtaaggtgctgaagatcatctcagtggaaaagtgcctggtgagatatatagactatggcaacaccgaaatattgaatcgttcagatattgtagagattccgctggagcttcagttttcttccgtcgccaaaaagtacaagctgtggggattacacataccctcagaccaggaggtgacccagttcgatcaaggaaccacattcctcggcagcctcatcttcgaaaaggagattaaaatgcggataaaggccactagcgaggacggcacagtcatcgctcaggccgaatatgggagcgtggacatcggagaggaggtgctcaaaaagggattcgctgaaaaatgtcggctggcttcaaggactgatatctgtgaagaaaagaaactggaccctggccaactagtgctccggaacctgaagtctcccatccctttgtggggccatcgcagcaaccaatctaccttcagccgtccaaagggccacctctccgaaaagatgactctggatctaaaagatgagaatgacgctggtaacctgatcacatttcctaaggagtcacttgccgttggagattttaacctgggcagcaatgtgagtctggagaagatcaaacaggatcagaaacttatcgaagaaaacgaaaaactaaagacagagaaggatgctttgctcgagagctataaagcacttgagctaaaggttgagcagatcgctcaggaactccagcaggagaaggctgcagctgtggacctaactaaccacctggagtacacactgaagacttacatcgacacacgtatgaagaacttggccgccaagatggaaatcctgaaagaaatgcggcatgtcgacatatccgtacgcttcgggaaggacctgtccgacgcaatccaagtgcttgacgagggatgctttaccacccccgccagtttgaatggccttgaaatcatctgggctgagtacagcctcgcacaggaaaatatcaaaacctgcgagtatgtgagcgaagggaatatcttgatagcgcagcgcaacgaaatgcagcaaaaattgtatatgagcgtagaagacttcatcctagaggtcgatgagtcatctctaaataagcggctcaaaaccctgcaggacctgtccgtgtctctggaagccgtgtacggccaggctaaggagggcgccaattcggatgaaattctgaagaaattttatgactggaagtgcgataagcgtgaagaatttacctctgtgcgtagcgaaacagacgcgtctttgcacaggctggtcgcctggttccagcgcaccctaaaagtgtttgatctgtctgttgagggcagtttgatctcggaagacgccatggacaacattgacgagattctggaaaaaaccgaatcttcagtgtgcaaggagctagaaatcgcactcgtggatcagggcgacgccgacaaggagatcatctcaaatacttactctcaggtgcttcagaagattcactccgaagagcggctgatcgcaacggtgcaggcgaagtataaggactccatcgagttcaagaagcagctgatcgagtacctgaacaagtcaccatccgttgaccaccttctgtcaatcaagaagacattgaaatccctgaaagcgcttttgcggtggaaattggtggagaagtcaaacctggaggagtctgatgatcctgacggttctcagatagagaagattaaggaggagatcactcaactgcggaacaacgtgttccaggaaatttatcatgagcgcgaggagtacgaaatgctcactagcttggcccagaaatggtttcccgaacttccactcctgcacccagagatcggactcctcaagtatatgaacagcggtggccttttaactatgtcactcgagcgggatcttctcgacgccgagccaatgaaagagctttcctccaaacggcctctcgtgcgcagtgaggtgaacggacaaataatcctgttaaagggttactcggtggatgtcgacacagaggcaaaagtgattgagcgagctgcaacctaccaccgcgcttggagagaggctgagggcgattctggcctgttacctctgatattcctctttctttgcaaaagcgatcctatggcgtatttgatggtgccgtattacccacgcgctaacttgaatgctgtgcaagccaacatgcctctcaacagtgaggagacgctgaaggtgatgaagggcgtggctcaaggcttacacaccctccacaaagctgatattattcatgggagcctgcatcaaaacaatgtattcgcgctcaacagggagcagggcatcgttggagatttcgacttcacaaagagtgtttcccaaagggcctccgtcaacatgatggtaggggacttgagcctgatgagcccagaactgaaaatgggcaaaccagcttcaccaggtagtgacctctatgcttatggttgcctgctcctatggctctctgtccagaaccaagagtttgagatcaataaggacggcatccctaaagtggaccagttccacctcgacgataaagttaaaagcctgctgtgttccctgatctgttacaggagctccatgaccgcagagcaggtcttaaatgctgagtgctttttgatgccaaaagaacagtcagtccccaaccctgagaaagataccgagtatactctctacaaaaaggaggaggaaattaaaacagagaatctggacaagtgcatggagaagactcgcaatggcgaggctaactttgactgttag

SEQ ID NO: 204727 - DNA, 3060 bp, Artificial Sequence
  Description of Artificial Sequence: Synthetic coding sequence
atgtgggtgcagggccacagcagccgggccagcgccaccgagagcgtgtccttctctggtatcgtgcagatggatgaggatacccattacgacaaggtcgaggacgtggtcggttctcatatcgaggacgcggtgacattttgggctcaaagtatcaaccgcaacaaagatatcatgaaaatcggatgctccctgtcagaagtctgcccccaggcctcatctgttcttggcaacctggacccgaacaaaatctacggagggctgttcagtgaggaccagtgctggtatcgctgtaaggtgctgaagatcatatctgtggagaaatgtctggtaaggtacatcgattacggcaacacagaaatcctaaatcggagcgatatcgtggaaatcccattagaactgcagtttagctcggttgccaaaaaatacaaactttggggcctccacataccctccgaccaagaggtgacacaatttgaccagggcacaacctttttaggcagtctgatcttcgagaaagaaataaagatgcgaatcaaggctacttcagaggacggtacagttatcgcacaggcagagtacggcagcgtggatataggagaggaggtgctcaagaagggatttgccgaaaagtgccgcctcgcgtcccggaccgatatttgtgaagaaaagaagctggatccagggcagttagtgctacgtaatctgaagtcgccaatcccactgtggggtcatcgatccaaccaatcaacattcagtagacccaagggccatttaagcgaaaagatgactctggatctgaaagatgagaacgatgcaggcaatctcattacattcccaaaggagtctctcgccgtaggcgacttcaatctgggctcaaatgtctctctcgagaagatcaaacaggatcagaagttaattgaggagaacgagaaactgaaaacggaaaaagatgcactgctggagtcttacaaagcacttgagctgaaagtcgagcaaatcgcccaggaactgcagcaggagaaggctgccgccgtggatctcacaaaccacctggagtatacccttaaaacctatattgacacgcgaatgaagaatctggccgccaaaatggaaattcttaaagagatgcggcacgttgacattagtgttcggtttgggaaagatttaagtgacgccattcaggtcctcgatgaaggatgctttactaccccggcctctctcaatggcctggaaattatctgggccgaatattctctcgcacaggagaatattaagacttgcgaatatgtcagcgagggcaacatcctcatcgcccagagaaatgagatgcagcagaaactgtatatgtcggtggaagatttcatactggaggtggacgagtcatcgctgaataagcgactgaagactctccaggatctgtctgtctccttagaggcagtgtacggtcaggctaaggagggcgctaactcagacgaaattctgaaaaagttctacgactggaagtgcgataaaagagaagagttcacgagcgtgagaagcgaaactgatgcatctctgcaccgtttggtggcttggtttcagagaaccttgaaagtgtttgacttgtcggtcgaaggcagcctcataagtgaagacgccatggataatatcgacgagatcttagagaagacggaatcatctgtctgtaaagaactggaaatagccctggtcgatcagggagatgccgataaagagattattagcaacacatattctcaggtgctccagaaaattcactcagaggaacgccttatcgcaacggtgcaggcaaagtacaaagactccattgagttcaaaaaacagctcattgagtatctgaacaagagtccctctgtggaccacctgttaagcatcaaaaagactctgaaatccctgaaggcgctgctccggtggaagctggtcgagaagtcaaatcttgaagagtccgatgaccccgacggaagtcagatcgaaaagatcaaggaggagataacgcagctgagaaataacgtgttccaggagatctaccacgaacgcgaggaatacgagatgcttacgtccctcgcccagaaatggttcccggagctcccattgctccatcctgagataggactgctaaagtatatgaacagtgggggattgttaacaatgtcacttgaacgggacttactggacgctgagcctatgaaggagcttagcagcaagcgacctcttgtgcggtcagaagttaacggccagataatactcctcaagggatactccgttgatgtagataccgaggcgaaggtgattgaaagagccgccacctaccatagggcctggagagaggccgagggcgattccggtctgctgcccctcattttccttttcctttgtaagagtgaccccatggcctatcttatggtgccatattacccccgggctaatctgaatgccgttcaggccaacatgcctctcaattcagaggagaccctcaaagttatgaaaggcgttgcccaagggttgcacacactccataaggctgacattatacatgggtccctccaccagaataacgtcttcgctctgaaccgcgaacagggaatcgtgggagattttgactttactaaaagcgtctcgcagcgggcgtcggtgaatatgatggtgggagatctgtctctaatgtctccagagctgaagatgggaaagcctgcaagtcccgggtcagatctgtatgcctatggttgtctgctcctttggctgtccgtccagaatcaggaatttgagattaataaagacgggataccaaaagtcgaccagttccacctggatgacaaagtgaagagcctgctttgtagcctaatatgttatcgatcttcgatgaccgccgagcaggtgctgaatgctgagtgcttcctcatgccaaaagagcagtcagtgccgaaccccgaaaaggacactgagtacacactgtacaaaaaagaagaagagatcaagaccgagaacttagataagtgcatggagaagacacggaatggggaagccaattttgactgttag

SEQ ID NO: 204728 - DNA, 2991 bp, Artificial Sequence
  Description of Artificial Sequence: Synthetic coding sequence
atggacgaggacacccactacgacaaggtggaggacgtggtgggctcccatatagaagacgccgttacgttctgggcccagtccatcaaccgcaacaaagacatcatgaaaatcggctgcagcctttccgaagtctgtccccaggctagctccgtcctgggaaatctggaccctaacaagatctacggtggacttttttctgaagatcagtgctggtaccgatgtaaggtccttaagatcatatctgtcgaaaaatgcctagtccgctacatcgattatgggaatacggagattcttaacaggagtgacattgtggagattccactagagctgcagttcagctcagtggccaagaaatataaactatggggcctgcatattccttctgatcaggaagtgactcagttcgaccaggggacgacctttctcggaagccttatattcgagaaagagattaagatgaggatcaaggctacttctgaggatgggacagtaatcgcccaggctgaatatggcagtgtagacatcggggaggaagtcctaaagaaagggtttgccgaaaagtgcagactggcaagccgaaccgacatctgcgaggaaaagaaattggacccaggccagttggtgctacgcaatctgaagagtccgatacccctgtggggccatcgatctaaccagagcacgtttagtcgacctaaaggacaccttagtgaaaagatgacattggacctgaaagatgagaacgacgccggcaatctgatcaccttccccaaagagagtttagcggtgggagatttcaatctaggctccaacgtttccttggaaaagataaaacaagatcagaagctaattgaagagaatgagaaacttaagacggagaaggatgcgctcttagagtcatacaaggccctcgagctgaaagtcgagcagattgctcaggagttgcagcaggagaaggccgccgctgtcgacctcactaatcaccttgaatatacattgaaaacctacatagacactagaatgaaaaatctggccgctaaaatggaaatcttaaaggagatgagacatgtggatatttccgtccgctttggcaaggatctgagcgatgcgatccaagtgctggacgaaggatgttttacaactccagccagtctcaacgggctggagatcatttgggccgagtactccttggcacaggagaatatcaaaacttgtgagtatgtctcagagggaaacatcctgatcgcccagcgcaacgaaatgcagcaaaaactgtacatgtccgtggaagatttcatcctggaggtggacgaatcttcactgaataagcggctcaagacattgcaggatttgtccgtgtcattggaggccgtttatgggcaggcaaaagagggcgccaatagcgacgagatattaaagaagttttacgattggaaatgcgataaacgggaggagtttacgtctgtccgctcagagaccgatgcatcgttgcatagactggttgcgtggtttcagcggaccctgaaagttttcgacttgtcggtggaggggagcctgatatccgaggatgctatggacaacattgacgaaattctggaaaaaacggaatccagtgtctgtaaagaacttgaaatcgccctggtggatcaaggtgatgcagacaaagaaatcatttccaatacttattctcaagtgctccagaagattcacagcgaggaaagattgattgcaaccgtgcaggcaaaatacaaggactcaattgagttcaaaaagcaacttatcgaatacttgaacaagagcccgagtgtcgatcacctgttatccatcaaaaagaccttgaagtcactgaaagctctattgcggtggaaactggtagaaaaatccaatctggaggagtcggatgacccggatggaagtcagatcgaaaagatcaaggaagaaattacacagctccgaaacaacgtgtttcaagagatttaccacgaacgggaagaatacgagatgcttaccagcttggcacaaaagtggttcccagagttgcccctactgcacccagaaatcggcctgttgaagtatatgaactcaggtgggttgctcacgatgtccctggaaagagatttattagatgccgagcctatgaaagagctgtcttcaaaaagacctctggtgaggtccgaggttaacggtcagatcatcctactgaaggggtattcggtggatgttgacaccgaagctaaggtcatagaacgggcggctacatatcacagggcttggcgggaggcagagggagactcagggctgctcccactcatctttctcttcctctgtaagtccgatcctatggcgtacttgatggtcccttactacccaagagcaaaccttaatgcagtacaggcaaatatgccgttgaattctgaagaaaccctcaaggtgatgaaaggagtggcacagggactccacactttacacaaggctgacataatccacgggagtcttcaccaaaacaacgtgttcgcactcaaccgggagcagggaatcgttggcgactttgattttaccaagtctgtttcccaacgagcttccgtgaatatgatggtgggtgatctgagtctgatgtctcctgaactgaagatgggtaagcctgccagccccgggagtgacctgtacgcctatggctgcctcttgttatggctcagtgtccagaaccaggaatttgagataaataaagacggcattccaaaagtcgatcaattccatcttgatgataaagtcaaatccttattatgtagcttgatttgctataggtctagtatgactgccgaacaggtgctgaatgcggaatgctttctgatgcccaaagagcagagcgtgcccaatcctgaaaaggacactgagtatactctgtacaagaaggaggaagagatcaaaactgagaacctggataagtgcatggagaagactcgcaatggcgaagcaaattttgattgctag

SEQ ID NO: 204729 - DNA, 285 bp, Artificial Sequence
  Description of Artificial Sequence: Synthetic coding sequence
atggacgaggacacccactacgacaaggtggaggacgtggtgggcagtcacattgaagacgccgtcaccttctgggcacagtctattaaccgcaacaaagacataatgaaaatcggttgctctctttctgaagtgtgccctcaggcaagctccgttctggggaacttagacccaaataagatctacggcggtcttttcagtgaggaccaatgttggtatcggtgcaaagtactcaaaattattagtgttgaaaagtgcctggtgaggtatatagactatggatag

SEQ ID NO: 204730 - DNA, 132 bp, Artificial Sequence
  Description of Artificial Sequence: Synthetic coding sequence
atggacgaggacacccactacgacaaggtggaggacgtggtgggctctcacatagaggacgccgtcaccttttgggcacagagcattaaccgtaacaaagacatcatgaagatcggatgctccttgagctag

SEQ ID NO: 204731 - DNA, 2991 bp, Artificial Sequence
  Description of Artificial Sequence: Synthetic coding sequence
atgtgggtgcagggccacagcagccgggccagcgccaccgagagcgtctctttctcgggaatcgtgcaaatggatgaagacacccattacgacaaggtagaggacgtggtggggtcacacattgaggacgcggtgacattctgggctcagagcataaacaggaacaaggacataatgaagattggctgctctctcagcgaggtatgtcctcaggcgtctagtgtgctgggaaatttggaccctaataaaatatacggcggcttgttctcagaggatcaatgttggtatagatgtaaagtgctgaaaatcattagtgttgaaaagtgccttgtgcgatacattgattatggaaacaccgaaatactaaacaggtccgacatcgtggagatccccctggagttgcagttctcatccgtggccaagaaatataagctttggggcctacatatcccctctgaccaggaggtgacacagtttgatcagggcacgactttcctcgggagccttatctttgagaaggagattaaaatgaggatcaaagctacctcagaagacgggaccgttatagctcaggctgaatatggtagcgtagatatcggggaggaagtcctgaagaagggttttgctgagaaatgcaggcttgcttcccgtacagacatatgcgaggagaaaaagcttgaccccggacagctggttctgagaaaccttaagagtccaattccgctgtggggccaccgctcaaaccagagcaccttttcgcgaccaaagggccacctgagcgaaaagatgactttggatttgaaagacgagaatgacgccggtaatctgattacttttccgaaggaatccttggccgtgggtgattttaacttaggctccaatgtgagccttgagaagatcaagcaggaccagaaactgatcgaggaaaatgagaaactaaagactgagaaagacgccctcctggaaagctataaggctcttgagctgaaagtggagcaaatcgctcaggaactgcagcaagagaaggctgcagcagtggatctcaccaaccatctggagtacacccttaagacgtacatcgacactcggatgaaaaacttggccgccaagatggagatcttgaaggaaatgaggcacgtcgatattagcgtgcgatttggtaaagacctgagcgatgcaatccaggtgctcgacgaaggctgttttaccaccccggcctcactcaacggcctagagatcatatgggcagagtactcactggcccaagagaacattaagacctgtgagtatgtaagcgagggaaacattctcattgcacagcgtaacgagatgcagcaaaaactatacatgtccgtggaagatttcattttagaggttgacgagagcagcttaaacaagcggctgaagacgctccaggacctatccgtatcactggaggcggtgtacggccaggccaaggaaggagccaacagcgatgagatcctgaaaaaattctacgattggaaatgcgataaacgcgaggagtttactagtgtgcggagtgaaaccgacgccagtctacatcggctcgtggcttggtttcagagaactctgaaggtgttcgatctgtctgtggaaggatcactcatctcggaggatgccatggacaatatcgacgagatactcgagaagactgaaagctcagtgtgtaaagaattagagatcgccctggtggatcagggagatgctgataaagagattatcagcaatacatacagccaagtcttacagaagattcactccgaggagcggctcatcgccacagtccaagccaaatacaaagactccattgaattcaaaaagcagctgatcgagtatctgaataagtctccaagtgtggaccacttacttagcatcaaaaagacactgaaatccctcaaagctctgctgagatggaagttggtggaaaaatccaatcttgaggaatcagatgaccctgatgggtcccaaattgagaaaataaaggaagaaataactcaacttagaaataacgttttccaagagatttaccatgagcgtgaggaatatgaaatgctgacctcacttgctcagaagtggtttcccgagctgccattgctgcatcccgagattggactgctaaagtacatgaacagcggaggcctccttactatgtccttagagcgtgacctgctcgacgcagagcctatgaaggagctgtcgtccaagagacccttggtgcgaagcgaggtgaacggccaaatcattctgctgaaggggtattctgtcgatgtggatacagaagcaaaggtgattgagcgggcagcgacctaccacagagcctggcgagaggccgaaggggatagcggtctcctgcctctgatttttctgtttctctgtaagtctgaccctatggcttatcttatggtgccatactatcctagagccaatctgaatgcagtgcaggcaaacatgccacttaactccgaagaaacacttaaagtgatgaagggtgtcgcccagggtctgcacaccctgcacaaggcagacatcatccatggcagccttcaccagaacaacgtgttcgcactgaaccgggagcaaggcattgttggtgatttcgatttcaccaagagcgtcagtcagagggcatcagttaatatgatggttggggacctgagtctcatgtctcctgaattgaagatggggaaacccgccagcccagggtcggacttgtatgcctacggctgtctgctcctatgggatgacaaggtgaagtctctcctgtgtagccttatctgctaccggtctagcatgacggcagaacaggtattgaacgccgagtgcttccttatgccaaaagaacaaagtgtccctaacccggagaaggatactgaatacaccctgtacaaaaaggaagaagagataaaaacagagaaccttgataagtgcatggaaaagactaggaatggggaggcaaactttgactgctag

SEQ ID NO: 204732 - DNA, 1545 bp, Artificial Sequence
  Description of Artificial Sequence: Synthetic coding sequence
atggccgacagcggcctggacaagaagagcaccaagtgccccgactgctcgtcagcctcacagaaggacgtgctgtgcgtctgctcatctaaaactcgcgttcctcccgtccttgttgtggagatgtcgcagacgtcatccataggctcagctgaaagtctgatctctttggagagaaaaaaggagaagaacattaatcgggacataacatctcgcaaggacctgcccagcagaacttccaacgtggaacgaaaggcttcacagcaacagtggggtcgagggaatttcacagaaggaaaggtgccgcacatccgcatcgaaaatggcgcagccatcgaagaaatttacacgtttgggaggatccttgggaaaggcagcttcggtatcgttatagaggccacggataaagagaccgaaaccaagtgggctataaagaaagtgaacaaggaaaaagccggcagctccgccgtgaagctgttagagcgagaagtgaatatcctcaaatcggtgaaacatgaacatatcatccatctggaacaggtcttcgagactcctaagaagatgtaccttgtcatggaactgtgcgaggacggtgagctgaaggagattctggacagaaaaggccacttttcagagaacgagacccgctggattatccaatcgctggcctccgccatcgcatatctccacaacaatgatattgtgcaccgcgatctgaagctggaaaatatcatggtcaaatcctccttaattgacgataataatgaaatcaatctaaatataaaagtgacggacttcggactggccgtgaaaaagcaatcccgctcagaggcaatgctccaggctacatgcggaacaccaatttacatggctcccgaggtgattagcgcccacgactactcacaacagtgtgacatctggtcgatcggggtcgtgatgtatatgttgcttcgaggtgaaccgcctttcttagcgtcctccgaagagaaactgttcgaactgatccggaagggagagctccacttcgagaacgcagtgtggaactcaatctcggactgtgcaaagtccgtgctcaaacagctgatgaaagtcgaccccgcgcatcgaattactgcaaaggagctcctcgacaaccagtggctgaccgggaacaagctgtcgagtgtgaggccaacaaacgtgctggaaatgatgaaggaatggaaaaataaccctgaatctgtggaggagaatactacagaggagaaaaataagccatctaccgaagagaagcttaagagttatcagccatggggcaacgtccccgacgcgaattacacctcagacgaggaggaggaaaagcaatccactgcttacgagaagcagttccctgccacatcaaaggacaattttgatatgtgctctagctcatttactagcagcaaattgctccccgctgaaatcaagggtgagatggaaaagactcccgtcacaccttcgcagggcactgccactaaatacccagctaagtctggtgctctctcacgtacgaaaaaaaagctttag

SEQ ID NO: 204733 - DNA, 1545 bp, Artificial Sequence
  Description of Artificial Sequence: Synthetic coding sequence
atggccgacagcggcctggacaagaagagcaccaagtgccccgactgcagttcggcgagccagaaggatgtcttatgcgtctgctcctccaagacccgggtaccaccggtcctcgtggtcgagatgtctcagaccagctctataggaagtgcggaatctctgatcagcctcgaacggaaaaaggagaagaatataaacagagacatcaccagtcgcaaggaccttccaagccggacatccaatgtggagcggaaggcttcccagcaacagtggggaaggggcaactttaccgaagggaaagtgccccatatacgcattgagaacggtgctgctattgaagagatctacaccttcggaaggatcctagggaaaggtagctttgggatcgtgatagaagccaccgacaaggagactgagaccaaatgggccatcaagaaggtgaacaaggaaaaagcgggatcttctgctgttaagcttctggaaagagaagtgaacatactgaagtcggtcaagcacgaacacattattcatttggagcaggtgtttgaaacacccaaaaagatgtacctggttatggaactgtgcgaggatggcgaacttaaagagatccttgatagaaaagggcactttagtgagaacgagacaagatggattattcagagtttagctagcgccattgcctacctgcacaataacgacatcgttcatagagacctcaaactggaaaacataatggtgaaaagtagtctgatcgacgataataatgaaatcaatctgaatatcaaggtcacagattttggactggctgtaaaaaaacagtctcggtctgaagccatgctgcaggctacatgtggaacacctatctatatggcccctgaggtgattagcgcccacgattactcccaacaatgcgatatttggtccataggcgtcgtgatgtatatgctgttgcggggcgaacccccattcctcgcatctagcgaggaaaagctgttcgagctcattcgtaaaggcgagctgcatttcgagaatgccgtgtggaacagcatttccgactgtgcgaaaagtgtgctgaagcagctcatgaaggtggatcctgcccatcgtattacagccaaggagctcctggacaaccagtggcttactgggaacaaactcagttctgttcgccccacaaatgtccttgagatgatgaaggagtggaagaacaaccccgaaagcgttgaagaaaatactaccgaagaaaagaataaaccaagcaccgaggagaagctcaagtcttaccaaccctggggcaatgtgccggatgcgaattacaccagcgacgaagaggaggaaaagcagagtaccgcgtacgaaaagcagttccctgccacctcaaaggacaatttcgatatgtgttcttcatcatttaccagctccaagttacttcccgcagagatcaagggagagatggaaaagactcccgtcaccccctcgcaaggcacagcaactaagtatcccgccaagtcaggggccctttccagaaccaagaagaaactgtag

SEQ ID NO: 204734 - DNA, 1347 bp, Artificial Sequence
  Description of Artificial Sequence: Synthetic coding sequence
atggccgacagcggcctggacaagaagagcaccaagtgccccgactgttctagcgctagtcagaaggacgtgttgtgcgtttgcagctcaaaaacccgagtgcctcctgttctcgtggtcgagatgtctcaaaccagctccatcggcagtgctgagtcgctgatcagtctggagagaaagaaagaaaaaaacattaacagggacataacaagccgaaaggaccttccaagcaggactagcaacgtggagcgcaaggctagtcaacagcagtggggacgtggcaacttcaccgaggggaaggtcccccacatcaggattgagaacggcgccgcaatagaagagatttatacattcgggcgaattctaggtaagggaagcttcggcatcgtgattgaggccaccgataaggagacggagaccaagtgggccataaaaaaagttaacaaagaaaaggctggatcatctgcagtaaagctgctcgagcgcgaggtaaatattctcaagtctgtcaagcatgagcacatcatccatctggagcaggtcttcgagaccccaaagaaaatgtatttggtgatggagttatgcgaagatggggagctgaaggagatcctcgacagaaagggtcatttcagcgagaacgagactagatggatcatccagtcactggcttcggcgatcgcctacttgcataacaacgacatcgtgcaccgcgatctcaaactggaaaatattatggttaaaagctcgctgatcgacgataacaatgagataaacctcaacattaaggtgaccgactttggtcttgctgtcaagaaacagagcagaagtgaagctatgttgcaagcaacttgtggaacaccgatctacatggcacccgaggtcatctctgcacacgattactcacaacagtgtgacatctggagtatcggagtggtaatgtatatgcttttgaggggagagcctccttttctggcttcctccgaggaaaagctatttgagctgattagaaaaggagagctccacttcgaaaatgccgtctggaatagcatcagcgactgtgcaaaatccgtgctcaagcaactcatgaaagtcgatccagcacatcggattacagcaaaggagctactcgataaccaatggctcacaagcacagcctacgaaaagcagttccccgcaacctcaaaggataatttcgatatgtgttcatcatcgttcacctcttctaagctgctgccggccgaaatcaagggggaaatggagaagacccctgtgacacccagtcaggggaccgccacaaagtacccggctaagagcggggccctgtcacgtacaaagaagaaactttag

SEQ ID NO: 204735 - DNA, 192 bp, Artificial Sequence
  Description of Artificial Sequence: Synthetic coding sequence
atggccgacagcggcctggacaagaagagcaccaagtgccccgactgctcctccgcttcccaaaaggatgtgctgtgcgtgtgttcatcaaagactcgcgtgcctccagttctcgtggtggagatgtcacaaacttcctccattggatcggcagaatcccttatctctttggaacgcaagaaggaaaagtag

SEQ ID NO: 204736 - DNA, 1545 bp, Artificial Sequence
  Description of Artificial Sequence: Synthetic coding sequence
atggccgacagcggcctggacaagaagagcaccaagtgccccgactgcagtagtgcatctcagaaggatgtgctgtgtgtctgttcatctaaaactagagtgcccccggtcctggttgttgagatgtcacaaacctcttcaatcggttcggccgagtcactgattagcctggagcggaaaaaagaaaagaatattaaccgggacatcacatctcgtaaagacctgccgtcgcgcactagtaacgttgaacgaaaagcatcccagcagcagtggggtcgcggaaacttcaccgaggggaaggtgcctcatattagaatcgagaacggcgccgcaattgaggagatatacacgtttggaagaatattagggaaaggctccttcggtatcgtcattgaagccactgacaaagagaccgagactaaatgggcgataaaaaaagtgaataaagagaaggcaggttcctcagccgtaaagctgttggagcgggaggtgaatatactgaagagcgtgaagcacgagcatattatccatttggaacaagtctttgaaacccccaaaaagatgtatctggtgatggaactgtgcgaagatggggaactgaaagagatacttgaccgaaaagggcatttcagtgagaatgagacaagatggattattcagagtctggcgtctgccatcgcataccttcacaacaacgacattgtacacagagatttgaagcttgaaaacataatggttaaaagcagtctgattgatgacaacaacgagatcaatttgaacattaaggtgactgactttggattggccgttaagaagcaatcaaggtcagaagcaatgctacaggccacttgtggaactcccatctatatggcacctgaggttatctccgcccacgattacagccagcagtgtgacatctggtcaataggcgttgtgatgtacatgctgctccgcggagagccccctttcctcgcctcatctgaggaaaaactcttcgaactgattcgcaaaggagaactgcacttcgagaatgcagtttggaactccatcagcgactgcgcaaagagcgtgttgaagcaactgatgaaggtcgatcccgcacatcgcattaccgccaaggaactgctggacaaccaatggttgacaggcaataaacttagctccgttcgtcctacaaatgtgctagagatgatgaaggaatggaagaataaccccgagtccgtcgaagagaatacaacagaagaaaagaacaaaccaagcacagaggaaaagctcaaaagctatcagccgtggggaaatgtgccagacgctaactacacctccgatgaggaggaggagaaacagtcaaccgcatacgagaagcagttcccagccacttctaaggacaattttgacatgtgttcctctagtttcacaagcagcaagctcctgccagcggaaattaaaggtgaaatggaaaaaacccccgtcacacctagtcaagggaccgccaccaaatatcctgccaagagcggtgcccttagcagaacaaagaagaaactgtag

SEQ ID NO: 204737 - DNA, 114 bp, Artificial Sequence
  Description of Artificial Sequence: Synthetic coding sequence
atggccgacagcggcctggacaagaagagcaccaagtgccccgactgctctagcgctagccaaaaggatgtgctgtgtgtttgtagtagcaagacaagagtgccccctgtgtag

SEQ ID NO: 204738 - DNA, 516 bp, Artificial Sequence
  Description of Artificial Sequence: Synthetic coding sequence
atggccgacagcggcctggacaagaagagcaccaagtgccccgactgctcctctgcctcccagaaggacgttctatgtgtgtgcagctctaagacccgcgttcccccggtgctggtggtcgagatgtcccagacctcctcaattggcagtgcggagtcgcttatttctctggaaagaaaaaaggagaagaatattaaccgagacatcaccagcagaaaggatctcccaagtaggacgtccaacgttgagcgaaaggcaagccaacagcagtggggccgtggcaattttactgaaggaaaggtgcctcacattcggattgagaatggggccgcaatcgaggagatatatactttcggccggatattgggcaaaggctcttttggcatcgtcattgaggccaccgataaggaaaccgagaccaaatgggcaataaagaaggtcaataaggaaaaggctgggagtagcgccgttaagctgctagagagagaggtgaatatcctaaagtccgtgaagtag

SEQ ID NO: 204739 - DNA, 90 bp, Artificial Sequence
  Description of Artificial Sequence: Synthetic coding sequence
atggccgacagcggcctggacaagaagagcaccaagtgccccgactgtagcagcgcatcccaaaaagatgtgctgtgtgtgtgcagctag

SEQ ID NO: 204740 - DNA, 1206 bp, Artificial Sequence
  Description of Artificial Sequence: Synthetic coding sequence
atggagaccggcaaggacggcgcccggcggggcacccagagccccgaacggaaaagaagaagccccgtgcctcgcgcaccctccaccaagttgcgcccggctgctgccgcccgcgcaatggatccagtcgcggccgaggcacccggcgaagccttccttgcaaggaggcgaccggaagggggaggtgggtctgctcgccctcgttactcactgctggcggagatcggacgaggctcttatggggtggtttatgaagctgtcgctggccggagtggagcaagagtggcagttaagaaaattagatgtgacgcacctgagaatgtggaattggccctggctgagttttgggccttaacctcactgaaaaggaggcaccagaacgtcgtacaatttgaagagtgcgttcttcagcgaaatggtctagcgcaacgtatgtctcacgggaataagagctcacagttgtacctgcgtctggtggagactagcctgaaaggggagcggattttgggatacgcagaggaaccctgctacctttggtttgtgatggagttctgtgaggggggcgacctcaaccagtatgtcctctcaagacgccctgatccagcgaccaacaagtccttcatgctccagttgacctctgccattgcattcttgcacaagaaccacatcgtgcacagggatctgaaaccagacaatattctcatcaccgaacgttccggcacgcccatattgaaggtcgccgacttcggcctgtcaaaagtctgtgcgggtctggctccaaggggaaaagaggggaatcaggataacaaaaatgtgaatgtcaataagtactggctgtcttcagcatgtgggtctgatttctatatggctccagaagtatgggaaggtcactacaccgctaaggcagacatctttgcgctcgggattataatctgggcaatgatcgaacgcataacgtttatagactcagaaacgaagaaggaactgcttggcacttatattaagcagggaacagagattgtgccagtgggcgaggcgctgctcgagaatcctaagatggagctccatatacctcagaagcgccgaacttccatgagtgagggcatcaaacaacttctgaaggacatgctggctgcaaaccctcaggacaggccagatgctttcgaactcgagactaggatggaccaggtgacttgcgctgcctag

SEQ ID NO: 204741 - DNA, 1605 bp, Artificial Sequence
  Description of Artificial Sequence: Synthetic coding sequence
atgggccaccaggagagccccctggcccgggcccccgccggcggcgccgcctatgtgaaacgtctgtgcaaaggcctaagctggcgggagcatgtcgagtcacatgggagcctgggagcacaggcttcccctgcctccgccgctgctgccgaaggcagcgcaacccggagggcgcgagccgcaacgtctcgagccgctcggtccaggaggcaacctggacccggcgctgaccacccacaagccggtgcccccggcgggaagagagccgcccggaagtggagatgcgctggccaggtcactatacagggacctgccccgccacgcccaagagcaggaaggcgcgacgaagccggaggggcacgcgccgccccactgcttcttccccccccccccgctgccatggaaaccggcaaggacggggcccgccggggcacgcagtcccccgagcgaaagcggcgttcccccgtgccccgagcaccgtctacaaagctgcgccctgcggccgcagctagagctatggacccagtagccgcggaggcacccggggaggcgttcctggcccggcggaggccagaggggggaggcggctctgcccgtccccggtacagcctgctggctgagatcgggcgtggatcatatggagtcgtgtacgaagccgtcgccggccgttctggtgcccgggtggccgtgaagaagatccggtgtgacgcccccgagaatgtggagttagccctggctgaattctgggccctcacttcactcaagaggcgacaccagaatgtggtgcagtttgaagagtgcgtgctgcagcgtaatgggctggctcaacgcatgtcgcacggaaacaagtccagtcaactgtaccttcggctggtcgagacctccctcaagggagaaagaattttgggttatgcggaagagccatgttacctgtggttcgtgatggagttctgcgaaggaggcgatctaaaccaatacgtgctatcccggcggccagaccccgccacaaacaaatcatttatgcttcagcttactagcgccatcgctttcttgcataagaaccatatcgtgcacagggatttaaagccagataacattttgatcaccgaaaggtccggcactcccatccttaaggtggccgatttcggattgtctaaagtgtgtgcggggcttgctcctcgcggcaaggaagggaaccaggataataaaaacgtgaacgtgaataaatactggctttcgtcagcatgcggatcggatttttatatggcccctgaagtgtgggaggggcactataccgctaaggccgatatcttcgctctcggcattatcatatgggccatgatagagcggatcacgttcatcgattccgaaactaagaaggagttgcttgggacctacataaagcagggaactgaaatagtacctgttggtgaggccctcctggaaaaccctaaaatggaactgcacatcccccagaaacggcggactagtatgagcgagggcattaagcagttacttaaagacatgttagcggccaacccccaggataggccagatgcttttgagctggagaccaggatggaccaagttacctgcgccgcctag

SEQ ID NO: 204742 - DNA, 489 bp, Artificial Sequence
  Description of Artificial Sequence: Synthetic coding sequence
atggaccccgtggccgccgaggcccccggcgaggccttcctggccagacggcgaccagaagggggaggcggttctgcacggccaagatactccttactggcagagattggccgcggaagctacggagtcgtatatgaggcagtggcggggcggagtggggcccgagttgccgtgaagaagatacgctgcgatgctccagaaaatgtggaactggctctggcagaattctgggctctcacctcattgaagagacgccatcagaatgtggtccagttcgaagaatgtgtgcttcagcggaatggcctggctcagcgcatgtctcatggtaataaatcttctcagctctacctgcgtctcgtggagacatcattgaagggtagatttctgggcacccattcgttgactacttctccaccagaggacgggaggggctacagatggtggccggggagactggccatcagtcggcaacttgatcccgccatgtag

SEQ ID NO: 204743 - DNA, 3948 bp, Artificial Sequence
  Description of Artificial Sequence: Synthetic coding sequence
atggagaagtaccacgtgctggagatgatcggcgagggcagcttcgggagagtttataaggggagacggaaatattcggcacaagtcgtcgctctaaaattcattccaaaattgggacggtctgagaaggagctacgtaatctgcaaagggagatcgagataatgagaggcctaagacaccctaacattgtgcacatgctggactccttcgagacagacaaagaagtcgtggtggttaccgattacgccgaaggagagctgttccagatattggaagatgacggtaagctcccagaagatcaagtacaggctattgcagcccagctggtgagcgcactgtattacctgcattcacatcggattttgcaccgcgacatgaagccacagaacattctgctcgctaaaggtggcggcatcaagttgtgcgacttcggttttgcaagagcaatgtcgactaacactatggtgctaacgagcatcaagggcacaccactttacatgtcccccgagcttgtggaggaaagaccttacgaccatactgcagatctgtggtcagtgggttgcattctgtatgagttggcagtgggtacaccgccgttttacgccacttcgattttccagttagtaagtctcattctcaaagaccccgtaaggtggccatctactatttccccttgctttaagaattttctgcaggggctgcttacaaaggatcccagacagcgtctaagctggcccgaccttctctatcacccattcatcgctggacatgttactatcattacggagccggcagggcccgatctaggtacgcccttcacctcccggctgccgccagaactccaggttctgaaggacgagcaagcccatagactagcccccaaaggaaaccagagtcgcatcctaacacaagcctacaaaaggatggcggaggaggccatgcagaaaaagcaccagaacacgggccctgctctagagcaggaggataaaactagtaaagttgcccccggcaccgccccactgcccagactgggcgctacgcctcaagaaagtagcctgctggctggcatcctggcctccgagctgaaatcatcttgggccaaaagtggaaccggcgaggttccctctgcgcctagagagaaccgtactacacccgactgcgagcgagcttttccagaggagcgtcccgaggtcctggggcagcgctccaccgacgtggtcgatctggaaaatgaggaacccgattctgacaacgaatggcagcatctcctggaaactacggagcctgtgcccatccaactaaaggctcctttaactctgctgtgtaaccctgatttttgtcagcgcattcaatcccaattacacgaagcgggaggccagattctgaagggcattctggaaggcgcgagtcatattctccccgccttcagagtgttgagcagcctcctgtcttcatgtagcgactcggtggcgctgtactccttttgtagggaggccggactgccaggactgctactgtcgctacttcgccacagccaggagagtaacagtctgcaacaacagagttggtacggaactttccttcaggacctcatggccgtcattcaggcgtacttcgcctgcacatttaatttggagcgatctcagacatcagactccttgcaggtcttccaggaagccgccaacctctttcttgacctattgggcaagctgctcgcccagcctgatgactccgagcaaacactgcggagagacagcctgatgtgcttcaccgtcttatgtgaagctatggatgggaattcacgcgctatctcaaaagcgttctattcgagcctgcttaccacccaacaggttgtcctggatggcctcctacacgggctgacagttcctcagttgccggtgcatacccctcagggcgccccccaggtatcccagcctctcagggaacaatccgaggacatacctggcgcaataagctcggcgctagccgccatctgtactgcccccgtcggcctgcccgattgctgggatgctaaagagcaggtgtgctggcatctcgcaaaccagctgacagaggattctagtcagctgagaccatctctgattagcggacttcaacatcccattctgtgcctacatttgcttaaagtgctttactcatgctgcttggtgagcgaagggctgtgtagactcctggggcaggagccgctggccctcgagagcctcttcatgttgatccaggggaaagtaaaagttgtggattgggaagaaagcactgaggttaccctgtactttctttccttgttggtattccgccttcagaatcttccctgcggcatggaaaagctcggcagcgacgtcgctactctcttcactcattcccacgttgtaagccttgtgagcgccgccgcttgtctgcttgggcagttgggtcagcagggcgtgactttcgatctgcagccaatggagtggatggccgccgctacacacgcactgtccgcccctgcagaagtgaggctcacacccccgggttcctgcggattctatgatggcctgcttatccttctactccagctgctcacagaacaggggaaggcaagccttatcagggacatgagttcctccgagatgtggacggtgttgtggcaccgatttagcatggttttacgcctccctgaagaagcctcggcccaagaaggcgagctgtccttgtccagtcctccatctcccgagccagactggacactgatcagcccacaaggcatggccgctctcctgtccttggccatggccacatttacacaggagccccagttgtgcttaagttgcctcagtcagcacggttccatactgatgtcaatccttaagcatttgttatgtccgagctttcttaaccagctgcggcaggctccgcacggttcagagttcctgcctgtggtcgtgctgtccgtatgtcagctcttatgttttccttttgctctcgatatggatgcggatctcctgattggagtgcttgcagacttgcgggactccgaggtggccgctcatctactccaggtgtgctgttatcacctccctctgatgcaagtcgaattgccaatctcactcctcactagacttgccctgatggaccctactagtcttaaccagttcgttaatactgtgagcgccagtccccgaacaattgtgtcatttttgagcgtcgccctgctgagtgaccaacctttgctcacgtctgacctgcttagtctgctggcccatacagcacgagtactgagcccgtcgcacctgagctttatccaggaactcctggctgggagcgatgaatcctaccgacctctgcgcagcctcctagggcaccctgagaatagtgtgcgtgcccatacttaccgactgcttggacacctgctgcagcactccatggctctgagaggcgctctgcaatctcaatcaggtctgttgtccctgctcctcctgggcctgggcgataaagatccagtagtgcgctgttccgccagcttcgctgtgggcaacgcagcttaccaggctggccccctgggcccagccctagctgcagctgtaccttctatgacacaactcctaggcgacccccaagctgggatacgccgaaacgtggccagcgctttaggtaatctgggccccgaaggactgggagaggagctcttacaatgtgaggtgccccagagactcctggagatggcctgcggtgatcctcagccaaacgtgaaagaagccgctctgatcgccctcaggtccctgcagcaagaacccgggatacaccaggtcctcgtgtcacttggcgcatccgagaagttatctttactgagcttaggaaatcaatccctccctcatagctcaccccggccagcttctgctaagcactgccggaaactcatccaccttctcagaccagctcatagcatgtag

SEQ ID NO: 204744 - DNA, 3885 bp, Artificial Sequence
  Description of Artificial Sequence: Synthetic coding sequence
atggagaagtaccacgtgctggagatgatcggcgagggcagcttcggtagagtctataaagggagaaggaagtattcagcgcaggtagtggctcttaagtttatcccaaagctcggacgtagcgaaaaagagctgagaaatctgcagcgggagatagagattatgagaggcctgaggcacccaaatattgtccacatgctggacagctttgagaccgacaaggaagtcgtggttgtgaccgactatgccgagggggaactttttcaaatactggaagacgatggcaagctgcccgaagaccaagtccaggccatagccgctcagttagtgtccgctctgtactacctgcactcccacagaatactgcatcgggatatgaagcctcagaatattctgctcgcaaaagggggaggaattaagctgtgtgatttcggattcgcaagagctatgtcaacaaatacaatggtgttgacatccataaagggtacacctctgtatatgagcccagaactagtcgaggagagaccatatgatcatacagctgacctctggtctgtagggtgtattctctatgaattggccgtcgggaccccacccttctacgcaacctcaattttccagttagtgtcactaatcctgaaagaccctgtgaggtggccttcgacgatcagtccttgttttaaaaattttcttcagggcttgctcacaaaggatcctaggcaaaggctaagttggccagatctcctgtatcaccccttcatcgctggccacgtgacgataattacagaacctgccggccctgatctgggaactccatttacatcccgccttccacctgagctccaagtgttgaaagacgaacaggcccataggctcgctcccaagggcaaccagagtagaattttgacccaggcctataaaaggatggccgaggaagccatgcagaaaaaacaccagaacactggtccggctttggagcaggaggacaagacaagtaaggtagcaccagggactgctcccctgcctagattgggagccactccacaagaaagtagcctcctggctgggatcctcgccagtgaactgaagtcctcctgggccaagagcggtacgggcgaggtgccatctgccccgcgcgaaaataggacaacaccggactgcgagcgtgcctttcctgaggaacgccccgaggtcctgggacagaggagcactgatgtggtggacttagaaaacgaggagcccgactctgacaacgagtggcagcatctcctggagactacggagccagtgcctatccaattaaaagcgccactgactctgctgtgcaatcccgatttttgccagagaatccagtcgcagctgcacgaggcaggtggccagatccttaaaggtattctggagggtgcttctcacatcttgccggctttcagagtcctgtcctcgctcctgagttcttgttcggactctgttgcgctctactctttttgtagggaggcaggcttgccaggtctgctgttgagcctgctgaggcactcccaggaatccaatagcctacaacagcagtcatggtacggtacattccttcaggacctgatggccgtaattcaggcatactttgcatgcacctttaacttggagcgaagtcagacttctgattctcttcaggttttccaagaagccgcaaatctgtttttggatctactcggaaagctgctcgcccagccagatgacagcgaacagaccctgagaagggatagtctaatgtgcttcacagtgttatgcgaagcaatggatggcaatagccgagcaatcagcaaggccttttattcctcacttttaactactcagcaggttgtgctggacgggctgcttcacggcctgactgtccctcagctgccagttcacaccccccagggcgcaccgcaggtctcgcagcctctgagggagcagtcggaggacatcccgggagccatcagcagcgcgctggcggccatctgtaccgcccccgtgggcctccccgactgttgggacgccaaggaacaggtatgttggcatcttgccaaccagctgaccgaagattctagccagctgcgcccctccctgatctcggggttgcagcatcccattctctgtttgcacctccttaaggtgctgtatagctgctgcctcgtctctgagggcctttgcagactgctaggccaagagcctttggccctcgagtctctgtttatgctgatacaggggaaagtgaaggtagtagattgggaggagagcaccgaagtgacattatactttctatcactgttggtcttccgcctgcaaaacctgccatgtggcatggagaagctggggagtgacgtggcgacactgtttacccatagtcatgttgtgtcgttagtgtcagccgcggcttgcctgctcgggcaactgggccagcagggcgtcaccttcgaccttcaaccaatggagtggatggcagccgctacacacgctctgagcgcccctgctgagctcctcaccgaacagggcaaagcctctctgatccgcgatatgtcttcatcagagatgtggacggtgctgtggcacagatttagcatggtgctacgcctacccgaggaggcttccgcccaggagggagaactctctttatccagtccgccatcacctgaaccggactggacactgatcagtccacaaggcatggcagctctgctgtcattggccatggcaacctttacacaggagccccagctgtgtctgagttgtctgagtcagcacgggagcatcctcatgagcatcttaaaacacctgctgtgcccttcctttctgaaccagttaaggcaggctccacacggttctgagtttttgcctgtagtggtcctcagcgtctgccagctcctttgtttcccgtttgccctggatatggatgcagacctactgatcggcgtcctggccgatctgcgggattcggaagtggctgcccacctgcttcaagtgtgttgttatcacttgccgctgatgcaggttgaactgcctattagcctgcttacacggcttgccctgatggatcccacttccctcaatcaattcgtaaacacggtcagtgccagcccaagaactatcgtttccttcctgagcgttgccctcttgtctgatcaaccacttttaacgtctgatttactctctctgctggctcacacagctcgcgtgctgtctccgagccatttatcatttatccaggagctgctcgctggctccgacgaatcctatcgcccactccgatccctgctgggccaccctgagaatagtgttagggctcacacgtacaggctgttgggtcatcttcttcagcacagtatggcccttcggggagcacttcagtctcagtccggccttcttagcttactattgttaggcctgggcgacaaggaccccgtggtacggtgcagtgcttcctttgccgtgggcaatgccgcgtatcaggcagggccattaggtccagccctcgccgccgccgttccatctatgacccagctcctgggggaccctcaggccgggatcagacggaacgttgcatcagcgctcggcaaccttgggcccgaggggcttggagaggagctcctgcagtgcgaggtgccccagcgactgcttgaaatggcatgtggcgatccgcagcccaacgtcaaggaggctgctctcattgcgcttagaagtctacagcaagagcccggaatacatcaagtcttggttagcctcggagcttctgagaagctgagcctgctcagcctaggaaaccagagtctgccccactcctctccccggccagcatccgccaagcactgtagaaagctcattcacctgttaaggccagctcatagtatgtag

SEQ ID NO: 204745 - DNA, 3885 bp, Artificial Sequence
  Description of Artificial Sequence: Synthetic coding sequence
atggagaagtaccacgtgctggagatgatcggcgagggcagcttcggccgggtttataaagggagaagaaaatatagcgcccaggtcgtcgctctaaaatttataccaaaattgggtcggtccgagaaggaactcaggaaccttcaaagggaaattgagattatgaggggcttgcggcaccctaacattgtgcacatgcttgacagcttcgaaaccgacaaggaggtcgtagtcgttacagattatgccgagggggaactgttccaaattctcgaagatgatgggaaactgccagaggatcaggtgcaggcgatcgccgcacagttggtgtctgccctctactacttacactctcaccgaatcctccaccgggatatgaagccgcaaaacattcttctcgccaagggggggggaatcaaactctgcgacttcgggttcgctagagcaatgtccaccaataccatggtcctcacgtctatcaaggggaccccactgtatatgtcccccgaactagtggaagaaaggccatatgatcatacagctgacctgtggtccgtgggctgtatcctgtatgagttggcagtcggaacaccaccattttatgcgaccagcatttttcagctcgtttccctgatattaaaagatcctgtacggtggccgagcaccatttccccatgctttaaaaacttccttcagggcctcctgaccaaagacccgagacagcgcctgtcctggcctgacctattgtatcatccttttatcgctggtcatgttacaataattacagagcccgcgggcccagatcttggcaccccctttacttccaggttgcctcccgaacttcaggtgctcaaagacgaacaggcgcacaggctggcaccgaaaggcaaccaatcccgcatactcacgcaggcctacaagcggatggcagaggaagccatgcagaaaaagcaccagaatacagggcccgccctggaacaagaggataagacctccaaggtggctcctggcaccgcacccttgccgagactgggcgccaccccgcaggagagcagtctgctcgccggaatattagctagcgaactgaagtccagttgggccaagtccggaactggtgaagtgccatcagccccccgcgagaataggactacccccgactgtgagcgcgcctttccggaggaacggccggaagtgctgggtcagaggtccaccgacgttgtcgatttagaaaacgaagaacccgacagtgacaatgagtggcaacatctactggaaaccacagaacctgttccaattcagctaaaggcccctctgaccctcctatgtaaccccgatttttgtcagaggattcagtctcagcttcacgaagcgggcggacagatcttaaagggaattctggaaggagcctcacacatactgcctgcttttcgggtgctttccagtctgctaagctcttgcagtgactcagtggccttatacagtttctgtcgcgaggctggcttgcccggtctcttgctgagtctgctcagacatagccaagagagcaactccctgcagcagcaaagttggtatggtacatttctccaggacctgatggccgtcatacaggcctattttgcatgcacgtttaacctggagcgcagccagacgagcgattcactgcaagtgtttcaggaggccgccaacttgttcttggatctgctcggcaagctcctggcccagcctgacgattcagagcagaccctcaggagagatagtcttatgtgttttaccgtactgtgtgaggcaatggacggcaactcaagagccataagtaaggcgttctatagctctcttttgaccacacagcaggtcgtcctggacggtttgttacacgggctgaccgtgccacagctcccagttcacaccccccagggtgcaccccaggtgtcacagcctctgcgggaacagagtgaggatatcccaggagccatcagttcggcattagctgccatctgtactgcgccggtgggtctaccagattgctgggatgccaaggagcaggtgtgctggcatctggctaatcagctgaccgaagattcttctcagctgcggccgagcctgatatccggcctccagcaccccattctctgcctgcatctgctaaaggtgctctattcctgttgccttgtgtctgagggattatgcagactgttaggccaggagcccttggctctcgagtccttgtttatgctcatccagggtaaggtcaaggtggtagattgggaggagagtaccgaagttaccttgtacttcttgtcattgctcgtgttccgcctgcagaatttgccatgtggaatggaaaaattggggagtgacgtcgctaccctcttcactcacagccatgtggtgagcttggtcagcgccgccgcctgtctgcttgggcagttaggccaacaaggcgtgacttttgacctacagccaatggaatggatggctgcggctactcatgcgctgagcgcacccgctgagatgagctgtgagcagggaaaggcgagcctgattcgcgacatgtcatcaagcgagatgtggacggtgttgtggcatcggttttcaatggtgctgcgtctgcctgaggaggcaagcgcacaagagggagagctcagcctcagcagtccacctagccccgagcctgactggacactcattagtccccagggtatggccgctcttttatcactggctatggccacatttacacaggaaccccagctgtgcctctcctgcctcagccagcatggaagcattctcatgtcgatactgaaacatctgctttgtccctccttccttaaccagctgcgtcaggccccacacggatcagaatttttacctgtcgtcgtcttgtctgtttgccaactgttgtgctttccattcgcactggacatggatgcagatctcctcattggggtgttggcggacctgagagacagcgaggttgcagcccacctgctgcaggtctgttgttaccacctgcctctaatgcaggtcgagttacccatcagcctcctgaccagactcgctctgatggaccctacatccctgaaccaatttgtgaacacagtgtccgcctcgccccggaccatcgtttctttcctgagcgtggccctgctcagcgaccaaccattattgacttctgacttattatctcttctcgctcacaccgctcgcgtgctgagtccctcccatctgagttttatacaggagttactggcaggtagtgatgaatcctatagaccactaagatctctcctgggccacccggaaaacagtgtgagggcccatacctatcggctgctgggacacttgttgcagcattccatggctctgcgaggtgcactgcagagccagagtggactgctgagtcttctcctgctcggcctcggggataaggatcctgttgtgcgttgtagcgccagcttcgctgtgggcaacgccgcataccaggccggaccactcggccccgcacttgcggccgccgttccatcgatgacgcagttgttaggagatccccaggctggtattaggaggaatgtggcatccgcccttggaaatcttggtcctgaggggctcggcgaagagctcctgcaatgtgaagtcccacaacgtttgctcgaaatggcgtgcggcgacccccagcccaatgtgaaggaggctgccctaatcgccttacggtctcttcagcaggaacctggtattcaccaagtgttggtaagcttaggtgcttccgagaagctgtccctcttgtccctagggaaccagagcttaccgcactctagcccgcgacctgcttctgccaagcactgccgaaaactgatccacttactgcgaccagctcactccatgtag

SEQ ID NO: 204746 - DNA, 840 bp, Artificial Sequence
  Description of Artificial Sequence: Synthetic coding sequence
atggagaagtaccacgtgctggagatgatcggcgagggcagcttcggcagggtgtataaaggtcgaagaaaatattctgctcaggttgttgccttgaaatttatccccaaactggggcgcagcgagaaggaattacggaatctacagcgagaaatcgagattatgcgcgggttacgccacccaaacatcgtccacatgttggactccttcgagactgacaaggaggtcgtagtggttaccgactatgcggagggggaactcttccagatcctggaggacgatggaaagttacccgaagatcaggttcaggccattgccgcccaactggtgtcagccttatattacttgcattcacaccggattctgcacagagacatgaaaccccagaacatccttctggccaaaggcgggggcataaagctctgtgattttggtttcgctcgtgcgatgtctacaaacacaatggtcctgacaagcatcaagggtactcctctgtatatgagtcctgagctagttgaggagcgtccatacgatcacactgccgatttatggtcagtaggttgcatcctgtatgagttggcggtgggcacccccccattctatgccacgtccatattccaacttgtgagccttatactgaaagatcccgtgagatggccaagtaccatctcaccttgtttcaagaactttttacaaggcctgctcactaaggaccctcggcaaagattgagctggccagacttgttataccacccattcatcgccggtcacgtgacaataattacagaaccagctggcccagacctcggcaccccattcacgtctcgacttcccccttag

SEQ ID NO: 204747 - DNA, 3948 bp, Artificial Sequence
  Description of Artificial Sequence: Synthetic coding sequence
atggagaagtaccacgtgctggagatgatcggcgagggcagcttcggccgggtctataaaggccggcgtaagtactcagctcaggtggtcgctctgaaattcattcctaaactaggccggagcgaaaaagaattacggaacctgcagagagagattgaaatcatgcggggactcaggcacccaaacatcgtacatatgttagacagcttcgaaacagacaaagaggtagtagttgtcactgactatgccgagggggagctctttcagattctggaggacgacggaaaacttccagaggatcaggtccaggcaatcgccgcccaattagttagtgcactgtattacctccatagtcatcgaatactacatagagacatgaagccacagaacatcctactggcaaaaggaggtggcataaaactctgtgatttcgggtttgcacgggcaatgagcaccaacaccatggttctaacatcaatcaagggcactccattatacatgagtcccgaacttgtagaggagcgcccatacgatcatactgccgatctgtggagtgttggttgcattctgtatgagctcgctgtcggaactcccccattttacgcgactagcattttccagctggttagtctgatcctgaaagatcctgtgcgttggccgagcaccataagtccctgctttaaaaacttcctgcagggactgctcacaaaggatcccagacagcgcctttcttggccggacctattgtaccatccgttcatcgccggccatgtgacaatcatcacagaacccgcagggccagacctcggaacacccttcacttcgagactgccacccgagttacaagtgttgaaagacgaacaggcccacagactagctcccaagggcaaccaatctagaatcctgactcaggcttacaagaggatggccgaggaggccatgcagaagaaacaccagaatacaggcccagcactcgagcaggaagacaaaacttcaaaggtcgcccccgggactgctcccctcccaagattgggggcaactccccaggagtcctccctgttggccgggatcttagcctccgagctgaagagctcctgggctaaatccgggactggagaagtgccatccgctccccgggagaatcgcaccactccagactgcgagagggctttccctgaagagaggccggaggttcttggccagcgctccaccgatgtcgtcgacctggaaaacgaggagccagattctgacaacgaatggcaacatcttctagaaacgaccgagcctgtgcctattcagctaaaggcccccctgacactactctgcaatccagatttctgccagcggatacaaagccagctgcatgaggctggcggccaaatactcaaagggattctcgaaggagcttctcacatcctgccggctttcagggtcctctcttcgttgctcagtagctgttcggatagcgtggccctttattcgttctgtcgtgaggccggactcccagggctgctactgagtttactgcgccactcccaggagagcaatagcctgcagcagcagagttggtacggcactttcttgcaagatctaatggccgtgattcaagcatattttgcctgcaccttcaacttggagcgatcacagactagcgactcactgcaggtgtttcaagaagctgccaatctatttctcgacctgcttgggaagctcctggcacagccagacgactctgagcagaccctgcggcgagatagcctcatgtgctttacagtgctatgcgaggccatggacggtaactccagagcgattagtaaggcgttttacagtagcttgctgacgactcagcaggttgttttggacgggctgttacatggtttgacagtgcctcagttacctgtgcacacgccgcaaggcgcccctcaagtcagtcagcccctccgcgaacaatccgaagacattcctggggccattagctccgcactcgctgctatctgcactgcccccgtggggttacccgattgttgggatgcaaaagagcaggtgtgctggcaccttgctaaccagctgaccgaagatagttcccagcttaggcctagtctgatttctgggcttcagcatccgattctgtgcctacacttgcttaaggtactatactcatgctgtctggtgagcgaaggactgtgtaggctgctgggtcaggagcccttggccctggagtccctgttcatgcttatccagggaaaagttaaagttgtggattgggaggagtcgactgaagtgacactgtacttcctatctttgctggtgttccggcttcagaatctgccctgcggaatggaaaagctcggcagtgatgtagctacactatttacacactcccacgtcgtctcattagtgagtgccgccgcctgcctacttggccagctgggacagcaaggcgtgacttttgacttacaacccatggaatggatggcggcagcaactcacgctctttccgccccagctgaggttcgtctgactcctcccgggagctgtggcttctacgacggtttgttgattttgctgttacagctcctgaccgaacaggggaaagcctcactcatcagggacatgagctccagtgagatgtggacagtactgtggcacagattctctatggtgcttcgcctcccggaggaagcatcagcgcaagagggcgagctcagcttgtctagtccaccttcccctgaaccagactggactctgattagcccccaggggatggctgccctgctctcgcttgctatggcaaccttcacacaggaaccccagctatgtctctcctgcctgtcacaacacggctctattctgatgtccattctgaagcacctactgtgccccagctttttaaatcagctcagacaggcaccccacgggagcgagtttttgcccgttgtagttttaagtgtttgccaattgctgtgttttccctttgccttagatatggatgctgatcttttgattggtgtcttggcagatctccgcgattccgaagtggcggcccatctgctgcaggtttgctgttaccacctccctctcatgcaagtcgaactgcctatctccctactgactaggctcgccctcatggatcctacgagtctgaatcaatttgttaacaccgtatctgcaagccccagaactatcgtgagcttcctgagcgttgccctgctcagcgaccaacctcttctgacctccgacctgctgtccctgctcgcccacacggctcgcgtgctatcgcccagtcacctgtctttcatccaggaactcttggccggctcggatgaatcctaccggccattgcggtcactccttggccatcctgagaatagcgtgcgggcacacacatatagactcctgggccacctgctgcaacattcaatggcattacggggagctctgcaatcgcaatccggcttactgtcactcctcctgctgggcctcggggataaggatcccgtagtaagatgttcagcgtcattcgcagttggaaatgccgcctaccaggcagggccattggggcctgccctcgctgccgcagtgccttccatgacccaacttctgggcgatccacaggccgggattagaaggaacgtggcctctgccttgggaaacctagggcctgagggcctaggagaggagctcctccaatgtgaggtaccacagcgcctacttgaaatggcatgtggcgatccacagcccaatgtgaaggaggcagcactgattgccctgaggtcgcttcagcaggagcccggcattcaccaagtgcttgttagcctcggtgcaagcgagaagttgtcgcttctgagcctgggtaaccaaagcctcccacatagcagtcctagaccagcgtccgccaagcattgtcgcaagctgatccatctgctccgacctgcacatagtatgtag

SEQ ID NO: 204748 - DNA, 1056 bp, Artificial Sequence
  Description of Artificial Sequence: Synthetic coding sequence
atgcggttcaccttccccctgatggccatcgtgctggagatcgccatgatcgtgctgttcggcctgttcgtggaatatgaaacagatcagactgtactcgagcaactcaacatcactaagcctaccgatatgggcatcttctttgaactgtaccctctattccaggatgtgcacgtaatgatctttgtcgggtttggattcctaatgaccttcctgaagaagtacggtttttcatcagttgggatcaatttgctggtggcagcacttgggctgcaatggggtacaatagtacaggggatattgcagagtcagggacaaaaattcaatatcgggatcaaaaacatgatcaacgctgacttctctgcagctaccgtccttatcagctttggcgcagttctgggcaagacatccccgacacagatgctgatcatgacgatcctcgagatcgtgttctttgctcataatgaatacctagtctccgagatttttaaagcctctgacataggggctagtatgacaattcatgcttttggcgcatacttcggcctagccgtagccgggatcctgtataggtccggcctacgaaaaggacatgaaaacgaagagagtgcatattattccgacctcttcgccatgataggtaccctcttcctttggatgttttggccttctttcaacagcgccattgcagaacccggagacaagcagtgccgcgcaatagtgaatacctatttttctctcgccgcatgcgtgctcaccgcattcgctttctcctcactagtggagcatagaggcaagctaaatatggtgcacattcagaacgctaccctggctgggggcgtcgcagtcggcacttgcgctgacatggccatccatccatttgggtctatgattattgggtctatcgccgggatggtatctgtgctgggctataagtttctgacagtttatggacatgcaggatcatgtactgggtttctgtataggaattcttcatgctggcgcagtgatgaccggtttaatagcaaggtcgcctctctgggaacagccatctag

SEQ ID NO: 204749 - DNA, 1389 bp, Artificial Sequence
  Description of Artificial Sequence: Synthetic coding sequence
atggagaccgtgcagctgcggaaccccccccggcggcagctgaagaaactcgatgaggacagcctcacaaagcaacctgaggaggtgtttgatgtcctcgagaaactgggcgaaggctcatacggttccgtgtataaagctatccacaaggaaactggtcagatcgtggcgataaagcaggtgccggttgaaagcgacctgcaggaaataatcaaagagatttccatcatgcagcaatgcgactcaccacatgtcgtcaagtactacggcagctatttcaagaataccgatctctggatcgtcatggagtattgcggcgctgggagtgtgtcagatatcataaggctccgcaacaagactctgacagaagacgagatcgctactatccttcagtctacactgaaaggacttgagtaccttcacttcatgcgaaagatccatcgggacatcaaagcaggtaacatactgctcaacacggagggacatgcgaagctagctgactttggagtggccggccagctgacagacaccatggctaaacgaaataccgtgatcggaacacccttctggatggctccggaggtgattcaggaaataggctataactgtgtggccgacatctggtctcttggtataactgctatcgaaatggccgaggggaaacctccatacgccgatattcatcccatgagagccattttcatgattcccactaaccctcctcccacgttccgcaaaccagagctgtggtcagacaacttcacagactttgtgaagcagtgtcttgtgaagtcacccgaacagcgggctactgcaactcaacttctgcagcatcccttcgttagaagcgctaaaggcgtttccatactgagggatctgatcaatgaggctatggacgtcaagctgaagcgacaggaatcacaacagcgcgaggttgaccaggatgacgaagagaattcggaagaagatgagatggattcgggcacaatggtgcgcgctgttggcgacgaaatgggcactgtgagagtggcgtccaccatgaccgacggagccaacactatgatcgaacacgacgacacgctcccctcccagcttggaacgatggtcatcaatgctgaagacgaggaagaggaaggcaccatgaaacgccgcgacgagactatgcagcccgcgaagccttcctttctggaatacttcgagcagaaagagaaggaaaatcagatcaattcttttggtaaatccgtgccaggtcccctcaaaaattcttctgattggaaaatcccccaagatggagactatgaattcaaaacaagccaggagcagcagtctggtaaggatatttgtattcagaattgccaggggaatctactatgtcggtacgcgttctag

SEQ ID NO: 204750 - DNA, 1464 bp, Artificial Sequence
  Description of Artificial Sequence: Synthetic coding sequence
atggagaccgtgcagctgcggaaccccccccggcggcagctgaagaagctcgatgaagattcattgacaaaacagcccgaagaggtattcgacgtgctggagaagcttggcgagggatcttatggatccgtgtataaggccattcacaaagagactggccagatcgtggccattaaacaggtaccagtggagtcagatcttcaggaaatcattaaagaaatttccatcatgcagcaatgcgatagccctcatgtcgtcaaatattatggctcttatttcaaaaatacagatctctggatcgtcatggaatactgcggggccgggtccgtgtccgacattataagattaagaaataaaacattgactgaggacgagatcgccactatactgcagtctacccttaagggcctagagtacctgcacttcatgaggaaaattcaccgagacatcaaggccggcaacatcttactgaatacagaagggcatgctaaactggccgacttcggcgtggctggtcagctaaccgataccatggccaaaagaaacacagtaatagggacaccattctggatggctccagaggtgattcaggagattggatacaactgcgtcgctgatatttggtccctgggcattacagccatcgaaatggctgagggaaagcccccttatgctgacatccatcctatgcgcgcgatatttatgatccctactaacccccctcccacgtttagaaaacctgagctgtggtccgataattttacagacttcgtcaagcaatgcctcgtgaagagtccagagcagagggcaaccgctacgcaacttctgcagcacccctttgttcggtccgctaaaggggtaagtatcttaagggacctgatcaacgaagctatggacgtaaagcttaagcggcaggagtcacagcagagggaagtggaccaggacgatgaggagaattctgaagaagatgagatggactccggaaccatggttcgggcggtgggagatgaaatggggaccgtacgcgtggcaagcacaatgacagatggcgccaacactatgatcgagcatgatgacaccttaccgagccagctgggtaccatggttattaatgccgaagatgaagaggaagagggaaccatgaagaggagagatgaaacaatgcagccggctaaacctagctttctggaatacttcgaacaaaaggagaaagagaaccagatcaatagtttcggaaagtccgtccccggcccactcaaaaactcaagcgattggaagatcccccaagacggcgattacgaatttcttaaaagctggactgtcgaagatctgcagaaacgtctccttgccctggaccccatgatggagcaagaaatagaagaaatccggcagaaatatcagagtaagaggcagccaatcctcgatgcgatcgaagcaaagaaacgcagacagcagaacttctag

SEQ ID NO: 204751 - DNA, 1389 bp, Artificial Sequence
  Description of Artificial Sequence: Synthetic coding sequence
atggagaccgtgcagctgcggaaccccccccggcggcagctgaagaagcttgacgaggactccttgaccaaacagccggaggaagtgttcgacgttttggaaaagctcggtgaggggtcttacggcagcgtgtacaaggcgattcacaaagaaacaggacagatcgtagcaataaagcaggttcctgtggagtcggacctccaggaaatcattaaggaaatatccattatgcagcaatgcgactcccctcacgtggttaagtattacggcagttactttaaaaacactgacttgtggatagttatggagtactgcggtgccgggtcggttagcgacatcattcgcctacgaaacaaaaccctgacggaggacgagatcgccaccatcctccagtcgaccctcaaaggcttggagtacctccatttcatgagaaagattcaccgtgacattaaggccggaaatatcctcttgaatactgaaggacacgcaaagttggccgatttcggcgtggccgggcagctcaccgacacgatggcaaaaaggaatactgttatcggtaccccgttctggatggccccggaggtcattcaggaaattggttacaactgcgtcgcagatatctggtcactcggaataacagccatcgaaatggctgagggaaagcctccctacgcggacatccaccctatgagagctattttcatgataccaactaatccccccccaacgttcagaaagcctgaattatggagcgacaactttacggacttcgtgaaacaatgtctagtgaaatccccagaacaacgtgcaactgcaacccaactgctccaacatcctttcgtgcgatcagctaagggggtttcgattctgcgtgatttgatcaacgaggcgatggacgtgaagctgaaacggcaagagtcacagcagagggaagtagaccaggacgacgaagaaaactcagaagaggatgaaatggacagcgggactatggtcagagcagtgggcgatgaaatggggaccgtgcgggttgcaagcaccatgactgacggcgccaatactatgatcgaacacgacgacaccctgccaagccagcttggcaccatggtgatcaacgccgaagatgaggaagaggaagggacaatgaaacgcagggacgagaccatgcagcctgctaagccctcatttctggaatatttcgagcagaaagagaaggaaaaccagataaactcgttcgggaaatccgtccctggccctctgaaaaattcttctgactggaagatccctcaagacggcgactacgaatttaagacctcacaggagcaacaatctggtaaggacatctgtatacagaattgtcagggcaatctgctatgcaggtacgctttttag

SEQ ID NO: 204752 - DNA, 1299 bp, Artificial Sequence
  Description of Artificial Sequence: Synthetic coding sequence
atggagaccgtgcagctgcggaaccccccccggcggcagctgaagaaactagacgaagatagcttaaccaaacagccagaggaagttttcgacgtcctggagaaactcggagagggatcctacggcagtgtgtataaagcaattcacaaggaaacaggccagatagttgccattaagcaggtccccgtagagtctgacctgcaggagatcatcaaggaaattagcatcatgcaacagtgcgacagtccccacgtggtgaagtattatggctcatatttcaaaaacactgacctgtggattgtgatggagtattgtggtgccggaagtgtgagtgatattatccgtctacggaacaagacggataccatggcgaaacgtaacacagtgatcgggactcctttttggatggcccctgaggtaatccaggagatcggatacaattgcgtggcagatatctggagcctggggatcacggctatcgaaatggccgagggcaagcccccttacgccgatatccatcctatgagggccatcttcatgattccaaccaatccacctcctacattcagaaagcccgagctttggagcgataactttacagacttcgtgaagcagtgcctcgtgaagagcccagaacagcgagccaccgctacgcagcttcttcagcacccttttgtccggtcagctaaaggggtgagtatcctccgggacctcatcaatgaggccatggacgtaaaattgaagcgacaggagtcgcagcagagagaagtcgaccaggatgacgaggaaaactcagaggaggatgagatggacagtggaacgatggttagagccgtaggcgatgagatgggcaccgtgcgcgtggcgtctacgatgaccgatggagctaatactatgatagagcacgatgataccttaccctcccaactgggcacaatggttattaacgccgaagatgaggaagaggaagggaccatgaagcgtcgcgacgagaccatgcagcctgctaagccgtctttcttggaatacttcgagcagaaggagaaggagaaccagatcaattcatttggcaagagcgtgccaggccctctcaaaaactcttctgactggaaaatccctcaggatggggattacgaatttctgaaaagctggactgtggaggacctgcagaagcgcctcctggctctggatccgatgatggagcaggaaatagaggaaatcaggcagaagtaccagtctaagagacagcccatcttggacgctattgaagctaaaaagagacgtcaacagaatttttag

SEQ ID NO: 204753 - DNA, 1254 bp, Artificial Sequence
  Description of Artificial Sequence: Synthetic coding sequence
atgaagcggcgggccagcgaccggggcgccggcgagaccagcgcccgagcgaaagctctgggaagtggaatcagtggtaataacgcgaagagggccggtccctttatcttaggccccagactggggaatagccccgtgccttctatagtacagtgcctggcgcgcaaggatggcactgacgatttctaccagctgaagattctgacccttgaggagcggggcgaccaaggtatcgagagtcaggaggaacgccaaggaaaaatgctgctccataccgaatattcgctgttgtcattgctccacacacaagacggggtggtccatcaccatgggttattccaggataggacgtgtgaaatcgtggaggacaccgagtcttcaagaatggtcaaaaagatgaaaaaacgcatttgcctggtcctagattgcctgtgtgcccatgacttcagcgacaaaaccgccgatttgattaacctgcaacattacgtgatcaaggaaaagagactgtctgaaagggagaccgttgtgatcttctatgatgtggttagggtcgtggaagcactgcaccagaaaaacatagttcaccgggatttgaaacttgggaatatggtactcaacaaacgaacccatcgtattacaatcaccaacttttgcctcggcaaacacctggtcagcgagggcgatctgctaaaggaccaacggggaagccccgcctacatctcaccggatgtcctgtcagggaggccatacagaggcaaaccctccgacatgtgggctcttggtgttgttctgttcactatgttatatgggcaatttcccttctatgactctataccccaagagctttttagaaagataaaggcagctgagtacacaatccccgaagatggacgggtctcagaaaataccgtttgcctgattagaaagctcctcgtgctggacccccagcaacggttagcagctgcggacgtgctggaagccctcagcgccatcatcgcgagctggcagagcctgagttccttgtctggccccctacaggtggtgcccgacatcgacgaccagatgtcaaatgcagattcctcacaagaggtatcttggggagggcagatgggtcactatccagccccaagggaccggcttcttggcgcagggagggcgagagccgaagtggccgcaaccagacgaccgcagagtttccttggcctgttgccccagccatggggggggaagggtcgcctccagtcctctgcctag

SEQ ID NO: 204754 - DNA, 1308 bp, Artificial Sequence
  Description of Artificial Sequence: Synthetic coding sequence
atgaagcggcgggccagcgaccggggcgccggcgagaccagcgccagagccaaagctcttggttcgggcattagtgggaataatgccaagcgcgccggtcccttcattttgggaccaaggctgggaaacagtcccgtgccatccattgttcagtgcctcgccagaaaagacggcacggatgacttttaccagctgaagatcctgactttagaagagcggggagatcaggggatcgagagtcaggaagaacgccagggcaagatgctacttcatacagaatactcattgctgagcttattacatacccaggatggggtggtacatcatcacgggctattccaggatcggacttgtgagatagtggaggacactgaatccagccgcatggtgaagaagatgaagaagagaatttgtcttgtactggattgcctgtgcgcccatgatttctctgataagacagccgacctaatcaacctacaacactacgttatcaaggaaaagcggctaagcgaaagagagactgtcgtgatattttatgacgttgtgagagtcgttgaggccctgcaccagaagaatattgttcatcgcgatttaaagctcggaaacatggtgctgaacaagcgcacacacaggattaccattaccaatttctgtcttgggaagcacttagtctctgaaggagacctcctgaaagaccagcgcggatcacctgcctacatctctcccgacgtcctcagcggccggccatacaggggtaaaccatctgacatgtgggcgcttggggtggtcctcttcacaatgctgtatggtcagtttcctttttatgactctattccacaggagctcttcaggaaaatcaaagctgctgaatatactattccagaggacggccgcgttagtgaaaacaccgtttgcctcattcgcaagctactagtgctcgatccccagcagagattggccgcggctgatgtgctggaagcactgtcagccattattgctagttggcagagcttgagctccctgtcaggtcctttacaagttgtgccggatatagacgaccagatgtcaaacgcggactcctcgcaagaggctaaagtgactgaagagtgtagccagtacgagttcgagaactatatgcggcagcagttgctgttagctgaagagaagtcttcaatccacgacgcacggtcatgggtgcctaagagacagtttggatccgcccctcccgtccgtagactcggacacgacgcccagccaatgacctctcttgatacggcaattctcgcccaacggtacctaagaaaatag

SEQ ID NO: 204755 - DNA, 1323 bp, Artificial Sequence
  Description of Artificial Sequence: Synthetic coding sequence
atgaagcggcgggccagcgaccggggcgccggcgagaccagcgccagggcaaaagcgctgggtagtgggatctctggcaacaacgccaaaagagcgggaccatttattctggctttatgcgcagtcggaccaagacttggaaacagtccggtgccctcgatcgtccagtgcctagccagaaaggacgggaccgacgacttttaccaacttaaaattttgacgctcgaagagagaggggatcagggcattgaaagccaggaggagcgccagggaaagatgctgttgcatacggagtactctttgttgagtctgcttcatacccaagatggggttgtgcaccaccatggtttgttccaggaccgtacttgtgaaatcgttgaggacactgagagctccaggatggtcaaaaagatgaaaaaaagaatctgcctggttctcgactgtctgtgtgcccatgattttagcgataagactgccgatctcatcaacctgcagcattatgtgatcaaggagaaacggctcagcgaacgcgaaactgtggtcattttttacgatgttgtaagagtggttgaggcacttcatcagaagaatattgtgcacagggacttgaagcttgggaacatggtgctgaacaagcggacccaccgcattaccatcactaacttttgtctggggaaacacctggtcagcgaaggcgatctgctaaaggatcagcggggatcccccgcctacatctctccggacgtactaagcggacggccctatcggggtaagccgtccgacatgtgggcattaggcgttgtgctttttaccatgctgtacgggcagttcccattttacgattctatccctcaggagctgttcaggaaaatcaaggccgcagaatacaccattcctgaggacggtagagtctctgaaaatactgtttgcttaatcaggaaactcctcgttctggacccccagcaacgcttggcagcagccgatgttctggaggccctgagcgctattatcgcatcctggcagtcattgagctctctaagcggccctcttcaggtggtgcctgatatcgacgaccagatgagcaatgcagactcatctcaggaggcgaaggttaccgaggagtgcagtcaatatgagttcgagaattatatgaggcagcagctgctgctggcagaggagaagagtagcatccatgatgctcggtcttgggtgccaaagcggcagtttggaagcgctccaccagtgagaagacttggacatgatgcgcagcctatgacatcattggacaccgctatcctggcgcagcgctatctcagaaaatag

SEQ ID NO: 204756 - DNA, 1308 bp, Artificial Sequence
  Description of Artificial Sequence: Synthetic coding sequence
atgaagcggcgggccagcgaccggggcgccggcgagaccagcgcccgagcaaaggccctgggtagtggcatatctggcaacaacgcaaaacgggccggaccttttatactcggcccccgcctgggcaatagccccgtcccttccattgtgcagtgtctggccagaaaggacgggaccgatgatttctatcagctgaagatcctaactctagaagagaggggggatcagggcattgagagtcaagaagaacgtcaaggcaaaatgcttctacacaccgagtacagcctcctgtctttgctgcatacgcaggatggggttgtgcaccaccatggcttgtttcaggacagaacgtgtgagatcgtcgaagatactgagtctagtcggatggtgaagaagatgaagaaaagaatttgtctggtgcttgattgtctctgcgcacatgactttagtgataaaacggctgatttgatcaatcttcagcactacgtgattaaggaaaaacgactttccgaaagggaaacagtggtgattttctacgatgtagttagggtcgtggaggcactgcatcaaaagaatatagtacatcgggatctgaaactcggcaatatggttctcaacaaaaggacgcaccgcataacgatcaccaacttctgtctgggcaaacacttagtctccgagggagacttgcttaaggaccagagaggatcaccggcctatattagtcccgacgtccttagcggtaggccgtaccggggtaagccctccgatatgtgggcccttggagtagtcctgttcacaatgctgtacggacaatttcctttctacgattctatcccacaggagttattcagaaaaattaaagccgcagaatataccatcccggaggatggacgggtctccgaaaatacagtctgtcttatcaggaaattactcgtgctagacccccagcagaggctggcagccgcggacgtactggaagctctcagcgcaatcatcgcctcttggcagtccctgtcttctctgtcaggtccgctgcaggtggtgccggacatcgatgatcagatgtctaatgcagattctagtcaggaggccaaagtgactgaggaatgtagccagtacgagttcgagaactatatgagacagcagttgctgttggctgaagaaaagtcttccattcacgatgccagatcttgggtgccgaagagacagtttgggtctgcaccccccgtaaggagactggggcatgacgcccaacctatgactagcctggacactgccattcttgcacagaggtaccttcgtaagtag

SEQ ID NO: 204757 - DNA, 1092 bp, Artificial Sequence
  Description of Artificial Sequence: Synthetic coding sequence
atggccatgcggcagacccccctgacctgcagcggccacacccggcccgtggtcgatttagcctttagcgggatcacgccatatggctactttctgattagtgcctgcaaaggagccggtcaacatttgcccaggctctcgggacaacatgacggaaagcctatgctcagacaaggggacaccggggactggatcggcacctttctgggccataagggtgcagtctggggcgccactctgaataaggatgccaccaaggctgctaccgccgctgccgatttcactgccaaagtttgggacgcagtgagcggggacgaacttatgactctggcacacaaacatattgttaaaaccgtggattttacgcaggatagcaactatctgctgacgggaggacaggacaagctgcttaggatatatgacctcaacaagcccgaggccgagcccaaggagattagcgggcacacaagtggcatcaagaaagcgctgtggtgctcggaggacaagcagattctgagcgctgacgataaaaccgttagattatgggatcacgccaccatgaccgaagtcaagtcactgaatttcaacatgtctgtctcctctatggaatatataccagaaggggaaatcttggtgatcacatacggaagatccatcgctttccactcggccgtctcccttgatcccattaaatcctttgaggctccagccaccattaactctgcctccttgcatcccgaaaaggagttcctagtggccggcggtgaggattttaaactgtataaatacgactataatagtggagaggagctggagtcttacaaagggcactttggaccaatacattgcgtgagatttagcccagacggggaattatatgcctccggttcagaggacggtactctccgcctgtggcaaacagttgttggcaaaacctacggcctctggaaatgcgtgcttccagaggaggactctggtgaactggcgaagcctaagatcggatttcccgagaccacagaggaggaactggaggagatcgcgagcgaaaacagcgattgtatctttccctctgccccagatgtgaaggcatag

SEQ ID NO: 204758 - DNA, 1053 bp, Artificial Sequence
  Description of Artificial Sequence: Synthetic coding sequence
atggccatgcggcagacccccctgacctgcagcggccacacccggcctgtagtggacctggctttttcagggatcactccttacgggtatttcctgatcagcgcatgcaaggacggaaaaccgatgctgcgccagggcgatactggagactggatcggaacctttctgggacataagggcgcagtctggggcgcaactcttaacaaggacgccacaaaggctgcaacagcggccgccgattttacagccaaagtctgggatgctgttagtggggatgagttgatgaccctggcccataaacacatagtgaaaactgtggatttcacacaagatagtaattacttgctaaccggaggacaggacaaactactacggatctatgatctgaataaacccgaagccgagcctaaggagatttccgggcatacatcgggaattaagaaggccctctggtgcagcgaggacaaacagatcttgagtgctgatgacaaaacagtacgtttatgggaccatgcgaccatgactgaggtgaaaagccttaacttcaacatgagtgtctcttcaatggagtacatcccggagggggagattctggtcataacctatgggagaagtatcgcttttcatagcgccgtcagtctggatccaatcaaatcatttgaggcccctgctacaatcaattccgcgtcccttcacccagaaaaggagtttctcgtcgctggtggcgaagacttcaagctttacaagtacgactacaacagtggagaggagctggaatcctataaggggcactttggccctattcattgtgtgaggttcagtccagacggagagctgtacgcaagtggctctgaggacgggaccctgagactctggcagacggttgtgggtaaaacatatggattatggaagtgtgtgctccctgaagaggacagcggagaacttgccaaacccaagatcggcttccctgaaacaactgaggaggaactggaggaaatcgcatccgaaaacagtgactgtatcttccccagcgctccagatgtgaaagcatag

SEQ ID NO: 204759 - DNA, 771 bp, Artificial Sequence
  Description of Artificial Sequence: Synthetic coding sequence
atgaccctggcccacaagcacatcgtgaagaccgtggacttcacccaagattcaaactatcttctgaccggtggccaggacaaattgctccgcatctacgatttgaacaagccggaggcagagcccaaggaaataagcggtcatacaagcgggatcaaaaaagcactgtggtgttcagaagataagcaaatcctgtctgctgacgataaaactgttcggctgtgggatcacgccactatgacagaggttaagtcacttaatttcaatatgagcgtctccagcatggaatatattccagaaggcgagatccttgttatcacctacgggcgctccatcgctttccattccgcagtgtcactggatcctatcaagtccttcgaagctccggccacaataaacagtgcctccctccaccccgaaaaagagttcctagtggccgggggtgaggatttcaagctgtacaaatacgactacaacagtggcgaggagctggaatcctacaagggtcactttgggccaattcattgcgtgcgattcagccccgacggagagctgtatgcaagtggctcagaggatggcacactgcgcctgtggcagactgttgtgggaaagacgtacggcttatggaagtgcgtactcccagaggaggatagcggggagctggccaaaccaaagatcggttttcccgagacaacagaggaagagctcgaggagattgcgtccgagaatagcgactgtatttttccctcggcccccgacgtgaaagcatag

SEQ ID NO: 204760 - DNA, 1707 bp, Artificial Sequence
  Description of Artificial Sequence: Synthetic coding sequence
atgaagaacaagatccaggtggtggtgctggagaacgagggcctgcagcagcagctcaaatctcagaggcaggaggaaaccctgcgcgaacagaccctcctagatgcttctggaaacatgcataactcatggatcaccactggcgaggattctggcgtgggagagacctctaaaagaccatttagccatgacaacgctgatttcggaaaagctgcgtctgccggcgagcagttggaactggaaaaactcaagcttacctatgaagagaaatgcgaaatcgaggaaagccagctgaagttccttagaaatgacttagcagagtaccagcgtacttgcgaagacctcaaagaacagctgaagcacaaagagtttctgctggccgccaatacttgtaatagggtcgggggtctgtgtctcaaatgcgcacagcacgaggccgtgctctcccagacccataccaatgtgcatatgcagacaatagaacgcctggtgaaagagagggatgacctgatgagcgccttagtcagcgtgcgctctagtctggcggacacccaacagagggaggctagtgcctacgagcaagtgaaacaggtgctgcagatttcagaggaagccaattttgaaaagaccaaagcgctgatacagtgtgatcaattgaggaaggaacttgagcgacaggccgagaggctggagaaggagctcgcgtcccaacaggaaaaaagagctattgaaaaagatatgatgaagaaagagatcacaaaggagagagagtacatggggtccaagatgttgatcttgagccagaacattgcacagctcgaagcccaggtagaaaaagtgaccaaggaaaagattagtgccattaatcagcttgaagagatacagagtcaactcgcaagcagggaaatggatgtcactaaggtatgcggcgaaatgaggtatcagcttaataaaacaaatatggagaaagatgaggccgagaaggagcaccgcgaattccgtgctaaaacgaatcgcgatctcgagattaaggaccaggagatcgagaagttgagaattgagctggacgagagtaagcagcacttggaacaggagcagcagaaggccgctctggccagagaggaatgtctgagactgacagagctgctgggggagtctgagcatcagttgcatctgacacggcaggagaaggattctattcagcaatcttttagcaaggaagcaaaggctcaggcgttgcaggctcagcaacgcgagcaagagctgacccaaaagatacaacagatggaagctcagcacgacaaaaccgagaacgaacagtacctcctccttacttcacagaacactttcctgacaaagttaaaggaggagtgctgtacgctggcaaaaaagttggaacaaatctcccagaagacaagaagtgagattgctcagctgtcacaagagaagaggtacacatatgacaaactgggcaaacttcaaagaagaaacgaagagttggaagagcagtgcgtccaacacggccgcgttcacgaaactatgaaacagaggctcagacagctggacaaacatagccaggcaaccgcccagcagcttgttcaactgttgtccaagcagaatcagctgctgctggaacgccaatctctgtccgaggaggttgacagacttaggacccaactcccgtccatgccccaatctgattgctag

SEQ ID NO: 204761 - DNA, 2013 bp, Artificial Sequence
  Description of Artificial Sequence: Synthetic coding sequence
atggccaagagccccgagaacagcaccctggaggagatcctgggccaataccagcggtccctgagagagcatgcttccagaagtatccaccaactcacatgcgccctcaaagagggcgacgttaccattggtgaagatgccccgaatctctctttcagcacaagcgtgggcaacgaggacgctcgcacggcctggcctgagttgcagcagagccatgccgtcaaccagcttaaggatctgctaagacagcaggctgataaagagtccgaggtgtctcccagccgacggaggaaaatgtctcctttgagatctctagagcatgaagagaccaatatgccaactatgcatgacttagtacacaccatcaatgaccagagccaatacattcaccatctcgaggctgaagtcaagttctgcaaggaggagctatctggcatgaaaaataagatccaggtggtggttctggaaaatgaaggccttcagcagcaacttaagagccaacggcaggaagaaactcttcgcgagcaaacactgcttgatgcgagcgagaagttaaaacttacttacgaagaaaagtgcgaaattgaagaatcccaactcaagtttctgaggaacgacctggccgagtaccaacgtacttgtgaagatcttaaagaacagcttaaacataaagagtttcttctggccgccaacacttgtaaccgggttggcggcctgtgtctcaaatgcgcacagcatgaggcagtacttagtcagactcacaccaacgttcatatgcagacgatcgaaagactggtgaaggagagggacgacttgatgtctgccctggtgtcagtcaggagcagcctagctgacacccagcagagggaagccagtgcgtacgaacaggtaaaacaagtgctccagatttctgaggaggccaacttcgaaaaaactaaggctctgattcagtgcgaccagctcagaaaggagttagagcgccaggctgagagacttgagaaagagttagcttctcagcaagaaaaacgagcgatcgagaaagacatgatgaaaaaggagattacgaaggagagagagtatatgggtagcaagatgcttatcctgtcccagaatatcgcccagctcgaggcacaagtcgaaaaagtcactaaggaaaagatctccgcaattaatcagctggaggaaatccagagccagctggcctctcgtgaaatggacgtcactaaagtttgtggggaaatgcgctatcaactgaacaagaccaacatggagaaagatgaggcagagaaggagcatcgcgagtttcgcgccaagacgaaccgggatttagaaattaaagaccaggaaattgagaagttgcgaattgagctggacgagtccaagcaacacctcgagcaggagcagcagaaagccgccctggctcgtgaggaatgtttacgtctgacagagctgctcggcgaaagcgagcatcaactgcacttgactagacaagagaaggacagcatacaacagagtttcagtaaggaagctaaggcacaggccctccaggctcagcagagagagcaggagctgacacagaagatacagcaaatggaagcccagcatgataaaacagaaaacgaacagtatttgcttttaacgtcgcagaatacctttctcacaaagctgaaagaagaatgctgcacactcgccaaaaagttggagcaaatttcccagaagactaggagcgagattgcgcagctgtcccaggagaaacggtacacatacgataagcttggcaagctgcagagacgcaatgaggaactcgaagagcagtgcgtccagcatggtagggtgcatgagacaatgaaacagcgtctccggcagctggataaacatagtcaggccaccgcccaacaactggttcaactgctgtccaaacaaaaccaattgctgctggaaagacagagcctcagcgaggaggttgaccgcctacggacccaactgccgtcgatgccacagtctgactgttag

SEQ ID NO: 204762 - DNA, 2142 bp, Artificial Sequence
  Description of Artificial Sequence: Synthetic coding sequence
atggccaagagccccgagaacagcaccctggaggagatcctgggccaataccagcgctccttgagggaacacgcatcaaggtctatccaccaactcacgtgtgcccttaaagaaggagatgtgaccattggtgaggacgctcccaatctttccttctctacctctgtggggaatgaggacgcgcggactgcatggcccgagctccaacagtcccatgccgttaaccagcttaaagatctgctcaggcagcaggctgacaaggagtccgaggtttcaccgtccaggcggagaaaaatgtctcccctgcgaagccttgagcacgaagagactaatatgccaaccatgcatgatctagtccacactattaacgatcagtctcagtacatccatcatctcgaggctgaagtgaaattctgcaaagaggaactgtcaggaatgaaaaacaagatccaagtggtcgtcctggaaaacgaagggctgcagcagcaactgaagtctcagcgacaggaggaaacactcagagagcagacgttgctcgacgcctcagggaatatgcacaacagctggattaccactggcgaagacagcggagtcggagagaccagtaaaagacctttctcccacgacaacgctgacttcgggaaggccgcctctgcgggtgagcagcttgagctcgaaaaactgaagctcacatacgaggagaaatgcgagattgaagagtcacaattaaaattcctgcgcaatgacctggccgagtatcagcgaacatgcgaagacttaaaggagcagcttaagcacaaggagttccttctggccgccaatacctgtaacagagtcggtggcctgtgtctgaaatgcgcccagcacgaagctgtcctgagtcagacccacactaatgtacatatgcaaacaatcgagcgcctggtcaaggagagagacgacctcatgtccgctctagtttcagtgcggagcagcctggctgacactcagcaaagagaagccagcgcctacgaacaggtcaaacaggtgcttcagattagtgaagaggccaacttcgaaaagaccaaagccctcattcagtgtgaccagctgcggaaagagctggagaggcaagctgaacggcttgagaaggagctcgcttcacagcaggagaaacgcgccattgagaaggacatgatgaagaaggagatcacgaaggagcgcgagtatatggggtcaaagatgctcattctcagccaaaacatagcccagctcgaggcccaggtcgagaaggtgacaaaagagaagatcagcgccattaatcagctggaagaaatccaatcccagttggcctcccgcgagatggacgtgacaaaagtgtgcggcgaaatgaggtaccagttaaataagacgaatatggaaaaggatgaggccgaaaaggagcacagagagtttcgggctaagaccaatagggacttggagattaaggaccaggaaattgagaaactgaggatcgagcttgacgagtcaaaacagcatctggagcaggagcaacaaaaagccgcactggcaagagaggagtgcctgcgcctgaccgaattgctgggcgagagcgaacaccagttacacctcacgcgtcaggagaaggatagcatccaacaatccttctcgaaagaggctaaggcgcaggccctacaggcgcaacaacgcgagcaggagttaactcaaaaaatccagcagatggaggcacaacacgacaaaaccgaaaacgagcaatacttgctgctgacttcccagaacacctttcttaccaagctgaaggaagagtgctgcactctcgcaaaaaaactcgagcagatctcccaaaaaactagatccgagattgcccagttgtcacaggaaaaacgatatacctacgataagttggggaagttgcaacgcagaaacgaggagctcgaggaacagtgtgttcagcacgggagggtccacgaaaccatgaaacaacggctcaggcagctcgacaaacactctcaggccactgcccagcagttggttcaactgctctccaaacaaaaccagttgctgctggaaagacaatctctttctgaagaggtggataggctcaggacacaattgccttctatgccacagagcgattgctag

SEQ ID NO: 204763 - DNA, 1083 bp, Artificial Sequence
  Description of Artificial Sequence: Synthetic coding sequence
atggccaagagccccgagaacagcaccctggaggagatcctgggccagtatcagagatcactgcgagagcacgcctcaaggtccattcatcaacttacttgcgcactgaaagaaggggatgtcacgatcggagaggacgcacctaatcttagctttagcacttccgtcggcaacgaagatgctcgtacagcctggcccgagctccagcagagtcacgcggtgaaccaactgaaggatttgctgcgacagcaagccgacaaggagtcagaagtgtcgccgtctaggcgccgcaagatgagccccttacgctccctggaacatgaagaaacaaacatgccaactatgcacgacctggtccacactataaacgatcagtcgcagtatattcaccatcttgaggctgaggttaaattctgcaaggaagagctgtccggcatgaagaataagatccaggttgtcgtgttagaaaatgaagggcttcagcaacagctgaaaagccagcggcaggaggagaccctgcgagaacaaaccttgcttgatgcctcaggaaacatgcacaacagttggatcacaacaggcgaggacagcggggtcggcgaaacctccaagaggccattctctcacgacaacgcggatttcgggaaagcagccagcgccggagagcaattagagctagagaaattaaagctgacatacgaagagaagtgtgagatagaggagagccagctcaaattcctcagaaacgatcttgctgagtatcaaagaacatgcgaagacttgaaagaacagctgaaacacaaggaattcttgctggccgccaatacttgcaaccgcgtcgggggcttgtgtcttaaatgtgctcagcatgaggctgtattaagccaaacacatacaaatgtgcatatgcagacaattgagcggttggtgaaagagcgtgatgaccttatgtccgccctggtcagtgtgaggtctagcctagccgacacccagcaaagggaagcctcagcttatgagcaggttaagcaggtgctccagatctcggaggaagctaattttgagaaaaccaagcacccttcccagtag

SEQ ID NO: 204764 - DNA, 1245 bp, Artificial Sequence
  Description of Artificial Sequence: Synthetic coding sequence
ctgctggacgccagcgagaagctgaagctgacctacgaggagaagtgtgaaatcgaagaatcgcagctaaagttcttgaggaacgacttagcagaatatcagagaacatgcgaagatttaaaggaacagctgaagcataaggagttcctccttgctgctaacacctgtaatcgggtaggcggactgtgcctgaagtgcgcacagcatgaagcggtactatctcagacccatacaaacgtgcatatgcagacaattgagaggttggttaaggaacgagacgacctaatgagtgccctggtttctgtacgctcgagtctggccgatacccagcagagagaagcctccgcctacgagcaggtgaaacaggtgctccagatttctgaggaggctaacttcgagaagactaaggcccttatccaatgtgaccagctccgcaaagaattagagagacaggctgagcgcctggagaaagaattggcctcacagcaagagaaacgtgccattgagaaagatatgatgaaaaaagagatcacgaaagagcgcgagtatatgggctctaagatgctgattctgtcccagaatattgctcagctggaggcccaggtcgaaaaggtgacaaaggaaaagatcagtgcaatcaaccagttggaggagatacagtcacagctagcatctagggagatggatgtaaccaaagtgtgcggcgaaatgcgttatcagttgaacaaaacaaacatggagaaagatgaggccgagaaagaacaccgagagttcagggccaaaaccaacagagacctggagatcaaagaccaggaaatcgaaaaactcagaatcgagctggacgagtccaaacaacatctagaacaagagcaacaaaaggccgcccttgcaagggaggagtgtctccgattgaccgaactgcttggtgaatccgagcaccagctccacttaacgagatccgaaatcgctcagctgagtcaggaaaagcgctacacttacgacaaattaggcaaactgcaacgacgaaacgaagagctggaagaacaatgcgttcagcacggcagagtccatgagactatgaaacagcggctgcgacagctggacaagcactcgcaagcgaccgcacaacaactcgtgcagctcctgtctaagcagaatcagctgcttcttgagaggcagtccctgtcagaggaggtggaccgcctgcggacccagttgccctccatgcctcaatctgactgttag

SEQ ID NO: 204765 - DNA, 729 bp, Artificial Sequence
  Description of Artificial Sequence: Synthetic coding sequence
atggacgacctgtgcgaggccaacggcaccttcgccatcagcctgtttaaaatcctaggggaggaagataacagtcgcaatgtgttcttctcccctatgagcatttcatcagccctggcaatggtcttcatgggggccaaaggcagcaccgcagcacaaatgtctcaggccctatgcctgtataaagatggggatatccacagaggcttccagagtctgctgagtgaagtcaaccgcactggcacacagtatctgttgcggacggccaaccgcctgttcggggagaagacctgtgacttcctgcccgacttcaaggaatactgtcagaaattctaccaggccgaactggaggaattgtccttcgctgaagataccgaggaatgccggaagcacatcaacgactgggtcgcagaaaagacggagggcaaaatcagtgaagtgttggacgcaggcaccgtcgaccccctgactaaactggtgttggttaacgctatctattttaaaggcaaatggaacgagcagttcgaccgcaaatacactagaggcatgctattcaaaactaatgaagagaaaaaaaccgtgcagatgatgtttaaggaagctaagtttaaaatgggctatgctgatgaagttcacactcaggttctcgaactgccttacgtggaagaggaactgtctatggtgattctgctccctgatgacaatacagacttggctgtgaaggagtag

SEQ ID NO: 204766 - DNA, 1335 bp, Artificial Sequence
  Description of Artificial Sequence: Synthetic coding sequence
atgaaggtggtgcccagcctgctgctgagcgtgctgctggcccaggtatggctggtacctggactggccccatcaccacaaagtcccgaaacaccagccccccagaatcaaacttcaagagtcgttcaggcgcccaaagaagaggaggaggatgagcaggaggccagcgaagaaaaggcctctgaggaggagaaagcttggctcatggcctcccggcaacagctggctaaagagacctcgaactttggcttcagcttgcttagaaagatatctatgcgtcatgacggtaatatggtcttttccccctttggcatgtcactggcaatgaccggccttatgctgggcgctacaggaccgacggaaactcagataaagcgaggactgcatctccaggcactaaaaccgaccaagcccggcctgctgccatccctgtttaagggcttacgggaaaccctctcccggaatctcgagctgggcttgacgcagggatcattcgcattcattcacaaagacttcgacgtaaaagaaacttttttcaatttaagcaagagatactttgatacggagtgtgttcctatgaattttcgaaacgctagccaggctaaaaggctgatgaaccattacataaacaaggaaactcgaggaaagatccccaaactgtttgatgagattaacccagaaacaaagctcattctcgtggattatatactgttcaaagggaaatggctcacaccctttgacccggtattcactgaagtcgatacctttcatctggacaagtataaaaccataaaagtgccaatgatgtacggtgccggcaagttcgcctccaccttcgacaagaacttcaggtgtcatgttcttaagctaccataccagggtaatgccaccatgttggtcgtgctgatggagaagatgggagatcacctcgcactcgaagactatcttactaccgacctggtggagacctggcttcggaacatgaaaacacgaaacatggaagtgttcttccctaagttcaagctggaccagaaatacgagatgcacgagctgctgcggcagatggggataagacgcatcttttcgccatttgcggacctctccgaattgtcagccaccggacgcaacctgcaggtatcacgggtcctgcagaggaccgtcatcgaggtggatgagagaggcacggaagctgttgccggaatcctttctgaaataacagcttactccatgcccccagtcataaaggtggaccgtcctttccatttcatgatctatgaggagacaagtggaatgctcttgttccttgggagggtggttaatcccacactgctttag

SEQ ID NO: 204767 - DNA, 1335 bp, Artificial Sequence
  Description of Artificial Sequence: Synthetic coding sequence
atgaaggtggtgcccagcctgctgctgagcgtgctgctggcccaggtgtggttggtcccaggcctggcacccagtccacagtctccggagactccagccccacagaaccagacaagccgagtcgtccaagcccccaaggaggaggaggaggatgaacaggaagcctctgaggagaaagcctccgaagaagaaaaggcttggctgatggcttcacgccagcaactagccaaagaaacttccaattttggattttccctgttaagaaaaattagcatgcgacatgatggaaacatggtgtttagcccattcggcatgtcgctcgccatgacagggcttatgctcggagccactggacctacagagactcaaattaagcgcggtcttcacctccaagcgcttaagccgacaaaacccggattgctcccttctctgtttaaggggctgcgggagacgctatccaggaatctcgaactgggactcacccaaggctcctttgcttttattcataaagattttgatgttaaagaaactttctttaacttgagcaagcggtacttcgatacggagtgcgtgccaatgaacttcagaaatgcttcccaggccaaacgcctaatgaaccattacattaacaaggaaactcgtggtaagattccaaaactcttcgacgagattaatccggaaaccaaactgattctagttgattacattttgtttaaaggcaagtggctcaccccgttcgatccagtgttcaccgaggtggacaccttccacctcgacaaatacaagaccataaaggtccccatgatgtatggcgccggcaagtttgcgtccacatttgacaaaaattttaggtgtcacgtcctgaaactcccctatcaaggaaatgccacaatgttagttgttctgatggagaaaatgggtgatcacttagcccttgaggactatttgactacagatttagtggaaacatggctcagaaatatgaagacccggaatatggaagtgttcttccctaagttcaaattggatcaaaaatacgagatgcatgaacttcttcgtcagatgggtattcggcggatattttctccttttgctgacctctcagagctttcagctactggtaggaacctgcaggtatctcgagtgttacagaggactgtaatcgaggtggatgagaggggcactgaagctgtagcagggatcctgtcagagattacagcatattctatgccaccagttattaaggtcgataggcctttccatttcatgatatacgaggaaacgtccggcatgctgttatttctgggccgggtggtgaaccccaccttgctgtag

SEQ ID NO: 204768 - DNA, 1335 bp, Artificial Sequence
  Description of Artificial Sequence: Synthetic coding sequence
atgaaggtggtgcccagcctgctgctgagcgtgctgctggcccaggtgtggctggtgcctggcctagccccaagcccgcaaagtcccgaaacgcctgcaccgcagaaccagacatcccgcgttgtccaggcaccaaaggaggaggaggaagacgagcaggaggccagtgaagagaaggcctccgaggaggaaaaggcctggttgatggcttctcgacagcagctcgccaaggagaccagcaattttggctttagcctgctcaggaagatatctatgagacacgacgggaatatggtgttcagccccttcgggatgtcactagcgatgacaggtttgatgttaggcgcgacgggacctactgaaacacagattaaaaggggcttgcacctgcaagccctgaagccaacaaaacccgggctcctaccttctctcttcaagggcctgcgcgaaactctcagccggaacctggaattgggcctgactcagggcagcttcgcctttatccataaggacttcgatgttaaagaaacatttttcaatttaagtaaacgatacttcgacactgagtgtgtccccatgaattttcgcaacgccagtcaggcgaaacggctgatgaaccattatatcaataaggagacccggggcaagattccgaaactgtttgacgagatcaatccggagaccaagttaatcttagtggactacatccttttcaaagggaagtggttaactccattcgatcccgtctttaccgaggtggatacttttcacttagataaatacaaaaccattaaagtccccatgatgtatggcgcaggcaagttcgcctcaaccttcgacaaaaacttccgctgtcacgtcttgaagctgccttaccagggcaatgcaacaatgctagtggtactgatggaaaaaatgggcgatcacctggcactcgaggactatctgaccaccgacctcgtggaaacgtggctgcggaatatgaaaaccaggaacatggaggtgttctttcctaagttcaagctcgatcagaaatatgaaatgcatgaattactccgacagatgggaataagacgcatttttagcccattcgctgacctcagcgaattgagtgccacagggcgcaatttgcaggtctcacgcgtgttgcagaggaccgtgatcgaagtcgacgaacgcggaactgaggcggtggccgggattctctcggaaatcaccgcctattccatgccccctgtgattaaagtggatagacctttccacttcatgatttacgaggagacttctggaatgttgcttttcttgggcagagtcgtcaatcccaccctgttatag

SEQ ID NO: 204769 - DNA, 1455 bp, Artificial Sequence
  Description of Artificial Sequence: Synthetic coding sequence
atgagccggagcacccaggagctgctgggctaccactgccggctgcaggataagctccaggagcaggagggctctctggctgcagaaggacgtcacagtttggcctctgcagcagaccacatgaaggtagtcccgtccctgctgctgtctgtcctcctggcccaggtgtggttggtgccaggtcttgccccctcgccacaaagccctgaaactcctgctccacagaaccagactagtagagtcgtccaggccccaaaggaggaagaggaagatgagcaggaagcgagcgaggagaaggcgagcgaagaagagaaagcctggctgatggcttctaggcagcaacttgccaaggagacctctaatttcgggtttagcctgctccgtaagatttctatgcgccacgacggcaacatggtgttttctccttttgggatgagcctagccatgacaggcctgatgcttggtgcgaccggccctactgaaactcagatcaagagaggactgcacctgcaggcattgaaacctactaaaccaggactactgccctccttattcaagggtctcagagagacgctctctcgtaatctggaactagggctgacacaaggcagtttcgcttttattcacaaagacttcgacgtcaaggagacattctttaacttgtccaagagatactttgataccgagtgtgtacctatgaatttccgcaatgcatcacaggctaagcggctgatgaaccactatatcaacaaggaaacaaggggaaagattccaaagctgttcgatgaaattaaccctgagaccaagctgatcctagtggactacattttgttcaaaggaaagtggctgacccctttcgaccctgtttttacagaggtggacaccttccatctggacaagtacaaaacaataaaggtgccgatgatgtacggagctggaaagttcgcttccaccttcgacaagaacttccgatgtcatgtgctgaagctgccttaccagggaaatgcaaccatgttggttgtgttgatggaaaagatgggcgaccacctcgccttagaggattacctgacaacagacctcgtggagacgtggctgcgcaacatgaaaactaggaatatggaggtgttctttcctaaattcaaactcgaccagaaatatgaaatgcacgagctgctccgacagatgggaatacggcgcatattctcgccattcgctgatctctcagagctatcagctaccggaaggaacctgcaagtgagtcgtgttctccagcgcaccgtcattgaggtggacgagaggggcaccgaagctgtggccgggattctgtctgagattaccgcctatagtatgcctcccgttattaaagtggaccgacccttccactttatgatctatgaggaaacgtccggcatgctgcttttccttgggagagtggtaaaccctactctgctttag

SEQ ID NO: 204770 - DNA, 288 bp, Artificial Sequence
  Description of Artificial Sequence: Synthetic coding sequence
atggagcggatgctgcccctgctggccctgggcctgctggccgccggtttctgccccgccgtgctgtgccatcctaattcccctctagacgaggagaatctgacacaggagaatcaggacaggggcacacacgtggacttaggactggcatccgcaaacgttgatttcgccttcagcctttataagcacccccaccgttggtcgataaggctgtgtctgatgtatttgagaagagcacaaaaacacctgctgccgcagcaaagcaaatcccccagctttcttcattag

SEQ ID NO: 204771 - DNA, 1272 bp, Artificial Sequence
  Description of Artificial Sequence: Synthetic coding sequence
atggagcggatgctgcccctgctggccctgggcctgctggccgccggtttttgccctgccgttctttgtcaccccaattcacctctggatgaagaaaacctcactcaggaaaatcaggatcgagggacacatgtcgatctaggcctggcatctgcaaacgtcgactttgcctttagtttatataagcagctggtgctgaaagccccagataagaatgtgattttcagcccactgagcataagcacagcattggccttcctgagtttgggcgcgcataacacaacactaaccgagatactgaagggattgaagtttaaccttaccgaaacctcagaagcagaaatccaccagagcttccagcatctgctgaggaccctcaaccagagttccgacgagttacagctgtctatgggaaacgcaatgtttgtcaaggagcagttatcattgctggaccgctttaccgaggatgccaagcggctatacgggagcgaggcgttcgccacggactttcaggactccgccgccgccaagaagctcatcaacgattacgtcaagaacggtacccggggtaaaatcactgatctgataaaggacctcgactcgcagaccatgatggtcctcgtgaattacatattcttcaaagcgaaatgggagatgcctttcgaccctcaggacactcaccagtcccggttttacctgagcaagaaaaaatgggtaatggttcccatgatgagtctgcaccacctgacaatcccctacttccgagacgaggagctgagctgtacggtcgtggagctgaagtatacgggaaacgcgtcagcactgttcatactgccagaccaggataagatggaggaagtggaagccatgctcctgcctgaaaccctgaagagatggagagattccttggaattccgggagattggagaactctacctgccaaagttttcgatatccagagattataatctcaatgatattttgctccagttaggcattgaagaagcgttcacctctaaggccgaccttagcgggataacaggagcccgaaacctcgccgttagccaggtggtccataaggctgtactagacgtctttgaggagggaacagaagccagtgctgctaccgctgttaagataaccctgctaagtgccctggtggagacccggactatagtgcgctttaatcgcccctttctaatgataatcgtgcccaccgatacacagaacatattctttatgtcgaaagtcactaatccaaaacaggcctag

SEQ ID NO: 204772 - DNA, 1272 bp, Artificial Sequence
  Description of Artificial Sequence: Synthetic coding sequence
atggagcggatgctgcccctgctggccctgggcctgctggccgccgggttctgcccagctgttctgtgccaccccaattctcctttagacgaagagaacctgacacaggaaaaccaggacagaggcacccacgttgacctgggattggccagcgcgaacgtcgacttcgccttctctctctataaacaactggttctgaaagcccctgacaaaaacgtgatcttttcccccctctcaattagcactgctctggctttcctgagccttggagcccacaataccaccttaactgagatcctgaagggcttaaaatttaacctcaccgagactagtgaggccgagatacaccagtcatttcaacacctgctcagaactctaaatcagtccagcgatgagctgcagctatccatgggcaatgccatgtttgtgaaggaacagttgagtttgcttgaccgctttacagaggatgccaagcgcctctatggttccgaagctttcgccacagatttccaggattccgcggccgccaagaaactgattaacgactatgtgaagaatggcaccaggggtaaaattacagatttgatcaaggatctggattcacagacaatgatggtgctcgttaattacatattcttcaaagctaaatgggagatgccttttgatccgcaggatacccatcagagtcgcttctatctctcaaaaaaaaaatgggtgatggtgcccatgatgtcactacatcatttaaccatcccatactttagggatgaggaactcagctgcaccgtggtggagctgaaatacacaggcaatgctagcgctttgtttattctcccagatcaagataagatggaagaagtcgaagcaatgctgctgcccgaaactctgaagcggtggcgggactctctggaatttcgtgagattggagagctttatttgccaaagttctccatctcaagggattataacttgaacgacatcctcctgcagctcgggatagaggaagccttcacatctaaggccgacctaagtggaataaccggggcgcgcaacctggcggtttcccaagttgtccacaaggccgtgctggacgtctttgaggaagggacagaagcatccgctgccaccgccgttaaaataacactcctctccgccctcgtagaaacaaggaccattgtccgtttcaataggcctttcctgatgataattgttcccaccgacacccagaatattttttttatgtcgaaagtgaccaaccccaaacaggcatag

SEQ ID NO: 204773 - DNA, 1272 bp, Artificial Sequence
  Description of Artificial Sequence: Synthetic coding sequence
atggagcggatgctgcccctgctggccctgggcctgctggccgccggcttctgtcccgccgtactgtgtcacccaaactcacctctcgacgaagagaacctgactcaggagaaccaggatcgcggcactcatgttgacctcggtctggccagtgccaacgtagacttcgctttttccctgtacaaacagctggtcctcaaggcccctgataagaatgtaattttctcccctctctcgatctcaacagcactcgccttcctgtcactgggtgctcataatactaccctgaccgaaatcctgaaagggctgaaatttaacctcactgaaactagcgaggcagaaattcaccaaagctttcagcatttattgcgcacgttgaaccagagcagcgatgagcttcaactctctatgggcaatgccatgtttgtgaaggaacagctgtccctgctggacaggttcacagaggatgcaaaacgtctgtatggttccgaggctttcgctaccgattttcaagactccgcagccgcaaagaaattgataaacgactacgttaagaacggtacaagggggaaaatcaccgaccttattaaagacctcgactctcagacgatgatggtgctcgtgaattatatattcttcaaagccaaatgggaaatgccttttgacccacaggatacccatcaaagtaggttttatttgagtaagaaaaagtgggtgatggtgcccatgatgtccctgcaccatcttacaattccctacttcagagatgaagaactgtcttgcactgtcgtagagctgaagtacaccgggaacgcgagtgccctgtttattctccctgaccaggacaagatggaagaggtggaggccatgctgttgccagagaccctcaagcggtggagagacagcctcgagttccgggaaattggggaactgtatctgcctaagttttccatcagccgcgattacaacctgaacgacatcttgctgcaacttggcatcgaggaggcctttacttcgaaggcagatctgtctggtattactggcgcccgaaacctggcggtcagtcaagtggtgcacaaggccgtacttgacgttttcgaggagggcaccgaggcatcagcagccaccgctgttaagatcacgttgctgagcgcacttgtggaaacccgcactattgtgcgtttcaaccggccattccttatgatcattgtgccgactgacacccaaaatatcttttttatgtcaaaggttacgaacccaaaacaggcgtag

SEQ ID NO: 204774 - DNA, 1347 bp, Artificial Sequence
  Description of Artificial Sequence: Synthetic coding sequence
atgaagatccactacagccggcagaccgccctggagagcaccagctacattcagcttcccgaagcagagctgcgcatggagcgaatgttgccgctcttagcactggggttgctcgcagctggattctgccctgcagtgctctgccatccaaacagcccccttgatgaggaaaacctgacccaggagaaccaagatagaggcacacatgtcgatctgggcctggctagcgccaacgtcgacttcgctttctctctatacaagcagttggtgctaaaggccccagataagaatgtcatcttcagccccctttcgatctctacggccctggcgtttttgagcctcggggcccacaataccacgctaacagagatccttaagggtctcaaatttaatttgaccgaaacttctgaggccgagatacatcaatcattccagcatctgctgaggactcttaatcagtctagtgacgagctgcagctgtctatgggcaacgcgatgttcgtgaaggagcagctctctctgctcgataggttcaccgaagatgctaagagactgtacggttccgaagcctttgccaccgatttccaggatagcgcagccgccaagaagttaattaacgactacgtgaaaaacgggactcgggggaagatcactgatcttattaaagacctggatagccagaccatgatggtcctcgttaattacatctttttcaaagctaagtgggaaatgccatttgacccccaggacacacaccagtctaggttctatttgagcaagaaaaagtgggttatggtcccaatgatgagtctccatcatcttacaatcccatattttagggacgaagaactcagttgtaccgttgttgaactgaagtacactgggaacgcctccgcgctcttcatcctccctgatcaggacaaaatggaggaagtggaggccatgctcctacctgagaccctcaaacgctggagagactccctggagttccgggaaattggcgagctttatctgccgaaattctcaatcagccgtgactacaatctgaacgatattcttctccagctcgggatcgaggaggcctttacttcgaaagccgacctgagtggtatcactggggccaggaatttggcggtaagccaagtagtgcataaggcggtactcgatgtcttcgaggaagggaccgaggcaagtgccgcaacagcggttaagatcacactgctgagcgctttagtggagacccgtacaatcgttagattcaaccgacccttcttgatgattatagtacctaccgacactcagaatattttcttcatgagcaaagtgactaacccgaaacaggcgtag

SEQ ID NO: 204775 - DNA, 918 bp, Artificial Sequence
  Description of Artificial Sequence: Synthetic coding sequence
atggagcggatgctgcccctgctggccctgggcctgctggccgccggtttctgtcccgcggttctgtgccatccaaattccccgcttgatgaggagaacctgacacaagagaatcaggaccggggcacacacgtggacctgggcctggccagcgcaaacgtggattttgccttttccttgtataaacagctcgtcttgaaggcgccagataagaacgttattttctctccactgagtatttctaccgccctggcatttctgtcactgggagcccacaacaccactcttaccgagatcctgaaaggtctgaaattcaacttgactgagaccagcgaggccgaaatccatcagagcttccagcaccttttaaggacgttgaaccaatcttccgacgagctgcagctttccatggggaacgcgatgtttgtgaaagaacagttaagcttgctggacagatttaccgaagacgctaagcgtctctatggctccgaagccttcgcaaccgactttcaggactcagctgcagctaagaaactcataaacgactatgtcaaaaacggaacacgcggtaaaatcacagatctgattaaagacctcgattcacaaaccatgatggtcctggtgaattatattttttttaaggctaaatgggagatgccgtttgaccctcaggacacccatcagagccgattctatttgagcaagaaaaaatgggtcatggtgccaatgatgtctcttcatcacttgactatcccctacttccgagatgaagagctctcctgcacggtggttgaattgaagtataccggcaatgcgagcgccttgtttattctgccagatcaggacaagatggaggaagtcgaggcgatgctactgcctgaaactctaaaacggtggcgggacagcctcgagttttag

SEQ ID NO: 204776 - DNA, 1284 bp, Artificial Sequence
  Description of Artificial Sequence: Synthetic coding sequence
atgcacctgatcgactacctgctgctgctgctggtgggcctgctggctctgagccacggccagctgcacgtcgaacatgatggcgagagttgttctaactcctcccaccagcagattctcgagaccggcgaaggatcaccgagtctgaaaatagctcccgctaatgccgacttcgcttttagattttattatttaattgcgtccgagacccccggcaagaacatcttcttctctcctttatccatatctgctgcctatgccatgctgtcactcggggcttgttctcattcacgaagccagatcctggaggggctgggattcaacctgacagagctgtcggagtccgacgtacatcgaggcttccagcatctgcttcacactctcaatctgcccggacacgggttagagaccagggtgggaagtgcactgttcctgtctcacaacctgaaattcctcgctaagttcctcaacgacactatggctgtgtacgaagctaagctgtttcacacaaatttttatgatacagtaggcacgatacagttgatcaacgaccacgtgaagaaggaaacacgcggcaagatcgttgacctcgttagtgaactgaagaaggacgtgctgatggtactggtcaattacatatactttaaggcactgtgggaaaagccttttatcagctcacggacaacccccaaagacttttacgttgatgagaacacgacagttagggttccgatgatgttgcaggaccaggagcatcactggtaccttcacgaccggtatctgccatgttccgtgctgcgcatggactataaaggcgatgcgacagtgttctttatcctgcccaatcagggtaagatgcgcgaaatcgaagaagtgctcacacctgagatgctaatgcgttggaataatctcctgaggaagcgaaacttctacaaaaagctagagttacacctgcctaagttcagtatttccgggagctacgtactcgaccagatcttaccaaggctgggcttcactgacctcttcagtaagtgggcggacctgagtggcatcacaaagcaacaaaaactcgaagcatcgaaaagtttccacaaagcaacactcgatgtggacgaagccgggaccgaggccgccgccgctacctctttcgccatcaagttcttttcagcgcagactaacaggcacatcttgaggtttaaccggccttttttggtcgtgatttttagcaccagtacccagagtgtgcttttcctgggcaaggttgtggaccccacaaaaccttag

SEQ ID NO: 204777 - DNA, 1284 bp, Artificial Sequence
  Description of Artificial Sequence: Synthetic coding sequence
atgcacctgatcgactacctgctgctgctgctggtgggcctgctggctcttagccacggacagctccacgtcgagcacgacggagaatcttgttctaattcctctcaccaacagatacttgagacaggagaaggatctccaagcctgaagatcgcacccgctaacgccgatttcgcctttcggttttattacctgatcgccagtgagacaccaggaaagaacatatttttcagtcccctgagcatcagcgccgcctatgccatgctgagtctgggcgcgtgtagccactcacggtcacagatacttgaggggctggggttcaacctcaccgagctgagcgaatcagatgtccaccgcggatttcagcacctgctacatacattaaacttgcccggtcacgggctagaaaccagggtcggatccgcattgtttttgtcacataacctcaaatttcttgccaagttcctcaacgacacaatggcagtatatgaggccaagctgttccacactaacttctacgatacagttggtacaatccagttaattaatgaccatgttaaaaaagaaacaaggggcaaaatcgtggatttggtgagtgagcttaaaaaggacgtcctgatggtactcgtgaactatatttactttaaagcactgtgggaaaagcctttcatctcttcccggactacccccaaggatttctatgtggatgagaataccactgtccgggtgccaatgatgttacaggaccaggaacaccactggtacctccacgacaggtacctgccatgcagtgtcctgagaatggactacaaaggtgatgccacagtgttttttatcctgcccaaccaggggaagatgagagaaatcgaagaagttttaacgccggagatgttgatgcggtggaacaacttattgcggaaaaggaacttttacaaaaagcttgagctacatctgcctaagttttccatctccggaagctacgtgctggaccagatcttgcctaggcttggttttactgatctctttagtaaatgggctgacctttcaggaattacaaaacagcagaagctggaggccagcaaatccttccacaaggctacgttggacgtggacgaagcgggtaccgaagcggctgctgcaacttcgtttgcaattaagtttttttccgcacagaccaataggcacattttacgcttcaataggcccttcttagttgtcattttctccaccagcacgcagagcgtcctttttctgggaaaagtggtcgacccaaccaaaccctag

SEQ ID NO: 204778 - DNA, 1284 bp, Artificial Sequence
  Description of Artificial Sequence: Synthetic coding sequence
atgcacctgatcgactacctgctgctgctgctggtgggcctgctggccctcagccatggccagttgcacgttgagcatgacggggagtcttgcagtaacagcagccaccagcagattctggagaccggcgagggctcccccagcctaaagatagcccctgctaatgcagatttcgcctttcgcttctactacctgattgcgtccgaaacgccgggaaagaacattttctttagccccctctcaatatctgccgcctacgctatgctaagcttgggtgcttgcagccattctagatctcagatcctcgaaggcctgggctttaatctgacagagttatccgaatctgatgttcaccgcgggttccaacatttattgcatacgcttaatctgcccggccacggactggaaacgagagtgggctccgcccttttcctctcacacaatctgaagtttctggccaaatttctaaacgacaccatggctgtctatgaagcaaagctcttccatactaatttttatgatacggtaggcactatccagctgattaatgatcacgttaagaaggagacgcggggtaagatagtagacttggtgtctgaactgaaaaaagacgtcctgatggtgctggtaaactacatttactttaaggccttgtgggagaagccttttatctccagtcggacaacacctaaagacttctatgtcgatgaaaacactacagtgagagtccctatgatgctgcaagaccaagaacatcactggtacctgcatgaccgatacttaccttgttccgtgttgcggatggactataaaggagacgctacggtgttcttcatcttgcccaatcagggaaagatgcgggagatcgaggaggtcctgacccccgaaatgctgatgaggtggaacaacttgctgcgaaagagaaatttctacaaaaaactggagcttcaccttcctaagttttctatcagcggcagttatgtgctggatcaaatccttcctagactggggttcacagatctatttagcaaatgggcggatttatccggcataacaaaacagcagaagctggaggcgtccaaaagtttccacaaggccacccttgatgtggacgaggccggaaccgaagctgccgccgccacttcgttcgcaatcaagttcttctcggcccagactaaccgacacattctcaggttcaaccgaccattcttagtggtgatcttcagtacaagtacccagagtgtcctgttcctcggtaaagtcgttgatccaaccaaaccctag

SEQ ID NO: 204779 - DNA, 1218 bp, Artificial Sequence
  Description of Artificial Sequence: Synthetic coding sequence
atgcccctgctgctgtacacctgcctgctgtggctgcccaccagcggattatggaccgtgcaggctatggaccccaacgccgcttatgtgaacatgagcaaccatcacagagggttggcaagcgctaatgtggacttcgccttctctctgtacaaacatctagtagcactgtcccccaaaaagaacatctttattagcccagtgtcaatctctatggctctcgctatgctgagtttgggaacatgcggccatactagagctcaactcctgcagggtctaggattcaacctcactgaaagaagtgaaaccgaaattcatcagggattccaacacctgcaccaactgtttgctaaaagcgacacgagcttggaaatgaccatgggtaatgccctgttcctggatggaagtctggagctattggaaagcttttccgccgacattaaacactattacgagtcagaggtactggcaatgaactttcaggattgggcaaccgcatcaagacagatcaacagctatgttaaaaacaagactcagggaaagatcgttgacctgttctcgggcctggactcacccgctatactggtcctggtcaactatattttcttcaagggaacatggacccagccatttgatttggcgtccacccgcgaagagaacttttatgtcgatgaaaccaccgttgtaaaggtgccaatgatgctgcagagtagcacaattagctacttgcacgatagcgagcttccatgccagctggtccaaatgaactacgttggtaacggcactgttttttttattctgccagataagggtaagatgaatacagtgatagccgcgctttctcgcgacactattaatcgatggagtgctggactgacttcctcacaggtcgacttatacattccaaaggtcactatttctggggtctacgacctgggagacgtcttggaagagatggggattgccgacctgttcactaaccaggcgaacttctcccggataacccaggacgcccaactgaaatctagtaaggtagtacacaaagcagttctgcagctgaatgaagagggcgtcgacactgcgggctccacaggcgttacactaaacttgacatcaaagcctattatcctccggtttaaccaacccttcattatcatgatttttgaccactttacttggtcatccctcttcctcgccagggtgatgaatcccgtgtag

SEQ ID NO: 204780 - DNA, 411 bp, Artificial Sequence
  Description of Artificial Sequence: Synthetic coding sequence
atgcccctgctgctgtacacctgcctgctgtggctgcccaccagcggactttggaccgtgcaggcaatggaccccaatgcggcctatgttaacatgagcaatcaccaccgaggtctggcttctgctaatgtcgatttcgcattcagcctctacaaacacttagtcgcactcagcccgaaaaagaacatattcatctcaccggtgtccatctctatggccttggccatgctctccttgggaacctgcgggcacacaagagcacagctgctgcaagggttagggttcaatctcactgaacgcagcgagactgagatccatcagggattccagcacctacaccagctattcgcaaaatcggacacctccttggaaatgaccatgggcaatgcgctctttctggacggctcctag

SEQ ID NO: 204781 - DNA, 1194 bp, Artificial Sequence
  Description of Artificial Sequence: Synthetic coding sequence
atggacagcctggccaccagcatcaaccagttcgccctggagctgtcgaaaaagctagccgagtcagcccagggcaaaaatatcttttttagcagctggagcataagcacttccctgacaatcgtctacctcggagccaagggaacgaccgctgcacagatggcccaagtactgcagtttaatcgtgatcaaggagttaagtgcgacccagaaagcgaaaagaaaagaaaaatggaatttaatctctctaactctgaagagatccattccgattttcagaccctcatctccgagatactgaaacctaatgacgattacctgctgaagactgccaacgcgatctacggtgaaaagacttatgcctttcataacaagtatctcgaggatatgaagacttactttggcgcagaaccacagcccgtcaacttcgtcgaagccagtgaccagatcaggaaggatatcaattcctgggttgaaaggcaaacggaaggtaaaatccaaaacctgttgccagacgatagcgtggactctactaccaggatgatcctagtgaatgccttatatttcaaaggaatctgggaacatcagttcttggtacagaatactaccgagaagccttttagaatcaatgagacgacttccaaacccgttcagatgatgttcatgaagaaaaaactccacatttttcacatagaaaagcccaaagccgtgggacttcagttatactataaatcacgcgacctgagtctcctgattctgctccccgaagacatcaatggtctggagcagttagagaaagcaatcacctatgaaaagctgaacgaatggacaagcgccgatatgatggagctgtacgaggtgcagctgcacctccctaagttcaagctggaggattcttacgatttgaagagtaccctgagctctatgggaatgtcagatgccttcagccagtccaaggcagatttctctggcatgagtagtgccaggaacctatttctgagtaacgtgttccataaggcgttcgtggagattaatgaacagggtactgaggctgctgcaggcagtgggagcgagattgatattcggattcgtgtgcccagtattgagttcaatgcaaaccaccccttcctatttttcattaggcacaataaaaccaacaccattctcttctacggccgactctgtagtccatag

SEQ ID NO: 204782 - DNA, 1020 bp, Artificial Sequence
  Description of Artificial Sequence: Synthetic coding sequence
atggacagcctgggcgccgtgagcacccggctgggcttcgacctgtttaaggagctcaaaaagacgaatgatggcaatatcttcttcagccctgtgggtatcttgaccgctataggcatggttctgctcggcacaagaggtgctacggcctcacaacttgaagaggtgtttcactctgagaaggaaacaaagagctctcgcattaaggcggaagaaaaagaggtgatcgaaaacaccgaggctgtgcaccagcagtttcaaaaatttctgaccgaaatcagtaagctgactaacgattatgagctgaacatcactaaccggctatttggggagaaaacatacttgttcctgcaaaagtacctggattatgtggaaaaatattaccacgctagcctggaacccgtggatttcgtgaatgcggccgacgaaagtaggaagaaaatcaacagctgggtagagtcaaagaccaacgagaaaattaaagacctctttcctgacggaagtattagctctagtacgaaactcgtgctggtgaatatggtgtatttcaaagggcaatgggatagggagtttaagaaggaaaacacgaaagaggagaagttttggatgaacaaaattattgataagattagcccagaaaaactggttgagtggacctctcctgggcacatggaggaacggaaggtgaacttgcacctccccagatttgaagtcgaagacggatacgacttggaggctgtcttggcggctatgggaatgggcgacgccttttctgagcacaaagcggactactccgggatgtctagcggctccggtttatacgcacaaaagtttttacactctagcttcgtggcggtaacggaggagggtaccgaagcagcagcggctacgggcatcggtttcaccgtgacatctgcgcccgggcacgaaaacgtccactgtaaccacccgtttctgtttttcatcagacataacgagtcaaatagcattctgttctttgggcgcttcagttctccttag

SEQ ID NO: 204783 - DNA, 1176 bp, Artificial Sequence
  Description of Artificial Sequence: Synthetic coding sequence
atggacagcctgggcgccgtgagcacccggctgggcttcgacctgttcaaagagctgaagaaaactaacgacggcaatatctttttttcccccgttggaattctgactgccattggcatggtactcttgggaacacggggggccacagctagtcagctggaagaggtctttcacagcgaaaaggaaaccaaatcaagccgcattaaggctgaggagaaagaggtgattgaaaacaccgaggctgtacaccagcaatttcaaaaatttctgaccgagatctccaagctgaccaacgactacgagttaaatatcactaatagactgttcggggaaaaaacatacctgttcctccagaagtatttggattacgtggaaaagtactatcacgcatctctggagcctgtggactttgttaacgctgccgatgagtccagaaaaaagattaactcctgggttgagtcaaagacaaacgagaagatcaaggacctgttccccgacggatctatcagctctagcacgaaactggtcctggttaacatggtgtactttaagggccagtgggaccgagagtttaagaaagaaaatacgaaagaagagaaattctggatgaataagtcaacgagcaagtctgtccaaatgatgacacagagtcatagcttctcattcaccttcttggaggacttacaggcgaaaattctgggtatcccctacaaaaacaatgatctgagcatgtttgtgcttttgcctaatgacatagacgggcttgagaaaattatagataagataagcccagaaaagctggtggagtggacctctccaggccacatggaagaaaggaaggtgaaccttcacttaccgaggtttgaagtggaggatggttacgatctggaggcagtgcttgcagccatgggaatgggtgacgcgttctccgagcacaaagcagattattcgggcatgtctagtggaagtggactgtatgcacagaagttcctgcacagcagttttgtggcagtgaccgaagaggggacggaggccgctgctgctaccggcattgggttcacagtgacatccgcccccggccatgaaaatgtgcactgcaatcaccccttcctgttcttcattaggcataatgagagcaacagcattctgttttttggcaggtttagctccccatag

SEQ ID NO: 204784 - DNA, 930 bp, Artificial Sequence
  Description of Artificial Sequence: Synthetic coding sequence
atggacagcctgggcgccgtgagcacccggctgggcttcgacctgttcaaagagctgaaaaaaaccaacgacggcaacatattcttcagtccagtgggtatcctgacagccattggtatggtactcttaggtactcggggtgccacggctagccagctggaggaggtcttccactccgaaaaagagaccaaaagttcccggatcaaggcggaggaaaaggaagtagagaagattaaagacctgtttcccgatggtagcattagctcatcgaccaagttagtgctagtgaacatggtgtatttcaaaggccaatgggacagagaatttaaaaaagaaaacactaaggaggagaaattttggatgaataagtctacaagcaaatcagtgcagatgatgactcaatctcacagctttagcttcaccttcctggaggatttgcaggccaagattctgggtatcccttataaaaataacgacctgtccatgtttgtactcctgccaaacgacatcgacggtttggagaaaatcatagacaagatatcccccgagaagctagtggaatggacgtcacccggacatatggaggagcgaaaggtcaatctccacttgcccagatttgaagtggaggatggctatgatctcgaggctgtcctcgcagccatgggaatgggcgacgctttcagtgagcacaaggccgattacagcggtatgtcaagtggctccggactgtacgcccaaaaattcctccattcaagttttgttgcggtcaccgaggaagggacagaggcagctgctgccactggaattggtttcacagtgacctcagctccaggccacgaaaacgtccattgtaaccaccctttcctcttttttattcgtcataatgagtccaactcaattctctttttcggccgtttctcctctccatag

SEQ ID NO: 204785 - DNA, 1173 bp, Artificial Sequence
  Description of Artificial Sequence: Synthetic coding sequence
atgaacagcctgagcgaggccaacaccaagttcatgttcgacctgtttcagcaatttcgtaaatcaaaggaaaataacattttttacagtccgatcagcatcacctccgctctgggcatggtactgctgggcgctaaggacaacacagcacagcagattaagaaagtgctgcacttcgaccaggtcaccgaaaacaccactggcaaggccgccacttaccacgttgaccgctccggcaacgtacaccatcagttccagaaactgctcacagaatttaataagtccaccgacgcatacgaactgaagattgctaacaaactctttggggagaaaacctatctgttcctccaagagtatctggatgcaataaaaaagttttatcagacatcggtggagtcagtagactttgccaacgccccagaagagagtaggaaaaagatcaatagttgggtggaatcgcagactaacgagaagatcaaaaacctcattccagagggaaatatcggaagcaataccacgctggtgctggtgaatgcaatctattttaaggggcagtgggagaaaaagtttaacaaagaagacacgaaggaggagaagttttggccaaacaaaaatacctataagtctatccagatgatgcggcaatacactagttttcatttcgccagccttgaagacgtgcaggctaaagtacttgagataccatataaaggaaaggatttgagcatgatcgttttattgcctaacgaaatagacggtctccagaagcttgaggaaaagttgacagccgaaaaactaatggagtggaccagcttgcagaatatgagagagacccgcgtggatctccacctgccacgtttcaaagttgaggaatcctatgatttgaaagatactctgagaaccatggggatggtagatatcttcaatggagacgccgatctcagtggcatgacagggtctagagggctggtgctgtcgggtgtcctgcacaaggcctttgtggaggtaacggaagaaggagccgaggctgctgcagctacagcagtggtggggtttggttcctctcccacctccaccaatgaggaatttcattgcaaccatccatttctgttttttattcggcaaaacaaaactaacagtatcttgttttacggaaggttcagcagcccatag

SEQ ID NO: 204786 - DNA, 1173 bp, Artificial Sequence
  Description of Artificial Sequence: Synthetic coding sequence
atgaacagcctgagcgaggccaacaccaagttcatgttcgacctgtttcagcagttccggaagagcaaggaaaataacatcttttactctcctatttccataacctccgcattaggcatggtgctgctgggggcgaaggacaacactgcccaacaaatctctaaggttctccatttcgaccaggttacggaaaatactactgagaaggccgccacgtatcacgttgacaggtccgggaacgtgcatcatcaattccagaagttgcttacggagtttaacaagtccactgacgcctatgaacttaagatcgccaacaagctgttcggggagaagacctaccagtttctgcaagagtatctggacgccattaaaaaattttatcagacatccgtcgaatctacagactttgctaacgcaccagaggagagccgaaagaagatcaactcatgggtggaaagccagactaacgagaagattaagaatctgtttcctgacggaactataggaaatgacaccaccctggtccttgtgaacgctatctactttaaaggccagtgggaaaacaagtttaagaaagagaatacaaaagaggaaaaattctggcccaataagaatacttacaagagtgttcagatgatgcgacagtacaatagtttcaattttgctcttctcgaagacgtgcaggcgaaagttctggaaataccatacaagggaaaggatcttagtatgatcgtgttgctcccgaacgagattgatgggctgcagaaactcgaagaaaaactgactgcagagaagctgatggagtggacctctctgcagaatatgcgtgagacatgcgttgacctgcacctgcctaggttcaagatggaggaatcctatgacctaaaagatactttgcgcacaatgggcatggtgaatatctttaatggggacgccgatctctccgggatgacatggtcacacggtctaagtgtgtcaaaagtgttgcataaggcattcgtcgaggtgacagaagagggggtggaggccgctgcagccacggccgtggtagtggtagagctcagcagtcccagcacaaacgaggaattttgctgtaatcaccccttccttttcttcattcggcaaaataaaaccaacagtattctgttttatgggaggttcagctctccatag

SEQ ID NO: 204787 - DNA, 1017 bp, Artificial Sequence
  Description of Artificial Sequence: Synthetic coding sequence
atgaacagcctgagcgaggccaacaccaagttcatgttcgacctgttccagcagttccgcaagagtaaggaaaacaacatattctattcgccaatcagtattacctccgcactggggatggtgttgcttggagccaaggataatactgcccagcagatctctaaagtgctgcattttgatcaagtgaccgaaaacacaaccgagaaggctgcgacctaccacgtggatagatccggcaatgtccatcatcaatttcaaaaactcctgacagagttcaataagtcaacagatgcttatgaactgaagattgccaataagctattcggggagaaaacctatcagtttctgcaggagtatctcgatgcgataaaaaagttttatcagacgtccgtcgaatccacggacttcgcgaatgcccccgaggagtctcgcaagaagatcaattcgtgggtagaaagccagacaaatgaaaaaatcaaaaatctcttcccagatggcaccatcggcaatgataccaccctggtcttggtgaacgcaatatatttcaaggggcagtgggagaataagtttaagaaggagaataccaaagaggaaaagttctggcctaacaaacttgaggagaaacttacagccgaaaagctgatggagtggacatcgctccaaaatatgcgggaaacgtgtgtagatcttcaccttccaaggtttaaaatggaggagagttacgacttaaaagacaccttgcgaactatgggcatggtaaatatttttaatggtgatgctgacttgagcgggatgacctggagccacggattgtcggtaagtaaggtcttacacaaggcttttgtcgaagttaccgaggaaggtgtggaggccgccgccgcgaccgcggtcgtcgtggtcgagctgtccagtccctctaccaacgaggagttctgctgcaaccacccttttttatttttcattcgccagaacaaaacaaactctattctgttttacggccggttttcttccccatag

SEQ ID NO: 204788 - DNA, 1128 bp, Artificial Sequence
  Description of Artificial Sequence: Synthetic coding sequence
atggacgccctgcagctggccaacagcgccttcgccgtggacctgttcaaacaactgtgcgagaaagagcccttgggaaacgtactcttttcacctatctgtctttccaccagcttgagcctggcccaggtcggtgcaaagggggacacagcaaacgagatcggccaggtgctccacttcgaaaacgtcaaagacgttccattcggatttcagactgtgacaagtgatgtaaataaactgtctagtttctacagtttgaagcttatcaagaggctgtatgtggacaaaagcctgaacctgtccacagagttcatcagctccacgaaacggccctacgcaaaagagttggaaacggtcgacttcaaggataagttggaggagaccaagggtcagattaacaactccatcaaagatttaactgatgggcactttgaaaacatcttggcagataacagcgtcaatgaccagacaaaaatccttgtagtgaatgcagcttactttgtggggaagtggatgaagaagtttagcgagagtgagaccaaggaatgtccgttccgcgtgaacaagacagacactaagcccgtgcagatgatgaacatggaagctacattctgcatgggcaatatcgattcaataaactgtaagataattgagctgccctttcagaacaaacatctgagtatgtttatccttcttccaaaggatgtcgaggatgagtctaccggcctagagaaaatcgagaagcagctgaacagcgagtcactcagccaatggacaaacccctctactatggcaaacgctaaagtgaaattgtctataccaaagtttaaggtggaaaaaatgatcgaccccaaagcctgcctcgaaaatctgggcctgaagcatatttttagcgaagatacaagcgacttttcgggaatgtcggaaactaaaggagtggccctgagtaacgtaattcataaggtgtgtctggagatcacagaggatgggggggactctatcgaggttcctggggctaggattctgcagcacaaagacgagctcaacgctgatcaccccttcatctacatcatcagacacaataagaccagaaacatcattttttttggcaaattctgcagcccatag

SEQ ID NO: 204789 - DNA, 390 bp, Artificial Sequence
  Description of Artificial Sequence: Synthetic coding sequence
atggacgccctgcagctggccaacagcgccttcgccgtggacctgttcaagcagctgtgtgagaaggaaccgctaggcaatgtgctgttctccccaatttgtctcagcacaagtctctccctggcgcaagtaggtgcaaagggtgataccgccaacgaaatcgggcaggttttgcatttcgaaaatgtaaaggacgtaccgttcggattccagaccgtgacttccgatgtaaataagctctcttctttttattctctgaaactcatcaaacgattatacgtcgataaatctctcaacctcagtacggaattcattagcagtaccaagaggccatacgctaaagagttggaaactgtggactttaaggacaagctggaagagacaaaatag

SEQ ID NO: 204790 - DNA, 1131 bp, Artificial Sequence
  Description of Artificial Sequence: Synthetic coding sequence
atggacgtgctggccgaggccaacggcaccttcgccctgaacctgctgaaaacactgggtaaggacaatagtaaaaacgtgttttttagtcccatgtctatgtcctgtgcactggccatggtctacatgggtgctaagggtaatacagcggctcagatggcccaaatccttagcttcaacaaatccggcggcgggggagacatccatcagggctttcagagtttgctgactgaagtgaataaaaccgggacacagtacctgttgagaatggccaaccgtttattcggggagaagagctgtgattttctctccagctttcgggactcttgccagaaattctaccaggccgagatggaagagctagactttatttcggccgtcgaaaaatcccgtaaacacattaatacttgggtggctgagaagacggagggcaagattgccgaattactgagcccaggttcagtcgacccccttactagactggtcctcgttaatgcggtttactttcggggcaattgggatgagcagttcgacaaggaaaatactgaggagcgcctgttcaaagtctccaagaatgaggaaaagcctgtgcagatgatgttcaaacagagtacctttaagaaaacctatataggcgaaattttcacacaaatactggtcttgccctatgtaggaaaagagttgaacatgatcataatgttacccgatgaaaccaccgatttaagaacagttgagaaagagctgacctacgaaaaattcgtggaatggacccggttggatatgatggacgaggaagaagtggaagtcagtctccctcggtttaaattggaggagtcatacgacatggagtctgtccttcgaaacttggggatgacagatgcgttcgaactgggaaaggccgacttctccggcatgagccaaacagacctcagcctcagcaaagttgtccacaagtcctttgtcgaggtaaacgaagaagggactgaagcagccgccgccacggcagctataatgatgatgcgctgcgctcgcttcgtcccgcgtttttgcgctgatcacccatttctgttctttatacaacatagcaaaactaatgggatcctcttttgcgggcggttctcttcaccctag

SEQ ID NO: 204791 - DNA, 546 bp, Artificial Sequence
  Description of Artificial Sequence: Synthetic coding sequence
tgactgaacctgctgaagaccctgggcaaggacaacagcaagaacgtgtttttttctccaatgtccatgagctgtgcgctggctatggtctacatgggagccaaagggaacaccgcagcccagatggcccagatcctgagttttaacaaatctggggggggaggcgacattcatcagggctttcagtctttactgaccgaggttaataagacaggaacccagtacctcttaagaatggccaatagggaatcctatgatatggaaagtgtgctccgtaacctcggaatgactgacgcattcgaacttggcaaagccgattttagcggcatgtcccaaaccgacctgagcctgtctaaggtggtgcataagtccttcgtggaagttaacgaagaaggaaccgaagcggcggctgctaccgcagccatcatgatgatgagatgcgcgcgctttgtgccaaggttctgtgccgaccacccatttctgttcttcattcagcattcgaagacaaacggtatcctcttttgcggcagatttagcagtccttag

SEQ ID NO: 204792 - DNA, 1131 bp, Artificial Sequence
  Description of Artificial Sequence: Synthetic coding sequence
atggacgtgctggccgaggccaacggcaccttcgccctgaacctgctcaaaaccctgggtaaagataacagcaagaacgttttctttagcccaatgtctatgtcatgtgctttagcaatggtgtatatgggggcaaaagggaacactgcagcacagatggcacagatcctgtccttcaacaagtcaggaggagggggggacatccatcaaggcttccaaagtttgctgaccgaggttaacaaaaccggcacacagtacctgcttaggatggctaatcgcctgtttggcgaaaaaagttgtgactttctcagctcctttcgcgactcatgccagaaattttaccaggctgaaatggaggaactggattttatcagtgccgtggaaaagagccggaagcacattaacacctgggtggccgaaaagacagagggcaagatcgctgagctcctttccccaggcagcgtggacccgctgacgagactggttctggtcaacgctgtgtatttccgaggcaactgggacgaacagttcgacaaggaaaatactgaagagagattatttaaggttagcaagaatgaggagaaacccgtccaaatgatgtttaagcaaagtaccttcaagaagacgtacatcggtgaaatctttactcagatcctagttttgccatacgtgggaaaagaactaaacatgatcatcatgctacccgatgaaacaaccgatcttagaaccgttgaaaaggaacttacgtacgaaaaatttgtggagtggacccggctggatatgatggatgaagaggaggttgaagtttctttacccagattcaagctggaggaatcctacgacatggagtctgtgctaaggaatctagggatgactgacgcgtttgagctgggaaaggcagatttttccgggatgtcacaaaccgaccttagtctcagcaaagttgttcataagtctttcgtcgaagtcaacgaagaaggcactgaagctgcagccgccaccgccgccattatgatgatgagatgcgcccgctttgtgccccgattctgcgcggaccacccctttctgtttttcatccagcactctaagactaatgggatattgttttgcgggagatttagcagcccttag

SEQ ID NO: 204793 - DNA, 1131 bp, Artificial Sequence
  Description of Artificial Sequence: Synthetic coding sequence
atggacgtgctggccgaggccaacggcaccttcgccctgaacctgctcaaaacgttggggaaggataattcaaaaaatgtgttttttagtcccatgtccatgagttgtgccctggccatggtctacatgggggccaagggtaacaccgccgcacagatggcacaaatcttgtcctttaataagtcagggggcggaggggacatccatcaaggttttcagtccctccttacggaggtcaacaagacaggcacccagtatctccttcggatggctaatcgtctatttggagagaaatcgtgtgattttctcagctccttccgtgacagttgtcagaagttttatcaagctgagatggaggagctcgatttcatcagcgctgtagaaaaatctcgaaaacatatcaacacgtgggttgcagagaaaaccgagggaaaaattgccgaacttctaagtccgggaagtgtagaccccctgacaaggcttgtgcttgtgaatgcggtctacttcagggggaactgggacgagcaatttgacaaagagaacaccgaggagagactgttcaaggtctcaaaaaacgaagagaaacctgttcagatgatgtttaagcaatctacttttaagaagacgtacatcggagaaatctttacacagattttggtgcttccttacgtgggcaaggagctgaacatgatcataatgctgccggacgaaacaactgatctccgtactgtggaaaaagagctcacttacgagaagttcgtggagtggaccaggctggatatgatggatgaggaagaagtcgaggtaagtctgccccggtttaagctggaagagtcctacgacatggagtcagtcctccgcaacctgggcatgaccgacgctttcgagctgggaaaagctgacttttccggcatgtctcagaccgatctgtcccttagtaaggtcgtccataaaagctttgtcgaggtgaacgaagaaggaactgaggccgcggcagcgacggctgcaatcatgatgatgcgctgcgcccgattcgtgcccaggttctgcgccgatcatccctttctgttttttatacaacactccaaaacaaacggaatcttattctgcggccggttttcttccccctag

SEQ ID NO: 204794 - DNA, 1131 bp, Artificial Sequence
  Description of Artificial Sequence: Synthetic coding sequence
atggacgtgctggccgaggccaacggcaccttcgccctgaacctgctcaaaaccctcggcaaggacaactccaaaaacgttttcttctcaccaatgtcaatgagttgcgcactcgcaatggtatacatgggggccaagggtaacactgccgcccaaatggctcagatcctgagttttaacaagtccggcggtggcggagatattcaccagggctttcagagccttctaaccgaagttaacaagactgggacacagtatttactcagaatggctaataggctattcggggagaaaagttgtgacttcctctccagctttagggatagctgccagaaattctaccaggcagagatggaagaactggactttatcagcgctgtggaaaaatctcgcaagcatatcaatacctgggtagctgagaagaccgagggaaagatcgccgagttgctttctcccgggtcagtcgatcctcttacaagattagtgctcgtcaatgccgtgtattttagggggaattgggacgaacaatttgacaaggagaacactgaggagagactgtttaaagttagtaaaaacgaggagaagccagtccagatgatgttcaaacagagcaccttcaagaagacctatataggagagatattcacacaaatcctggtgctgccatacgtgggcaaggaacttaacatgataataatgctgcctgacgagaccactgacctgagaaccgtcgagaaagaacttacctatgaaaaatttgtcgagtggaccagactcgacatgatggacgaggaggaggtggaagtgtctctgccccgtttcaagctagaggaatcatatgacatggagtctgtactcagaaacttgggaatgactgacgcgttcgaactcgggaaggctgatttcagtgggatgagtcaaaccgatctgtcactgtctaaggtcgtgcataagtctttcgtagaggtgaatgaagagggcactgaagcggctgcggccaccgcagccatcatgatgatgcgctgcgctaggttcgtccccaggttttgtgctgaccacccatttctgttctttatccagcactccaaaactaacggtatactcttctgtggcagattctctagcccgtag

SEQ ID NO: 204795 - DNA, 1131 bp, Artificial Sequence
  Description of Artificial Sequence: Synthetic coding sequence
atggacgtgctggccgaggccaacggcaccttcgccctgaacctgctgaagacactcggcaaagacaacagtaagaatgtatttttctccccaatgtctatgtcctgtgctctggcaatggtctacatgggagcaaaggggaacaccgccgctcagatggctcagatcctgtccttcaataaatcgggtggtggtggagatatacaccaaggattccaatcactgcttactgaagtcaacaagaccggcacacagtacctcctgcggatggcaaatcgactgtttggggagaagtcttgcgacttcctttcctccttccgagacagttgccagaaattttatcaggccgaaatggaagaactggattttatctctgccgtggagaaatcgcggaaacatatcaatacatgggtggcagaaaagaccgagggcaaaattgcagagctgctgagccctggatctgtggaccccctgactaggttagtgctggttaatgctgtgtattttcggggaaactgggacgagcaattcgataaggagaatactgaagagagattgtttaaagtcagcaagaatgaagagaagccggtccagatgatgtttaagcaatctacattcaaaaaaacttacatcggggaaatttttacgcagatcctcgtgttgccctatgttggcaaggagctaaacatgatcataatgctgcccgacgagacaactgacctaaggacagtggaaaaagagcttacttacgaaaagttcgtggaatggacacggctggacatgatggatgaggaagaggtggaagttagccttccacgcttcaaactggaagagtcttatgatatggaatctgtcttgcgaaatctgggcatgactgatgctttcgaactcggaaaggctgatttctcaggcatgtctcagaccgacctgtctctgtccaaagttgtccataaatcgttcgtcgaggtaaacgaggagggcacagaggccgcggccgccaccgccgctatcatgatgatgcggtgcgccagattcgtaccacgtttctgcgccgaccacccgttcctgttcttcatccagcacagcaaaaccaacgggatcctcttttgcggtcgattttcttccccttag

SEQ ID NO: 204796 - DNA, 1131 bp, Artificial Sequence
  Description of Artificial Sequence: Synthetic coding sequence
atggacgtgctggccgaggccaacggcaccttcgccctgaacctgctcaagacactgggaaaggataatagtaaaaacgtctttttctcacctatgtctatgagttgcgctctcgcgatggtgtacatgggagccaagggcaatacagcagcccaaatggcacagatcttgagcttcaacaagagcggcggaggtggcgacatccaccaaggtttccagagccttctgacagaggtgaataagactggtactcaatacctgctccggatggcaaacaggctgttcggcgagaaatcatgcgatttcctgagctcttttagggactcctgtcaaaagttttaccaagcagagatggaggagctggatttcatctccgccgtggagaaaagccgcaagcacataaacacctgggtcgccgagaagacggaaggaaagattgctgagctcctgagccccggctcagtggatccactcacgcgactcgtccttgtgaatgcagtgtactttcgtggcaattgggatgagcaatttgacaaggaaaataccgaagagaggctctttaaggtatcaaagaacgaagaaaaaccggtccagatgatgttcaagcagtctacattcaaaaagacttacatcggagaaattttcacccagattttagtgctcccgtatgtgggtaaggagctgaatatgattatcatgctccctgatgaaacaaccgacctgcgcactgtggaaaaagagctgacatatgaaaaatttgtcgagtggacccggctcgatatgatggatgaggaggaagtagaggtgtcactcccgcgattcaagctagaggagtcctacgatatggagagtgtcctgaggaatctcggcatgacagacgcttttgaactgggcaaagccgacttctccggaatgtctcagaccgacctcagcctatctaaagtagttcataagtctttcgtggaggtaaatgaggaaggcaccgaggccgcggctgccaccgccgccatcatgatgatgaggtgtgctagattcgtgcctaggttttgcgccgaccaccccttcctattttttatacagcattcaaaaactaatggaatattattctgcggtaggttctcctctccttag

SEQ ID NO: 204797 - DNA, 579 bp, Artificial Sequence
  Description of Artificial Sequence: Synthetic coding sequence
atggacgtgctggccgaggccaacggcaccttcgccctgaacctgttgaaaacactgggcaaggataatagtaagaatgtctttttttctccaatgtccatgagttgcgctcttgctatggtttacatgggcgccaaggggaacacggctgcccaaatggcccaaatactgtccttcaataagagcggcggaggtggggatattcaccagggcttccagagcctacttaccgaggtgaataaaacaggtacccagtatctgctgcggatggccaatagggaatcgtatgacatggagagcgtactacggaaccttggtatgactgacgcatttgaactggggaaggctgacttctcaggcatgtcccagacagacctgagcctgtcaaaagttgttcacaagtccttcgttgaggtgaacgaagagggaacagaagctgcggccgccacagctgccatcatgatgatgcggtgcgccagattcgttccgcggttttgtgccgatcaccctttcctcttcttcatccaacatagtaagactaacggtatcctgttctgcgggaggttttcgtcaccgtag

SEQ ID NO: 204798 - DNA, 1143 bp, Artificial Sequence
  Description of Artificial Sequence: Synthetic coding sequence
atggccagcctggccgccgccaacgccgagttctgcttcaacctgttccgtgaaatggacgacaatcaggggaacggcaatgtattctttagcagcctgtcactgtttgccgccctggccttggtgaggctcggggcccaggacgacagcctgtcacagattgacaagttgctccatgtcaatacagctagcggctatgggaattcttccaactctcaaagcggcctgcagagtcagcttaaacgagtgttcagcgatattaacgccagccataaggattatgacctgtcaatagtcaatggcctctttgctgagaaagtgtatgggttccataaggactatattgaatgtgccgaaaagctctacgacgcaaaagtcgagagggtcgatttcaccaatcaccttgaggacacccgaagaaacatcaataaatgggtcgaaaacgagactcatggcaagatcaagaacgtgatcggggaggggggaataagcagttctgctgttatggtcctcgtcaatgcggtgtactttaagggaaagtggcagagcgccttcaccaaaagcgagaccatcaactgtcactttaagagccctaagtgcagcggtaaggccgtcgcgatgatgcatcaggagagaaaatttaatctgagtgtaattgaggatccatcaatgaaaattctcgagctccgttacaacggtggcatcaatatgtacgtgctattgcccgaaaacgacctgtcagagatcgagaacaagctgactttccagaatctcatggaatggacaaatccccgccgtatgacctccaagtacgttgaggtgtttttcccacagtttaaaattgagaagaactatgagatgaagcagtatctgagagcactcgggttgaaggacattttcgatgagtcaaaggcggatctttctggaatagcatctggaggacgcctttatatctcaaggatgatgcacaagagctacatcgaagtgaccgaggagggcaccgaggccaccgccgctactgggtctaacatagtggagaaacaattgccgcagtcgactctcttcagggctgaccatccttttttatttgtgatccgaaaggacgatatcatattgttcagcgggaaggttagctgcccttag

SEQ ID NO: 204799 - DNA, 1143 bp, Artificial Sequence
  Description of Artificial Sequence: Synthetic coding sequence
atggccagcctggccgccgccaacgccgagttctgcttcaacctgtttcgagagatggacgacaatcagggaaatgggaatgtattctttagcagtttgagtctgtttgctgccttggcgctggtaagactcggtgcacaggatgattcgttgtcacagattgacaaactgttacacgtcaatacggccagcggatacggaaattcatccaactctcagtcaggtctccagtctcagctgaaacgggtgttctccgacataaatgcatcacataaggactacgatctcagcattgtgaatggcctgtttgctgagaaggtttatggatttcacaaggactatatagagtgcgctgagaaactttatgatgcgaaggtcgagagggttgatttcacaaatcacctcgaggatacacgccgaaatatcaacaaatgggtggagaacgagactcatggaaagattaaaaatgtgattggtgagggggggatctctagctccgcagttatggtccttgtcaacgctgtctattttaaaggcaagtggcagtcggctttcactaaaagtgaaaccattaactgtcacttcaagagccctaaatgttctgggaaggccgtggcgatgatgcatcaggagagaaaattcaacttgagcgtaatcgaggacccttctatgaagattctcgaactccgctataatggtggaataaacatgtacgttttgctcccagaaaatgacctgtctgagatcgagaacaaactgacctttcaaaacctgatggagtggacgaatcctagacggatgaccagtaagtacgtcgaggtatttttcccacaatttaagatagagaagaactatgaaatgaagcagtatctccgcgctctgggattgaaagacattttcgacgagagcaaagccgatctcagtggtatcgcatctggcgggaggttgtatattagcaggatgatgcacaagtcttacattgaagtgaccgaagagggcactgaggcaacagcagctaccggatccaacatcgttgagaaacagctgcctcagtccaccttgttcagagccgatcatcccttcttgtttgtaatccgcaaggacgatattattctttttagcgggaaagtctcatgtccttag

SEQ ID NO: 204800 - DNA, 387 bp, Artificial Sequence
  Description of Artificial Sequence: Synthetic coding sequence
atggccagcctggccgccgccaacgccgagttctgcttcaacctgtttcgggagatggatgataaccaagggaatggcaatgtgtttttctcctcattgagcctttttgcagccctggcactcgttaggctcggggcacaggatgactccttatcccaaatcgataagttgctgcacgtgaatacagcctccgggtacgggaacagtagtaacagccagtcaggccttcagagccagttaaagcgggtcttctccgacattaatgcatctcacaaggattacgacctgagtattgtgaacggactattcgctgagaaagtctacggcttccataaggattatatcgagtgtgcagagaaactatacgacgcaaaagtggaaaggtag

SEQ ID NO: 204801 - DNA, 387 bp, Artificial Sequence
  Description of Artificial Sequence: Synthetic coding sequence
atggccagcctggccgccgccaacgccgagttctgcttcaacctgtttagggagatggatgataatcaggggaacggtaacgtcttttttagctctctctcgctttttgctgcccttgctctggtgcgcctgggagcacaggacgactcgctgtctcagattgacaaactgctgcacgtgaacactgccagtggctatggcaattcgtctaactctcagtcagggttgcaaagccaattaaagagagtttttagcgacatcaatgcatcccacaaggactatgatctgtctatcgtgaatggactgtttgccgagaaggtttatggctttcataaggactacatcgaatgtgcggaaaagctttacgacgcgaaggtcgaacgttag

SEQ ID NO: 204802 - DNA, 498 bp, Artificial Sequence
  Description of Artificial Sequence: Synthetic coding sequence
atggccagcctggccgccgccaacgccgagttctgcttcaacctgttcagggaaatggacgacaaccagggtaacgggaacgtcttcttcagctctctatctctctttgctgccctcgctttagtgaggcttggggcacaggacgatagtttatcccaaatcgacaaacttctgcatgttaatacagccagtggatacgggaattcatccaacagtcagtctggtctccagtcccaacttaagagggtcttcagcgatattaacgcaagtcacaaagactacgatctgtctattgtcaacggattgttcgctgaaaaggtatacggatttcacaaggattacatcgaatgtgccgagaaattatacgatgcaaaggtggaacgcgtagattttacaaaccatctagaggatacgagaaggaacatcaacaagtgggttgaaaacgaaacccacgggaaaataaaaaatgtcatcggtgaaggcggaatcagtagttag

SEQ ID NO: 204803 - DNA, 1092 bp, Artificial Sequence
  Description of Artificial Sequence: Synthetic coding sequence
atggccagcctggccgccgccaacgccgagttctgcttcaacctgttcagagaaatggatgataatcagggcaatggtaacgtgtttttttcttccttgagcctgttcgccgctctcgctctggtaagacttggcgcacaggacgactcattgagccaaattgacaaaagtggccttcagtctcagcttaagcgcgtgtttagtgacatcaacgccagccacaaagattatgatctgagcattgtaaacggactcttcgccgagaaggtctacggattccacaaggattacatcgagtgtgctgagaaactctatgatgctaaggtggaacgggtggactttaccaatcacctggaggatacacgacgtaatatcaataagtgggtggaaaatgaaactcacggtaaaattaagaatgtgataggcgaagggggtatatccagctcggctgttatggtactcgttaatgctgtttatttcaaggggaaatggcaatctgcatttacaaaatcggagacaattaattgccactttaaatctccaaaatgctcgggcaaggccgtggcgatgatgcaccaggagcgaaagttcaatttatctgtcattgaggacccgtctatgaaaatcctggaactgaggtacaatggaggtattaatatgtacgtgttgctgccggagaacgacctgtcagaaatagaaaacaaactcaccttccagaatctgatggaatggaccaatcctcgccgaatgacaagcaaatacgtagaggtttttttccctcagtttaagatagagaagaactatgaaatgaaacagtatctgagggccctgggcctgaaggatatctttgacgaatcaaaagccgatctcagcggaatagcttctggaggtcggttatacatttccaggatgatgcacaaatcttatatcgaagtcacagaggagggcacggaagctaccgctgccaccggctccaatattgtggaaaagcagttgccccagtctactctctttcgggccgaccacccgtttctctttgtcattcgcaaagacgatataatcttgtttagtggaaaggtaagttgcccctag

SEQ ID NO: 204804 - DNA, 1143 bp, Artificial Sequence
  Description of Artificial Sequence: Synthetic coding sequence
atggccagcctggccgccgccaacgccgagttctgcttcaacctgttccgggaaatggacgacaaccagggaaatggaaatgtttttttttctagcttgagcctcttcgccgcgttagccctggtgcgtttgggggcccaagacgactccttgagccagatcgataagctgctgcacgtgaataccgcgagcgggtatgggaactcgtcgaacagtcagtccggtctgcagtcccagcttaagcgtgtgttcagtgatattaatgccagccacaaggattacgatctgtctatagtgaacggcctgttcgccgagaaggtttacggattccataaggattatattgagtgcgctgagaaactgtacgatgccaaggtagagcgcgtggattttactaatcatttagaagacacccgcaggaacatcaacaaatgggtcgagaatgagacacatggcaagatcaaaaacgttatcggggagggcggtataagctcttccgctgtcatggtgttagtgaacgccgtgtacttcaaggggaagtggcagtctgccttcacaaaaagcgagacaattaattgtcacttcaaatcccccaagtgttccggcaaagcggtagccatgatgcaccaggagcggaagttcaacctttccgtcattgaagacccctcgatgaagatccttgaattgaggtataatggggggattaatatgtacgtgctgttaccggagaacgatctatcagaaatcgaaaataagcttaccttccagaacttgatggagtggacgaatcccagaaggatgacgagtaagtatgttgaagtcttcttccctcagttcaagatcgaaaagaactacgaaatgaaacagtacctacgagcgctggggctcaaggacatctttgatgagtctaaagcagaccttagtgggattgcatccgggggcagactctatatttctcgcatgatgcataaatcctatatcgaggtgaccgaagagggcacagaggccacagctgccactggttccaatattgtggagaagcagctccctcagtcaacactgtttcgcgctgaccacccgtttctgttcgtgataagaaaagatgatatcatcttgttctccgggaaggtcagctgtccgtag

SEQ ID NO: 204805 - DNA, 1125 bp, Artificial Sequence
  Description of Artificial Sequence: Synthetic coding sequence
atggacgacctgtgcgaggccaacggcaccttcgccatcagcctgttcaagattttaggcgaggaagacaacagtcgcaacgtgttctttagcccaatgtcgatatcatctgccttggctatggtatttatgggcgccaaagggagtactgccgcccagatgtcacaagccttgtgcctctataaagatggagacattcaccggggatttcagagtctactgtccgaagtgaatcgcactggtactcagtacctgctgaggaccgctaaccgactttttggcgagaagacttgcgacttcctgcccgattttaaagagtattgtcaaaagttctaccaggcggagctcgaggagctctctttcgccgaagatacagaggagtgtagaaagcatatcaacgactgggtggcggagaaaaccgaaggcaaaatctccgaggttctcgacgcaggaaccgtcgaccctctgaccaagctggttctcgttaacgccatctattttaaaggaaagtggaatgaacagtttgaccggaaatacactagagggatgctattcaaaactaatgaagaaaaaaagaccgtgcaaatgatgttcaaggaagcaaaatttaagatgggatatgccgacgaggtacacacgcaagttcttgagctgccgtatgtcgaggaggagctgagtatggtcatcttgctgcccgatgacaatacggatttggccgtcgtggagaaggctcttacatacgagaagttcaaggcctggacgaacagcgaaaaactcaccaaatcaaaagtgcaggtgttccttcctaggctgaagctggaagagagctatgacctggaaccatttcttcggcgcctcggcatgattgacgcttttgacgaagccaaggctgattttagcggaatgagtaccgagaagaatgttccattaagcaaggtggcacacaagtgtttcgtcgaggtaaatgaagagggaacagaggcggccgcagcgacagctgtggttcggaacagtaggtgtagccgcatggaaccgcgcttttgtgcggatcatccctttctgttcttcatccgccatcacaaaaccaactgcatcctcttttgcgggcgctttagctctccgtag

SEQ ID NO: 204806 - DNA, 1125 bp, Artificial Sequence
  Description of Artificial Sequence: Synthetic coding sequence
atggacgacctgtgcgaggccaacggcaccttcgccatcagcctgttcaagattctgggggaggaagataactctaggaatgtgttcttttctcccatgagtatcagtagtgcattagcgatggtgtttatgggggctaagggctctacggccgcacaaatgtctcaagcgttatgcctgtacaaggacggggacattcatagaggctttcagagccttttaagtgaggtcaatcgcaccgggacccagtacttactgagaaccgccaatcgactgtttggcgagaagacctgcgactttctgcctgatttcaaggagtactgtcagaaattctaccaagccgaactagaggagctgagtttcgcagaagacaccgaggagtgccgcaaacatattaatgattgggtggccgaaaagaccgaagggaagatctctgaggtgctggatgccggaaccgtcgacccattgaccaagctcgtgctcgtcaatgccatctattttaagggaaagtggaatgaacagtttgatagaaaatacactaggggtatgcttttcaagaccaatgaggagaagaagactgtccagatgatgtttaaggaggcgaaatttaagatggggtatgccgatgaagtgcatacccaggtacttgagctaccttatgttgaggaagaactgtccatggtcatacttcttcccgatgacaataccgatctcgcagtggtcgagaaggccctgacttatgagaagtttaaggcttggaccaactctgaaaagctaaccaagagcaaagtgcaggtgttccttcctagactcaaactcgaggagtcctacgacttggaacctttcctcaggaggcttgggatgatcgacgcctttgacgaggccaaggcagattttagcgggatgtccacggagaaaaatgttcctctctcgaaggtggcacataagtgcttcgtcgaagtaaacgaagaaggaacagaggccgcagcggctaccgcagtggttcgtaactcaagatgttcgaggatggaacccagattctgtgctgatcacccctttctgttcttcatccgacatcacaagacgaattgcattttgttttgtggacgcttctctagtccctag

SEQ ID NO: 204807 - DNA, 495 bp, Artificial Sequence
  Description of Artificial Sequence: Synthetic coding sequence
atggacgacctgtgcgaggccaacggcaccttcgccatcagcctgtttaaaatccttggggaagaagataacagccgtaatgttttcttttctcctatgagcatctcctctgctcttgctatggtctttatgggggctaagggcagtaccgccgcacagatgtcgcaggcgctttgtctctacaaggatggtgacattcaccggggattccagtccctgctttctgaggtgaaccgtacagggactcagtatctgctcaggactgccaaccgcttgtttggggagaaaacgtgcgattttctcccggacttcaaagagtactgtcagaagttctatcaggctgagttagaagagctgagttttgccgaggacactgaggaatgtagaaagcatatcaacgactgggtggcagagaagaccgaggggaagattagcgaagttctcgacgccggcactgtcgatcccctgacaaaactggtattggtgaacgcatag

SEQ ID NO: 204808 - DNA, 375 bp, Artificial Sequence
  Description of Artificial Sequence: Synthetic coding sequence
atggacgacctgtgcgaggccaacggcaccttcgccatcagcctgtttaagattctgggtgaagaggacaattcccgaaatgtctttttctcacccatgagtatatcatctgccctcgctatggtattcatgggcgctaagggaagcactgccgcccagatgtctcaggcactgtgcctctacaaagacggcgacatccaccgtggtttccagtctctcctgagcgaggtgaaccgaaccggaactcagtacctgctccgcacggccaatagactcttcggcgagaaaacctgtgacttcctgcccgatttcaaggaatactgtcagaagttttaccaagctgaactggaagagcttagctttgctgaggattag

SEQ ID NO: 204809 - DNA, 579 bp, Artificial Sequence
  Description of Artificial Sequence: Synthetic coding sequence
atgctgttcaagaccaacgaggagaagaagaccgtgcagatgatgtttaaggaggcaaagttcaaaatgggatacgctgatgaggtccacacccaggtgttggagctcccttatgtggaagaagaactttccatggttattctgcttccagacgataacaccgatctggccgttgtggagaaggctctaacatatgagaagttcaaagcatggaccaacagcgaaaagctcaccaaatcaaaggtgcaggtattccttccacggctcaaactggaggaaagctacgacctggaaccctttctgaggcgtctcggcatgattgacgccttcgatgaggctaaggcagatttttctggcatgagcacagaaaaaaatgtcccgctgtcgaaggtggctcataaatgttttgtggaggtgaatgaggaaggtactgaagcagctgccgctacagctgtggtacggaattcacgttgcagcaggatggagcctcgcttttgtgccgatcacccctttttgttctttattaggcaccataagaccaactgcattttgttctgcggaagattcagctctccatag

SEQ ID NO: 204810 - DNA, 1131 bp, Artificial Sequence
  Description of Artificial Sequence: Synthetic coding sequence
atggagaccctgagcaacgccagcggcaccttcgccatccggctgctcaagatactctgccaggacaacccgagccacaacgtcttctgtagccctgtttcaatcagttccgctctggctatggttcttttaggagcaaagggcaacaccgctacccagatggctcaggccttatccttgaatacagaggaagatatccaccgtgcgttccagtctctactcactgaagtgaataaagccggcacccagtatcttcttaggaccgcaaaccggctgtttggtgaaaagacatgccagttcctttctacctttaaggaaagttgtctgcaattttaccatgccgaactcaaagaactaagttttattcgggctgcagaggaaagtcggaagcatataaatacatgggtgagtaagaaaacagaggggaaaatagaggagttgctgcccggcagtagtatcgacgcagagactcgtctcgtactggtcaatgctatatatttcaaaggcaagtggaatgagcctttcgacgagacgtatactagggaaatgcccttcaaaatcaaccaggaggagcaaagacccgttcagatgatgtaccaggaggccaccttcaagcttgcacatgtgggagaggtccgagcccagctgctggagctgccctatgcacgcaaagagctttccctcctggtcctcttaccggacgacggggtagagctgtccaccgtagagaagagcttaactttcgaaaaactgaccgcatggaccaagccggattgtatgaagagtactgaagtagaggtgcttcttccaaagttcaagctgcaggaggattacgacatggagagtgtgttgcggcacctcggcatagtcgacgctttccagcagggaaaggcagatttatcggccatgtcagcggaacgcgacctctgtcttagcaagttcgtccacaaatcatttgtcgaggtgaacgaggagggcaccgaggcagctgccgcttcgagttgttttgttgtggcagaatgttgtatggaatccggacctagattctgcgctgaccaccccttcctctttttcatccgacataatagagccaactccatcctattctgtggtcgatttagctcaccgtag

SEQ ID NO: 204811 - DNA, 1104 bp, Artificial Sequence
  Description of Artificial Sequence: Synthetic coding sequence
atgagcagccccccccccgcccggagcggcttctaccggcaggaggtcacaaagaccgcgtgggaagttagagccgtctatcgggatctgcaacccgtaggctcgggcgcgtatggtgcagtctgcagtgcagtggacggacgcacgggtgcaaaagtagcaatcaagaagttgtacaggcccttccaaagcgagctgtttgcaaaacgtgcttacagagaacttcgcctcctgaagcacatgcgtcatgaaaacgtgataggcttacttgatgtgttcacaccagacgagaccctggatgactttactgatttttacctagtaatgccttttatggggacagatctgggcaaactgatgaaacacgagaagttgggagaagatcgtatccagtttctggtgtatcagatgctcaagggactccggtacatacatgcggcaggcattatccatagagatctgaaaccaggtaatctggcagtgaatgaagattgcgagctcaagatactcgactttggtttggcacgccaggcagactccgagatgacaggctatgtggtaacccggtggtacagagcccctgaggttatccttaattggatgcgctacacacagacagtggacatttggagcgtgggctgcataatggcggaaatgattacgggcaagactctcttcaaagggagcgatcacctggaccagttgaaggagattatgaaggtgacaggcaccccacctgccgagtttgtgcaacgtctgcaaagcgacgaagctaagaattacatgaagggcttacccgaactggagaagaaagacttcgccagtatcctgacgaacgcaagccccctggctgtcaatctcctcgaaaaaatgctggtcctagacgccgaacagcgtgttacggcaggtgaggctcttgctcacccctattttgaatctttgcacgatacagaggacgagccacaggtgcagaaatacgatgactcctttgacgatgtcgacaggactctagatgaatggaagagggtgacctataaagaggtactgtcttttaagcctcccagacagttaggtgcccgtgtttccaaggagacccccctgtag

SEQ ID NO: 204812 - DNA, 1500 bp, Artificial Sequence
  Description of Artificial Sequence: Synthetic coding sequence
atgaagcacagcctgaacgccctgctgatcttcctgatcatcaccagcgcttggggtggtagcaaaggccccctagatcaactggaaaagggtggtgaaactgcacagagcgccgaccctcagtgggagcagctgaataacaagaacttgtctatgccacttttacccgctgattttcacaaggaaaacaccgtgacaaatgattggattccggagggggaagaggacgacgattacctggacttggaaaaaattttttcggaagacgacgactatattgacattgtggatagcttatcagtcagtcccacagactcagatgtatccgcaggtaatatcctgcagttattccatgggaagtcgcgtattcagaggctgaatatcctaaacgccaaattcgccttcaatctttatagggtgctgaaagatcaggtgaacacatttgataatatattcatcgcccctgtgggcatttctaccgccatgggcatgatctcactcggcctcaaaggggaaacgcacgagcaggtgcattcaatcctgcactttaaagattttgttaatgcttccagtaaatacgagataacgaccatccataacctgttccgcaagcttactcaccggttgtttaggcgtaattttggatatacactgaggagcgtcaacgatctctacattcagaagcaatttcccattctgctggacttcaagaccaaagtgcgggaatactacttcgcagaggctcagatcgcggatttttccgaccccgccttcatctcgaagaccaataaccatataatgaaactgactaaaggattgatcaaggatgccttggaaaatatcgaccccgccacccagatgatgatcctgaactgtatctactttaagggatcatgggtcaacaagtttcctgtggagatgacccacaaccacaatttcaggttgaacgagcgagaagtggttaaagtcagcatgatgcaaactaagggaaacttccttgccgctaacgaccaggagctcgactgtgatattctccagctggagtatgtgggcggcatttctatgctaatcgtcgtgcctcacaagatgagtggtatgaagacactcgaagcccagctgacgccccgggttgtcgaaaggtggcaaaagtcaatgactaatcggactcgcgaggttctgctgccaaagttcaagctcgaaaaaaactataacctggtagagagcctcaaacttatgggtatcaggatgctgtttgataagaatgggaacatggcaggcattagcgaccagcgtattgctatcgacttgtttaagcaccagggaacaataactgttaacgaggaggggacccaagccaccaccgtgaccactgtgggttttatgcccctgtcgacacaggtgagatttacggtagaccgcccgttcctttttcttatatacgaacataggacttcatgccttcttttcatgggaagggtggcaaacccatcccgctcctag

SEQ ID NO: 204813 - DNA, 1197 bp, Artificial Sequence
  Description of Artificial Sequence: Synthetic coding sequence
atgaactggcacctgcccctgttcctgctggccagcgtgaccctgcccagtatctgttctcattttaatcccttgtctttagaggagcttggctctaacactggaattcaggtatttaaccagatcgttaaaagcagaccccatgacaatatagtgatatcgcctcacggcatcgcctcagtgttgggcatgctgcagctgggggcagatggccggactaagaaacagctggccatggttatgcgctatggtgttaacggcgtgggcaaaatactgaagaaaattaacaaggcaattgtgtctaagaagaataaggacattgtgaccgtggcaaacgccgtattcgtgaagaacgcaagcgagatcgaggtgccttttgttacgagaaacaaggatgtgtttcagtgcgaggtgagaaatgtcaattttgaggacccggccagcgcctgcgactccattaatgcctgggtcaaaaacgaaacgcgtgatatgatcgacaaccttctgtcccccgacctgatagatggggtgctaactagactggtgttagtgaacgccgtttactttaaagggttatggaaatcacgattccaacctgaaaacacaaaaaaacggaccttcgtcgcagcggatggaaaatcataccaggtacctatgctcgcccagctgtccgtattcaggtgcggatctacttctgcacctaacgatttgtggtacaattttatcgaactgccctatcacggcgagtccatttcgatgcttatagcactgcccacggaatcctcaacaccgctgagtgcaataattcctcatatatcaaccaaaaccatcgactcttggatgtcaatcatggtgccaaagagagtccaggtcattcttcccaaattcacggcggtagctcaaacagatttgaaagagcctctgaaggtgctcggaattactgacatgttcgacagcagcaaagcaaatttcgccaagattaccacaggatccgaaaatctacatgtgtcacatattctgcagaaggccaagatagaagtcagtgaagatggcacaaaggccagcgccgcaactacggctattctgatcgccagaagtagccctccctggtttatcgtggacaggcctttcttatttttcatccgtcacaatcccacgggggccgtactcttcatgggacaaataaacaaaccttag

SEQ ID NO: 204814 - DNA, 1194 bp, Artificial Sequence
  Description of Artificial Sequence: Synthetic coding sequence
atgaactggcacctgcccctgttcctgctggccagcgtgaccctgccatctatctgttcacactttaaccccctgtctcttgaggagctgggcagtaacacaggcatccaggtgttcaatcaaattgtcaagagccgaccgcacgataatatcgtgatctccccccatggcatcgcttccgttttgggcatgctgcaattgggagccgatggccgcaccaaaaaacagcttgcgatggttatgaggtatggggtgaacggggtaggtaagatcctgaaaaagattaataaggcaattgtgagtaaaaagaataaggatatagtgactgtggccaacgccgtgtttgtcaaaaacgcatctgaaatcgaggttccttttgttacccggaacaaagacgtttttcaatgtgaggtcaggaatgtcaactttgaagacccagccagcgcatgcgattcgattaatgcttgggttaaaaacgaaacccgggatatgatcgacaatctgcttagccctgacctgatcgatggtgttctgaccagactggtgctggtgaacgcggtgtacttcaaaggcctttggaagtccaggttccagcctgaaaataccaaaaaaaggaccttcgtcgccgcggatggtaagtcttatcaggtgcccatgttagcccagctctccgtcttcagatgtgggagtacctcagccccaaatgatctgtggtataacttcatcgagcttccataccacggcgagagcatctcgatgttgatcgctctccctaccgaatccagtacacccttatccgctattatcccccatatttccactaaaacgatcgacagttggatgtcaatcatggtccccaagagggtgcaggttatcctgcctaagtttactgccgttgctcagaccgatcttaaggagccactgaaggtgctgggcataacagacatgttcgactcctccaaggctaatttcgcgaaaattacccgctctgagaaccttcatgtgtcccacatcttacagaaagctaagatagaagtgagcgaggatggtaccaaggcctcagctgccacgacagccattctgatcgcccggtcttccccgccctggttcatcgtggaccggccattcctcttctttatcaggcataaccccaccggagctgtgctttttatgggccagattaataaaccatag

SEQ ID NO: 204815 - DNA, 1194 bp, Artificial Sequence
  Description of Artificial Sequence: Synthetic coding sequence
atgaactggcacctgcccctgttcctgctggccagcgtgaccctgccctccatctgcagccattttaatccactgagcctggaggaactgggaagtaatacgggaatacaagttttcaatcagattgtgaagagccggccccacgataatatcgtgatctctccccatggcattgcctccgtgctggggatgttgcagctgggggctgatgggcgtacaaaaaaacagctagccatggtgatgcggtacggcgtgaacggggttggcaagatcctgaagaaaatcaataaggctatagtctctaaaaaaaataaggacatagtgacggtggcgaacgcagttttcgtgaagaacgcctctgagattgaagttccgtttgtgacgagaaataaagatgtattccagtgcgaggttcgtaacgtgaattttgaagaccccgcttcagcatgtgattccattaacgcatgggtaaagaatgagacgcgggacatgatcgacaacttgctcagcccagatttaatagatggggtcttgacccgccttgtactcgtaaacgcggtgtatttcaaggggctgtggaaatctcgcttccagccagaaaataccaagaaacgcacattcgtcgccgcagacggcaagagctaccaggtgcctatgctcgctcagctgagcgtattcaggtgcggctccaccagcgcgcccaacgacctttggtataactttatcgagctgccataccacggcgagtcaattagcatgctcattgcattgcctaccgagagctccacgcctctgtctgctataatcccccacatctcaactaagactatcgacagttggatgtctatcatggtccccaagcgcgtacaggtaatcttgcccaagttcactgcagtggcgcagacagacttaaaggaacccctcaaagtgctcgggataaccgatatgtttgatagttcgaaggcgaatttcgctaaaatcactcgttccgaaaatcttcatgtaagtcacatcttgcagaaggcaaagatcgaagttagcgaggacgggactaaagctagtgctgctactacagcaatcttgatcgcaaggagttcgccaccatggtttattgtggataggccgttccttttcttcattcgccacaatcccaccggggctgtgctcttcatgggccagatcaataagccatag

SEQ ID NO: 204816 - DNA, 129 bp, Artificial Sequence
  Description of Artificial Sequence: Synthetic coding sequence
atgaactggcacctgcccctgttcctgctggccagcgtgaccctgccatcaatctgttctcatttcaaccccttgtccctagaggagttaggctcgaatactggtattcaggtcttcaatcagatctag

SEQ ID NO: 204817 - DNA, 831 bp, Artificial Sequence
  Description of Artificial Sequence: Synthetic coding sequence
atgaactggcacctgcccctgttcctgctggccagcgtgaccctgccttcaatctgcagccacttcaaccctctcagcctagaggagctgggatccaacacaggtattcaggtattcaaccagatcgttaagagtcgaccacatgataatatcgtcatctccccgcatggtatcgcgagtgtgctgggcatgctgcaactcggagccgatggccggactaaaaaacaacttgccatggtgatgaggtatggcgtgaatggtgttggaaaaatcctgaaaaagattaacaaggcaatcgtgagtaagaaaaataaggacatcgtaaccgtagctaatgccgtgtttgttaagaatgcttcggaaatcgaagttccattcgtgactagaaacaaggatgtcttccagtgcgaggtgcggaacgttaatttcgaggatccggcatcagcctgtgactccatcaatgcttgggtaaaaaacgagacgcgtgacatgatagataaccttctgtctcccgacttaatcgatggagtgctcacaagactggtactggtgaacgcagtctatttcaaaggcctttggaagagcaggttccaaccggagaatactaagaagagaactttcgttgccgctgatggaaagtcctaccaagttcctatgctggcccagttgtctgtttttcggtgcgggtctacatcagcccccaatgacttatggtacaactttatcgagttgccatatcacggtgaaagtatctctatgcttatcgcacttcctactgagtcaagcacacctctgagcgctataatcccgcacatcagcacgaaaacttag

SEQ ID NO: 204818 - DNA, 1230 bp, Artificial Sequence
  Description of Artificial Sequence: Synthetic coding sequence
atgagcgactgccggagcagcctggtggagggcaccatgaactggcatctccccttattcctgctggcctcagtcacactgcctagcatttgcagtcacttcaaccctctatcactggaagagcttgggagcaacaccgggattcaggtgttcaatcagatagtcaagagtcgcccccatgataacattgtgattagcccccacggcatcgcaagtgtattaggcatgctccagttgggggccgacggaagaacgaagaagcaacttgcaatggtgatgcgctacggagtcaacggggtaggtaagatcctcaaaaagattaacaaggcaattgtgtcaaagaagaacaaagatatcgtgacagtagcaaacgctgtgtttgtgaagaacgccagcgaaatcgaggtcccctttgttacacggaacaaagatgtatttcagtgtgaggttcggaacgtgaacttcgaggaccccgcaagcgcatgcgactccataaacgcctgggtgaaaaacgagacacgggacatgatcgataatttgctgagcccagacctcattgatggtgtgctcactaggttggtgttagtcaacgcagtctactttaaggggctgtggaaatcccggttccaaccagagaatacgaaaaagcgcactttcgtggcggctgatggcaagtcctatcaagtgcccatgctggctcagctgtcagttttccggtgcggctcaacttctgcgcctaacgatctgtggtacaacttcattgagcttccttaccatggggagtcgatttcgatgctcatagcgttacctactgagagtagcacacctcttagtgcaatcattccgcacatttcaaccaagaccatcgacagctggatgtctataatggtccccaaaagagtgcaagttatactcccaaagtttaccgctgtcgctcagacagacctaaaagagcccctgaaagtactcggcattactgatatgtttgatagtagtaaggccaattttgcaaaaatcactcggtcagagaacttacacgtaagtcacattctgcagaaggctaagattgaagtgagcgaggacgggaccaaggctagcgcagcaaccacagctatactgattgcacgaagcagtccgccatggttcattgtcgatcggccttttctattcttcatcaggcataaccccacaggagccgtcctgttcatgggacagatcaataagccatag

SEQ ID NO: 204819 - DNA, 264 bp, Artificial Sequence
  Description of Artificial Sequence: Synthetic coding sequence
atgaactggcacctgcccctgttcctgctggccagcgtgaccctgccgagcatctgctctcactttaaccccctgtccctagaggaacttgggtctaacacagggatccaggttttcaaccaaatagtaaagtctcggccacacgacaatattgttatctccccacatgggatcgcaagtgtgcttgggatgcttcagctcggcgccgatggccgtacaaaaaagcagctggctatggttatgagatatggtgttaacggctag

SEQ ID NO: 204820 - DNA, 1257 bp, Artificial Sequence
  Description of Artificial Sequence: Synthetic coding sequence
atgcaggccctggtgctgctgctgtgcatcggcgccctgctgggccacagcagctgccagaatcctgcaagtcccccggaggaggggtcaccggatcccgactccacgggggcactagtcgaggaagaagacccctttttcaaggttcccgtcaataagcttgcagctgcagtttccaactttggatatgatttatatagggttagatcaagcacctctccgaccacaaatgtgctccttagccccctgtccgtggccaccgccctgtccgccctgtccctgggagccgaacagcgcactgaatctatcatccatagggcgctgtattacgaccttatctcttctcccgacattcacggaacatataaagagctgctagatactgtgaccgcgccccagaagaacctgaagtccgcttctcgcatcgtattcgaaaagaagctccgcatcaagtcctcctttgtggccccacttgaaaaatcctatgggacacgtccgcgcgtgctcactggtaatccgcggctcgacctacaggagatcaataattgggtccaggcgcagatgaaggggaaactagctcgcagtactaaggaaatacctgacgaaattagtatcctgcttctgggggtggctcatttcaaggggcagtgggtgacgaaattcgattcccgaaaaacttccttggaggatttttacttggacgaagagcggacggtgagagtgcctatgatgtctgatccaaaagcagtcctgaggtacgggctggattccgacctttcttgcaagatcgcgcaactgcctctgaccggatctatgtccatcatcttcttcctcccactgaaggtgactcagaaccttactctgatcgaggaatcacttacatccgagttcattcatgatattgatcgggaattgaagaccgtgcaagcagtgttaactgtgcctaagttgaaattgtcgtatgagggcgaagtcacaaaaagcctgcaggagatgaagcttcagagtttgtttgacagcccagatttctccaagatcacagggaagcccatcaagctgactcaggtggagcaccgagcaggcttcgaatggaatgaagacggagcagggactaccccctctcccggcctacaaccagcccacctcacctttcctctggactatcacctgaaccaacccttcatctttgtactgagggacacagacacaggcgccttactcttcatcggaaaaatactggatcctcgcggaccatag

SEQ ID NO: 204821 - DNA, 1233 bp, Artificial Sequence
  Description of Artificial Sequence: Synthetic coding sequence
atggccttcctgggcctgttcagcctgctggtgctgcagagcatggctaccggtgcgacatttccagaggaggcgatcgctgatctttctgtgaacatgtacaataggctgagggcaaccggcgaagacgagaatattctgttctcgccactgtctattgcattggcaatgggcatgatggagctgggagctcaaggatcaacccagaaagagattagacattccatgggatacgactccctgaaaaatggggaagagttttcctttctgaaagagttctcgaatatggttacggccaaggagagtcagtatgtgatgaaaatcgccaactccctgtttgtccaaaacggattccacgtgaacgaagagtttttacagatgatgaagaaatacttcaacgctgccgtaaaccatgtggactttagtcaaaacgttgctgtagccaactatatcaacaagtgggttgaaaataacacgaataacttagtcaaggatctggtttcaccccgcgatttcgatgctgccacctatcttgctctcattaatgcagtctatttcaaggggaactggaagagtcagttccggcccgaaaacacccggaccttctcattcactaaagatgacgagagcgaagtgcagattcccatgatgtatcagcaaggtgaattctactatggtgagttctccgacggctccaatgaagctggaggcatatatcaagtccttgagatcccttatgaaggagatgaaatcagtatgatgctggtgctttcccgccaggaagtgccactggcaaccctcgagccattggtaaaggcccagctcgtggaggagtgggcaaacagcgtgaaaaagcaaaaggtagaagtttatcttccgcgatttacggttgagcaagaaattgacctcaaagacgtgctaaaagcactgggcatcaccgaaatattcataaaggatgcaaacctgacaggactctcagataacaaggagatttttctgagcaaagctatccataagtcatttctagaggttaatgaggaaggctccgaagcagcagctgtgtccgggatgatcgccatttcccgcatggccgtactgtacccacaagtgatagtggaccacccgtttttcttcctgattaggaaccgacgaaccggtaccatcttgtttatgggaagagtgatgcaccctgagactatgaatacgagtggccacgacttcgaggagctttag

SEQ ID NO: 204822 - DNA, 1233 bp, Artificial Sequence
  Description of Artificial Sequence: Synthetic coding sequence
atggccttcctgggcctgttcagcctgctggtgctgcagagcatggctactggagccacatttccagaggaggccatcgccgacctgtccgtcaatatgtataataggctgagagctaccggcgaagacgagaacatccttttcagccccctaagtatcgccctggcgatgggaatgatggagcttggcgcacagggtagtacacagaaggaaattaggcattccatgggctatgacagcctcaaaaacggggaagaattcagctttctcaaagagttttccaatatggtgaccgctaaggaaagccagtatgtgatgaaaatcgctaacagcctgttcgttcagaatggctttcacgtgaacgaggaattcttgcagatgatgaagaagtactttaatgccgcagtaaatcacgtcgactttagccagaatgtggcagtggccaattatattaacaagtgggtggaaaataacactaataacttggtcaaggacctggtgagtcctagggacttcgacgccgctacctacctcgcattgattaacgccgtgtattttaaaggaaactggaaaagtcagttcaggcccgaaaatacccgaactttttccttcactaaggacgacgagtccgaagttcaaattcctatgatgtatcagcagggcgaattctactatggggagttttcagatggctctaatgaagcagggggcatctatcaggttcttgagatcccctatgaaggtgatgagatcagcatgatgcttgtcctgtcacgtcaggaggttccactggcgacattggagcctcttgtcaaggctcagctggttgaagaatgggcaaattcagtgaaaaagcagaaagtggaggtgtacttacctagatttactgtggagcaagagattgaccttaaagatgtgctcaaggcactgggaatcactgaaattttcatcaaggatgcaaatctcaccggactgagcgacaataaggagatctttctcagcaaggcaatccacaagtctttcctcgaggtgaacgaggagggctccgaagccgccgcagtaagcgggatgattgctatcagtcggatggccgtcctataccctcaggtgatcgtagaccaccccttcttctttctcatacgcaataggaggaccggcactatcctgtttatgggaagagttatgcaccctgaaaccatgaacacgagcggtcatgattttgaggaattgtag

SEQ ID NO: 204823 - DNA, 738 bp, Artificial Sequence
  Description of Artificial Sequence: Synthetic coding sequence
atggccttcctgggcctgttcagcctgctggtgctgcagagcatggctactggagcaacttttccagaggaagcgatcgctgacctatcagtgaatatgtataacaggctgagagcaacaggtgaggacgaaaacattctgttctcccctctctctatcgccctcgccatgggaatgatggagctcggcgcacagggatccacacagaaggagattaggcactctatgggctacgatagccttaagaacggagaagagtttagctttctgaaagaattctccaatatggtcacagccaaggaatcacaatatgttatgaaaattgcaaatagtctgtttgtgcagaacggttttcacgtgaatgaggagtttctgcaaatgatgaagaagtatttcaatgcagccgtgaatcacgtcgacttcagtcagaacgtggcagtcgcgaactatattaataagtgggtcgagaacaataccaataatctcgttaaggatcttgtgagtccaagggactttgacgccgcaacctatctcgctttgatcaacgccgtgtactttaagggaaactggaagagccaattcagacccgaaaatacacgtaccttctccttcaccaaggacgacgaatctgaagtccagatcccaatgatgtaccagcagggtgagttttattatggggaatttagcgatggatccaatgaagcaggcggtatataccaagtgctagaaataccttag

SEQ ID NO: 204824 - DNA, 483 bp, Artificial Sequence
  Description of Artificial Sequence: Synthetic coding sequence
atggccttcctgggcctgttcagcctgctggtgctgcagagcatggccactggcgccacattcccagaggaagcaattgccgatctgtcagtaaacatgtacaaccgcctgagggcgacaggcgaagatgagaacatcttgttttcaccactgtccatcgctctggcaatgggcatgatggaactcggtgctcagggcagtacgcagaaggagattaggcactctatgggatatgactcattaaaaaacggtgaagaatttagctttttgaaggagttcagtaacatggtgactgcgaaagagtctcaatacgtcatgaagatagcaaatagtttgtttgtacagaacggattccacgtgaacgaagagttcctgcagatgatgaagaagtattttaacgccgccgtcaaccatgttgatttctcccagaacgtggccgtggctaactacattaataaatgggttgagaataacaccaactag

SEQ ID NO: 204825 - DNA, 591 bp, Artificial Sequence
  Description of Artificial Sequence: Synthetic coding sequence
atggtgggcggcctgaagcggaagcacagcgacctggaggaggaggaagagcggtgggaatggtcccccgccggcctacaatcttaccagcaggcactgctgaggatttccctggacaaagtgcagcggagcctcggccccagggcaccctcccttaggaggcacgttctcatccataataccctgcaacaactccaagcagctctacggctggcacctgcgcctgctttgccccccgagcccttgtttttaggcgaagaggatttttcactatcagcaacaatcggaagcattctccgggagctagatacctctatggatggcacagagcctcctcaaaatcccgtgaccccactgggccttcagaatgaggtcccacctcagcccgatcccgtgtttctggaggccttgtccagcaggtacctaggagactcagggttggatgatttttttctcgacatagacacatccgctgtggagaaagagccggctagagcgccccccgagccccctcataacctcttttgcgcccctggcagctgggaatggaacgagcttgatcacatcatggaaataatcctgggatcatag

SEQ ID NO: 204826 - DNA, 591 bp, Artificial Sequence
  Description of Artificial Sequence: Synthetic coding sequence
atggtgggcggcctgaagcggaagcacagcgacctggaggaggaggaagaacgctgggagtggtctcctgccgggttacaaagctatcaacaggctcttcttcgtattagcctcgacaaggtgcaaagatccctgggccctcgggccccctctcttcgccgacatgtcctgattcacaatacactccagcagctgcaggctgccctgagattagctcctgcccccgctctcccgcctgaacccctgtttctcggggaagaagacttctccctgagcgcgaccatcgggagcatccttcgagagctggataccagtatggatggtaccgaacctccacaaaaccccgtgactcccctgggactgcagaacgaagttccacctcagccagatccagtttttctcgaagctctgtcgagtcgctatttgggtgactccggactggatgactttttcctggacatcgacactagcgctgtagaaaaagagccggctagggcccctccggaacctccccacaacttattctgcgcccccgggtcttgggagtggaacgaacttgaccatataatggaaatcatcctggggtcttag

SEQ ID NO: 204827 - DNA, 369 bp, Artificial Sequence
  Description of Artificial Sequence: Synthetic coding sequence
atgaagctgctgaccggcctggtgttctgcagcctggtgctgggcgtcagtagcagatccttcttttctttccttggcgaagctttcgatggggcacgggatatgtggagggcttactcagacatgcgggaggccaattatatcggctctgataaatatttccacgccagaggaaattatgacgccgccaaacgaggacctggaggagcctgggctgccgaggtcattacagacgcccgtgagaatattcagaggttctttggtcatggagccgaggattcactcgcggatcaagcagccaatgagtgggggaggagtgggaaagatcctaatcacttccgccctgctggtctcccagagaaatattag

SEQ ID NO: 204828 - DNA, 369 bp, Artificial Sequence
  Description of Artificial Sequence: Synthetic coding sequence
atgaagctgctgaccggcctggtgttctgcagcctggtgctgggcgtgagtagcaggtccttcttctccttccttggggaggctttcgacggtgctagagacatgtggagggcgtacagtgatatgagggaagctaattacattggttccgataagtattttcacgcgcgtggcaactatgacgctgcaaagagaggtcccggcggcgcatgggcagctgaagtcataactgatgctcgggaaaacatccagcgcttctttggacatggtgcagaggacagcctagcagaccaggcagcaaatgagtggggaaggtccggcaaagaccccaatcatttcaggcccgcaggacttccagagaaatactag

SEQ ID NO: 204829 - DNA, 369 bp, Artificial Sequence
  Description of Artificial Sequence: Synthetic coding sequence
atgaagctgctgaccggcctggtgttctgcagcctggtgctgggcgtttcttcaaggagcttcttttctttcctcggggaggcattcgacggcgcccgcgatatgtggcgggcttattccgacatgcgcgaggccaactatatcggctcagacaagtacttccatgcaaggggaaattatgatgccgccaaacgcggcccaggaggcgcctgggctgcagaggtgataactgacgcaagagaaaatatccagcgcttcttcgggcatggggcagaagactcattggctgaccaagccgccaacgagtggggacggagcggtaaagaccctaaccatttccggcctgctggcttgcctgagaagtattag

SEQ ID NO: 204830 - DNA, 369 bp, Artificial Sequence
  Description of Artificial Sequence: Synthetic coding sequence
atgaagctgctgaccggcctggtgttctgcagcctggtgctgagcgtttcctccaggagtttcttttcgttccttggagaagccttcgatggcgccagggacatgtggcgcgcctatagcgacatgcgcgaggcaaattacattggaagtgacaaatattttcatgctagggggaactatgatgcagccaaaaggggccctgggggcgcatgggcagccgaagtcataagtaacgccagagagaacatccagagactgactggcaggggtgctgaggactctcttgccgaccaagcagccaataagtggggaaggtcaggacgagatcccaaccacttccgtcctgctgggctgcccgaaaagtactag

SEQ ID NO: 204831 - DNA, 252 bp, Artificial Sequence
  Description of Artificial Sequence: Synthetic coding sequence
atgaagctgctgaccggcctggtgttctgcagcctggtgctgagcgtttcttcaaggtctttcttttctttcctgggggaagcttttgatggagcaagggatatgtggagggcatattcagatatgcgtgaggcaaattatatcggcagcgacaaatacttccacgcaagaggaaactatgacgctgccaagaggggcccaggcggggcctgggcagcagaagtgattagcttgttttccgccgagttgtag

SEQ ID NO: 204832 - DNA, 369 bp, Artificial Sequence
  Description of Artificial Sequence: Synthetic coding sequence
atgaagctgctgaccggcctggtgttctgcagcctggtgctgagcgtgtctagccggtcttttttctctttcctcggggaagcctttgacggggccagagacatgtggagggcttactccgatatgagagaggccaattacattggctcggataagtactttcacgcacgcggaaattacgacgccgccaagagggggccaggaggcgcttgggccgccgaagtgatctctaacgctcgcgaaaatatccaacgacttacaggacggggagcagaggacagcttagctgatcaagcagcaaataagtggggaaggtctggtagggatccaaaccacttcagacccgctggccttcctgaaaagtattag

SEQ ID NO: 204833 - DNA, 369 bp, Artificial Sequence
  Description of Artificial Sequence: Synthetic coding sequence
atgaagctgctgaccggcctggtgttctgcagcctggtgctgagcgtctcaagccggagttttttcagctttctaggggaggcctttgacggggctagagacatgtggcgggcctacagcgacatgagggaagccaactatataggtagtgacaaatactttcatgcccggggtaattacgatgccgccaagcgtggacccggcggtgcatgggcagctgaggtgatttcgaatgcaagggaaaacatccagagattaacaggacggggggcggaagattccctggccgaccaggcagccaataagtggggccggtccggaagagatcctaaccacttccggccggctggcctgcctgaaaagtactag

SEQ ID NO: 204834 - DNA, 393 bp, Artificial Sequence
  Description of Artificial Sequence: Synthetic coding sequence
atgcggctgttcaccggcatcgtgttctgcagcctggtgatgggcgtgacctcggagtcctggcgatccttctttaaagaggcgctacaaggtgtcggcgacatgggtagggcttattgggacatcatgatctcaaaccatcagaattccaaccgctatctatatgcaagggggaactacgatgccgctcaacggggaccaggcggagtctgggctgctaaacttatatctcggtcacgagtgtatctccagggtcttattgattgttacctgttcggaaattcatcaacagtactggaggattccaagagcaacgagaaagccgaggaatggggtaggtccgggaaagatccagatcgcttcaggccagacgggcttcccaagaagtactag

SEQ ID NO: 204835 - DNA, 1278 bp, Artificial Sequence
  Description of Artificial Sequence: Synthetic coding sequence
atgggcgaggacgccgcccaggccgagaagttccagcaccccggcagtgacatgcggcaagagaaacctagctccccttcccctatgccctcttctacaccgagtccgagtctgaatctcggtaatactgaggaggcaatccgagataattcccaggtgaatgctgttacagttttaactctcctggacaagctggtgaacatgctagacgctgttcaggagaaccagcacaagatggaacaaaggcagatcagcttagaggggagcgttaaaggtatccagaatgatttaacgaaactaagtaagtatcaagcttcgaccagtaacacggtgagcaagttactggaaaagagtcgcaaggtcagtgcccacacaagagctgtcaaggagagaatggatcgtcagtgtgctcaggtcaagagactcgagaataaccatgcacagctgcttcgtcgcaatcattttaaagtgctcatctttcaggaagagaatgaaattcccgcctccgtgttcgtgaaacagcctgtgtccggggccgtcgagggaaaggaagagcttcccgacgaaaataagtctcttgaagaaaccctgcacactgtcgacttgtcttccgatgatgatttacctcatgatgaggaggcgttggaagatagcgccgaagagaaggttgaggaaagtagggcagagaagatcaagaggtctagcctgaaaaaagtggattcccttaagaaggctttttctaggcagaacatcgagaaaaagatgaataaactggggactaaaattgtgagcgtcgagcggagagaaaaaattaagaagagcctgaccagcaatcaccagaaaatctcttccggcaagagcagcccattcaaagtctccccccttacatttggcagaaagaaggtgcgcgaaggggagtcccacgccgagaatgagaccaaatccgaggacctgcctagctcagaacagatgcctaatgatcaggaggaagagagttttgccgaaggacactccgaggccagcctggcctccgccttggtagagggtgagatcgccgaagaggcagccgaaaaggccacatcaagggggtccaactcaggaatggactccaacatcgatttaacaatcgttgaggatgaggaagaggagtctgtcgcactggagcaggcacagaaggtgcgctacgagggcagctacgccctcaccagcgaagaggcggagaggtccgatggggaccctgtgcagcccgccgtgctgcaggtacaccaaacttcctag

SEQ ID NO: 204836 - DNA, 1290 bp, Artificial Sequence
  Description of Artificial Sequence: Synthetic coding sequence
atggcccagcccggcaccctgaacctgaacaacgaggtggtgaagatgagaaaggaggtgaagcgcattagagtgctggttatccgaaaactcgttagatctgttggccggctgaagagtaagaaagggactgaagatgcgctgctcaaaaatcaaagaagagcccagcggctcctggaggagattcatgccatgaaagagctgaaacctgacattgtaacaaaatctgccttgggtgacgacatcaatttcgagaagattttcaagaaacctgacagcacagccactgagagagcaatagcccggctggcagtccacccgctgctcaaaaaaaagatcgacgtgttgaaggctgccgtccaggcctttaaggaagcaagacagaacgtggccgaagtcgaaagctccaagaatgctagtgaggataatcattctgagaataccctctactcgaacgataatgggagcaatcttcaaagggaagccaccgtcataagtgaacagaaggtgaaagagactaagattctggcaaagaaacccatacacaattccaaagaaaagatcgccaaaatggaacacggaccaaaagcagtcacaatcgctaattctccatctaaaccctcagaaaaggacagcgtcgtgtcgctggagagccaaaaaactcccgcagacccaaaacttaagactctgtcccaaaccaagaagaacaagggttctgattccagcctgtctgggaactctgatggcggggaagaattctgtgaagaggagaaggaatacttcgacgactctacagaagaacggttctacaagcaaagctccatgtcagaggattccgacagcggggatgacttctttatcggtaaggtgaggaggacacgcaagaaggagtcctcttgtcactctagcgtgaaggaacagaagccattagaaaaagttttcctgaaagaagacactggcgaaacgcacggcgataccaggaatgacaaaatcaaacccagcactgaaaccaggaaacttgaaagtgtgttttttcactcactgagcggcagcaaatccagcagacgcaactttaaagagcaggcccctaaaacacgctcgctggattttccccagaatgagcctcagatcaaaaatcagttcaataaaaagttgtccggtagattagagaacacgaaacagcaactccaacttcccttgcacccatcctgggaggcaagcagacggagaaaagaacagcagtccaacatcgctgtcttccagggaaagaaaattacgtttgatgactag

SEQ ID NO: 204837 - DNA, 1296 bp, Artificial Sequence
  Description of Artificial Sequence: Synthetic coding sequence
atgaccgtgaagaccgaggccgccaagggcaccctgacctacagccgcatgcggggcatggtggcaatcctgattgctttcatgaagcagcggcggatgggcctgaacgactttatccaaaaaattgccaacaatagttacgcctgtaagcatccggaagtgcaatcaatcctgaagatttcccagccccaggaaccggagcttatgaatgccaacccttctcctccaccgagcccatcccagcagattaacctgggaccatccagcaatccccacgccaaacccagtgattttcactttcttaaggtgatcggcaagggttcgttcgggaaggtcctgctagctcgtcacaaagctgaggaagtcttttatgctgtgaaagttctgcagaagaaggccattctcaagaagaaggaggagaaacacataatgagcgaacgcaacgtgttgctgaaaaacgtgaaacatcctttcctggtgggattgcactttagctttcagactgctgataaattatactttgtgctggactatatcaacgggggcgaattgttctaccacctccagcgggagaggtgtttcttggagcctagggcacgcttctacgccgccgagattgcctcggccctcggctacttgcatagtctgaatatagtgtaccgcgacctgaagccagagaacatcctgttagactctcaaggtcacatcgttctcactgacttcggactgtgcaaggagaacattgagcacaattccaccacttccacattttgtggaaccccggagtacctagcccctgaggtgcttcacaagcagccatatgacaggacagtggattggtggtgcctcggtgctgtactgtatgagatgctgtatgggctgccgcccttctatagccggaacactgctgagatgtacgacaatatcttaaataaacctttgcaattgaaacctaatattaccaactctgccaggcacttgctagagggccttctacaaaaggaccggacaaagcgactgggtgccaaagacgactttatggagatcaaatcacatgttttcttttcgttgattaattgggatgacttgattaataagaagataactcctccctttaaccctaatgtgagcggcccaaatgacttgcgccacttcgatccagagttcaccgaggagcctgtgcccaattctattgggaagagccctgattctgtgctggttactgcttcagttaaagaggccgcagaggcatttttgggcttctcatacgctcctcctacggacagtttcctatag

SEQ ID NO: 204838 - DNA, 1266 bp, Artificial Sequence
  Description of Artificial Sequence: Synthetic coding sequence
atgaagcccagcaagcggttcttcatcagcccccccagcagcaccgcttttatgaaacaacggagaatggggttgaatgactttatccagaagatagcaaacaacagctatgcatgtaagcacccagaggtccagtccatcctcaagatcagtcagccacaggagccggagttgatgaatgccaaccctagcccgcctccatccccttcccagcagatcaacctcggtccaagttccaatccacacgctaagccaagcgatttccactttctcaaagtgataggcaaaggtagttttggcaaggtgttactcgccaggcacaaagccgaggaggtcttttacgccgtgaaggtgctgcaaaaaaaagcaattttaaagaaaaaggaagaaaagcatatcatgagtgaacggaacgtcctcctcaagaacgtgaagcatccattcttggtaggactacatttctctttccagaccgccgacaagctgtacttcgtgctggattatatcaacggcggggagctgttttaccacctgcagcgagagcgatgtttccttgaacctcgggcgcgcttttacgcagctgaaattgcctctgcattgggctatctgcactcgcttaacattgtttacagagacctgaaaccggaaaatatactgcttgactctcagggccacatagtgcttaccgacttcggcttgtgcaaagagaacatcgagcacaattcgaccactagcacattctgcggcacaccagagtacttagcaccagaagtgctgcacaaacagccatacgacaggacagtagattggtggtgtctgggggcagtgctgtacgagatgctctatggcctgcctcctttttactcgaggaacaccgcagaaatgtacgacaatattctgaacaaaccattgcaactgaagccaaatatcacaaactccgcacggcatttgctggagggtctgcttcagaaggatcgaaccaagcgtctcggtgcgaaagatgatttcatggaaataaagtctcatgtgttcttctccttgatcaattgggacgatttaatcaacaaaaagatcacacccccctttaacccgaatgtgagtgggcccaacgacctccggcacttcgacccggagtttactgaagagccggtacctaacagtataggaaaaagtcccgacagtgtcttagtaacagcaagcgtaaaagaagcggccgaggccttcctggggttctcgtatgcaccgcccactgattcttttctgtag

SEQ ID NO: 204839 - DNA, 1581 bp, Artificial Sequence
  Description of Artificial Sequence: Synthetic coding sequence
atggtgaacaaggacatgaacggcttccccgtgaagaagtgcagcgcctttcagttctttaagaaaagggtgcggcgctggatcaaatcaccaatggtcagtgtggataaacaccaaagcccgagcctgaagtacaccggtagttctatggttcacatcccgcctggcgaaccagattttgaatcttccttgtgtcagacatgcctgggggaacatgccttccagagaggagttctccctcaggaaaacgagtcctgcagctgggagactcaatcaggttgcgaggtgagagaaccatgcaatcatgccaatattttgacaaagcctgatcctcgtactttctggactaacgacgaccctgcgttcatgaagcagcgacgaatgggactgaacgatttcattcagaaaatagccaacaacagttatgcgtgcaaacaccccgaagttcagagtattttgaagatttcacagccacaggagcccgagctcatgaatgccaacccaagcccacccccttctcctagtcaacagatcaacctaggccctagttctaatccgcacgcaaagccgtccgattttcattttctgaaagttataggtaagggatccttcggcaaagtccttctggccagacataaggctgaagaggtcttctatgccgtgaaagtcttgcagaaaaaagcgatcctgaagaaaaaggaggagaaacacattatgagcgaaaggaatgtactgctgaagaatgtaaagcacccgtttctcgtgggcctgcatttttcgttccagaccgctgataagttgtacttcgttttggattacatcaacggcggcgaattgttctatcatttacagagagagcggtgctttttggagccaagggcccggttttatgctgctgagatagccagcgctctgggctacctgcactcattgaatattgtctatagagatctgaaacctgagaatattcttctggattcacaggggcatatagtgctgactgattttggcctttgtaaagaaaacattgagcataattctacaactagtacattctgtggcaccccggaatatttggcccctgaagtgctccataagcaaccatatgatcggaccgtcgattggtggtgtctcggtgccgtgctgtatgaaatgctttatggactgccccccttttactcccggaatactgccgaaatgtacgataacatcctgaataagccattgcagctgaagccaaacattacaaattctgcaagacacctgctggaagggctgctgcaaaaggacagaacaaagaggttgggtgccaaggatgactttatggagattaaatcacacgtattttttagtctgatcaactgggatgacctcattaataagaagatcacccctccattcaaccccaacgtgtccgggcctaatgatttaagacatttcgaccctgaatttacagaagagcccgtaccgaactcaatcgggaaatcccctgacagcgtgttagtaacagctagcgtaaaagaagccgctgaagcatttctgggcttcagttatgccccacctaccgacagtttcttatag

SEQ ID NO: 204840 - DNA, 1338 bp, Artificial Sequence
  Description of Artificial Sequence: Synthetic coding sequence
atgggcgagatgcagggcgccctggcccgggcccggctggagagcctgcttagaccacggcataagaagcgtgcagaagcccagaagcgatcagagtctttcttgctctccgggttagcctttatgaagcaaagacgtatggggctcaacgactttatacagaaaattgcaaacaactcctatgcttgcaaacaccccgaagtgcagagtatacttaaaatctctcagccacaggaaccggaactcatgaacgcaaatccaagccctccccccagcccttcccagcagattaacctgggccccagttcaaaccctcatgccaagccctctgactttcactttctcaaagtaatcggcaaaggctcattcgggaaagtgttgctcgcacggcacaaggcagaggaggtattttacgcagtaaaagttttacaaaagaaggccattctgaagaaaaaagaagagaaacatatcatgtcagagcgtaacgtcctgctaaaaaacgtcaaacacccttttctggtggggctgcacttcagcttccagacggcagacaagctgtacttcgttctggactatataaatggcggggaactgttctaccatcttcagagagaacgttgttttcttgagcctcgtgcaaggttctacgcagccgagatagcctctgccctcggttaccttcactctcttaacatagtctatcgcgacttgaaacccgagaatattctgcttgatagccaggggcatatcgtgctgaccgattttggtctgtgtaaagagaatatcgaacacaactccacaacctccaccttctgcggcacccccgaatacctcgcaccagaggtacttcacaagcagccttatgatcgaaccgtggattggtggtgcctgggagcagtgctgtacgaaatgctctatggcctacctcctttctatagcagaaacactgctgagatgtacgacaatatccttaataagcccctgcagttaaagcccaatataaccaattccgcacgtcatctgctcgagggcttactacagaaagatagaaccaaaaggcttggagctaaagatgacttcatggagatcaagtcgcatgtttttttttctctgattaactgggatgatctgattaacaaaaagatcactcctccattcaacccaaacgtaagcggccctaatgacctacggcattttgatccagagtttaccgaagagcctgttcctaacagcatcggcaagagccctgactctgttctagtaactgctagtgtgaaggaggctgctgaagctttcctcggattctcctacgccccccctaccgatagctttttgtag

SEQ ID NO: 204841 - DNA, 435 bp, Artificial Sequence
  Description of Artificial Sequence: Synthetic coding sequence
atggtgagcgtggacaagcaccagagccccagcctgaagtacaccggttcatcaatggtgcatattccaccaggagaacccgactttgaatcaagtctctgtcaaacctgcctgggcgaacatgctttccaacgtggggtgctgccccaagaaaacgagagttgctcttgggagacacagagcggttgcgaagtgcgggagccatgtaaccatgcgaacatactgaccaagcccgatccacgcacattttggaccaacgacgacccagcattcatgaagcaaagacgaatgggcctcaatgactttatacagaagatcgctaacaatagctacgcctgcaaacacccagaagtgcagtctattctcaagatttctcagcctcaagaacccgaactgatgaatgcaaatccctcaccccccccttcacctagctag

SEQ ID NO: 204842 - DNA, 1380 bp, Artificial Sequence
  Description of Artificial Sequence: Synthetic coding sequence
atgagcagccagagcagcagcctgagcgaggcctgcagccgggaggcatacagcagtcacaattgggctttgccccccgcgtcaaggtctaacccccagcccgcctatccctgggcgacccggcggatgaaagaggaagcaattaagcctcctctgaaagcattcatgaagcaacgcaggatgggattgaatgatttcatccaaaaaatcgcaaataacagctatgcgtgtaaacatccagaagtgcaatctattctcaagatctcccagcctcaggagcctgagctgatgaacgccaatccctctcctccaccatcacctagtcaacaaattaacttggggcccagttccaatccgcatgcaaaaccaagcgactttcatttccttaaggtgatcggaaagggctcattcgggaaagtacttctggcgcgacataaggctgaggaagtattctacgccgtcaaagtactacaaaaaaaggcgatcctgaaaaaaaaggaggaaaagcatatcatgtctgagaggaacgtactgctgaagaacgtgaaacaccctttcctagtgggccttcattttagcttccagaccgctgacaagttatacttcgtgctagactatatcaacggaggtgagcttttttaccaccttcaacgagagaggtgttttctggaaccccgggctaggttctatgccgctgagatagcttctgctctgggatatctgcatagcctcaacatagtgtatcgtgatcttaagcctgagaatattcttttagacagtcagggccatatcgtgctgacagacttcggactttgcaaggaaaacatagagcacaactccactacctccaccttttgcggaacgccagaatacttagcgcccgaggtcctccacaaacagccttacgacagaactgtcgactggtggtgcttgggggccgtgctgtatgaaatgctatacggcctaccacccttctactcaaggaataccgccgagatgtatgacaatattttaaacaaacctttgcaattaaaacccaacatcactaattcagcccgtcatctgctggaaggcctgttacagaaggacagaaccaagcgtttgggagccaaagatgattttatggagatcaagagccacgtgttcttttctttgatcaactgggatgacctcatcaacaagaagatcacacctccttttaacccaaatgtgagcggccccaacgaccttagacactttgacccagagtttacagaagagccggtaccaaattccattggaaagtctccggattcggtacttgtgacggccagtgtaaaggaggccgccgaagcgttcttgggcttctcttatgccccacctacagactcattcctttag

SEQ ID NO: 204843 - DNA, 183 bp, Artificial Sequence
  Description of Artificial Sequence: Synthetic coding sequence
atggtgaacaaggacatgaacggcttccccgtgaagaagtgcagcgctttccagttcttcaagaaacgggtgcgaaggtggattaaatcccctatggtctccgtggataagcaccagtctccttctcttaaatataccggcagcagcatggtccatataccgccgggggagcccgacttttag

SEQ ID NO: 204844 - DNA, 1284 bp, Artificial Sequence
  Description of Artificial Sequence: Synthetic coding sequence
atgcagggcctgctgaccagcggccggaagcccagcggcggcggcagatgtacaggccgcggtgggtggcggggccaatggtgcctgaagccatggatgggcggtgccgacccccccacccctacgctgtcctgcctgctcctgcccgtgccgccggagttgcccgaccattgttacagaatgaattcatctcctgctggcaccccctcacctcaaccttccagagcaaacgggaacataaacctgggaccgtccgctaaccctaatgcccagccaactgacttcgacttccttaaagtaataggcaagggtaattacggaaaggtcctcctggccaagaggaaatccgatggcgctttctacgctgtgaaagtgcttcagaaaaaaagcatactgaagaagaaagagcaatcccacatcatggcagaacggtccgttctcctcaagaacgtcaggcaccctttcctcgttgggctaaggtacagtttccagacaccagagaaactgtactttgtgctggattacgttaacggcggagagctgttcttccacctgcagagagaaagacggtttctcgagcctagggcacgcttttacgccgccgaagtggcatctgcgatcggttacttgcatagtctgaacatcatataccgggatttgaagccagagaatatcctgttagactgccagggccatgtagtgctgaccgacttcgggctttgtaaggaaggcgtggaaccagaagacactaccagcactttctgtggtactccagaatacctcgcccccgaggttctgcgcaaagagccctacgacagggctgtagactggtggtgtctgggagccgtgctgtacgaaatgctccacggcttaccgcccttctacagccaggatgtgtcccagatgtacgaaaacatcctgcaccagcctttacagattccggggggacggactgtggccgcctgcgacctgctgcagtctctgcttcataaggaccagaggcagcgtttgggaagcaaggctgatttcctggagatcaagaatcacgtttttttctcacccatcaattgggacgacctgtatcacaaaaggctaaccccccctttcaaccccaacgttactgggccagcggacctgaaacacttcgatcccgagtttacccaggaagccgtgtcaaagtccatcggttgcacgccagatacagttgcgagctcctcgggtgcatcctctgccttcttagggtttagctatgctccagaggatgacgacatcttggactgttag

SEQ ID NO: 204845 - DNA, 1101 bp, Artificial Sequence
  Description of Artificial Sequence: Synthetic coding sequence
atgaacagcagccccgccggcacccccagcccccagcccagccgggccaatggaaacattaatttgggccctagcgccaatccaaacgcccagccaactgacttcgactttctgaaagtcatcggaaagggcaactatggcaaagtcctgcttgcaaagaggaaatcggatggtgccttttatgctgtcaaggtgttgcagaaaaagagcatcctcaaaaaaaaggaatcacatattatggctgagcgcagcgtgttactgaagaatgtgaggcacccatttttagttggactgcggtatagctttcaaacgcccgagaagttatatttcgtacttgactacgtgaatggcggcgagctttttttccacctacagcgtgagcgtcgctttctggaaccccgggcacgattttacgccgcagaagttgcaagcgctatcgggtatctgcacagtttgaacataatatatagagatttgaaaccggagaacatcctgctggactgccagggtcacgtggtgctgacagatttcggcctctgcaaagaaggcgttgagccggaggatactacctcaacattctgtggcacccccgagtacctggcccctgaagtgttgcgaaaagaaccctacgacagagcagtggactggtggtgcctcggggctgtcctatatgagatgttgcacggcttgccacccttttattctcaggatgtgtcacagatgtatgagaatattctccatcaacctctccagattcccggcgggaggactgtggctgcatgcgatctcctccagtcactgctgcataaagaccagcgccagcggctgggctcaaaggctgatttcttggagatcaaaaaccacgtttttttctcacctataaactgggatgatctttaccataaaagacttacgcccccttttaaccctaacgtgaccgggcctgcagacttaaagcactttgatccagagttcacacaagaggcagtttccaaatctattggctgtacgccagatactgtcgcgtccagctcaggcgcctcgtcagccttcctcggcttctcttacgctccagaggatgatgacatcctggactgttag

SEQ ID NO: 204846 - DNA, 1104 bp, Artificial Sequence
  Description of Artificial Sequence: Synthetic coding sequence
atgaacagcagccccgccggcacccccagcccccagcccagccgggctaacgggaacattaacctgggccccagcgctaatccgaatgctcagccgactgactttgattttctgaaagtcattggtaagggtaactacggtaaagtgctgctggcaaagagaaagtccgacggggccttttatgccgttaaggttctgcagaaaaagtcgattttgaaaaagaaggaacaatcgcatataatggcagagagatcggttctgctgaaaaacgtacgacatccttttctcgtgggtttgcgatacagcttccaaacccctgagaaactctatttcgttctcgactacgttaacgggggcgagctgttcttccatctacaacgtgagcgcagattcctggagccccgggcccgattttatgccgccgaagtggcctccgctatagggtacctgcattctctgaatatcatttacagagatcttaaacccgagaatatcttgctcgactgccaaggccatgtggtgctgacggacttcggcctgtgcaaggaaggcgttgagcccgaagataccacatcgacattctgcgggacaccagagtaccttgcacccgaagttctgcgcaaggagccttacgacagggcggtcgattggtggtgcctcggagctgtcctttatgagatgttgcatggcctgccccctttctatagtcaggacgtgtctcagatgtacgaaaatattttgcaccagccgctgcaaattccaggtggtcgaaccgtggctgcgtgtgatcttcttcagtccttgctccataaggatcagcgccagcgcctgggatcaaaagctgatttcctcgagattaaaaatcacgtattcttttcaccaattaattgggatgatctgtaccacaagaggctgactccacctttcaacccgaacgttacaggcccagcagatttaaagcatttcgatcctgagttcacacaagaggccgtgtccaagtcgatcggttgtaccccagacacagtggcttccagcagcggggcatcttccgcctttctcgggttttcctacgctcctgaggacgatgacatcctggactgctag

SEQ ID NO: 204847 - DNA, 1104 bp, Artificial Sequence
  Description of Artificial Sequence: Synthetic coding sequence
atgaacagcagccccgccggcacccccagcccccagcccagccgggctaatggcaatattaacctcgggccatccgctaatcccaatgcccaacctacagatttcgatttcctgaaagtgatcggcaaaggcaattatggcaaggttctgttagccaaacggaaaagcgatggagcattttacgccgtgaaagtgctgcagaagaaaagcatcctaaagaagaaagagcagagccatatcatggccgaacggagtgtactgctgaagaacgtgcgccatccctttttagtggggctgcgatactcattccaaacacccgagaagctgtatttcgtgttggattatgtgaatggtggtgagctattcttccaccttcagcgggaaaggcgcttcctagaacctagggcccgtttctacgcagccgaggtcgcttctgcaatcgggtacttacatagcctcaacattatctacagagatctcaaaccagaaaatatacttctggattgtcagggccacgtcgtgctcaccgacttcgggctgtgcaaggagggagtggagcctgaggacactactagcacattctgcgggacccctgagtatctcgctccagaagtcctccgcaaggagccttacgaccgcgccgtggactggtggtgtttaggggcagttctttatgagatgttacacggactccctcctttctacagtcaagatgtgtcgcagatgtatgagaatattttacatcagcccctgcaaattccgggagggcgaactgtggcagcctgtgacctgcttcagtcgctactgcacaaagaccagagacagcggctggggtccaaagcagatttcctcgaaattaaaaaccacgtgttcttctcaccaatcaattgggatgacctgtatcacaaacgcctgactccgccattcaatccaaacgtaaccgggcctgcagatttaaagcactttgatcctgagttcacccaagaggccgtgtctaagagcattggctgcacccctgatacagtggcttcatctagtggcgctagttctgctttcttaggtttctcgtacgcccccgaggatgatgatattctggactgctag

SEQ ID NO: 204848 - DNA, 597 bp, Artificial Sequence
  Description of Artificial Sequence: Synthetic coding sequence
atgaacagcagccccgccggcacccccagcccccagcccagccgggcaaacggcaacatcaacttgggcccctcggccaacccgaacgcacagccaaccgatttcgactttctaaaagtcattgggaaagggaactacggaaaggtgctccttgcaaagaggaaatcagatggcgcattctatgctgtaaaagtgctccagaagaagagtattctcaaaaagaaggaatcccacattatggcagaaagatctgtcctgctgaaaaacgtgcggcatcccttcctggtcggattgcgctacagctttcagacaccagagaaactttattttgtgctagattatgttaatggtggtgaacttttctttcacctgcaacgtgagaggagatttctggaaccacgggcacgcttctacgctgctgaagttgctagcgccatcgggtacctgcattcgctgaatattatctacagggatctgaagcccgaaaatatccttctggactgtcagggtcatgtggtgctgaccgatttcggcctgtgtaaggagggtgtggagccggaggacaccacatccactttttgcggtactccagagtag

SEQ ID NO: 204849 - DNA, 1104 bp, Artificial Sequence
  Description of Artificial Sequence: Synthetic coding sequence
atgaacagcagccccgccggcacccccagcccccagcccagccgggcaaacgggaacattaaccttggacccagtgctaaccccaatgcacaaccgacagactttgacttcctgaaagtaattggaaaaggcaactacgggaaggtgctgctggccaagagaaaatccgatggcgccttctacgcggtaaaggtgctgcagaagaaatcaatccttaaaaaaaaggagcagtcccacattatggctgagcggagcgtgttactgaagaacgtgaggcatccgttcctcgtcggcctgcggtacagtttccagacaccagagaagctgtacttcgtactcgactatgtgaatgggggagaactttttttccatctccagcgagagagaaggtttctcgagccaagggctcgcttctatgcagcggaggtggcctcagcaattggatacttgcattcattgaacatcatttatcgggatttgaaacctgaaaatattttgttagactgtcagggccacgtggtgttgaccgattttggcctgtgtaaggagggcgtggagccagaagataccacaagcacattttgcggcactcccgagtatctggccccagaggtgcttcggaaggagccttatgatcgtgccgtggactggtggtgccttggcgcggttctgtacgaaatgctacacggattgcccccattctattcccaggacgtgtctcagatgtatgagaatattttacaccagcccctccagatccctggcggacggaccgtcgcagcatgcgatctcctgcagtctcttcttcacaaagaccagaggcaaaggctgggaagcaaggccgactttttggaaatcaagaaccatgtgttcttctctcctatcaactgggacgatttgtaccacaaaaggctaacccccccattcaaccccaatgtgacgggcccagccgatctcaaacatttcgatcccgagtttacccaggaggctgtctccaagagcataggttgtacccctgacaccgtggcctccagctcaggcgcgtctagcgcattcttgggttttagttacgcaccagaggacgacgatattcttgattgctag

SEQ ID NO: 204850 - DNA, 1182 bp, Artificial Sequence
  Description of Artificial Sequence: Synthetic coding sequence
atgcagggcctgctgaccagcggccggaagcccagcggcggcggccgctgtaccgaactacctgatcattgctatagaatgaacagctcccctgccggaaccccctcaccccagccttctcgagcaaatggcaatatcaacctaggaccgagtgccaatccgaacgcccaacccactgattttgacttcctgaaagtgattggcaagggaaactatggtaaagtgctgcttgctaagagaaagagcgacggcgccttttacgctgtcaaggtcctgcagaagaaatccatcctgaagaaaaaagagcagagtcacataatggcagagaggagcgtgctgttaaagaacgtgcgtcacccttttctggttggactccgctactcgttccaaactccagagaagctctatttcgtgctggattatgttaacgggggcgagctgttctttcacttacagagggaaagacgcttcctggagcctcgcgcgcgtttctacgctgccgaggtggcatctgccatcggctatctccacagtctcaacatcatctacagggacttgaagcccgagaacatactgctggactgtcagggacatgttgttctgaccgatttcggcctttgtaaagagggggtggagcccgaagacaccacttctacgttttgtggtaccccagagtatttagcaccagaagtgctaagaaaagaaccatatgatcgagctgtcgactggtggtgcctgggcgctgtgctttatgagatgcttcacggtcttccacctttttattctcaagacgtctctcagatgtacgagaacatcctgcatcagccccttcagattccagggggtaggactgtagcagcatgcgatttgcttcagagcttgctgcacaaggatcagcgccaacggctcgggtccaaggcagactttttggagattaagaatcatgtgttcttctcccctatcaattgggacgatctgtaccacaaacgcctcacccctcccttcaacccaaacgtgactggcccagcagacctgaaacacttcgatcccgaattcacccaggaggccgtgagtaagagcatcgggtgcaccccagacacagtggcttcctcctcaggcgcctctagtgctttcttgggtttcagctatgccccggaggacgacgacattttggactgctag

SEQ ID NO: 204851 - DNA, 1491 bp, Artificial Sequence
  Description of Artificial Sequence: Synthetic coding sequence
atgcagcgggaccacaccatggactacaaggagagctgccccagcgtgtctattcccagttcagacgagcaccgcgaaaaaaaaaagagatttactgtttacaaagtattagtcagtgtgggtagaagcgaatggtttgtgttcagacgctacgctgagtttgacaaactgtataacactctcaagaaacagttcccagcaatggcactgaagatccctgcaaagaggattttcggagataacttcgatccagacttcataaagcagaggagggctgggcttaatgagttcatacaaaacctcgtgcggtatcctgaactgtacaatcacccagacgtgcgggccttcttgcagatggactcccccaaacaccaatcggatccgtccgaggacgaggacgagagaagctcccagaagcttcactctacttcacagaacattaatctcggaccctcagggaatcctcacgcgaagcccaccgattttgacttcctgaaagtgatcggtaagggcagcttcggaaaggtgctcctggctaagaggaagctggacggtaaattctacgcggtgaaggttttgcagaagaagatagtgttaaaccgcaaagagcagaagcatataatggcggagaggaatgtgctgctgaagaacgttaaacaccccttcctcgtcggcttgcactacagcttccagactacggagaagctgtatttcgtcttagacttcgtgaatggaggcgagctcttttttcacctgcaaagggagcggagcttccccgagcaccgggcacggttttacgcagcagaaatagcttctgcgcttggctacctccactctatcaagattgtctacagggacctgaaacccgagaacatcctgctggactccgtgggccatgtcgtgctaaccgattttggcctctgtaaagagggtatcgcgatcagcgataccactactactttttgcgggactccggaataccttgcacccgaagtcattcgcaagcagccatatgataataccgtggattggtggtgtctgggggctgtgctttacgagatgttgtacggcctaccccccttctactgtagggacgtagccgaaatgtatgataatatcctccataaacctctctctctgaggcctggtgtgagcttaactgcgtggagtatcttagaggagctgctggagaaggaccgccagaaccgtcttggcgcaaaagaagactttctggagatccagaaccacccttttttcgaaagtctgtcgtgggctgatctagttcagaaaaaaatccctcctcctttcaatccaaatgtcgccggccccgatgacatccggaacttcgatacagccttcactgaagaaaccgtgccgtactccgtgtgcgtgagttcagattactctattgttaatgcttccgtcctggaagctgatgatgcgtttgtgggtttctcttatgcccccccatctgaagacctgttcttgtag

SEQ ID NO: 204852 - DNA, 1491 bp, Artificial Sequence
  Description of Artificial Sequence: Synthetic coding sequence
atgcagcgggaccacaccatggactacaaggagagctgccccagcgtcagcattccgtcttcagacgagcacagagagaaaaaaaaaaggttcaccgtgtataaagtcctggtgtcagtcgggagatctgaatggttcgtgtttcgtcgctatgccgagtttgataagttgtacaacacgcttaaaaagcagttcccagctatggcactcaaaattcccgctaagagaatcttcggtgataactttgaccctgacttcattaagcaacgcagggccggtttgaatgaattcattcaaaatctggtccgatacccggagctatacaaccaccctgacgtgcgcgccttcctccaaatggattcccccaagcatcaatcagacccctcagaagatgaggacgagcggtcatctcagaaactgcactctacttcccagaatattaacctgggtccaagcggcaatcctcacgctaagcccacagactttgacttcctgaaggtcatcggaaaggggtcttttggcaaagtgctactggcaaagagaaagctggatggaaaattttacgcggttaaagtgctgcagaaaaaaatcgtcctgaaccgcaaagaacagaaacatatcatggccgagcggaatgtgttgctcaaaaatgtgaagcacccgttccttgtcggacttcattatagcttccaaactaccgaaaagctctattttgtcctggacttcgttaatgggggtgaactttttttccacctgcagcgtgagagaagctttccggaacaccgggctaggttctacgccgccgaaatagccagtgctctggggtacctgcattccattaagatcgtttacagagatctgaaaccagaaaacatcttattggatagtgtcggccacgtcgtgttgacggactttggactgtgcaaagaagggattgccatctctgataccacaaccacgttctgcggtacccctgagtacctggcccccgaagtaattcgaaagcagccgtatgataataccgttgattggtggtgtcttggggctgtattgtacgagatgctgtacgggttgcctcccttctattgtagagatgtggctgaaatgtatgataacattctgcataagccgctgagcctcagaccaggcgtgagcctgacagcctggtccattctcgaggaactgctggagaaggaccgtcagaacagactgggggccaaagaagattttctggagatccaaaatcacccatttttcgaaagcctttcctgggccgacctggtacagaaaaagatcccccctccattcaatcctaacgtcgccggaccagacgacattcgcaactttgacaccgccttcactgaggagacggtaccctactccgtgtgtgtatcatccgactacagtatcgtaaatgcttctgttctcgaagcggatgacgctttcgtgggcttctcctatgctcctcctagtgaagacctgttcctgtag

SEQ ID NO: 204853 - DNA, 1491 bp, Artificial Sequence
  Description of Artificial Sequence: Synthetic coding sequence
atgcagcgggaccacaccatggactacaaggagagctgccccagcgtatcaatcccttcgtcggacgagcatcgcgaaaaaaaaaaaagatttacggtttataaggtgctggtgtcagtgggccgttccgaatggttcgttttcaggcggtacgccgagttcgataaattgtataacactctgaagaagcagtttcccgccatggctctaaagattccggcaaaacgcattttcggagataattttgacccagacttcattaagcaacgcagagcaggtcttaacgagtttattcaaaatttagtgcgctacccagagctttataatcacccggatgtaagagcatttctccaaatggatagcccaaagcaccagtctgacccgtccgaggacgaagatgagcggtccagccagaagctccactctaccagtcagaatatcaatctgggaccgtctggcaatccacatgctaagcctactgacttcgacttcttgaaggttattggcaaggggagctttggcaaagtcctactggcgaagagaaagcttgatgggaaattctacgccgtgaaggtgctgcaaaaaaaaatcgtgttaaatcgcaaagagcagaagcacataatggctgaaagaaacgtcctgctcaaaaatgttaagcacccgtttctggtgggactgcactattcctttcagaccactgagaagttgtactttgtgttggattttgttaatgggggggaactttttttccatctccagagagagagaagttttcccgaacaccgagctagattttacgctgctgagatcgcctccgcgctggggtatctgcatagcattaagattgtctaccgggatctcaagcctgagaatatcttacttgactccgtgggccacgtagttttgaccgattttggtctgtgtaaagaaggaatagctatttcggataccaccacaactttttgtggcactcctgaatacctcgcgcctgaggtgatccgtaaacagccgtatgacaacaccgtagactggtggtgtctgggtgcagtgctgtacgagatgttatacggcttaccccccttctactgcagggatgtcgcagagatgtacgataacatactgcataaacccctgtctctgcgtccaggagttagcctgactgcctggtccatcctggaggaacttcttgagaaggatcgacaaaaccgcttgggggcaaaagaggatttcctcgagatacagaaccatccctttttcgagtcgctttcttgggccgatcttgtccagaagaagatcccgcctccatttaaccccaatgtggctgggcccgatgatatcagaaactttgatactgcctttaccgaggagaccgtcccctattcagtgtgtgtgtcatctgattactccattgtgaatgcttccgtgttagaggctgacgacgccttcgtaggattctcatacgctcccccgtccgaagacctctttttatag

SEQ ID NO: 204854 - DNA, 1491 bp, Artificial Sequence
  Description of Artificial Sequence: Synthetic coding sequence
atgcagcgggaccacaccatggactacaaggagagctgccccagcgtgtctatcccctcttcagacgagcaccgggagaagaagaagcggttcaccgtatacaaggtgctcgttagcgtgggacgtagcgaatggtttgtgtttcggcgatatgccgagttcgataagttatataatacactgaaaaaacagtttccagccatggctctaaaaatccccgctaaaaggatttttggggacaatttcgatccagattttattaaacagcggagggctggcctaaacgagttcatccaaaaccttgttcgctatccagagctgtataatcaccccgatgtgcgagcctttctccagatggactcccctaagcaccagagtgaccccagcgaggacgaagatgagcgctcttctcagaagctgcattcaacaagtcagaatattaacctcggcccgagcggcaacccgcacgccaaaccaactgacttcgatttcctaaaagtcattggtaagggatcatttggaaaggtgctgctggctaagcgtaagctggatggcaagttctatgctgtgaaggtgctgcaaaagaagatcgtcctgaataggaaggaacagaagcacattatggcagaaagaaacgtcctgctgaagaacgtgaaacatcccttcttagtgggtctgcactattcctttcagacaactgagaaactgtacttcgtcttagatttcgtaaatggtggtgagctgttcttccacttgcagagagagcgttcgtttcccgaacatagggctcgcttctacgctgctgaaatcgcgagtgctctgggatacctacactccatcaagatcgtctaccgagacctgaagcccgaaaatattttactggattccgtgggccacgtagttctcactgacttcggtctctgtaaggagggaatcgctatcagtgataccacaaccactttttgtggcacacccgagtacctggcacctgaagtcatcaggaaacaaccatatgacaacaccgtggactggtggtgcctcggcgctgtcctgtacgaaatgttatatggcctgccccccttctactgtcgagatgttgccgaaatgtacgacaacatccttcacaaaccgctctctttaagacctggtgtctccctgacagcctggtctattctcgaggagctgcttgagaaggatcgacagaaccgcttgggtgccaaggaggatttcctcgagattcagaatcaccccttcttcgagtcgctcagctgggccgacctggttcagaaaaaaattccaccgccctttaaccccaatgtggcaggtccagacgatataagaaatttcgacacagccttcacagaagaaaccgtgccctatagcgtgtgtgtgagcagcgattacagcatcgtgaatgcaagcgttttggaagcagatgatgctttcgtgggcttctcttatgctcccccctccgaagacctgttcctgtag

SEQ ID NO: 204855 - DNA, 1395 bp, Artificial Sequence
  Description of Artificial Sequence: Synthetic coding sequence
atgcagcgggaccacaccatggactacaaggagagctgccccagcgtgtctatccccagttcggatgagcacagggagaagaagaagaggttcacagtgtataaggtgctcgtgtcagtggggcggagtgagtggtttgtcttccggcgttacgccgaattcgataagctgtataacactctcaagaaacaatttcccgccatggcccttaagattccggctaagagaatcttcggagacaatttcgatcctgattttattaagcagcgccgtgccggccttaatgaattcatccagaatttggtccggtaccctgaactgtacaaccatcccgacgtcagagccttccttcaaatggactcgcctaaacaccagtcagacccctcggaagacgaagacgaacgtagctctcagaagctccattccacctcacagaacatcaaccttggacccagcgggaacccacacgctaagcctacagatttcgacttcctaaaagtcattgggaaggggtcgtttggaaaagtgcttctcgctaagcgcaagcttgacggcaagttttacgccgtcaaggttcttcagaaaaaaatagtccttaacaggaaggaacagaaacatatcatggccgagcgaaacgtgctcctcaagaatgtcaagcacccattcctcgtcggcctccattattcctttcagaccacagaaaagttgtattttgtgctggacttcgtcaacggcggcgagttgttttttcatctccagagggagcgcagctttcccgagcatagagcacggttttatgcggctgagattgccagcgctcttggatacttgcactctattaagatagtctacagggacttaaagcccgagaatatcctcctggactcagtagggcatgtcgtgctgactgactttgggctatgtaaggaggggatcgccatttccgatactaccacaaccttttgcgggactcccgaaccaccgttctactgtagagacgtggctgaaatgtacgacaacatccttcacaagcctctgagtctcaggccaggggtaagcctgacggcctggagcatcttggaggagctcctggaaaaagatcgccagaatcgtctcggagccaaggaagatttcctcgaaatccagaatcatccttttttcgagtcattatcatgggcggatctggttcagaaaaagatacccccgccctttaatcccaatgtcgccgggccggacgatatccgtaatttcgataccgctttcaccgaggaaacggtgccttattctgtgtgtgtgtcatctgattatagcattgtcaatgcatcggtcctggaggcagacgatgctttcgtaggattcagttacgcccctccgtctgaggatcttttcttgtag

SEQ ID NO: 204856 - DNA, 1491 bp, Artificial Sequence
  Description of Artificial Sequence: Synthetic coding sequence
atgcagcgggaccacaccatggactacaaggagagctgccccagcgtttccataccatcatccgacgagcaccgcgagaaaaaaaagcgcttcaccgtgtacaaggtgttggtctctgtgggacgctctgaatggttcgtctttcgccgttacgctgagtttgacaagctttataataccctaaaaaagcagttccccgccatggcgctcaaaattccagctaaaaggatctttggggacaattttgatcccgactttattaaacagagacgagcaggcctgaacgagtttattcaaaacctcgtcaggtaccccgagctctataaccatcctgatgtacgagccttcctgcaaatggattctcctaagcatcagtcagacccatctgaggatgaagatgaaaggagctctcaaaagctgcattctacaagtcagaacatcaacctgggtccctccggcaacccccacgccaaacctacagatttcgatttcctcaaagtaattggcaaaggatcttttgggaaagttcttctcgctaaacgaaaattagacgggaagttctacgccgtgaaggttttgcagaaaaaaattgtgctgaataggaaggagcaaaagcacatcatggccgaaagaaacgtcctcttgaaaaacgttaaacacccatttctggtcggtctccactactcattccagactacagagaaactatacttcgtgctggacttcgtgaacggaggcgaactttttttccacctgcagcgagagcgttcctttccagagcaccgcgcccggttctacgccgcagagatcgcaagcgccctgggctatttgcatagtattaagatcgtttatagggacctgaaacccgaaaacatcctgttagattctgtcggccacgtggtgctgactgattttgggctctgtaaggaagggatagcaatcagtgacactacaacaacgttttgtgggacccccgagtacctggctcccgaggtcattcgcaagcagccctacgacaatactgtagactggtggtgcctgggcgccgtgttgtatgaaatgctgtatggccttccccctttttactgccgggatgtggcggagatgtacgacaatatactgcataagccactgagtttgagaccaggcgtgtctctcaccgcgtggtccatactggaagaacttctggagaaggaccggcagaatagactgggagctaaggaggactttctggagatccagaatcatccattttttgaatcattaagttgggccgatctcgtgcagaaaaaaatacccccccccttcaacccaaacgtggccggaccagacgatattcgaaatttcgacacggccttcacagaagaaacagtgccgtactcagtgtgtgtttcatctgattattcaattgtgaatgcatctgtgctggaggcggatgacgcttttgttggattttcttacgcaccaccctccgaagacctttttctctag

SEQ ID NO: 204857 - DNA, 1491 bp, Artificial Sequence
  Description of Artificial Sequence: Synthetic coding sequence
atgcagcgggaccacaccatggactacaaggagagctgccccagcgtctcaatcccctcctccgacgagcatagggaaaagaaaaagaggtttaccgtgtacaaggtgttggtgtcagtgggcagatcggagtggtttgttttccggcggtatgctgagttcgacaaactatataataccctgaaaaagcagttccccgcaatggccctcaagatccctgcaaaaaggatcttcggcgataacttcgaccctgacttcattaagcagaggcgcgcgggcctgaatgaattcattcagaatctggtccgctatccagagctctacaatcatcccgacgtgagggcgttcttgcaaatggactcaccaaagcaccagtccgatccctctgaggacgaggatgagagatctagccagaaactccactcaacttcccaaaatattaacctgggcccatcggggaatccacatgctaaaccaaccgacttcgactttttgaaggtaattggaaaaggatcattcggtaaagtgctactcgccaagaggaagctcgatgggaagttctacgccgtaaaggtcttgcagaaaaagattgtcctgaaccggaaggagcagaagcacataatggccgagcgcaacgtgttgttaaaaaacgtgaaacacccttttctcgtgggcctgcattactcattccaaacaaccgaaaaactctacttcgtgctggacttcgttaatggcggagaactgtttttccatctccagcgtgagaggtccttcccagagcaccgcgccaggttctacgctgccgagattgcctctgccctgggctacctgcatagtattaaaattgtgtacagagatcttaagccggagaacattctgctggattccgtcggccacgtcgtccttactgacttcggactgtgcaaagaaggcatagcaatttctgacactaccaccactttctgtggaacccctgaatacctggcccctgaggtaatcaggaagcagccgtacgacaataccgtcgactggtggtgtctgggagcagttctgtacgagatgctttatggattgccgcctttttactgcagggacgtcgctgagatgtacgacaatatcctccacaagcctctaagcctccgtccaggggtgtcattaaccgcttggtcaattctggaagagcttctagaaaaagacagacagaaccggctgggggctaaggaagacttcctagagatccagaaccatccctttttcgagtccttgtcctgggctgatctggtacaaaagaaaattccaccgcctttcaacccaaatgtggccggacccgacgacattcgcaactttgatacagcctttacagaagaaaccgtcccttattctgtttgtgtgagcagcgactactcaatcgtcaacgcctcagtgctggaggctgacgatgcgtttgtggggtttagctacgccccgcctagtgaggatctatttttgtag

SEQ ID NO: 204858 - DNA, 1725 bp, Artificial Sequence
  Description of Artificial Sequence: Synthetic coding sequence
atggaggccagcctgggcatccagatggacgagcccatggccttctctcctcaacgggatcggtttcaggctgaaggctccttaaaaaagaacgagcagaacttcaaattagctggcgtcaagaaagacatcgagaagctgtatgaggccgttcctcagctgtccaatgtattcaaaatcgaggacaagatcggcgaaggaaccttctcttccgtctacctagcaaccgcccagctgcaagtggggcccgaagaaaagatcgccctaaagcatctgattcccacttcacatccgattcggatcgcagctgaattacagtgtctgaccgtggcaggcggacaggacaacgtcatgggtgtcaaatactgcttccgcaagaacgatcacgtagtgatcgctatgccttacctggaacatgagtctttcctcgacatacttaattccttgagctttcaagaggtgagagagtacatgctgaacctgttcaaagccctgaaacgcattcatcaatttggcatcgtccatcgcgatgtgaagcctagcaatttcttatataacagacggctcaagaagtatgcattggtggattttggcctcgcccaagggactcacgacacgaaaatagaactgctgaagtttgtgcagagcgaggcccaacaagaacgctgcagtcagaataaatcccacatcattaccgggaacaagattcctctcagcggccccgttcccaaggagctggaccagcagagtaccaccaaggcctctgtgaaaaggccttacaccaatgcccagatccagatcaagcagggcaaggacgggaaggaaggctccgtgggcctctccgtccagaggtcggttttcggcgagcgcaactttaatatacactcatctatctctcatgaaagccctgccgtgaaactgatgaagcagagcaagacagtggacgtcctctccaggaaactagccaccaagaaaaaggctatcagtacgaaagtcatgaattccgctgtgatgcgcaagaccgcctcgtcttgcccagctagtcttacctgtgactgttatgccacagacaaggtgtgctcaatttgcctgtctaggcggcagcaggtggccccccgggccgggaccccgggcttccgcgccccagaagtgctcacgaaatgccccaatcagacaacggccatagacatgtggtcagccggggtcatcttcctgagcctcctgtccggacggtaccccttttataaagcatccgacgatctgacagcattagcacaaattatgacaattagaggctccagggaaactattcaagccgccaagacattcgggaaaagtattctgtgctccaaggaggtccccgcacaggatctacgcaagctgtgcgaaaggcttcggggtatggactctagcaccccaaaattgactagcgatatacaggggcacgcgtcacaccagcctgccatttccgaaaagaccgatcataaagcaagctgccttgtgcagacacccccggggcaatactcaggcaattcatttaagaaaggagactccaacagctgcgaacactgctttgatgaatacaacactaacttggaaggctggaatgaagtccctgacgaagcctacgatttgttggataaattgctcgatctaaatcccgcatcaagaattaccgccgaggaggctctcctccaccccttcttcaaggatatgagcctatag

SEQ ID NO: 204859 - DNA, 1611 bp, Artificial Sequence
  Description of Artificial Sequence: Synthetic coding sequence
atggtgctggacctggacctgttccgggtggacaagggcggcgaccctgccctcatacgggagacccaggagaaaagatttaaggatcctggactcgttgaccagctggtcaaggcagattcagagtggcgtagatgccgatttagagcggataatctgaacaaactaaagaatctttgtagcaagaccattggcgaaaagatgaagaaaaaagagcctgtcggtgacgatgagagcgtgccagaaaatgtattgagcttcgatgatctgaccgccgacgccctggccaacctcaaagtcagtcagataaaaaaggttagactgctcatcgatgaggcgattctaaagtgcgatgccgaaagaattaagttggaggcagagagattcgaaaatctgagagaaattggaaacttgcttcatccgtctgtgcctatttcgaacgacgaggacgtggataataaggttgaacggatctggggggattgtacagtgagaaagaaatatagccacgtagatctggtcgtgatggttgatgggtttgaaggagaaaaaggagcagtcgtggccgggagtcggggctattttctcaaaggggtcttggtcttcctggagcaggctcttattcaatatgcattaaggaccctcgggtcgcgtggttatatcccaatttatacccctttctttatgcgaaaggaggtgatgcaggaggtggcccagctctcccagtttgacgaagaactgtataaagtgattgggaaaggctccgaaaagtccgacgacaactcctacgacgaaaagtacctaatcgccacttccgaacaaccaattgctgctctgcatagagatgaatggttgcggccagaagacctgcctattaaatatgccggactttcgacttgttttaggcaagaggtgggttcccatgggcgcgatactagaggcatctttcgtgttcatcagtttgagaaaatagagcagttcgtgtatagctcaccacacgacaacaaaagttgggagatgtttgaagaaatgattacaaccgccgaggaattctaccagtctttagggattccttatcacatcgttaatattgtttctgggagcctaaatcacgccgcgtctaagaaactagacctagaggcctggtttccaggctccggcgctttcagagagcttgtctcctgctccaactgtacggactaccaagcgcgccggttaagaatacgctatggtcagacgaaaaagatgatggacaagaggaagaacaacctgcatcttagtactcaaaacaaacttgaagccagcctgttttctccaaagaaggtggagttcgttcatatgctgaacgccacaatgtgtgcaactacacggactatctgcgcaattctggagaactatcagactgagaaaggaatcacagtcccagagaagttgaaagagtttatgcccccgggccttcaggaactcattccttttgttaagcccgctcctatcgaacaagaacccagcaagaagcaaaaaaagcaacacgagggcagcaagaaaaaagccgcagccagggatgtcactctagagaatagactgcagaatatggaggtgacggatgcatag

SEQ ID NO: 204860 - DNA, 1563 bp, Artificial Sequence
  Description of Artificial Sequence: Synthetic coding sequence
atggccgccagcatggcccggcggctgtggcccctgctgacccggagagggtttcgcccgaggggaggctgtatatcgaatgactcaccacgaaggtcgttcaccactgaaaaacggaacaggaatcttctgtacgaatatgcgagagaagggtactccgccctcccgcagctggacattgagcggttctgcgcttgtcctgaagaagctgcccacgcccttgaactgcgaaaaggcgagttgcgcagcgccgatctccccgcgattatcagcacctggcaagagctccgtcagctacaggaacaaatccgctcactggaggaggagaaagcagcagtcaccgaagctgtgagggctttgctcgcaaatcaggactccggggaggtacagcaagtacgcctagatcccggggcaggtagcatcttcggacctacatttttgccctttcccggacagctgtccttgttagttgaggcccagctggaggaacaattctatcttcaggcactcaagctgcctaatcagacacacccagacgttcctgtgggagacgagtcccaggccagagtacttcatatggtgggcgacaagcctgttttctcatttcagccccggggacaccttgaaatcggagaaaagctcgacataatcaggcagaagagacttagtcacgtgagtggacataggtcatactatctgcgaggagctggcgctctcctccagcacggcctcgtcaacttcacattcaacaaactcctaaggcggggcttcacaccgatgaccgtgcctgacctgctgagaggcgcggtgttcgaaggttgtggaatgacccccaatgccaacccgtcccagatctacaatattgacccagctagattcaaggacctaaacctcgctgggaccgcagaggtaggcttggccgggtactttatggaccacaccgtggcatttcgggacttacctgtaaggatggtctgctcctcaacctgctaccgtgccgaaaccaatacaggacaggaacctagaggcctttacagagtgcatcacttcactaaagtggagatgtttggagtcacgggacctggattggaacagagctcacagttgctggaggagttcttgtccctccagatggagatcttgacagagcttggcctccactttagggtactggacatgccaacgcaggagctgggactccctgcctacaggaaattcgacatagaggcctggatgccaggacgaggtcgctttggtgaggtgacgagcgcaagcaattgtacagacttccagtcacggagacttcacatcatgtttcaaaccgaggccggcgaattacaatttgcccatacagtgaatgcaaccgcttgcgctgttccccgcctgctgattgcattgctggagtccaaccagcagaaggacggctctgttctggtgccacctgccctccagtcctacctgggcacagatcgcatcacagcacctacacatgtccctttgcagtatatagggcctaaccaaccaagaaagcctggcttgccaggacaacccgcggtatcctag

SEQ ID NO: 204861 - DNA, 426 bp, Artificial Sequence
  Description of Artificial Sequence: Synthetic coding sequence
atggagatgctgcagggcctgctgctgctgctgctgctgagcatgggtggagcatgggccagtcgcgagccgcttcgtccatggtgccatcctattaacgcgattctggctgtggaaaaggaggggtgtcctgtttgtatcacggtaaatacgacgatctgcgcagggtactgccccacgatgatgagggtgttgcaggcagtgttgcctccactcccacaggttgtgtgtacatatagggacgttaggttcgagtctatcaggctgccgggatgcccacggggcgttgacccagtcgtctcatttcctgttgccttaagttgtcggtgcggcccatgtagaaggtcaactagtgactgcggcggtcctaaggaccatccccttacttgcgaccacccgcagctaagtgggttactgtttctctag

SEQ ID NO: 204862 - DNA, 837 bp, Artificial Sequence
  Description of Artificial Sequence: Synthetic coding sequence
atgggcgcccggctgagccggcggcggctgcccgccgaccccagcctggcccttgatgctttacctcctgaactgttagtgcaggtactgtctcacgtccccccacgtagcctggtcacaaggtgtcggcctgtgtgcagggcctggcgggacatcgtcgacgggcctacagtgtggcttctgcagttggcccgtgatcgctccgccgagggaagagccctgtatgctgtggcccaaaggtgtctcccctccaatgaggacaaagaagagttccctctgtgtgccctggctcgctattgtttacgagcacccttcgggcggaatctcatctttaattcctgtggcgagcagggctttaggggttgggaggtagaacacggcggcaatggttgggcgatagaaaaaaacttgactcccgtgcccggggccccgagccagacctgttttgttacgtcgttcgagtggtgctctaagcgtcaactggtagatctggtgatggaaggggtctggcaggaactcctggatagcgcccaaattgaaatttgtgttgccgactggtggggtgcgagggaaaattgcggctgcgtgtatcagctcagggtgaggttgctggatgtgtatgaaaaggaagtggtcaagttcagtgcatcccctgatcccgtgcttcagtggacagagcgcggctgccgtcaggtgtcccacgtgtttactaacttcggcaagggcatcaggtatgtgtcattcgagcaatatggcagggacgtgagtagttgggtggggcactatggagctctagtgactcactcatcagtccgcgtgcgtatcaggctgagttag

SEQ ID NO: 204863 - DNA, 864 bp, Artificial Sequence
  Description of Artificial Sequence: Synthetic coding sequence
ttcaagcagggcctgtggctgctggagatgggcgcccggctgagcaggcggcggctacccgccgatccttcattagcactggacgccctgccccccgagttactcgtacaagtgctgtctcacgtgcccccccggagtctggtcacacggtgccgacctgtgtgcagagcctggagagacatcgtggatggcccgactgtctggctgctgcaattggcccgcgatcgttcagctgagggcagagcactgtatgcagtggcgcaaaggtgcctacccagtaacgaggacaaggaggagttccctctatgtgcactggcccggtattgtctgagggcccccttcggacgcaacctaatcttcaattcttgcggggagcagggcttccgtggttgggaggtagagcatggtgggaatggctgggccatcgaaaaaaatttgactccggtgcccggggccccatcgcagacgtgcttcgttacttctttcgagtggtgttccaagaggcaactggtggacctagtgatggaaggagtttggcaggagcttttagactccgcgcaaatagagatctgtgtggcggactggtggggcgctcgagaaaattgcggctgcgtctaccagctgagggtacgcttgctggatgtctacgagaaagaggtagtgaagttctccgccagtcccgatcccgtgctgcagtggactgagcggggatgtcggcaggtatcccacgtgtttactaactttggtaaaggaatcagatatgtgagtttcgaacagtacggtcgagacgtctccagctgggtgggacactacggagccttagttacgcacagttctgtgagagtgcgtattcggctgtcatag

SEQ ID NO: 204864 - DNA, 1563 bp, Artificial Sequence
  Description of Artificial Sequence: Synthetic coding sequence
atggccgccagcatggcccggcggctgtggcccctgctgacccggcgggggttcaggcctcggggaggctgcatttccaacgacagcccccggcgctcattcacgaccgagaaacgaaatcgcaatcttctatacgagtacgcgcgggaggggtactccgctctcccgcagctagacatcgagcggttctgcgcctgtcccgaggaggctgctcatgccctcgagctcagaaaaggagagctacggtccgccgatctgccggcaatcattagtacatggcaagaactaaggcagctccaggaacagattagatctttggaggaagaaaaggcagccgtgacagaagccgttagagccctgctcgcaaaccaggattccggcgaagtgcagcaggtcagattggatcctggcgcaggaagtatttttggcccaaccttcctccccttccctgggcagttgagtctgctcgtggaagctcagctggaagagcagttttacctgcaggccttgaaactccctaatcagacacacccagatgtgccagtaggtgacgagtcacaggctagagtgcttcatatggtaggcgataaacctgtcttctccttccaacccagaggtcatttggagattggcgaaaagctcgacatcatccggcaaaaaaggcttagccatgtgtctggtcacagatcatattacctccgcggggccggagctctcttacagcacggactggtgaactttacgtttaataagttgttgcgcaggggcttcactccgatgaccgtacctgatctccttcggggtgccgtgttcgaaggctgcgggatgacgcccaatgcaaatccaagccagatctataacatagatcccgcccgctttaaggacctgaatttggcaggtactgctgaggtgggattagcagggtatttcatggatcatacagtcgctttccgtgacctgccagtgagaatggtctgctcctctacctgctacagagccgagaccaataccggtcaggaaccacgcgggttatatagggtccatcacttcaccaaggtggaaatgtttggagtgactgggccaggattggagcagtcaagtcagctgctggaggaattcctgtcattgcaaatggaaattctaacagaactgggcctccattttagggtgctggacatgcccacacaggagctcggtctaccagcttatcggaagttcgatatcgaggcatggatgccaggacggggcaggtttggagaggttacctcagctagcaattgcactgacttccagtctaggcgacttcatatcatgttccagactgaagccggcgaactccagtttgcacacacagttaatgcaaccgcttgcgcagtccctaggttactgattgctttgttagaatctaaccagcagaaggacggaagtgtgctggtgcctccagccttgcaatcatatctgggaacagatagaatcaccgcccctactcacgtgcctcttcagtacatcggccccaaccaaccccgaaaacccggactgcctggacagcctgccgtgagctag

SEQ ID NO: 204865 - DNA, 1557 bp, Artificial Sequence
  Description of Artificial Sequence: Synthetic coding sequence
atggagggcgtgtggcaggagctgctggacagcgcccagatcgagatttgcgttgcagattggtggggagctcgcgagaattgcgggtgcgtgtatcagctccgcgtgagactgttagatgtttacgaaaaggaagtcgtaaagttttcggcctctcccgatcctgtgctgcaatggacagagcggggctgtcggcaggtgagtcacgtttttaccaatttcgggaagggaattaggtacgtgtcatttgagcaatatggaagggacatctctacctggcaggaactccggcagctgcaagaacagatccggtccctagaagaggagaaggcagctgttactgaggcggtgagggcactcctggctaatcaggactcgggagaggttcagcaggaccccaagtaccaaggcctgcgcgctaggggcagagaaattcggaaggaactggtgcatctgtatcccagggaggcacagttagaagaacagttctacctccaggccctaaagctgcctaatcagacacaccccgacgtcccggtcggcgacgaatcgcaggctagggtcctgcacatggtcggggacaaaccagtattttcttttcaacccaggggccatttagagattggggagaagttggacatcattagacagaagcgtttgtcacatgtgtccggccacagatcttactatttgagaggagctggggcacttctgcagcatggtttagtgaattttacttttaacaagctgttacgccggggcttcaccccaatgacagtgccggaccttctgcgtggagcagttttcgaagggtgcgggatgacgcccaacgcgaacccatcccagatctacaatatagatccagcacgcttcaaagacctcaacctggctggaaccgccgaggtgggactggccggctactttatggaccatactgtggccttccgagatcttccagttcgaatggtatgcagcagcacatgttaccgggccgaaaccaatactggccaggaaccccgcggcctgtaccgtgtgcaccatttcaccaaagtagagatgttcggggttactggcccagggctcgaacaatcctctcagctattggaagagttcctctccctgcagatggagatattgactgagctcggattgcacttcagagtcttagacatgcccacccaggagctcggtctgcccgcgtatcgtaaattcgacatagaggcctggatgccgggacgtggaagatttggggaggttacatcagctagcaattgtaccgactttcaatcccggaggcttcacatcatgtttcagaccgaggctggcgaactgcagtttgcccatacagtgaacgctactgcgtgtgccgtgccccggctgctaattgcccttctagagtccaaccagcagaaagacggaagtgtcctcgtgcctcccgccttgcaaagctacctgggcactgaccgaattacggctcccacacacgtgccacttcagtatatcgggcctaaccagccccgtaaacccggcctgcctggccaacccgccgtgtcatag

SEQ ID NO: 204866 - DNA, 711 bp, Artificial Sequence
  Description of Artificial Sequence: Synthetic coding sequence
atggccgccagcatggcccggcggctgtggcccctgctgacccggagaggattccggcctcgaggaggatgcatctcaaacgactctccgagacgcagcttcaccactgagaaacgcaacaggaatttgctgtacgagtacgcccgagagggatactctgcgcttccccagctcgatatcgaaagattttgtgcctgccctgaggaggccgcccatgctttagagcttaggaaaggagagctaagatcagctgacctgcccgcgatcattagcacctggcaagagcttcgtcaactgcaagagcagattagatctctggaggaggagaaggccgccgtgacagaggccgtgagggccctgctggccaaccaagacagcggagaggtacagcaggatcccaagtaccaaggtctcagggcccgcggccgggagatcagaaaagaactcgtacatctataccctcgggaggcgcagcttgaggaacagttctatctccaggccctgaagttgcccaatcaaacacatccagacgtgcctgttggagacgagagtcaggcgcgagtgctgcacatggttggggataagcctggggcatgcccgacctgtctggccacaggtccaattacctgcgccggtctggaaccctcctgtagcaccgcatggtccacatcacacagcaccagcttttctgcaggagcaagccccccctag

SEQ ID NO: 204867 - DNA, 1281 bp, Artificial Sequence
  Description of Artificial Sequence: Synthetic coding sequence
atgcacgccctgttcgccgacagcttcgccgccctgggccggctggacaacattaccctcgtcatggtgtttcatccacaatacctcgagagcttcctaaaaactcagcactatctccttcaaatggatgggcccctcccactgcattaccggcactatattgggataatggctgccgcacgacatcagtgtagctatctggtcaacctgcacgttaatgatttcctgcacgtggggggtgatccaaagtggctgaacggtctcgagaacgcaccacaaaagcttcagaatctcggcgagctaaacaaagtcttggcccaccgtccatggcttatcaccaaggaacacattgagggattactaaaggcggaggagcactcttggagcctcgccgagctggtccacgccgtcgttttgctgactcattatcatagcctggcatctttcactttcgggtgcggaatctccccggaaattcactgtgacggggggcacacctttcggcccccgtcagtgtcaaactattgcatttgtgacattaccaatggcaaccattcagtcgatgagatgccagtcaattctgctgagaatgtgtctgtcagcgatagctttttcgaagtggaggctctcatggaaaaaatgaggcagctccaggagtgtcgcgatgaagaggaggccagccaggaagaaatggcttctcgattcgagatcgaaaaacgtgagtctatgtttgtcttcagtagcgatgacgaggaagtaactcccgcccgcgcagtctcccggcacttcgaggacacatcctatggatacaaagacttttctcgtcacgggatgcacgtacctactttccgcgtgcaggactattgttgggaggaccacggttatagcctggtgaatagactctatccggacgtgggacagctgatcgacgagaagtttcacatcgcctacaacctgacctacaatacaatggccatgcacaaagatgtagatacatcgatgcttcggagagctatctggaattatatccactgtatgtttgggattagatatgacgattatgattatggagagattaatcagctgctggacagatctttcaaggtgtatatcaaaacggtggtatgtactcccgagaaagtgaccaaacgcatgtacgactccttttggcgtcagtttaagcattctgaaaaggtgcacgtgaatctcctattgattgaagcacgcatgcaagcagaactactttacgcactgcgcgcaatcacccggtatatgacatag

SEQ ID NO: 204868 - DNA, 1479 bp, Artificial Sequence
  Description of Artificial Sequence: Synthetic coding sequence
atgcggctggccgccgccgccaacgaggcctacaccgcccccctggctgtcagcggactcctgggctgcaagcaatgtggaggaggccgggaccaagacgaggaactggggatccggattccccgcccactcggacagggcccctcacgtttcatccctgaaaaagagatcttacaggtagggagcgaggatgcacagatgcatgctctgtttgctgacagttttgcggccctcggtcgcttggacaacatcaccctggtgatggtatttcacccacagtacttggaatcttttcttaagacccagcattatctgctgcagatggatggcccacttcccttacattatcgccactatataggcattatggccgcagccaggcatcagtgctcatacctcgtgaatttgcacgtgaacgatttcctccacgttgggggcgatcccaagtggctaaacgggctcgaaaacgctccccagaagcttcagaacctaggagagctaaataaggtattagcccatagaccctggttgatcacaaaggagcatattgagggcctcctaaaagctgaagagcactcgtggtcactggctgaactagtacatgccgtcgtactcctcacacactatcacagtctggcaagcttcacatttggatgtggtatctccccagagatccattgtgacggcggtcacacatttcggcctccatcagtatccaactattgtatttgcgatatcaccaatggtaatcattcagtggacgagatgcccgtcaatagcgctgagaatgtatcagtgagcgacagtttctttgaagtggaggctctaatggaaaaaatgagacaactgcaggagtgccgcgacgaagaggaggccagtcaggaagagatggcctctagattcgaaattgagaaacgggagagcatgttcgtgttcagcagcgacgacgaagaagtgacccccgctcgagccgtgagccggcacttcgaagacacctcctatggctacaaagacttcagccggcatggtatgcatgtacccacattccgcgtacaggattactgttgggaggatcatggatatagccttgtaaacaggctgtacccagatgtggggcaattgattgacgagaaatttcacatcgcctataatctcacttacaatactatggccatgcacaaggacgtggacacaagtatgctgaggcgcgccatatggaattatatccactgcatgtttggtatacggtatgacgactacgattacggtgagattaaccaacttttggaccgctcatttaaagtgtacattaaaaccgtagtttgtacacctgagaaagttacgaagcgtatgtacgactccttttggcggcaattcaagcacagcgagaaggttcacgtcaatttgctgctgattgaggcccgcatgcaagccgagctcctctatgccctgagagccattacccggtacatgacctag

SEQ ID NO: 204869 - DNA, 1656 bp, Artificial Sequence
  Description of Artificial Sequence: Synthetic coding sequence
atggccgagggcgagaacgaggtgcggtgggacggcctgtgcagccgggatagtacaactcgggagaccgctctcgaaaacatccgccaaaccatcctccgtaaaacggaatatctcaggtccgtcaaggagaccccgcatcgccccagtgacggcctgtccaataccgaatcatcggacgggctgaacaagttactggcccacctccttatgctgtccaagcgctgtccctttaaagatgtccgtgaaaagtcagagttcatcctcaagagtatacaagagttaggtatacgcatcccaaggcctttaggccagggtccatctcgcttcattcccgagaaagagatcctgcaagtgggttccgaggatgcccagatgcatgctctgtttgccgatagtttcgccgctttgggtaggttggacaacatcacgctcgtgatggtattccacccacagtacctggagtctttcctgaaaacacagcattatttgctacagatggacggtccattgcctttacactatcggcactacataggcatcatggctgccgcacggcatcagtgcagctacctggttaacctgcatgtgaacgactttctacacgtggggggggacccaaaatggctgaatggactcgagaatgccccccaaaaacttcaaaacctcggggaactcaacaaagttctcgctcacaggccatggctgatcaccaaagaacacatagaagggctattgaaggccgaggagcatagttggtccctcgccgagctcgtgcacgcagtggtcctactcacacactatcatagcctggcctcgtttacctttgggtgtggtatttcaccagagattcattgcgacggaggacatacctttaggcctccttctgtgtctaattactgcatctgtgacattaccaatggtaatcacagcgttgacgaaatgcctgtcaactccgcagagaacgtgagtgtttcagattccttctttgaagttgaagctcttatggaaaagatgcggcagctacaggaatgtcgcgacgaagaagaagccagtcaggaagaaatggcatctcgctttgagattgagaagcgcgagagcatgtttgtgttcagctcagacgacgaagaggtcaccccagcacgggccgtatcccggcattttgaagataccagctatggttacaaggattttagcaggcacggcatgcatgtgcccactttccgggtgcaggattattgttgggaggatcatggctactccctggttaaccggctgtacccggacgtgggtcaactgattgatgaaaaatttcatatcgcttacaatctcacttacaacacaatggcaatgcataaagacgttgatacctccatgcttagaagggccatctggaattacatccattgtatgtttggaatccggtatgatgactacgattacggcgaaatcaatcagctcttggatcgttctttcaaggtttatattaagactgtggtttgtacgcccgaaaaggtgacaaagcgtatgtacgattcattctggcgtcagttcaagcactcagagaaagtgcatgtgaatcttctcctgatagaggcccgcatgcaggcggagcttctctatgcgttgcgggcgataacgagatacatgacctag

SEQ ID NO: 204870 - DNA, 1302 bp, Artificial Sequence
  Description of Artificial Sequence: Synthetic coding sequence
atgcgggccgagggcctgggcggcctggagcggttctgcagccccggcaagggtagaggtttgagggctctgcagccgttccaggtcggggatttactgttttcttgtccggcatacgcttatgttctgacagtcaacgaacgcggcaatcactgcgagtactgcttcaccaggaaagagggtttgtcaaagtgtggcagatgtaagcaggctttttattgcaacgtcgaatgccagaaggaagattggcccatgcataagcttgaatgcagcccaatggtggtgtttggggagaattggaatccctctgaaacagtgcgccttacagctcgcatactagccaaacaaaagatccatcctgaaagaaccccctctgaaaagctgttggctgtcaaagaatttgagagtcacctggataagctggacaatgaaaaaaaggacctgatccaaagcgacatcgcggctcttcatcacttttactcaaaacacctcggattcccagacaatgattctttggtggttctgttcgcccaagtgaactgcaacggatttaccatcgaagatgaggagctgagccacttagggtctgcgatttttcccgacgtagccctgatgaatcactcctgttgccccaacgtgatcgtgacatacaaggggaccctcgccgaagtgagagcagttcaggagatcaagccgggcgaggaggtgtttacttcttacatcgaccttctgtacccaacagaagacagaaacgatcggctgcgggacagctacttctttacatgtgagtgtcaggaatgcaccacaaaagataaggataaggccaaggtcgagataagaaagctttctgacccccccaaagcagaggccatcagggatatggtgcgctacgctaggaacgtcatcgaagagttccggcgggccaagcactataaatccccttcagagttactggagatatgtgagttgtcacaggagaagatgtcatccgtgttcgaggactctaacgtctatatgctccatatgatgtatcaggcaatgggggtctgtctgtacatgcaagactgggaaggtgcgttgcagtacgggcagaaaattatcaaaccatacagtaagcactaccccctgtattcactaaatgtggcctctatgtggctgaaactgggacgcctgtacatgggccttgaacacaaggctgctggggaaaaagctctgaaaaaggccatagctattatggaagtggcccatggcaaggatcacccgtacattagtgagattaaacaagaaatcgagtcgcactag

SEQ ID NO: 204871 - DNA, 819 bp, Artificial Sequence
  Description of Artificial Sequence: Synthetic coding sequence
atgcgggccgagggcctgggcggcctggagcggttctgcagccccggcaaaggcaggggactgagagcgctacagccctttcaggtcggcgatctcttgttctcgtgccctgcctatgcatatgtgttaacagttaatgaaaggggtaaccactgtgaatactgttttactcgcaaagaagggctctcaaagtgtggcaggtgtaaacaggcattttattgcaacgtcgaatgccagaaggaggattggccaatgcacaaacttgaatgcagtccgatggttgttttcggcgaaaattggaacccctcagagactgtcaggttgactgctcgcatcctggccaagcagaaaattcaccccgagcgtactcccagcgaaaaactgctcgcggtgaaggaattcgagtcccacctggataagcttgataacgagaaaaaggatctgatccaatctgatattgccgctctccatcacttctacagcaaacacctaggattcccagataacgactccttggttgttttgtttgctcaggtgaactgtaacggcttcactatagaggatgaagagttgtctcaccttgggtcagccatcttccccgatgtggcgctgatgaaccacagttgttgtcccaacgtgatagtcacctataagggcactctggccgaggttagagccgtgcaggagatcaagccgggtgaggaagtgtttacctcttacatagatctcctatatcctacggaggataggaacgaccgactgcgggattcttactttttcacgtgtgaatgccaggaatgtactactaaggacaagtag

SEQ ID NO: 204872 - DNA, 5712 bp, Artificial Sequence
  Description of Artificial Sequence: Synthetic coding sequence
atggccgccggcacctgggccgccgccgccgccgccgccgccgccgactacttcgtgcttgtcgctttcgggcctcatccacgtggatctggcgagggccaaggacagatcctgcagcgcttccccgagaaagactgggaggataacccatttccccagggcattgagcttttctgccaacccagcgggtggcagctgtgcccagaacgcaatccgcccacctttttcgtcgccgtcttaactgatataaattccgagcgccactactgcgcctgtctcaccttctgggagcctgccgaaccctcacaggagaccacacgagtcgaagatgccaccgagcgggaagaggagggagacgagggcggacagacccacttatctcctacggcccccgcaccctcagcacagctgtttgcgccaaagactctggtgttggtttcaagacttgatcacacagaggtgttcaggaattcgctcgggctcatctacgccatccatgtagaagggttgaatgtgtgtctggagaacgtgatcggcaacctactcacttgtacagtgcccctggctggcgggtcccagaggactatctctctgggagctggcgatcgccaagttattcagacgccgttggcagacagtttgccagtgagcagatgctccgttgcactcctgttccgacagctgggcattaccaacgttctgagcttgttctgtgccgctctaactgaacataaggtcctgtttttgagtcgcagttaccagcgcctggcagacgcatgcagggggttgttggctctcttattcccactacgatattcttttacctatgtgcccatcttacctgcccagctgttggaggtactctccactcccacccccttcataatcggggtgaacgcagccttccaggcagagacacaggagctgctggacgttatcgtagctgatctcgacggaggaaccgtgactattcctgaatgcgtacacatccccccattgcccgaaccactgcaatcacaaacacatagcgtcctttcgatggtgctcgatccagagctagaactagcggatctggcgttcccacccccgactacatcaaccagtagtctgaaaatgcaggacaaagagctgcgggcagtcttcctgcggctgtttgctcagctcttacagggatacagatggtgtttgcatgtggtaagaattcaccctgaaccagtgatccggttccataaggcagctttcctaggccaacgcggtttggtcgaggatgatttcctgatgaaggtgctggagggtatggcatttgcaggtttcgttagtgagaggggggtgccataccgtcccaccgatttgtttgatgagttggtggcgcacgaggtggccaggatgcgtgccgacgaaaatcatccacagagggtgctgagacatgttcaggaactggcagagcagctgtacaagaatgagaacccgtacccagcagtcgccatgcataaggtacaacgacctggggagtccagccacctgaggcgggtgcccaggccatttcctaggctggatgaggggacagtgcaatggatcgtcgatcaggctgctgccaaaatgcaaggcgcacctccggcggtaaaggcagaacggcgaactaccgtcccgagcggaccaccaatgactgcaatcctggaaaggtgctctggattgcacgtcaactccgcccgacggctggaggtcgtgcggaattgtatatcttatgtatttgaaggcaagatgctggaggccaaaaagttgctccctgcagtgttaagggctctcaagggcagagccgccaggcgctgcctggcgcaagagctacacctacatgtgcagcagaaccgtgctgtgctcgaccaccaacagttcgactttgtggtgcggatgatgaactgctgcctgcaagactgcacctctctcgacgagcatggtatcgcggccgccttactcccgctggttaccgccttttgccgtaagctcagcccaggcgtaacccagttcgcctactcctgcgtgcaggaacacgtggtctggagtactccacagttttgggaggctatgttctacggtgacgtccaaactcatattagggctttgtacctggagcccaccgaagatctcgcaccggctcaggaggtgggcgaagcaccttcccaggaagacgaacggtccgctctcgacgtggccagcgagcaacgcaggttatggcctacactttcccgcgaaaagcagcaggagctggtacaaaaggaagagagtactgtattctcccaggccatccactacgccaaccggatgagttacctgcttctgccactcgactcttcaaagtccagactactgcgagaaagagccgggttgggcgatctggagagtgccagcaactcattggttacaaattctatggcaggctcagtcgcggaatcgtatgataccgaatccggttttgaagacgcagagacatgcgatgtggcaggtgccgtcgtgagatttatcaataggtttgttgataaggtttgtaccgaaagtggcgtgacctcggatcacctcaaagggctgcatgttatggttcccgacatcgtgcagatgcacattgaaacactagaggcagtccagagggagtccagaaggctcccacctattcagaaaccaaagcttctccgacccaggctgctgccaggggaagagtgtgtgttggacggcctccgggtatacttactccctgatggtagagaggaaggagctggtgggtcggcaggggggccggccctgttgccagcggagggcgctgtgttcttgaccacttaccgagtgattttcactggtatgcccacagatccactggtcggggagcaggtcgtcgttcgatcctttcctgtggccgcactcacaaaggagaagcggataagcgtccagactccagtggatcagctgcttcaggatggactgcagcttagatcttgtacatttcagcttctgaagatggctttcgacgaagaggtgggcagcgattctgctgaactgttcagaaagcagttgcacaaactccgctacccaccagatattcgagcaacatttgcattcacgctgggatccgcacacacgccagggcggcctccaagagtgacgaaggataaaggcccaagtctccggactttatctaggaacctggtcaaaaatgcaaaaaaaaccatcggaagacagcatgtgacgcggaagaagtacaacccgcccagttgggagcatcgggggcagccccccccagaggaccaggaagatgaaatttctgtgagtgaggagctcgagccaagcaccttaacgccttcatcagcgttgaagccatcagataggatgacaatgagcagcctggtcgagagggcatgttgcagagactaccagcggctgggacttgggaccctgagcagctccctgagccgagcaaagtcagagccatttcggataagccccgtgaaccgaatgtacgctatctgtcggagttatccagggttgctgatagtgccgcagagcgtgcaggataacgccctgcagagagtttcgaggtgttatcggcaaaatcggttcccagtagtctgttggagatccggccgttccaaagcagtgctgttgcgcagtggagggttacacggaaaaggggtggtcgggctgttcaaggcgcagaacgccccaagcccgggacaaagtcaggcagattcatcttcactggaacaggaaaagtatttacaagcggtagtatcatctatgcccagatacgctgatgccagcggccggaacacactatccggtttctcttcggcccacatgggatcccacgtcccaagccccagagcaagggtgaccaccctgtccaatcccatggctgcctcagcttccaggcgaactgccccacgggggaagtggggcagcgtgcggacctcagggagaagttccgggctgggaaccgacgtgggatctagactggccggcagggacgcccttgcacccccacaggctaatggtggacccccagacccggggttcttgcgacctcagcgggcagcactgtatatcttgggggacaaggcccagcttaagggcgtccgcagcgatcctctccagcagtgggagctcgtgcccattgaggtgttcgaggcccggcaggtaaaagcgagcttcaaaaaactgctcaaggcatgcgtgcccggctgccctgccgccgaacccagccccgcctccttcctccgatcactggaggatagcgaatggctgatacagattcacaagttactgcaagtctctgttttggtagttgagctactggactcaggctcttctgtcctagtaggcctagaggacggctgggacatcactactcaagttgtttcactggtccagcttctgagcgatccattctatcggacacttgagggtttccgcctcctagtggagaaggagtggctgagctttggtcatcgcttctcccaccgaggggctcatacactcgccggacagagctctggcttcacacctgtgtttctgcaatttttggactgtgtacatcaggttcatctccagttccctatggagttcgaattctctcagttttatctaaagtttctgggataccaccatgtcagtcggagattccgcacttttctgctagacagcgactacgagcggatagaactgggcctattatacgaggaaaagggcgaaagacgaggtcaggtgccatgtcgatccgtttgggagtacgtggatagactttccaagagaacacccgtgttccataattacatgtacgcccctgaggacgccgaggtgctgaggccctacagtaacgtatcaaacctcaaagtgtgggatttctatacagaggaaacgctcgccgaaggtcccccatacgattgggaactggcgcagggtcccccggagccacccgaggaggagcgctctgatggtggcgcccctcagagtaggagaagggtggtgtggccttgctacgactcgtgtcccagggcccaacctgatgccatatcaagactcctggaagagctccagagactggagacagagctgggccagcccgctgagcgttggaaggatacctgggaccgagtcaaggcggcccagcggcttgagggaagaccggacggccgcggcacaccctcttctctccttgtctcgacagcaccccaccaccggcgctctctaggagtataccttcaggagggccccgttgggtctacattatccctttccctggactccgaccagtcatccgggagcaccacatcagggtcacggcaggctgcaaggcgatcaacctcaaccctgtatagccagtttcagactgcagaaagtgagaaccggagctacgaagggaccctttataagaagggcgctttcatgaaaccttggaaagcccggtggtttgtgctagacaagacaaagcatcagctgcgctactatgatcaccgagtagatacggagtgcaagggggtcattgatcttgcagaggtggaagcagtggctccaggcactccgacgatgggcgctcctaagactgtcgacgagaaggcctttttcgatgttaagaccacccgtcgcgtgtacaatttctgtgcccaggatgtaccgagtgcccaacagtgggtggataggattcagagttgcctgtcagatgcatag

SEQ ID NO: 204873 - DNA, 2697 bp, Artificial Sequence
  Description of Artificial Sequence: Synthetic coding sequence
atggccgccggcacctgggccgccgccgccgccgccgccgccgccgattactttgttctggttgccttcgggccacacccacgggggagcggcgaggggcaggggcagatcctgcagcgcttcccagaaaaagactgggaggataacccatttccccagggtattgaactgttttgtcagccttccggctggcagctgtgcccggagcgaaatccccctactttctttgtggctgtcttgacagatatcaacagcgagaggcactactgtgcctgcctgaccttctgggagccggccgagccctcccagcaggaaactacacgcgtcgaggacgcaacagaaagggaagaagagggggatgaaggcggacagactcacttaagcccaaccgcgccggccccctctgcccaactgtttgcgccaaaaactctggtgttagtcagccgacttgaccataccgaggtgtttcggaattccctcggactcatttatgcaatccatgtggaagggttgaatgtctgccttgagaatgtcattggcaacctgttgacgtgcactgttcctttggcaggcggctcacagcggaccatttcactcggggccggagatcgccaagttatccagacccccctggcagattcgctccctgtctcccggtgttctgtagccttgctgtttaggcaattggggatcacaaatgtcctgtctttgttctgtgcagctctgacggaacacaaggtgctgttcttaagccggtcataccagagactggctgatgcctgtaggggcttgctggctcttctgttcccgttgagatattcctttacttacgttcccatactgcccgctcagctccttgaggtcctgagcacacccacgccttttataataggagtgaatgctgccttccaggcagagactcaagaactgttagacgtgattgttgcagacttagatggtggcacagttacaatcccagagtgcgtgcacatccctcccctgcctgaaccgctccaaagccaaacacacagcgtcctcagcatggtgctggacccagaattagagctggctgatttggcttttccgcctccaacaacctccacttcctcactcaagatgcaggataaggagctcagagctgtcttcttgcgcctgttcgcacaattgttgcagggataccggtggtgcctacatgtggtgcgaatacacccagaacccgtcattagattccacaaggccgcttttctcggacagcgcggtctcgttgaagacgatttcctgatgaaggttctggaaggtatggctttcgccgggttcgtgagcgagagaggggtgccctatcggccgactgatctcttcgatgagttggtagcacatgaggtggctaggatgagagccgacgaaaatcatccccagcgagtgttacggcatgttcaggagctcgccgagcagctctacaagaacgagaacccttaccctgcagtcgccatgcacaaggtgcagagacctggcgagagcagccacctgaggcgtgtgcccaggccattccctaggctggacgagggaactgtgcagtggattgtcgatcaggctgccgccaagatgcaaggtgctccacccgccgtgaaggcagagcggcgtactacagtcccatctgggcctccaatgacagccatcctggaacggtgctctggcttacacgtgaacagcgccaggcggcttgaggttgtgcggaactgcatttcttatgtcttcgagggcaagatgctcgaggcgaagaaactgctgcctgccgtccttcgcgcactgaaaggacgagccgctaggaggtgtctggctcaggagctgcacttgcatgtgcaacagaatcgggcggtgcttgaccatcagcaattcgacttcgtagtcaggatgatgaattgctgtctgcaggactgcacgtctctggacgaacacggcattgctgcagccctgttacctctggtaacagccttttgccggaaattgtcacctggcgtcacccagtttgcatatagttgtgtccaggaacacgtcgtgtggagcacccctcaattctgggaggccatgttctatggagacgtgcaaactcacatacgcgctctatacctcgaaccaacagaggacctcgcgcctgcccaggaggttggagaagctccgagtcaggaggatgaaaggtccgcgctggatgtcgcctcagaacaacggcgcttgtggcctacccttagccgggaaaagcaacaggagctggtacagaaggaggaatcgaccgtcttctcacaggcaattcactacgcaaaccggatgagttacctgctcctacctctggactcatccaagtccagactgcttcgggaacgtgccgggctgggggacctggagagcgcatccaatagtcttgttactaacagcatggccggcagtgtagcggagtcatatgataccgagtccggcttcgaggatgctgagacctgtgatgtcgctggcgcagttgtcaggttcataaaccgtttcgtggataaggtctgcacagagagcggagtgacatcagaccacttaaaggggctacacgtgatggtgcccgatatcgttcagatgcacattgaaactctggaagccgttcagagagagagcaggagactgcccccaatacagaagccaaagctcctgcgaccttag

SEQ ID NO: 204874 - DNA, 5682 bp, Artificial Sequence
  Description of Artificial Sequence: Synthetic coding sequence
atggcccggctggccgactacttcgtgctggtggccttcggcccccacccaagagggtccggagagggccaggggcaaatcctccaacggttcccagagaaagactgggaggacaaccctttccctcaaggaatcgaattattctgccagcctagcggatggcagctgtgtcccgaacggaaccccccaactttctttgtggccgtgctaaccgacattaattcagagcgccattactgtgcctgcttaactttttgggagcccgccgaaccttcgcaggaaactacaagggtggaagatgcaacggaaagggaggaagagggcgatgagggaggacagactcacctgtctccgaccgcaccagcgccgtcggcacagctgtttgccccaaaaacgttggtcctggttagcagactagatcatacagaggtgttcagaaactctctgggcctgatctacgcgatccacgtggagggcctgaatgtgtgtttagaaaacgtgattggcaatttactgacctgtacagtgcctctcgctggtggatcacagcggacaatatcactgggcgccggcgataggcaggtaatccagacccccctagctgattccctgcccgtttcgagatgcagtgtggctttattattcaggcagttggggatcacaaacgtgttgagcctgttctgcgccgccctgacagagcacaaagttctttttcttagccgaagctatcagcggttagctgacgcctgtcggggcctgctggcccttctgtttccactgcgctacagctttacctacgtccccattctgcctgcccaacttctggaggtgttgtcaaccccaacaccctttatcatcggcgtgaatgcagccttccaggccgagacacaggagttactagacgtgattgtggctgatctggacggtgggacagtcactattcctgagtgcgtgcacattccacctctacccgaaccgctccagagccagacccactcggtgctgagtatggtgctggaccccgaactggaactggcagatctggccttccccccccctacaacttctacttcttcactgaagatgcaggataaggagctgcgcgccgttttccttagattgtttgcgcagcttctgcagggatatcggtggtgccttcatgtggtcagaatccaccctgaacccgtgatcagattccacaaggctgcctttctgggacagcgcggactcgtagaggatgatttcctcatgaaagtcctcgaggggatggcttttgccggctttgtgagcgagcggggggtcccctataggccaacagatcttttcgacgagttggtcgctcacgaagtcgctcggatgcgtgcggacgaaaaccacccacagagggtcctgcgtcacgtacaggaactcgctgagcagctgtataagaatgagaatccctatcctgccgtggctatgcacaaggtgcaaagaccgggtgagtcaagccacctaaggagggtccccagaccattcccaagactggacgaaggtaccgtgcagtggattgtggaccaagccgccgctaagatgcagggggccccacccgccgtgaaggctgagagacgcactaccgtgccctcaggaccccccatgactgcgatattagaaagatgttccggcctgcacgtaaactcagccagacgtctggaggtggtgcgtaactgtatctcatatgtcttcgagggcaaaatgctggaagctaaaaagttattacccgctgtgctacgagcactcaagggtcgcgctgccaggcgctgtctcgctcaggagcttcacctacacgtgcaacagaatagagcagttctcgaccaccaacagtttgactttgtggtgcgtatgatgaactgctgcttgcaggactgcacttcattggacgagcacggaatcgcagccgccctgctgcctctagtcacagcattttgccgcaagctgagtcccggagtgacccaattcgcctactcttgtgtgcaggaacacgtggtctggagcacacctcaattctgggaggctatgttctatggcgatgtgcagacccatataagggccttatacttggagcccaccgaagatctcgccccggctcaggaggtaggtgaagcaccctctcaggaagacgaacgatcggcgctggatgtggcctcagagcagagaagattatggcctactctgtccagagagaagcaacaagagctggtccagaaggaggagtcaaccgtgttctcccaggccatccactatgcaaacaggatgtcttacctcttacttcccctggattcctcaaaatcacggctgctacgtgaaagggccggactcggcgacctcgagagcgcttccaattcgctggtcacaaacagcatggctggaagcgtcgcagagtcatatgatacagagtccggcttcgaagacgccgagacttgtgatgtggccggcgctgtggttagattcatcaaccgctttgtggacaaagtgtgtactgagtcaggggtgacctcagaccatttgaagggactccacgttatggtgcccgatattgtgcaaatgcatatcgagaccctggaagccgtgcaaagggaaagcagacgccttccgccgatacagaaacccaaactgctgcgtcccagactgctgcccggcgaggagtgcgtgctcgatggactcagagtgtacctgctgccagacggtagggaagagggtgccggtgggagcgccggtggtcctgcactccttccagccgaaggggccgtgttcttgactacctatcgggtcatcttcaccggcatgcctacggacccattggtcggggagcaggtagtggtacgatcatttccagtggccgcccttaccaaggaaaagcggatctcagtgcagaccccagtggatcagctgctgcaagatggcttacaactgaggagttgcaccttccagctgctcaaaatggcgttcgatgaagaggtaggctccgattctgccgagttgttcaggaagcaattgcataagttgcgatacccccccgacatcagggctactttcgctttcaccctcggaagtgcacatacaccaggacgccctcctcgcgtgactaaggacaagggccctagcctccggactctctcgagaaatctggtgaagaacgctaagaagaccattggacgccagcacgtgacgagaaagaagtacaatccccccagctgggaacaccgcggccagccccccccggaggaccaggaggatgaaatctctgtgagtgaggaactggaaccctctactctcacccccagctcagcactgaagcccagtgatagaatgacaatgtcgagtttggtcgaacgggcctgttgccgcgactaccagaggcttggcttaggaacgctcagctctagcctgtccagagccaaaagcgagccttttagaataagccctgtaaatcggatgtacgcgatttgtagatcataccccggcttgctgattgtgccccagtccgtacaggacaatgcattgcaaagggtgtcccggtgctacagacaaaaccgttttccagtagtctgctggcgctcaggacgaagtaaagcagtcctcctccgcagcggaggccttcacggaaagggtgtcgtcggactcttcaaagcacaaaatgccccctctccaggccaatctcaggccgattcaagttccttggagcaggaaaagtacttgcaggctgtggtgtccagcatgccacgctacgctgacgcttctggacgcaatacactgagtggatttagctccgcacatatgggaagccatgtgcccagcccacgcgctcgagtgacaaccctaagtaacccaatggccgctagcgcttctaggagaaccgctccccgcgggaaatggggttcggtcagaaccagcggaagatcttctggactgggcaccgacgttggatcgaggctggcgggaagggatgcactggccccaccacaggctaacgggggaccaccagaccccggtttcctgaggccccaaagagccgccctgtatatcctgggagataaagcccagctgaagggagttcgctcggaccctctccagcagtgggagttggtgcctatcgaggtgtttgaagccagacaggtaaaggcatcatttaaaaagctcctgaaagcctgcgtgccaggatgccccgcagctgaacctagtcctgccagttttttgaggagtttagaagattccgaatggcttatccaaattcataaattgctacaggtctctgtgcttgtggtggaactcttggacagcgggtcttccgtcctggtaggcctggaggatggctgggatattacgacccaggtcgtcagtttggtccaactcctctctgatccattttacagaaccttggagggttttcggctgctcgtggaaaaggaatggctgagtttcggacatcgattctcccatagaggtgctcacacactggcaggccagtctagtgggttcactcccgtatttctccagttcctggattgtgttcatcaggttcatctgcagtttccaatggagtttgagttcagccagttttacctcaaatttctaggctaccatcacgtctcaagaaggtttcgcaccttcctgctcgattccgattatgagcggatcgagttgggccttctgtatgaggaaaagggcgagagacggggccaggtgccatgcaggagcgtgtgggagtatgttgacaggttatcaaagcgcaccccagttttccataattacatgtacgccccagaagacgccgaagtgctacgcccgtactcaaacgtttcaaacctcaaagtctgggatttctataccgaagagacattagcagaggggccaccttacgattgggagctagcccagggaccacccgagcctcccgaggaagaacggtcagacggaggcgcacctcagtcgaggaggcgggtggtatggccctgttacgactcctgtccacgggctcagccagacgccatctcccgcctgttggaagagctgcagcgcctggagacagaacttggacaacccgccgaaaggtggaaagatacttgggacagggtgaaggcagcacaacgcttggaagggaggcccgacggaagaggaacgccctcgagtctgctggtgtccaccgctccacatcacagaaggagcctaggagtctacttgcaggaggggcctgttgggtccaccctcagtctgagcctggacagcgaccagtccagcggctctaccacatcaggctctagacaggcagcgagacggtctacatcaacgctgtactcacagtttcaaacagccgaatcggagaatcgctcatacgagggcaccttgtataaaaagggagcattcatgaaaccctggaaagctcgctggttcgttctggataaaaccaaacaccagctgagatattatgatcacagagttgatactgagtgcaagggagtcatcgacctggccgaagttgaagctgttgctccaggaaccccaaccatgggtgctcctaaaaccgttgatgagaaggccttttttgacgtcaagacaacacgccgagtctacaatttctgtgctcaggatgtgccctcggctcaacagtgggtcgatcggattcagtcctgtctcagcgacgcatag

SEQ ID NO: 204875 - DNA, 5604 bp, Artificial Sequence
  Description of Artificial Sequence: Synthetic coding sequence
atggcccggctggccgactacttcgtgctggtggccttcggcccccatccacggggatccggggaagggcaagggcaaatacttcaacggttccctgagaaggactgggaggacaaccctttcccacaggggatcgagctcttctgtcaaccctcaggctggcaattatgtcccgaacgtaatcctccgacctttttcgttgccgtactaactgacatcaattctgagcgtcattattgcgcctgtctgacgttctgggaaccagcagaaccctctcaagaaaccactcgtgtggaggacgcaacagagagagaagaggagggtgacgaggggggtcagacccacttgagccccactgccccagcaccttctgctcagctcttcgcaccgaaaacgctggtcctagtctcccgtttagaccacacggaggtcttccgaaatagtttgggattaatctacgccattcatgtcgaaggcctgaatgtgtgcttggagaatgtgattggtaatcttcttacgtgtacagttcctttggccggtggttcacagagaaccatctcactcggggctggtgaccgacaggttatccagacacccctggcggattcactccccgtatctcgatgcagtgtggcactgttgtttagacagttgggaattacaaacgtgctctctctgttctgtgcagccttgacagagcacaaggtcctgttcctaagccggagttaccagcggctggccgatgcctgccggggccttctggccctccttttcccattgcgctactctttcacatacgtgcccattctcccagcccaactccttgaagtccttagtacacccaccccattcataattggcgttaacgccgcatttcaggcagaaacccaggagttgttagatgtcatcgtggctgacttagatgggggcaccgtaactatccccgagtgtgttcatatccccccactcccagagccgcttcagtcccagactcattcagtactctcaatggtcctggatcctgaactcgagctggcagacctcgcttttcctccaccaacaacttcaaccagctcactgaagatgcaagacaaagagctgcgcgctgttttcctgagattgtttgcgcagctcctgcaggggtatagatggtgcctgcatgtggtgcgtatccatcccgagccagtaatcagatttcataaggccgctttcttaggccagcggggacttgttgaggacgacttcctgatgaaagtcctcgaaggcatggcatttgcaggatttgtgagtgaaaggggcgtgccctataggccaacagatttgtttgatgagctggtcgcgcacgaagtcgcacggatgcgggcggatgaaaaccacccacaacgtgttcttcgacatgtgcaggaactagcggaacagctttacaaaaacgaaaatccttacccggccgtcgccatgcacaaagtgcagcgtcccggcgaaagttcccacctgcggagggtccctagaccttttccaagactggatgagggcacagtccagtggattgttgaccaggccgccgcaaaaatgcagggggctcctcccgcagtgaaagccgagagaagaactacggtgcccagcggcccccctatgaccgcgatcctggaacgctgtagtggcctgcatgtgaacagcgcgaggaggctggaggttgtgagaaactgcatttcttacgttttcgaaggcaagatgctggaagcaaaaaaacttctcccagccgtgctacgcgccctgaagggacgtgctgccaggcgctgtctggcacaggagctccacttgcacgtgcaacagaacagagcagtgctggatcatcaacagttcgatttcgtggtccggatgatgaattgttgcctccaagattgcacttcactggacgagcatggtatcgcagcggccctgttacccctcgtcaccgccttttgtaggaaactctcgccgggcgtgacccagtttgcctattcttgcgtgcaggagcacgtggtgtggtcaacgccgcaattttgggaagctatgttctatggggacgtgcagacccatattcgcgcactgtacctagaacccaccgaggacctcgcacctgctcaagaagttggggaagccccgagtcaggaggatgagcggtcagcgttagacgtagcttccgaacagcggcgtctctggccaacactctcccgagagaaacagcaggaattagtccagaaagaggaaagtacagtgttctcccaggctatccactatgcgaaccgtatgagttatttattgttgccactggattccagcaagtcgaggctgcttcgtgagcgcgccggcctcggggaccttgagagtgcgtctaacagcttagtcaccaatagcatggcaggatctgtggctgaatcatacgacactgagtccggcttcgaggatgctgagacctgcgacgtagcgggggctgtggtccgctttattaacaggttcgtggataaggtgtgcaccgagagtggggtgacgtctgaccacctgaaaggactgcatgttatggtgcctgacattgtacaaatgcatatcgagaccttagaggctgtgcagcgggaatcccggcggctaccacccattcaaaaacctaaactcctacgccctaggttgctaccgggagaagagtgtgtgctggatggtcttagagtgtatctgctgcctgacggcagggaggaaggcgcgggaggaagcgctgggggaccagcactgctgcccgcagaaggggccgtgttcctgacaacttacagggttatcttcactgggatgccaaccgaccccttagttggggaacaggtggtcgtcaggagcttccctgtcgctgccctgaccaaagaaaagcgcattagcgtacagacacccgtagatcagctactgcaggacgggctgcagctccgctcctgcaccttccagctgttgaaaatggcgtttgatgaggaagtcgggtctgattccgcagaattattcaggaaacaactccataagctgcggtaccctccggacatacgcgccaccttcgccttcacattagggagcgcccacacacccgggaggcccccacgggtcacaaaggataaagggccctctctgaggacgctgtcacgaaacctagttaagaatgcaaaaaagacaatcggcaggcagcacgtgacgcgcaagaaatataatccaccatcatgggaacaccgcggacagcctccccctgaggatcaagaggacgaaattagcgtatctgaggagttagaaccctctacactcacgcctagttctgctctcaagccatccgatcgtatgactatgagcagcctcgtcgagcgcgcatgttgcagagactaccagaggcttggcctgggcaccctgagcagcagccttagtagggctaaatctgaacccttcaggatttcccccgtgaacaggatgtatgctatttgccgctcgtatccaggcctgctgattgttccacagtctgtgcaggacaacgcactgcagcgcgtctcacgctgctatcggcagaaccgatttcctgtggtctgttggaggagtggccggtccaaagccgtccttttacggtctgggggactgcacggcaagggtgtcgtaggtctgtttaaggcacagaatgcgccatcccccggacagtcccaggcggacagttctagtcttgaacaggaaaagtacctgcaggccgtcgtctcttcgatgccccggtacgcagacgcatccggtcggaataccttgtcagggttctctagtgcacatatgggaagccatgggaagtggggcagcgttcgaacctcaggtcggtcttctgggctgggcactgatgtgggttcccgactggccggtcgcgacgcactggcccccccacaagcaaacggtggcccccctgacccaggatttctacggccccagagggctgcactctacatactgggggacaaggcgcaattaaaaggggtaaggagtgaccctttgcagcagtgggagcttgtccctattgaggtatttgaggcccgccaggtcaaagccagcttcaagaagcttctcaaggcctgtgttccgggatgccctgccgccgagccaagtcccgctagcttcctacgcagcttggaagattcagagtggcttatacagattcacaagctgctccaggtgtccgtgctcgtcgtggagctactggatagcggtagtagcgtcctggtgggtctggaggacgggtgggacatcaccactcaggtcgtgtccttggtgcaactccttagtgaccctttttaccggaccctggaagggtttagactgctagtcgagaaagagtggctgtctttcggccaccggttctctcaccgcggcgcacatacactggcagggcagtctagtggcttcacacctgttttcctgcagtttcttgattgcgtccatcaggttcatctgcagttccccatggaatttgaattctctcagttctaccttaagtttctgggctaccatcatgtgtcacggcgtttcaggaccttcttgctggattcagactatgagcgcatagagctagggttgctttacgaagagaaaggcgaacgcagaggacaagtaccctgccgatccgtttgggaatatgtggatcggctttctaagcggactcccgtctttcacaattacatgtacgctcccgaggacgcggaagtactgaggccctatagtaacgtgtctaatctcaaagtctgggacttctataccgaggaaaccttggcggaaggaccgccatatgattgggagctggcgcagggcccaccagagccccccgaggaggagcggtctgacgggggggcaccccaatctcggagaagggtcgtgtggccttgctatgatagctgcccaagggcccaacccgatgcaatttctagactgttagaggaacttcagcgactggaaacagaacttggccagcccgctgagaggtggaaagacacatgggaccgtgttaaggctgcccagcgactggaggggaggcccgacggtcgggggacgcctagttccctgctcgtgtccacagcgccccaccaccgtaggagcctgggggtctacctccaggagggaccagtgggttcaacactctccttgagtctcgattccgaccagagttccggttccacaacctctggaagtcgacaggctgcccgacgcagtacaagtaccctgtacagccagtttcagacagctgagtccgaaaatagatcttacgaagggacactttacaagaagggggcctttatgaaaccctggaaggctagatggttcgtgctggacaagacaaagcatcaactacgctactacgatcaccgggtggataccgagtgtaagggcgtgatcgacctcgcggaggtagaggccgtcgcccctggcacaccaacaatgggtgctcctaagacggtcgacgagaaggccttcttcgacgtgaaaaccactaggcgggtctataacttctgcgcccaggacgtcccatcagcccaacagtgggtcgatcggattcagagctgtctgtccgatgcctag

SEQ ID NO: 204876 - DNA, 5550 bp, Artificial Sequence
  Description of Artificial Sequence: Synthetic coding sequence
atggcccggctggccgactacttcatcgtggtgggctacgaccacgagaaaccggggtcgggcgaaggcttaggaaaaattattcaaaggtttccccaaaaggactgggacgacactcctttccctcaaggcattgaacttttctgtcagccggggggctggcagctctcacgggagcgtaagcagcctactttttttgtggtggtgctgacagacattgactccgaccgccattactgtagctgtttgacattctacgaggctgagataaacctccaaggcacaaagaaggaagagattgaaggagaagccaaggtatctggactgatacaaccggctgaggtgttcgctcctaaaagcctggtattagtctctcgcctatactatccagagatctttcgtgcatgtctgggtttgatatacaccgtgtatgtggacagtctgaacgtatcactagaaagccttattgccaatctgtgtgcatgcttagtgcccgccgcaggtggaagccaaaagctgttcagtttaggggctggagaccgacaacttatccagactccactgcacgactcacttcctattacaggaaccagcgtggctctcttatttcagcagcttggtatccaaaacgtcctgagcttattctgtgccgttttgacagagaataaggtgctcttccactccgcaagcttccaaaggttgtctgatgcctgccgggcattggaaagcctcatgttcccactgaagtatagctatccgtacatacctattctgcctgcccaattattggaggttctttcatcccccacacctttcatcataggagtgcacagcgttttcaagacagatgtgcacgagctcctggatgtcataattgcagatctcgacgggggaaccattaaaatccctgagtgcattcacttatcaagtctgccggagcccctcctgcaccagacccagagcgcactgtcattgatcctccatcctgatctcgaggtggccgatcacgcctttccgccacctaggaccgccctgtcacactctaaaatgctggacaaggaagtgcgcgctgtgttcctcagacttttcgcgcaactgtttcaaggctatcggtcatgtctacagcttattcgcatccacgccgagccagtgatccatttccacaagacagctttcctgggccagagagggttggtagaaaatgactttctgacaaaggttctatcaggtatggcctttgccggcttcgtatctgaacgaggccccccttaccggtcttgcgacttatttgacgaactggttgcctttgaggtggaaaggatcaaggtggaagagaacaaccccgtaaaaatgattaagcacgtgcgggagctcgcagaacagttgttcaaaaatgaaaatccgaatcctcatatggctttccagaaagtgccgcggcctacggagggttcccatctgcgagtgcatatactgccctttcctgaaatcaacgaggcacgggtccaggaactgatccaggagaatgtcgcgaaaaatcagaacgctcctcctgcgactaggattgagaagaaatgcgtggtgcctgccggaccacccgtggttagtatcatggacaaagtgaccacagtattcaatagtgctcagcgactggaggtggtgagaaactgcatcagtttcatcttcgaaaacaaaatcctcgagactgagaaaaccctgccagccgctctacgagccctgaaaggcaaggccgctcgacagtgccttactgacgagctcggcttgcacgttcaacagaatcgcgcgattctggaccaccagcaattcgattacattattaggatgatgaactgtacactgcaggactgttcctctctggaggaatacaatattgcggctgctctgctcccactcaccagcgcgttctataggaagctggctcccggcgtgagccagttcgcatacacctgtgtgcaggaccatccgatctggactaatcagcagttctgggagaccaccttttataacgctgtccaggaacaggtgcggtccttgtatttgtctgctaaggaagataatcatgccccccacctgaagcagaaggataagctcccagatgaccattatcaggaaaagacagccatggacctggctgccgagcaactacgcctttggccaactctgtctaagtccacacagcaggaactggtgcagcatgaggagagcacagtgttctctcaggcaatccattttgcaaacctgatggttaatttgctggtgccattggatacaagtaagaacaagctattacggacatcagctcccggggactgggagtccgggagcaatagcattgtgacaaactctattgcaggaagcgttgcggaaagctacgacaccgaatccggtttcgaagatagcgaaaataccgatattgcgaacagcgtggtgagattcattactagatttatcgataaggtttgcactgaatctggcgtgacgcaggatcatatcaagtcgctgcattgcatgatccccggaattgtggccatgcacattgagactctggaggcagtgcacagagagtccaggcgtttacctcccatccagaagccaaagattctgcggccggcgctcctcccgggggaagaaattgtatgcgagggcctgcgagtgctgctcgaccctgacgggagagaggaggctacgggggggctcttgggtgggccccaactcctacctgccgaaggagcactgtttctgactacctaccggatactgtttaggggcaccccccacgaccagttagtaggagagcaaaccgtagtgagatcctttccaatcgcctctatcaccaaagagaagaaaatcaccatgcaaaaccaacttcagcagaatatgcaggaaggacttcagattacaagtgcctccttccagttgatcaaagtggcgttcgatgaggaggtcagtcctgaggtcgtggaaattttcaaaaaacagctgatgaaatttcggtacccccaatctatcttctccactttcgccttcgcagcaggtcaaaccactcctcagattatactacccaagcagaaagaaaaaaataccagtttccgtacattttccaagactatcgtgaagggcgcaaaaagggccgggaaaatgacaatcggacgccagtatctactcaaaaagaagacagggacgattgtggaggaacgagtgaatcggcctggttggaacgaagatgatgatgtgtcagtatctgacgaatccgagctgcctacatctacaacccttaaggctagtgagaagtctaccatggagcaactcgtggaaaaggcctgcttccgtgactaccagagactgggtcttgggactatctccggcagttcttctagatcacggccagaatacttcagaataactgccagtaatcggatgtactccctttgtagatcctatccagggctgctggtagttccacaagctgtgcaggattcgagcttgcctcgagtggctagatgctaccgccacaaccgacttccagtcgtttgttggaaaaattcacgctcgggtaccttactattacggtccggaggttttcacggtaaaggtgtggtcggcctttttaagagtcagaattcaccacaggccgctcctacgtcatcccttgaaagcagtagctcaatcgagcaggagaaatatctgcaagcgttgctcaatgctgtcagcgtccaccaaaagctgcggggcaattcgacattgaccgtcaggcctgccttcgccctttctccaggagtctgggcttctctgaggagctcaacaagactcatcagctcacctacgtcctttatagatgtgggcgctcggctcgcagggaaagaccattcagcttcattcagcaactcaagctacttacagaaccaactgctgaaaaggcaggcagcattatatatatttggcgaaaagagccaactgcggaactttaaggtggagttcgctctgaactgtgagtttgtgcctgtcgagttccacgagattcgccaggtgaaggcatcctttaagaagctgatgcgcgcatgcatcccaagcacgatccccacagactctgaagtgacattcttgaaggcactcggggatagtgagtggttccctcaactccaccgcatcatgcaattggctgtggttgttagcgaggtgctggaaaacgggtcgtccgtgttagtgtgtctggaagagggctgggacataaccgcccaggtgactagcttagtgcagctgctgagcgacccattttacagaactctggagggatttcagatgctggtggagaaggagtggctcagttttggccataaatttagtcagcgctcaagcctcaccctcaactgccagggaagcggcttcgctccggtgtttttgcagtttctcgattgcgtgcaccaggtgcataaccagtatcccaccgagttcgaattcaatctgtactaccttaaattcctcgccttccactatgtgtcaaatcgattcaagacatttctgctcgacagcgactatgagcgcctggaacatggcactctcttcgatgataagggagaaaaacacgctaaaaagggcgtgtgtatctgggagtgtatcgaccggatgcataaaagatctcccattttctttaactatctctattcacccctcgaaattgaagccctaaaaccaaacgtgaatgtcagctcactcaagaagtgggattactacattgaggaaacgttgagcactggtccatcgtacgactggatgatgttgacacccaagcacttcccgtcggaggacagtgacctggccggcgaagcgggtcctagaagtcagagacggaccgtgtggccatgttacgatgacgtgtcgtgcacccagccggatgcattaacatctctgttttctgaaatcgagaagcttgagcacaagctgaaccaagcgcccgagaaatggcaacaattgtgggagcgggtaactgtggacttaaaggaagagcctcgaacagacaggtcccaaaggcatctgtcaagaagccccgggatcgtttccacaaacttacccagctatcaaaagaggtccttgctgcacctgccagattccagcatgggagaggaacagaactcatccatttcccctagcaacggggtcgagagacgcgccgccacactttacagccaatacacaagtaagaacgatgagaacagatcattcgagggtacattgtataagcgtggagccctcttaaaaggctggaagccgaggtggttcgtgctcgacgtgacgaaacatcagctccgctactacgacagtggtgaggacaccagttgcaaaggtcacattgacctcgcagaggtggagatggtaatcccggccggacccagtatgggggcccccaagcacacatccgataaagcgtttttcgatctgaaaacctcaaaaagagtttataacttctgtgcacaagacggccagagcgcccagcagtggatggataaaatccaaagctgtatcagcgacgcctag

SEQ ID NO: 204877 - DNA, 4791 bp, Artificial Sequence
  Description of Artificial Sequence: Synthetic coding sequence
atggagagccgggagaccctgagcagcagccggcagcggggcggcgagtcagattttctgcccgtgtcatcagccaagcccccagctgctccaggctgcgcaggagagcctcttctcagcaccccaggtccaggcaagggcatcccagttgggggcgaacgcatggagcctgaggaggaagatgagctcggctcaggaagggacgtcgacagcaattcaaatgccgactccgagaaatgggtagccggggacggtttggaagaacaggaattcagcattaaggaggccaatttcactgaggggagcctgaaactgaaaatccagaccacaaagagagctaagaaacccccgaaaaatcttgagaactatatctgtcctccagagataaaaatcaccattaagcagtctggcgatcaaaaggtgtccagggccggaaagaatagcaaggccaccaaggaagaagaacggtctcactccaaaaaaaaactcctcaccgcaagcgaccttgctgctagtgacctgaaaggctttcagccccaggcctacgaaaggcctcaaaagcactccacactacattacgacacgggtctccctcaggatttcactggtgacaccctcaagcccaaacatcaacagaagtcctccagccaaaaccatatggactggagcacgaattcagactctggccccgtcacccagaactgttttatttccccggagtccgggagggagacggccagtacttccaaaattcccgctctcgagccggttgcaagcttcgctaaggcacaggggaagaagggatccgcaggcaatacatggtcccagcttagcaataacaacaaagatctgctcctggggggggttgccccctcaccttctagtcacagttcgccagctcctccctcaagttcagcggagtgcaacgggctgcagcctcttgtcgatcaagatggcggaggcaccaaggagccacctgagcctccaacagtaggttccaaaaagaagagttctaagaaggatgtgatttcccagaccattcccaaccccgatctggactgggttaagaacgctcagaaggcatttgataatacagagggcaaacgggaaggctatagtgctgatagtgctcaagaggcctcacccgcgaggcaaaatgtgagtagcgcttcaaaccctgaaaatgattccagccatgtgagaatcaccatcccaataaaggccccatccctggaccctactaaccacaagcggaagaaacggcagtcaatcaaagcggtggtggagaaaatcatgccggagaaggctttagcttcgggtataaccatgagctccgaggtggtcaaccggatcctttccaattctgaaggcaacaaaaaggacccacgcgtaccgaagcttagcaagatgatagaaaatgagtccccctccgtgggacttgagaccgggggcaacgctgagaaggtgattcccggcggcgttagtaaacctcggaaacctcctatggtgatgacccccccaacatgcaccgaccacagtccttctagaaagctgcccgagatacagcaccctaagttcgccgctaagcgccgctggacttgttcaaagccaaagccgagtacaatgttacgcgaagctgtgatggcgacctcagataagctcatgctggaacctccaagtgcttatccaatcactccttcttcccccctctacacgaacacagactctctaactgtcattaccccagtcaagaaaaagcggggtcgtcctaaaaagcagcctctgctgactgtcgagacaatccacgagggaacaagcaccagtcccgtcagccccatctctcgtgaatttccaggtacaaaaaagcggaagagacggcggaatctggcaaagctggcccaattagtccccggggaagataaacctatgtcagagatgaaatttcataaaaaagtggggaagcttggggtgcttgataaaaaaaccattaaaaccatcaataaaatgaagaccttgaaacgaaagaatattctgaatcagattctttcttgctccagctccgttgccctgaaggccaaagccccgcctgaaacttcacctggggcagcggccatcgagtcaaaactgggcaagcagatcaacgtatcgaagcggggcaccatttacatcggtaagaagagagggaggaagcctagggccgagctgccccctcccagcgaagagcccaaaactgccatcaaacacccgagacctgtgagttcacaaccagacgtgcccgctgtcccatccaattttcaaagcttggtcgcgagttcccctgctgctatgcatcctctaagcacacagcttggaggctcaaacggcaatctgtcaccagctagcacagagaccaatttttctgagctgaagaccatgcccaaccttcaacctattagcgctctgcccaccaagacacaaaaggggatccactcagggacatggaagttgagccctccgaggcttatggctaactcaccaagccacctctgtgagatcggttcccttaaggagattaccctctccccagtttccgaatcgcacagtgaggagactattccgtccgactccggcattggaacggataacaacagcaccagtgatcaggcagaaaaatcatcagagagtcgtaggcggtattcctttgacttttgctccctagacaatccggaagcgatacccagtgacacctctacaaaaaatcggcacggccatcggcaaaaacatttaattgtggataactttctcgctcacgaatcacttaaaaaacctaagcataagagaaagagaaagtcacttcagaaccgcgacgacttacagttcctcgcagatctcgaggagctgataaccaagttccaagtcttcaggatcagccatcgcagttacactttttatcacgaaaacccttatccatccattttccgaattaactttgaccactattaccctgtcccatacatccagtatgatcccctgctgtatctaaggcggacaagcgatttaaagagcaagaaaaagcgtggcagaccggcgaagacaaatgacacaatgactaaagtaccatttttacagggctttagttaccctattccatcaggcagctactatgccccttatgggatgccttacaccagtatgcccatgatgaatctaggctattatgggcaatatcccgcccctttgtatctgtcgcatactttgggggcagcctctccgtttatgcgccccacggtccccccaccacaattccacaccaattcacacgtcaagatgtccggagctgccaagcacaaagctaagcatggtgtgcacttacagggacctgtatccatgggactcggggacatgcaaccgtcattgaatcctcctaaggtgggctctgcatctctgtccagtggtcggctgcataagagaaagcacaaacacaagcacaaacacaaggaggaccgcatcctcggcacacacgacaacctttctggtctgtttgccggaaaggccacaggattcagctcccacatcttgtccgagagactgtcgagcgcggataaagagctccctttggtgtctgagaagaacaaacacaaggagaagcagaaacaccagcattccgaggccggccacaaggcctccaagaataattttgaagtggatactctgagcaccctgtctctgtccgacgcccagcactggacacaagccaaggagaagggcgacctctcaagcgaacccgtcgatagctgcactaaaagatattccggctctggtggagacggcgggtccaccaggtcggagaacctggatgtgttctccgagatgaaccccagtaacgacaagtgggactccgacgttagtggctctaagcggcgttcctatgagggatttggtacctaccgtgaaaaggatatccaggcattcaaaatgaataggaaggaaagatctagctacgattcaagcatgtcaccgggcatgccatccccgcatttaaaagtcgatcagaccgccgtgcatagcaaaaacgaaggctccgtgcccactatgatgacccggaaaaaacctgcagctgttgattctgtgacaatcccccctgcgccagtgctgagtttactcgcagcctccgctgccaccagtgacgcggtggggagttctttaaagaagaggtttaagcggagagagattgaggcaatccagtgcgaagtgaggaagatgtgcaattacacaaaaattctgtctacgaaaaagaatctcgatcatgtcaacaagattctgaaagccaagcgcctgcaacgccagtccaagaccggcaacaattttgtcaagaaacgccgtggacggcctcgtaagcagcccacccaattcgacgaggactcaagagaccagatgcctgtcctcgagaaatgtattgacctaccttctaaacgcgggcagaagccctcattgagtcctctcgttctggagcccgcagctagtcaggatacaatcatggccactattgaagccgttatacacatggctagagaagctcctcctctgcctcctccaccgcctcccccactgccgcctccacctcccccgccactgccgcccccacctccactccctaaaactccccgggggggcaaacgcaagcataaaccacaagcgcccgcccagcccccacagcaaagtccaccacagcagcctctgccccaagaggaggaagtcaaggcaaaaagacaacggaagagcagaggtagcgagtctgaggtgctgccatag

SEQ ID NO: 204878 - DNA, 729 bp, Artificial Sequence
  Description of Artificial Sequence: Synthetic coding sequence
atggagagccgggagaccctgagcagcagccggcagcggggcggcgagagtgattttctccccgtgtcttctgcaaagccaccagcagcccccggttgtgccggagagccgctgttatcaacaccaggtccaggtaaaggaatcccagtgggtggggagaggatggagccagaggaggaagacgaattaggaagtggcagggacgtggattcaaactccaatgccgatagtgaaaaatgggtggcaggcgacggcctcgaggaacaagaattcagcattaaggaggcaaattttaccgagggatcccttaagctgaagatccaaacaacgaagcgcgcaaaaaagccgcctaagaacctggagaactacatatgtccacccgaaatcaagattacaattaaacagagcggagatcaaaaagtgtcacgcgccggcaagaattccaaagctacaaaggaggaagagcgctcccatagcaagaagaagctgctcactgcctcagacctggccgcatctgacttgaagggatttcagcctcagatcaaggatagcagcaaagaggaggtttggaagagacgaggaggccagggcatcccattcaagaagcagttcctgagtcaggagagggccatgtgtttctcctgtcctagaaacccctttcccgcgaaaccagggtcccttaccctgcctttccacagcgagccagcggtgtgggcccaggaagtatag

SEQ ID NO: 204879 - DNA, 414 bp, Artificial Sequence
  Description of Artificial Sequence: Synthetic coding sequence
atggagagccgggagaccctgagcagcagccggcagcggggcggcgagagtgattttttacctgttagttcggcaaagccacccgccgctccaggatgtgctggggaacctcttctcagcaccccaggacctggaaaaggcataccagtaggcggcgagcggatggagccagaggaggaggatgaactgggatccggtagggatgtcgatagcaattcgaacgccgattccgagaagtgggtggcaggagatggcctcgaggagcaggaattctcaatcaaagaggccaattttacagaaggaagcttaaaattgaagattcagacgacaaagcgagccaagaagccccctaaaaatcttgaaaattacatttgccctcctgagattaaaatcactatcaagcagagtgggtag

SEQ ID NO: 204880 - DNA, 2055 bp, Artificial Sequence
  Description of Artificial Sequence: Synthetic coding sequence
atgttcgccgaggccgccaagaccacccggccctgcggcatggccgaattcaaggagaaaccggaggcccccaccgagcagttagatgtagcttgtggccaggaaaacctgccagtgggagcttggccacccggcgcagccccggccccattccagtatacacctgatcacgttgttggaccaggcgctgatatcgaccctacccagatcacgtttcctggatgcatatgtgtaaaaaccccctgcttgcccggtacatgttcctgtcttagacatggtgagaactatgacgacaacagctgtctgcgggatattggatcaggcggtaagtatgccgagccagtctttgaatgtaatgttctttgtaggtgttctgaccactgtagaaacagggttgtgcagaagggcctgcagttccactttcaggttttcaaaacgcacaagaaaggctggggactgcgcactctcgaattcatacccaagggccgcttcgtttgtgagtacgccggcgaagtgcttggattctcggaagtgcagagaaggattcacctgcagacaaagagcgactcaaattatatcatcgccatccgcgagcacgtgtataatggtcaagtaatggaaacatttgtcgatccaacctatattggaaacatcggacgttttcttaaccatagttgtgagcctaatttgctgatgattcctgtgagaattgattccatggtccctaagctggccctcttcgccgccaaagacattgtgcctgaggaagagctctcatacgactatagcgggcgttatctgaatctgaccgtgagcgaagacaaggagcgccttgaccatgggaaactgcgtaagccttgttattgtggcgctaagtcatgtactgctttcctcccatttgacagcagcctatactgccccgtagagaagtctaatatcagctgcggcaacgagaaggagccatcaatgtgtggtagcgcccccagtgtgttccctagctgtaagagattgacactggagacgatgaaaatgatgttggacaagaaacaaatacgcgccatttttctcttcgagtttaaaatgggcaggaaggccgcagagacaaccaggaatattaataatgcctttgggccgggaacagctaatgagcgtaccgtccaatggtggttcaagaagttttgcaagggcgatgagtctttggaggacgaagagaggagtgggagacccagtgaagtggacaatgaccagctgagagcaataatcgaggctgatcccctgaccactacccgggaagtggctgaggaactgaacgtgaatcactctacagtcgtcaggcacctgaaacagatcgggaaagtgaaaaaactggataagtgggtccctcatgaactgaccgaaaaccagaagaaccggcgtttcgaagtaagttcgtctcttattctcaggaaccacaatgaaccgtttctagacagaatcgtcacatgtgacgagaaatggatcttgtatgataacaggagaaggtctgcgcagtggcttgatcaggaggaagccccaaaacattttccgaagcctatccttcatcctaagaaggtcatggtcaccatctggtggagtgctgcaggcctaatccactatagcttcttgaaccccggcgaaactatcacttcggagaagtacgcccaggagatcgacgaaatgaatcagaaactgcaacgactccaactagcactggtgaacaggaaaggaccgatcctgctgcacgacaatgctcggcctcatgtcgcccagccaacccttcagaaattgaatgaattaggatatgaggtgctgccgcaccctccatactctcctgatctcttgcccaccaactaccacgttttcaaacatcttaataatttccttcaagggaaaagatttcataatcagcaggatgctgagaacgccttccaggagtttgtcgagtcccagtccactgatttttacgccaccgggattaatcagctgatttctcggtggcaaaaatgcgtggactgtaatgggtcatactttgattag

SEQ ID NO: 204881 - DNA, 1098 bp, Artificial Sequence
  Description of Artificial Sequence: Synthetic coding sequence
atgttcgccgaggccgccaagaccacccggccctgcggcatggccgaattcaaggagaagccagaggccccgacggagcagttggacgtggcctgcgggcaggagaacctgccagttggtgcttggccgccaggagccgcccctgcaccattccagtatacccctgaccacgtcgttgggcccggggctgacatcgatccaactcagattactttccctggctgcatttgtgtgaagacaccctgccttcccggaacctgcagctgcttgaggcacggtgagaattacgatgataatagttgtctgagagacattggttccggcggtaagtacgccgagcccgtattcgagtgtaatgtgctgtgccgctgcagtgaccattgccggaaccgagtggtgcagaaaggtctccagttccacttccaggtgttcaagacccacaaaaaggggtggggcctgcggaccctggagtttatcccaaagggacgattcgtgtgtgaatacgctggagaggtactcgggttttcagaagtgcaacgcaggattcatttgcagaccaagagtgactcaaactatatcatcgctatccgtgagcatgtgtataacgggcaggtgatggagacattcgtggatcctacatatatcggtaacatagggcggttcttgaaccactcatgcgagccaaatctgctgatgatcccggtgcgaatcgattccatggtgcccaaactcgccctgtttgccgccaaggacattgtgccagaagaggaactgagctatgattactcaggcagatacctgaacctgaccgttagcgaagacaaagaacgtttggaccacgggaaactgcgtaaaccctgctattgtggagcaaaatcctgcaccgcctttcttccattcgacagttccctctattgccctgtggagaaatcaaatatttcctgcggaaatgaaaaggagccaagcatgtgcggtagcgctccaagcgtctttccctcttgtaagcgccttactctggaggtctcattgttttcagacaaacaacttgcccctccatactccggcagacagtggctggcaagctttacctccgcctag

SEQ ID NO: 204882 - DNA, 516 bp, Artificial Sequence
  Description of Artificial Sequence: Synthetic coding sequence
atgttcgccgaggccgccaagaccacccggccctgcggcatggccgaatttaaggaaaagcctgaggctcctaccgagcagcttgatgtggcctgcggacaggagaacctacccgtcggtgcgtggccacctggcgccgctccagcccctttccaatacaccccagaccacgtagtgggacctggcgcggacatcgacccaactcagataacatttccgggctgcatctgtgttaaaaccccatgccttcccggaacctgctcttgtctgcggcacggagaaaattatgatgacaattcctgtttgcgcgatatagggagcggcgggaaatacgccgagccagtgtttgaatgtaatgttctttgccgctgctctgatcactgtagaaaccgcgtggtacaaaaaggactccagttccattttcaggtgttcaagacccacaaaaaaggttggggcctgcggaccttggagttcattccaaaagggcgtaaggttgagcaccagctctggaagtag

SEQ ID NO: 204883 - DNA, 1101 bp, Artificial Sequence
  Description of Artificial Sequence: Synthetic coding sequence
atggacagcgacgacgagatggtggaggaggccgtggagggccacctcgacgacgacggcctccctcacggcttctgtacagtgacatactccagcactgatcggttcgaaggaaactttgtgcatggcgagaagaacggcaggggcaaattcttttttttcgacggaagcacattggaagggtactatgtagacgatgctctgcagggacaaggcgtgtatacgtatgaggacggtggagtgctccagggaacttacgttgacggagagctgaatggacctgctcaggagtacgacaccgatggacgattgatttttaaaggccagtataaggacaatataaggcatggcgtctgctggatctattacccggatgggggaagtctagtgggagaagtaaacgaagacggcgaaatgaccggcgaaaagatcgcttatgtgtatcctgacgagcggaccgccctgtacggcaagtttattgacggggagatgatcgagggcaaactggccacactgatgagtaccgaggaaggacgcccacatttcgaattgatgcccggaaattctgtctatcacttcgacaagtcaacatcaagctgcatttccacaaacgcgctcctgccagacccctatgagtctgagcgggtgtacgtcgcggagtctctcatttcgtccgcgggtgaagggctgtttagcaaggtcgccgtggggcctaacaccgtgatgtcgttttataatggagtccgcatcactcaccaggaggtcgattctcgcgactgggccttaaatggaaacactttgtctttagatgaggagaccgtcatcgacgttcctgagccctataaccacgtctccaaatactgtgcttctctggggcacaaagcgaatcactccttcacccccaactgcatctacgatatgttcgtacacccccggttcgggcccatcaagtgcattcggacgctgcgcgccgtagaagccgacgaggaactgactgttgcgtatgggtatgatcactctccaccaggtaagagcggaccagaggcccctgaatggtaccaggtggagctgaaggcttttcaggccacacagcaaaaatag

SEQ ID NO: 204884 - DNA, 5124 bp, Artificial Sequence
  Description of Artificial Sequence: Synthetic coding sequence
atggaccaggagggcggcggcgacggccagaaggcccccagcttccagtggagaaactataagctcatagtcgacccggctctggatcctgcgctgcgcaggccgagccagaaggtctatcggtacgacggggtccatttttcggtgaacgattctaagtacatccccgtggaggacctacaagaccccaggtgccacgtgcgctccaagaatagagatttcagtctgccagtacccaagttcaaattagacgaattctacatcggccaaatcccactcaaggaggtgacgtttgcccgcctgaacgacaacgtgagagagaccttcttaaaggatatgtgccggaaatacggtgaggtcgaggaagtagaaattctgctccacccaaggacacgcaagcatctgggtttggcccgagtgctattcacctccactagaggcgccaaggagaccgtaaagaacctccacctgacgagcgtcatgggaaacatcatacatgcacagcttgacatcaaaggccaacagagaatgaaatattacgaactgattgtcaatggctcttacaccccccaaacagtacctacaggaggcaaggcactttcggaaaaatttcaaggaagtggggctgcaacagagaccgcagagtcacgcaggcgcagcagtagtgacacggcggcttatccagcaggcacaaccgccgtggggacccctggaaacggaaccccgtgtagccaggacacctcattttctagttctagacaggacacacccagtagcttcggtcagttcacccctcagtcaagtcaaggaactccttataccagccggggttccacgccttattctcaggactcagcatactcttcaagtacaacgagtacttcctttaagccaaggcgctccgaaaatagttaccaagacgccttctccagaaggcatttctcagcttcaagcgccagcaccactgctagcaccgccattgcagccacgacggccgccacagcctcctcttcagcatcttcttcaagcctgagttcctcatccagtagcagcagctccagttcctcatcccagttccgcagcagtgatgcaaattacccagcctactatgaaagttggaatcggtatcaaagacacacatcatatccgcctcggcgtgcgacaagagaggagccacctggggcacctttcgcggagaataccgccgagagattccctccctcttatactagctatcttcctcccgagccaagcagaccaaccgatcaggactacagaccccccgcctcagaagctccaccacccgaacctccagagcctgggggaggaggcggcggcggtggtccatcaccggagcgtgaagaagtgcggacctcacctaggcccgcaagtcctgctcggagtggctcccctgcaccagagaccaccaatgagtccgtccccttcgctcagcatagctcactggacagccgcattgagatgctcctcaaggagcagaggtctaagttcagctttctcgccagtgataccgaggaggaggaagagaactccagcatggttctgggtgcccgtgacacaggaagtgaggtgccatccggctcaggccacggaccttgcacacctccccctgcccctgccaactttgaggatgttgctccaactggttccggggaacctggcgctacccgggagtctcctaaagccaatgggcagaatcaagcatccccttgtagcagtggagatgacatggaaatatctgacgatgaccggggtggctctcctcccccagccccgactcctccccagcaaccgccacccccccctccacctcctccaccgcctccaccatatctcgctagcctgcccctcggctatcctcctcaccagccggcctacctgctccctccccgtcccgacgggccccccccccccgaataccctccacccccaccgccccccccccatatttatgactttgttaattcactggagctgatggaccggctgggagctcagtggggaggtatgccaatgtcattccagatgcagacacagatgctgaccaggttgcatcaactcagacaggggaaaggactcatcgccgcatccgccgggccccctggaggagctttcggcgaagcttttctcccctttccgcccccccaggaagccgcctatgggctcccttatgccttatacgcccagggtcaggagggacgcggtgcctacagccgggaagcttatcatctccccatgcctatggctgctgaacctctgccctcatcctcagtgtccggggaagaggcccgtctgcctccccgggaagaggccgaactggctgaaggaaagactctgccaacggccgggacagttggtcgggtactcgccatgcttgtgcaagaaatgaagagcatcatgcagagagacctaaatcgaaaaatggtggagaatgttgctttcggggctttcgaccagtggtgggagagtaaggaggagaaagctaagccatttcaaaatgccgccaaacaacaggcgaaagaggaggacaaagagaaaacaaagctgaaggaacctggtctcctaagcctggttgactgggctaagtccggcggcactaccggtattgaagcattcgcgttcggctccgggcttagaggtgccctgcgactcccgtcgtttaaagtgaagagaaaggaacccagcgagattagcgaggccagcgaagagaaacggcctcgcccttctacccccgctgaggaggacgaagacgacccagagcaggagaaggaagcaggcgagcccggaaggcctggaaccaaacccccaaaacgagatgaagaacgcgggaagactcaggggaagcatcggaaatcatttgctctggattccgagggggaggaggcctctcaggagtcctcctcggagaaggatgaagaagatgatgaggaggatgaggaagacgaggacagggaggaagccgtggatactactaagaaagaaaccgaagtgagcgacggtgaagatgaggagtctgacagctcatccaaatgctctctatatgccgattcagacggagagaatgatagcacctccgacagcgagtcttcttcatcctcttcttccagttcatccagcagctctagcagtagctcatcttccagttcgtccagctccgagtcatccagcgaggacgaggaggaagaagagaggccagcagctctacccagtgcctccccaccgccgagggaagtgcccgttccaactcctgcccccgttgaggtccctgtgcctgagcgcgtggccgggagtcccgtgaccccgctccctgagcaagaggcttcaccagctcgcccagccggccccacggaggagtcgcctccgagtgcccccctacgcccgccagagccacctgccgggcctcctgccccagcaccccgccctgacgaacggccttccagccccatcccactgctcccccctccaaagaagaggagaaaaaccgtgagtttctccgcaatagaggtggtgccagccccggaaccgccccctgctactcccccccaggccaagtttcctgggcccgcctcacggaaagcccctcgaggagtggaacggaccattcgtaacctgcctctggaccacgctagcctggtgaagagctggcctgaggaagtgtctcgcggcggacggtccagagctggtggtcgcggaagacttactgaggaagaggaggccgaaccaggaaccgaagtggatctggcggtgctcgccgatttggccttgacccctgcccgaaggggccttcccgctctgccggccgtggaggattccgaggccacagagacgtcagacgaagcggaaagaccaaggcctttgctgtcacatatcctcttggaacataattatgcactggccgtgaaacccacccctcctgccccagctttgcgacctcctgagccagttccagctcctgctgcactgttttcctccccagccgatgaagtcctagaggcacccgaagtcgtcgtggctgaggcagaggagccaaagccccagcagctgcagcagcaacgcgaagagggagaggaggagggcgaagaggagggagaagaggaagaggaggagagtagtgattcctctagttcatccgacggagaaggcgcattaaggcggcgatcactgaggtctcacgcccggaggcggcggcccccgcccccccctccacctccacccccaagggcctacgaaccaaggtccgagttcgagcagatgacaatcctttatgacatttggaatagcggactggactccgaagacatgagttatcttcgtctcacttacgagcggctactccagcaaacaagcggggcggattggcttaacgacacccactgggtccaccacacaatcaccaatttaacgacacccaagcgcaagaggcgcccccaggacggcccgcgcgaacatcagacagggagcgccaggtccgagggttactaccccatatctaagaaagagaaggacaagtatctggacgtgtgtccggtgtcagcaaggcaactggagggggtggatacccaggggacaaatcgggtcctgtccgagcggcggagcgaacagcgacggctactgtcggccatcgggaccagtgccatcatggacagcgatctgctgaagctcaaccagctcaagttccgaaagaagaaactgcgcttcgggaggagccggattcacgagtggggccttttcgccatggagcccatcgcagcggatgagatggttattgagtacgtcggacagaacatcaggcagatggttgcggacatgcgggagaagcggtacgtgcaagaggggataggtagttcctatctgttccgcgtggatcacgatacaattatcgacgccacgaagtgcggaaacctcgctcgctttatcaaccactgttgcacgcctaactgttatgccaaggtgatcacgattgagtcacaaaagaaaattgtgatttattccaagcagccaattggcgtggacgaagaaattacttatgattataagtttcctctggaggataacaagatcccatgtctgtgcggaacagagtcttgtaggggatctttgaattag

SEQ ID NO: 204885 - DNA, 213 bp, Artificial Sequence
  Description of Artificial Sequence: Synthetic coding sequence
atggaccaggagggcggcggcgacggccagaaggcccccagcttccagtggcgaaactacaagctcattgtagatcctgctctggatccggccttgcgcaggccctctcagaaagtttacaggtacgacggagtgcacttctccgttaacgatagcaaatacatacccgtggaggacctgcaagacccaaggtgccacgtccgctctaaatag

SEQ ID NO: 204886 - DNA, 744 bp, Artificial Sequence
  Description of Artificial Sequence: Synthetic coding sequence
atggaccaggagggcggcggcgacggccagaaggcccccagcttccagtggcgtaattacaaactgattgtcgaccccgccctcgatcctgcactgcgaagaccttctcagaaggtatacagatatgacggcgtccatttttcagttaatgatagcaagtatatccccgtggaagacctgcaggatccccgatgccacgtgcggtctaaaaacagagacttcagcctacccgtgcccaagttcaaattagacgagttttacattgggcagataccgctgaaggaggtgaccttcgccagactgaacgacaatgtgagggaaacctttttaaaagacatgtgccgcaaatatggggaagttgaggaggtcgagattctcctccacccacggacccggaaacacctcggacttgcccgggttctgttcacatccacacgcggcgccaaagaaactgtgaaaaatttgcacttaacctcagttatgggtaacataatacatgcccagttggatattaaaggccaacagcgaatgaaatactacgaactgatcgtgaatggctcctacacgcctcagaccgtacctacaggcggtaaagcactctccgaaaaatttcagggttccggtgctgcaactgagacagccgaatctaggagacgcagttcatcagatacagccgcgtacccggcggggaccaccgcagtgggaactcccggaaacggaaccccctgttcccaagacacttag

SEQ ID NO: 204887 - DNA, 5772 bp, Artificial Sequence
  Description of Artificial Sequence: Synthetic coding sequence
atggagaacagccaccccccccaccaccaccaccagcagcccccccctcagcccgggccttctggggaacgcaggaatcatcactggcgctcctacaagctgatgattgatcccgctctgaagaagggacaccacaagttgtatcgatacgacggccagcacttctctctcgccatgagctctaatagacccgtagaaattgtagaagacccccgcgtggtcggcatctggacaaagaacaaagaacttgaactcagcgtccctaaatttaaaatcgatgaattttacgtggggccagttccaccaaagcaggttacctttgctaagttaaatgacaacatccgggaaaactttctgcgagatatgtgtaagaaatacggggaggtggaagaagtcgagatcctatataaccctaagaccaagaaacacctcgggatcgctaaagtagtcttcgctacagtcagaggggctaaagatgccgttcagcatctgcacagcaccagcgtgatgggaaatattatccatgtggaattagacacgaagggcgagacgagaatgagattctacgagcttctcgtaactggtcgatatacacctcagaccttgcctgtgggcgaactggacgccgtctctcccatagtgaacgaaaccctccaactgagcgacgccctgaagcggctaaaggacggtgggctgtccgcgggctgcggcagcggatcatcttccgtcacacccaactctgggggcacaccattcagtcaggatacagcatactccagctgccgcctagacacacctaattcatatggccagggcacaccactcacgcctcggctggggacaccattttcacaagacagtagctatagtagtcgccagcccacgccctcatatttgttttcccaggatcccgccgtgaccttcaaggcacgaagacatgaatctaaatttactgacgcatacaaccgcagacacgaacaccattatgtgcacaactccccggccgtcacggcggtggccggagctacggctgcttttaggggcagctctgatcttcccttcggggccgtggggggcacgggcgggtcatctggtccccctttcaaggcccagccacaagacagtgccaccttcgcccacaccccccctccagcccaggctaccccagctcctggctttaaatcagcattcagcccgtaccaaacacccgtggcccacttccctccaccacccgaggagccgaccgccaccgcagcattcggggctcgggattctggtgagttcaggagagctccagcccccccaccattaccaccagctgagcccttagccaaagagaaacccgggacacctcccggaccgcctcctcccgatactaatagtatggagctgggagggaggccgacgtttggttggtcccccgagccctgcgatagccctggaacacccacgctggagagctcgccggccggcccggagaagccccatgactccttggattctcgaatcgagatgttgttaaaagagcaacgcaccaagctgctttttctgcgtgagcctgattcggatacagagttgcagatggagggaagccctatttccagctcttcctctcagctgtctcctttagcacctttcggaactaactcccagccagggtttcgcgggcccacacccccatcttcacggcccagctctaccgggctagaggacatctcccctacgccattaccggactccgatgaggatgaggagctggatctgggactgggccctagaccaccacccgaaccaggcccccccgaccccgccgggttgttgtcacaaaccgctgaggtggcgctggacttagttggcgacaggactccgacctccgaaaagatggacgagggtcagcagtcatccggcgaggacatggaaatctccgatgacgagatgccgtctgcgcctataacatccgctgactgccctaaacccatggtcgttaccccaggggctgcagctgtggcagccccttcagtgttagctccgacactccctctgcctcccccgccaggcttcccacctctcccccctccaccaccaccaccaccacctcaaccaggcttcccgatgcccccacccttaccgcctcccccaccgcctcccccaccagcccacccagcggtgactgttcctccaccgcccttgcccgccccacccggggtgccaccgccacctattttgcctccgctgcctccgtttcctccggggctgtttccagttatgcaggttgatatgtctcatgtactggggggccaatggggcgggatgccaatgagttttcagatgcagacccaggtgctcagcagactcatgaccggacaaggagcgtgcccctatccccctttcatggcagctgccgcagctgcagcctctgctggcttacagtttgtgaatctcccaccgtatagaggacctttttctctatcaaacagcggccctggacgcgggcagcattggccccccctgcccaaattcgaccccagtgtgccccctccaggatacatgccccggcaggaagatccacacaaggctacagttgatggtgtgctactggtcgtacttaaagagctaaaagcaattatgaagagagacttgaaccgcaaaatggtcgaggtggttgccttcagggcctttgatgagtggtgggacaaaaaagagcggatggcaaaggcctcactgaccccagtgaagtccggggagcacaaagatgaggacagaccaaagcccaaagatcgcatcgccagctgcctactggagagctggggtaagggagaagggttggggtacgagggcctgggtctcggcattgggttgcggggcgccatcagactgcccagctttaaggtgaaaagaaaggaaccacctgatacgacgtcgtccggcgatcaaaaacgcttgagacccagcacatcagtagacgaggaagacgaagagtccgagagagagagagaccgcgacatggctgatactccctgtgagctggccaagcgggatcctaagggagtgggagtgagacggagaccagcgcgacccctagaactggacagtggaggagaagaagatgaaaaagaaagtctgtccgaggagcaggaatccacagaagaagaggaagaggccgaagaggaggaggaagaagaagatgacgacgacgacgatagcgatgaccgagacgagtcagagaacgatgatgaggataccgccctctctgaagcttctgaaaaggatgagggggatagcgacgaggaggagacagtctctattgtgacatccaaggccgaagcaacctcttcttccgagtctagtgagagcagcgagttcgagagcagctctgagtctagcccttcctcttcagaggatgaggaggaggttgtggcccgcgaggaggaggaggaggaggaggaagaggagatggtagccgaggagagtatggcttctgccggacccgaagattttgaacaggacggcgaggaagcagctttggcccctggcgccccggccgtagattcccttggcatggaggaggaggtggacattgaaaccgaggccgtggccccagaggaaagaccaagtatgctggatgagccacctctccccgtgggggtcgaagagcccgccgattccagagagccgcccgaggagccaggtctgagccaggaaggcgcgatgctcctcagccccgagccccctgcgaaagaggttgaggctcgacctccactgagccctgagagggctcctgaacacgacctcgaagttgagcctgaaccccctatgatgcttcctctccccttgcaaccacctctaccaccacctagaccccccagacctcctagccctcctccagaaccggaaacaacggacgcttcccaccctagcgtccccccagaacctctcgccgaagatcacccaccgcacactcctgggctgtgcggatcgctggccaagagccagtccacagagacagtccccgctacgccgggcggcgagccacccctctctggaggctcatccggcctctctttgagctccccccaggtgccaggcagcccgttctcataccctgccccgagtcccagtcttagctcgggtggtttgcctcggacccctgggcgagacttctctttcacgccaaccttttccgagccatcgggacctctgctgctgcctgtatgccctctgcctacgggccgccgagacgagcgctctgggcctttagctagcccagttctgctcgagaccggcttgccactgccgctgccccttcccctacccctaccccttgccttgcccgctgtgctgcgcgcccaggccagagcccccacacccctgcccccactcctccccgcccctctcgcttcttgtccccctcccatgaagcgaaaacccggacgcccacgcaggagccctccatctatgctgtcactcgacggaccactggtgcggcctcctgccggtgctgctttaggcagggagttactgctacttccagggcaaccccagactcccgtctttccctctactcacgatcctcgtactgtcacactggatttcagaaacgcagggattcccgctcccccccctcccttacctccccagccacccccgcctcctcccccacccccagtggaacctacaaaattgccttttaaggaactcgataaccagtggcccagcgaggctatcccacccgggccccggggtcgcgacgaagttacagaagaatatatggaactggccaaaagcaggggcccttggaggagaccccctaagaagagacacgaggacctggtgcccccggccggatcaccggaactctccccgcctcagcctctgttcaggccacgcagtgagttcgaggagatgacaattctttatgatatatggaatggtgggattgatgaagaagatataaggttcctgtgtgtgacttacgaacgacttctgcagcaggataacggcatggactggctgaatgatacactgtgggtgtaccaccccagcacctcactgtcctctgccaagaagaagaaaagagacgacgggatccgggagcacgtaactgggtgcgcccgctcagaaggcttctacacaatcgataaaaaggataagttgcgctatttaaatagcagccgggcttcaacggacgagcctcctgccgacactcaaggcatgtccatacctgcccagccccacgcttctactcgagccgggtccgaacgaaggtccgagcagcggaggctgctttcctcgtttaccgggtcctgcgactcagatctgttgaagtttaaccagttgaagtttcggaaaaagaaactcaaattctgcaaaagccatattcatgactggggcttatttgctatggagccaatcgctgcggatgagatggtgatagagtatgtcgggcaaaacatccgacaagtcattgccgacatgcgagaaaaaaggtacgaggacgagggaatcggcagcagttatatgttcagagtggaccacgatactattattgatgccaccaagtgtggtaactttgctcgcttcattaaccattcgtgtaatcctaattgctatgccaaggtgataaccgtggagagccagaaaaagatagttatttattccaaacagcatattaatgtcaacgaggaaataacatacgactacaagtttccaatcgaggacgtaaagataccttgtctctgtggcagcgagaactgtcgcggtactctgaattag

SEQ ID NO: 204888 - DNA, 5772 bp, Artificial Sequence
  Description of Artificial Sequence: Synthetic coding sequence
atggagaacagccaccccccccaccaccaccaccagcagccccccccacaacccggtccatctggagagaggagaaaccaccattggcggtcttacaagctgatgatcgaccctgctctgaaaaaagggcaccataagctatatcggtacgacggtcaacactttagtttggccatgtccagtaaccgtcccgttgaaatcgtggaggatcccagagtcgttggaatttggaccaaaaacaaggagttggagctttctgtgcctaaatttaagatcgacgaattttatgttggtcccgtacccccaaagcaggtgactttcgcgaagctgaacgataacatcagggaaaattttctgcgcgatatgtgcaaaaaatatggagaggttgaggaagttgagatcctgtacaacccgaagacaaagaaacatttaggaatcgcaaaagtggtgttcgccaccgttagaggcgcaaaagacgctgtgcagcatctgcactctacctcggtcatgggtaatatcatccacgtcgaactggataccaagggagaaaccagaatgaggttttatgaactgctggtgactgggagatacacaccccagacactgccagtgggtgaactggatgcggtatcgccaattgttaatgaaacactgcagttatccgacgcgctgaagcgcctaaaggacggcggactgtcggcaggatgtggatctgggagttctagcgtaacacccaactccggaggaactcccttctctcaagataccgcctattcaagctgtagactggacacgcccaacagctatggacaggggacccctctgacccccaggctcggtacaccttttagccaagatagctcatattcctcaaggcaaccgactccttcctacctattttcccaagaccctgccgtaacatttaaggcaagacggcacgaatctaagttcacagacgcatacaatcgccgccatgaacaccactatgttcacaattctcccgccgtgactgctgttgctggagcaaccgccgctttccgcgggagcagtgatcttccttttggcgccgtcggaggcactggagggagctccggcccacccttcaaagcccagcctcaggatagcgcgacattcgcccatacgcccccccctgcacaggcaacccccgcccccgggttcaaaagtgctttttctccctaccagacccccgtggcccattttccaccaccccccgaagagcccactgcaacagcggcgttcggtgcccgcgattcaggggaattccgacgggctccggcaccacctcctctgccgcccgctgagccacttgcaaaggaaaagccagggactcctccaggtcctcctccccctgataccaacagtatggaactcggaggcagacctacctttggctggtcaccggaaccttgtgactcccccggcacaccaactctggaaagctcgcccgccggcccagagaagccacatgacagtcttgatagcaggatcgaaatgctcttgaaagaacagcgcactaaattgctgttcttaagagagcccgattctgatacagaactgcagatggagggctcacccatttcctcatcctccagtcagctgtccccgctcgctccgttcggaactaattctcagcccggatttcgaggcccgacccccccatctagccgaccaagttccacaggtctcgaggacataagcccgacccccctcccggactcagacgaggacgaagagctcgaccttggtcttgggcccagaccaccccctgagccggggcccccagatcctgccggacttctgagtcaaaccgccgaagtagcacttgatttggtgggagaccgcaccccaacaagcgaaaagatggatgaagggcagcagtcctctggcgaggacatggaaatatcagatgacgaaatgccatccgctcccataacaagtgctgactgtccgaaacctatggtcgttactcccggcgccgccgcggtggcagcgcctagcgtgttggccccaactctcccccttcccccacctcccggctttccacccctgccacctcccccgccccctccccctccccagccgggattcccaatgccaccccccctacctcctccccccccccctccccctccggcccatcccgcagtgacagtgccaccacctcccttacctgcgcctccgggggtcccgccgccccccattttaccaccgctgccccctttccctcccgggttgtttcccgtcatgcaggtagacatgagtcacgtgttgggcggacagtggggaggaatgccgatgtccttccagatgcaaacgcaggttctgagtagactgatgacagggcagggagcttgcccgtacccaccattcatggcagcagcggcggccgccgcgtctgcaggcctccagttcgtgaatctgcctccctatcgcggaccttttagcttgagcaactccggtcctgggagggggcagcactggccacctctccccaagtttgacccttctgtgcccccacctggatacatgccccggcaagaagatccacacaaggctacagtcgatggcgtactgctcgttgtcttaaaggagctgaaggcgatcatgaagcgggatctgaaccggaagatggtggaggttgtcgccttccgagccttcgacgaatggtgggacaaaaaggagaggatggccaaagcatcccttacacctgtcaaaagcggagaacacaaggatgaggaccgacccaagcccaaggaccgcatcgctagttgtcttctggagtcttggggtaaaggtgaggggttaggatacgaagggttgggacttggcattggcctgcggggggctattcgccttcccagttttaaggtaaaaagaaaagaaccccccgacacaacaagctctggggatcagaagcggctgcgcccttcgacgagcgtcgatgaggaggacgaggaaagtgagcgggagcgtgaccgggacatggccgacacgccctgtgagctagccaagcgggatcccaaaggggtgggggtgagaaggagacccgctagacctctcgaactcgattccggcggggaagaggatgagaaagaaagcctctctgaggagcaggagtctaccgaggaggaagaggaggctgaagaagaagaggaggaggaagacgatgatgatgacgactcagacgacagggatgaaagcgaaaacgatgatgaggataccgcactgagcgaagcctctgagaaagacgaaggagacagcgacgaagaggagactgtgagtatagtcacatccaaggccgaggctacgtcctcctcagagtctagtgagagcagcgagttcgaatccagttcagaatcaagccccagctcatcggaggatgaggaggaggtggttgctagggaggaagaagaggaagaagaggaggaggagatggtggctgaagagtctatggccagcgccgggcctgaagattttgaacaggatggagaggaggccgcattggcacctggggctccggccgtcgacagcctgggaatggaagaagaagtggacatcgaaacagaggctgtggcgccagaggaaagaccctccatgcttgatgagccaccactgccggtgggagtggaggagcccgccgactccagggagccccctgaagaacctgggctctcacaggaaggcgcaatgctgctgagccctgagccaccagctaaggaagtggaagcccgtcctccactcagccccgagcgcgccccagagcacgatttagaggtggaaccagagccgccaatgatgcttccccttcccctccagcctcctctgccacctcctcgaccaccccgacctccatccccgcccccagaacctgagacaactgacgcttcgcatccctcagtgccaccggagccactggccgaggaccacccgcctcacacccccggcctttgtgggagcctcgctaaaagtcagtcaacggagaccgtgcctgccacaccaggcggcgagccacctctgtccggcggcagtagcgggctcagcttgtctagtccacaagttcctggctcccccttctcttaccccgccccctcaccctccctgtcatcaggcggtctgccccgaacgccagggagggatttctccttcacacctaccttcagcgaaccaagcggaccactgctcttgcccgtttgcccattgcccaccgggaggagagatgagcgcagcggtcccctggcttctccggtgctgctcgaaaccggactcccccttcctctacctctaccactgcctctcccactggctctgccagccgtactcagagcccaagcgcgcgccccaactcccttacccccactgctgccagcgcctctcgccagctgtcctccaccgatgaaacggaagcctggccgtccccgccggtcgcccccaagcatgctgagtctggacggcccgctggtgcgccccccggccggtgccgccttgggccgggaattgctgctcctgcctggccagccccagaccccagtgtttcctagcacgcacgaccctcgaaccgtgacactagatttccgcaatgccgggattccagccccccccccaccgctccctccacagcctccaccacccccaccgccgccccctgtagaacccacgaagctgccttttaaggagttggacaatcagtggccttcagaggctatccctcccggacccaggggccgggatgaggtgaccgaagaatacatggaactcgccaagagccgtggaccttggcgccggcctcccaagaagcgccacgaggacctagttccacctgcagggtcacccgagctcagccctcctcagcccttattccgccctaggtctgagtttgaggaaatgactatcctgtacgacatctggaatgggggcattgacgaggaggacataagattcctctgcgtaacgtatgaaagactccttcagcaggacaacggcatggactggctgaatgacaccttgtgggtgtatcacccttcaacatcactgtcttcagctaaaaagaagaagcgagacgacgggattagggagcatgtgacagggtgcgcgagatctgaaggtttctatacaatcgataaaaaagataaactaagatacctcaacagttcccgcgccagcaccgacgaaccccctgctgacactcagggtatgtcaatcccagctcagccccacgcgagcacccgcgccggctcagaacggagatcagagcagcgccgactcctctcctccttcaccgggagctgcgattctgacttgcttaaatttaaccagctaaaatttaggaagaaaaaactgaagttttgtaagtctcacattcatgattgggggttgttcgccatggagcccatcgcggcggatgagatggtaatcgaatatgtggggcagaacatcaggcaagttatcgccgacatgcgggagaagagatacgaggatgagggcataggtagctcttacatgtttcgggtggaccatgacacgatcattgacgctacgaagtgtgggaacttcgccaggtttataaaccactcctgcaacccaaattgctatgctaaagttatcacagttgagagccagaaaaaaattgtcatttactctaaacagcacattaatgtgaacgaggaaataacatacgattataaatttcccattgaggacgttaaaataccctgcttgtgcggctcagagaactgtaggggcacgttgaattag

SEQ ID NO: 204889 - DNA, 7695 bp, Artificial Sequence
  Description of Artificial Sequence: Synthetic coding sequence
atgaagcagctgcagccccagcccccccccaagatgggcgacttctacgaccctgaacatccgacccctgaggaggaagagaatgaggccaagatcgagaatgtgcaaaagactgggttcataaaaggccccatgtttaagggcgtcgcaagcagtcggtttctgcccaagggaactaagaccaaggttaatctggaggaacagggcagacagaaggtttctttttcattcagcttgaccaagaaaacgctgcagaataggttcttgactgccctgggcaatgagaagcagtccgacacaccaaatccccccgccgtgccactgcaggtcgactcaactcccaaaatgaagatggagatcggcgacactctgagcacagcagaggagagctctcctcccaagtcccgcgtggaactcggaaagatccacttcaagaagcacctcctgcatgtaacctcgcgaccactactagccacaacgaccgctgtcgccagcccccccacacatgctgctcccctccctgctgtgatcgccgagtccaccacagtggattcccccccttcaagccctcctccgcccccacctcccgcccaggccaccacactgtcctctcccgccccagttactgagccagtagctctccctcacacacctatcacggtcttgatggcggctcctgtgcctttgccagtcgatgtcgctgtccgtagcctcaaggaacctcctattattattgtaccagagtcgctggaggcagacacgaaacaagatacaatcagcaattccctggaggagcatgtgacgcagatattgaatgagcaggctgacatctccagtaaaaaagaggactctcatatcggaaaggacgaggaaatccccgattcttcaaaaatcagcctgtcctgtaagaagacagggtcaaagaagaagagctctcaaagcgagggcatttttttggggtcggaatctgatgaggacagcgttcggacctcctcctcgcagaggtcacatgacctgaaatttagcgcctctatagagaaggagagagattttaaaaagtcttctgcaccgttaaagtccgaggacttagggaagcctagtagatccaaaactgatcgcgatgataagtatttcagctacagcaaactggagagggatacacggtatgtttcctccaggtgtcgatctgagcgagaacggcgcagatctcgctcacatagtcgctctgaaagaggtagtcgaacaaacctcagctatagtcgcagtgaaagaagtcattactacgattctgaccgccggtaccatagatcctctccttacagagaaagaaccaggtactcgaggccctatactgacaatagggcgcgtgagtcctcagactccgaggaggagtacaagaaaacttacagcagacgaacgtctagccactcctctagctaccgggatctgaggactagctcttacagcaagagtgatagggattgtaagacagaaacgtcatacctggaaatggagaggagaggaaaatactctagcaaattggagagagaatcaaaacgcacatccgaaaacgaagcaattaagcggtgctgcagccccccaaacgaactgggctttcggcgggggtccagctactccaagcacgattctagtgcctctaggtataaatccacattgtccaagcccattcccaaatcagataaattcaagaattcgttttgctgtacagaactgaacgaggaaatcaagcaaagtcattcatttagtctgcagacaccatgctccaaaggaagcgaactccgaatgataaataagaatcccgaaagggagaaggctggcagcccggccccctcgaatcgtctcaatgacagccccacccttaaaaagctggatgagctgcccatcttcaaaagtgagttcataactcatgactcacatgattcaattaaagagttggacagcttgagcaaggtgaagaatgaccagctgaggagcttttgtcccattgaacttaacataaatgggtcccccggcgccgaaagtgatctcgctaccttctgcacatccaagactgacgccgtgctcatgacatctgacgacagcgtcaccgggtcggaactgtcacctctggtaaaagcttgcatgctgtcctcaaatggatttcagaatatcagtcgctgtaaagagaaagacctagacgatacttgtatgttgcataagaagtccgagtcaccgttccgtgagactgaaccccttgtgtcgccccaccaggacaagttgatgtctatgcccgtgatgactgtagattattcaaagaccgttgtaaaagaacccgtggatacacgcgtgtcatgttgtaagacaaaggactccgacatttactgtaccctgaatgattcgaatccatcattgtgtaacagcgaggcggagaatatagaaccctcagtgatgaaaattagcagcaattcctttatgaacgtgcacttggagagtaaacctgtgatttgcgactctagaaacctgaccgaccattccaagttcgcctgcgaagaatataagcagagtattggctctacctcatccgcttctgtgaaccatttcgacgatctgtatcagccaattggtagctctgggatcgcctcgagcctacagtctttgcctcccgggatcaaggtggactctctgacgctgctgaagtgtggcgagaacacatctcctgttcttgatgctgtactgaagtctaaaaagagtagcgagtttctcaagcatgccgggaaagagaccattgtcgaggtgggttcagatctgcctgattcagggaagggatttgcttcccgggaaaacagacggaacaacgggctgagcggcaaatgtttgcaggaggctcaggaagaaggcaacagcattctacccgagaggcgggggaggcccgaaatcagtcttgacgagcggggcgagggtggacacgtgcatacatcagatgacagcgaggtggtgtttagttcttgcgacctcaacttaaccatggaagatagcgacggcgtgacctatgccttaaagtgtgacagttccggacacgcgcccgaaatcgtgagcacagtgcacgaggactactctggcagcagcgagtctagcaatgatgaaagcgattccgaagacaccgactcagatgatagctccattccccgtaacaggctccaatctgtggtagttgttcctaagaatagcaccttgcccatggaagagactagtccatgtagtagtcgctcaagccaatcctacaggcattacagcgatcactgggaggatgagcgcctagaatcgcgcaggcacctgtacgaagaaaaatttgaatctattgccagtaaagcttgccctcagactgataaattctttcttcacaaaggtactgagaaaaatccagagatctcatttacacagtctagccgaaaacagattgacaaccggctacccgaattgagtcaccctcagtccgatggcgttgactccaccagtcataccgatgtgaaaagtgacccactcggacatcccaactccgaggagacagtgaaggctaaaatccccagcaggcagcaagaagaattaccgatttacagctcggattttgaggacgttcccaataagtcctggcagcaaactaccttccagaatagaccggactcccggctgggtaagaccgagctaagttttagtagctcctgtgagattccccatgtcgatgggctgcatagctccgaggagctgaggaacctgggatgggatttttcacaggagaagccatctaccacctaccaacagccggactcttcctatggcgcgtgtggtggacacaaatatcagcaaaatgcagagcagtatgggggcaccagagactactggcaaggaaatgggtactgggatcctcgttctgggagacccccagggacaggagtggtgtatgacaggactcagggccaagtcccggacagtctgaccgacgatcgggaggaggaagaaaactgggatcagcaggacggaagccatttctccgaccagtcagacaagttcttgctttccctccagaaggataaaggttccgtccaagcacctgagataagcagtaatagtatcaaagacacattggccgtgaatgaaaaaaaggatttctccaaaaatcttgagaagaacgacatcaaggatagaggccctctgaaaaagcgtcggcaagaaatagaaagtgattctgagtccgatggagagctccaggaccggaagaaggtgcgggtggaagtggaacagggggagacttcagtacctcctgggagtgctttggtaggtccaagctgcgtcatggatgactttcgtgatccccaacgctggaaggagtgcgccaagcagggaaagatgccttgttacttcgacttaatagaagaaaatgtctatctgacagagcgaaagaaaaataaatcacacagggatatcaaacgcatgcagtgtgagtgcactcccctatctaaagacgagcgggcccaaggagaaattgcctgtggagaagattgtctcaataggctcttgatgatcgaatgtagcagcagatgcccaaacggagattactgctccaatcgtagatttcaaaggaaacagcatgctgacgttgaagtgattctaactgaaaagaagggatgggggctgagggctgccaaagatttgccttccaatacttttgttctggaatactgcggagaggttctggaccataaggagtttaaagccagagttaaagagtacgctagaaacaagaatattcactattactttatggcgctgaagaatgacgagataattgacgctacacagaagggaaattgttctagattcatgaatcatagctgtgaacccaattgtgaaacccagaagtggaccgtcaacggacaactgcgggtcggcttctttacaactaaactggtgccgtctggttccgagctgacttttgattaccagtttcagcggtatggaaaagaagcgcagaagtgtttttgcggatccgcaaactgccgcggatacctgggcggagagaatcgcgtctctattcgtgcagctggcggtaagatgaaaaaggaacgtagtcgcaaaaaggactcagtagacggcgaactggaggcccttatggagaatggagaagggctatccgacaagaaccaggtactgagtctctctaggctgatggttcgaatcgagactctggagcaaaagctgacctgcctcgaactgattcaaaatacccacagtcagtcatgtttaaaatctttcctggaacggcatggattgtccctgttgtggatctggatggcggagttaggcgacggcagagaatcaaaccagaagttacaagaggagattatcaagactcttgaacacttgcctatccccacaaaaaacatgctggaggagtccaaggtgctgcccattatccagagatggagccagacgaagaccgccgttccaccgctgagcgaaggggatggctactcatcagagaatacctcccgggcccacacacccctcaatacacctgatccctccaccaagctgagcacggaggcggacacagacacacccaaaaaactgatgttccgtcgcttgaagataatatccgagaacagcatggacagtgccatttcagacgccaccagcgaactggagggcaaagatggaaaggaagacctggaccagctggagaatgtgcctgtcgaagaagaggaagagcttcagagccagcagctgctgccacagcagctacctgagtgcaaggtcgatagcgagacaaatatcgaggcttccaagctccccacatcggagcccgaggcggacgccgagatagagcctaaggaatctaatgggacgaagctggaagagcctatcaacgaggagacaccaagccaggacgaggaggaaggcgtttcggacgttgagagcgagagaagtcaggagcaaccagacaagaccgtggacataagcgacctcgctaccaagttactcgactcctggaaagatctcaaggaggtctacagaattccaaaaaagtcgcagacagagaaggaaaacacaaccacagagcgagggagagatgccgtcggcttccgcgatcaaactccagcaccaaagacccctaaccggtcacgggagcgggatcccgataagcagacccaaaacaaggaaaagcgaaagcgtcgctcctcgctcagtccaccaagctccgcatacgagagggggaccaagcgccctgatgaccggtacgatacaccaacttccaagaaaaaggttaggataaaagaccggaataagctgagtacagaagaacggaggaagctgtttgaacaggaagttgctcagagagaagcacagaaacagcagcagcagatgcagaacctaggcatgaccagccctttgccctacgattcacttgggtataacgcccctcatcacccatttgcagggtatcctcccgggtatcctatgcaggcatatgtcgaccctagcaatcctaatgccggtaaggtgcttctgcccaccccatcaatggatccggtatgttcacctgctccctatgaccacgcccagcccctcgttggtcacagtacggaacccctatcagctcccccccctgtacctgtggttccccacgtggccgctcctgttgaagtgtcatcatcgcagtacgtagcccagtctgatggcgtggttcaccaagatagcagtgtggccgtactgccagttcccgcacctggtccagttcaggggcagaattactccgtctgggactcaaatcagcaatctgtatctgtgcaacagcagtacagcccggcccaatcccaagccaccatatactatcaggggcagacctgccccacagtgtatggcgtgactagcccctacagccaaaccaccccaccaattgtgcagagttacgctcaaccaagtctgcagtatattcaggggcaacaaatcttcacggcccacccacagggtgtggttgtacagcccgcggcggctgtcaccacaatcgtggcccccggtcagcctcaacctctgcagccgtccgaaatggtggtcaccaataaccttttggacctgccccccccatcgcctcccaaacccaagaccattgtgttacctcccaactggaaaactgccagagatcctgagggtaagatatattactatcatgtaatcactcggcagacccagtgggatccccccacgtgggaatcccccggcgatgatgcctctttggaacacgaggccgagatggacctcggaacacctacgtacgatgagaacccaatgaaggcctccaagaaaccgaagacggccgaagctgatacgagctcggagttagctaaaaagagtaaagaggttttccggaaagaaatgtcccagtttatcgtacagtgtcttaatccatatagaaagccagactgcaaagtcggaaggattaccaccacagaagactttaaacatctagcgcggaagctgactcacggagtcatgaacaaggaactgaagtattgcaaaaatcccgaggacctcgaatgtaacgagaatgtcaagcacaaaacgaaggaatatatcaagaagtatatgcaaaagtttggggcggtgtataagcctaaagaggataccgaactggagtag

SEQ ID NO: 204890 - DNA, 7695 bp, Artificial Sequence
  Description of Artificial Sequence: Synthetic coding sequence
atgaagcagctgcagccccagcccccccccaagatgggcgacttctacgaccccgagcaccctaccccggaagaacaggaaccagaggctaagatagaaaacgttcaaaagaccgggttcatcaaaggaccaatgtttaagggggtcgcctctagcagattcctgccaaagggcaccaaaaccaaagttaatttagaggagcagggcagacagaaagtctcattctcctttagtttgaccaaaaagaccctccagaatcgcttcctgaccgcgttagggaacgaaaaacagagcgatactccaaaccccccagctgtgccattgcaagttgattctacccccaaaatgaagatggagataggagatacactgagcaccgcagaagagagctccccgccaaagagcagagtcgaacttgggaagatccacttcaagaagcatctcctgcacgtcacgtcaaggccactcctcgcgactactacagccgtggctagtccccctacccatgctgcacctttgcctgctgtgatcgccgaatcaacaactgttgactctcctcccagtagcccacctccccctccgccccccgctcaagcgactactttgagcagcccagcccccgtgactgaaccagtggccctgcctcacactcccattactgtgcttatggccgcacctgtgcccttaccagtggacgtggccgttcggtcactaaaggaacctccgatcatcatcgtccccgagtccttagaggccgatacaaagcaggacacaatctcgaattctcttgaggagcatgtcacccagatcctgaacgaacaggccgatatctcctccaagaaagaagattcccacatcggaaaagacgaagagattcccgacagctctaagatatcgctgagctgcaaaaaaactgggagcaagaaaaagtcttcccagtctgagggcatctttctgggttccgagtccgatgaggattccgtacgtacatcctcatcacagagatctcacgaccttaagtttagtgccagcatagaaaaagagcgagattttaagaagagctccgcccctttaaaaagtgaggatctcggaaaaccaagtcgttctaaaacagatcgagatgacaaatacttttcttactcaaaactggaaagagatacacgctatgtgtcaagtcgttgccggagtgagagggagagaaggagatcccgctctcacagcagaagcgaacgaggatctcggaccaacctgagctacagcaggagtgagagatcacattactacgatagcgacagaagatatcacaggtcatccccttacagagagcgtactcgctattcaaggccttacactgataacagagctagagagtcctctgactccgaagaggaatacaaaaagacttactccagacgtactagtagccatagcagtagttatcgagacctaagaacatcatcttatagcaaatccgatcgggactgcaaaaccgagacaagctacctagaaatggagaggcgtggcaagtattccagcaagctggagcgtgaaagcaagagaaccagtgaaaatgaagccatcaaaagatgctgctctccgcctaacgaactgggcttccgacgtgggtctagctacagcaagcatgactcatcagcttccagatataagagcacactctccaaaccaatccccaagtccgacaaattcaaaaattctttctgttgcactgagctgaacgaggagattaaacagagccatagcttcagtctccagactccttgctcgaaggggtctgagctgcggatgatcaataaaaatcctgagcgtgagaaagctgggtctcctgcccccagcaatcggttgaacgacagccctaccctgaagaagctggatgaactccccatcttcaaatcagaattcataactcatgacagccatgactctataaaggagttagactccctgtctaaagtgaagaacgaccagttgcggtcattctgtcccatcgagctgaatatcaatggaagtcctggcgccgagagcgacctagccacattctgtaccagcaaaactgatgcagtgctgatgaccagcgacgattctgtcacggggtccgaacttagtcccttagtaaaggcatgcatgctttctagcaacggctttcagaatatctctcgttgtaaagaaaaggatttggatgacacttgtatgctacacaaaaaaagtgaaagccccttcagagaaaccgagcctttggtgtctcctcatcaggacaaactgatgagtatgcctgtgatgactgtggactattcaaagactgtcgtgaaggagcctgtcgacacccgtgtgagttgctgcaagacgaaggattccgacatctattgtacgctgaatgacagcaatccctccttgtgcaattccgaagctgaaaacattgagccatccgtgatgaagatctcctccaacagtttcatgaacgtgcacctcgagtccaagccagtgatctgcgatagcaggaatctaacagatcactctaaatttgcttgcgaggagtacaaacaatcaataggcagtacaagctcagcttccgttaatcattttgatgacctgtatcagcccatcggctcaagtggcattgcaagctctctccagtcactgccaccaggaatcaaagtggattccctcactctcctgaaatgtggagaaaacacgagccccgttctggacgctgtcctgaaatccaaaaagtcttcagaatttctcaagcatgcaggcaaagagaccatcgttgaagtgggatctgatctgccagattcaggtaaaggctttgctagccgcgagaataggcgtaacaatggtctgtccgggaagtgcctgcaggaggcgcaagaggagggcaacagcatacttccagaacgcaggggaaggccagagatttccctcgacgagcgaggggagggcggtcatgtacatacctcagacgactcggaggtggtgttttccagctgtgacctgaacctgactatggaagactctgatggagtcacatacgctctgaagtgcgatagctcagggcacgcacccgaaattgtgagtaccgtccatgaggattattctggatcttccgagtcctccaatgacgagagtgattctgaggacaccgacagcgatgactcaagtatcccaaggaaccgtctgcagtcggtggtagtggtcccaaaaaactccacactgcctatggaggaaacctcaccgtgttcttcacgctcatctcaatcatatcgccactattccgaccattgggaagacgagcgcctggagtccaggcggcatctttacgaagaaaagttcgagtcaatagcctcgaaagcctgtccccagacagataaattcttcctgcataagggtacagaaaaaaatcccgagattagctttacgcagtccagtcggaagcagattgacaacaggctgcccgagctgagtcatccgcagtctgacggcgttgacagtacatctcacacagacgttaagtcagaccccctgggccaccctaatagcgaagaaacagtaaaggctaagataccctcgcgacagcaggaggagctgcctatttacagtagcgattttgaggatgtcccaaataaatcttggcagcagacaacatttcagaaccgaccggacagccggttgggaaaaactgaattaagcttcagctcttcctgtgagatcccccacgtcgacggcctgcatagctccgaggagctgaggaacctggggtgggatttttctcaggaaaagccgagcaccacctatcaacagcccgattcttcatatggtgcctgcggaggacataagtaccagcagaacgccgagcagtacggagggactcgcgactattggcagggaaacggttactgggatcctagatcaggccgtcctccgggaaccggagtggtgtacgatcggacgcaaggacaggtacctgattcactcactgatgaccgcgaagaagaagagaattgggaccagcaagatggaagtcacttctcggaccagtccgataaattcttgctgagcctgcaaaaagacaaggggtctgtccaggcccctgaaattagctccaactcaattaaagatactctggcagtgaatgaaaagaaggatttttctaaaaacctggagaagaacgacattaaggacagggggccacttaagaagaggaggcaggagattgaatccgatagcgagagcgatggcgagctacaggatcgtaaaaaggtccgggtcgaagttgagcagggtgagacttccgtgccccctggatcagccctcgtggggccttcctgcgtaatggatgactttcgagacccacagcgctggaaagagtgcgccaagcaggggaaaatgccatgctatttcgaccttatagaagagaatgtttatctgacagagaggaaaaaaaacaagagccatcgggatattaaacggatgcagtgtgagtgcactccacttagcaaagatgagcgcgcccagggagaaatcgcctgcggcgaagactgcctgaaccggctcctgatgatagaatgttcgagcagatgcccgaatggcgactactgctcaaacagaagattccaacggaagcaacacgctgacgtggaagtcattcttacagaaaagaaagggtggggtctccgagcagccaaggatcttccgtccaacaccttcgtgctcgaatattgtggagaggtattagaccacaaggagttcaaggcccgagtaaaagagtacgcacgaaataaaaatattcattattactttatggccctgaagaatgacgaaataatcgatgctactcagaaaggaaactgctcccgtttcatgaatcatagttgtgaacccaactgcgagactcagaaatggactgtgaacgggcaactgagagttggtttttttaccaccaaactggtgccttccgggtcagagttgacctttgactaccagttccaacgctatggcaaggaagctcagaagtgtttttgcggcagtgccaattgccgtggatatctgggcggagaaaaccgggtctcaattcgcgccgcaggggggaagatgaaaaaggaacggtcacggaagaaagactctgtcgatggagagctcgaagcgctgatggagaatggagaaggcttgtccgacaagaatcaagttctttccctgagtagactgatggtgagaatagagacccttgagcaaaagctcacctgtttagaactgattcaaaatactcattctcagagctgccttaaaagttttctggaaagacacggactgtccctgctctggatctggatggctgaactgggcgacgggagggagagcaatcagaaattgcaggaggaaatcataaagactctagaacacctgcccattcccactaagaacatgttagaagagtcaaaggttcttcctatcattcaacggtggagccagaccaagactgctgttcctccactcagcgagggtgatgggtacagttccgagaacacttcccgtgcacacactccattgaacacccctgacccgtctacgaaactctctacggaagccgacaccgacacccctaagaaactgatgttcaggcggttaaagattatctctgagaactcaatggattccgcaatatctgatgctacgtcagaactagaaggaaaggacgggaaagaggatctagatcagctcgaaaacgtaccagtcgaagaggaagaagagttgcagagccaacagctactgccccaacagctgcctgaatgtaaggttgacagcgaaacaaacatagaggcctcaaagttacctacttctgaaccggaggctgacgctgagatagaaccgaaggagtcaaatggcacaaaattggaggagcccattaacgaagaaacaccctcccaggacgaggaggaaggtgtgagcgacgttgagtctgaacgaagccaggagcagcccgataaaaccgtcgatatttccgacctggctactaagctactggattcatggaaggacctgaaagaagtgtaccggattccaaaaaagtcccaaaccgagaaggagaatacaaccaccgaaagaggcagagacgcagtggggtttcgggatcaaaccccagcaccaaaaacaccaaatcgctcacgagaacgtgacccagacaagcagacccagaataaagagaagcgcaagagaaggagctcactgtcccccccctccagtgcctacgaacggggaacaaaaaggcccgacgacagatacgatactcccacctctaagaaaaaggtacgcatcaaagacagaaacaaactttctaccgaagagaggaggaagttgttcgagcaggaagtcgcccagagggaggctcagaagcagcagcagcagatgcagaatttgggcatgacaagccctctaccatacgattctcttggctacaacgcccctcaccatccgttcgcaggataccccccaggttaccctatgcaggcctatgtcgacccttcaaacccaaatgccggaaaggtgctgttaccaactccatccatggacccagtctgttccccagcgccctatgatcacgcccagccattagtggggcactccactgaacccctctccgctccaccgcctgttccggtggtgccacacgttgctgctccggtcgaagtgagttcgagtcagtatgtggcccaatccgacggcgtggtgcatcaagactcttctgtggcagtcctgcccgtccccgccccgggacctgtgcaaggacagaattacagcgtgtgggacagtaatcagcagtccgtaagcgtccaacagcagtactctccagcgcagtctcaagccaccatctattatcaagggcaaacatgcccaacagtatacggcgtcactagcccatatagtcaaaccacgccccccatcgtgcagagctatgcgcagccatccctgcagtatatccaagggcagcaaatctttactgcacaccctcagggcgtggtggtgcagccagccgcggctgtgacaacgattgtggcgccaggccagccacagccactccagccaagtgagatggtagtgaccaataacttgctggacttgcctcctccatctccaccaaagcccaaaacaatagtgctgcctcctaactggaaaaccgcaagagatcctgagggcaaaatctactattatcacgtcatcactcgtcagacacagtgggatccacccacctgggagtccccaggcgacgatgccagtcttgagcacgaagcggaaatggatttgggaaccccaacctacgatgagaacccaatgaaggccagtaaaaagcctaaaactgcggaggctgatacttctagcgagctggccaaaaaatctaaggaggtgtttcggaaggagatgtcccagttcatagttcagtgtctaaacccttaccggaagcccgactgtaaagtgggcagaatcacaactacagaggacttcaagcacttggctcgaaagctcacgcatggggtcatgaacaaggaattaaaatattgtaaaaacccagaggacctggaatgtaacgaaaacgtgaaacataagactaaagaatacattaagaagtatatgcaaaaattcggcgccgtttacaaacctaaagaggatacggaactggaatag

SEQ ID NO: 204891 - DNA, 5145 bp, Artificial Sequence
  Description of Artificial Sequence: Synthetic coding sequence
atgaagcagctgcagccccagcccccccccaagatgggcgacttctacgaccccgaacatccaacacccgagaaaaaggaacgggaggccaaaattgaaaatgttcagaagaccggcttcatcaagggtccaatgttcaagggagtggcatcaagccgcttcctgccgaagggtaccaagactaaggttaatctcgaggaacagggccgccaaaaggtttccttcagtttctcactgacgaaaaaaacccttcagaatagattcctgactgccctcggcaacgagaagcagagcgatacccccaatcctcccgctgttcccttacaagtggatagtacaccgaagatgaagatggagatcggggacacactgagcacagctgaggaatctagtcctcctaaaagcagggtggagcttgggaaaatacacttcaaaaaacacctgctgcacgtgacatcgcgtcctctgctggctaccactacagccgtggccagtccacccactcacgcagccccgttgccagccgtgattgctgaaagcacgacagtggatagtcccccctcaagccccccgcctcctccaccacccgcgcaggcaaccactctgtcctcccctgctcctgtaacagagcctgtggctctgcctcacactccgattactgtgttgatggcggcgcctgtgccacttcccgtggatgtcgccgttcggagtcttaaagaaccccccatcattattgtcccagagtcactcgaagctgacacaaaacaagacaccatctctaattcccttgaggagcacgtgactcagatcctaaatgagcaggctgatatatcatccaaaaaggaagattcgcacataggaaaagacgaagagattcccgactccagcaaaatcagtctgtcttgcaaaaaaacgggttcgaaaaaaaagtccagtcaatctgaggggatcttcctcggctccgagagcgacgaagacagtgtccgtacgagtagctcccagcgatcgcatgatttaaagttctcagcctctattgaaaaagagcgcgacttcaagaagagctccgcccccctaaaatcagaggatttgggaaagcctagcagatcaaaaacagaccgcgacgacaagtatttttcctacagcaagcttgagagagacacgagatatgtatccagtaggtgccgatccgagagggagcgccgacggagcagatcccatagccgaagtgaacgaggctcaaggacaaatcttagctacagtcggtcagagaggagccactactacgactccgatagaagataccatagatctagtccttaccgtgaacgtacacgatactctagaccctacactgacaacagggccagggagagctctgacagcgaagaggaatacaagaagacgtattctaggaggacctcctcccattcctcttcttacagagacctgaggacatcctcctactcaaagtctgacagagactgcaagactgagacatcctatctcgaaatggaaaggagaggcaagtacagtagcaagctggagagggagagcaagcgtacatctgaaaacgaagctattaagcgctgttgcagtcctccaaacgagctggggttcagaagaggaagctcttattccaaacatgatagctccgcgtctagatataagtctaccctgagtaaaccgattcccaagagcgataaatttaagaatagtttctgctgcacagagctgaatgaggaaatcaagcagagccacagcttctcactccaaacgccttgttcaaagggaagtgaactgcggatgatcaataaaaaccccgaaagagagaaggctggctcacctgcacccagtaacaggctcaacgattcccccacacttaagaagcttgatgagttacccatctttaaaagcgagtttataactcatgattctcatgacagcatcaaagagcttgactccttgtctaaggtcaaaaatgatcaactgcggtcattctgtcccatcgagctgaatatcaatgggtctccaggagccgagagcgacctggcgaccttttgtacctccaagaccgacgccgtcttaatgacttcagatgattcagtcacaggatccgagctttcaccactcgtcaaggcctgcatgttaagctctaacggcttccaaaatataagcagatgtaaggagaaggatttagatgacacctgcatgctgcacaaaaaaagcgagagccctttccgcgagacggagccactcgtgtcgcctcaccaggacaaactgatgagtatgcctgtgatgaccgtggactatagcaagaccgtggttaaggaaccagtggacacccgtgtaagctgttgcaagactaaagacagtgacatctactgcacactgaacgattcaaatccaagcttatgtaacagcgaagccgagaatattgaaccaagcgtcatgaagatctcatctaattcttttatgaacgtccacctggaaagcaagcctgtgatctgtgatagccggaatctaaccgatcacagcaagtttgcatgtgaggagtataagcaatccattggctccacctcttcagcgagcgtcaaccattttgatgacctgtatcaacccattggcagtagcggtattgccagtagtctgcaaagccttccgcctggtattaaagttgacagtctgacactcttgaagtgtggtgaaaacacttcgcccgtgctagacgctgtcctgaagagcaagaaaagctcagaatttctaaaacatgccggcaaggaaacaatcgttgaagtgggctctgatctccccgattctggaaaaggattcgcgtctagagagaataggagaaacaatggactgtcagggaaatgtctgcaggaggcccaagaggaaggaaacagtatcctgcctgagcgtagaggtaggccagaaattagtttagacgagagaggtgaaggtggacatgtccacacctcagatgacagcgaggtcgttttctcaagttgcgacctgaacttaactatggaggatagcgacggcgttacctatgcattgaagtgtgactcgagcggacatgcaccggaaatagtgagtacagtgcacgaggactatagcggatccagcgagtcgtcgaacgatgaatctgacagtgaagataccgatagcgacgattctagtatcccacgcaacaggctccagtccgtggtggtggtgcccaagaactccaccctcccaatggaggagacctccccgtgctccagcaggagttcccagtcatatagacattactccgatcactgggaggatgaaagacttgaatcacgccgtcatctgtatgaagaaaaattcgaatctattgctagtaaggcctgccctcagaccgacaaattctttctgcacaagggaactgagaaaaacccagagatttcatttacacagagctctaggaaacagatcgataatcggctgcccgagctatctcacccccaatctgacggcgtggacagcacatcgcacaccgacgttaaaagcgaccccctggggcaccccaacagcgaggaaaccgtaaaagccaaaattccttcccgccagcaggaagaattgccaatttactccagcgattttgaagatgttccaaacaagtcctggcagcagaccacatttcagaataggccagactctcgactggggaaaaccgaactaagctttagtagctcctgtgagatcccccatgttgacggactccactcgtcagaggaactccgtaatcttggatgggatttttcacaggaaaagccaagcacaacatatcagcagccagatagtagctacggtgcctgcggtgggcataagtatcagcagaacgctgagcagtacggtggtacccgcgactactggcagggcaatggttactgggaccctcggtccggacgaccacccggcacaggagtggtttacgaccggacacaagggcaggtgcctgattctttgacagatgacagggaagaggaggaaaattgggatcaacaggatggaagccacttttcagaccaaagtgataagtttctgctgagcctgcaaaaggacaagggtagcgtgcaagcgcccgagatctcatcaaacagcatcaaagatactctcgctgttaatgagaaaaaggacttcagcaaaaatttagagaagaatgacatcaaggatcgtggccccctgaaaaaacggcgccaagaaatagaatctgacagtgaatcggacggggagttgcaggatcggaaaaaggttcgcgtggaggttgaacaaggcgagaccagtgtcccccccgggagtgcattagtgggaccttcctgcgtgatggatgactttagagatccacagagatggaaggagtgcgccaaacaggggaaaatgccatgttacttcgacctgattgaagaaaacgtgtacctaaccgagagaaaaaagaacaaaagccatcgagacattaagagaatgcagtgcgagtgcacccctctttcgaaagatgaacgggcacagggtgaaattgcctgcggcgaagattgtctgaataggctgctgatgatcgaatgctcatctcgctgtccaaacggggactactgctcgaatcgccgattccaaagaaagcagcatgctgatgtcgaagtcattctaactgagaaaaaaggatgggggctaagggccgccaaggatttacctagtaatacattcgtgctcgagtactgcggggaggtcctcgatcacaaggagttcaaggcccgggtgaaggagtatgcaagaaataagaacatccactactactttatggctctcaaaaacgacgagatcattgatgctacccagaagggtaattgttctagatttatgaatcatagctgtgagccaaactgcgagacccagaaatggacggttaatggtcagctaagggttggcttcttcacgactaagctcgtgccctccggaagtgaactgacctttgactaccagttccagcgatacggtaaggaagcacagaagtgcttttgtggaagcgctaattgtcggggatacctaggcggcgagaatcgggtctccattcgggcagccggggggaagatgaagaaagaacggtcaaggaagaaggactcttag

SEQ ID NO: 204892 - DNA, 3876 bp, Artificial Sequence
  Description of Artificial Sequence: Synthetic coding sequence
atgagcagcctgcccggctgcatcggcctggacgccgccaccgccacggtcgagtccgaggaaattgcagagcttcagcaagcagttgtcgaagagctcggaattagcatggaggagcttaggcacttcattgacgaggagttggaaaaaatggactgtgtacaacaaaggaagaaacagctagcagaattggaaacgtgggtgatccagaaggagagtgaggttgctcatgtggaccagctgttcgatgacgcctcccgcgctgttactaattgtgagtctctggtgaaagacttttacagcaaactcggacttcagtacagggacagctcttcagaagacgaatcttcacggccgacagaaattatcgagatccctgacgaagatgatgacgtgctctccatcgactcaggtgacgctggcagcaggaccccaaaggaccagaaactgagagaggccatggccgctttgcgtaaatccgcccaggatgttcagaagttcatggatgccgtgaacaagaagtcaagctcacaagacctgcataagggcaccttaagtcagatgtctggcgagttaagcaaggacggcgatctaatcgtgtccatgaggatcctcggcaagaagcgcaccaaaacctggcataaggggaccctgatagcaattcaaactgtgggccccggtaaaaaatacaaggtcaaattcgataacaaaggtaagagccttcttagcggtaatcatatcgcctatgactaccacccaccagcggataaactgtatgtcggctcgagggtggtagccaagtacaaggacggcaaccaggtgtggctctacgccggcatagtggccgaaacgccaaacgtgaagaacaagctgagattcttgatcttcttcgacgatgggtatgcaagctacgtgacccaatctgaattataccccatatgtagaccgctgaagaaaacgtgggaagatatcgaggacatttcctgcagagactttatagaggagtacgtgaccgcataccccaatcgccccatggtacttttaaagtccggacagctgatcaaaacagagtgggagggcacttggtggaagagccgggtagaggaggttgacgggagcctggtacgcatcctcttccttgacgacaagagatgtgaatggatttaccggggtagtacacgcctggagccaatgttcagtatgaagacctccagcgcctctgccctggaaaaaaagcaaggccaacttaggacccgccctaacatgggggccgtgagatccaagggccccgtcgtccagtacactcaagaccttacaggcaccggaactcagtttaagcccgtagagccaccacaacccactgccccccctgcacctccattcccgcctgcacctccactctctccacaagcaggagacagcgatctggagtctcagttagcccagtcgcgtaaacaagtcgccaagaagtctacatccttccgcccaggatctgttggatctgggcatagcagcccaaccagtcccgccctaagcgagaacgtgtcaggaggcaagcctgggattaaccagacatacagatccccactgggcagcactgcctctgcccctgctcccagcgctctgccggccccacctgccccccctgtattccatggaatgcttgagcgcgctcctgcggagccatcgtatagagccccaatggaaaagctgttttacctgcctcatgtttgttcttatacctgtctgagccgtgtcagaccaatgcgcaatgaacagtaccgcggtaaaaaccccctcctggtccccttgctctatgactttcggcgcatgacagcgcgccggcgagttaacagaaaaatgggtttccacgttatctataagacgccctgcggtctttgtctgagaacgatgcaggagatcgagaggtatctgtttgaaacaggctgcgacttccttttcctggagatgttctgcctcgatccgtatgttctcgtagaccgtaagttccagccttacaaaccgttctactacattttggacatcacttatggaaaggaagacgtaccactaagctgcgtgaacgaaatcgataccacccccccccctcaggttgcgtacagtaaagagaggattcccgggaaaggcgtattcatcaacacgggccctgagttcctcgtaggttgtgattgcaaagacggatgtcgagataagtctaaatgtgcatgccaccaacttaccatacaggctacggcctgcacgcctggtggacaaatcaacccaaactccggctaccagtataaacggctcgaggagtgcctcccaaccggcgtttatgagtgcaataagcgctgtaaatgtgacccaaacatgtgcactaatcgcctcgtgcaacacggccttcaggtcagattacaacttttcaagacgcaaaacaaaggctggggaattagatgccttgatgatatagccaagggcagctttgtgtgtatttatgctggcaagattctgaccgacgactttgccgataaagagggcctcgagatgggcgatgaatactttgcgaaccttgatcacattgagtccgttgaaaacttcaaagagggatacgaatccgatgccccttgctccagcgatagttcgggagtggatctaaaggatcaagaagacgggaattccggaacggaggatccggaggagtccaatgacgactcgtcagatgacaacttttgtaaggacgaagacttttctacttcatctgtctggaggagttatgccacccgcagacagaccaggggccagaaagaaaatggactgtccgaaaccacttctaaggactctcatccacccgatcttggtcccccacacattcctgtaccaccctcaatacccgtgggaggatgcaatccccccagctctgaggagactccaaagaacaaggtggctagctggctgagctgcaactccgtgagtgaaggcggattcgccgattccgattctcacagttctttcaagaccaacgagggtggagaagggagggctggtggctctcggatggaggccgagaaagcctctacaagcggcctggggatcaaggacgagggggacataaagcaggcaaagaaggaggataccgacgaccgcaataagatgagtgtagtaacagagagttcccggaattacggctataaccccagccccgttaagccggagggcctccgccggccgccttctaagacatctatgcatcagagtcggaggcttatggcatccgcccagtctaatcccgatgacgttctgaccctatcgtcatccactgagtccgaaggggagagcggtacttccaggaagcccactgccgggcaaaccagcgcgacagccgtggactctgacgacatacagacaatttccagtggatccgagggcgatgactttgaagacaaaaaaaatatgacgggcccaatgaagcgacaggttgctgtaaaatctacccgagggttcgcgctcaagtcgacccacggcatagccattaaatcaactaatatggcctccgtggacaagggagaatctgcccccgtgcgaaagaacaccaggcagttctatgacggcgaggagtcctgctacatcatagacgccaagctggagggcaatcttgggcggtaccttaaccattcctgcagcccaaatttattcgtgcagaatgttttcgtagacacacatgatctgagattcccttgggtggcgttcttcgccagtaagaggatacgcgcagggacagagctaacgtgggattacaactacgaagtgggtagtgtcgaggggaaagagctgctttgctgttgcggcgccatcgagtgcagaggccggctgctgtag

SEQ ID NO: 204893 - DNA, 1194 bp, Artificial Sequence
  Description of Artificial Sequence: Synthetic coding sequence
atgagcagcctgcccggctgcatcggcctggacgccgccaccgccacagtcgagtccgaggagattgccgaattgcagcaggctgttgtggaggagctcggaatcagtatggaggaactgcggcattttatcgatgaagaacttgagaagatggattgtgtgcagcagagaaaaaaacagctggccgaattggagacctgggtgatccagaaagagagcgaggtggcccatgtggaccagctgttcgacgatgcatcaagagcggtaactaactgtgagtccctcgtcaaggatttctattccaagcttggtctgcaatacagggactcctctagcgaagatgagtcctcccgaccaaccgagatcatagagatacctgacgaggacgacgatgtcctaagcattgacagcggggacgctggcagtaggacaccaaaagatcagaaactcagggaggcaatggccgccttgagaaaatctgcccaggatgtccagaagttcatggatgccgtgaacaaaaagagcagctcgcaagacttgcacaaaggtacgctgtctcagatgagcggggagttgtcaaaagacggtgacctgattgtgagtatgaggatcctgggcaagaagagaacaaaaacatggcacaagggcacgctcatcgcaatccagacagtcggacccggcaagaagtacaaggtcaagtttgacaataagggcaagtctctgctgtctgggaatcatattgcttatgattatcatccgcctgcagacaagttatatgtcggctctagggtcgtggccaaatacaaagacggcaaccaagtatggctgtacgccgggatcgtcgctgaaactccgaacgtaaaaaacaagcttaggtttctcatatttttcgatgatggatatgcaagctatgttacccaaagcgagctttaccccatatgccggccactgaaaaaaacatgggaagatatcgaggacatttcctgtagggactttattgaggagtacgtcactgcataccctaaccgacctatggtgctgttgaaatcaggccaactcatcaagactgaatgggagggtacctggtggaagagcagggttgaagaggttgacggtagtttggtgcggatcctcttcctagtcctcttcttctccactatactggaggccgaagttgggggaggaggaacatag

SEQ ID NO: 204894 - DNA, 750 bp, Artificial Sequence
  Description of Artificial Sequence: Synthetic coding sequence
atgagcagcctgcccggctgcatcggcctggacgccgccaccgccactgtggagtctgaagagatcgccgaactgcaacaggccgtcgttgaggagttgggcatcagtatggaggaactgcggcactttatcgacgaggaactggagaaaatggattgtgtgcagcagcgcaaaaagcagctcgcggagctggagacttgggtgattcagaaggaaagtgaagttgcccacgttgatcagctgttcgacgacgcttcaagagcagtgaccaactgtgagagcctggtgaaggacttctattccaagctaggcctccagtaccgtgatagttcgtcagaggatgagtcctcccgccccacagaaatcatagaaattccagatgaggatgatgatgtgctgagtatagattctggagacgccggatctcgaacaccaaaagatcaaaaactgcgggaggccatggctgcactccggaagagtgcccaggacgtacagaaatttatggatgcggtgaacaaaaaatcttcaagccaggacttacacaaaggtacactcagtcaaatgtcaggtgagctctctaaggatggcgacctgattgtgtctatgaggattttaggaaaaaaacgcactaagacctggcataaggggactctgattgccatccagaccgtcggatttagtttcagtctcatgatggctatgctgcctatgtctcatagccgcaactgcattcccttcgccggtcactag

SEQ ID NO: 204895 - DNA, 3873 bp, Artificial Sequence
  Description of Artificial Sequence: Synthetic coding sequence
atgagcagcctgcccggctgcatcggcctggacgccgccaccgccaccgtggaaagcgaagaaatcgccgaactgcagcaggcagttgtagaagagctcggaatcagcatggaagaactcaggcacttcatcgatgaagaactggagaaaatggattgtgtgcaacagcgcaaaaaacagctcgctgagctggaaacctgggtcattcagaaggaatcagaagtcgctcacgttgatcagctgtttgacgacgcctcgcgtgcagtcacaaattgcgagagcctcgtcaaagacttctacagcaaactcgggctccaataccgcgacagttcaagcgaggatgagagctcccggccaacagagattattgagatccctgacgaggacgatgacgttttgtcaattgactccggcgatgccggcagtcggacgcccaaggatcagaagttgcgggaggcaatggccgctctcaggaaaagcgcacaggatgtgcagaaattcatggatgccgttaacaagaagagctcctcgcaagatctccacaaagggacactctctcagatgtccggggaattaagtaaagatggagacctaatcgtttctatgcgcatcttaggaaagaagcgcacaaaaacgtggcacaaaggaactctgatcgcaattcagacagtaggccccggaaagaagtataaggtcaaattcgataacaagggcaaatctcttctgagtggaaaccacatcgcctacgactaccacccccccgcagacaaactatatgtgggatcacgcgttgtcgctaagtataaagatgggaaccaggtatggttgtacgctggaatagtggcagagacacccaacgtaaaaaataagctacgatttttaatcttctttgacgacggatacgcatcctacgttactcagtcagagttgtaccccatttgtagacctctgaaaaagacctgggaagatatagaggatatctcttgccgggactttatcgaagagtacgttacagcgtatcccaatagacctatggtgcttctcaagtccgggcagcttattaaaactgagtgggagggaacctggtggaagagtcgagttgaagaggtagacggttcactggtgcgtatcctgtttctggatgataagcggtgcgagtggatttaccgtgggtcaacacggttggagcccatgtttagcatgaaaacctccagtgcttctgccctggaaaaaaagcagggacagctgcgcacacgaccaaacatgggagccgtgcgctccaaagggccggtggtgcaatacacccaggatttgactgggacaggaacccaatttaaacccgtggaacctcctcagcctaccgcaccccctgcaccccctttcccccccgccccccctctgtcacctcaggctggcgactccgatttggagtcccagctggctcaaagccggaaacaagtggccaaaaagagcacaagcttcaggcctggcagcgtgggttccggtcactcatcgcccacttctcctgccctaagcgagaatgtgtccgggggcaagccggggatcaaccagacgtataggtcccctcttggcagcactgcttctgccccagccccaagtgccttgcctgcgccccctgctcccccagtgtttcacggaatgcttgagagggctcctgctgagccttcataccgggcaccaatggagaagctcttttatctccctcatgtctgcagttatacgtgtctctctagagtgcgaccgatgcgtaacgagcagtacagagggaagaatcccctgcttgtgcccctcttgtatgacttccggcggatgaccgcccgtaggcgggtcaatagaaagatggggtttcatgtcatctacaagaccccttgcggtctatgtttaaggacaatgcaggaaatagagcgttacctctttgaaactggatgtgattttctcttcttggagatgttttgcctcgacccgtacgtcctggtggaccgcaagttccaaccttacaagcccttctactatatccttgatatcacctatgggaaagaagatgtgccgctgtcatgcgtcaacgagatagacaccaccccacccccgcaagttgcatactcaaaagaaaggatccccggcaagggggtgttcatcaataccggtcccgagttccttgttggttgtgattgcaaggatggctgcagggataaaagcaagtgcgcctgccatcagttgaccattcaagccactgcgtgtacccctggagggcagatcaaccctaactcggggtatcagtataagagactggaggaatgtttacccactggagtttatgagtgtaacaaaagatgtaagtgtgaccctaatatgtgtaccaataggctggtgcagcacggcttgcaggtcagactgcagctgttcaaaacacaaaataaggggtggggaattaggtgtctcgacgacattgcaaaaggaagtttcgtgtgcatttacgcgggcaaaattctgaccgatgactttgcggacaaagaaggactagaaatgggggatgaatacttcgccaaccttgatcacatagaatccgtggaaaattttaaggagggttatgaaagcgacgcaccctgcagcagcgatagttccggtgtggacctaaaggatcaagaagatgggaatagcggcacggaggaccctgaagaaagcaacgatgatagctccgatgataacttctgtaaagacgaagacttcagtacctcctccgtgtggcgcagctatgcgactcggagacagacaagagggcaaaaagaaaacggtctctctgagaccacaagtaaagactcacacccccctgatttagggcctcctcacattcccgtccctcccagcatccccgttggtgggtgtaatccaccctcttccgaggaaacccctaagaataaagtagctagctggctgagttgtaactcggtgagtgagggcgggtttgcggactccgactcacactcttcatttaagaccaacgagggtggggagggtcgggccggtggctcacgtatggaggcagagaaagcttctaccagtggattgggaattaaggatgagggcgacatcaagcaggctaagaaagaagacactgacgacagaaataaaatgtcggtggtaacagagtccagtcgtaactatggctataacccatcgcccgttaaaccagagggccttcgcaggccaccatccaagacaagtatgcaccagtctcgcaggctgatggcctccgctcagtcaaatcccgacgatgtgctcaccctgtcatcatccaccgagtcagaaggcgagtcaggaaccagcaggaaaccaacagcggggcaaacctcagcgactgccgttgactccgatgacatccagaccatttcaagtgggagtgagggggatgacttcgaggacaagaaaaatatgacaggtcccatgaaaagacaggtggccgtgaaatcgacgcgcggctttgcgttaaagtctacacatggtattgccattaagagtacaaacatggctagcgtggacaaaggagagtctgcacctgtgcgcaagaatacccggcaattttacgacggggaagagagttgctatatcatcgacgccaaactggaaggtaatcttggcagatacctgaatcatagctgttcgccgaatcttttcgtgcagaatgtgttcgtggacacacatgacctcagattcccatgggttgccttcttcgccagcaagattagagcagggaccgaactcacctgggactataattacgaggtgggatcagttgagggcaaggagctgctgtgttgctgcggggcgatcgaatgccggggtaggctgctatag

SEQ ID NO: 204896 - DNA, 504 bp, Artificial Sequence
  Description of Artificial Sequence: Synthetic coding sequence
atgagcagcctgcccggctgcatcggcctggacgccgccaccgccactgtggaaagcgaagagattgctgagttgcagcaggctgtggtagaggaacttggaatttctatggaggagctccggcattttatcgatgaggagttagagaagatggattgtgtgcaacaaaggaaaaagcagctagcagagctggagactgtaggaccaggcaaaaaatacaaggtgaagtttgacaataagggcaaatctctgctgtctggcaatcacattgcgtacgactatcaccctccggctgacaaactgtatgtgggttctcgggttgtggctaagtataaggacggaaatcaggtttggctctacgcaggcatcgtggcagaaacgcccaatgtcaagaataaactgcgcttcctcatattcttcgacgatggctacgccagctatgtgacacaatctgaactgtacccgatttgccgcccccgggagtgtttttcccttattccctag

SEQ ID NO: 204897 - DNA, 471 bp, Artificial Sequence
  Description of Artificial Sequence: Synthetic coding sequence
atgagcagcctgcccggctgcatcggcctggacgccgccaccgccaccgtcgaatccgaagagatcgcagagcttcagcaggcagttgttgaagaactgggtatctccatggaggagctgcgccacttcatcgacgaggagctggagaaaatggattgtgtccagcagagaaagaagcagctcgccgagctagagacttgggttattcagaaagaaagcgaagtggctcacgtggatcagcttttcgacgacgcctcccgggcagtgacgaactgtgagagtctagtcaaagatttctattcaaaactcggcctgcagtaccgcgacagttcgagtgaggatgaatctagtcggcctacagaaatcatcgagatccccgatgaggacgacgacgttctgtcgattgattcaggggacgccggttctcggaccccaaaggatcaaaaactccgcgaagcaatggccgcttag

SEQ ID NO: 204898 - DNA, 3780 bp, Artificial Sequence
  Description of Artificial Sequence: Synthetic coding sequence
atgagcagcctgcccggctgcatcggcctggacgccgccaccgccacggtggagtccgaggaaatcgctgagctgcagcaggctgtggtggaggaactgggtatttcaatggaggaacttcgccactttattgacgaagagcttgaaaagatggactgcgtgcagcagcgcaagaaacagttggccgagctggaaacatgggtgatacagaaagaatctgaggtggcccatgtcgatcagctcttcgatgacgcctctagggccgtcacaaattgcgagagcttggttaaagacttttatagtaaacttgggctccaataccgcgacagtagctcagaagacgaatcttctcggcctacggaaatcatcgaaatcccggacgaagacgacgacgtgctgagcatcgattccggagatgccggttctaggactccaaaggaccagaaactgagggaggccatggccgctctgcgtaagagcgctcaggacgtacagaagttcatggacgctgtcaacaagaagagctctagccaagacctgcataagggcaccttgtctcaaatgagtggtgaactttctaaagatggagatcttatcgtgtcgatgcggatcctgggcaagaagaggaccaaaacgtggcacaagggaaccctgatagctattcagaccgtgggacctgggaagaaatacaaagtgaaatttgataacaagggcaagagtcttctcagcggcaatcacatcgcctatgactaccaccctcccgcggataagctatatgttggctcgcgagttgttgctaagtataaggatggaaaccaagtttggttgtacgcgggaatcgtagcggagactcccaatgtgaagaataaattgagatttctaatcttcttcgacgatggttacgccagctacgtgacacaatctgaactgtatcccatttgccgcccccttaaaaaaacctgggaagatatagaggatatctcttgccgggatttcatcgaggagtatgtgacggcatacccaaatcgtcctatggttcttttaaagtccggtcaactgatcaaaaccgagtgggagggaacatggtggaaatccagggtcgaggaggtcgatggcagtctcgtgagaattctgttcctggatgacaagaggtgtgagtggatctatcgcggaagtacacggctggagccaatgttcagcatgaagacaagctccgctagtgccctcgaaaaaaaacaaggccagctgcgcacacgtccgaacatgggggccgtgcggtccaagggccccgtagtgcaatacacgcaggatctgactggaaccggaacccagttcaaacctgtggaacctccccagcccactgcgcctcccgctccaccttttcctcccgcccctccactgagcccgcaggcaggcgatagcgacctcgagtcccagttagcccagtctagaaagcaggtggccaagaagtctacctcgttccgacccggatccgttggctctggccatagcagcccaacctctcccgccctctcagagaatgtttccgggggaaagccaggcatcaaccaaacttaccgatctcctctgggatccactgcctcagctcccgccccatccgccctgcctgctcccccagctcctccagtttttcacgggatgctggagcgagcaccggccgagccaagctaccgtgcacccatggaaaaactgttttacttgccacacgtttgcagctacacctgcctgtctagagtgaggccaatgcggaatgagcaataccggggaaagaacccacttctcgtacccctcttgtacgacttcagacgtatgactgctcgcaggagagtcaatcgcaagatggggttccatgtcatatataaaacaccttgcggactgtgtctccggactatgcaagaaattgagaggtatctgtttgagactggctgcgatttcctgtttctcgagatgttttgcttggatccatatgtgttagtggaccgcaagttccagccttataagccattctattatattctcgacatcacctacggcaaggaggatgttccgctgagttgcgtcaacgaaattgatacaacacctcccccccaggtcgcatattcaaaggaaagaatacctgggaaaggagtgtttattaacaccggccccgagttcctcgtggggtgtgactgcaaggatggctgtcgcgacaaatccaaatgtgcctgccatcagctgacgatccaagccacggcttgcacacctggaggacagattaatccaaacagcggctatcaatataagcgcctcgaagagtgtcttccaactggggtctacgaatgcaataaacggtgtaagtgcgaccctaacatgtgtactaaccggctcgtccagcatggactgcaggtacggctccaattgttcaaaacccagaacaagggttggggcatcaggtgcctggacgatatagccaaaggttcctttgtttgcatttacgcagggaagattctcacagacgatttcgcagacaaagagggcttggaaatgggcgatgagtactttgcaaacctcgaccacattgagtccgtagagaactttaaagaaggctacgagtcagacgccccatgctctagcgactccagtggggtcgacctaaaggatcaggaagatggaaacagtggcactgaagaccccgaggagtcaaatgacgacagcagcgacgataacttttgtaaagacgaagacttcagtacgtccagcgtttggaggtcatacgccactaggcgtcagacacggggccagaaggagaacggactctccgagaccacatccaaggactcccaccctcctgacctggggcccccacacattcctgtgcccccaagtatccctgtagggggctgcaacccaccttcttctgaagagacccccaaaaacaaggtagcatcctggctgagttgcaactcagtgtcagaagggggcttcgccgacagcgacagccactcatcgtttaagaccaacgaaggtggtgagggacgcgcggggggatcgagaatggaagctgagaaggcgtctacaagcgggctggggatcaaagacgagggcgacatcaaacaggccaagaaggaggataccgatgatagaaacaaaatgagtgtggttactgagtcaagccgcaactacgggtacaaccccagtcccgttaagcctgaggggctgagacggcctccatcaaaaactagcatgcatcagtctagacgtctgatggcctcggcacagtccaaccccgacgacgttctgacgttatcttcttccaccgaaagcgaaggcgaatcaggaaccagtagaaagcctactgccgggcagacaagcgcaaccgcagtggattccgacgacatccagaccattagttccggaagcgagggcgacgacttcgaagataaaaaaaacatgacaggtccgatgaaaaggcaggtcgccgtgaaaagtacccggggctttgccctcaagtcaacacatggaatcgcaatcaaaagtactaacatggcaagcgtggataaaggcgagagcgctccggttcggaagaacacgcgccagttttatgacggcgaggaatcatgttacattatcgacgcaaaactcgagggaaatctggggcggtatctcaacgttaggcccctatccccccctctggatgccggcctctcgcatgggcctcagatttcctttaatatcctttacaaacctttttcttgttacaagctgttaatttctaagtag

SEQ ID NO: 204899 - DNA, 492 bp, Artificial Sequence
  Description of Artificial Sequence: Synthetic coding sequence
atgagcagcctgcccggctgcatcggcctggacgccgccaccgccacggtggagtctgaggagattgctgagttgcagcaggccgtcgttgaagaacttggtatctcgatggaagagctcagacactttattgacgaagaactggagaagatggactgtgtccagcagcggaaaaagcagctagcagagctagagacttgggtcattcagaaggagtccgaagtagcacacgtcgaccagttgttcgatgatgccagtcgggctgtgaccaactgcgaaagtttggtcaaggacttctatagcaagctgggccttcaataccgagatagctccagcgaagacgagtcaagtcggccgaccgagatcatagaaattcccgatgaggacgacgacgtgttgtccatcgattcaggcgacgcagggagccgcaccccaaaagatcaaaagctaagggaagctatggcggctctgagaaaatccgcacaggactag

SEQ ID NO: 204900 - DNA, 1911 bp, Artificial Sequence
  Description of Artificial Sequence: Synthetic coding sequence
atgagcagcctgcccggctgcatcggcctggacgccgccaccgccactgttgagagcgaggaaatcgcagaactgcagcaagcggtggtcgaagaactggggatatctatggaagagctcaggcacttcatagacgaggaactggaaaaaatggattgcgtgcagcaacggaaaaaacagcttgccgaactcgaaacgtgggtgattcagaaggagtccgaggtggctcacgtagaccagttatttgacgatgcctcaagagccgtaacaaattgcgagtccctggttaaggatttctatagcaaacttggcctgcaatacagagactcttccagcgaggatgagtccagcaggccaactgagatcatcgagatcccggacgaggatgatgatgtcctgagtatcgacagcggcgacgctgggtctcgaacgcccaaggaccagaagttaagagaggccatggctgccctgagaaaaagtgcacaggatgtgcagaaattcatggatgccgtgaacaaaaagtccagttcccaggacctgcacaagggcacactcagccaaatgtccggggaattatccaaagacggcgatctgattgtctctatgcgcatattaggcaagaaacggactaaaacatggcataaaggcaccctgattgccattcagactgttgggcctggtaaaaagtataaagtcaagttcgataacaaaggaaagagtctgctgtctggtaatcacatcgcatacgactatcaccctccagctgataaactgtacgtaggatcacgggtggtggccaagtacaaagacggtaatcaggtgtggttgtatgcaggtattgtcgccgagacacctaacgtcaagaataagctgaggttcctcatttttttcgacgatggttacgcgagctacgtaacccagtctgagctgtacccgatttgcaggccccttaaaaagacatgggaggatatagaggatatatcgtgtcgcgattttatcgaagaatatgtcactgcttatcccaacaggcctatggtactactaaaatctggacagctgatcaagaccgaatgggagggaacctggtggaagagccgcgtggaagaggttgatggctctctggtacgcatactgttcctagatgacaaacgatgtgagtggatatatagaggttccactagattggagccaatgttttccatgaagacatctagtgcctccgcgcttgaaaagaagcagggccagttgcgaactaggcctaacatgggagccgttcgctcaaaggggccagtagttcagtatacacaagacctgaccggaacgggcactcagtttaagcctgttgaacccccacagcctacagccccacccgcaccgccttttccaccagcccctccgctgtcaccccaggccggcgactctgaatctcttgagagtcagctggcgcagagtaggaagcaggtggctaagaaatcaacttcttttcgcccaggctcagtcggctctgggcactcctctcctacatcaccggctcttagtgaaaacgtctctggggggaaacccggtattaatcaaacctatcgaagccctttgggatcaactgcgagtgcccctgcgccatcagccctgcccgcgccaccagctcctcctgttttccacggcatgttggaacgcgctcccgccgaaccatcatatagagcacccatggagaagctgttctatctcccgcacgtatgttcttatacctgtcttagccgggtccgccccatgagaaatgaacaatatcgaggaaaaaatccactcctagtgcctctactgtatgattttcggagaatgacagcccggcggagggttaaccgaaaaatgggattccatgtgatctataagacaccatgtggtctgtgtctgtag

SEQ ID NO: 204901 - DNA, 2160 bp, Artificial Sequence
  Description of Artificial Sequence: Synthetic coding sequence
atgggcgagaagaacggcgacgccaagaccttctggatggagctggaagatgatggtaaggtcgacttcatttttgaacaggtgcagaacgtactacagtcattgaaacagaaaataaaggacgggtctgcgactaataaggaatacattcaggcgatgattctagtgaacgaagccaccatcatcaactcttctacctcgattaaaggcgcctcccagaaagaagtaaacgcacagagctccgaccccatgcctgttactcagaaagagcaggagaacaagagcaacgcctttcctagcacctcctgtgagaattcattcccagaagactgtacattcttaaccactgaaaacaaagagattctttcactggaggataaggtggttgattttagggagaaggactcctcctcaaatctgtcctaccagagtcatgattgttcaggagcatgcttgatgaaaatgccattgaatctgaagggcgagaatcccctgcagctcccaattaagtgccactttcagaggagacatgcaaagaccaacagccatagctccgctctgcatgtttcctataagaccccctgcggacgcagcctgcggaatgtggaagaagtgttcaggtatttattggagactgaatgcaacttcctgtttaccgacaatttttcttttaacacctatgtgcagctggctaggaactatcccaaacagaaagaggttgtgtccgatgtggacatatcaaacggggtggagagcgttcctatctccttttgcaatgagatcgacagccggaaattaccccagtttaagtataggaagacggtttggcctagggcatacaaccttactaatttcagttctatgtttaccgattcatgcgattgctccgaagggtgtatcgacatcacaaaatgcgcatgcttgcagctaacagccagaaacgccaaaacatcgccgctgtcatccgataagatcacaactgggtataagtacaaaaggcttcagcgccagattcccaccggcatctacgaatgtagtctgctgtgtaagtgtaaccgacaactctgccagaatagagtcgtacagcacggaccacaggtcaggcttcaggtgtttaaaacggagcaaaaggggtggggagttagatgtttagacgacattgatcggggtacgtttgtgtgtatttatagcggccgcttgctgtctcgcgcaaatactgagaagagctatggcatcgacgaaaatggccgcgacgagaatacgatgaaaaacatcttctctaagaagcggaagttagaggttgcctgttccgattgtgaagtcgaggtgctgccactcgggctcgagacgcaccctaggacagcgaaaaccgaaaagtgcccgcctaagttttcaaataatcccaaggagctgacggtggaaaccaagtatgacaatatttctcgcatccagtaccactcagtgatccgcgatcctgaatccaaaactgccatcttccagcacaacggaaagaaaatggagtttgtctcctctgagagtgttacccctgaggacaatgacggcttcaagcctcccagggagcacctgaacagtaaaaccaagggtgcacagaaagattccagttctaaccacgtcgatgaatttgaggacaatctcctcatcgaatcagatgtgatcgatattaccaagtaccgggaagaaaccccccctagaagtcgatgcaaccaagctacgacactcgataaccagaatataaaaaaggccatcgaggtccagattcagaagccacaggaaggccgaagcacggcctgtcaacgccagcaggtgttctgcgacgaagaattgctctcggaaacaaagaatactagttccgacagcttaacaaagtttaacaaagggaatgtgtttttactggatgccacaaaagagggcaacgttggtagatttcttaaccattcatgctgccctaatttattggtgcagaacgtgtttgtggaaacccataatcgcaactttccccttgtcgcattttttactaataggtatgtgaaggctcgaacagagctgacatgggactacgggtatgaagcaggcactgtgcctgaaaaagaaatattttgccaatgtggcgttaacaagtgtaggaagaagattctctag

SEQ ID NO: 204902 - DNA, 2124 bp, Artificial Sequence
  Description of Artificial Sequence: Synthetic coding sequence
atgggcgagaagaacggcgacgccaagaccttctggatggagctggaggatgatggcaaagtagacttcattttcgaacaggtgcagaatgtgttgcagtctctgaagcaaaagatcaaagacgggtctgctactaacaaggagtacattcaagctatgatcctcgtcaatgaagccaccataatcaactccagcacctccataaaggaccctatgccagtgacccaaaaggagcaagagaataaatcgaatgcatttcccagcacctcgtgtgaaaactccttccccgaggattgcacctttctgacgacagaaaataaggagatactcagcttagaggataaagtagtggatttccgcgagaaagactccagttcgaatctgagctatcagagccatgactgctctggtgcctgtcttatgaagatgccgctgaatttaaaaggcgaaaatcccctccagctgccaatcaaatgtcacttccagcgccgccacgccaagacaaactcacactcaagcgctctgcacgtgagctacaagaccccctgtggaaggtcactgagaaacgtagaggaggtgttccgatatctgctggagaccgagtgtaattttctttttaccgacaatttttctttcaatacctacgtccagttagcaagaaattatcctaagcagaaggaagtggtcagcgatgtcgatattagcaacggcgtggagagcgtcccaatttctttctgcaatgagatcgattcccggaagctacctcagtttaagtatcgcaagacggtttggccccgtgcttacaacctgacaaatttttcgagcatgttcacagattcatgcgattgttcagagggctgtatcgatattacgaagtgcgcttgtctgcaactgacagccagaaacgctaaaacctcccctctcagctcagataaaatcactacagggtacaaatacaagcgactgcaaaggcagatccccaccggcatttacgaatgttccctgctgtgtaaatgcaacagacagctctgccagaaccgagtagtccagcacggtccacaggtacggctacaggttttcaaaacggaacagaagggttggggagtgaggtgcttggacgatatagatcgcggtacgtttgtgtgcatttatagcggacggctcctatcccgtgctaacacggaaaagagctacgggatagatgagaacggtcgggacgagaacacgatgaagaatatatttagcaagaaacggaaactggaagtggcgtgctcagattgtgaggtcgaggtattgcctctgggcctggagacacatccaagaacggcgaaaacagagaagtgtccaccaaaattctccaacaaccctaaagaattaactgtggagacaaaatatgataatatctcaagaatccagtaccatagcgtcatccgggaccccgagtcaaaaacggccattttccaacataatggtaaaaagatggaatttgtgtcctccgaaagtgtgactcctgaggataatgatggcttcaaaccacctcgcgaacacctgaattctaagaccaaaggcgctcaaaaggactccagcagcaaccacgtggacgaatttgaagataatttactaattgagtcggatgttatcgatatcactaagtatcgtgaggagaccccacctagatcaaggtgcaatcaagctacaacgctggataatcagaatataaagaaggcgattgaggtacagatccagaagccacaggagggacggagtaccgcttgtcagaggcaacaagttttttgcgacgaggaactcctgtccgaaaccaagaacacatcctctgatagcctcacgaagtttaacaaggggaacgtgtttttactggatgcgacaaaggagggcaacgtcgggagatttcttaaccattcctgttgtccgaacttgctcgtgcagaatgtttttgtggaaactcataacagaaacttcccgttggtagcattttttaccaacagatacgtgaaggccaggaccgagctaacttgggactacggctatgaggcagggactgttccagagaaggaaattttctgtcagtgtggggtaaataagtgtcgtaaaaagatcctgtag

SEQ ID NO: 204903 - DNA, 975 bp, Artificial Sequence
  Description of Artificial Sequence: Synthetic coding sequence
atgagccggcccagcagcaccggccccagcgccaacaagccctgctcaaagcaacctcctcctcagccccagcatactccaagtcccgctgcccctcctgccgcagcaaccatcagcgcggcgggcccaggcagttcggctgtgcctgcagccgctgcagtgatctcaggacctgggggcggcggcggggcaggtcctgtctctccccaacatcacgagttgacgtcactgttcgaatgccctgtgtgttttgactacgtgttgcctcctattctccagtgccaggccggacatttggtttgcaatcagtgccggcagaagctgagctgttgccccacgtgtcggggtgccctgactcccagtatcaggaatttagcgatggaaaaagtcgcatcagctgtgctctttccatgtaagtatgccaccacaggatgcagtctgaccctgcaccataccgaaaaacccgagcatgaggatatatgcgagtaccgaccatacagttgtccctgtccgggagccagctgtaaatggcagggatccctggaggccgtaatgagccacctcatgcacgcacacaagtccatcacaactctacaaggagaggacatcgtgttcctggcaactgacattaatctgcccggggccgtggattgggtaatgatgcagtcctgtttcggacaccatttcatgctcgttctggagaagcaggagaagtatgagggccaccagcagtttttcgccatagtcctcctgatcggcaccagaaaacaagccgagaacttcgcttatagattagaactgaacggtaaccggcggaggctgacctgggaggctacgccgaggtccatccacgatggagtcgctgctgccatcatgaacagtgactgcctcgtgtttgacacagccatcgcccatctcttcgccgacaatggtaatttgggtataaatgtgacgatcagcacctgttgtccatag

SEQ ID NO: 204904 - DNA, 990 bp, Artificial Sequence
  Description of Artificial Sequence: Synthetic coding sequence
atgatgagcaacagcagcagcgagatcgacgtgatcaagacccggataccaacatacgatgaagacgataacacaatcctgtatgcctacgaaacgaagcccgagtttgtcaacaaagagccaaacatagtctcggacgcatcctgcaataccgaggagcaattaaagactgtggatgacgtcctgatacactgtcaagtgatttacgatgccctgcagaacttggacaaaaaaatcgacgtcatacggagaaaagtgagcaagatccaacgcttccatgctagatccctgtggacaaatcacaaacggtacggatacaagaaacactcttatcggctggtaaagaaactgaaactccagaaaatgaagaaaaatgaggtttatgagaccttttcctaccctgagtcatattctcccactctgcccgtttcccggcgtgaaaacaattctccatccaatttgccccggccctctttctgtatggaagaataccaacgagctgagctcgaggaagaccccatattgtcacgtacgcccagtcccgttcaccccagcgacttctccgagcataattgccaaccttattatgctagtgacggtgctacatatgggagttcctcgggcttgtgcctgggaaaccccagagccgacagcattcataacacttattcaaccgatcacgcatctgccgcccccccctcggttaccaggtccccggtagaaaacgacggttatatcgaagaagggagcattaccaagcatccctctacgtggtcagttgaggctgtggtgttgttcctcaaacagaccgacccccttgctctgtgcccactcgtcgacttgtttcggtcacacgagatcgacggtaaggcgctgctactcctaacatctgatgtgctgctgaaacacctcggggtgaagttgggtacagctgtgaagctgtgctactatattgacaggctgaagcaaggtaaatgttttgaaaattag

SEQ ID NO: 204905 - DNA, 909 bp, Artificial Sequence
  Description of Artificial Sequence: Synthetic coding sequence
atgatgagcaacagcagcagcgagatcgacgtgcaggagcccaacatagtgtctgacgctagctgcaataccgaggagcaacttaagacagtggatgatgtgctgatacactgccaggttatctacgatgctctgcaaaaccttgacaagaagatcgatgttattaggaggaaagtcagcaagattcaaagatttcacgcccggtcgctgtggaccaatcataaacgctatggctacaagaagcacagctataggctcgtaaagaagttgaaactgcagaaaatgaagaaaaatgaagtgtacgaaacttttagctatcctgagtcctactcccctaccctgcctgtctcaagacgtgagaacaattctccttccaatttaccacgcccctccttctgtatggaggagtaccaaagggctgagctggaggaagatcccatcctctcacggaccccctctcccgttcatccatctgatttttccgaacacaattgccagccatactacgcaagcgatggcgccacttacggcagttcctctggactgtgtcttggaaaccctcgcgccgatagcattcacaatacttactcaactgaccacgccagtgccgccccacctagtgtgacccgctctcctgtggagaacgacggctacatcgaggaggggagcatcaccaagcacccgtctacctggtccgtcgaagctgtcgttctcttccttaagcaaaccgacccgcttgcgctgtgtcccctggtcgacctctttagatcccatgaaatcgacggaaaggccctcctactcctgactagtgatgtattgttaaaacatttaggtgtcaagctgggaaccgcagtgaaactgtgttattacatcgacaggttgaaacaagggaagtgttttgagaattag

SEQ ID NO: 204906 - DNA, 627 bp, Artificial Sequence
  Description of Artificial Sequence: Synthetic coding sequence
atgaagaagaacgaggtgtacgagaccttcagctaccccgagagctacagcccaacacttcctgtaagcagacgagagaataatagcccgagcaatcttccacgtccctctttctgtatggaagaataccagcgcgcggaattggaggaggatccaattctttcgagaacaccatccccggtgcacccatcagacttctctgagcataactgccagccttactacgctagtgatggcgcaacgtacggatctagctccggactttgcctggggaatccgcgcgcagattctatccataacacttatagcaccgatcacgctagcgcggcaccaccttccgtgacacgcagccccgtagagaacgatggctacatagaggaggggtccatcacgaagcacccaagcacatggagcgtggaggcggttgttttgtttctgaaacagacagaccctttagccctgtgcccgctggtggacctctttcgctcccatgaaattgacggaaaagcactgctgctgttgacctcagatgtgctcttgaaacatttgggggtgaagctggggaccgcggttaagttgtgctactatatcgacagactgaaacagggaaagtgcttcgagaattag

SEQ ID NO: 204907 - DNA, 627 bp, Artificial Sequence
  Description of Artificial Sequence: Synthetic coding sequence
atgaagaagaacgaggtgtacgagaccttcagctaccccgagagctattctccaacgctaccagtgagtaggcgagaaaacaactctccttctaacctcccgcgtcctagcttttgtatggaagagtaccagcgggccgagctcgaagaggacccaatcctgtctcggaccccgtccccagtacaccccagcgacttcagcgagcacaactgccaaccatactacgcatcggatggcgccacatacggctcttcgtctgggctttgtctggggaatccccgggccgactcaatccacaacacttattcgaccgatcatgcgtccgccgccccacctagcgtgacccgatctcccgtggaaaatgacggatatatcgaggagggcagcatcactaaacacccatcgacttggagcgtagaggccgtcgttcttttcctgaaacagaccgatcctctggctttgtgcccgttggttgatctgttccgctcccatgagatcgatgggaaggctttgctgctcctcacatcggatgtgctgttgaagcatctcggcgtgaaactgggcactgccgtgaaactctgttactatatcgaccgtctgaaacagggtaagtgcttcgaaaattag

SEQ ID NO: 204908 - DNA, 447 bp, Artificial Sequence
  Description of Artificial Sequence: Synthetic coding sequence
atgatgagcaacagcagcagcgagatcgacgtgcaggagcccaacattgtcagcgatgctagttgtaatactgaagagcagctgaagacagtggacgacgttttgatccactgtcaggtgatctatgatgctcttcaaaatctggataaaaaaatcgatgttataagaaggaaggtgagcaaaatacaacgctttcatgcaaggtcactttggacgaaccataagcggtatggctacaagaagcactcctacaggctcgtgaaaaaactgaaattacagaaaatgaagaaaaacgaggtatacgagacgtttagctatcccgagtcatattccccaactttacccgtcagccgccgcgaaaataacagtccctctaacttaccacgcccctcgttctgcatggaggaatatcagcgcgccgaactggaggaagaccctattctttag

SEQ ID NO: 204909 - DNA, 2103 bp, Artificial Sequence
  Description of Artificial Sequence: Synthetic coding sequence
atgggccagaccgtgaacgaggacagcatggacgtgaagaaggagaaccaggaaaaaacgccacagagcagcacctccagcgtgcaaagggatgacttccactgggaggagtatctgaaagagaccggatctatctccgccccatcagagtgtttccgacaatctcaaattccccccgttaacgatttcaaagtgggaatgaagcttgaggcccgtgacccccgaaacgccacttctgtgtgcattgcgacggttattggcatcacaggcgcgagattacgactccggcttgacggcagcgacaacagaaacgatttttggcggctcgtagatagccccgacatccaacccgtaggcacctgcgagaaagaaggcgaccttcttcagccccctctgggttaccagatgaacacaagcagttggccaatgtttctcctgaagacgttaaacgggagcgaaatggccagtgccactcttttcaaaaaggaacctcctaagccccctcttaataatttcaaggttggcatgaagctcgaggccatagacaaaaaaaacccatatctcatttgccccgctactatcggtgacgtaaagggagatgaggttcatatcacttttgacggctggagtggcgcatttgactactggtgtaaatacgattccagagacattttccccgcagggtggtgtcggctgacaggagacgttctgcagccaccgggcacaagcgtcccgattgtcaagaatatcgccaagaccgagagctctccgtccgaggcttcccagcattccatgcagagccctcagaagacaacgttaatcctgcccacacagcaggttcgtagaagcagccgcatcaaacctcctgggccaaccgcggttcctaaacggagttccagcgttaaaaacattactcccagaaagaaaggacctaacagcgggaagaaggaaaagccactcccagtgatttgttctacatccgctgcaagtctgaagagtctgacacgcgatcgggggatgctgtacaaagacgtggctagcggcccatgtaaaatcgtgatgtccaccgtatgtgtatatgtgaacaaacatggtaatttcggaccccatctggatcccaagcgtatccagcagctgcctgaccattttgggcccggaccagttaatgtggtcttgaggagaatagttcaggcttgcgtggactgtgctctggagactaagaccgtgtttggttacctcaagcccgataatagagggggcgaagtcattactgctagtttcgatggggagactcactctatccagctaccgcctgtaaatagcgccagctttgccctccgctttctggagaatttttgccacagccttcagtgcgacaacctgttaagtagccagcctttttcctcaagccgaggccacacccatagttcagctgaacacgacaagaatcagtccgccaaggaggacgttacggaaagacagagcacaaagcgctcccctcagcagaccgtcccctatgtggtgcccttaagccctaagctgcctaagactaaggaatacgcaagcgagggtgaaccactgtttgctggaggttctgctatacctaaagaggagaacttgtctgaggatagtaaaagcagcagccttaactcaggcaactacctgaaccccgcttgtaggaatcctatgtacattcacactagcgtatctcaggacttcagtcgcagtgttcccggcacaacttcttccccactcgtcggagatatcagtcccaaaagctctcctcatgaggtcaaattccaaatgcagcgtaaatcagaagccccatcatacatcgccgtcccagatccgtccgtgctcaaacagggctttagtaaagacccttccacttggtctgttgacgaagtgatccaattcatgaaacacacagatcctcaaatcagtggccctctggccgatctattccggcagcacgagattgatggaaaagccttattcctgctgaagagcgatgtaatgatgaagtacatgggcctgaagctggggccagccctcaaactctgttactacattgagaagctcaaagagggtaaatattcatag

SEQ ID NO: 204910 - DNA, 1038 bp, Artificial Sequence
  Description of Artificial Sequence: Synthetic coding sequence
atgcagagcccccagaagaccaccctgatcctgcccacccagcaggtcagacgaagttcgcgcatcaagcccccaggaccaacagccgttcctaagaggtcttcctctgtgaagaacataacccctcgaaaaaaaggcccaaactccggaaagaaggaaaagccgttgcccgtgatctgctcgacctctgcggcctcattaaagtctcttaccagagaccgagggatgctgtataaggatgtggcctctggaccatgcaaaattgtgatgagtaccgtttgtgtttatgtcaacaaacacggaaattttggcccgcatcttgaccccaagcggatccagcaactcccagatcacttcgggccgggacccgtgaacgtcgtgttacggcgcatcgtgcaggcctgtgtcgattgcgctctagagaccaaaaccgtgtttgggtaccttaaacccgacaacaggggtggggaagtgatcacagccagttttgacggcgaaacacacagcatccagctccctcctgtgaactctgcctccttcgcactgcggttcctggaaaatttctgccacagcttgcaatgcgacaatctcctgtcaagtcagcccttttcttcgagtagaggacacacgcactcttccgccgagcacgataagaaccagtccgccaaggaagacgtgactgagcgccagtcaaccaagaggtccccacagcagacagtgccatatgtcgtccccttaagtccaaagcttcccaaaaccaaagagtatgctagcgagggcgaacccctgtttgccggggggagcgctatacccaaagaggaaaacctgtcggaggactctaagtcaagcagccttaacagtggaaactaccttaacccagcatgcagaaatcccatgtacatccatacctctgtgtcacaggacttttcaaggtccgtccctggcacgacttcaagcccccttgtgggcgacatcagccccaaatcttccccccatgaggttaaattccagatgcagcgcaagtcagagggtaattag

SEQ ID NO: 204911 - DNA, 378 bp, Artificial Sequence
  Description of Artificial Sequence: Synthetic coding sequence
tgagccaaggaggacgtgaccgagcggcagagcaccaagcggagcccccagcagacagtcccatacgtggtgcctctgagccctaaactgcccaaaactaaggagtatgcaagtgagggagaacctctcttcgcagggggaagcgctattcccaaggaggaaaacttatcagaggattcaaaatcttcgtctctgaattccgggaactaccttaatccggcctgtcgcaatcccatgtatattcatactagtgtaagccaggatttcagtagatctgtgccagggaccactagttcaccactggtgggcgacatatctcccaagtcttccccacacgaagtgaagtttcaaatgcagcgtaaatcagaaggcaattag

SEQ ID NO: 204912 - DNA, 1734 bp, Artificial Sequence
  Description of Artificial Sequence: Synthetic coding sequence
atgggccagaccgtgaacgaggacagcatggacgtgaagaaggagaatcaagaaaagacaccccaaagccagatcccgcccgtcaacgattttaaagtggggatgaagcttgaagctcgtgatcctcgcaatgcaacttctgtgtgcatcgccaccgtgatcggcatcacaggtgccaggctgcggcttcggctcgatggctctgataatagaaacgatttctggagattggttgatagccctgatatccagcctgtgggaacgtgcgagaaagagggagacctgctgcaacctcctctggggtaccagatgaacacttcaagttggcccatgttcctgcttaaaacacttaacggtagtgagatggcctctgcgacgctgtttaaaaaggagcctcctaaaccaccccttaataacttcaaagtcggaatgaaactagaagccatagataagaaaaacccatacctgatctgccctgctaccattggcgacgtcaagggtgatgaagtccatatcacattcgacgggtggtcaggagcctttgactactggtgcaagtacgatagccgcgatatcttccctgcaggatggtgccgactaaccggagatgtcctacagcccccagggacttctgtgcccatcgtgaaaaatattgctaaaacagaaagctcgccaagcgaggccagccagcatagcatgcagtccccccaaaaaaccaccctgattctgcctacccagcaggtccgcaggtctagtcggattaagccaccgggtcctaccgccgtccccaaacgctcttcatccgtcaagaacattacaccacggaaaaaggggccaaacagtggcaagaaagaaaagcctctgccagttatctgcagtacttctgctgccagtctgaagtctcttacccgagaccgtgggatgctgtataaagacgtggcctcaggcccgtgcaagattgttatgagcacagtgtgcgtatatgtgaacaagcacgggaattttggtccgcacttggatccgaaaaggattcagcagctgccagaccactttggtccggggccagttaacgttgtgcttagacgaattgtgcaagcctgtgtggattgcgcccttgagaccaagacggtgttcgggtacctgaaaccagataacagaggaggcgaggtaatcacagctagcttcgatggggaaacgcattctattcaactccccccagtaaattcagcttcctttgcactgcgcttcttggagaatttctgtcactcccttcagtgcgataacctgttatctagccagccattttcatcctcacgcgggcacacacattcatcagccgagcacgacaagaaccagtctgctaaagaggacgttacagagagacagagcaccaaacgcagcccccagcagaccgttccctacgtcgtgccgctgtctcccaaactaccaaagacaaaggagtatgccagtgaaggtgaaccactctttgccggcgggtccgctatcccaaaggaggagaatctatccgaggattctaaatctagctcccttaactctgggaactacctgaatcccgcttgtcgcaaccccatgtatatccacacttctgtctctcaggacttcagcagaagcgtacccgggaccactagttctcccctggtgggggacatctcacccaagtcatcacctcatgaagtgaagtttcaaatgcagaggaaatccgaaggaaactag

SEQ ID NO: 204913 - DNA, 615 bp, Artificial Sequence
  Description of Artificial Sequence: Synthetic coding sequence
atgcagagctacgccagcgccatgctgagcgtgttcaacagcgacgactacagtccggcagtgcaggaaaatattcctgccttgaggcgatcaagctcctttttatgtactgagtcttgcaactcaaaataccagtgtgaaactggtgaaaatagcaaaggaaatgtgcaggaccgggtcaaacggccgatgaatgctttcatcgtatggagccgagatcagcggcggaagatggctctcgagaatccccgcatgcggaacagtgagatcagcaaacaactagggtaccaatggaaaatgctgacagaagccgagaagtggcccttttttcaggaagcccagaaactgcaggccatgcatcgggagaaatacccaaactacaagtacaggcctaggcggaaggctaaaatgctgccaaaaaattgctctctcctgcccgctgaccccgcatccgtcctttgcagcgaagtccagttggataacagactttaccgagacgactgtaccaaggctacccactcacggatggaacaccagctgggtcacctgccccctatcaatgccgcctctagtccccagcagcgagatagatattcacactggactaaattgtag

SEQ ID NO: 204914 - DNA, 594 bp, Artificial Sequence
  Description of Artificial Sequence: Synthetic coding sequence
atgcagagctacgccagcgccatgctgagcgtgttcaacagcgacgattactccccagcggtacaggagaacatccccgctctccgaaggtcatccagctttctctgcactgaaagctgcaattccaagtaccagtgcgaaaccggtgagaattctaagggcaatgtgcaagaccgcgtaaaacgccctatgaatgcattcattgtgtggtctagggaccagagaaggaaaatggcccttgagaatccgcgcatgcgcaatagcgagatcagcaagcagttgggatatcaatggaagatgctgacagaggccgaaaagtggcccttttttcaggaagctcaaaagcttcaagccatgcaccgggagaaatatccgaattacaagtaccgaccaagacgcaaggcaaagatgctgccaaagaactgctccctcctgccagccgacccagctagcgtgctgtgtagcgaggtgcagctggacaaccgactgtaccgagatgattgcaccaaagctacccatagccgcatggagcaccagctgggccatttacctccgattaacgctgccagcgctgccactggacccttgcaatag

SEQ ID NO: 204915 - DNA, 498 bp, Artificial Sequence
  Description of Artificial Sequence: Synthetic coding sequence
atgcagagctacgccagcgccatgctgagcgtgttcaacagcgacgattacagccccgccgtacaggaaaacatacctgcccttagaagaagtagtagttttctctgtaccgaaagctgtaatagtaaataccaatgtgaaactggggagaacagtaagggaaacgtacaggacagagtgaagcggccaatgaacgccttcatagtatggtcccgagaccagcggcgcaagatggctcttgagaatccacgaatgagaaactccgagatttccaagcagctaggctaccagtggaagatgttgaccgaagcggagaagtggcctttctttcaggaagcccaaaagctccaggcgatgcacagagaaaaatatccaaactacaagtatcggccacgacgaaaggctaaaatgttgccgaaaaactgctcactcttgcctgccgatccagcctcggtcctttgtagtgaagtgcagggacagcaagtggttcagggctag

SEQ ID NO: 204916 - DNA, 3729 bp, Artificial Sequence
  Description of Artificial Sequence: Synthetic coding sequence
atgaagaacctgctgaccgagaagtgcatcagcagccacaacttccaccaaaaagtgatcaagcagcggatggaaaagaaggttgactctaggtattttaaagacggggccgtaaagaaaccttacagcgctaaaaccctctctaataagaagagcagtgcaagctttggcatccgtagggaacttccaagtactagtcatctggttcagtatcgaggaactcatacatgcacaagacagggtcgcttgcgagagttgcggatccgatgcgtcgcccggaaatttttgtacctgtggattaggatgacatttgggagagtttttccctccaaggccagattttactacgagcagagactgcttcgcaaggtgttcgaagagtggaaagaggagtggtgggtcttccaacacgagtggaagctgtgcgtacgggccgattgccactacaggtattacctgtacaacctcatgttccaaacctggaagacctacgtgcgacagcaacaagaaatgcggaacaagtacattagggccgaagtgcacgacgcaaagcaaaagatgcggcaggcatggaagagctggctgatctacgtggtggtccgaaggaccaaactccagatgcaaacaaccgcactggaattcagacagcgcatcatcctgcgggtgtggtggagtacctggcggcagcggctcggtcaggtgagggtaagccgcgccctccatgcttcagctctgaagcaccgggccctctccttacaggtccaggcctggtcccagtggcgcgaacagttgctgtatgtgcaaaaggagaaacagaaggtcgttagcgccgtgaagcatcatcaacattggcaaaagcgacgctttctgaaagcgtggctggagtatctgcaggttagaagagtgaagcgtcagcaaaatgagatggctgagagatttcatcatgtgaccgtactgcagatttatttctgcgattggcaacaagcttgggaacgccgggaatcactatatgctcaccacgcccaagtcgagaagcttgctcgcaaaatggcgttgcgacgagctttcacacactggaaacactacatgctgctgtgcgcagaagaagcagcccagttcgaaatggctgaagagcatcacagacattcacagctgtacttttgctttcgcgcacttaaggataacgtgacacacgcccatcttcaacagattaggcgtaacttggctcaccagcagcatggggtgacgttgctacaccgcttctggaatctttggcggagtcagatagagcagaaaaaagaaagagagttgctccccttactccacgcagcttgggatcactacaggatagcacttctgtgcaaatgtattgagctctggctgcagtacacccagaagcggaggtataagcagcttctgcaagctagagctgacggccatttccagcagagagctctcccggcagccttccacacatggaatcgcctttggaggtggcgtcatcaggaaaacgtactgagtgctcgcgctaccaggttccaccgtgaaacgttggaaaagcaggtgttttctttatggagacagaagatgtttcagcaccgggagaataggttagctgaaagaatggctatcctgcacgcagaaagacagttactctatcgcagctggtttatgtggcaccaacaggccgctgctaggcatcaggaacaggaatggcagaccgtggcatgcgctcaccacaggcatggccggttgaagaaggcattttgcctgtggcgcgaaagtgcccagggtctgaggaccgagcgcacgggtagggttcgcgcagcagagttccatatggcccaactgctgagatgggcctggtctcaatggagagagtgccttgcgttacggggcgccgaacggcagaaactgatgcgcgcggacctgcatcaccagcactctgttttacatcgtgccttgcaggcctgggtgacctatcaaggtagggttcggagtattctaagggaggtggcagcacgggaaagtcaacataataggcagctgctgcgaggcgctctccgcaggtggaaggagaataccatggctagggtggacgaggccaaaaagacgttccaggcctccacccattatcgaagaactatttgctccaaagttctggtccagtggagggaagccgtgtcagtgcagatgtactatagacaacaggaggactgtgccatttgggaagcacagaaggtgcttgaccgtggatgcctccggacttggtttcagaggtggtgggactgtagccgacgttcagcccagcagagactccaattagaacgggcagttcagcaccatcaccgccagctgctgttggagggcttagccagatggaagacccatcacctgcaatgcgtgcggaagcgacttttgcaccgccagtccactcagctgctggcacagagattgagtcgtacctgcttccgccagtggagacagcagctcgcagcgagaagacaagaacagcgtgccaccgtacgggccctctggttctgggccttctctttgcaggccaaagtatgggcaacgtggctggcattcgtactggagcggcggcgaaagaaagctcgcttacagtgggcactccaggcctatcagggacagttgttgcaggagggcgctaccaggctgttgagatttgctgcatccatgaaagcatcccgtcagcagctgcaggctcaacaacaggtgcaagctgctcactccctgcacagagccgtgcggcgatgcgccaccctgtggaaacagaaagtcctgggcaggggggggaagccacagccccttgctgcgatcgccccttccagaaaggtcacctttgagggtccacttttgaatcggatcgcggccggtgccggcgatggaactttagaaacgaaaagacctcaagcgtcccgcccactgggggccctggggcggctcgccgccgaagagcctcacgcattagagctgaacactgctcactcagcgaggaagcagcctcggcgcccacacttcttgctcgaaccagcgcagagtcagagaccccagaaaccgcaagagcacggtttaggaatggcccagcctgcagccccctctctgaccagacccttcctagcagaggccccaactgccttagtgccgcactccccccttcctggcgctctgtcaagtgctcctggccctaagcagccacccactgcctccaccggccctgagctcctcctgctgccactttcctcctttatgccatgtggcgcagctgcacctgctcgcgtctctgcccagagggcaacaccaagagataaaccgcccgtgccatctagcctcgcctcagttcctgatcctcatttactgctgcctggagacttctcagctacaagggctggccccgggctgtctactgcagggagtcttgacttggaggctgagcttgaggagatccagcagcagctattgcactaccaaactactaaacagaacctctggagctgcaggagacaggcgtcatccctcaggaggtggctagagctgaacagggaagagcctggccctgaggatcaggaagttgagcagcaggtgcagaaagagctggagcaggtggagatgcagattcagcttcttgccgaggaactgcaagcacagcggcaaccaatcggcgcctgtgtagcccgcatacaggctctccgtcaggctttatgttag

SEQ ID NO: 204917 - DNA, 3483 bp, Artificial Sequence
  Description of Artificial Sequence: Synthetic coding sequence
atgaagaacctgctgaccgagaagtgcatcagcagccacaacttccaccaaaaggtgattaaacagcgaatggagaagaaggtggacagcaggttttattatgagcagcgtttactacggaaggtcttcgaggaatggaaggaagagtggtgggtattccagcatgagtggaagctctgcgtccgagccgattgccattatcgatattacctctacaacctgatgtttcagacatggaagacttacgtgagacagcagcaagaaatgcgcaataagtatatcagggcagaggtccatgacgccaagcaaaaaatgaggcaggcttggaagtcatggctgatctatgtggtggtgagaaggactaagcttcagatgcaaacgacagcgttagaatttcgccaacgaattatactgagagtctggtggagcacatggcggcagcggctagggcaagttcgcgttagcagggccctccacgcctccgcactgaagcacagagctctgtccctccaggtacaggcctggagccagtggcgcgagcaactgctctacgtccaaaaggaaaaacagaaagtcgtgagtgctgtgaagcaccaccagcactggcagaagagaaggtttctgaaggcctggcttgaatatctgcaggtgcgccgtgtaaaaaggcaacagaatgagatggctgagcggttccaccatgtgacagttctccagatttatttttgcgattggcagcaagcatgggagcgaagggaaagcctttacgcacaccatgctcaggtggaaaagctcgccagaaagatggccctgcgaagagccttcactcactggaaacactatatgttgctctgtgcagaggaggctgcacagttcgaaatggcagaagaacaccataggcactctcaactgtacttctgcttccgcgccttaaaggacaacgtcacacacgcgcacttacagcagatccgacgaaacctggctcatcaacaacacggtgtaaccctgctccaccgtttctggaatctgtggcggtcgcagatcgaacagaaaaaagaacgggaattactcccattgttgcacgctgcgtgggatcactaccggatcgccctcctttgtaagtgcatagagttgtggttgcagtacactcagaagaggaggtataaacagctactgcaggcccgcgctgacgggcatttccagcagagggctctccccgcggcatttcatacctggaatcggctgtggagatggcgccaccaagaaaatgtgcttagcgcacgggcaacgcgattccatagagaaaccttggagaagcaggtctttagtttatggaggcagaaaatgtttcagcacagggagaacaggttagccgagaggatggccatccttcacgccgagcgtcagcttctgtatagaagctggttcatgtggcatcagcaagcagctgctaggcaccaggagcaggaatggcaaacagtcgcgtgtgctcaccaccgccatggcaggctgaaaaaggccttttgtctgtggagggaaagtgctcaaggcctgagaactgaacgcacagggcgggtgagagccgccgagttccacatggcccagctactgcgctgggcatggagccagtggagggagtgtctggcattgcgcggggccgaacgccagaagttaatgagagccgacctgcaccatcaacacagtgtcctgcacagagctctgcaggcctgggtgacttatcaaggaagggtgcgctctatcctgagggaggtcgccgctagggagtcccagcataatcgccagttattgcgaggggctttacgccgatggaaggagaacacaatggcacgggtggacgaagctaagaaaacgtttcaagccagcactcattaccggaggaccatttgctccaaagtgctggtccagtggagagaggccgtgagcgtgcagatgtattacaggcaacaggaagattgcgccatttgggaagctcagaaggtcttagaccgagggtgccttaggacttggtttcagcgttggtgggattgcagccgaagatcagcacaacaaagactccagctggagcgcgcggttcaacaccatcaccggcagttattgctggagggacttgcacgctggaagactcaccacctgcagtgcgttcggaaaaggcttcttcaccggcagagcactcaactcctggctcagcgtttaagtcgaacttgcttcagacaatggagacagcaattggccgcccggcgccaggaacagcgagctaccgtcagggcactgtggttttgggccttctcgctccaggctaaagtatgggcaacctggctggcctttgtgctcgaacggaggcgcaaaaaggcccgactgcagtgggctctgcaagcataccaagggcagctcctccaggagggtgcaacacgattactccgttttgctgcgagtatgaaagccagccggcagcagctccaggctcagcagcaggtccaggcggctcactccctacaccgcgccgtccgtagatgtgccaccctgtggaagcagaaggtgctgggccgtggcggcaagcctcagcctctcgctgccatcgccccatcacggaaggtgactttcgaagggcctctgttgaacaggatcgctgctggagccggggacggaaccctggaaacgaaaaggccacaagcctcccggcctctgggggccctcggacgtctggctgccgaggagccccacgcgttggagcttaatactgcccactcagcccgcaaacagccgcggcgcccccactttctgctagagccagcccagtctcagcggccacaaaagccacaggaacatggcttaggcatggcacagcctgccgctccgagtcttacacgaccattccttgctgaggcgcctacggccctggtcccacatagcccccttcctggagctctttcatccgcaccaggcccaaagcaaccccccacagcctcaaccggacctgagttgctcttgctacctctgagctcctttatgccgtgcggcgcagctgcgcctgcaagggttagcgcccaacgagctactccccgggacaaaccgcccgttccgtctagcctagcgagcgtacccgatccccacctattgctcccaggagacttttcagctacccgtgcagggcctggcctttctaccgcgggctcactcgacctcgaggcagaattggaagagatccagcagcagctgttacattaccagaccacaaagcaaaacctgtggagctgtcggcggcaggcctcaagcctgcgccgttggctggagcttaacagagaagagcctggcccggaggaccaggaggttgaacagcaggtgcagaaggagttggagcaggtggaaatgcagatacagctgttagccgaagaactgcaggcccaaagacagccaattggtgcgtgtgtcgcacggatccaggccctgcggcaagcgctctgctag

SEQ ID NO: 204918 - DNA, 3096 bp, Artificial Sequence
  Description of Artificial Sequence: Synthetic coding sequence
atgaagaacctgctgaccgagaagtgcatcagcagccacaacttccaccagaaggttataaagcagcgcatggaaaagaaagtggactctcgcttctattatgagcagaggctgctccggaaagtatttgaagaatggaaggaggagtggtgggtattccagcacgagtggaaactctgcgtgagagcggattgccactaccgagtctggtggagcacctggaggcagaggctcgggcaggttagagttagccgggcgctccatgcctcagcattaaagcaccgagccttgtcccttcaggttcaagcatggagccagtggcgggaacagttactgtatgttcagaaggagaagcagaaggtcgtgtctgctgtgaagcatcatcaacactggcagaagagacgcttcctgaaggcctggctggagtacctgcaggtaaggagagtaaaaaggcagcagaacgaaatggcagaacggttccaccacgttactgtattgcagatctatttctgtgattggcaacaggcgtgggagcgcagggagtccctgtacgcccaccacgcccaggtggagaagctcgcacgcaagatggctttgcgcagagcgttcacccattggaagcactacatgttactgtgcgccgaagaggctgcccagtttgaaatggccgaggagcaccatcgccattcacagctctatttttgtttccgagcactgaaggataatgttacccatgcacatctccagcagataaggaggaacctcgcacaccagcagcacggtgtcactctcttgcacagattttggaatctgtggcgcagccagatcgaacaaaagaaggaaagagagctactcccactactgcacgccgcgtgggaccattaccggatcgctctcttgtgtaagtgtattgaactgtggctgcagtacacccagaagcgtcggtacaagcagctcctgcaggcccgcgctgacggccacttccagcagcgcgcgcttcccgccgcattccacacatggaaccgtctgtggcgttggcgccatcaggagaatgtgctgtcagctcgcgccacccgcttccaccgtgaaaccttggagaagcaggttttctcattatggaggcaaaagatgtttcagcatagagagaataggctggcggagagaatggccatcttgcatgcagagcgacagttgctgtataggagctggtttatgtggcaccagcaggcagcagcacgccatcaagaacaggaatggcagactgtcgcctgcgcacatcatcgacacgggcgcttaaaaaaggcattttgcctctggagagagagcgcccagggtctgcgaacagagcggaccggaagggtccgggcagcagagtttcacatggcacagcttctcaggtgggcctggagtcagtggagagagtgtctcgccctacgcggagctgaacggcagaagctcatgcgtgccgacctgcaccatcagcactccgtgctccatcgcgctctccaagcgtgggtgacctaccaaggcagggtgcgatcaattctgcgtgaagtggcagcaagggagtcccagcacaacagacaactcttgcgaggcgctctaagaagatggaaagaaaatacaatggcccgcgtcgatgaggcaaagaagacctttcaagctagcacacactacagaagaaccatctgtagcaaggtgctcgtgcagtggcgcgaggccgtgtctgttcagatgtactacaggcaacaagaggattgcgctatttgggaagctcagaaggtgctggaccgcggatgtctccgcacgtggttccagagatggtgggactgctccagacgatctgcccagcagaggctgcaattggaaagagccgtccagcaccaccatcgacaattgctgctggaggggctcgcaaggtggaaaacacatcacctgcaatgtgtgagaaagaggctgttgcatcggcagagcacccagttactggctcaacggctgtcccgaacctgcttccgtcaatggcggcagcaacttgcagcgcggcgccaggaacaacgtgctacggtgcgggccctgtggttctgggctttctctctacaggcaaaggtgtgggccacatggctggcattcgtactggaacgccgacgtaaaaaagcccgcctccagtgggccctgcaggcctatcaaggacagctccttcaggaaggcgctacacgcttgttgagatttgccgccagcatgaaggcctcgcgtcaacaactgcaggctcagcagcaggtccaggccgctcattctctgcaccgagccgtgaggagatgcgccacattgtggaagcagaaagtcctaggaagaggtggcaagcctcagcccttggcagccattgccccctctaggaaggtgaccttcgagggccctttgctcaataggattgcggcaggagctggggatggcacgctcgaaactaagcgtccacaggcttctagacccctcggcgccctcggcagactggctgctgaggaaccacacgctttggaattaaatacggcacatagcgcgcggaagcagccaagacgcccgcatttcctgttggagccggcccagagtcagcgcccccagaagccacaggagcatggattggggatggcccagcccgcggctccctcactcacccgccccttcctcgctgaggcacccaccgccctcgtcccccactcccccctaccaggcgccctcagctctgcaccaggtccaaagcagccccccactgcctcaaccgggcccgagctcctcctgcttcccctgagctcgttcatgccttgcggcgccgccgcacctgcacgcgtgagcgctcagagagccacgccccgagataaacccccagtgccgtcctcactagcaagcgtacccgatcctcatctcctgttgcccggagacttcagcgccacaagggctggccctggactgtccacagcagcatggaccctgcggctcaatctccgtcggagctcatctaactattgtacaacacgacccccgtcccgtactagcggccctgttggtggcaagagagctgcctgtgccggcggctggtcctag

SEQ ID NO: 204919 - DNA, 2976 bp, Artificial Sequence
  Description of Artificial Sequence: Synthetic coding sequence
atgaagaacctgctgaccgagaagtgcatcagcagccacaacttccatcagaaggtcattaagcagagaatggagaagaaggtggacagtagatatttcaaggatggagctgtcaaaaaaccctattccgctaaaacgctgtcaaacaaaaagagcagcgcgtcatttgggatcagaagagaactgccaagcacgtctcatctggtgcagtaccgcggcacacacacctgcacgaggcaaggaaggttacgtgagctgcgcatcagattttactacgagcagcgcctccttcggaaggtatttgaggaatggaaggaggagtggtgggtgttccaacatgaatggaagctgtgcgtgcgcgctgactgccactacaggtactatttgtacaacctcatgttccagacctggaaaacctatgtccggcagcaacaggagatgaggaataagtacattcgagcggaggtgcatgatgcaaagcagaaaatgcggcaggcttggaaaagctggctaatctatgtcgtggtgaggcgaaccaagttgcagatgcaaaccacagctctcgaatttaggcagagaatcattttgcgcgtctggtggagcacctggcgccagagactcgggcaggtgagagttagtagagctctgcacgcgagcgctcttaaacaccgggcgctgtcgctacaggtacaggcttggtcccagtggagggagcagctcctgtatgtgcaaaaggagaagcagaaggtagtgagtgccgtaaagcaccatcaacattggcagaagaggcgattcctgaaggcatggctcgaatacctccaagtgcgaagagtcaagcgacagcaaaatgaaatggctgaacgtttccaccacgtcaccgtcctccagatctatttttgcgattggcagcaggcctgggagcgccgcgaaagtctgtacgcccatcacgctcaggtagagaaattagcccggaaaatggctctccggcgcgccttcactcattggaaacactatatgctcctgtgcgccgaagaagccgcccaatttgaaatggccgaagagcaccacaggcattctcagttgtacttctgttttcgagccctcaaagataacgttacccatgcccacctgcagcagatccgcaggaacttggcccaccagcaacatggcgttaccctgttgcatcgcttttggaatctctggcgctcccagatcgagcagaagaaggaaagggagctcctgcccctgctgcacgcagcttgggatcactaccgaatagctctgctatgcaaatgcatagaactttggttacagtacactcagaagagaaggtataaacagctgctgcaggcaagggctgatggtcactttcagcagagagccctgccggccgcctttcacacttggaatcgcctctggagatggcgccaccaggagaacgttctatctgcccgagccacgcgctttcatcgtgaaactctagaaaaacaagtattctccctgtggcggcagaagatgtttcaacaccgggaaaatagacttgctgagcgcatggccattctccacgccgaacgtcagctgctgtacagatcctggttcatgtggcatcagcaggcggccgcaaggcaccaagaacaggaatggcaaaccgtcgcttgcgctcatcaccgccacggcaggctgaagaaggccttctgtctgtggagggaaagcgctcagggccttaggacggagcgaaccggccgcgtcagagcagccgagttccacatggcccagttgctcagatgggcctggtcccagtggcgagaatgtctggctctccggggcgcggagaggcaaaaattgatgagagcagatctgcaccatcagcatagcgtgctgcatcgagccctccaagcgtgggtgacctatcagggacgggtcaggtcaatacttcgggaggtcgcagcacgtgaaagccaacagctgcaagcccagcagcaggtgcaagcagcacactccctccatagagcggtccgtcgatgtgccaccttgtggaagcagaaggtcctcgggagaggggggaagccccagcctctggccgccatcgctccttcgcggaaggtgacatttgaaggacctcttctaaacagaattgcagcgggggcgggagacggcaccctcgagacaaagagaccacaggcctcacgtcctcttggcgcgctgggtcggctcgctgccgaagagcctcatgcgctggagctgaataccgcacactctgctcgaaaacagccgcgacgtcctcacttcctactagagccggcgcagtctcaaagaccccagaaaccccaggagcatggcctgggcatggcccagcccgctgccccttcacttacccgtcctttccttgcagaagcaccaacagcactggtgccacactcaccacttccaggagctctgtcctctgcccccgggccgaagcagccaccgacagcttccacaggacctgagctgttgctgctgccactcagttccttcatgccatgcggggccgcggcaccagcccgggtgagcgcccagagggctacacctagggataagccgcccgtgccttcttccctggcatccgtacccgatccccacctcttattacccggagactttagcgctaccagagcgggtcctggcttgtctaccgcaggatccctggatctggaggctgagttggaagaaattcagcagcagttactgcattatcagaccacaaagcagaacttgtggtcctgtagaaggcaggcctccagtcttcggcgatggttggaattgaatcgggaagagccaggacctgaggaccaagaggtggagcagcaggtacaaaaagagctagagcaggtcgaaatgcagatccagttgttggcagaagagctccaagcgcaacgccagccaattggcgcctgtgtcgcccgcatccaggcactgcgccaagctctatgttag

SEQ ID NO: 204920 - DNA, 3636 bp, Artificial Sequence
  Description of Artificial Sequence: Synthetic coding sequence
atgaagaacctgctgaccgagaagtgcatcagcagccacaacttccaccaaaaggtgatcaagcagaggatggagaagaaagtagatagtaggtacttcaaagatggggccgtaaaaaaaccttactccgccaagaccctgagtaacaagaaatcatctgccagttttgggattagacgtgagctgccctctacttcccacctagtgcagtaccggggcactcacacatgtacacgacagggccgcctgagagaactccgcataaggtgtgtggctcgtaaatttctgtacctgtggattcgcatgacctttggcagggtgttcccctccaaagcccgtttttattacgaacagcggcttttgcggaaggtgtttgaagagtggaaggaagagtggtgggtgtttcagcatgaatggaaattgtgcgtcagagctgattgccactataggtactatctatacaatctgatgttccaaacttggaaaacctacgtaagacagcagcaagaaatgagaaacaagtatatccgcgcagaggtgcatgatgctaaacagaaaatgaggcaggcttggaaatcgtggttgatttatgtggtggtccgaaggaccaagctgcagatgcagactaccgccctggaatttaggcagaggattatcctacgcgtctggtggtctacctggcgacagcgactcggtcaagtgagggtgtctcgcgctctacatgcttctgccctaaagcaccgggcactgtctttacaggtccaggcctggtctcaatggagagagcagctgctgtacgtgcaaaaagagaagcagaaagttgttagcgccgtgaaacaccaccagcactggcagaaaagacgatttctgaaagcttggctggagtaccttcaggtgcgccgggtaaagaggcaacagaacgagatggccgagcgtttccaccacgttacagtgctgcagatttacttttgcgattggcaacaggcatgggagcggagggagtccttgtatgcccaccacgcccaggttgagaaattagcccgcaaaatggcccttcgcagggctttcactcactggaagcactacatgctgctgtgtgccgaggaagctgctcagtttgagatggcagaggagcatcatcgtcattcacaactacttctgcacagattctggaacctctggaggtcacagatcgagcagaagaaagagagggagttgctgcccctccttcatgcagcctgggaccactaccgaatcgcccttctgtgtaaatgtatcgaactgtggctgcagtacacgcaaaaacgccgatataaacagctgctgcaggctcgcgcggatggccacttccagcagcgagcattgcccgcagcattccacacgtggaatcgactttggcggtggagacaccaggagaatgtgctatccgcacgcgccacgaggttccacagggaaactctggaaaagcaggtcttctccctgtggagacagaaaatgttccagcacagagaaaaccggctcgcagagcgcatggcaatcctgcatgcagagcgccagttgctgtaccggagctggtttatgtggcaccagcaggcagccgccaggcatcaagagcaggagtggcaaaccgtggcctgtgctcaccaccgccatggtaggttgaagaaggcgttttgcctgtggcgcgaaagcgcccagggcctccgtaccgagagaaccggcagagtccgagctgcggaattccacatggctcagcttttgcgatgggcttggtcgcagtggcgtgaatgtttggcccttaggggagccgagcggcagaaactgatgagggccgacctgcatcaccaacacagcgtccttcacagggctttgcaagcgtgggtgacctaccaaggaagggtgagatctatccttcgcgaagtggccgcccgcgagtcacagcacaatagacaactactgaggggcgccctccggaggtggaaggagaatacgatggccagagtcgatgaggctaaaaaaactttccaagcctctacgcattacagacgcacaatctgcagtaaggtccttgtccagtggcgcgaggccgtttctgtccagatgtattataggcagcaggaggactgcgcaatctgggaagcccagaaggtgttagacaggggctgtctgagaacgtggttccagcggtggtgggattgttcaagaagaagtgctcagcagcgcctccaattggagcgagcagtgcagcaccaccacagacaactgctcttagaaggccttgcaaggtggaagacccaccatctgcaatgcgtgcggaaaagactgctgcacaggcagtccacccagctgttagcccagaggctaagccgaacatgttttcgccaatggagacagcaactggcggcgagaagacaggaacagcgtgccacagtgagggcgctgtggttctgggccttctctttgcaggccaaggtgtgggccacctggcttgcttttgtcttagagagaaggaggaagaaggctcggctgcaatgggccctgcaggcatatcagggacagctcctgcaagaaggagccacccgactcctgagatttgccgcttctatgaaggcctcacgacaacagctacaagctcaacagcaggtgcaggcagctcacagcctgcacagagcagtgcggaggtgcgccacgctttggaagcaaaaagtgctcggtcgtggcggcaaaccccagcccctggccgccattgctccctcaaggaaggtaaccttcgaaggaccccttcttaataggatagcagctggtgctggcgacggcaccttggagaccaaaaggccccaggcatcaagaccgctcggcgctctgggccggctggccgcagaagagcctcacgctctggaacttaacacagctcacagtgcccgtaagcaacctaggcgaccccactttctgctagagcctgcccaaagccagagaccccaaaagccccaagagcatggccttgggatggcccagcccgctgcccccagcttgacccgaccattccttgccgaggctcctacggccctagtaccacactcgcccctgcccggggctttatcaagcgctcctggacctaagcagcctccaacagctagtaccggcccagaactgcttctgttgcctctatcgagtttcatgccctgcggcgctgcagcccccgctagagttagtgctcaacgcgctacgcctagagacaagcccccggtgcctagtagcctggcttcagttccggaccctcacctgctgcttcctggagatttcagtgccactcgcgcgggcccaggcctgtcaactgcagggtcactggacttagaagccgaactggaggaaatccaacagcaactgttgcactaccagactaccaaacagaacctctggagctgtcgacgccaggctagtagtctgcgacgctggttagagctcaacagagaggagcccgggccagaggatcaggaggtcgagcagcaggtgcagaaggaattagagcaggtggaaatgcagattcagcttttggctgaggagttacaggctcagcggcagccaattggcgcctgcgttgcacgaatccaggctttgaggcaggccctgtgctag

SEQ ID NO: 204921 - DNA, 3483 bp, Artificial Sequence
  Description of Artificial Sequence: Synthetic coding sequence
atgaagaacctgctgaccgagaagtgcatcagcagccacaacttccaccagaaagtgattaagcagcggatggaaaaaaaggtggacagtaggttctactatgagcagaggttactgcgcaaagtatttgaggagtggaaggaagagtggtgggtgtttcagcacgaatggaaactttgcgtgcgggctgattgccactaccgttactacctttacaatctcatgtttcagacttggaaaacctacgtacgtcagcagcaggagatgaggaacaagtatatccgagccgaagttcacgatgcaaagcagaagatgagacaggcttggaagtcgtggctgatttatgtggttgtgcgccgtactaagttacagatgcaaacgacagccttggaatttcgtcagagaattattctgcgtgtgtggtggtccacctggaggcaacggctgggacaggtgcgagtctcacgcgctctacacgcatccgctctgaagcatagggctctctcgctgcaagtgcaagcttggagccagtggcgggagcaactgctgtacgttcagaaagaaaaacagaaagtcgtttccgcagtgaaacaccatcaacactggcaaaagaggaggtttctcaaggcttggctggagtacctccaggtgcgaagagtgaagcggcagcagaacgaaatggcagaacggttccatcatgtcacggtgctccaaatctatttctgtgactggcagcaggcctgggagcggagggaatctctttatgcccatcacgcccaggttgagaaactggctcgcaagatggctctccggcgggcttttacacattggaagcattatatgctactctgcgctgaggaggcggcccagttcgagatggccgaggagcaccaccggcactcacagctgtacttctgctttcgcgccctgaaggacaacgtgactcacgcacatctgcagcaaatacgccgaaacctcgcccaccagcaacatggggtgaccctccttcaccggttctggaacttatggaggtcgcagattgaacagaagaaagaaagagaacttctgcctctcttgcacgccgcatgggaccactacagaattgccttgctctgtaaatgcattgaactctggttgcagtatacacagaaaagacgttacaagcagctgctccaagctagggcggatggtcacttccagcagcgagcactcccagcagcatttcacacgtggaatagactgtggcgatggcgccaccaggaaaacgtgctctctgcacgagccacacgattccacagagaaacgttagaaaagcaagttttctccctgtggagacagaaaatgttccaacacagagagaaccggttagctgaacgaatggcaattttgcatgccgagaggcagttgctatataggagctggtttatgtggcaccagcaagcagccgcacgacaccaggagcaggaatggcagactgtggcgtgcgcacatcataggcacggtagacttaagaaggccttctgcctctggcgggagtcagcccagggcctgcgcactgaacgcacagggagggtgagggccgctgaattccacatggcccaactcctgcgctgggcttggtcacagtggcgagagtgtctcgcactgcgaggggccgaacgacagaaactgatgcgtgccgacctgcaccatcagcactccgtgctccatcgagccttacaggcttgggtcacttatcaaggaagggtgcggtcaattctgcgtgaggtggccgcccgtgagagtcagcacaacagacaacttctgagaggcgccctcaggcgctggaaggaaaacactatggctcgggttgatgaagctaagaaaacttttcaagcaagcacacattatagacgtactatctgctctaaagtactggtccaatggcgcgaggcagtgtctgtgcagatgtactacaggcaacaagaggactgtgccatatgggaggcgcagaaagtactagatcggggctgcctgcggacttggttccagagatggtgggattgctccaggaggagcgcgcaacagaggttgcagctggagagggctgtgcaacaccaccataggcaactgctgctcgaggggttggcaagatggaagactcaccatctgcagtgcgtgagaaaacgccttctgcaccggcagtccacacagctgttggctcagcgcctctcccgaacctgttttagacagtggcggcaacagctcgccgctcgcaggcaggagcagagggccacggtgagggcattatggttctgggcgttctcactgcaggccaaggtttgggctacctggctggcctttgtgctggaacgacggcgaaagaaggctcggctgcaatgggccctgcaagcataccaggggcaattgctccaagagggcgctacaagacttctgcgattcgcggcgagcatgaaagcctccaggcaacaactgcaagcccagcaacaggtgcaggcagcccactcgctccacagagccgtgcggcgttgcgctacattgtggaaacagaaggttcttgggcgaggaggtaagcctcagcccctggctgcaattgccccatcaaggaaagtgacatttgaggggccgttgcttaacagaatcgcagcaggagcaggagacgggactctggagaccaaacgcccacaggcttcacgaccgctgggggccttggggcgcctcgccgcagaggagcctcacgctctggaactcaacaccgcacattccgccagaaagcagcctaggcgcccacactttctcttggaaccagctcagtcccagcggccacagaagccacaggagcacggcttgggcatggcccagccagcagccccttctcttacccgccccttcctcgccgaggcccccaccgcattggtgccccattctccactccccggagccctcagtagtgcgcccgggcccaaacagccacctacagctagcacaggcccagagcttctgcttctcccgcttagctcatttatgccttgcggtgccgcagcacccgctagggtgtccgcccagcgggccaccccgagagataagcctccagtcccttcatccctagctagcgtacccgacccgcacttactcttacccggtgactttagcgcaactcgggccggaccggggctctccactgccggctccctggatcttgaagctgaactagaagaaatccagcagcagctgctgcattatcagaccaccaagcagaatctgtggtcatgcagaagacaggcaagcagtctgcgccgttggctcgagctcaacagggaagaacctgggcccgaggatcaggaagtggagcaacaggtccagaaggagcttgagcaggtggaaatgcagatacagctgttagccgaagagttgcaggcccaacggcagcccatcggagcatgcgtggctagaatccaagccctgaggcaggcactctgctag

SEQ ID NO: 204922 - DNA, 240 bp, Artificial Sequence
  Description of Artificial Sequence: Synthetic coding sequence
atgaagaacctgctgaccgagaagtgcatcagcagccacaacttccaccagaaggttatcaaacagcgcatggagaaaaaggtggatagcagatacttcaaagatggggccgttaaaaagccttactctgccaagactctgtccaacaagaagtcttccgcttctttcggcatcaggagggaactgccctccacatctcacctcgtgcagtatcgtggcacacatacctgtactaggtag

SEQ ID NO: 204923 - DNA, 3564 bp, Artificial Sequence
  Description of Artificial Sequence: Synthetic coding sequence
atgaagaacctgctgaccgagaagtgcatcagcagccacaacttccatcagaaggtgatcaagcagaggatggagaaaaaggttgattcaaggtatttcaaggatggagccgtcaaaaagccctactcagccaagactctttccaataaaaagtcgtctgcttcgtttggcatccgccgagaactgcccagtacttcccacttggtgcagtaccgtgggacccacacgtgtaccagacaaggacgcctgagggagctgagaatcagattctattatgagcagcggctcctccgaaaagtgttcgaggaatggaaggaagagtggtgggtgttccaacacgaatggaagctgtgcgtgagagctgactgtcactatcggtactatctttacaacctaatgtttcagacatggaaaacctatgttagacagcaacaggagatgagaaacaagtatatccgcgctgaggtacacgacgccaagcagaagatgaggcaagcatggaagagttggcttatctatgtggttgtcagaaggactaagctgcagatgcagactactgcactggaatttaggcagcgaattatcctgcgggtgtggtggtctacatggcgacaacggttggggcaagtgagagtaagtcgcgcgctgcatgccagtgcactgaaacaccgagccctctcgttacaagtgcaggcttggagccagtggcgggaacagctgctatacgttcaaaaggaaaaacagaaagtcgtttcagctgtgaagcatcaccagcactggcagaagagaagatttctgaaagcatggcttgagtatctgcaagtgcgtcgggtgaagaggcaacagaacgaaatggcagagaggtttcaccatgtgactgtcctgcagatctatttttgcgattggcaacaggcttgggaacgacgagagagcctgtacgctcaccacgcccaagtggaaaagctggcacgcaaaatggccctgcggagagcattcacccattggaaacattatatgttactttgcgccgaagaggccgcacagttcgagatggcagaggagcatcacaggcacagccaactgctgctacatcggttctggaatctctggagatcccagattgaacaaaagaaggagagggagttgctccctttgcttcacgctgcttgggatcactatagaatcgcactcctgtgcaagtgtatcgaattgtggctccaatacacccagaagcggaggtacaaacagctgctccaggctcgtgcggacggccactttcaacagagagcactgccagctgcgtttcacacttggaacagactgtggagatggaggcaccaggaaaacgtgctgagtgcccgtgctacccgattccaccgggagacgctggaaaagcaggtgttcagtttatggcgacaaaaaatgtttcaacacagggaaaaccggttagcggagcggatggcaatactccacgctgagcgccagctcctgtaccggagttggtttatgtggcaccagcaggccgccgccaggcaccaggagcaggaatggcaaacagttgcctgtgcccatcaccggcacggtcggttgaaaaaggctttctgtctttggcgggaaagcgcccagggcctgagaacggagaggaccggccgagtgcgcgcagccgaattccatatggcccagctcctgaggtgggcctggtcccagtggagagaatgcctggccctgcgaggcgccgaacggcagaaactgatgcgggccgacctccaccatcaacactcagtcttacaccgcgcactgcaggcttgggtgacctatcagggtcgggtgagaagcattctgagggaggtcgctgcacgggagtcacaacacaacagacagctgctcagaggtgctctgaggagatggaaagagaacaccatggccagggtggacgaagccaagaaaacgttccaggcaagtacacactaccgacgcacaatctgctcaaaagttctggtccaatggagagaggcagtgtctgtgcagatgtactatcggcagcaggaggactgtgccatttgggaagcacagaaggtactggaccggggttgtctgcgcacttggtttcagcgctggtgggactgttccagaaggagtgcacagcagagactgcagctcgagcgagccgttcagcatcatcaccgccagctgctcctggaaggacttgctcgatggaaaacacatcacctccagtgtgtaagaaagcgacttctccatcgccaatctacgcagctgttagcgcagaggttgtctcggacttgtttccggcaatggcgacagcagcttgcagcaagacgtcaagagcaaagagcaaccgtgcgggctctttggttctgggcctttagcttgcaagcaaaggtgtgggccacctggcttgccttcgtcctggagcggagacggaagaaggcccgcctacagtgggctctgcaggcttatcagggacaactgctgcaggaaggcgcaacacggcttctcagatttgccgcttccatgaaggcctcgagacagcagctacaggcacagcagcaggtgcaggcagcacactcactgcatagagctgtacgcagatgtgctaccctttggaaacaaaaggtgctgggtagggggggtaagcctcagccattagccgctatagcaccctctcggaaggtaacatttgaaggacctcttttgaatcggattgctgctggagcaggggatggcaccttagaaacgaagagaccccaggcctcccgccctctaggcgcactcggcaggctcgctgccgaggagccacacgctctggagctgaatactgcacactccgctcgaaaacagccgagacgcccccatttccttttagagcccgcccagtcccagagaccccagaagccccaggagcatggactgggcatggcccagccagctgctcccagtctgacaagaccatttctggcagaggccccaaccgccttggtgccgcacagccctctacccggagcactctccagtgcccccggtcctaaacagccaccaaccgctagcacaggtcctgagctgctgcttctccccctgagctcattcatgccatgcggcgcggccgcgccagcccgagtgagtgcccagagagctaccccacgggacaagccccctgtgccctctagtctcgcatcagtgccggacccccatctcctgctaccaggcgacttcagtgctacccgtgccggaccaggattgagtaccgccggatccctcgatctcgaagccgagctcgaagaaattcagcaacagctcctgcactaccagacaaccaagcagaacctgtggtcgtgcagacgacaggccagttcactgaggcggtggttggaactgaaccgggaggaacccggccctgaggatcaggaggtagagcagcaagtccagaaagagctggaacaggtggaaatgcaaattcaattactcgccgaggaactgcaggctcagcgtcaacctatcggggcctgcgtggccagaatccaggcacttcgacaggcgctttgctag

SEQ ID NO: 204924 - DNA, 378 bp, Artificial Sequence
  Description of Artificial Sequence: Synthetic coding sequence
atggacgccgtggccgtgtaccacggcaagatcagccgggagaccggtgaaaagctccttctggccactggcctggacggaagctatctgcttcgagactctgaatcagtaccgggtgtttattgcctttgcgtgctgtatcatggatacatatacacatatcgggttagtcagacagagacaggctcatggagcgccgagacagcaccgggagtccataagagatacttccgcaagatcaagaacctgatctcggcctttcaaaagcccgatcagggcatcgtgatcccactgcagtaccccgttgaaaaaaaaagctctgccaggtctacgcaggggattagggaggaccctgacgtgtgtcttaaggctccctag

SEQ ID NO: 204925 - DNA, 387 bp, Artificial Sequence
  Description of Artificial Sequence: Synthetic coding sequence
atggacgccgtggccgtgtaccacggcaagatcagccgggagaccggagaaaagcttttgcttgctacagggctagacggatcatacctgcttagggactctgagagcgttcccggtgtatattgcttatgcgtgttgtaccacggatatatttatacatatagagtatcgcaaacagaaaccgggtcttggagcgccgagacagcacccggagtgcacaagcgatattttcgcaaaataaagaatcttatctcagcttttcaaaagccagaccaagggatcgtgattcccctgcagtatcctgtcgagaagaaatcctcagcccgatctacacagggtaccacgggtatccgggaggatcccgatgtgtgtctgaaggctccatag

SEQ ID NO: 204926 - DNA, 177 bp, Artificial Sequence
  Description of Artificial Sequence: Synthetic coding sequence
atggacgccgtggccgtgtaccacggcaagatcagccgggagaccggggagaaactgttgttggctactggattagatggatcctatttgctgcgagacagcgagagtgtccctggagtttactgcctatgcgtcttacaccactggggatatattaaatttattaacaagctctag

SEQ ID NO: 204927 - DNA, 234 bp, Artificial Sequence
  Description of Artificial Sequence: Synthetic coding sequence
atggacctgccctactaccacggccggctgaccaagcaggactgcgaaactttgttgctgaaggaaggcgtagacggcaactttctgttacgggacagcgagtcaatcccaggcgtattatgcctgtgtgtaagctttaaaaatatcgtgtacacatatagaatattcagggaaaaacacggttattacagaatccaaaacagcaactccgattacgtggatgtgttgccatag

SEQ ID NO: 204928 - DNA, 399 bp, Artificial Sequence
  Description of Artificial Sequence: Synthetic coding sequence
atggacctgccctactaccacggccggctgaccaagcaggactgcgagactctgctgttgaaagagggcgtggacgggaatttcctactgcgcgattccgaaagtatcccgggggtgctctgtctgtgcgtatccttcaagaacattgtgtacacatatcggatcttccgggaaaaacatggatattataggatccagactgcagaagggagtccaaagcaagttttcccgtctctaaaagagttaataagcaaatttgaaaaaccaaatcagggcatggtggtccacctgttgaaacccattaaaaggaccagtcctagcctgagatggcgaggactgaaattagagttagaaacgttcgtcaactccaactctgactacgttgatgtgttaccatag

SEQ ID NO: 204929 - DNA, 2271 bp, Artificial Sequence
  Description of Artificial Sequence: Synthetic coding sequence
atgaacggcgcccccagccccgaggacggcgccagccccagcagcccaccgttgccccctccccctcctccttcctggcgcgagttctgcgagtcccacgcacgcgccgcagctctcgactttgcacgaagatttaggctttatctcgcctcccaccctcagtacgcgggcccgggcgcggaagctgcattcagccgaagatttgccgagctattcttgcagcacttcgaggcagaggtagcccgtgcctccggatcactgagcccacccatcttagcaccactctcccccggtgccgagatatcacctcatgatctgtctctagagagctgcagagtgggcgggccgctggcagtcctgggaccctcacgatcctcagaagatcttgcaggtcctttgccgtcttcagtgagctcttcaagtacgacctcctccaaacctaagctgaaaaaacggttttccttacggtccgtggggcgaagcgtgcggggcagcgtgagaggcatccttcaatggcgcggcactgtagatccgccgagtagtgcagggcctctggagacatcatcggggccccccgtgctgggcgggaactccaactctaacagtagtgggggtgccggaactgtcgggcggggactggtgtcagacggaacttcacctggcgagcggtggacccaccggtttgagagactaagattgtccagaggcggtggcgcactcaaggatggcgcaggaatggtacaacgcgaggagcttctgagctttatgggtgccgaggaggccgcaccggatccagcgggggttggccgcggtgggggggtagccggccccccctccggggggggcggtcagccacagtggcaaaaatgtcggctgctgctgcgctctgagggggagggcggaggggggagcaggcttgagttcttcgttccacccaaagctagtagaccacgcctgagcattccctgctctagcatcaccgatgtgcggacgacaactgctctggagatgcccgacagggaaaatacttttgtagtgaaggttgaaggacctagtgagtacatcatggagacggttgacgcgcagcatgtgaaggcctgggtttccgacattcaggagtgtctgtcaccgggcccatgccctgctacaagcccgcggcccatgaccttgcctctggcgcccggaaccagcttcttgactcgggaaaacacggactcactagaactctcttgcctcaaccactctgagtccctcccgagccaggatctcttgctcggcccttctgagtcgaatgatcggctgtcgcagggcgcgtacggaggcctctccgatagaccctccgcttccatctccccttccagtgcctccatcgcagcttcacattttgacagcatggaacttctgccccccgaactacctcccagaattcctattgaagaaggccctcctactggcacggtacaccccttaagtgctccttatccacccctcgacacccctgagactgccaccggttcatttcttttccagggcgagcctgaaggaggagagggcgaccagccactttccgggtacccttggttccatggaatgctgagtaggcttaaagcggcccagttagtgctgacaggcgggaccggttcccatggagtgtttctggtgcggcagtcagaaactcgccggggagagtacgtgctcaccttcaactttcaggggaaagccaaacacctccgtctatcgctgaatgaggaggggcagtgcagggtgcagcatctctggttccaatccatctttgacatgctcgagcactttcgggtccacccaatacccttggagtcgggaggcagctccgacgtagtgctggttagctatgtgccttcctcccagcgtcagcaggaacctaccaccagccacgatcccccccagccccccgaacctcccagctggaccgatcccccacagcccggcgcagaggaggcttcaagagcgccagaagttgcggccgctgccgctgctgctgccaaagagcgccaagaaaaggaaaaggctggaggcggcggcgtgcccgaggagctcgtgcccgtggtggagctcgtaccagtggtcgagctcgaggaggcgattgcgccaggaagcgaagcccaaggcgccgggagcggaggtgatgcaggtgtcccccctatggtgcagctacagcaatcgccactcgggggcgacggtgaggaaggagggcatccccgggccattaataaccagtactcattcgtgtag

SEQ ID NO: 204930 - DNA, 2016 bp, Artificial Sequence
  Description of Artificial Sequence: Synthetic coding sequence
atgaacggcgcccccagccccgaggacggcgccagccccagcagccctcccttgccaccacctcccccaccaagctggcgagaattttgtgaaagtcacgcgagggcggctgccctggatttcgccagaaggttcagattgtatctggctagtcatcctcagtacgctggacctggcgccgaagcagcttttagccgccgctttgcagaactatttttgcaacatttcgaggcggaagttgctagggcttcaggatctttatcccctcccatcttagcccccctgagtcccggtgccgagatttccccgcacgatctgagcctggaaagctgcagggtgggaggtcccctggccgttctcggaccctctagaagttcggaggacctggccggccctctgcccagttcagtgagttccagttcaacaacctctagtaagccaaaacttaaaaaaagattctctctcagatcagtcggtcggtccgttcgaggtagcgttcggggcatcctccaatggaggggcaccgtagacccaccaagttcagccggcccattggagacctccagtggacccccggtgttaggcgggaattcaaattccaacagctcagggggcgccggaacggtagggagaggcttggtctcagatggaacgtctcctggtgaaaggtggacacatagatttgagaggctgagactctccagggggggtggcgctctgaaagatggggctggcatggtccagcgtgaggagctgctcagctttatgggagccgaagaggcagcgcccgatccagcaggtgtaggcagaggcggaggcgtggcgggtccaccatcgggggggggtggccagccacagtggcagaagtgtcggctgttactgaggagcgagggtgaaggcggcggtggaagccgactggaattctttgtgccacccaaggcttcgcggccccgactttcaattccatgctcatccattacggatgtgagaactaccaccgcactggaaatgcccgatcgcgagaacaccttcgtagtgaaggtagaaggcccaagtgagtatattatggagacagtggatgctcagcacgttaaggcatgggtgtctgatatacaggagtgcctctctccgggcccctgtcctgccacctcccctagacctatgacacttcctctagcacccggtacgagctttctgacacgggagaatacggactctttggagctttcgtgcctgaatcatagcgagtctctcccttcacaggacctcctgctgggacccagcgagtccaacgatcgtctgtctcagggtgcctacggaggattgagcgaccgcccatcagcttccattagcccttcctctgcctctattgcggcctcacacttcgatagcatggaactgttgccgccagaactccctcctcgtattccaatcgaagagggcccccctactggtactgtgcaccccctgagtgccccataccctccactggacacgcctgagaccgccacaggctcgttcctgttccagggagaacccgagggaggggaaggcgaccaacctctaagcgggtatccgtggttccacggcatgctttcgcgcctgaaggccgcgcaactggtgttgaccggcggcactggcagtcacggcgttttcctggtgagacagagcgaaaccaggcgcggagaatatgttcttacttttaattttcagggaaaagctaaacatttgagactatctcttaacgaggagggccagtgtcgggtacaacatctttggttccaaagcatcttcgacatgctcgagcattttcgtgtacaccctatcccacttgaatccggcggcagttccgatgtggtcctggtctcttacgtaccatctagccaaaggcagcaggggagggagcaggctggtagtcacgcgggggtctgtgagggtgacgggtgccaccctgatgcctcctgtaccctgatgccattcggcgcgtcggactgcgtgaccgaccatcttccctag

SEQ ID NO: 204931 - DNA, 2052 bp, Artificial Sequence
  Description of Artificial Sequence: Synthetic coding sequence
atgaacggcgcccccagccccgaggacggcgccagccccagcagccctcctctccctccaccacctcccccatcctggcgagagttttgtgagtcccacgctcgagcagcagcactggactttgcccgtcggtttagattatacctggcaagtcatccccagtatgctggaccaggggccgaagccgcattctcgagacgcttcgctgagttatttctccaacacttcgaagccgaagtggccagagcaagtgggtccttgagtcctccgattctggcgccgctcagccccggtgctgaaattagtcctcacgacctgtctcttgagagctgtcgtgtgggaggacctctcgccgtgcttggtccaagccgaagctctgaagacttagcaggtcccttgccgagctctgtgagcagctcctcaactacctcgagcaaacccaaactgaagaagaggttctctcttcgctcagttggcaggtcagtgaggggcagcgtccgggggatccttcagtggaggggtacagtagatccaccaagttcagcagggcccttagagacctcttccgggcctccagtcctggggggtaatagcaattccaactccagtggaggagcagggaccgttggccgaggcttggttagcgacgggacctctcccggcgaacgctggacccacagatttgagcgtttacgcctttcccgcggaggcggggctctgaaggatggagccggcatggtacagagggaagagctgctgtcgttcatgggggcagaggaagcagctcccgatccagccggggtcggaaggggcggaggggttgcgggacccccatctggcggcggaggacagcctcagtggcagaagtgccgcctgctactgcgatccgagggcgagggcggcggaggcagccgcctggagttcttcgtgccacctaaggccagcagaccaagactatcaataccttgttcctcaatcacggacgtacgcactaccaccgccctggaaatgcccgacagggaaaatacttttgtagtcaaagtggaggggccatccgagtacattatggagacagtagatgcccagcatgttaaggcttgggttagcgacatccaagaatgcctctctcctggaccttgccctgcaacctccccgcggccaatgaccctccccctggcacccggaacttcctttctgaccagagagaacacggacagcctggaactctcctgcctgaaccattcggaatccctgccttcccaggatcttctcctcggcccctctgagtctaatgacagattgtcacagggcgcttatggaggcctctccgataggccatcagctagcatcagtccctcgtctgctagtatcgccgcctctcacttcgacagcatggaactgctgcctccagagctccccccacgcatcccaattgaggagggccctccaacaggcaccgttcatcctcttagtgcaccatatcctcctcttgacactccagagaccgcgaccggttctttcctgttccagggtgagccggaaggaggagagggtgaccagcccctatctggctacccttggttccatggcatgctgagccgcttaaaggctgcacaattggtgcttacaggcggcactgggagccatggtgtctttctggtaaggcagtctgagactcggcgcggggaatatgtgctcacattcaattttcagggcaaggcaaaacacctccgcctgtcactgaacgaggaaggtcagtgccgcgttcagcacttgtggttccagtctatattcgacatgcttgagcactttcgggttcaccccattccactggagagtggcggttcttccgacgtcgtcttggtgagttacgtgcccagcagtcagagacagcagggggagcagagtaggtcagcaggcgaggaggtgcctgtgcacccacgcagcgaggcaggaagccgccttggggccatgagagggtgcgcacgcgagatggatgccacacccatgcctccagctccctcttgcccaagcgaaagggttacggtttag

SEQ ID NO: 204932 - DNA, 2016 bp, Artificial Sequence
  Description of Artificial Sequence: Synthetic coding sequence
atgaacggcgcccccagccccgaggacggcgccagccccagcagcccaccactgccacctccccccccaccctcctggagagagttctgcgagtctcacgcacgtgccgccgcgctggactttgccagaagattccgcttatacctggcttcacaccctcagtatgctggacctggggccgaagcagctttctccagacgctttgctgaactgtttctgcaacatttcgaggccgaagtcgctcgtgcctccggtagcctcagtcccccaattttggcccctttgagccccggggcagagatatccccacatgatctctccttggagagttgccgtgtcggagggcccctggcggtgctgggtccctcccgctcctccgaggatctggctggacccctcccctcaagcgtgtcaagttcgtccacgacctcttctaagcctaaacttaagaagcggttctccctcaggagtgttggtaggagcgttcgcggtagtgtgaggggtattttacagtggagaggcacggtagaccctcccagctccgccggtccgctggagacttcaagtggaccacccgttcttggtgggaattctaactctaactccagcggaggcgcaggaaccgtcggccgaggcctcgtatcggacggtaccagcccaggtgagaggtggacccacaggttcgagagactgcgcctgtcgagagggggaggcgccttaaaggatggagcggggatggtgcagagagaggagctgctgtccttcatgggagcagaggaggccgctcccgaccccgccggagtcggtagaggcggtggtgtggccggacccccaagtggaggcgggggccagccacagtggcagaagtgtcgcttgctgctgcgttctgagggcgaggggggcggagggtcacgcctggaatttttcgtgccgcccaaggctagtcgccccagactgtctattccctgtagctcaattaccgacgtgcgtaccacaacagccctcgagatgccagaccgggagaacacgtttgtcgtgaaggtggagggtccttctgagtacatcatggaaaccgttgatgctcaacatgttaaagcatgggtttctgatattcaggagtgtctttccccaggcccttgccctgctacgagtccacgacccatgactctgcccttggcgcctgggacctccttcctcactagagagaatacggactctctggagctctcctgcctgaaccattccgaaagcctgccatcacaggaccttttacttggcccaagcgagtccaacgaccgactttcccagggcgcttatgggggcttatccgaccgcccaagtgcttctataagtccatcctcggcttctattgctgctagccatttcgacagcatggagctgctgccaccagaactccccccacggattcctatcgaagaaggccctcccactggcactgtccaccccctttctgccccatatcctcccctggatacccccgaaacagccaccggcagtttcctgtttcagggggaaccggaaggcggcgagggggaccagccgctgtcggggtatccttggttccacggaatgctcagccggcttaaagccgcccagttggtgctcaccgggggaactggatctcacggagtatttctagtgcgccagagcgaaacacgccgcggcgagtacgtgctgacatttaactttcaggggaaagcgaagcaccttaggctgagcttgaacgaagaaggtcagtgcagggtccaacacttgtggtttcagagcatctttgatatgctggaacacttcagggtgcacccaattcctcttgaatcgggcggttcctcagacgtcgtcttagtgagttatgtcccatcttcccaacggcagcagggaagggagcaagcgggctcgcacgcaggagtgtgtgaaggggatggctgtcatcccgacgcatcttgcaccttgatgccttttggggcttcagactgtgtaactgatcacctcccgtag

SEQ ID NO: 204933 - DNA, 1008 bp, Artificial Sequence
  Description of Artificial Sequence: Synthetic coding sequence
atgcccgaccgggagaacaccttcgtggtgaaggtggagggcccctcagaatacattatggagactgtggatgctcagcacgtcaaagcctgggtctcagacatccaggaatgcctgtctcctggtccatgccccgcaacttctccaaggcccatgaccctgccactggcgcccggtacttcatttctgaccagggaaaacaccgattccctggaattatcatgtcttaaccactctgagtcccttccctcgcaggaccttctgctgggtccaagcgaaagtaacgacaggctttcccagggagcctacggaggcctgagtgataggccttccgcttcaatctccccctcttccgcctcaatcgcggctagtcacttcgacagcatggagctcctgcctccagaactccctcctaggattcccatagaggagggcccaccgacaggaacagtgcatccactatcggcaccgtaccctccactggacactcccgaaacagccacgggctccttcctgttccagggcgaacctgaaggcggagagggggaccaaccgctctctggctatccctggttccacgggatgctctcaagactgaaggcggcccagctggtcttgacaggcggaaccgggtcccacggtgttttcttggtgcgccagtcagaaaccagaaggggcgagtatgttctgactttcaactttcagggcaaagctaagcatctgcggctaagcctcaacgaagaaggacagtgtcgggtgcagcatctatggttccaatcaatttttgacatgctcgagcacttccgagttcatcccatcccactggaatccggtggctcttccgacgtcgtactggtgagctacgtgccctcatcccagaggcaacagggcagggaacaggcaggaagccacgccggtgtatgcgagggggatgggtgccatcccgatgccagctgtacactgatgccttttggcgcaagtgattgtgtgaccgatcatctcccctag

SEQ ID NO: 204934 - DNA, 1122 bp, Artificial Sequence
  Description of Artificial Sequence: Synthetic coding sequence
atggccgaggccagccggccccggctgagcatcccctgcagcagcattaccgacgtccggactactactgccctcgaaatgccggatcgggaaaatacgttcgttgtgaaagtcgaaggaccgagcgagtatatcatggaaactgttgatgcacaacacgtgaaagcctgggtgagcgacatccaggaatgccttagccccggaccttgtccagcaacctcccctagaccaatgactctcccgttagccccagggacttccttcctgacccgggagaatacagacagtctcgaattatcctgcctgaaccactcggagagcctgccgagccaagacctgctgttgggcccctccgagtccaacgaccgcctctctcaaggcgcatacgggggactgtcggaccgtccctcagcgtccatatccccctcatctgcatcgatcgccgcgagccacttcgacagcatggagttgctgccccccgagctgccacccagaatcccaattgaagaagggcctccaacaggaacagtgcaccccctttcagctccctatccccctctggatacccctgaaactgcgacgggctcattcctgtttcagggggagcctgaggggggcgagggggatcagccacttagtggttatccctggttccacggcatgctctctcgtctcaaggcagctcagttagttctcaccgggggaacaggatcccacggggtattcctggttcgccagtccgaaaccaggcgcggggaatatgttctcacctttaattttcaaggtaaagctaagcatcttaggctgagtctcaatgaggaaggacaatgtagggtgcagcatctatggtttcagagcatctttgacatgctcgagcatttcagggtacatcctattccattagaatcagggggcagttcagacgttgtgctagtgagttacgtgccaagtagtcaacgccaacagggagagcagtcgaggagcgcaggggaggaagtgcccgttcatcccagaagcgaagccgggtcgcggctgggagcgatgaggggatgtgcgcgagagatggacgccactcccatgccaccggctccctcctgcccttcagaacgtgtcacagtgtag

SEQ ID NO: 204935 - DNA, 1728 bp, Artificial Sequence
  Description of Artificial Sequence: Synthetic coding sequence
atgaacggccccgccctgcagcccagcagccccagcagcgcccccagtgcatcacccgctgccgcacctagagggtggagtgagttttgtgagctgcatgccgtggcagcagcgagggaacttgcacgccagtactggctgttcgctcgcgaacatcctcagcacgcccccctcagggctgaactcgtgagtttgcaattcaccgatttgttccagaggtacttttgtcgggaggtacgtgacgggagagctccaggaagggactaccgagacaccggcagggggccaccggccaaagccgaagcatctcctgaacccggaccaggccccgctgcgccgggactgcccaaagcgcgttcctcggaagaactggctccaccaagacccccgggtccctgctcttttcagcacttccggcggtccctgagacacatcttccggaggcgctcagctggcgaactgcctgccgcccacaccgccgcggccccagggactccaggcgaggcagccgagaccccagcaagaccaggtttggcgaaaaagtttctgccgtggtcgctggccagggagccaccgcctgaggcattgaaggaggcggttctgcggtactcgcttgctgatgaagcctcgatggactctggcgcccgatggcagcgtggtcgcctcgctctgcgtcgcgcccccggccctgacggtccagaccgggtgcttgagttgtttgatccccctaagtcttctcgccccaagctccaggctgcctgttcatctatccaggaggtgagatggtgtacaaggcttgagatgccagacaacttatacactttcgtgctcaaagtaaaagataggacagacatcatttttgaggttggagatgaacagcagctcaactcttggatggcggaactttccgagtgtactggtaggggtctcgagtccactgaagccgaaatgcatattcccagtgcccttgagccgagcacttcatcgtctccacgtggcagcacggatagtctgaatcagggagccagtccaggcggcctgctggatcccgcatgtcaaaaaacagatcattttctgtcttgctacccatggtttcacggccccatttccagagtgaaggctgctcagttagttcagttgcaaggccccgacgcccacggcgtgttcctggtcagacaaagcgaaactcggcggggcgaatatgtgctgacttttaactttcagggcatcgcgaaacacttgcgcctatctctcacggagcggggccaatgcagagtgcagcacctgcacttcccaagcgtggtggatatgctccatcacttccaacggagtccaattcctctggaatgcggcgcggcctgcgatgtccggctctcatcctacgtggtcgtggtgtctcaacctccaggatcatgtaataccgtgctctttccattttccctgccgcactgggactccgaatccctaccacattggggctctgagcttggcttaccgcacctctcatcttccggatgcccccggggcctcagtcccgaaggtcttccgggccggtcctctcctccagagcaaatctttcacctggtgccctccccggaggaattggcaaatagccttcagcacttggaacatgagcccgtgaatcgagccagagacagtgactatgagatggactcgtcaagtcggagccatttacgcgcaatcgataaccagtataccccactttag

SEQ ID NO: 204936 - DNA, 1122 bp, Artificial Sequence
  Description of Artificial Sequence: Synthetic coding sequence
atgggcttccccgtgctgtgccggggctggcggcggacctggcccggatgtgctagctggctaggtgctccgccgcctcagaaaccattgctgtcccccttacttctgaatcaccgctcctcgaaatcatctcgacctaagttgcaagctgcctgcagctccatccaggaggtgaggtggtgtactaggttggaaatgcccgacaacttgtacacttttgtcttgaaagttaaagaccggactgatattatctttgaagtgggggacgaacagcagcttaactcctggatggctgagttatcagagtgtactggacgcgggctggagtccacagaggccgagatgcacatccctagcgctctggagccttccacaagctcaagcccccgagggagtaccgactctctgaaccagggggcttcccccggcgggcttctcgatccagcttgtcagaagacagatcactttctgtcgtgctacccctggttccacgggcccatttctcgagtgaaagcagcgcaactcgtacaactgcagggtccggatgctcatggagtttttcttgttcgccaaagcgagactcgtcgcggggaatacgtcctgacattcaacttccagggcatcgctaaacacttacgtctgtcactgaccgagcgaggccagtgtagggtccagcacctgcactttccctcagtggtcgacatgcttcaccacttccagcgatctcccattcctctcgagtgtggggctgcctgcgatgtccgactttcctcttacgttgtggtcgtcagccagccccccggatcttgcaacactgtgttgttccccttcagcctgccacactgggatagcgaaagcctcccccattggggcagcgagctaggcctgccccatctgagctcatccggctgtccacggggactgtcccctgagggcctgccaggcagatcgtcccctccagagcagatttttcatttggttccaagcccggaagagctggccaatagcctccagcatctggaacacgagcctgtcaatcgtgcccgggatagtgactacgagatggattccagctctaggagtcacctgagagccatcgacaatcaatacactccgctgtag

SEQ ID NO: 204937 - DNA, 1209 bp, Artificial Sequence
  Description of Artificial Sequence: Synthetic coding sequence
atgatcccccccagcagcccccgggaggacggcgtggacggcctgcccaaggaagccgttggtgccgagcagcctcccagccccgccagcaccagtagccaggaatctaaattacagaagctgaaacggagcctttcctttaaaaccaagtcgctcaggtcaaaatccgcagacaacttttttcagcggacgaactccgaggatatgaagctgcaggctcacatggtggctgaaatcagtccatcgtcgtctcctctgcctgcacccggctcactgacctccaccccggcacgagcgggcctccaccctggagggaaggcacacgccttccaggaatatattttcaagaaaccaactttttgcgacgtctgtaaccatatgattgtgggcacgaatgctaagcacggcttaagatgtaaggcgtgcaagatgagcatccaccacaagtgtaccgatggcctagccccccagcgatgtatgggcaagctgccaaaggggttccgaagatactattcttcgccactcctgatccacgagcagttcgggtgtatcaaagaggtcatgccgattgcatgtggtaataaggtggaccccgtgtacgaaactctgcgattcggcactagcctcgcacagagaaccaagaaagggagttctgggtccggctccgacagcccgcataggacatctaccagcgatctggtcgaagttcctgaagaggcgaacggaccaggcggcggttacgatctgaggaagagaagtaacagcgtgtttacttacccagagaacggcacggatgattttcgagacccagccaaaaacatcaatcaccaggggtccctctctaaggatccattgcagatgaatacatacgtagccttatacaagtttgtcccgcaggagaacgaagacttagaaatgagaccaggggacatcattactctattagaggattcaaacgaggattggtggaagggaaaaattcaggaccggatcggatttttcccagctaactttgtccaaaggctgcaacaaaatgaaaagatctttagatgcgtgaggacctttatcggatgtaaagagcagggccaaatcacgctgaaggaaaatcagatctgcgtctcttctgaggaggagcaagacggcttcatccgagtcctgagcggcaagaagaagggccttattcccctggatgtgcttgagaacatctag

SEQ ID NO: 204938 - DNA, 1005 bp, Artificial Sequence
  Description of Artificial Sequence: Synthetic coding sequence
atgaagctgcaggcccacatggtggccgagatcagccccagcagctcacctttgccagcacccggtagcctgacatctacgcccgcacgcgcggggctgcaccctggtggaaaagcccacgccttccaggagtacatctttaagaagcccactttttgcgatgtgtgtaaccacatgatcgtaggcaccaacgcaaaacatggattgcggtgtaaggcctgcaaaatgagtatccaccacaaatgcacagacgggctggccccacagcgctgtatgggcaaactgccgaagggttttcgtcgctactactcctctccgctgctaatccatgagcagttcggatgtatcaaggaagtgatgcccatagcctgcggcaacaaggtcgatcccgtctacgagactctgcgcttcggtacctccttggcacaacgaaccaagaaaggaagtagtggctctggtagtgactcaccccatagaacctccacttcagacctggtcgaggtgcccgaggaagctaacgggcctggcggtggctatgaccttcgaaaacgcagcaattccgtctttacgtatcccgaaaacggcactgatgattttcgggatccagccaagaacatcaaccatcaggggtctctgtccaaagacccgctgcaaatgaatacgtatgtggcattatacaaattcgtgccccaggagaacgaggacctggagatgaggcccggggacattatcaccctccttgaggactctaacgaggattggtggaagggaaagatccaggacaggattggattttttccagcaaattttgttcaacggctacagcagaatgagaagatcttccgatgtgtgaggactttcattgggtgtaaagaacaaggccagatcaccttaaaagagaaccagatctgtgtatcaagcgaggaggaacaagatggctttattcgagtcctaagcggtaagaaaaaaggtttaataccactggacgtgctggagaatatttag

SEQ ID NO: 204939 - DNA, 4422 bp, Artificial Sequence
  Description of Artificial Sequence: Synthetic coding sequence
gtggccatcatcgccggcaacttcgagctggccgagtacatcaagaaccataaggagaccgacatagtgccgtttagagaggcccctgcctattcaaacaggaggagacgtcctcccaataccctggccgctcctcgggtgctactcaggtccaactcagataataatctgaatgctagtgctcctgactgggccgtctgtagtacggcaacatctcataggtcactgtcccctcagctgctgcagcagatgcccagtaaacctgagggagcggcgaagaccatcggttcttacgttccaggtccccgatcccggtctccaagcctgaaccggctggggggcgccggcgaggatggaaaacgcccccaacccctgtggcacgtagggtccccgtttgcactgggggctaacaaggatagcttgtcagcattcgagtaccctggtccgaaaagaaaactgtattccgcagttcccggccgtctattcgttgcggtaaagccctaccagccccaagtcgacggagagatacccttgcacagaggcgatagggtgaaagtcctgtcaattggtgagggtggattctgggaaggctctgctagagggcacatcggatggttcccagccgagtgcgtagaggaagtacagtgcaaacctagagatagccaggctgaaactagggctgatcggtccaagaaattgtttcggcattatactgtggggtcctacgactcctttgatacatcttctgactgcattatcgaagaaaagactgtcgtgctccaaaagaaggacaacgagggtttcggattcgtgctgcgaggcgccaaagctgatacgcccattgaagagtttacgccaacaccggcttttcctgcactccagtacctggaatccgtggacgagggcggtgtagcttggcaagcagggctgcgcacaggtgacttcctgatagaagtgaataacgagaacgtcgtgaaggtaggccaccgacaggtcgtgaatatgattcgccagggtggcaaccacctagtgctgaaagtcgtaacagtcactaggaatttggacccggacgacaccgctagaaagaaagcaccgcctccacccaaacgcgctcccacaacggccctgactctccgatctaagagtatgaccagcgaactggaagagctggttgataaggataaaccagaagaaatagtcccagcctcgaaaccttccagggccgctgagaacatggccgtggaacctagggtcgcgacaataaagcaacgtccctcctcaagatgctttcctgccgggtcagacatgaattcagtgtatgaaagacagggtatcgctgtcatgacccccaccgtacccggcagccctaaggcccccttcctgggcatacctagaggcactatgcggagacagaaaagtatcgattcacgcatctttctgtcaggaatcacagaagaagaacgccagtttcttgcccccccaatgctaaaattcacacggtctctttcaatgcccgacaccagtgaagacattcccccccctcctcagagcgtaccgccctcaccaccaccacccagccccaccacatacaattgccctaaaagcccgacccccagagtgtatggcactataaaacccgccttcaatcagaatagcgccgctaaggtcagccctgcaactcgaagcgataccgttgccactatgatgcgtgaaaaaggtatgtacttcagacgggaattggacaggtatagcctggacagcgaggacctgtactcaaggaatgccggaccacaggctaattttagaaataagcgcggccagatgcccgagaacccatattccgaggtaggcaagattgctagcaaagcggtttacgtgcccgccaagccagcgcgcagaaaaggcatgctagtaaagcaatccaatgtggaggactcccctgaaaaaacttgttcaattccgatccccactatcatcgtgaaggagccctcaacctccagttctggaaagtcctcccagggatcctctatggaaattgacccacaggcaccagagcctccaagtcagctcagacccgacgaatcattgaccgtgtcctctcctttcgccgcagcaatagccggagccgtccgagacagggaaaaaaggctggaagctaggaggaatagccctgcctttctgagcacggacctaggagacgaagatgtaggactgggcccacccgctcccaggacaaggcccagcatgttcccagaagagggcgattttgctgatgaagattctgctgagcagttatcctcgccgatgccgagtgccacgccacgcgagcctgagaaccacttcgtagggggggccgaagcctctgctccaggtgaagccggtcgtcctctgaattcaacaagcaaagctcaggggccagaaagttcgccggcagttccctcggcatcttcagggactgcaggacctggaaattacgtccatccgttgactgggagactgcttgatccaagttcacctctggccttagccttatcagccagagaccgcgctatgaaggagtcgcaacaaggcccaaaaggagaggcgccaaaggccgatctgaacaagcccctatacattgacacaaagatgaggccttctctcgatgctggcttcccaactgtcacacgacagaacaccagaggtcctctccgtagacaggaaaccgagaacaagtatgagaccgaccttggcagagaccggaagggtgacgataaaaagaacatgctcatcgacatcatggacacttctcagcagaaaagcgcaggcctactcatggtgcacaccgtcgatgctaccaagctggataacgcgctgcaggaggaagacgaaaaagccgaggttgagatgaagccggactcctctcccagtgaagtccctgaaggagttagcgagacagagggggcgctgcaaatcagcgcagcacctgagccaacaacagttccaggcaggacaatcgtggcggtcggttcaatggaagaagcagtcattctgccattccgcattccaccccctccgctggcttctgtggacctcgatgaggactttatcttcaccgagcctttaccaccaccccttgagtttgcaaactcattcgatatcccagatgacagggctgcatcggtccccgccttatcagatctggtcaagcagaagaaaagcgatacaccccagtcaccaagcctcaatagcagccagcccacgaactccgccgattcaaaaaaaccagcttctttgtctaactgcctcccagccagtttcttgcccccacccgaaagcttcgatgctgtagctgactctgggattgaagaagtcgactctagatccagttctgatcatcacttggaaaccactagcaccatctccaccgtcagttccattagtaccctatctagcgagggcggggagaacgtggacacttgcactgtgtatgcagatggtcaagcattcatggtcgataagcctccagttccacctaaacccaagatgaaacctatcatccataagagcaatgccttgtatcaggacgccttggttgaggaggatgtggactccttcgtgataccgcctcccgctccaccgccccctcccgggtccgctcagcctggaatggccaaagtgctccagccaagaacatcgaaactgtggggagacgttaccgaaatcaagagtcccatcctgagcggaccaaaggccaacgttattagcgagctgaacagtattttgcagcagatgaacagagagaagctggccaaacccggggaaggtctggattcccccatgggagcaaaatcagccagcctcgcccccagaagcccagagatcatgtccacgatttcaggtacgcgatctacaacagtgacttttaccgttcggcccgggactagtcagcccataactcttcagagccgaccccccgactacgaatctcggacgagcggcacaagaagagcccctagcccagtcgtttcacctaccgagatgaataaggagactctccctgccccgctgtccgcagcaaccgcttctccctcccccgcactgagcgatgtctttagcttgccttcacagccaccctctggcgatttgttcggcctgaaccccgcggggcggtctcggagtccgtcccctagcattctacaacagcctatttccaataaaccatttacaactaaacctgtgcacttatggaccaagccggatgtggccgattggctcgagagtttgaatttaggtgaacacaaagaggcctttatggataacgagatcgacggcagtcaccttcccaacttacagaaggaagacctcatagatctcggtgttactcgggtcggccaccgtatgaatatcgagagagccctcaagcagctgttggaccggtag

SEQ ID NO: 204940 - DNA, 5553 bp, Artificial Sequence
  Description of Artificial Sequence: Synthetic coding sequence
atgccccggagccccaccagcagcgaggacgagatggcccagagcttttctgactactccgtgggtagcgagtctgactccagcaaggaggagactatttacgacactatacgggccacagctgagaaaccaggaggtgcacgtactgaagaaagtcagggtaatacactcgtgatccgagtggtgattcacgatctccagcagaccaagtgcatacgcttcaaccctgacgcaacggtgtgggtagccaagcagcgaatcttgtgcacgctgacacagagccttaaggacgttctcaactatgggttatttcagccagccagtaacggtcgagatggtaagtttcttgacgaagaaaggctcctgagggaataccctcagccagtgggggagggggttccctctctcgagttccgatataagaaacgtgtctacaagcaggcttccctagacgagaagcagctcgctaaactgcacacaaagacaaatctgaagaaatgcatggaccacatccagcatagattggtagagaagattacaaagatgcttgaccgcggcttagatcctaatttccacgacccagaaaccggcgaaactcctctgaccctagcggcccagctggatgatagcgtagaggtgatcaaagcattaaaaaatggaggcgcccatttggacttccgcgccaaagacggcatgaccgcgcttcataaggctgctagagccagaaatcaggtcgccctaaagactctgcttgagctcggggcctctcccgattataaagactcatacggtctgacccccctgtatcacacggcaattgtcgggggcgacccatactgttgcgaactgctcttgcacgaacatgcaaccgtgtgttgtaaagacgagaatggttggcacgagattcaccaatcaagatgttggggccatataagcgaaccacatcacaccctactcagcgggtcagcccgatctcagcagtctagaagtgccagttcagccctccatgtttgcgccatgtacagcagtttctcatgcgtgcggatttccctgttgttccatggaaggattaccgaattgaaacagtacaagaaaagtacccccttccaggttgccatcattgcgggcaatttcgagttggctgaatatatcaaaaaccacaaggaaaccgatatcgtgccctttcgcgaggcccccgcttacagtaataggagacgccgcccccctaacacacttgccgctccgagagtcctgcttagaagcaactcagataacaatctcaacgcctcggcaccagattgggcggtgtgttctactgctaccagccacaggtcgctgtccccccagctcttgcaacagatgcccagtaagccggagggtgccgcaaaaactattgggtcgtacgtacccgggccgagatcccggagtccttctctgaatagattgggcggagccggtgaggatgggaagcgtccccagcccctttggcatgtgggctctccattcgctctgggggccaacaaggacagcctgtctgccttcgaatatcctgggcctaaaaggaaactgtattcagccgtcccagggcgactgttcgtagctgttaagccatatcaaccccaggttgatggcgaaataccgctgcaccgtggtgatcgggtgaaggtgttatcaatcggtgagggcggattttgggagggatcagctcgtggacatattggctggtttcccgcagaatgtgtggaggaggtgcagtgcaagccaagagattcacaggctgagacgagggctgatagatctaagaagctctttcggcattacaccgtggggtcctacgacagtttcgatacttcgagcgactgtataatcgaagaaaagacagtcgtgctccaaaaaaaggacaacgaagggtttgggttcgtactcagaggcgccaaggccgatacgccaatagaagaattcactcctaccccggcattcccagcactgcagtacctggagtcagttgatgaaggcggggtcgcctggcaggccgggctacggaccggcgactttctgatagaagtgaacaatgagaatgtagttaaagtcgggcaccgccaggtcgttaacatgatccggcaggggggtaatcacctcgtgctcaaagtggtgacagtcacgcggaatctggacccagacgatacagctcggaagaaggcacctcctcccccgaagagggcgccaaccacggccctgacactccggagcaagagtatgacctcggagctagaggagcttgtggataagggtgtgatcagaaaggtaagtgacaagcctgaagaaattgtgccagctagcaagccgtcacgcgccgcggaaaatatggccgtcgaacctagggttgccactatcaaacagcgcccttcaagccgctgtttccctgccggcagtgatatgaactccgtctatgagaggcagggaatcgcggtcatgacccccactgtgcccggatccccgaaagccccgttcctgggtatccctcgcggcacaatgagaagacagaagtccatagattcaagaattttcctctccggaattacagaggaggagcggcagttccttgcgcctcctatgctgaagttcacaaggagcctgtccatgcccgacacctcggaagacattcccccacccccacagtctgtgccacctagtccacccccacctagccctacaacttacaattgccctaagagtcctacaccccgcgtgtatggcactatcaagccagcatttaaccaaaacagcgctgccaaggtatcccctgcgacgaggtcggacaccgtggcaactatgatgagggagaaggggatgtacttccgtagggagctggaccgctacagcttagattccgaggatttatattcaagaaatgcaggaccacaggctaactttcgaaataagcgcgggcaaatgccagaaaacccctatagtgaggtggggaaaattgctagcaaggccgtctatgtgcccgccaagcccgccaggaggaaggggatgctcgtcaaacagtccaacgtggaggatagccctgagaagacgtgttcaatccctattcctaccatcatcgtgaaagaaccctcaacctctagctctggcaaaagtagccagggctcttcgatggagatcgacccccaggcccctgaaccaccctctcagctccggcccgacgagtcactgactgtgtcttctcctttcgctgccgccattgccggtgctgtccgcgacagagagaaaagacttgaagctcggagaaatagccctgccttcttgtctactgacttaggcgacgaggatgtgggcctcgggcctcccgcccccagaacacggccatctatgttccctgaagagggcgactttgccgatgaggacagcgctgaacagctgtcaagcccaatgccttccgctacaccgagggagcctgagaatcactttgtaggcggggccgaagcttccgcccccggagaagctgggcggcctctgaactctacctccaaggcacaagggccagaatctagccccgccgtcccgtcagcctcatctgggaccgcagggcccgggaactacgttcatccgctgactgggagactgctggatccttcatctcccctcgcattagcgctgtctgcccgggatcgagctatgaaggaaagccagcaaggtcctaagggcgaggctccaaaagccgatctcaacaaacccctgtatatcgatacaaaaatgcgtccctcgttagatgcaggattccctaccgtcactcgacaaaacactcggggtccattacgtcggcaagaaactgaaaacaaatatgaaacggatcttgggcgtgatcgtaaaggtgacgataaaaagaacatgctgatcgatatcatggatactagccagcagaagtccgctggactcttgatggtccacaccgtcgacgccaccaagctcgacaatgctctgcaggaggaagacgaaaaggcagaggtggagatgaagcctgattcatctccctctgaagtgccagagggggtgtcagaaaccgaaggtgcacttcagatctccgccgcgcccgaacccaccacagttccaggaagaactatcgtggccgtggggtcaatggaagaggctgtgatcctgccatttaggattccaccgcctcctttggcaagcgtggatttagacgaggactttatcttcaccgagccactgcctccacccctggagtttgccaacagtttcgacatccccgatgacagagcagcaagtgtgcctgccttgtccgacttggtgaaacaaaagaaaagcgataccccacaatccccgtcgttgaactcttcacagcctacaaacagtgccgatagcaagaaaccagcttccctctccaattgcctgcccgcaagtttcctgccccctcctgaaagttttgacgccgtggcggatagcgggatcgaggaagtcgacagcaggtcatcctcagatcatcacctggaaacaacgagtacaattagcactgttagcagcatcagcactctgtcatccgaggggggcgagaatgttgacacctgcactgtctacgcagacggacaggcatttatggtggataagccgcccgtgcctcctaaacccaagatgaagcctatcattcacaaatcgaatgctctgtaccaggacgcactagtggaagaggatgtagattccttcgtcatccctcctcccgctccgccccccccaccaggctccgctcagcctggcatggcaaaagtcttgcagccgcgcacctctaagctgtggggagacgtcactgagataaagagtcctatcttatcaggtccaaaggccaacgtcatctcagagcttaattccattttgcagcagatgaatcgcgagaagctggcaaagccaggcgagggccttgactcgcccatgggggccaagagcgcatctctggcccctagatctcccgagattatgtcgacgattagcggaacacggtctactacagtgacttttaccgtgagaccagggacaagccagccaattacattgcagtccaggcctccggattacgagagcaggacttccgggacgcgtcgtgcaccaagccctgtggtatcaccaacggagatgaataaggagaccctgcccgcccccctttctgcagccactgcttctccctcccccgcactgtcagacgtgtttagtctcccctcacagcctccatctggagacctattcggattgaatcccgcaggaagatcgcgaagtccctccccaagtatccttcagcaaccaatcagcaataagccattcacaaccaagcccgtgcacctgtggactaaacctgatgtggccgactggctggagtccctgaacttgggtgagcacaaagaggcatttatggataatgagattgatgggagccacttgcccaacctgcagaaggaggatctcatcgacctgggggttacacgcgtcggccaccgcatgaacatcgagcgcgctctgaagcaactgctggaccgctag

SEQ ID NO: 204941 - DNA, 846 bp, Artificial Sequence
  Description of Artificial Sequence: Synthetic coding sequence
atgatgatgaacgtgcccggcggcggcgccgccgccgtgatgatgaccggctacaataatggccgctgtccaagaaatagcctctactccgactgcatcattgaagagaaaacagtcgtgctgcagaaaaaggacaacgagggattcggattcgtacttcggggagccaaggcagacactccgatagaggagtttaccccaaccccagcatttcctgcactccagtacttggaaagcgtggatgaaggcggcgtggcatggcaggctggattaagaacgggagattttctgatcgaggtgaacaacgaaaacgtcgtcaaagtgggccacaggcaagtggtgaacatgatcaggcagggtgggaatcacctggtactaaaggtggttacagttaccaggaaccttgaccccgacgacacagccaggaagaaggcacctccacctccgaaaagggctcccacgaccgccctcacgctgaggagcaagagcatgacgtcagagttagaagagcttgtcgataagggcgttatcaggaaggggaaggacaaaccagaggagatagtcccagcaagtaagcccagccgtgctgcggagaatatggctgtcgaaccccgagtggccacgattaaacagcggccaagcagtcgatgttttcctgctggctcagatatgaattcagtttatgagagacaagggatcgcagttatgaccccaactgtaccaggctcccccaaagcaccctttttgggcataccacgcgggaccatgcgtcgacaaaagtctatcggtaagaaatgcggtactccaccgcagaaactgcctctgggcttccagacccagccttag

SEQ ID NO: 204942 - DNA, 3762 bp, Artificial Sequence
  Description of Artificial Sequence: Synthetic coding sequence
atgatgaacgtgcccggcggcggcgccgccgccgtgatgatgaccggatacaataacggccgctgtcctcgaaactcactctactcggattgtatcatcgaggagaaaacggttgttctccagaaaaaggacaacgagggattcggtttcgttctgagaggagccaaggccgacaccccaatcgaggaattcacaccaactcccgcctttcctgccctccagtatctggagagtgtcgatgagggcggcgtagcctggcaggccggactgcgcactggtgactttttaatcgaagtgaataatgaaaacgtggttaaggttggccacagacaggttgttaacatgatccgacagggcggtaaccacctggtgctgaaggtagtgaccgtgactcgcaaccttgatccagacgacactgcacgcaaaaaggctcctcccccacctaaaagagctcctaccaccgcactcaccctacgctctaagtctatgacatcagaactcgaggagctggtagataaggacaagcccgaggaaatcgtccctgctagtaagccgagcagggctgctgagaatatggcagtcgagccaagggttgctactataaagcagaggcccagctctaggtgctttcctgccggctcggacatgaactccgtttacgaaaggcagggcattgcagtgatgaccccaacagtccccgggagccccaaagcaccttttctcggaataccgagagggacaatgcgaaggcagaagtccatcgattcaagaatctttctatcgggaataaccgaggaagaaagacagttcctggccccccctatgctgaagtttaccagaagtctaagcatgccagacacttctgaagatattccgccaccaccccagtccgtgccacccagccctccaccgccttccccaacgacttacaactgccccaagtcccctacccccagagtctacggtacgattaaaccggctttcaaccagaattctgcagccaaggtaagccctgcaacaagatcagatacagttgccacaatgatgcgagaaaaggggatgtactttcgccgggagctggatcgatactcactcgatagtgaggatctttattcgaggaatgccgggccacaggccaattttaggaataaaagaggccagatgcccgaaaatccttacagcgaagttgggaaaatagcttcgaaagccgtgtacgtgccagccaagccagcccggcgcaaggggatgctggtcaagcagagcaatgtggaggacagcccagagaagacgtgttctattcccattcctacaattatcgtgaaggagccgagtacgtctagcagtggtaaatcctcccagggttcaagcatggagattgaccctcaggccccagagcctcctagtcaactgaggcccgacgaatcactaaccgtttctagcccatttgcagcagctatagcgggtgcagttagggatcgggagaaacgcttagaggctcgacggaactcccccgctttcctgtccacggatttgggcgatgaggacgtcgggctgggtccgcccgctccccgaacacgccctagcatgttccctgaggagggtgacttcgccgatgaagactctgcggagcagttgtcctcgccaatgccatccgccacgccccgcgaacccgagaatcactttgtaggtggcgctgaagcatccgcgcccggggaagccgggcggcctctgaacagcacatctaaggcacagggcccagagagctcacccgcagtcccaagcgcaagttccggtactgccgggccggggaattatgttcatcccctgactggacgcctcttggaccctagctcccctctggcgttggctctgtcagctcgggacagagccatgaaggagtcccagcagggaccgaagggcgaagcccccaaggctgatctgaataaaccactatatattgatacaaagatgcggccatctctggatgcaggattcccgaccgtgactcgtcagaacaccagaggaccgctccgtcggcaggagactgaaaacaagtatgagactgacttaggtcgagatcgtaaaggagacgacaagaagaatatgctcatcgacatcatggacaccagtcaacaaaaatccgctggactgctgatggttcatactgtagatgccaccaaactggataatgctcttcaggaagaggatgagaaagccgaagtggagatgaagccagactctagtccctctgaggtaccagaaggggtgtctgagaccgaaggcgccctgcagatttccgccgcaccggagccaacaactgtccccggcaggaccatcgtagcagttggctcaatggaggaggctgtgattttaccatttcggatcccgccaccgcccctcgccagtgtcgatttagacgaggactttatttttactgagccattgccccctccgcttgagttcgcaaattcattcgacatccctgacgatcgcgctgctagcgtccccgccttgtctgatctggtgaagcagaaaaagtctgacacaccgcaatcaccttccctcaattcaagtcagcctacaaatagcgctgatagcaagaagcccgcctctctctccaactgcctgcccgcaagtttcctgccccctcccgagtctttcgatgccgtggccgacagcggtatcgaagaggtcgattcgcgttctagttcagaccatcatctggagactacctcaacaatttccactgtcagttccatatctaccctgagtagcgaggggggcgaaaacgtggacacatgcactgtctacgcagatggacaagccttcatggtcgacaaaccgcctgtaccacccaagccaaagatgaagcctattatccataagagcaatgccctgtatcaggatgctctggtggaggaggacgttgattcgtttgtgatcccgcctcccgccccaccccccccgcccgggtccgctcaaccagggatggccaaggtgctgcaacccaggacctctaaactgtggggtgatgtgactgaaatcaaaagcccaatattaagcgggccaaaagccaatgtcatcagtgagcttaactccatcctgcaacagatgaaccgagaaaagctcgccaagcctggagagggcctggatagccccatgggtgccaagtcagccagcctggccccccgcagtccagaaatcatgagcaccatctccggtacaagatccacaactgtgaccttcactgtgcggcctgggacctcacagccgatcacgttacagtcacgaccacccgattacgaaagcagaacaagcggtaccagaagagccccctcacccgtggtttctccaactgagatgaataaagagactctgcccgctcccctttccgcagcgaccgctagtccttctccagccctaagcgacgtcttctccctgccttcccaacccccttctggtgacctgttcggtctcaacccggctggacggtctaggtccccgagtcccagtattctgcagcaacctataagcaacaagccctttacaactaaacctgtgcacctgtggacaaaaccggatgtcgccgactggcttgaaagcctgaacctcggcgagcacaaggaggctttcatggataacgaaattgatgggtcgcatctccccaacttacaaaaagaggatcttatcgatcttggcgttactcgtgttggtcaccgtatgaatatcgagcgcgcactcaaacaactgcttgatagatag

SEQ ID NO: 204943 - DNA, 843 bp, Artificial Sequence
  Description of Artificial Sequence: Synthetic coding sequence
atgatgaacgtgcccggcggcggcgccgccgccgtgatgatgaccgggtacaacaatgggcggtgccctaggaacagcttgtatagtgactgtatcattgaagagaaaacggttgtgctgcagaaaaaagataatgaaggttttgggttcgtgctcaggggtgctaaggctgacacacctattgaagagttcacgccgactcccgcattcccagccctgcaatacctggagagtgtagatgaggggggcgtggcctggcaggcgggcctaaggacaggtgacttcctcattgaggtgaataatgaaaatgttgtaaaagtcggccacaggcaggtggtcaatatgatcagacaggggggaaatcatttagtcctcaaagtggttacagttacacgaaacctcgatccagatgacacagcgaggaagaaggccccacctcctccaaagcgcgctcccaccacggcgttaaccctgagaagcaaatctatgacctcggagcttgaggaactggtggacaaggcttccgtgcgcaagaagaaagataagcctgaagaaatagtcccggcatccaagccatcccgggccgccgaaaatatggccgtggagcctcgggtggcaactattaaacagagaccatcttcacgctgttttccagctggctcagatatgaacagcgtgtatgagcggcaggggatagcagtcatgacaccaaccgttcctggctcacccaaagcacccttcttgggcatccctagggggaccatgcggcggcagaagtcaattggaaagaagtgcgggactcccccccagaagctgccactggggtttcagactcaaccttag

SEQ ID NO: 204944 - DNA, 4413 bp, Artificial Sequence
  Description of Artificial Sequence: Synthetic coding sequence
atgaagagcctgctgaacgccttcaccaagaaggaggtgcccttccgagaggcacccgcctattccaacaggcgcaggcggccacccaacaccctcgctgctccacgagtgctgctgcgatctaattctgacaacaacctcaatgcgagcgctccggattgggccgtctgtagtactgccacaagtcaccggtccttatctccacagttacttcagcaaatgccatccaaacctgagggcgccgctaagaccattgggagttatgttcctggccctcgctcccgaagtcctagcctgaatcgccttggcggggcaggtgaggatggaaaacgaccacaaccactctggcatgtaggtagtccctttgctttgggtgccaacaaggactctttgtcagcatttgagtacccaggacctaaaagaaaactgtatagcgcagtaccaggtcgcctgtttgtcgccgtcaagccctaccagccacaagtcgatggtgagattccactgcacagaggggatcgggtcaaggtgctcagtatcggcgaagggggcttctgggaaggatcagcaagggggcacatcggctggtttcccgcagaatgcgttgaggaggtacagtgtaagcccagggatagtcaggctgaaaccagagcggaccgttcgaaaaagttgtttcgccactatacagtaggatcctatgacagctttgacaccagcagcgattgtattattgaggagaaaacagttgtgctacagaagaaagataatgaaggatttgggttcgtgctgaggggagccaaagccgacacgccgattgaggaattcacaccgactcccgctttcccagcgctgcaataccttgagagcgtcgacgagggcggcgttgcctggcaggccggactgcgcaccggcgatttcctcatagaggtgaacaacgagaatgtggttaaggtgggccataggcaggtcgttaacatgattcgccaaggcggcaaccaccttgtgctcaaagtggtcactgtgacacgcaacctcgatcctgatgacacggccagaaaaaaagccccccctcctccaaagcgggcacccactacagccctgacattgcgctccaaatctatgacctctgagttagaagagttggtcgacaaagcctcagtgcgtaagaagaaagacaagcctgaagagatcgttcctgctagcaagccatcaagagctgcagaaaacatggctgttgagccccgcgtcgccacgatcaaacagcggccatcttctcgctgtttccctgccggctctgatatgaactccgtctacgaaagacagggcattgcagttatgactcccacggttcccgggagtcccaaagccccctttcttggtatcccaagaggcacgatgaggaggcagaaatcaattgactcgcggatctttttgtcagggattacagaagaagagaggcagttcctcgcacctcccatgctaaaatttactcggtctttgtcaatgccggatacatccgaggatatcccccccccaccacagtctgtcccacccagcccaccacctccaagcccgaccacatacaactgccccaagagccccactcctcgggtgtacggaaccattaagcctgcctttaatcaaaattcagcagcgaaggtctcgccagccaccaggtcagatacagtagctaccatgatgcgcgagaaagggatgtacttcaggcgcgagctggaccggtactcccttgactccgaggatctgtactcccgcaatgcaggacctcaggctaattttcggaataaacgaggacaaatgccagagaacccctactctgaggtaggcaagatcgcttccaaggcagtttacgtccccgcaaagccagcgagacggaaaggaatgctcgtcaagcagtcaaatgtggaggactcccccgagaagacatgcagcatacctataccgacgataattgttaaagagccctccacttcttcctcagggaaatcttctcagggaagttctatggagatcgacccccaggctccagagccgccctcgcagctcagacccgacgagagtcttaccgtgtctagccctttcgctgccgccatcgctggggcggtgcgagatagagagaagcggctcgaagctcggaggaatagtcctgcatttctgagtacagacctgggggacgaagatgtcgggttgggaccccccgccccacgaacacggccttctatgtttcccgaagagggcgattttgccgacgaggactcagcggagcaattgtcgtcgccaatgccctccgcaacccctagagaaccagagaatcacttcgtgggcggggctgaagcctctgcccctggggaggctgggagacccctgaattcaaccagtaaagcccagggtccggaaagcagtcctgcggttccttcggctagctccgggacagctggcccaggaaactacgttcaccctcttacaggaaggctccttgaccccagctcacctctcgccctggcgctgtctgcgagagatcgagcaatgaaagagagccaacaaggccccaagggggaggcacccaaagcggatctaaataagccactctatattgacactaaaatgcggcccagtctggatgcaggattccccaccgtgacgagacagaatacccggggtccactgcgccggcaggagacggagaataagtacgagacagatctcgggcgtgaccgcaaaggggacgacaagaagaacatgcttatcgatattatggacacatctcaacaaaaatcagcaggcctgctgatggtacatacggtggacgccacaaagttggataatgctctgcaggaggaagacgaaaaggccgaagtggagatgaaacctgattcctcaccaagcgaggtgcctgaaggggtctccgaaacagagggcgccctgcagatcagtgcagcacctgagcccactactgtgccgggcagaaccatcgtcgctgttgggtccatggaggaggcagtgattctacctttccgcatccctccacccccactggcatccgttgatctggatgaagactttattttcactgaaccattacccccaccccttgagttcgccaattctttcgacatccctgatgacagagcagcgagcgttcctgcgctcagcgatttggtgaaacagaagaagtcagatacgccccagagccccagtttgaatagttcccaacccactaactcagccgattctaaaaagccagcctccctatccaattgcctgcctgcctctttcctcccacccccagaatccttcgacgcggtggcggacagcggcatagaagaagtggatagtcgaagctcttccgatcaccacctggaaacaacgtcaacgatctcaacagtgagcagcatatctaccctgtctagcgaaggcggcgaaaatgtggacacctgtacagtgtacgccgacgggcaggcctttatggtggacaaaccccctgttcctcccaaacctaagatgaagcccattatccataagtcaaatgctttataccaggacgccctagtagaggaagacgttgattccttcgtgataccaccacccgcccctccacctccacctggatcggctcagccaggcatggccaaagtgttacagcctcggacaagcaaactctggggggacgtcactgaaatcaaaagccccattctgagcggccctaaagcgaacgtgattagtgaactcaatagcattctgcagcagatgaaccgcgagaaactagccaagcctggcgagggactcgattcaccaatgggagccaagtcagcgagtctggccccccggagccctgagataatgtcaaccatctccgggacgagatccacaaccgtgacttttacggtgaggcctggtacctcccagcccataaccctgcagagtaggccacccgactacgaaagcaggacctcaggaaccagacgggctccttcacctgttgtgtctcctaccgaaatgaacaaagaaacactcccagcccctcttagcgcagctacagcaagtccatcaccagctctgagcgatgtattttcacttccatcccagccacccagcggcgacctgtttgggcttaacccagctgggcgatcaagaagtccttcgccctcaatactccagcagcctataagcaataaaccatttaccacgaaaccagtgcatctgtggacaaaacccgacgtcgctgactggcttgagtccttgaacctcggcgagcataaggaagcttttatggacaacgaaatcgacggtagccatcttcctaacctgcaaaaggaggacctcatcgatctgggcgtcaccagggtggggcaccgtatgaacatagaaagggcattgaaacagctcttagacaggtag

SEQ ID NO: 204945 - DNA, 816 bp, Artificial Sequence
  Description of Artificial Sequence: Synthetic coding sequence
atgatgatgaacgtgcccggcggcggcgccgccgccgtgatgatgaccggatacaacaatgggcggtgtccccggaacagtctctattcagactgtatcatcgaagagaagacggttgttttgcagaagaaggacaatgagggctttggattcgtgctgagaggtgcgaaggcggatacccctatcgaagaattcacgccaacccccgcgttccctgcccttcagtatcttgaatccgtcgatgaagggggcgtggcttggcaggccgggcttagaacaggggacttcctaattgaagtcaacaacgaaaacgttgttaaagtgggacacagacaggtggtaaatatgatccgccaggggggaaaccatctggtgcttaaagtggttacggttactagaaatctcgaccccgatgacactgcacggaaaaaagcccccccacctcctaagagagcccccactaccgccttgaccctgcgtagcaagagcatgactagcgagctggaggaacttgacaaaccagaagaaatcgttcctgcatcaaagccttcccgggccgcagagaacatggccgtggaaccacgtgtcgcaaccattaagcagcgcccaagttcgaggtgtttccctgctggaagcgatatgaacagcgtttacgagcgtcaaggaattgccgttatgacaccgacagtccccggtagtccaaaagctcctttcttaggcattccacgcggaaccatgcgcagacagaaaagcataggcaagaaatgtggaacacctcctcaaaaactgcctctgggattccaaacccagccgtag

SEQ ID NO: 204946 - DNA, 3765 bp, Artificial Sequence
  Description of Artificial Sequence: Synthetic coding sequence
atgatgatgaacgtgcccggcggcggcgccgccgccgtgatgatgacagggtacaataatgggcggtgccctaggaattccctctattccgactgtattattgaagaaaaaactgtcgtgctccagaaaaaagataatgagggcttcggcttcgtccttcggggggcaaaagcagatacccctatcgaggagtttacacctacccccgccttccccgccctccaatatctggagagcgtcgatgaaggcggggtggcgtggcaggctggacttcgcacaggagacttcctcattgaggttaataacgagaacgtcgtgaaagtgggacaccggcaagtcgtcaatatgatcagacagggaggcaaccatctagttttgaaggtggttaccgtgacgcgaaacctggaccctgacgacaccgctaggaagaaagctccaccaccccccaaacgagcaccaactactgcacttacactgcgtagtaagtccatgacatccgaattggaggaactggtagataaggacaaacccgaggagattgtgcctgcttctaagccatcccgcgcagctgagaacatggctgtggaacccagggtggctaccatcaagcagaggcccagtagtcgctgttttcctgccgggagcgatatgaactccgtgtacgagagacaggggattgccgtaatgaccccaacggtgcccgggtcaccaaaggcccccttcctcggaattccccgcggcactatgaggcggcagaagtccatcgactctcgcatctttctgtctgggatcactgaagaggagaggcaatttctggctccgcctatgctgaagttcacccgctccctgtcaatgccggacacctccgaagatatccctccccccccgcagagcgtgccccctagccccccccctcccagccccaccacatacaactgtccgaaatctccaaccccccgggtgtacgggacaataaagccagcttttaatcagaattccgcagccaaagtaagccctgcaaccaggagtgacacagtggccacaatgatgagagagaagggcatgtactttagaagagagctcgaccgctattcacttgactctgaagatctctacagtcgcaatgctggaccccaggccaatttcagaaacaagcgcgggcagatgccagagaacccctactccgaagtgggtaagattgctagcaaagcggtttatgttcccgccaaacccgccaggcggaaggggatgctagttaaacaatctaacgtcgaggattcccctgaaaaaacttgcagtatcccaatcccaactattatcgtaaaagagccatccacctcttcttccggcaaatcttcacagggttcttcaatggagattgatccccaggctccagagccaccgtctcagctgaggcccgacgagtccttaaccgttagcagccccttcgccgctgctattgctggggctgtgcgggatcgcgaaaaaagactcgaggctcgacgcaactctccagccttcctctctactgatctgggggatgaggatgtgggtttaggccctccagcccccagaacaagacctagcatgtttcccgaagaaggcgattttgccgacgaagacagcgcggagcagctgtctagtccaatgcctagcgccactcctcgcgaacctgagaaccactttgtgggcggagctgaggcaagtgctccgggcgaggctggtcgaccgctcaacagcactagcaaagcacagggacccgaaagttctcccgctgttccctccgcgagctccgggaccgccggacctgggaactatgtgcacccgttgacaggacgtctcttggatccatcctccccactggccctcgccctgagcgctcgggatcgcgccatgaaggagtcacagcagggccccaagggtgaagcgcccaaggccgatctcaataaacccctgtacatcgataccaagatgaggccatccctcgacgcaggcttccccaccgtgacacgtcagaatacacgcggcccactacgacgtcaggagacggaaaataaatacgaaactgacttaggtcgggatcgtaagggggatgataagaaaaatatgctgatagatattatggatacttcgcaacagaagtcggccggcctgctcatggtgcatacagtcgatgccacaaagctggataacgcattgcaagaggaagatgagaaggctgaagtcgaaatgaaacccgatagctccccaagtgaggttccggaaggcgtgagtgaaactgagggcgctttacagattagtgccgctcccgaaccaaccactgtgcccggaaggaccattgtggcggtaggttctatggaggaggctgttattcttcctttccggatacctccgcctcccctcgcctcagtggacctggatgaagacttcatttttaccgaaccgttgcctccgccacttgaattcgccaatagctttgatatccctgacgaccgagctgccagtgtcccagccttgagtgatctagtaaagcagaagaaatctgacaccccacagtctccttccctcaatagtagccagccgacaaattccgccgatagtaagaagccggccagcctgagcaattgcctgcctgccagcttcttgccccccccagaaagtttcgatgccgtggccgattcgggaatagaagaagtggacagcaggtccagtagcgaccatcacctggaaacaactagtactattagtacagtctcctctattagcaccctctccagcgaagggggcgagaacgtggatacctgcaccgtctacgcggacggacaggcgttcatggtggacaaaccccctgtgccgcctaagccaaaaatgaagcccattatccacaaaagcaacgctctatatcaggacgctctggtggaggaggatgtggactcattcgtgataccaccccctgccccccccccgccacccggttccgcccaacctggtatggccaaagtgctgcagcctcggactagcaagttatggggtgacgttactgagatcaagagcccgatcctgagtgggcccaaggccaatgtgatatctgagctcaattcaatcttacagcagatgaaccgagagaagcttgccaaaccaggagaggggctcgattcccctatgggagctaagtccgcctccctggccccgcggagtcccgagatcatgtccaccatctcgggaactcgctctactactgtgactttcacagttcgacctggcacctctcagcctattaccctccagtcgaggcctcccgattacgaatcaagaacatcaggcacacgcagagcaccaagtcccgtggtaagcccgactgagatgaacaaagaaactctacccgcacccctctccgctgcaactgcgagcccatctcccgcgctgtcagatgtgtttagtctgcctagccaacctccttctggcgatctattcgggctgaacccagccggtcgatcgcgttctccgtccccctctatcctccagcagccaatcagcaataaacccttcacaacgaaaccggtgcatttatggacaaaacctgacgttgccgattggctggagtcgttaaacctgggggagcacaaggaggcctttatggataatgagatagacgggagtcacctgcctaatctgcagaaagaggacctcatcgaccttggagtgactcgagtcggacaccgaatgaacatcgagcgagcccttaagcagctgctggacaggtag

SEQ ID NO: 204947 - DNA, 915 bp, Artificial Sequence
  Description of Artificial Sequence: Synthetic coding sequence
atgccccggagccccaccagcagcgaggacgagatggcccagagctttagcgactactctgtgggaagcgagtcggacagctcaaaagaggaaaccatctacgatacaatcagagctaccgccgagaagcccgggggggccaggactgaggaatctcagggtaacaccctggttattcgagttgtgattcacgacttgcagcagaccaaatgcatccgcttcaaccctgacgcaaccgtttgggtcgcgaagcaacggattctgtgtaccctgacccagagcctgaaggacgtgctgaactatggacttttccagccagcgagtaacggcagggatggtaaatttctcgacgaggagcgtctgctgcgggaataccctcagccagtcggggaaggcgtgccctctctggagtttagatacaagaaaagagtctacaaacaagccagtttggatgaaaagcagctcgccaaactgcatacaaagactaacctgaagaagtgtatggatcatatacagcatcgtctagtggaaaaaatcaccaaaatgctggacagaggactggaccccaattttcatgatcctgaaaccggagaaacccccctgacattggcagcgcagctggacgacagtgtggaggtgattaaggctctgaagaatggcggagcgcacttggactttagggcgaaagacggaatgactgctctccacaaggcagcccgggcgcgaaatcaagtagcccttaagacactccttgagctgggtgcatctcccgactacaaggactcttacggccttacccccttatatcacaccgccattgtaggcggggacccctattgttgcgagctgcttctccatgaacatgcgacagtgtgttgcaaagatgagaacggatggcacgagatccaccagtag

SEQ ID NO: 204948 - DNA, 5244 bp, Artificial Sequence
  Description of Artificial Sequence: Synthetic coding sequence
atggacggccccggcgccagcgccgtggtggtgcgggtgggcatccctgacttgcagcaaactaagtgtctgagactggatcccgctgctcccgtctgggccgcaaagcagcgtgtactgtgtgcccttaatcacagcctgcaggacgcgctgaattatggtcttttccagccaccctcacgaggccgcgcgggtaagttcctggacgaagaacgtctgctacaggaatacccaccaaatttagatacccctttaccgtacctggagttccggtataaaagaagggtgtatgcacagaacctgatcgatgataagcagttcgcgaaactgcatacaaaggcaaatctcaagaagtttatggactatgtgcagctgcacagcacggataaggttgcccggcttttggataaggggctagaccccaatttccacgatccagactcaggtgagtgtccgctctcactggccgcccagctggacaacgccaccgatcttctgaaggttctgaaaaacgggggggcccatctggacttccggactcgcgacggtctcaccgccgttcactgcgctacacggcagagaaacgcggcagctctgactaccctgttggatcttggcgcttctcctgactataaggactctagaggcttgacacccttataccactccgctctcgggggaggcgatgctttgtgttgtgagctgctcctccacgatcacgcccagctaggtatcaccgatgagaacggctggcaggaaatccaccaggcatgcagatttggtcatgttcaacacctcgagcatctcctgttctacggcgccgacatgggagcccagaatgcttcagggaacaccgctctccacatttgcgcactctataatcaggaaagttgcgcacgggtactgctgttcagaggagctaaccgagacgtccgtaactacaacagccagactgcattccaggttgccattattgccgggaactttgaactggctgaggtcattaagacacataaagattcggatgtcgtcccctttagggagaccccttcatatgccaaacgcaggaggctcgcaggaccaagcggtctggcatctccgcgaccactccagagatccgctagcgacatcaatctgaagggcgaggcccagccggcagcaagtcccgggcccagcttaagatcactcccacatcaactgctgctgcagcggctgcaggaagaaaaggaccgcgatagggacgcggatcaggagagtaatatcagtggccccctcgctggcagagccggtcagagcaaaatttcagaccctggaccaggcccaggcggagttggtggcgctccccttcccccccctggggctccccgcagttgcattcgtatccgggccaggtttcccgccccccccgctccaccagcgccacccccgcgtggacctaagcgaaagttgtattccgccgtgcctggaaggaagttcatagcagtaaaggcccacagccctcaaggcgagggtgagattccactacaccgaggcgaagcagtgaaggtgcttagcatcggggaaggcgggttctgggagggaactgtcaaaggccggaccggatggttcccagctgattgtgtggaagaggtccagatgcggcagcatgatactcggccagagacccgtgaagatcgcactaagaggctgttccgccattacaccgtcgggtcttacgacagtctgacgtcccactccgattatgttatcgatgataaagtggccgtattgcagaaaagggaccatgagggttttggttttgtcctgaggggtgccaaagctgaaacaccaatcgaggaattcacgcctactcctgcttttccagcattgcagtatctcgaatccgtggacgtggagggagttgcttggagagctggattgcgcacaggtgacttcttgattgaagtgaacggcgttaatgtggtgaaagtaggccataagcaggttgtggcactaattaggcagggcggaaaccgcttagtgatgaaagtggtgtctgttacgcggaagcctgaggaagatggagccaggcgtagggccccccccccgccgaaacgagcaccctctacaacgctcacactgcgtagtaaaagtatgaccgccgagctcgaagaacttgccagcatcagacgccgaaaaggagagaagctagatgagatgctggcagcggctgcggaacctactttgcgtcccgacatcgcagatgctgatagccgggccgctaccgtgaagcagcggcctacctctcgcagaatcactcccgccgaaatttcttccctctttgagcgccaggggttgcctggccctgagaaactgcccgggtctctgaggaaaggcatccctcgaaccaagtctgtcggggaagatgaaaagttggccagtctcctggagggccgattcccccggagtactagcatgcaagacccagttagggagggacgaggaattcccccacctccccaaactgcgccgcccccgccacccgctccgtactattttgacagcggtccccctcccgctttctccccacctcctcccccgggcagggcttacgatacagtccgctccagcttcaaacccggactcgaagccaggctaggagcaggtgcggccggcctctacgagccgggagccgctctaggcccccttccctatcccgaaagacagaagagggcgcgctccatgataatactccaggacagtgctcccgaatccggggatgctcctcggccaccccctgcagcaactccacctgagcgccccaagcgaagaccgcgacctcccggtcccgacagcccatacgccaacctcggcgctttctctgcatctctgtttgctccttccaagccacaacgcaggaagagtccgctggtgaagcagctgcaggtggaggacgctcaggagcgtgctgcgctggcggtcggatctccggggcccggcggcggctcttttgctagggaaccttcccctacccatagggggccacgacctggagggctggattatggagcgggagacggacctggcttagcctttgggggcccaggccctgccaaagatcggaggctggaggagcgtcgtaggtctacagtatttctctcagtcggcgccatcgagggttcagctcctggagctgatttaccttccctgcagccctctcggtctatcgatgagcggctgctgggcactggacctaccgctggtagggacctgctgctgcccagtcctgtgagcgcccttaaaccactggtgtctggcccgagcctaggcccatccggcagcacctttatacaccccctgactggcaagcctctggatccctccagtccgttagctctggcgttagccgcccgggaacgtgctttggcttcccaggccccctcccggtcacctacaccggtgcacagtccagacgccgaccgccctggacccctgtttgtcgatgttcaggctcgagacccagaacgcggcagtctggccagcccagcatttagccctagatcgcctgcgtggattccagtgcccgcaagaagagaggccgagaaggttccacgtgaggaacgcaaatctccagaagacaaaaaaagcatgattctgtctgttttggatacctctctgcagcgccccgctggtctgattgtggtgcatgccacctctaatggacaggagccatctagattgggaggcgcggaggaggagcgccccggtacaccagagcttgccccagccccaatgcagtccgcagctgtggctgaacctctaccatccccacgcgcacagcccccaggggggaccccggccgacgccggccctgggcagggttcttccgaagaggaacctgaacttgtcttcgccgtcaacctgccccccgcacagctttcttcttcagatgaggagactcgagaagagctcgcccgaatcgggctggttccccctcccgaggagttcgcaaacggagtgctgctggcaacacctctggcaggccctggtcctagccccactactgtgccttctccagcttccgggaagccctcaagtgaacccccgccagccccagagagcgcagcggatagtggcgtcgaggaggctgacaccagaagcagttcggatccccacttagagactaccagcacaatttccaccgtttcttctatgagtacactcagctctgagtcaggagagctgacagatactcacacatcctttgctgacggacatactttccttttggaaaaaccccctgtccccccgaagcccaagctgaagtcacccttaggcaaagggcccgtcacatttagagaccccttactgaagcagagctcggattctgaattgatggcacaacagcatcacgcagcgtctgccggtctcgcttcagctgccggacccgcgagacctagatatctctttcagcgtagatccaaactgtggggggatcccgtggaaagcagaggactgccgggccccgaggacgataagcctaccgtgatttctgagctgagctcaaggctgcagcagctgaataaggacacacggagtctgggggaggaaccagtgggcggcctgggctccctcttggaccctgcaaagaaatcaccaatcgctgccgccagattattctcttccctaggcgaactttccagtatttccgctcaacgaagccctggtgggccaggcgggggagccagctatagcgtccggccttcaggtcgttatcccgtggctcgccgtgccccatctccggttaagcctgccagcctggaacgcgttgaggggctaggtgcgggggcaggcggagctggaaggccttttggccttacccctccaactatcctcaagtcctcatccctgtctatcccccatgaacccaaggaagtaaggtttgtagtccggagtgtcagtgctaggtccagatctcccagtccctccccgctgccctcgcccgccagcggaccagggcccggcgcaccagggcctcggcgtcccttccagcagaaacccctgcaactgtggtccaagttcgatgtgggcgactggctcgaaagcatacatctgggcgaacacagggaccggtttgaagatcacgaaatcgaaggagcacacctgcctgccctgactaaggatgatttcgtggagctaggcgttacacgggtcgggcatcgcatgaatattgaacgcgctctgcgccagcttgatggcagctag

SEQ ID NO: 204949 - DNA, 5229 bp, Artificial Sequence
  Description of Artificial Sequence: Synthetic coding sequence
atggacggccccggcgccagcgccgtggtggtgcgggtgggcatcccagatttgcaacagaccaaatgtttacggttggatcctgccgcccctgtatgggccgcaaagcaacgagtactgtgtgctctgaatcacagcctgcaagatgcattgaattacggcttattccagcctcccagtcggggacgagcaggtaagtttcttgacgaagagaggttgctgcaagagtacccccctaatctggatactccccttccatatctggagtttaggtacaagcgacgggtgtacgcccagaatctgattgatgacaagcaattcgccaaactgcacacaaaagccaacttaaaaaaatttatggactacgtgcagctccatagtacagacaaagtcgctcgactcctggataagggattggaccctaacttccatgatcccgattcgggggaatgccctctctctctggctgcccagctggacaacgctactgatctgctcaaggtgctcaagaatgggggagcacatttagacttccgaacccgcgacggactcaccgctgtgcactgtgccaccagacagaggaatgctgccgctctgacgactctcctggatcttggggctagtcctgattacaaagattcccgaggtcttactccactgtaccattcggccctcggcggcggcgacgctttatgttgcgaactgttactccacgaccacgcgcagctggggataactgacgagaacggatggcaagagatccaccaggcgtgtagatttggccatgtgcagcacctggagcacctgctcttctatggggcagatatgggagcccagaatgcgagcggcaatacagccctccatatctgcgcattgtacaatcaggaaagttgtgcccgggtgctgctgttcagaggagctaatcgggatgttagaaactataatagccaaacagcttttcaggtggccatcatcgccggaaatttcgaactggccgaagtgatcaagactcataaagatagtgatgtcgtaccttttagagagacccccagctacgccaagcgtcgaagattggcagggccttccgggttagcctccccccggcccttgcagaggtccgcatcggatattaaccttaaaggggaggcccagcctgcagcatcccccggaccttccctgagaagtttacctcaccaacttctgctgcaacggcttcaggaagagaaagaccgcgaccgtgatgccgaccaggagagcaacatttcaggccctctcgccgggagagccggacagagcaaaatcagcgagcccggtgcccctcgctcttgcatccgcatccgggcccggttccctgcgccgcccgcaccgcctgccccccccccccgcggaccaaaaaggaagttgtacagcgccgtgcctggccgaaaatttatcgctgtgaaggcacattccccccagggcgagggggaaattccactgcacagaggagaggcagtgaaggtgctttctatcggggaggggggcttttgggaagggacagttaagggtaggacaggctggtttcccgctgactgtgttgaagaggtgcagatgcggcaacacgacacgcgccccgagactcgcgaagaccggaccaagcggcttttcaggcactacacagtggggtcctacgattcgttgacctcccactcagattacgtgatcgatgataaggtggcagtgctgcagaaacgggatcacgagggcttcggttttgtactgaggggcgctaaggctgagactccgatagaggaattcactccaacacccgcatttccagcactgcagtacctggagtctgtcgacgtggagggcgtggcctggagggcaggcctacgaacaggggattttttgatagaagttaatggagtgaacgttgttaaagttgggcataaacaggtggtcgccctgattcgccaaggaggcaaccgcctggtaatgaaggtggtttcagtgacccgtaagcctgaagaggatggagcacgccgtagagcgccgccccctccaaaaagggctccttccacaaccttgacgctcaggagcaagtccatgacggcagagttagaggagctcggggagtggcgtggcagggaggggagcgagaaattggatgagatgctggctgcagcagctgagcccactctaagacccgatatagccgacgcggattctagagcagctaccgtgaaacagaggccaacaagccgccgcatcaccccagctgagatctcatccttgtttgaacgccaggggctgcctggccccgagaagctccccgggagcctgagaaaaggcataccccgtaccaagtcggtgggggaggatgagaaacttgccagcctcctggagggaaggttccctaggtcaacttccatgcaggaccccgtgcgagaagggcgcggaatcccgccccctcctcagacagcccccccacctccgcctgctccgtactattttgatagcggccccccgcctgcattcagtccgccgccaccccccgggagagcatacgataccgtaagatcgagcttcaaaccagggttggaggcccgtctgggtgccggagctgcagggctgtacgaacccggcgctgcccttgggcctctcccttatcctgagcggcagaagcgggcccgttcaatgattattctgcaggattcagcccctgagtccggtgatgccccccggcctcccccagccgctactccaccagagagaccaaagcggcgaccaaggccccctggaccagacagtccttacgctaatcttggcgccttcagtgcctcactttttgccccctcaaaaccccaacgccggaagagccctcttgtgaagcagttacaggtcgaggacgcacaggagcgagccgccctggctgtcggctctcctggcccgggggggggctctttcgcccgagagccctcacctacacacagggggccacgacctggggggctggactatggtgccggggatggtccaggactggcttttggaggcccagggcccgcgaaggatcgtagacttgaagaacggcggcgctctacagtgttcctctccgtcggagccattgaggggtcggccccaggcgccgatctgccctccctccaaccctcccgatccatcgacgaacggctgctgggaacaggccccaccgcaggcagggacctccttcttccctcaccagtgtccgccctgaaacccctggtttccggacccagtctagggccctctggtagtacgttcatacaccccctgaccggtaaacctctggacccctcctctcctctcgcactggcactcgctgcccgcgagcgcgccctggcatcccaggctccctccaggagcccaacccccgtgcacagtcctgatgctgaccgccccggcccactatttgttgacgttcaggccagggacccggagcgggggtccttggcgtctcctgcttttagccccaggtcccccgcctggattcctgtcccagcccggcgggaagctgagaaggtgccccgcgaagagagaaagagccctgaagacaagaagtctatgattctctcagttcttgacacatccctgcagcggccagcaggactgatcgtggttcatgccacttccaacggccaagaacctagccgactggggggcgccgaagaagagagaccaggtacaccagaactcgctccagccccgatgcagagtgcagcagtggcagaacccctgccgagcccaagggcccagccacctggtgggacccccgctgatgcgggaccaggacagggcagctctgaggaggagcccgagctcgtctttgcggtgaacctcccacctgcacagttgtccagctcagacgaggagaccagagaggagttagctcggatcggcctggttccccccccagaagaattcgcaaatggggtcctactcgctactccgctggcagggcccggccctagccccacaaccgtgcccagtcccgcgtccgggaaaccatcaagtgagccccccccagctcctgagtccgctgcggattcaggcgtggaagaggccgatactcgatcctcttcagacccgcatctggagaccacgtcaacaatatctaccgtctcaagtatgagcactctgtcctctgagagtggcgaacttacagacacacacacatcatttgccgacggccacaccttcctgctggagaaacccccagtgccccccaaacccaaactgaagtcccctctcggcaaaggccccgtgacctttcgtgatcccctgctaaagcagtcatccgatagcgagctgatggctcagcagcatcatgcagcttccgcaggtctcgcctctgcagcaggcccagcgcgccctcgctatttgtttcagcggaggtcaaaactgtggggggatccggtcgaatcccgcggactacccggtccagaggacgataagcctacagtgatatcagaactcagctctagattgcagcagctgaataaagataccagaagcctgggggaggaacctgtggggggactgggtagtctcctggaccctgcaaaaaaatcccccatcgctgccgctcggtgtaggtctccaatggttggactccggctcttttctagtttaggggagctttcttcaatttctgctcaaaggtcacccggcggtcccggaggtggggccagttacagcgttcgcccttcagggcggtatccagtagcccgacgcgcgccgtctcctgttaaaccagcatccctcgagcgggtcgagggcctgggtgcaggagctggaggcgcgggccgcccttttggcctgaccccacccactatcttgaagagctctagcttatcaattcctcacgagccaaaggaagttcgctttgtcgtccgctcagtctcggcccggtcacggtcccccagccccagcccattgccttccccagcttccgggccgggccccggagcccccggcccccgaagaccttttcagcaaaaaccccttcagctgtggagcaaatttgacgtaggagactggctggagtcgattcacctgggcgaacacagggacaggtttgaggaccatgagatcgaaggtgcccatttacccgccttaacaaaggatgattttgtggagttaggtgtgaccagggtgggacatcgaatgaatatcgaacgagccttacgtcagctcgacgggtcatag

SEQ ID NO: 204950 - DNA, 2736 bp, Artificial Sequence
  Description of Artificial Sequence: Synthetic coding sequence
atgcccccccggcggagcatcgtggaggtgaaggtgctggacgtgcaaaaaagacgtgtacctaacaagcattacgtctacatcatccgagtgacgtggagtagcggcagtactgaggctatatatcggaggtattcaaagttctttgacctccagatgcagatgctcgacaagttccccatggaaggcggacagaaggatccaaagcaaagaattatcccattcctgccggggaagattctgtttagacggtcccatattcgggatgtggcggttaagagactcatccctattgacgagtattgcaaggcactcatccagctgccaccgtatatctcacaatgtgacgaggtcctccaattcttcgagacgcgtcccgaggatcttaaccctcccaaagaggagcacataggaaagaagaagagtggcggggaccagactagcgtcgaccctatggttctggaacagtacgtagtcgtcgccaattatcaaaagcaggagagctcagagatctctctgtctgtcggacaagtagtggatatcattgaaaagaatgaatccggttggtggtttgtgtccaccgccgaagagcagggctgggtgccagcaacctgtctggaggggcaggacggggttcaggacgaatttagtctgcaaccagaagaggaggaaaagtacacagtcatttacccgtacacggctagagaccaggacgagatgaacctggagcgcggcgcagtggtggaggtcattcaaaagaatctggagggttggtggaagatcaggtaccaaggcaaagagggctgggccccggccagctacctcaagaagaatagtggcgagcccctacctccgaagcctggtcctgggtcccccagccaccccggcgcacttgacctggacggcgtctcccgtcagcagaacgctgtcggaagagagaaagagctgctcagcagccagcgggacggaaggtttgaggggaggcccgtgcccgacggtgatgccaagcagcgatctcccaagatgagacagcgcccacccccacggagggatatgacaattccacgcggactcaatctgccaaaaccccctatcccaccccaggtggaagaggagtactatacaattgccgaattccaaaccaccattccagatggcatcagctttcaggccggcctcaaagtcgaagttatcgaaaaaaacctgtcgggatggtggtatatacaaatcgaagacaaagagggttgggcccccgctacttttatcgacaaatacaagaagacatctaatgcgtcacgccctaacttcctggcccccttgccccacgaagtcactcagctgcgcttgggggaggccgctgcactggagaataacacaggcagtgaggccactggcccaagtagacctctccccgatgccccccacggtgtcatggatagtgggcttccatggtcgaaggattggaaaggtagcaaggacgtcctgcgcaaggcatctagtgatatgtccgcgagcgccggatacgaggagataagcgacccagacatggaggaaaagccaagcctgcctccaaggaaagaatctattatcaagtcagagggggagttgctggagcgagagagagaaaggcagagaacggaacagctccgcggccctactccgaagccgcccggcgtgatccttccaatgatgcctgccaagcacattccccctgctagggactcgaggcgccctgagcccaaacccgataagtctcgcttgttccagctgaaaaacgatatggggctggagtgtgggcataaagtactcgcaaaggaagtaaaaaaacccaatttaaggcctattagcaagagcaagactgatctgcctgaggagaagccagacgcgacaccccaaaacccttttctcaagtcgcggccccaagtgaggcctaaacccgccccttcacctaaaaccgagcccccgcagggagaggatcaggtggacatctgcaaccttcgtagcaaactcagacccgccaagtctcaggacaagtccctgctcgacggggagggcccacaggcagtgggaggccaggacgtcgctttcagccgctcatttctacccggggagggcccaggcagggcccaggatcgtaccggcaagcaagatggactttctcctaaggagatcagctgtcgcgcccccccaagacccgcaaagactaccgacccagtttccaagtcagtaccagtgcctctccaggaagcacctcagcagcgcccagttgttccaccccggcgcccccctcctccaaaaaagacttcttcctctagcagacccttgccagaggtcagaggaccccagtgcgaagggcacgagtctagggctgcacccacaccgggacgggcgctacttgtacctcccaaggctaagccattcctttctaatagtctggggggccaggatgacacaaggggcaaaggcagcctcggtccatggggtacgggaaaaattggcgagaatagagagaaagccgccgcggccagcgtgccaaacgccgatggactgaaggattcactttatgtagccgtggctgacttcgagggggacaaagatacaagttcctttcaggagggtaccgtcttcgaagttcgggagaaaaattcaagcgggtggtggttttgtcaggtgctctcaggcgcaccaagctgggaagggtggattccctccaactacctccgaaaaaagccatag

SEQ ID NO: 204951 - DNA, 2805 bp, Artificial Sequence
  Description of Artificial Sequence: Synthetic coding sequence
atggaggagatctggaagttcagcacctacctgaacctgggctacgtaagtatgtgccttgagcacttattgtttgaccacaaatactggctcaactgcatcctggtagaggacactgaaatacaggtgagtgtcgatgacaaacacttggaaaccatttaccttggtctgttgatacaggaagggcacttcttctgccgggcgctgtgtagcgtcaccccccccgccgagaaagaaggcgagtgtctaaccctgtgtaagaatgagctaatcagtgtgaaaatggcagaggccggcagtgaactcgagggcgtaagcttggtcaccgggcagcggggcctagtactggtctcggccttggagccgctaccgctcccattccaccaatggtttttgaagaattaccctggctcgtgcggtctgagtagaaaaagggactggaccggcagctaccagatcgggcggggccgttgtaaggccctcacggggtacgagccaggcgaaaaggacgaactgaatttctatcagggtgagagcattgaaattataggctttgtcatcccagggctgcagtggtttatcggaaagagcactagcagcggccaagtaggcttcgtgcccacccgcaacattgacccagattcctatagcccgatgagtagaaactcagcttttcttagtgacgaggagagatgctctctgctggcccttgggtctgataaacagaccgagtgcagcagttttctgcacacactggcacgcaccgacataacaagtgtctataggctaagtgggtttgaatcaatccaaaacccccccaacgacctatcggcgtcacagcccgaaggattcaaggaggttagaccagggagggcctgggaggaacaccaagctgtggggtcccgccagagcagcagttctgaagactcgtcacttgaggaggagctcctctctgcgacctctgactcataccggctgccggagccagacgacctcgatgacccagaattgctgatggacctttctaccggacaggaggaagaggcagagaattttgccccgattttggcgtttttagatcatgaaggctatgccgaccacttcaaatccctgtacgacttttcatttagctttctgacgtcctctttctacagtttttctgaagaggatgaatttgtagcctacttagaggcatcaaggaagtgggctaagaagagccatatgacctgggcccatgcacggctctgctttttgttaggtcggctgtccattcgcaaagtcaaactgagccaggcccgggtctatttcgaggaggcaatccatattcttaacggcgctttcgaagatctatctctggtcgctactctctatatcaaccttgccgctatctacctcaagcagcgattgaggcataaagggtcagctcttttggagaaagcaggcgctctgctcgcctgtctgcccgatagggagtcatccgcaaaacacgaactcgacgtggtcgcctacgtgctgagacagggtattgtggtggggtcttctccactggaggcgcgagcttgctttttagcaattcggttattactctcactcgggaggcacgaggaggttctgccatttgctgaacggcttcagctcctgtcgggccatccccccgcatccgaggccgtggcctctgtactgagctttctgtacgacaaaaaatatttgccccacctcgctgtggcttccgttcagcagcatggtattcagtctgctcaggggatgtctttgcccatatggcaggtgcacctggtgctgcagaacacgaccaaactgctgggctttccaagccccggatggggggaggtgagcgccctggcttgccctatgctgagacaggccctggccgcttgtgaagagctggctgaccgttcaactcaacgagccctctgtttgattttgagcaaggtttatctggagcaccgatcgccagacggtgccatccactatctgtctcaggccctggtgctgggtcagttgcttggcgaacaggagagtttcgaaagttctctctgcctagcgtgggcatacctgctggcctcacaggcgaaaaaagccctagatgttctcgagcccctgttatgctcccttaaggaaaccgaatcattgactcagcgaggggtgatctacaatttgctgggcttggctttgcagggcgagggacgggttaatcgggcagccaagagttatctgagggcccttaatcgcgcccaggaggtgggcgacgtgcacaatcaagctgtggcgatggcaaacctcggtcacctgagtctgaagtcttgggctcagcacccagcccggaattacctactccaggctgtgcgtctgtattgcgagcttcaggcctctaaggagacggatatggaattggtgcaggtcttcctgtggctggcacaggttcttgtgagtggtcaccaactcacccatggcctgctgtgttacgagatggccctccttttcgggctgcgccaccggcacctcaagagtaagtatgtgccatgttgctgggaggccattgagaagagcgtcggcagcagcttcatccattttctgtctcaggttattagttttatgagcctgctgtgcgtgcaggtctcttttcgcccccctaatcctagtgctatctccaccgcgctttgcccacagacacttagacacgctagtcctacaatgtctaccggttggccttggctcagtaacagcggcacggggcggtggaaaggggggtgttggagcccatgggggtccttcattggaacctag

SEQ ID NO: 204952 - DNA, 453 bp, Artificial Sequence
  Description of Artificial Sequence: Synthetic coding sequence
atgagcgagcagatgatgcagagcgtgggctgccggatcagcctgagcgtctttcaatttctgggcgaccagaggcaggagttagtcgccttccaccgcctggcaacggtctattattccctccacatgtacgaaatggcagaggactgctacctgaagacattatccttatgtcctccatggcttcagtctcccaaagaggccctgtactacgccaaagtttattacagactcggcaggctgaccttctgccagctaaaggacgcccatgatgccacagagtactttttactggccctcgcggctgccgttctgctgggggatgaggaactccaggataccatccgctcccgtctggataatatttgtcagagcccgctgtggcacagcagaccatccggctgttctagtgagcgggcccgatggctgtcaggcggcggcctcgccctatag

SEQ ID NO: 204953 - DNA, 3867 bp, Artificial Sequence
  Description of Artificial Sequence: Synthetic coding sequence
atgggcggctgcttctgcatcccccgggagcggagcctgacccggggccccggcaaggagacccccagcaaggaccctactgtttcttccgagtgcatcgcctccagtgaatacaaagaaaaatgttttctgcctcagaatattaatcctgacctgaccctcagcttctgtgtgaaaagtcggagtcggcgctgtgtcaatggacctctacaggaagcagcacggaggaggctgtgggctttggaaaacgaggatcaagaggtccgcatgctgtttaaagacctttctgctcgccttgtgtctattcagtcacagagggcccagtttttaattactttcaaaacaatggaggagatttggaaattctcaacttacttgaacctcggatacgtctctatgtgcttggagcatctcctctttgatcataagtattggctgaactgtatactggtggaagataccgagatccaggtgtccgtggacgacaagcatttggagaccatatatctgggactcctgatacaggagggtcactttttctgccgcgctttgtgctctgttactcccccagctgagaaggaaggcgagtgcctcacactgtgtaaaaatgaactaatctcggtgaaaatggcagaggcaggctcagagcttgaaggcgtgtccctcgttaccggacagcgtgggctggtgctggtgtccgccttagaacccctgcccctgcccttccatcagtggttcctcaaaaactacccaggatcatgcggcctgagtcgaaaacgcgactggaccggatcataccagatcggccggggcaggtgtaaagctcttaccggctacgagccgggtgaaaaggacgagctcaatttctatcaaggggaatcaatagagattattgggttcgtcattcccggacttcagtggttcatcggcaaaagtacctcaagcggccaagttgggtttgtgcctacccggaacattgacccagactcctattcccccatgtccagaaattccgctttcttgagcgatgaagagaggtgttccctacttgcccttggctccgataaacagaccgagtgcagttcctttctgcatacactggccaggacggacattacgagtgtttatcggctgtcaggctttgagtctatccagaatccccctaacgacctaagcgcctctcagcctgagggctttaaggaggtgcgtccaggacgtgcttgggaggaacaccaggccgtgggtagtcggcagtcttcttcatcggaggattcaagcctggaggaagagttgctatccgcaacctctgatagctaccgcttacccgagcctgatgacttggacgaccccgaattattgatggacctgagcaccggtcaggaggaagaggccgaaaatttcgcccctatcctggccttcttggatcatgaaggctacgccgaccattttaagagcctgtatgactttagtttcagcttccttacttctagtttttattcttttagtgaggaagatgagttcgtggcgtatttggaagcttctcggaagtgggccaaaaagagtcacatgacttgggctcatgcccggctgtgtttcttattagggaggctgtccatccgcaaggttaaactgtctcaggcacgggtatactttgaagaggccatacacatcctgaatggcgcgttcgaggatctatctttggttgccactctatatatcaatctggcggctatttatctgaagcagagactgcgccataaaggttctgccctgctggagaaggctggagcgcttttggcatgcctccctgacagagagtcatcagctaaacacgaactggatgtggtcgcttatgtgctgcgccagggcatcgtggtcggctcttccccgctggaagcccgcgcctgcttccttgccatcaggcttctactcagcctgggtcgccacgaggaggtgctgccatttgcggaaagactgcagttgttaagtggtcatccacccgctagcgaagccgtcgcgagtgttctgtccttcctgtacgacaagaaatatctacctcacctggccgtggcctcagtgcagcagcacggtatccaatcagcgcaggggatgtccctgcctatctggcaggtgcacctggtcctgcaaaacactaccaaactgctcggcttcccctctccagggtggggagaggtgtcagcattggcttgtccaatgcttcgccaggctctggccgcctgcgaagaactggctgataggagcacccagcgagccctatgtttgatactgtcgaaggtctacttggaacataggagtcccgatggggcaatacattacctgagccaggccctcgtgcttggccagctgttgggggagcaggagtcctttgaaagctccctctgcctggcgtgggcctacttactggcctcccaggcgaagaaggcgctggatgtgctcgagccactactgtgtagcctgaaggaaactgaatctcttactcaacggggagtgatctacaatctgctgggtctagctcttcagggagagggaagagtcaatcgggccgccaagagctatctacgcgcgcttaatcgcgcgcaagaggtcggtgatgtccacaatcaggccgtggctatggcgaatctgggacatctgagcctgaagtcttgggctcagcatcctgcgcggaactatctcctccaggctgtcaggttgtactgtgaactgcaggccagcaaagaaacggatatggagttggtacaggtatttctatggctcgctcaggtgctagtatctggccatcagcttactcacggccttttatgctacgaaatggccttgctgtttggcttacggcacaggcatctgaaaagtcagctgcaggctacaaagtcgttatgccatttttactcctcagtgtcacccaatcctgaggcctgcattacgtatcatgagcattggctcgcgctggcccagcagttacgggatagggagatggaagggagactacttgaatcactcgggcagttgtatcgaaatttaaacacagcccggtcactccgccgatccctcacatgtattaaagagtctctgagaatttttatagatctgggcgagactgacaaggcagcagaggcatggttaggtgcagggaggctgcattaccttatgcaggaagatgagctggtggaactctgcctccaggcagccattcagaccgctcttaagtcagaggaacctcttctggcacttaagctgtatgaagaggcaggggatgtgtttttcaacgggaccaggcacagacatcacgccgtggagtattacagagccggcgcagtgccattagcacggcgcctgaaggccgttcgaacggagctgcgtatctttaataagctaactgagttacagataagtctggagggttatgagaaggctctcgaattcgctacgttagctgctcggctgtcaacggttacaggagatcaaaggcaggagctcgttgctttccaccggttggcgaccgtctattactcattgcacatgtacgaaatggctgaagactgttatctgaagacactgagcctgtgcccgccctggctccagtcccccaaagaggccctgtactacgccaaggtttactatagactgggccgtttgaccttttgccagcttaaggacgcacatgatgccaccgaatatttcttattggccctggctgcggcggtcctgctgggggatgaggagctacaggacacaattcgcagcagactggacaacatatgccagtcccccctgtggcactcaagaccctccggctgcagtagcgaacgggccaggtggctatccggaggcggcctagccctctag

SEQ ID NO: 204954 - DNA, 2181 bp, Artificial Sequence
  Description of Artificial Sequence: Synthetic coding sequence
atggacctgagcaccggccaggaggaggaggccgagaacttcgcccctattctcgccttcctggaccatgaggggtacgcggaccacttcaaaagtctgtacgacttcagtttttcttttcttaccagcagtttctatagcttcagcgaagaggatgagtttgtggcctatctggaggcctccaggaagtgggccaagaagtcccatatgacatgggcgcacgctagactgtgctttctcctgggaaggctttccattagaaaagtgaaactatcccaggctcgggtgtacttcgaagaggccatccacatcttgaacggggctttcgaggatctatccctcgttgccacactctacattaacctggctgcgatctaccttaagcagagattaaggcacaaggggagcgcgctacttgaaaaggccggtgcattacttgcatgccttccggatcgtgagtcaagtgccaaacacgagctggacgttgtggcctacgtcctccggcaaggcattgtggtagggtcatcacctttggaggctcgcgcttgcttcctagctattcgtctgcttctgtctctgggccgacatgaagaggtccttccgtttgctgaacgcctgcagctactgagcggccacccacctgccagtgaggctgtggcgtccgtacttagctttctctacgacaagaaatatttgccccacctagctgttgcaagcgtacagcagcatggaattcagtctgcccagggcatgagcctgccgatttggcaagtacaccttgtgttgcagaacactaccaagctgctgggctttccttctccgggatggggtgaagtgtcagccctcgcttgcccgatgctacgccaagcgctggctgcctgtgaggaactggcagatcgaagtacccaaagggctttatgtctcatcctgagtaaagtgtatttggaacatcggtcgccagacggggcaatccattatctctcacaggccctggtgcttggacagctcttgggagagcaggagtctttcgagtccagtctgtgcctagcatgggcttacctgctggcgtcccaggccaaaaaggcccttgacgttctggagcctcttctgtgctcccttaaggagacggaatcacttactcagagaggcgtcatctataacttactcggattggctctgcagggcgagggacgggttaatagagcagcaaaaagctatctaagagcccttaaccgtgctcaggaggtgggggacgtgcacaaccaagcagtcgcaatggcaaacctggggcacctgagtctcaaatcttgggcccaacatccggctagaaactatctgttacaggccgtgcgactgtactgtgagctgcaggcctccaaggaaacagacatggaactggtccaggtgtttctctggctggcgcaagtgcttgttagtggacaccaactgacgcatggtcttctatgttacgagatggccttattgttcggtctgcgtcaccgtcacttgaaatcccagcttcaggcaacaaagtcactctgtcacttctattccagcgtgagtccaaaccctgaggcgtgcatcacctaccatgaacattggctagctctggctcagcagttgagagaccgtgaaatggagggtcgcctcctcgaaagtctgggccaactctataggaaccttaatacagctcgttctctgagacgtagtctcacttgcataaaagagagtctgagaatcttcatcgatctgggggagacagataaggccgccgaggcttggttaggcgccggccgcttgcactatctgatgcaggaagatgagctggtggaattgtgcctgcaggccgcaatccagacagccttaaaatctgaggagccactgctggctctaaagctgtacgaggaggctggtgatgtcttttttaatggcacccggcatcggcatcacgcagtcgagtactacagggccggggcggttcccttggcccgccggctcaaggcggtgcgcacggagctgagaatctttaataaactcaccgagttacagatctccttggaaggatacgaaaaggctctagagtttgcaacgcttgcggcccggttgagtactgttaccgaggctagggccggtggcctctccccacccggctactcagtcttactccccgcgcacgtgtag

SEQ ID NO: 204955 - DNA, 720 bp, Artificial Sequence
  Description of Artificial Sequence: Synthetic coding sequence
atgcccctgctgctgctgggcgagaccgagcccctgaagctggagagagattgtagaagtcctgtggatccttgggccgccgcttctcccgatctggccttagcctgtctctgtcactgccaggacctgtcttctggggccttccccgaccgcggagttctgggaggtgttctttttccaacggtagagatggtcataaaggtgttcgtggcgacctcaagcggatcaatcgcaataagaaaaaagcaacaagaggtggtgggtttcctggaggcaaataagattgacttcaaagaactggacattgcgggcgacgaggataaccgaagatggatgcgggagaacgtccccggcgagaagaagccacagaacgggatacccctgccaccacagattttcaacgaagagcagtattgcggggactttgactcattctttagcgctaaggaagaaaatattatttattcgtttctcggactggccccacccccagattccaaagggagtgagaaggctgaggaggggggagaaacggaagcccaaaaggaggggtcggaggacgtaggcaacctgccggaagcccaggagaaaaacgaggaagagggggaaaccgctacagaggagactgaggagatagcaatggagggcgcagaaggagaagcagaagaagaggaggagactgctgagggggaggaaccaggggaagacgaagactcctag

SEQ ID NO: 204956 - DNA, 387 bp, Artificial Sequence
  Description of Artificial Sequence: Synthetic coding sequence
atgcgggagaacgtgcccggcgagaagaagccccagaacggcatcccactaccaccccaaattttcaatgaggagcaatattgtggggacttcgacagtttctttagtgcgaaggaagagaacattatatactcctttttagggttagctccgccccccgatagtaaggggagtgagaaagctgaggaagggggcgaaactgaagcccaaaaagagggaagtgaagacgtgggtaatctgccagaggctcaggaaaaaaacgaagaagaaggagaaactgcgaccgaagagactgaggagatcgctatggaaggagcggaaggagaagccgaggaggaagaggagaccgcagagggcgaggaacccggggaagacgaagactcttag

SEQ ID NO: 204957 - DNA, 387 bp, Artificial Sequence
  Description of Artificial Sequence: Synthetic coding sequence
atgcgggagaacgtgcccggcgagaagaagccccagaacggcatccccctgcctcctcaaatctttaacgaggagcaatattgtggcgacttcgattcattcttctccgctaaggaagagaatataatctattctttcctgggtcttgctccaccccccgactcaaaagggtctgagaaggcagaagaaggaggagagacagaagctcaaaaggagggttctgaggacgtcggcaacctgcctgaagctcaggagaagaatgaagaagaaggggaaaccgccactgaggagactgaagaaatcgctatggagggtgcagagggcgaggccgaggaggaagaggaaactgcagagggggaagagcctggtgaagatgaagattcctag

SEQ ID NO: 204958 - DNA, 387 bp, Artificial Sequence
  Description of Artificial Sequence: Synthetic coding sequence
atgcgggagaacgtgcccggcgagaagaagccccagaacggcatccctcttccacctcaaatttttaacgaggaacagtactgcggcgactttgactcatttttctccgcaaaagaagagaatattatctactcctttctgggcctggctccacctccagatagcaagggcagtgaaaaagccgaggaaggtggcgagactgaagctcagaaagagggatccgaagacgtcggtaacctccccgaagcgcaggaaaaaaatgaggaagaaggggagactgcaacagaggagaccgaggagattgcgatggaaggagcagagggcgaagccgaggaggaagaggagacggctgagggcgaggagccaggagaagatgaggactcctag

SEQ ID NO: 204959 - DNA, 321 bp, Artificial Sequence
  Description of Artificial Sequence: Synthetic coding sequence
atgcgggagaacgtgcccggcgagaagaagccccagaacggcatcccactgccacctcaaatattcaatgaggagcagtattgtggagattttgattctttttttagcgccaaggaagaaaatattatctactcgtttttgggcttggcccctcccccagatagcaagggatccgaaaaggctgaagagggtggagaaacagaggcccagaaagaggggagtgaggacgtaggcaatctgcccgaggcgcaagagaagaatgaagaagaaggagagaccgctactgaagaaacagaggagatcgccatggagggggcatag

SEQ ID NO: 204960 - DNA, 2373 bp, Artificial Sequence
  Description of Artificial Sequence: Synthetic coding sequence
atgaacatcatgaacaccgagcagagccagaacagcatcgtgagccgtatcaaggtctttgaggggcaaaccaatatcgaaactagtggtctgcctaaaaagcccgagattacgcctaggtcgctgccacccaagccgacggtgagttccggaaagcccagtgtagcgcctaagcctgcggctaacagagcttcaggtgagtgggactccggcactgagaacaggttgaaagttacgagcaaagaggggctgaccccttatccccctctccaagaggcaggcagcatccctgtgaccaaacccgaactcccaaaaaaacccaaccctggactcattcgcagcgtcaaccctgaaattccaggccgagggcctctggccgagtcttccgattcggggaaaaaagtcccaaccccagctcctcggcccctactcttgaaaaagtccgtctcatccgagaaccccacgtaccccagtgcacccctgaaaccagtcactgtgccaccaagacttgcgggcgcatcccaagcaaaagcctacaagtctctcggcgaaggtccacctgccaatcccccggtccccgtgctccaatccaagcctctcgtcgatattgatctgatctcattcgacgacgatgtgctccccaccccatcaggtaatttggcagaggaatctgtgggaagtgaaatggtcctggaccctttccaactgcccgccaaaacagaacccattaaagagcgagcagttcagcctgctcctactcgcaagcccactgtaatcaggatcccagccaagccaggaaaatgcctccatgaagatccacagagcccccctccactacccgctgaaaagcccataggtaacacctttagcactgtctcaggcaaactgagtaacgttgagcggaccaggaacttggagtccaatcacccagggcagactgggggcttcgtgcgggtaccgccaaggctgccacctcggccagtaaacggcaaaactattccaacccaacaaccacccaccaaagtacccccagaaaggcctccccctcctaaactgagcgcaactcggagaagcaataagaaactgcccttcaaccgcagcagctccgacatggatctccaaaaaaagcagtccaacctagctaccggactttctaaggccaaatctcaggtttttaaaaaccaggaccccgtgctccctccacgacctaaacccggacatcccctgtactccaagtacatgctctcggtaccacacggcatagccaacgaagatatcgtctcacagaatccgggcgagctctcctgcaaacgtggagacgtactcgttatgctcaaacagactgagaacaattacctggaatgccagaaaggggaagatacagggagagttcacctcagtcagatgaaaatcattacaccactggatgaacaccttcgcagccggccaaatgacccaagccacgcacagaaacccgtggattccggagctccccacgccgtggtactccacgacttccctgcggaacaggtggacgatctgaacctgacttcgggggagattgtgtaccttctggagaaaattgacacagattggtacaggggaaactgtcgtaatcagatcggcatcttcccagccaattatgtgaaggtaattattgacataccggaagggggaaatggaaaacgcgagtgcgtctcaagtcattgcgtgaaaggtagcagatgcgtggccagatttgaatacattggggagcagaaagatgaactgtctttctccgagggcgaaattatcatactgaaagagtatgtcaacgaagagtgggcacgtggagaagttcgaggtcggacaggtatcttcccattgaacttcgtagaaccagtagaagattaccccacctcaggagccaacgtgctttcaaccaaggtgcctctgaagaccaaaaaagaagattccggctcaaattcacaagttaactctctcccagctgagtggtgcgaggcgttgcattccttcaccgccgagacctcggacgacctgtctttcaagcgcggtgaccgcatccaaattctggagcgactggacagcgactggtgtcggggtaggctccaggaccgggaggggattttcccagccgtattcgtccgcccatgccctgccgaagctaaatctatgctagctattgtgccgaaaggccgtaaggccaaggcactctacgacttccggggagagaacgaggatgaattgtccttcaaagctggcgatattataactgagttagagtcggtggatgatgactggatgtccggcgagctgatgggcaagtccggcatcttccctaagaattatattcagttccttcagatatcatag

SEQ ID NO: 204961 - DNA, 2373 bp, Artificial Sequence
  Description of Artificial Sequence: Synthetic coding sequence
atgaacatcatgaacaccgagcagagccagaacagcatcgtgagccgaataaaagtgttcgaaggacagacaaatatcgagacgagcggcttgcctaagaagccagagattacacccagaagcctacccccaaagccgaccgtctcttcaggcaagccaagcgtcgcacctaagccagccgctaaccgagcgagtggtgaatgggatagtgggaccgagaatcgccttaaagtaactagcaaggaaggactaactccctacccgcccctgcaagaggccggatctatcccagtgacaaaaccagaacttccaaagaaacctaaccctgggctgatacgatccgtcaatcctgagatccccggtaggggccctctggcagagtccagtgattctggcaagaaggtgcccactccagcgccacgccctctgctgctgaaaaagtcagtgagctcagagaacccaacgtatcccagtgccccacttaagccagtgacagtcccgccaagactggccggagccagtcaggccaaagcgtataagtcactgggagagggccccccggctaatcctcccgttccggtgcttcagagcaaaccgctggtggacatcgacctaatttcgttcgacgatgatgtgctaccaactccatccggcaatctggcagaagagagcgtcgggagcgaaatggtgcttgaccctttccagctgccagctaagactgagccaattaaggaaagggcagtacaacccgccccaaccagaaagccaacagtcatcaggatccctgccaaaccaggaaagtgtctgcacgaagatccacaatctcctccaccactcccggctgaaaaaccgatcggcaacacatttagtacagtgtctggcaaattatccaacgtcgagaggacaaggaacctcgaatctaaccacccgggccagacgggtgggttcgtacgcgtccctccaagattgcctccgcggccagtgaacggaaaaactatccctactcagcagccgcctacaaaagtacctcccgaaagaccccccccccccaaactaagtgctacccgccgaagcaataagaagctgccattcaatcgctcatctagtgacatggatttgcagaaaaaacagtcaaacctggcaactggtctgtccaaggcaaaaagccaagtgttcaagaaccaggacccagtgctgccgccaagaccaaagcccggtcacccactctattcgaagtatatgctttccgtacctcatggcatagctaacgaggacatagtcagccagaaccccggcgagcttagctgcaaacgcggcgacgtgctggtaatgctgaagcaaaccgaaaataattatttggaatgccaaaagggtgaggatactggaagggtgcacctctcccagatgaaaataataaccccactggacgagcacttgcgcagcaggcctaacgatccctcgcacgcccagaagcccgtcgattctggcgccccacacgccgtggtgttgcatgacttcccggccgagcaggtagacgatctgaaccttacaagcggggagatcgtgtaccttctggaaaaaatcgacacggactggtaccgaggtaactgcaggaatcaaattggcatttttcccgcgaattatgtcaaagtcatcattgacatccccgagggcggaaatggaaaacgggaatgcgtgagttctcattgtgttaaaggtagccgctgcgtggcccgctttgaatatattggggaacagaaggacgaactaagtttctcggagggtgaaatcattatactgaaggagtacgtcaacgaggagtgggccaggggagaggtgcgtggacgcaccggaatctttcccttaaatttcgtcgagcccgtggaggattatccaacttcaggggctaatgtcctgtccacaaaggtgcctttgaagaccaagaaggaagactctggtagtaatagccaagtgaatagcttaccggccgagtggtgcgaagctctgcattctttcaccgctgagacctctgatgacctgtcctttaagaggggtgatcgaatacagattcttgaaaggctcgacagcgactggtgcaggggaaggcttcaagatcgggaaggcatctttcctgccgtgtttgtaaggccttgtccggcagaggctaagagcatgttggcaatagtgccaaagggcaggaaggccaaagccttatacgacttccgcggggaaaatgaagatgagttatcattcaaggccggtgacataataacagaactggagtcagtggatgatgactggatgtccggcgaactcatgggcaaaagcggtatcttcccgaaaaattatatccagttcctccagatttcatag

SEQ ID NO: 204962 - DNA, 2304 bp, Artificial Sequence
  Description of Artificial Sequence: Synthetic coding sequence
atgaacatcatgaacaccgagcagagccagaacagcatcgtgagcaggattaaagtttttgagggccagacaaatattgagacctccggtttacctaagaaacccgaaataaccccccgctccttaccccccaagccgacggtgagctccgggaagccatcggtggcaccaaagcctgcagccaaccgcgcgagcggcgagtgggacagcgggacagagaacagactgaaagtgacctctaaggagggtcttacaccgtaccctccactccaagaggcaggctcaatacccgtgacaaagcccgagctgcccaagaaaccaaaccccgggttaattcgatccgtgaatccagaaatcccaggcaggggcccgctagctgaaagtagcgactctggaaaaaaggtgcctacacctgcgccacgtcccctgctcctgaagaagtccgtctcttccgagaatcccacatatcctagcgcaccactgaagccagtcacagtgccaccacgactcgctggtgcaagccaggccaaagcctacaaaagcctgggcgaagggccccccgctaatcccccagttcccgtgctgcagtcgaagccccttgtggatatcgatcttatcagctttgatgatgacgtcttgccgaccccctcaggcaacctcgctgaagaaagcgtaggatcagaaatggtgttggacccttttcaattacccgctaaaactgaaccaatcaaggagagagccgtgcagcccgcaccaaccagaaagcctacagtgattcgcatcccagctaaacccggcaaatgtcttcacgaagacccacagtcccctccgcccctccccgccgaaaagcctatcggcaacacattctctacagtttcaggaaaattatccaatgtggagagaacgcgcaatttagagtccaatcacccaggtcagacagggggcttcgtgcgcgtgccgccacggctgcccccacgaccagtgaatggcaagactatcccaacacagcagcctcccaccaaggtcccgccagagcggcctccaccccccaagctgagcgcaacccggcggtcaaataaaaaactgcctttcaatagatcatcgtccgacatggaccttcagaagaaacagagtaatttggccacggggctaagcaaagccaagtcacaggtgtttaaaaatcaggacccagtcctcccgcctaggcccaagcccgggcaccctctttattcaaagtacatgcgcggggatgtcttggttatgctgaaacaaacggagaacaattacctggaatgtcagaagggagaggatacaggcagagtgcacttgtctcagatgaaaatcattactccactagacgaacatctgcgatcacgcccgaacgacccatcgcacgcccagaagcccgtggatagcggcgctccacacgctgtggtgctgcatgactttcctgctgaacaggttgacgacctcaacctcacctccggtgagatagtctatctcctcgagaaaatcgataccgattggtatagagggaattgtcgaaatcaaatcggcatctttcctgcaaattacgtcaaggtgattattgacatacctgaggggggcaacggaaagagggaatgtgtgtccagccattgcgtgaaaggtagtcgttgcgttgctcggttcgaatatataggtgagcaaaaagatgagctctcattcagtgaaggcgagatcatcatactgaaggagtacgtaaatgaagagtgggccagaggggaggtgagaggacgaaccggcatttttccactgaacttcgtggaacctgtggaggattaccccaccagcggagctaatgttctgagcactaaggtgccactcaagacgaagaaggaggactcgggaagcaattcccaggtaaactctttgccagccgagtggtgcgaagccttgcatagcttcacagcagagactagtgatgacctatcgttcaagcggggggatcgcattcagatcctagaaaggctggactccgattggtgtaggggtagacttcaggatcgggagggaatctttccagccgtttttgtcaggccttgtccggccgaggccaagagcatgctggcaatcgttcctaaagggcgtaaggctaaggctctttacgacttccgtggcgagaacgaggatgaacttagctttaaggccggcgacataattacggaactagagtctgtggatgacgactggatgtccggagagttgatgggtaagtccggcattttcccaaagaactacatacaatttctacagatctcttag

SEQ ID NO: 204963 - DNA, 2196 bp, Artificial Sequence
  Description of Artificial Sequence: Synthetic coding sequence
atgaacatcatgaacaccgagcagagccagaacagcatcgtgagccggattaaggtgttcgaggggcagactaatatagagacaagcggattgcctaaaaaacctgaaattacaccacgctcacttcccccaaaacccacagtctcaagcggcaaaccaagcgtggctccaaaacctgcggcgaaccgcgccagtggggaatgggattcagggaccgagaatagactgaaggtgaccagcaaagaaggactgaccccttacccccccttgcaggaagccgggagtattccagtcacaaagcccgaattacccaagaaacccaacccaggacttattcggtccgtgaatcccgaaatcccaggccggggaccactcgctgaatcttccgacagcggaaagaaagtacctaccccagcgccgaggccacttcttctgaagaaatctgtgtccagcgagaatccgacatacccctcagcaccacttaaacctgtgactgtcccaccccgactggccggagcatcacaggcaaaggcttacaaatctctcggcgagggacccccggccaatcctcccgtgccagtactgcagagtaagccccttgtggatatcgatctaatcagcttcgacgacgatgtgctgccaactccctccggtaatcttgccgaagagtccgtgggttccgaaatggtgctgggactgcacgaggaccctcagagcccaccccctttgccagcagaaaagccaattggcaataccttcagcacagtgagcgggaaattgtccaacgttgagagaacacggaacctggagtccaaccatccaggacagactggcggattcgtccgcgtaccgcccaggctgccaccacgcccagtgaacggaaagactattcccactcagcagccccctacaaaagtgcctcccgagcggcccccccctcctaaactgagcgccacaagacgcagtaataagaaactcccattcaatagatctagctctgacatggaccttcagaaaaaacaatctaatcttgctaccggcctgtccaaagcaaagtcacaggtgtttaagaaccaggatcccgttctgcctccaagaccaaaacctggccaccccttgtattctaaatatatgagaggcgacgttctggtcatgctcaaacagactgagaacaactacctcgaatgtcaaaagggcgaggatacaggccgagtgcacctatcccagatgaagattataacacccctggatgagcacttgcggtccaggccaaatgatccaagccacgcccagaagccagttgatagtggcgctccccatgccgttgtgcttcacgactttcccgcggaacaagttgatgatctgaatctgacctctggagagattgtatatctgctggagaaaatcgatacagactggtacaggggaaactgtcgcaaccagattggaatctttcccgcgaactatgttaaggtgattatcgatatcccagaaggcggtaacggcaagcgcgagtgcgtttcttcccactgtgtaaaaggctctagatgcgtcgcacgctttgaatacattggggagcagaaggatgagctgtctttcagcgaaggggaaatcattatactgaaggagtacgttaacgaggagtgggcccggggcgaagtacggggtaggacgggaatctttccactgaactttgtggaaccggtcgaggattatccaaccagtggagctaatgtcctctccaccaaggttccattgaagacaaaaaaggaagacagcggctcgaatagtcaggtgaactctttgccagccgaatggtgcgaggccctgcactctttcacagcagagacgtcagatgatctgtctttcaagcgcggtgatcgtatacagattctggagcgtttggacagcgattggtgccgaggcagactgcaggatcgggaaggcattttccctgcagtatttgtaagaccctgccccgcagaagctaaatctatgctggcgatcgttccgaaaggcaggaaagctaaggctctgtacgactttagaggtgagaacgaggatgaactgagctttaaagccggagatattatcactgagttggagagtgtggatgacgactggatgagtggtgagctgatgggaaagagtggtatttttcccaagaactacattcaattcttgcagatatcttag

SEQ ID NO: 204964 - DNA, 2196 bp, Artificial Sequence
  Description of Artificial Sequence: Synthetic coding sequence
atgaacatcatgaacaccgagcagagccagaacagcatcgtgagccgcataaaagtgtttgagggacagacgaacatagaaacatccggactgccgaaaaaacctgaaattactccacgttcgcttcctcctaagcccactgtttcttcaggtaaaccttccgttgccccaaagcccgcagcaaatcgggccagcggagagtgggatagcggcacagagaatcgcttgaaagtaacttctaaagaggggctgaccccttatccacctctgcaggaggctgggtcaattcccgtgactaaacctgaactgcccaagaagcctaatcctggcctgatccggtccgtgaaccccgagattcctgggcgggggcctcttgccgagtccagcgactccggcaagaaggtgccgacccccgcaccacgccctttgctgctaaagaaaagtgtttcgagcgagaatccaacgtatcccagcgccccgctaaagcccgtgactgttccacccaggctcgctggagcctcacaggccaaggcctacaagtcattgggcgagggaccgcctgctaacccgccggtcccagtgttgcagtccaaacccctggtcgacatcgatctaatcagctttgacgacgatgtgcttccgacaccctctgggaaccttgctgaggagtcagtggggtctgaaatggtgctgggcttacacgaagatccacagtccccgcctcctttgcctgccgaaaagccgatcggcaacacattttccactgtgtcagggaagctgtctaacgtcgaacggacaagaaaccttgaaagtaatcaccctggacagacaggcggatttgtgcgggtccctccccgcttaccaccccggccagtcaacgggaagacgatccccactcaacagccgcctactaaggtgccaccagagcgccctccgccacccaaactgtctgctaccaggcgcagcaacaaaaaactacccttcaataggagttcatctgatatggacctccagaaaaagcagtccaacctcgcaacaggactttccaaagccaagtcccaggtgtttaagaatcaggacccagtgctccccccgcgcccgaaacctggacatccactttattctaaatacatgcgtggggacgtgctggtgatgctaaaacagaccgagaataactacctcgaatgccaaaagggtgaagataccgggcgagttcacctcagccagatgaaaataatcaccccactggatgagcacctgcgctcacgaccaaatgacccatctcatgctcagaaaccagtggactccggcgctccccacgcggtcgtgctccatgattttccagcagaacaggtcgacgatctcaacctcacctctggggagattgtttacctgttagaaaagattgataccgactggtaccgcggtaactgcagaaaccagatcggaatatttcccgcgaactacgtcaaggtcatcattgacatccccgagggcggcaacggaaaacgcgagtgtgttagttcgcattgcgttaaaggcagtcggtgtgtggctcggttcgagtatatcggagagcagaaagacgaattatccttcagcgaaggcgagattatcatcctgaaggaatacgtgaacgaggagtgggcccggggggaggtccgcgggcggactggcatctttcctctgaactttgttgagcccgtggaagactaccccacaagcggcgctaatgtgctatctacaaaagtgcccctgaagaccaaaaaggaggattccgggtcaaattctcaggttaactccctgcctgctgaatggtgcgaggctctacacagcttcacagccgagactagcgatgacctttcatttaagaggggggatcgaatccagatattggagaggctggattccgattggtgcagagggcgactacaggatagggaagggatctttccagccgtgttcgtgaggccctgtcccgcagaagcaaagtccatgctggccatcgtcccaaaaggtagaaaggcgaaggcactatatgattttcggggagagaacgaagatgaactcagttttaaagccggtgatattataaccgagcttgaaagtgtggatgatgattggatgtctggggaattgatgggtaagtctggcattttcccgaagaattatattcagttcctccagattagttag

SEQ ID NO: 204965 - DNA, 2304 bp, Artificial Sequence
  Description of Artificial Sequence: Synthetic coding sequence
atgaacatcatgaacaccgagcagagccagaacagcatcgtgagccggattaaggtgtttgagggacagactaacatcgaaacgagcggattgcctaagaagcccgaaattactccgcgctcactgccgccgaaacctaccgtgtcgtctgggaaacccagcgtggcccccaaacccgctgcaaatagggcttcgggggaatgggattcgggaaccgagaaccggttgaaggtgacctctaaggagggcttaactccataccctcctctgcaagaggccggatccattccagtaacaaagcccgaattacccaagaagccaaatcccgggctgattaggagcgtgaaccctgagataccagggaggggaccactggctgaaagttctgactctggaaaaaaggttcccaccccggctcctaggccacttttacttaagaagtcagtgtccagtgagaatcctacatatcctagcgctcctttaaaaccagtaaccgtgcccccccgcctcgccggggcttcccaggccaaggcctacaagtctctcggcgaggggcctcccgcaaatcccccagtgccagttttgcagtctaaacctctcgtggatattgaccttatttccttcgacgatgatgtgctgcctactccgtccggtaatcttgcagaggagagtgtggggtccgagatggttcttgacccatttcagctcccagccaaaaccgagccaataaaggaacgggccgtccagccagcccccaccagaaagcccacggtaatccgcattcctgctaaaccaggaaagtgtctgcatgaagaccctcaatccccccctcccctacctgcggagaagcctatcgggaacaccttctctactgtctccggcaagctgtcgaacgtagagaggacacgaaatctggagagcaatcaccctggacagaccggagggtttgttagggtgcccccccgccttcccccccgccccgtgaatggcaagaccattcccacccagcagcctcccacaaaggtcccacctgagcgaccccctcctccaaagctttccgccactcggcggtcaaacaaaaagcttccgttcaaccgttccagtagcgatatggatctccagaagaagcagtctaaccttgcaaccggtctgagcaaagccaaatctcaggtctttaagaatcaagatcctgttctcccacctaggcctaagcccggtcacccactgtattctaagtatatgagaggagacgtgctagtgatgctgaagcagacagaaaacaactatttggaatgccagaaaggcgaagacaccggaagggtccatttgtcccagatgaagattattaccccattagatgaacatctgcgcagcaggccgaatgatccctcccacgcccagaagcccgttgactccggcgctccccacgcagttgtactccacgactttcctgctgagcaagtcgacgatctcaacttgaccagcggcgagattgtgtatctgctggaaaagatagatacagactggtacagaggtaattgcagaaaccagattggcattttcccggcaaattatgtcaaggtcattatcgatatccctgagggaggaaacgggaagcgggagtgcgtgtcctcacattgcgtcaaaggctccagatgcgtggccagattcgagtatattggagagcagaaggatgagctgtctttctctgaaggagaaatcatcatcttgaaggagtacgttaatgaggagtgggctcggggggaagtcaggggtcggactggcatcttcccactgaacttcgtggagccagtggaggactatcctacgagtggcgctaatgtgctaagtaccaaggtgcccttgaagactaaaaaggaggattccgggtccaactcccaggtgaattctctcccggccgaatggtgtgaagcgctgcactctttcacagcagagactagtgatgatttgtccttcaagcgcggagacaggattcaaatacttgagagactggattctgattggtgtcgcggacgccttcaagacagagagggtatcttcccggcagtgttcgtgcggccctgccccgcagaggctaaaagcatgctggctatcgttccaaagggccggaaagcaaaagccctgtatgacttcagaggtgagaatgaagatgaactttctttcaaggcaggggatatcattacggaactggaatctgtggatgatgactggatgagcggcgaactgatgggtaagagcggcattttcccaaagaactacatccaattcctgcagatttcttag

SEQ ID NO: 204966 - DNA, 2304 bp, Artificial Sequence
  Description of Artificial Sequence: Synthetic coding sequence
atgaacatcatgaacaccgagcagagccagaacagcatcgtgagccgcatcaaagtgttcgaaggtcaaaccaatatcgagacttccgggctgccgaagaagcccgagatcactcccaggagcctcccacccaagcccacagtgtcatcagggaaaccctcagtggccccaaagccggccgccaacagggcttctggtgagtgggacagcggtactgaaaataggttaaaggtcaccagcaaggagggcctcacaccgtaccctcctctccaggaagccggctctatcccagtgaccaagcctgagctgccaaagaagcccaatccagggctgattcggtcggtgaatcctgagatcccagggaggggtccattagctgaaagtagtgactccggaaaaaaggtgccgacacctgccccacgcccactgcttctaaaaaagtcagtctcatccgaaaaccccacatacccttcagccccactcaagcctgtaaccgtgccacctagactggctggcgctagccaggccaaggcatataaatcacttggagagggccccccggccaaccctcccgtgcctgtcctccaaagcaaaccactcgtcgatattgatctcatctccttcgacgatgatgtgcttcccacaccatcaggcaacctggctgaagagtccgttgggtctgagatggttctggacccattccagctgccggccaaaacagagccgatcaaagagcgcgcagttcagcctgctcctacgaggaagcccaccgtaatccgaatcccagcaaaacctggcaagtgcctgcacgaagaccctcagagccctccccccctacccgctgagaagccaatcggcaatacattttccacggtgtcaggcaagctctctaatgtcgaaagaactagaaatctagagagtaaccacccgggccagaccgggggtttcgtaagggttcctccccgcttaccacctcggcccgtcaatggaaaaacaatcccaacccagcagccccccaccaaagtgccacccgagcgccccccgccccctaaactgagcgctacgagacgcagcaataaaaagttgccctttaatcgttcatctagcgacatggaccttcagaaaaaacagagtaacctcgccacaggcttatcaaaggccaaaagccaggtgttcaaaaaccaggaccctgttctgcctccccgccccaagcctggccaccctctgtattcaaagtacatgaggggcgacgtccttgtcatgctgaagcagaccgagaacaactatcttgaatgtcagaaaggagaggataccggccgggtccacctgagccagatgaagatcattacccctcttgacgaacatctccgatctcggcctaatgacccttctcacgcacagaagccagtggatagcggggcgcctcatgcagtcgtgttgcacgactttccggccgagcaagttgatgatcttaacttgacctctggcgaaatcgtgtacttactagaaaaaatagatacggactggtacagaggtaattgtcgaaaccagataggcatctttcccgcaaattacgtgaaggtcattattgatattccggaggggggcaatgggaagcgcgagtgcgtttcgtcacactgcgtcaagggaagcagatgcgtggccaggtttgagtacatcggggagcaaaaggatgagctgtcgttctcggaaggggaaattataatcctcaaagagtatgtcaatgaagagtgggctaggggcgaggtcaggggtcggaccggaatcttccctctgaatttcgttgaacctgtggaggactaccctacatctggggcgaacgtcctatctaccaaagtccccctgaaaactaaaaaggaggatagcggtagcaattcacaggtgaattcactcccggcagagtggtgcgaggcgctgcacagctttactgcagaaacgtcagatgacctcagcttcaagcgcggagacaggattcaaatcctggaacgccttgattccgactggtgtagagggaggcttcaggatagggaggggatcttcccagctgttttcgtgagaccctgcccagccgaggcgaagagcatgttggccattgtcccaaagggtaggaaagccaaggccctttacgatttccgtggcgagaacgaggatgagctctcctttaaagctggcgacattataacggagctggagtctgtcgacgacgactggatgagcggcgaacttatggggaagtctggtatttttccaaagaattatatccagttcttgcagatctcctag

SEQ ID NO: 204967 - DNA, 2190 bp, Artificial Sequence
  Description of Artificial Sequence: Synthetic coding sequence
atggacgacctgaccctgctggacctgctggagtgccccgtgtgcttcgaaaaactggacgtaacagctaaagtgttgccatgccaacacactttctgcaaaccctgtttacagcgggtgtttaaggcgcacaaagaactgcgttgtcccgaatgtagaaccccagttttctccaacattgaggctcttccggcaaatcttctgttagtaaggctgctcgatggggtaaggtctggccagtcctcaggaaggggcgggtcttttcgtagacctggcactatgaccctccaggatggccgaaagagccgcaccaaccctaggcggcttcaggccagccccttccggctggtgcctaacgttagaatccacatggacggcgtcccccgcgctaaggcactgtgtaattatagaggtcagaacccaggagacttgcgctttaataaaggagatattatcctacttcgaagacaactggatgagaactggtaccagggagagattaacggcatctcaggtaattttcccgctagcagtgtggaagtcatcaaacagttgccccagcctccccctctttgcagggccctctataactttgacctgagagggaaagacaagagcgagaatcaagattgtctaacttttctcaaggatgacatcattaccgtcatctcccgggtggacgaaaattgggccgagggaaaactcggcgacaaagtgggcatcttcccaatattgttcgtcgagcccaatctgacagcccgccacctgctggagaaaaacaagggccgacagtcctctcgaacgaagaatctgtcactggtcagttcttccagccgggggaataccagcaccttacggagagggccggggtcaagacgcaaggtccctggccagttctcaatcaccacagcacttaatactctgaaccgtatggtgcactctccgagcggtaggcacatggtcgaaatatctactcctgtgctgatttccagcagtaaccctagcgtgatcacgcagccgatggagaaagctgacgttccctctagctgtgtggggcaagtcagcacataccatcctgcccccgtcagcccgggccattcaactgctgtggtcagccttcctggtagccagcagcatctgtccgcaaacatgttcgtcgccttacattcatattccgcccacggacctgatgaactcgatcttcagaagggagagggtgtacgtgttctgggcaagtgccaagacgggtggctgcggggagtgtcactcgtgacaggccgagtgggcatcttcccaaacaattacgtgatccctatttttcgtaaaacaagtagttttcccgacagccgatcccccggtctatacaccacttggacactcagcacaagctcggtgagctcacaaggatcaatcagcgagggcgacccccggcagtcgcgaccctttaagagcgtgttcgttcctaccgccatagtcaacccagtgcgcagcactgccgggccagggaccttaggacaagggtcacttcgcaaggggcggtcctctatgcgaaagaacggatccctgcagcggcctctgcagtccgggattcccaccttggtagtggggagtcttagaagatcgccaactatggtccttaggccacagcagttccagttctaccagcctcaagggattccctccagtccctccgccgtcgtagtggagatgggatccaagcctgctttgactggcgagcctgctctcacttgcatttcccgcggatctgaagcttggatccatagcgcagcaagctcactcattatggaggacaaggagattcccatcaaaagcgaacccctgccaaagcccccagcatccgctcccccctctattttagtcaaacctgagaactcacgcaacgggatcgagaaacaggtgaaaactgtgaggtttcagaactacagcccacccccaactaaacactacacgtcgcatccgacttccggtaaaccggaacagccggccacactgaaggcctcccagcctgaagcagcgtccctcggtcctgaaatgaccgtgctctttgctcatcggtccggatgtcacagtggacagcagacagacctgcggcgtaagtccgcactcggtaaagcaacgactctcgtatccacggctagcggaacacaaacggtatttccgtctaagtag

SEQ ID NO: 204968 - DNA, 2190 bp, Artificial Sequence
  Description of Artificial Sequence: Synthetic coding sequence
atggacgacctgaccctgctggacctgctggagtgccccgtgtgcttcgaaaagcttgacgtgacagcaaaggtgctgccctgccaacacaccttctgcaagccatgcctccagagggtgttcaaggcgcataaggagctacggtgcccggaatgtcgtacccctgttttttccaacatagaggcccttccagccaatttgctcctagtacggttgctcgatggtgtaagatcagggcagagcagcgggcgcgggggttcattcagaagacccggaactatgactctccaggacggccggaagagccggaccaatcccagaaggctgcaggcgagcccatttcgcctggtgccaaatgtgagaatccacatggacggtgtgcccagggcaaaagcactatgtaactatcgcgggcagaatcctggcgatctccgttttaacaagggcgatataatcctgctccgacggcagcttgatgaaaattggtaccagggcgagatcaacggcattagcggcaatttccccgcctcttctgtcgaggttattaagcagcttccacagccccctcccctatgccgagccctgtacaacttcgacctgcgcgggaaagacaagagcgagaaccaggactgcctgacatttctgaaggacgatatcattactgtgatttctagggtagacgagaactgggcagagggcaagcttggagacaaggtcggaatcttcccaatcctcttcgtcgagcctaaccttacagctcgccacctcctggagaagaataaggggcgccagtcaagccggacaaaaaacctgagccttgtgtccagttccagtcgaggaaatacatcaactctgcgtcggggcccggggtccaggcgaaaggttcccggacaatttagcatcacaacagcacttaacacactgaatcgtatggtgcactcacccagcggccgccacatggtcgagatcagcactcctgtcctgatcagttccagtaacccttccgtaatcacccagccaatggagaaggccgatgttcccagcagttgtgtagggcaggtgagtacctatcatcctgctcccgtgagtcctggacacagcacggctgtcgtctctctgcctgggtcgcagcaacacttatccgcgaacatgttcgtggcccttcacagctactcagcccacgggcctgacgagttggatctgcagaagggagagggggtgagagttcttggaaagtgccaggacggctggctgaggggggtgtccctcgtcactggccgagtcggcatttttcccaataattacgtgatccccatcttcagaaagacaagctctttccccgactctcgcagtccagggctgtatactacttggacgctgagcacatcatcagtgtcgtctcaggggtctatcagcgagggcgacccccgtcagagtagacccttcaaaagtgtatttgtgcctacggcaatagtcaatccggtgaggtctaccgcaggaccaggtaccctaggccaagggagcttgaggaagggccgctcaagcatgagaaaaaacggaagcttgcagagacccctgcaatcgggtattcctacccttgtcgttggcagtctgcggcgctctccaaccatggttttacgcccgcagcagttccaattctatcagccccagggaatcccttcatcaccctctgcagttgtggtagagatgggatcaaaacctgctctgaccggagagcctgccctgacctgtattagtcgagggagcgaggcatggatacactccgccgcctcctcactgatcatggaggacaaggaaattccaattaagtcagagcctctgcctaagccacctgcctctgcaccccctagtatcttggtgaagccggaaaactcaagaaacgggatagaaaagcaggtgaaaaccgtgcggttccagaactacagccctccccccacaaagcactatacctcacaccccacttctggcaagcccgagcagcctgcaaccctaaaggcgtctcaaccggaagccgcaagtctgggtccagagatgactgttctgttcgcccataggtcgggctgtcacagcggtcagcagactgacctgcgaaggaagtccgccctggggaaggcgaccacacttgtctccacagcaagcggcacccagacagtgttcccgtcaaaatag

SEQ ID NO: 204969 - DNA, 387 bp, Artificial Sequence
  Description of Artificial Sequence: Synthetic coding sequence
atggaggacaaggagatccccatcaagagcgagcccctgcccaagccccctgcgtccgcaccaccaagtatactggtgaagccggaaaactcaagaaatgggatcgaaaaacaagtcaagaccgtccgattccagaactactcaccaccccctaccaaacattatacctcacacccaacgtcagggaagcctgaacaaccagccactttgaaggcctctcagccggaagctgcatcactcgggccggagatgacagtgctgtttgcacaccgaagcgggtgtcactcaggacaacagacagatctgcggagaaaatctgcactgggtaaggccacgactctcgtatcgaccgcctctggcacacagacggtcttcccttccaagtag

SEQ ID NO: 204970 - DNA, 1686 bp, Artificial Sequence
  Description of Artificial Sequence: Synthetic coding sequence
atggccgccgaggagatgcactggcccgtgcccatgaaggccatcggagcacaaaacttgcttacgatgcccggtggggtggcgaaggcagggtacttacacaagaagggcggcacacagctgcagcttttgaagtggcctctccggttcgtgatcatccataaaagatgtgtttattacttcaagtcatcgacgtccgcttctccgcagggtgctttcagtctctccggttataacagagttatgcgtgccgccgaagagacaacctcaaacaacgtcttcccctttaaaattattcacatcagcaaaaagcaccgaacctggtttttttcagccagctctgaagaggagaggaaatcatggatggcactgctacgtagagaaataggacactttcatgaaaagaaagatctgcccctggataccagtgatagctcatcagacaccgacagcttctatggcgccgtggaacgtccggtggacatatccctgtcgccctacccgacggataatgaagattatgagcatgacgacgaggacgattcctacctggagcccgactcaccagaaccagggcggctggaggacgcactcatgcacccacccgcgtacccgcctcctcctgtacccacacccagaaaacctgcttttagcgacatgcccagggcacactcattcacatctaagggaccgggacctctgctgccaccgcctcctccaaaacatggcctgcccgatgtgggcctggcggccgaggatagcaagagggatcccctgtgcccgaggagagctgaaccatgccctagagtgcccgctactcctcgcaggatgagtgacccccctttaagcaccatgccgactgcccccggcctcaggaagcccccttgtttcagagagtccgcttccccatcccccgaaccatggaccccaggacatggagcgtgtagcactagctcagccgcaattatggccactgccacatccagaaattgtgacaaattgaagagcttccatctctcccctaggggacccccgacctccgagcctcctcctgtgccagccaataagcccaagtttctcaagatagcagaagaagaccccccacgagaggctgccatgcctggcttgttcgtaccacctgtggccccccgccctcccgccctcaagctaccagttcctgaagccatggcgaggcccgcagtcctgcccagacccgagaaaccccagttgccccacctgcaacgatcacccccagatggacagagttttcgctcattttcatttgagaagcctcggcagccaagccaggccgacaccggcggtgacgattctgacgaggactacgagaaggtgccattacccaactctgtgtttgtgaatactacggagtcttgtgaggtggaacgcttattcaaagccactagcccaagaggagaaccccaggatgggttatactgcatccgcaattcctctacaaaaagtggaaaggtcctcgtggtgtgggacgaaacctcaaacaaagtgcggaactatagaatttttgaaaaagacagtaagttctaccttgaaggcgaagttctgtttgtgagtgtgggctctatggttgaacattatcacacacatgtactgcccagccaccagtccctgttacttcgccatccttatggctacaccgggcctagatag

SEQ ID NO: 204971 - DNA, 294 bp, Artificial Sequence
  Description of Artificial Sequence: Synthetic coding sequence
atggccgccgaggagatgcactggcccgtgcccatgaaggccatcggtgctcagaacctattaacaatgccaggcggagtggcgaaggccggctacttgcataagaagggcggcacccaactgcagctccttaaatggcccctgagatttgtcattatccacaagagatgcgtgtattactttaaatcgagcacatctgcttccccccagggtgccttctctcttagcggttacaatcgccagcccaggccacagcctgcacaggcattgtctcagacggaagctgggccctag

SEQ ID NO: 204972 - DNA, 1686 bp, Artificial Sequence
  Description of Artificial Sequence: Synthetic coding sequence
atggccgccgaggagatgcactggcccgtgcccatgaaggccatcggagctcagaacctgctgaccatgcccgggggggtcgcaaaggcaggttaccttcacaaaaaaggagggacccagttgcagctcctgaagtggcccttaaggtttgttataatccacaagcgatgcgtctactactttaagtctagtacgtcagccagcccccagggtgcattctccctctcaggctataatagagttatgcgcgccgcagaggaaaccaccagcaataacgtttttccgttcaagataattcatattagcaaaaaacatcgcacctggttcttctctgcttcaagcgaagaggagagaaaatcgtggatggctctgctccgcagagagatcgggcacttccatgagaagaaggacctccccctcgacacctccgattcatcgtcggatactgactccttctatggcgccgtggaaaggcctgtggatattagcctgtccccatacccgacagataatgaggattatgagcacgatgacgaagatgacagctatctggaaccagattctccagagccaggaaggctcgaggacgcactgatgcaccctcccgcatatccaccgcccccggtgcccacacctcgcaaacctgcttttagcgacatgccccgtgcccactcgtttaccagcaaaggaccagggcccctgttgcccccccctcctccaaagcacgggttgcctgatgtgggcctggccgccgaggacagcaagagggaccccctgtgtccccgtcgggctgagccctgtccacgcgtgcccgccacgcctcgacggatgtccgacccacccctgtccaccatgccaactgcgcccggattgcgtaagcctccctgcttccgtgagagcgcttctccctctccagagccctggaccccaggccatggggcgtgttccacaagctcggccgcaattatggcaactgcgacctccaggaactgcgataaattgaaaagcttccacctgagcccacggggccctcccacttccgagccgccgcccgtcccagcaaacaagccaaaattcctgaaaatcgctgaggaggatcctcctcgggaggcagctatgccagggctgtttgtgccccctgtcgcaccacggccaccggcactaaagttgcccgtcccagaagcgatggcacggcctgccgtcctaccccgccccgagaaaccgcagttgccacacctccagaggagtcctcctgacggccagagttttcggtcctttagtttcgagaaacctcgccagccctcccaggccgacaccgggggagatgattccgatgaagactacgagaaggtgcccctgccgaatagtgtttttgtgaacactacagaatcctgcgaagtggagcggctgttcaaggccacatctcctagaggagagccccaggatggcctgtattgcatacgtaactcatccacaaaaagtgggaaggtcctggtggtgtgggatgagaccagcaacaaggtaagaaattatagaatctttgagaaagattccaagttttaccttgagggcgaggtcctctttgtctctgtcggcagcatggtcgaacactaccatactcacgtcctgccatcgcaccagagtctgttgctccgccacccttatggctacacgggaccccgttag

SEQ ID NO: 204973 - DNA, 1770 bp, Artificial Sequence
  Description of Artificial Sequence: Synthetic coding sequence
atggccagcctgggcccccggacccccgcccccagccggagccggggcaggcgcgcaatgtgttgggtgagtaccataagcttcatggccgccgaagagatgcactggccggtgccaatgaaagctattggcgcccagaatctcctgacaatgcctggcggagtcgctaaagccggttacctgcataagaaaggaggtactcagctccagctgctgaaatggccattaaggttcgtgatcattcacaaacgctgcgtttattattttaagtcttctacttctgctagcccgcagggggccttcagtctttccggatacaatagagttatgcgggctgccgaggagactacatctaacaatgtattcccatttaaaatcatccacatctctaagaaacacagaacctggttcttttccgcttcaagtgaggaagagcgcaagagctggatggcactgctgagacgggaaattgggcactttcacgaaaaaaaggacctgcccctcgatacttccgactccagtagtgacacagacagtttctacggggccgtggaacgcccggtggacatctcactatccccctacccgaccgataacgaggactacgaacatgatgatgaagatgacagctaccttgaaccagactcccccgagccaggcaggttggaggacgccttaatgcatccaccagcatatcccccaccacctgtccccactccccgcaaacccgcctttagcgacatgccccgagctcactccttcacgtcgaagggccctggtcccctgctgccaccaccccctcccaaacatggtctccctgacgtgggattagccgccgaagattctaaacgtgacccactgtgccccagacgagccgaaccatgccctcgggtgccagccaccccgaggcggatgtcagatcccccccttagcacaatgccgacagcccctggcctacgcaagcccccatgtttccgggagtcagcaagcccgtctccagagccttggactcctggccatggtgcttgctccacctccagcgccgctatcatggctacagccacaagtcgcaattgcgacaagttaaagtcatttcatctgtctccccgcgggccgccaacttcggagccacctcccgtcccagccaataagccaaagttcctaaagatagcggaggaagatcccccgagagaagccgcaatgcccggactgtttgttccaccagtggccccgcgccccccagctcttaaactcccagtgccagaagctatggctaggcctgctgtattaccgagaccagagaaacctcagttgccacacttacagcgttccccccctgatgggcagagcttcaggtcgttttcgttcgagaaaccgcggcagccatcccaggctgacaccggaggtgatgacagtgatgaagattatgaaaaggtccctctgcccaatagtgtcttcgtgaatactactgagtcttgtgaggtcgaaagactattcaaagccacaagtcccaggggtgaaccccaagacggcttgtactgtattcgcaactcaagcactaagagtggtaaagtgttggtggtttgggatgaaacctctaataaggtgcgcaactacagaatattcgagaaagacagcaagttctacctagagggggaggtgctgttcgtatcggttggttctatggttgaacattatcatacacatgtcttacctagtcaccagagcctgctgctccggcacccatatggctatacaggaccaaggtag

SEQ ID NO: 204974 - DNA, 1686 bp, Artificial Sequence
  Description of Artificial Sequence: Synthetic coding sequence
atggccgccgaggagatgcactggcccgtgcccatgaaggccatcggagcccagaatctgctcacaatgcctgggggggtggctaaggccggctacttgcacaagaaaggcgggacgcaactgcagctgctgaaatggccgctcagattcgtgatcattcataagagatgcgtgtactactttaagtcgtccacctctgctagcccccagggggcctttagtctatccggctacaacagagtcatgagggctgcagaggaaacgaccagcaataatgtgtttccgttcaaaatcattcatataagcaaaaagcatagaacctggtttttctccgccagctccgaagaagagcgcaaaagctggatggccctgctgcgtagggagataggacactttcatgaaaaaaaggatttgccactggacacttccgacagctcctcagatactgacagcttctacggggccgtcgaaagaccggtcgacataagtctgagcccataccccaccgacaatgaggactacgagcatgatgatgaggatgattcttatctggagcccgacagccccgagccgggccgtctcgaagatgcactgatgcaccctcccgcatacccccccccccctgtgccaacaccacgtaagcccgcattttctgatatgccacgagcccattcctttacaagcaagggacctgggcctctgctgccaccaccccctccaaaacatggcttgcccgacgtagggcttgccgctgaagacagcaagagagacccactctgccctagacgagccgaaccgtgtcctagggtgccagccactccaaggcggatgtccgacccgcccctaagtacgatgcccacggctcccggcttaaggaagccaccatgctttcgcgagtccgccagcccatcacctgaaccctggacaccgggtcacggcgcctgcagtactagcagtgccgccatcatggcaactgctacctctcgaaactgtgataaactgaagagttttcatttaagcccgagaggtccgccaacaagcgagccgccgccagtgcctgctaacaaacccaagttcctaaagatcgccgaggaggaccccccgcgggaagctgccatgcccgggctttttgttccacctgttgcaccccggccccccgccctcaagctgccagtgcctgaagccatggcccgtccggcagttctgccacgtccagagaagccccagttgccacatctccagagatctcctcctgacgggcagtccttccggtcattctcttttgagaaacccaggcaaccatcgcaggcggatacaggaggagacgacagtgatgaagattatgagaaggtgcctctccccaattcagtctttgtgaacactactgaaagctgtgaagttgaacgactgtttaaagccaccagcccacgaggggaacctcaagatggcctatactgcattcgaaatagttccacaaaaagcggaaaggttttagtcgtgtgggacgagacaagtaataaggtccgcaattaccggatattcgaaaaggattccaaattttacctagagggggaagtactgttcgtctcagtcggctccatggtggagcattatcacactcatgttctgcccagccatcagtccttgttgctccggcacccttacggctacaccgggccacgctag

SEQ ID NO: 204975 - DNA, 429 bp, Artificial Sequence
  Description of Artificial Sequence: Synthetic coding sequence
atggccgccgaggagatgcactggcccgtgcccatgaaggccatcggtgctcagaacttgctgactatgcctggcggcgtcgctaaagctggctacctgcacaagaaaggaggcactcaactgcagctactgaagtggccactgcgattcgtcattatccacaagagatgcgtctattatttcaagagcagcacgtccgcgtcccctcagggtgcattctctctgtcaggatataatcgcgttatgagggccgccgaagaaaccacctcgaacaacgtatttcccttcaaaattattcatatctcaaagaaacatcggacatggtttttctccgcaagcagtgaggaagagaggaagtcgtggatggcactcttaagacgtgaaattggccacttccatgagaaaaaggatctgcccttagatacctag

SEQ ID NO: 204976 - DNA, 429 bp, Artificial Sequence
  Description of Artificial Sequence: Synthetic coding sequence
atggccgccgaggagatgcactggcccgtgcccatgaaggccatcggcgcccagaacttgctgactatgcctggcggcgtggctaaagcaggctatctgcacaaaaaggggggcactcagctgcaactgctaaagtggccccttcggtttgtaattatccacaaaaggtgcgtgtattacttcaagtcttcaacatcagctagcccccagggagctttcagccttagtggatacaacagagtgatgagggcagcagaagagactacatccaataatgtgttcccctttaaaatcatacatatttctaaaaagcatcggacgtggtttttttccgcttcttctgaggaggaacgaaagtcttggatggccctgctaagacgcgaaattggtcacttccatgagaaaaaggacctgccactggacacatag

SEQ ID NO: 204977 - DNA, 1857 bp, Artificial Sequence
  Description of Artificial Sequence: Synthetic coding sequence
atggccggcagcggcccccggccccggagctggggccggcgggaggctggcgctcgagacgaggctgcggcggcgggtggtcgcggaccaggcccatgtagatgtagtcaagggcggagagcttggattgcccccggcaaaccagccatgccagctgcctggactccttttatggcagcagaagagatgcattggcctgtccccatgaaagcaatcggcgctcagaatctattgactatgcctgggggggtggcgaaagcagggtatctgcacaagaagggtggaacgcaactacaactcctcaagtggcccctaagattcgtcatcatacataagaggtgcgtatattatttcaaatcttccacgtccgcctctccacaaggtgcgttttctcttagtggttacaatcgcgtgatgcgcgccgccgaagaaaccacaagcaacaatgtgtttccctttaaaatcattcacatcagcaaaaagcaccgcacctggttctttagcgccagttccgaagaagagaggaaaagttggatggcactgctgcgtagagaaattgggcattttcacgagaagaaggatctgccattggataccagtgactccagttccgacaccgacagtttttacggcgcagtggaacgtcccgtggatatttccttatcaccttatccaacggataatgaggattatgagcacgacgatgaggacgatagttatctggaaccggacagccccgaacctgggaggctggaagacgcactcatgcatccaccggcctatcccccccccccagtgccaacaccaagaaagcccgcttttagtgacatgccaagggcccacagtttcactagcaagggtcctggacccctcttgccacccccaccaccaaagcacgggctacccgacgtggggcttgctgcagaagattccaagcgcgacccactgtgccccaggagagcagagccgtgtcctcgggtccccgctactcctagacgcatgtcagatcctccattgagcaccatgcccactgcacctggcttacggaagcccccgtgctttcgtgagtcagccagtccgtcccccgaaccttggactcctggacacggagcttgctccacttccagcgctgctataatggccactgccacgagccgtaactgcgataagctgaagtcttttcacctgtccccaaggggacctcccacaagtgaacctcctccggttcctgctaataagcctaaatttttaaaaattgctgaggaagatccgccgcgcgaagcagctatgcctggtctgttcgtacctcccgtcgccccaaggccacctgctctgaaactccctgtgcccgaggcaatggcgcgtcctgccgtactgcctaggcccgagaaacctcagctccctcacctgcagcgctccccaccggatggtcagtcattccgtagctttagtttcgagaaaccccggcagccttcccaagctgatacaggcggggatgattccgatgaagactacgagaaggtgccgctgcctaactcagtgtttgtgaatacgaccgagtcatgtgaggtcgaacgcctgttcaaagcaacgagccctaggggggagcctcaggacggactgtactgtattagaaactcctccaccaagtcaggaaaggtacttgtggtctgggacgaaacaagcaacaaggtacgcaattatcgaatattcgaaaaagattctaagttttacctggaaggcgaggtacttttcgtatctgtaggatcaatggtcgagcattatcacacacatgtgcttccgagccatcaatccctcctcctcagacatccttatggctatactggtcctcgatag

SEQ ID NO: 204978 - DNA, 519 bp, Artificial Sequence
  Description of Artificial Sequence: Synthetic coding sequence
atggccgccgaggagatgcactggcccgtgcccatgaaggccatcggagcccagaaccttttaacaatgcctggcggggtcgctaaggctggatacttacacaaaaaaggcggcactcagctgcagctactaaaatggccattgagatttgtgattatccacaagcgttgtgtgtattattttaaatcttccacatcagcttccccgcaaggcgctttctccttgagtggctataacagggtgatgcgggcagctgaggagacaacaagtaataatgtgtttcccttcaaaatcatccatatctcgaagaaacaccggacatggttcttctccgcctccagcgaggaggagagaaaatcttggatggcccttctgagaagggagattggtcacttccatgagaagaaggatctgcccctagacacaagcgactcctcgtctgataccgacagcttttacggtgcggtggagagacctgtcgacataagtttaagcccctacccgacggacaacgagtag

SEQ ID NO: 204979 - DNA, 567 bp, Artificial Sequence
  Description of Artificial Sequence: Synthetic coding sequence
atggccgccgaggagatgcactggcccgtgcccatgaaggccatcggcgctcaaaatctgctgactatgccagggggagtcgctaaggcagggtatctacacaagaaagggggcactcaactgcagctcctcaagtggcctcttcgattcgtgatcatccataaacgctgcgtgtattactttaaaagtagcacgtcagcatcaccccagggtgctttttcgttaagcgggtacaatcgagtgatgcgcgccgctgaagagacaacctccaacaacgtattccccttcaaaatcattcacatttctaagaagcaccgtacgtggtttttctccgcatctagtgaagaagaaagaaagtcctggatggccctgctaagaagagagatcggacattttcacgaaaaaaaggacctgccgctcgatacctctgattcctcctccgacactgacagtttctatggcgctgtcgaacgcccagtggatattagtctttccccctatccaacagacaacgaggattatgaacacgacgatgaggacgactcctacctagagccagactcttag

SEQ ID NO: 204980 - DNA, 1686 bp, Artificial Sequence
  Description of Artificial Sequence: Synthetic coding sequence
atggccgccgaggagatgcactggcccgtgcccatgaaggccatcggggcacagaatctcttaacaatgcctggtggagtggccaaggccggctacctgcacaagaaaggtgggacacagcttcagctgctcaagtggcctctgaggttcgtcattattcacaagagatgcgtatattatttcaaatcctccactagcgcaagcccccagggggccttcagcttatccggttacaacagggtcatgagggccgccgaggagacgactagtaacaacgtgtttcccttcaagattattcatatctccaaaaaacataggacttggtttttctccgcatccagcgaagaagagagaaagtcctggatggccctgttgagacgggagatcgggcactttcatgaaaagaaggatctgccactcgataccagcgattctagctcagacaccgattccttctacggtgcagtggaacgccctgtcgacatttctttgtccccataccccactgacaatgaggattatgagcacgacgatgaggacgatagctatctggaacccgacagtcctgagccagggcgactggaggacgctttgatgcacccacccgcctacccgcctcccccagtcccaaccccacggaaacccgccttcagcgatatgccccgagcccattcattcacaagcaaaggtccgggacctcttctccccccccccccaccaaaacacgggctgccagacgtcgggttggctgcagaggattcaaagagagacccgttatgtccaagaagggctgaaccctgcccaagggtcccagcaactccaagacgcatgagtgatccccctctctctaccatgccaacagcaccggggctccggaaaccaccatgctttcgcgaaagcgcctctccttcaccagaaccctggaccccgggccatggggcctgcagcacgtcatcagccgcaatcatggctaccgccactagtcggaactgcgataaattgaagagcttccatctgagcccccgcgggccgccaacatcagagccaccacctgttccggccaacaagccgaagtttctcaaaatcgcagaggaggatccacctagggaggccgccatgcccggacttttcgtgccaccagtcgcaccccggcctcccgctttaaaattacccgttcctgaagctatggcccggcccgcagtgttgcctcggccagaaaaaccacagctgccacaccttcagaggagtcctcccgacggacaatctttccgttccttcagcttcgaaaaaccacggcagccttctcaggctgacacaggcggtgacgactccgatgaagactatgagaaagtgccactgcccaatagtgtttttgtaaatacaactgaatcatgtgaggtggaacgtctcttcaaagccacttctccacgaggcgaacctcaggatgggctgtactgcataagaaactctagcacaaaatcaggcaaagtcctggtggtgtgggacgagacctccaacaaggtcagaaattataggatcttcgagaaggattcgaagttctacctcgaaggtgaagtgctgtttgttagcgtagggtcaatggtggaacattaccacacgcacgtgctgccgtcccatcaaagcctgcttttgcgccacccttacggatataccgggccccgatag

SEQ ID NO: 204981 - DNA, 585 bp, Artificial Sequence
  Description of Artificial Sequence: Synthetic coding sequence
atggccgccgaggagatgcactggcccgtgcccatgaaggccatcggcgcacaaaacctactgaccatgccaggaggggtggccaaggccggctatctccataagaagggaggcacgcaactgcagctcctgaagtggcccttgagatttgtcatcattcacaagcggtgtgtgtactatttcaagtcgtccactagtgcctccccccagggtgctttttccctgtctggatacaatagagttatgagggcggccgaagagaccaccagtaacaacgtgttccccttcaagataatacacatttcaaagaagcatcgcacatggttcttctcagcttcctccgaagaggagcggaagtcctggatggcgctactgagacgagagatcggacattttcacgaaaagaaagacttgcctctcgacacgtcggactcgagtagtgatactgacagtttctacggcgccgtcgagcggcctgtggacatatcattgtcaccttaccctaccgataacgaggattacgagcacgatgacgaggatgactcgtacctggaaccagatagcccagagcccgggcgcctatag

SEQ ID NO: 204982 - DNA, 411 bp, Artificial Sequence
  Description of Artificial Sequence: Synthetic coding sequence
atggccgccgaggagatgcactggcccgtgcccatgaaggccatcggcgcgcagaacttactcactatgccaggaggtgtggcaaaagccggctatttgcataagaaaggaggaacccagctacaactgctgaagtggcccctgcgatttgtcattattcacaagcggtgcgtttactactttaagtcctctacttcagcaagcccccagggggcattctcactctcggggtataatagagtgatgcgcgctgctgaagagacaaccagcaataatgtgtttccttttaaaattatccatatctctaaaaagcaccgcacttggttctttagtgcatcgtccgaagaagaacgtaagagctggatggctctcctgagacgagagatcggacacttccacgagaaaaagtag

SEQ ID NO: 204983 - DNA, 2892 bp, Artificial Sequence
  Description of Artificial Sequence: Synthetic coding sequence
atggccgcccagcggatccgggccgccaacagcaacggcctgccccggtgtaagtcagaagggacattaatagatcttagtgaaggattctccgagacgagtttcaatgacattaaggtgccaagtccctccgctctgctcgtggacaaccccaccccctttggcaacgcgaaggaggtgattgctatcaaggattactgccctactaacttcacaacactcaagttctcaaagggagaccacctgtatgtgcttgacacatccgggggtgaatggtggtatgctcacaatacaaccgaaatgggatacatcccgagctcatatgtgcagccgctcaattataggaatagcaccctgagcgatagcggcatgatcgacaaccttcctgacagccctgatgaggttgctaaagagttggagctgctcgggggctggacagatgacaaaaaagttcccggccgaatgtacagtaacaatcctttctggaacggcgtccagactaacccttttctcaacggaaacgtgccagttatgccttccctcgacgagttgaatccaaaatccacagtggacctgttactgtttgacgccggcacatcatcatttactgagagctcatctgccactaccaacagtaccggaaatatttttgacgagttgccagtcaccaatgggttgcatgccgagcctcctgtgcgccgcgacaacccatttttcagaagtaaacgtagttacagtctaagcgagttgtcagtcctgcaagccaaaagcgacgccccaacatcatcctcttttttcacagggctgaaaagccctgcgcctgagcaattccagtccagagaggattttaggactgcctggctgaatcatcgcaagctggcccggagctgtcatgacctcgacctcttggggcaaagccccggttggggacaaacacaagccgtcgagactaacatcgtgtgtaaactggactcaagcggcggtgccgtccagttgccagacacctcaatctccatacacgtgcctgaaggccacgtagccccgggggagacacagcagatttcgatgaaagccttacttgacccacctttagagctgaatagcgatagatcgtgtagcatctcccctgttctggaagtgaaattatcgaacttagaggtgaaaacttcgattatcctcgagatgaaggtctccgccgaaatcaagaacgaccttttcagtaaatccaccgttggattgcaatgtctgcggtccgattccaaggaaggaccttacgtgtctgtgcccttgaattgctcttgcggcgatacagtccaggcacagctccacaacttggaaccatgcatgtacgttgccgtggtggcacatggtccaagcattctgtatccgtcaacagtttgggatttcattaacaagaaagtcaccgtcgggctctatggaccgaaacacatccaccctagttttaaaacagttgtaaccattttcggtcatgattgtgccccgaaaacccttttggtctccgaagtcacacgacaggctcctaaccctgccccagtcgctctccaattgtggggtaagcaccaatttgttctgtctcgtccccaggacttaaaagtctgcatgttttctaatatgactaactacgaggtgaaagcaagcgagcaggctaaagtcgtacgtggttttcagctcaagctcggaaaggtgtcaaggctcatctttcctatcacctcacaaaatccaaatgaactatcagacttcaccctgagagtccaggtaaaagacgaccaagaagccattctcactcagttctgcgtccagacaccccagccccctcctaagtctgccatcaagcccagcggccagagacggttccttaaaaaaaacgaggtagggaaaattattctcagcccatttgctacaaccacaaaatacccgacttttcaagatcgcccagtaagtagtttaaaatttggtaaactgcttaaaacggttgtgaggcagaacaagaaccactatctgctcgagtacaaaaaaggcgatgggattgcgctcctgtcagaggagagggtgagactccgaggtcagctttggaccaaggaatggtacatcggatactaccaggggcgagtcgggctggtgcataccaaaaatgtccttgttgtgggcagggcccgccctagtttgtgttcaggtcctgagctttccacctctgtgctgctcgaacagattctgcgaccatgtaagttcctgacgtacatttacgcctccgtccgtactttactaatggagaacatctctagttggcgcagctttgcagacgccttgggatacgtaaacctgccactcaccttcttctgtagagctgaactcgactcagaaccggaacgcgttgcatcggtgctcgagaagctcaaggaggattgtaataatacggaaaacaaagagcgcaagagttttcagaaggaactggtgatggctctcttgaagatggactgccaggggcttgtggtgagattgattcaggacttcgtcctcctcacaaccgctgtagaggtagcacagcgctggcgggagctggccgagaagctggcaaaagtctcaaagcagcagatggatgcgtacgagagcccgcatcgggataggaacggggttgttgacagcgaagctatgtggaaaccagcctatgacttccttctgacgtggagccaccagatcggggattcgtatcgggacgtgatccaggagctgcatctgggattagataagatgaaaaatcccataacaaagaggtggaaacacctgacgggcaccctcattctagttaactcattagacgtgctccgagccgctgccttctcgcccgctgaccaggacgacttcgtcatctag

SEQ ID NO: 204984 - DNA, 2892 bp, Artificial Sequence
  Description of Artificial Sequence: Synthetic coding sequence
atggccgcccagcggatccgggccgccaacagcaacggcctgccccggtgcaaatcagaaggcacactgatcgatctgagcgaggggtttagcgagacaagcttcaatgacataaaggtgcctagtccttcagctctcctagtggacaaccccaccccattcggcaatgccaaagaggtgattgccatcaaggattactgcccaacaaattttactaccttaaaattttctaagggcgaccacctatatgtcttggacacttccgggggtgaatggtggtacgcccataataccaccgaaatggggtacatcccctcttcttatgttcagccactgaactaccgcaactctacattaagtgactcgggcatgatagacaaccttcccgactctccggatgaagtggcgaaggaactggaattgctggggggctggaccgacgacaagaaggttccaggaagaatgtactccaataatccgttctggaacggggtgcagacaaacccctttttgaacggaaacgtgcctgtgatgccctctctggacgagctgaacccaaaaagcacggtggatctgctcctgttcgatgccggaacctcctcattcactgagagcagttctgccactactaacagcactggtaacatattcgacgagttgcccgtgaccaacggcctgcatgcagagcctcctgtgcgcagggataacccgttttttagatccaagcggagttattctttgtccgaattatcagtgctgcaggctaaatcagacgccccgacatcttcaagcttttttacaggcctaaagagcccggccccggaacagtttcagagtcgggaagactttagaaccgcttggctcaaccaccgcaaattagcgcgcagctgtcatgacttggaccttctggggcagagtcctggctgggggcagactcaggctgtggagaccaatattgtctgtaaactggactcctctgggggcgccgtgcaactccccgatacttctatttccatacatgtgcctgagggccacgttgcccctggcgagactcagcagatttctatgaaagctctgctcgaccctccactggagctgaattcagacaggtcttgttccatttcgcctgtattggaagtcaagttatcgaacctggaagttaaaacaagtattatccttgaaatgaaggtcagcgctgaaattaagaatgacctattcagcaagagtacagtgggcctgcaatgcttgcgaagcgactccaaagagggtccatacgtttcagtgcctttaaactgttcttgcggggacaccgttcaggcccaacttcataacctcgaaccctgcatgtatgtcgcagtcgtggcgcatggtcccagtatcctctatccctccacagtctgggattttatcaacaagaaggtaacagtcgggctctacgggccgaagcacatccatccctctttcaagacagtagtgacaatcttcggtcatgactgcgctcctaagaccctgcttgtaagcgaagtcaccaggcaggcccccaatcccgccccagttgccttgcagctctgggggaaacatcaatttgttctgtcccgccctcaggatttgaaagtgtgtatgttctcgaacatgacgaactatgaggttaaggctagtgagcaggccaaggtggtccggggctttcagctcaagttgggcaaagtaagccgacttatctttccaattacctcacagaatccgaatgaacttagtgacttcactttaagagttcaagtgaaggacgatcaagaagctattcttactcaattctgtgtgcagacgccgcagcccccccccaaaagtgccatcaagccctccggccaaagacgatttctgaagaagaacgaagtcgggaagataattctaagccccttcgccaccactacaaagtacccgaccttccaagatcgacctgtctcgtctttaaaatttggcaagctgctgaagaccgtagtccggcagaataagaatcattacctgctggaatacaaaaaaggcgatgggatcgccctcctctccgaggaacgcgtccgcctgcgagggcagctgtggacaaaggagtggtatattgggtactaccagggtcgagttggactggtacataccaaaaatgtgttggtggtgggaagagcccggccctccctgtgcagcggtcccgagttgagcacatccgtcctgctggagcaaattttgaggccctgcaaattcttgacctatatttacgcctctgtcagaaccttgcttatggagaatatcagcagttggagaagttttgccgatgcacttggttacgtgaatcttcccttgacatttttctgccgggccgaattggactccgaacccgagcgggtggcttccgtgttagagaaattaaaggaagattgcaataatacagagaataaggaacggaaatcttttcagaaagaactggttatggcacttcttaagatggattgccagggcctggtcgtcaggctgattcaggacttcgttctgctcaccaccgctgtggaggtggcacagagatggcgggagctcgccgaaaagttagctaaggtgtcgaaacagcagatggatgcatacgagtctccgcaccgagacaggaacggcgtggtcgattcagaagcgatgtggaagccggcctacgactttcttctcacctggagtcatcagattggggatagctatcgcgacgtgattcaagagcttcaccttggcctggataagatgaaaaaccccataacgaagcggtggaaacatttgacaggcacattgattctcgtcaattctcttgacgtcttgagggcagccgccttcagccccgcagaccaggacgatttcgttatctag

SEQ ID NO: 204985 - DNA, 2892 bp, Artificial Sequence
  Description of Artificial Sequence: Synthetic coding sequence
atggccgcccagcggatccgggccgccaacagcaacggcctgcccaggtgtaagtcagagggaaccctgatcgacctctccgaaggattttccgagacctcatttaacgacattaaagtgccctcaccatctgcattgctagtggacaatccaacaccctttggaaacgctaaagaggtgatagctattaaagattattgccctactaacttcaccacactcaagttctccaaaggcgatcacttgtacgttctggatacctccggaggagagtggtggtatgcccacaacacaacggaaatggggtatattcctagctcttacgtccagcccctgaactacagaaactccactctgtctgattctggtatgatcgataacttgcctgacagcccggacgaagtcgccaaagagctcgagctgctggggggatggaccgacgataagaaggtgcctggcagaatgtattctaacaacccattctggaatggggttcagacaaacccattcctgaacgggaatgtgcctgtgatgccatccctcgatgagctgaatccaaagagcacggtggacctgctgttgttcgatgccggcaccagctcatttacagagtcttcttctgcaaccacgaatagtaccggcaacatttttgatgagctgcccgtcaccaacggcctccatgccgagcctccagtgcgtcgcgataaccccttctttcggagcaagagatcctattccctctcagagttgagcgtcttgcaggcaaaaagtgatgcacccacatcaagttctttctttacaggccttaagtcacctgcgccggagcagttccagagccgggaggatttccgtacggcttggctcaaccaccgtaaacttgcacggagctgccacgatctggacctgctcggacagtctcctggttggggccaaacgcaggctgtcgaaaccaacatagtatgcaagttggattccagcgggggagccgtccagctgccagacacctcaatctcgattcacgtgcctgaaggtcatgttgcaccaggagaaacgcagcaaattagcatgaaggcattactggacccacctttagaactaaattctgacaggtcctgtagcatcagccccgtcctagaggtgaaactcagcaacctggaagttaagaccagcatcatcctcgagatgaaggtgtcagcggagattaaaaacgatttattctctaaatctacagtcggtctgcagtgcctcaggtccgacagtaaggaaggcccctatgtctccgtgcccctgaactgcagttgtggagatacagttcaggcccaacttcataacctagagccctgcatgtatgtagccgtagttgcccacggcccatctatcttgtacccttcaactgtgtgggacttcatcaacaagaaggtgaccgtgggactgtatggccccaagcatatccacccgtccttcaagaccgtggtgaccatcttcgggcacgactgcgctccgaaaacactgctggtatctgaggtgacgcgacaagcccctaatcccgcccctgtggccttacaactgtggggtaaacaccagttcgtgctttcacggccccaggatctgaaggtctgtatgtttagcaacatgacaaactatgaggtcaaggccagtgaacaagcgaaagtggtcagaggctttcagctgaaactgggaaaagttagccgtctgatcttcccaattaccagccagaatcccaacgaactttcagactttaccctccgggtccaagtgaaggacgatcaagaggctattctgacccagttctgcgtgcagactccacaacctcccccgaaatctgcgatcaaaccctcaggacagcggcgtttcttgaaaaaaaacgaagtcggaaagataatcttgtctccttttgcaacgactaccaagtatcctacattccaggataggccagtctcttccctaaagtttgggaagctgctgaagaccgttgtgcggcagaacaaaaatcattatctgttagagtacaagaaaggcgatggcatcgcactactcagtgaggaacgtgttaggttgcgggggcagctctggaccaaagaatggtacatcggctattatcaaggcagagtcggcctagtccatactaaaaacgtcttggtggtgggtagagctaggccttctctctgtagcgggcccgagcttagtacatctgtgctgctggaacagattctgcgcccatgcaaatttcttacatatatttatgcgtctgttcgcacgctcctgatggaaaatatttcctcttggagatcatttgctgatgccctcggatatgtcaacctgcctctgacattcttctgtagagccgaactggactcagagccggagagagtcgcctcagttctggaaaagctaaaggaggattgcaacaatacagagaacaaggagcgcaagtcctttcagaaagagctggtcatggctctcctcaagatggattgccagggcctggtggttcgacttatccaagatttcgtgcttctcaccaccgccgttgaggtagcccagcggtggcgcgaactggcggaaaagttggccaaagtgtccaagcaacagatggacgcttatgagtccccccatcgcgatagaaacggcgtggtggactcggaagcgatgtggaaacccgcatacgatttcctgttaacgtggtcccaccagataggggatagttatagagacgtgatccaagaactgcatttaggactggataagatgaaaaatccaataactaaaaggtggaagcacctgacaggtaccctaatcctcgtgaactcactcgacgtgcttcgtgcagccgcattttccccagccgatcaggacgacttcgtgatctag

SEQ ID NO: 204986 - DNA, 369 bp, Artificial Sequence
  Description of Artificial Sequence: Synthetic coding sequence
atggccgcccagcggatccgggccgccaacagcaacggcctgcccagatgtaaatcagagggaactctgattgacctcagtgaaggattttcagaaacatcctttaacgatatcaaagttcccagtccctcagccttgctggtggacaacccaactccattcggcaatgccaaggaggttattgccataaaggattattgcccaacgaatttcactactcttaagttttcaaagggcgaccacctgtacgtgcttgacacatcaggtggggagtggtggtacgcgcataatactacagaaatgggatatattccttcttcctacgttcaacctctcaactaccggaattccaccctttccgattcctag

SEQ ID NO: 204987 - DNA, 1662 bp, Artificial Sequence
  Description of Artificial Sequence: Synthetic coding sequence
atggccgcccagcggatccgggccgccaacagcaacggcctgccccgatgcaagtctgaaggaacactgattgacctgagcgagggcttctctgagacctctttcaacgatatcaaggtgccttctccctcggccttgctggtggacaatccaaccccattcggcaacgctaaagaagtgatcgccatcaaggactactgtcctactaacttcaccactctcaaattttctaaaggggatcacctgtacgttttggataccagtggaggcgagtggtggtatgcccacaacacgactgaaatgggatatatccctagcagctacgtccaacctctaaactatcggaactccaccctaagcgatagcggcatgatcgataatctgccggactcgcccgacgaagtcgcaaaagagctcgagttactcggtggctggacagacgacaagaaagtgcccggccggatgtacagcaataacccgttctggaatggagtccagacaaatcctttcctcaacggcaacgtgcccgtgatgcccagtctggatgaacttaatcccaaatctacagtggatctactgttgttcgatgctggtacctcgagttttaccgaatcctccagcgccactaccaattcaacaggtaacatctttgacgagttaccagtgactaatggcctgcacgcggagccgccagtgcggagagacaatcccttctttcggagcaagcgctcttactctctttccgaactttctgtgttgcaagcaaagtcagatgccccaacaagttcatccttttttactggcctcaaaagcccggcccccgagcagtttcagagtagggaggatttccgaacagcctggctgaatcaccggaagctggccagatcatgccatgatctggatctgttgggtcaatcccccgggtggggccagacacaagccgtggaaaccaacatcgtgtgcaagctagacagttccggcggcgcagtgcagctgcctgacacttctatttcaattcatgtgccagaaggccatgttgctccgggcgagacacagcaaataagcatgaaagccttactagacccccccctggagctgaactctgacagatcctgttctatcagcccagtactagaggtaaagctgagtaacctggaagtgaagaccagtattatcctggagatgaaggtgagtgcagagattaagaatgacttatttagcaagtctacagtagggctgcagtgtctaagatctgattccaaagaaggaccctacgtgtccgtcccgctcaattgttcttgcggggacacagtccaggctcagcttcacaacttggaaccctgcatgtatgttgccgttgtagctcatggtccatctattctttatcccagcaccgtgtgggattttatcaacaagaaggtcactgtgggcctgtatggcccaaagcatattcatccaagctttaaaactgtcgtgacaattttcggccatgattgtgctccgaagactctgctcgtttccgaggttaccaggcaagcacccaacccaccaattaccaagagatggaagcacctgaccgggacgttaatcctggtgaactcactggacgtgctgagagctgccgcgttctcccccgctgaccaggatgattttgttatttag

SEQ ID NO: 204988 - DNA, 171 bp, Artificial Sequence
  Description of Artificial Sequence: Synthetic coding sequence
atggccgcccagcggatccgggccgccaacagcaacggcctgccccgatgtaaatccgagggaactctcatagatctgagcgaggggttctccgagacctcttttaacgacatcaaggtcccatctcctagcgccctcctggtggataaccccaccccattcgggaactag

SEQ ID NO: 204989 - DNA, 522 bp, Artificial Sequence
  Description of Artificial Sequence: Synthetic coding sequence
atggccgcccagcggatccgggccgccaacagcaacggcctgcccagatgtaaatctgagggcaccttgatcgatctttcagagggcttttctgagacttcgtttaacgatatcaaagttccatcccctagcgcgctccttgtcgacaacccaaccccatttggtaacgcaaaggaagtcattgccatcaaggattattgtcccactaacttcaccacgctgaagtttagtaaaggagatcacctctacgtgctggacactagtggaggggagtggtggtacgcccataatactactgagatgggctacatcccttcatcttatgtgcaacctctgaattatcggaattccaccctgagcgactctggtatgatcgataatctgcctgattccccagacgaagtggcaaaagagctggagcttttgggcggctggaccgatgacaagaaagtgccaggacgcatgtattcaaataatcccttttggaatggcgtgcaaacaaacccttttctgaacgggtag

SEQ ID NO: 204990 - DNA, 174 bp, Artificial Sequence
  Description of Artificial Sequence: Synthetic coding sequence
atggccgcccagcggatccgggccgccaacagcaacggcctgccccgctgcaaatccgaggggactcttatcgatctgagtgaaggctttagtgagactagctttaacgacattaaagttccgagcccctctgcactgctcgtggacaacccgaccccgttcggtaatgcctag

SEQ ID NO: 204991 - DNA, 606 bp, Artificial Sequence
  Description of Artificial Sequence: Synthetic coding sequence
atggagaacatcagcagctggcggagcttcgccgacgccctgggctacgtgaacctgccactgacattcttttgccgggccgaactggacagtgagccagagagagttgcaagcgtgctggaaaagctaaaggaagactgcaataatacagaaaataaggagcgtaagtcctttcaaaaggagctggtcatggcactcctgaaaatggattgccagggtctagtggtgagactgatccaggattttgtcctgctgacaaccgcagtggaagtcgcccagaggtggagagagctggccgagaaactggctaaggtgagcaagcagcagatggatgcctacgaatctccccacagggacaggaatggcgtcgtcgattcagaggcgatgtggaaaccagcatatgacttcctgctcacctggtctcaccagattggcgattcttatagagacgtgatccaggagcttcacttgggcctcgataagatgaagaacccgatcacaaaacgctggaagcacttgaccggcacattaatactggtaaatagcctcgacgttctgagggccgccgctttttcacccgctgaccaggacgatttcgtcatttag

SEQ ID NO: 204992 - DNA, 897 bp, Artificial Sequence
  Description of Artificial Sequence: Synthetic coding sequence
atgctgaaccacgccacccagcgggtgatggaggccgagcagaccaagactcgaagcgagctggttcacaaggaaacagccgctcgatacaatgccgcaatgggcaggatgaggcagctggagaagaagcttaagcgggcaattaacaaaagcaagccatactttgagctgaaggcgaagtactatgtgcagttggagcagttgaaaaaaacagtcgatgatctgcaagcaaaacttaccctggccaaaggcgaatacaagatggccctgaagaacttagagatgattagcgacgaaattcatgaaaggcgccgcagctccgccatggggcccagagggtgcggcgtgggcgccgaaggctcctcgactagtgtggaggatctccccggctccaaaccagagcctgatgctatctccgtcgctagtgaggcatttgaggacgatagctgctctaatttcgtaagtgaagacgattccgagactcagagcgtgagtagcttctcatccggacctacttctccttctgaaatgccagatcagttcccagccgttgtgcgtcctgggtccctggacctacccagtccagtgagtctttctgagtttggtatgatgttcccggtattgggacccaggtccgaatgcagcggggccagttcaccagaatgtgaggtggagcggggtgatagagccgaaggcgccgagaacaagacttctgataaggctaacaataatcgcgggttgagcagcagctctggatctggaggtagttctaagtctcaaagctctacatcaccggagggtcaggccctggagaatagaatgaagcaactctctttacagtgttcaaaaggtagagatggcatcatcgccgacatcaagatggtgcagattggatag

SEQ ID NO: 204993 - DNA, 387 bp, Artificial Sequence
  Description of Artificial Sequence: Synthetic coding sequence
atgctgaaccacgccacccagcgggtgatggaggccgagcagaccaaaacccgatcggagctggtccataaagagactgcagcccgttataatgctgctatgggcagaatgaggcaacttgaaaaaaagcttaaaagagctattaacaaatcgaagccttattttgagctcaaggctaagtattatgttcaactggagcagctgaagaaaactgtcgatgacttacaggctaagctgacgctcgccaagggcgagtataagatggctctgaagaacctggagatgattagtgacgagattcacgaacggagaagaagcagcgctatgggaccacgcgggtgtggtgtgggtgccgagggcagttccacctcagtggaagatctttag

SEQ ID NO: 204994 - DNA, 1368 bp, Artificial Sequence
  Description of Artificial Sequence: Synthetic coding sequence
atggacgccgccctgaagcggagccggagcgaggagcccgccgagatattaccgcccgcccgcgacgaagaggaagaggaggaggaggggatggagcagggattggaagaggaggaagaggtcgacccaagaatacagggcgagctcgagaagctgaaccagtccaccgacgatattaatagacgcgagaccgagctggaggacgcaaggcagaaatttaggagtgttctcgtggaggccaccgtgaagcttgatgaattggtgaagaagataggtaaagctgtagaagatagcaaaccctactgggaagcccggcgcgttgccaggcaggcccagctggaagcccagaaggctactcaggactttcagcgcgcaactgaagtcttgagggctgcaaaggaaacaatctctttggccgagcagcgcctcctggaggatgacaaacgacaattcgacagtgcttggcaggaaatgctcaaccacgccacacagagagttatggaagctgagcagaccaaaacccgatccgagctggtccacaaagagacagctgcccggtataatgccgcaatggggcgtatgcgtcaactagagaagaaattgaaacgtgccatcaacaagtctaagccttacttcgagctgaaagctaagtactacgtccagctcgagcagttgaagaagaccgtcgacgacttacaggctaaactgaccctcgccaaaggggagtataaaatggccctgaaaaacttagagatgatctccgacgaaatacacgagcgccgcagaagcagtgctatgggcccgaggggatgcggcgttggagctgagggcagctctacttcggtggaggatctgccaggatcaaaaccagaacctgacgcaattagcgtggctagcgaagccttcgaggatgacagctgctccaattttgtctccgaagacgactcagaaacccagtccgtgagctctttcagctctgggccaacttctccatcagaaatgcctgatcaattcccggccgtcgtaagaccagggagcctggatctgcccagccctgtgagcctgtccgagtttgggatgatgttccctgttctcgggcctcgatcagaatgtagtggcgccagcagccccgagtgtgaggtagagcgcggcgaccgcgccgaaggagcagaaaacaagacaagcgacaaggcaaataacaaccgcggcctgagttcctcctctggatccggcgggtcttctaaatcacagtcatccacgagtccggaaggacaggcactggaaaatagaatgaaacagctatccctccagtgcagtaagggtagggacggcataattgctgacatcaagatggtacagattggctag

SEQ ID NO: 204995 - DNA, 897 bp, Artificial Sequence
  Description of Artificial Sequence: Synthetic coding sequence
atgctgaaccacgccacccagcgggtgatggaggccgagcagaccaagactaggtcagagctcgtgcacaaagagaccgccgctcgctacaacgccgcaatgggccgtatgcggcaattggagaagaagttaaagcgagcgattaataaatcaaagccttactttgaactgaaggctaaatattacgtgcaactggaacagctgaaaaaaactgtagacgacctgcaggctaaacttacactggccaagggggagtacaagatggcgttgaagaacctggaaatgattagtgacgaaatccatgagcggaggaggtcgagcgcaatgggccccagaggctgtggcgtgggagccgagggtagctccactagcgttgaagatctgcctggttccaaacccgagcccgatgccatttctgtcgcatcagaagcatttgaggacgattcttgtagcaacttcgtgagtgaggatgactctgagacccagtccgtcagctcattcagctccggtcctactagccccagcgagatgcccgaccagttccccgcagtggtaagacccgggagcctggacttgccctctcccgtgtccttgagcgaattcgggatgatgtttcctgtgctcggacctagatccgaatgctcaggtgcgtcaagtccagaatgtgaagtcgaaagaggggacagagcggagggagcagaaaataagacctctgacaaggccaataacaaccgcggtttatcatcctccagcgggtccggaggttcttcaaagtcccaatcttctacctccccagaaggccaggcattagaaaatagaatgaagcagttaagcctgcagtgctcaaagggcagggatggaattattgctgatattaaaatggtacagatcggatag

SEQ ID NO: 204996 - DNA, 156 bp, Artificial Sequence
  Description of Artificial Sequence: Synthetic coding sequence
atgctgaaccacgccacccagcgggtgatggaggccgagcagaccaaaacacgcagcgagctggtgcacaaagaaaccgcggctcgctataatgctgccatgggcaggatgcgccagctggaaaagaaactgaaaagggcgattaacaaaagttag

SEQ ID NO: 204997 - DNA, 897 bp, Artificial Sequence
  Description of Artificial Sequence: Synthetic coding sequence
atgctgaaccacgccacccagcgggtgatggaggccgagcagaccaagactagatctgaacttgtccacaaggaaaccgccgcccgatataatgcggctatgggccgcatgagacagctagaaaagaagctgaagcgggcaatcaataagtccaagccatattttgagctcaaggccaagtattacgtacagttggaacagctcaagaaaacagtggacgacctgcaggcaaaactcactctcgcaaaaggcgaatacaagatggctcttaaaaatttggagatgatctcagatgagattcatgaaaggcgtcggtccagtgctatgggccctagagggtgcggagtgggcgccgaagggtcctccacttccgtggaggatctgcccggcagcaagcctgagcctgacgcgattagcgtggcaagcgaagcctttgaggatgatagttgttccaatttcgtgtcggaggatgattcagaaacccagagcgttagctctttctcgagcggccccacgagcccttccgagatgcctgaccaattccccgccgtggtacgtccaggctcgctggatctgcctagtccagtctccctctctgaattcgggatgatgtttcctgtcctaggaccaagaagcgaatgttcaggcgcaagtagtccagaatgtgaagtagagaggggggatcgcgccgagggcgcggaaaacaaaacatctgataaagccaataataatcgaggcctgtcatcttccagtgggtcgggcggcagctccaaaagccagtctagcacttcgccagagggacaggcactggagaatcgaatgaagcaactcagcctgcagtgctccaaggggcgggatggtatcatagcggacatcaagatggtccagattgggtag

SEQ ID NO: 204998 - DNA, 2580 bp, Artificial Sequence
  Description of Artificial Sequence: Synthetic coding sequence
atgatggagggcctgaagaagcggacccggaaggccttcggcatcaggaagaaggagaaggacacggacagtaccggaagtcctgaccgcgacggcatacagggcaaaaagaagacacagaagacccaactgttgctaacgagttgcttctggcttagggctctcagcctcacacttagccagaagaagagtaacggagctccgaacggtttctatgccgaaatcgattgggagcggtataactcccccgaattagatgaagaagggtacagtattcggcccgaagaaccgggctccacaaaggggaaacatttctactcttcctcagaatcagaggaagaggaagagagccataagaagtttaatatcaagatcaagcccctgcagtcaaaggacatcctgaaaaatgctgccaccgttgatgagctaaaagctagtattggcaacatcgcgctgtctcccagtcccgtgcgcaagagcccacgcaggtctcccggtgccattaagagaaatctctccagtgaagaagttgcacggccccgtcgcagtactcctacccccgaactgatttcaaaaaagccgcccgacgacactaccgcccttgcaccactctttggtccgccactggagagcgcatttgatgagcaaaagaccgaggtcctgctggaccaaccggagatatggggctccggacaacctattaatccatctatggaatcccccaaactgacgaggcctttccctactggtacgccacctccacttcccccaaagaatgtaccggccacacctccccgaacaggtagcccccttaccatcgggcccggaaatgatcagtccgctacagaagtcaaaattgaaaagctccctagcattaacgaccttgattccatcttcgggccagtgctcagccccaagtcagtggctgttaacgcagaagaaaaatgggtgcacttttccgatacatcccctgagcatgtgacaccagagctgaccccgcgcgagaaggtcgtctccccacctgccaccccggataatcctgcagatagccctgcccccggccccctgggccctccgggtcccactggaccgccagggcctccaggacccccccgaaacgtgttatcgcccctaaaccttgaggaagttcagaagaaagtagcggaacaaacttttatcaaagatgactatctcgagaccatcagctctcctaaggactttggtctcggccagcgcgccacacctccacccccaccaccgccaacatataggaccgtagtttcttcacccggccctggctccggcccgggaccaggcactacctcagacggcaagacagaagcccagcgatatcaggtgatatgtcccagcttgcaagccggtggaaatgaactggattcctatagcggggcgagctctccggccagaccagccacccctcttgtgccatgtcgcagtaccactcccccccccccgccgccacggccaccatcacgaccgaaactccctcccggcaagccaggagtgggtgacgttagcagaccctttagccccccaattcacagcagctctcccccaccaatcgcacctttagctagagctgaatccacctcctctatcagctcgaccaattccctgagtgcagcgactacacctaccgtggagaatgagcagcccagtctggtgtggtttgaccgtgggaagttctatctgacttttgaaggcagtagcagaggccccagtccgcttactatgggagctcaggacaccctgccggtcgcggctgcttttaccgaaacagtgaacgcgtactttaagggcgccgatcctagtaagtgtattgtgaagatcacaggcgagatggtgctctcgtttcccgctggaattacacgccatttcgctaacaatccgtctccggcagctctgacattccgcgtgatcaacttttcaaggttagagcacgtcctgcccaacccacagttgttatgttgcgacaatactcagaatgatgccaacacgaaagaattttgggtaaacatgccgaatctgatgactcatcttaagaaagtgagtgagcagaaaccacaggctacctactataatgtggacatgctgaaatatcaggtgtctgctcagggcattcagtccactcccctaaacctcgccgtgaattggcggtgtgagccctcaagcacagatctgcgcatcgactacaagtataatactgacgcaatgacaaccgcggtcgctctgaacaatgtgcagttcctcgtgccgatcgacggtggagttaccaaactgcaagcggttttgccgccagccgtttggaacgccgagcagcagagaattctgtggaagattcctgatatctcccagaaatctgaaaatggcggagtcggaagtcttcttgccagatttcagctgagtgaaggcccctccaagccttctcccctggtcgtccagtttacaagcgaagggtccacgctttccggatgcgacatcgagctggttggcgcaggttatcggttcagccttatcaaaaagcggtttgcagcaggcaaatacctggccgataattag
